United States Patent 12,144,834 (METHODS AND COMPOSITIONS FOR TREATING GASTROINTESTINAL AND INFLAMMATORY DISORDERS) - sequence listing, part 4

SEQ ID NO: 197 - DNA, 12752 bp, Bacteroides thetaiotaomicron
gataatatactgtatatcaagatataacatttaataaaagatacgtaatacgattcagcagagtgagagcaaacacttgctctcactctgctaccattggatctctaactgctaaaacatcgatgaataaaggcatacagacgaactgttagagcatgagagcaaaacggctatcaaatcactgtggaaaaataaatatagacggctatcatattaagcaaaaaacggtcaaaaagggcaggaaataaatgatagtacataagatacctattccgatccccgtgatttttgttttaactgtaatatcaacagaatctatttgcttgattttaaacaactttctttctaccacaaagaatattgtagagtacaaaagtggaagaatataaaagactactggatttaactctataaaaatggcataaaacggaaacatagctctaaaaaagaccataaacaccaatgcctgcgttaaaatccaatatatctttttatttttccaataactgagtcctgtcagtataacaattatccagaaaaatgccggacaaaatacattctctttgtacttacaaaaatcagcaagtcccccatacattgcatcagcttcggccatagaatacaaagtacgatagtcatgaatctccaaacagagaaaaatgactcctgcaataatttctatataaggaatcaattttagtatattctttttaactggagaccgctctttcatgtatcaaattatttttcaaacaaatatagtttttattaattgaaaaaacaaatacataattatcagatacaggcaaataaagattgggcattcccgagcaaaatccaccttcagttgttattcaaagacaaggatattttatactataaaaagtcaatgtcatggaaaaaaacatttttaagttagataatgaacagctcaaagcaattgtatgctcatttcgggataaaacagaagaagggttaaaaacggaaaatgcagagatacaatgcattcctaccttcattgctccaaaaacaacccatattaaaggaaagtcactggtacttgacctgggaggaaccaattatcgggtggcaatcgtagatttcgacaaagcaacaccaaccgttcacccgaacaatggctggaaaaaagacatgtcaattatgaagtccgtcggatatacccgcgaagagttattcaaagaattggccgatatgattataggaatcaaacgtgaggaagaaatgcctatcggttattgtttttcttatccggccgagtccgtaccgggtggagacgccaaactgttacgctggacaaaaggagtagatattaaagaaatggttggagaatttatcggaaaacctttactcgactatctgaatgaaagaaacaaaattaagtttacaggcatcaaggtagtaaacgatactatagccagtttattcgccggtctcacagataatagttatgatgcatatatcggcctcatcgtagggacaggaaccaatatggcaacttttatccctgccgataaaattgaaaaactggatcagtcatgcaatgcacatggattgattcctgtcaatttggaatcaggcaatttccatccgccctttctgactgcggtagatgataccgttgacgctatttccggtaatccgggaaagcaacgttttgagaaagcggtatccggtatgtatctgggagacatactgaaaacagcctttccgctggaagagttcgaagagaaattcgacgcacagaaactgacttccattatgaattacccggacatctacaaggatgtatatgtacaggtagcacaatggatttatggcagatccgcacaattggttgccgcctcacttacggggcttatcatgttactgaaatcctataataaagatatacgaaaagtttgcctggtagccgaaggcagtcttttctggagtgaaaacaggaaggataaaaactataacattctcgttatggaaaaactaagagaactccttcaattattcggcctggaagatattgaagtggatataaaaagtatgaataacgcaaacctgatagggacaggcattgcggcattatcataatatactcccgtcactgccggcttctgtacaaacatacagggcatgaagccgacagtgatgtaaccacacccgaacttcataaaaagaaaaagcgcagataaatgattatttaagccgctcttttcgtatttttgcatcaatacaagaatgagtatgcagaacaacgacaccataaaatccggagacatatactgcggacaggaaagaaagaccggcaaatactttgcctatcagattatcgacgttaagaaagagattatgacttatcttcttttggactatttcgatgagaaatttcctgatgaaaaggcagtcaaggaaatgaagccattcaggcgacatcgttggttcttcaaagaaggtactactaattatagccattcggaacgaaataaattgcccgagggagctgcatatgcaggtcacagaactccgcttatttcgggtgagtgcaaagtttatggttgctggccaaacggatatgacaatgtcggcgaagaagaatgggcaaagatcccaacagatgctcgtcagaaattcaaagctgcccttaatgatacggctgaaattgtagtatccggaattgaatgccgccgcagtttccaatacattgacgataagttactgtcggcaatggacaactattcggagctggagaaactccccgtagcctattctttcagtgcaactaaattctatccatcacttattccattcctcgaaacccgttggacagccacaaaactcgattggaaaaatcacggtcaaaacaatctcgacctcagccgtacacacttacgggaaattacactagatggagaaggactgaaaagcgtaagtctaccggagagttgcagaacaatctcattttcaagcaccttatcgccggagctcaaggtttattcacctgacggcggtagtaatctgactctgaaaatagaacttgaggcagatcatgtacccgatgtcggattaccgcaattggaaattctcgtactggaccgggcagtaaagctggatttattacccgtgaccaatctataccctaatctctactatctaagaatttgcggcaaaccgggatacctctccaacatatcttcgctacgcaatctgaaaacgctggaagtgctttcgctcgaagaaatcttcggattcacagcggaagagtttcccacaccggggacctgtccccttctaaacaccctttggatggaaagtatccccgaagaggccggaaaacaaataaagaaaaaatataaaggaaagataactgaactggacatccgcaagttacgcaagccggaatggctcgccgaaaacctggataacccgttacgccactgggacggcagcgaatttgttccaccggccaagtttaaaaaggcagtggtaatctatcgcaatgcgagacgcgatgcattggtcgccgccaaccaatatctgatagacagagatgctgcccttctgcaaaatcgacttgaacaaacaggtaaggaatttgtcatcgctttcaataagctcgacggcaaatcgggattcattgagacagaagaacgcgaagatttatgcgctgccttccaggtcatacttgatgcagtggactcatcagtaaactttttggggttcacgatgaatcacgaccgcatttgggagattatgaacgagcacagagattggtaacaccaagtcatataaccgtatctctataaccatgtctcgtttcaagaaatgtccgcccgatattatttattataaggaatcacacttaaactataattaccatcaggcaacaaatccgaatcaaattctatttcaatatctttagactctcctttcaacaatgtgaaataattatcattcatcagagcaggtaatatacgctcaccatcagaagagcgaatagcctgtacgtgaacagcaaaagcgactgatgatcccacattttcgatctttgctttaatcactttcttaccattactatccactaagcttgatgttgtacgcaatttggctttcggcaaattattcaatgctttatagtctcccggtttattggaacgccaataaaagttatcagaaagcagttgcccgttttcatcgttcagttccaacttgatgaaatgcacaggagtcaaatccgttggcttcttttttctaccatataattcaaattcataaagtgaatatccccacatagtagcctgtttcaacccttgcattttcacataacgagtacgaacaggttttatcttaatctcttcgacaccgcctttagagtcctcattgatataaatttctttccagtttattgcatcatccgaaatcaacagtttataagcttttgcatgagcagcttcccagttcaatatgacagaggctatttcagtaggttcacccagatcaacataaatccattcttcatcacggggttcactcgcccaacgactgccatcactggcatcaatcgcggcacttggctctccggcatctgccgaaatggaggaagcaaccgctttcttaccgaaagcaaggttgtctgttgtaaaattcagatggaaacaataggaatccttattagcggcggcatccaaaactacagactggctataacgccccatttctttcccatccagattatagactttacctgtagccgtaagtcctttctgctctttcaaagtggtattgatcacttttacactattatcagcataactccactgaatatgaaccggttcacacgcctttctgattccccagtaagccccggtcaagtcataataataatcataggtttgccataccaatgaaggataagccgactgccccatccaagtcaatatgccggaagcatcttcccaaatatgatgttgaaagccttcgtacatcgctttattcacctcaacattcactaattgagctttccggcaaaaatcttcaatacctttcgctttaccataattgaactctacggtagagaaatatttgtcgggactggcgttccccgccgaattgccaaagaaatgcttgtcccacatttcattacgtggccaccaatctttttcgggcataaatttcttaaagctatcgaaagtagtaaagacagctgtacctatttctgtacggaatccccatcctttagttatattggcaccatatccataaggggctttggtaaaataccagttaggatgagaattagtccaaggtccactcccggaaaggccgtcactatgggaattggcatgataggcccgatcacccccatcgtatgttctaacgtcttcctccagccacttattaagaggctgtaacggatacccctcattatcaccacaccacactgcaatacaagcatgattacgcaaacgcttgatcttttccactgcattcatattgaaagcaaaaacatcatccggaagattcgaatttgaatttaaccagaagtcgtcccacaccataatgccgtatttatcgcaagcttcataaaactcatcatccgtaaccgaaccgatccaattgcgtatcatattaaaatgcatctcattgtgaagtttcaatttaagatcatattcttcaccccgacaacgcaacatatattcgctcattccccagtttcctccttttacataaacaggttcaccatttattttaagatgaagcacaccgtcaaccagctcggaaccgtattcacgaataccaaatgtaatattctgtttatcagaagccttaccattcaccatataagtcagttcgcaggtataaagatttggctgtccgtaaccattaggccaccacaaagcaggattctgaattataaattgactgaacttgctatcatccagaagaaaagtccgctgtttgcctgcctcaattaccaaatcttcggtaaattcaatgttgcccggctgaatgatacctttcaacactcctttctgctctatatctgtatgattccgtagttccaactgcaagcttaaaaccgctttgtttttagaaggaactttcgaacgtatccaaggatcgacgatagacacttcgccgttttttgtcaaatagacgtcgtcagtaataccagtcagaagaccgggaacataaggcatccaatcccagccggcacatgacatataagtaggacttgcataattgggaaccggagtgcctacccaatgcacaaggacggcaagcacattcttaccgttttttgacagcaaatcggttatatcgaaattcccccgatgcataaatccatcaagcaacccgagacgcgtcccattaaagaatatttctcctttacggttaaccccttcaaaatttagccatactctttctccgttttccacctccggcgaattaaactctgtacgataccagaagttacggtcatattttgctttatcgactttatacgcattatcagcaaaattcggatcaggctccagtccttctaatacatacgaaccaaacaccgttcccggcacagttgctttgacccaatccctcgtgtcatatcgggtagtcatcatatcagaaggatgctcaatttctgcctgagctttcactttccatatcgtcagatttccatcactattcaatgaaatttttactttttgtgcatgaacggtgataccagtaaataataaaacaagtaacagtgtagtcttccaaatattcatatcttctatttctttttcacattacagatcagtatatgaacgattaatcgctcatatacccctaaaaaagaaatcagatagtcatattattatattttgtattcctctatcttcctgtacaaagtggtaagaccgatcttcagcaagcgggcagtttccgtcttgttgcctttcgtatattccaggacgcgggcaatatgccttcgttccatagcagccagttcaaaactaccgatattatcatccgaacattcataatgagtattctgaatctccaacggaagatcgcacacatccagatgcccgccttcgcagacaatcagactccgttctatcacattccgcaattcacggatatttcctttccagggttgctgttccaacgcatgaagaaaagcaggagtcatctcattgaccgtatacgaaagtttctcggaaaagctctttgcaaaggcagtggcaagaattctgatatcaccggtacgttcgcgaagtgccggcagatgtacctgaaataccgaaagacgataaaacaggtcttcacggaaacgtcccgctttgatttcctctgtcagattgcggttggtagcagcaataatacgaacattcacgtgcgtcggtttcgtatctcctatctttatatattcgcctgtttcgagaatacgcagcaatttggcctgtagttcaaaagccatttctccgatttcatccaaaaagatcgtaccgttgttggcttcttcgaagagtcctttcttgtccttcaaagctccggtgaaggacccggctttatgcccgaacatttcactctccagcagttccttactgaaagacgaacagttcacggcaacaaagctctgtttgctccgcttactattataatgtatggcttgtgcaaatacttcttttccggtccccgtttctccggtcaacaacaccggaacatcagtcaccgaaaccttctgtgccagcataacagcttctttcagcactttcgattctcccagaatggaatcaaaagaatatagctgactgactttcttttccagtttctctaaccggacattcatcttagccttctcaacggcacgactgatcagagggataatcttattattatcgtcccctttggttatataatcaaatgcaccgttcttgattgcctgcactccgtcgggtatattaccgtgagcggtaagaagaatgacttccacattcggagctgtctttttaatgttcaacaccagatcgaccccgtttccatcgggaagaaagacatcacacaaagccacatccggctgttgaatttccaactgcctgatagctgccttgcaatcacccgcctgacacacctcataaccctccagtccgagcatacgagccaacaggctacgaatctgaacctcatcgtcaatgataagaattttactcataattaatttataaaaaatgaagaaagacaaacagggtgcgcaaatataagtcttttttctatgatccgagaacaattctccctactttattgttatttccacaggaaactatttacgcaacaaacttatgaagatcattattattggaggcgttgccggaggagctaccactgctgcccggatcagacgcacaaacgaagcagctgaaatcatccttttagaaaaaggaaagtatatctcttatgccaattgcggactgccgtattacatcggaggcgtgatcaaagaacgggaaaaactgtttgtacagacgcccgaagcattttctacgcgctttcgtgtagacgtacgaactgaaaatgaagtaatcttcatcgaccggaagagaaaaacagtaacggtaagacaaagtagcggagacacttacgaggaaagctacgacaaattactgatatcgaccggagcctcccctgtacgtcctcccctgccgggaatcgacctgaacggaatcttcacactcaggaatgtagccgacacagaccgaatcaaagaatatatcaacagtcatgctccccgaaaggctgttgtcatcggagccggatttatcgggctggaaatggcagagaacctgcacgcacaaggagctaaagtttctattgtggaaatgggaaatcaagtgatggctcccatcgacttctccatggcatcccttgtacaccagcatttgatggacaaaggagtgaacctgtatctggagcaggcagtagcctctttcgaaagagacggaaaaggattgaaagtcatcttcaagaacggacagtccatctctgccgacatcgttatactttccatcggcgtacgtccggaaacgacactggcacgtgccgcagagctgaagatcggcgaagccggaggaatcgccgtcaacgactacctgcaaacgtcggacgaatcgatttacgccatcggtgacgctatcgaattccgccacccgatcaccggaaaaccgtggctcaattaccttgctggtcccgccaatcgtcagggacgaattgtcgcagacaacattcagggagcacacatcccttatgaaggagccatcggaacttccattgcaaaagtattcgacatgactgttgcttctaccggattacccggcaaacgattgcggcaggcagaaatcaattatatgtcttcgaccatccatccgtcctctcacgcaggatattacccggatgccatgccgatgagtattaaaatcactttcgacccgaagacaggtaaactgtacggcggacagatcgtcggctatgacggtgtagacaaacgcattgacgaaatcgcgcttgtcatcaagcatgaaggtacgatctatgatctgatgaaagtggagcaggcttacgcccctccgttctcttctgccaaagatccggtagccgttgcaggatacgtagccgaaaacatcataactgggaaagtacaacccgtctattggagacagttgagggatatcgagatggaaaacaatttcctgctggatgtacgtactcctgacgaattctcgctcaatacactgccgggtgcagtgaacattccgctggacgaactgcgtgaccggctggatgaactgccgaaagacaagatgatctatacattctgtgccgtcggcctcagaggataccttgcttatcgcattctggtacagcatggatttgaaaaggtacgcaacctttccggaggattgaaaacataccacgctgccgcagcacccatcatcctgagagaagaaagtgagaacgaagtacctgcacaaccgaacgcaaacatacaacagccggcagatgcgcaacctcaaaagacagtttcaccagttgaagcagtgaagacaatccgtgtagacgcttgcggactgcaatgtccggggccgattctgaaaatgaaaaagacaatggattcgctggtttccggcgaccgggtagaaattacctcaaccgatccgggattcccgcgtgatgctgccgcatggtgcaactcgacaggaaatcagttgatttccaaagaaacagcaggaggaaaatctgtagtagtgatcgaaaagggcgaacctaaatcctgcaatattgttacctcctgtgaaggcaaaggaaaaactttcatcatgttcagtgatgatttagacaaagctttagctacctttgtgctcgctaatggcgcagctgccaccggacaaaaggtaacgatctttttcaccttctggggactgaacgttatcaagaagctgcataagccgaacgtcgaaaaagatatctttggaaaaatgttcggcatgatgctcccttccagttcccgaaagctgaaactctctaaaatgagcatgggaggaataggaggaaaaatgatgcgatacatcatgaaccggaaaggaatcgactctctggagtccttacgccaacaagctctggagaacggtgtggaatttatcgcctgccaaatgtccatggacgtcatgggagtgaaacaggaagaacttctggacgaagtgacaataggcggagtagcaacatacatggaacgggcggataatgcaaatatcaacctgtttatatagaaaaagaacaaacaaaaaaacaagtagcatatgaagacaatatgtgtaatgcgcgatgtattcaaagcaatggcaagatttgaagatgcatttgaaaaagtgtatcaggtatcattaaatgaagcgatgatattatgtgccctgcaagaagcctcgcccaataatatgacggccacgagcctgtccaaacgaacggagctgacaccctcgcacgcttcaaagatgctccggattctggaagaaaaagaactgattgtcagaacactcggagaagaggaccggagactgatgcagttccatctcagtcagagcggtaaaaaactagtccgacaattagcacttgaaaaagtggaaataccggaattactgaaaccgctattcgaatcggtagattcctaaatcaagcagcccgatacatgtaatatcggcttgcagaagaataaaacggtgaaccgcctgttcatatattacaggttgttcaccgtttctcgtttcgtcattcttcaagccaccctctaagaagagacatcactttctgcttctgatcttcggacattgtaccgatgcgtgcaagatgactgcctcccggctctacaaaaacatgaatattctttttattcttcagccatgttactccggcagctgtccagggatcattctgaccatagataaaaatcatcttcggatcgttcttcttcaagaaccgcacaatcttattgctcaatgtcttatcgaatttcatcttccgcatatcttccggcaacatcagtcttctcagataatccttgctggtctttatagaaaggtaaggtttaaaaggagcgatatcgtatccataataccccaattcgcgggcagcctgcacgaagaaagaaagagtcgggctgtctactataaaataagaaggtccgctgattgccagcaaatgatccagcagtgtatcgtcagaagccgaggtttccggtatactacggatatccgttccccattgccagatagagaaagagtattccagcacacagaaatcgtatatttcttccagaggagcgcggaatgtatagttcttttcagtacacattttttcaaaacggggcaacaaacgagcctttcgcttcaatacttccaactggaaatcttctatttttttcctatcggcttccgtacctacccggcggaggaaaggttcgtgccgaccgtcttcacgcgcataacaaagaggagcaacataaggcacggaaacatccacatcgtcggggaagaaaacacggtataataaggaggtctgcccacccttgctgatccccgtactgatccatttgccaggatataaagtcttgaaagcggttgtcacggcatgcaaatcctcggcagaattctctgcggtcaggtattgccagtcgcacggttcgggagtggattcgagaaagtagcgatgctccacaaagatcatattggcatcgaacaattcagaaagttcttcccgataagtggggcgcaaagcataccctgccccatatccttcagtgacaatcactgtgggacggtcataaccgacgtgtcccacaatcacccgctggcggaaacttcccttttcgggatgtcgatgatccagcggctgagtcaggtacattacatacttttccgggaagcggctggtgtcgagcaactttattccgctgacggacttatttttttcgatcttctgaataaacgattcctgcgccgacaatgagacgggcgcaactgcgatcagcagcacgattgagaaccatacgaaaagaggtatccgaatgtgtttcataagcatttgagtgttaattttctcgcaaagataatcatttgcacgaacctttttacacatttcttgttgtttgtaacaaaagccccaaggtaccagggcgtgatttttatataacctaaacattataaaag

SEQ ID NO: 198 - DNA, 12665 bp, Bacteroides thetaiotaomicron
aagctatcttattttccacagcttcataccaaaaacaaaaaaagaaagaaaattttaggaaatgctgattttcttattatatatttgcagtaaaatgaaaaactacagaatctcaaaataatgaaaatatctttttccagacagactaaagaaagagctttcaaacaactttacgaggattattatgcccctttctgcctgtatgcaaaaagatttgtagatgataaagaagtccgcgaggacattgtttcggatgtattcacctccctatgggacaagttggataccgactctttcgatttgcaatcagagacagcattgggatatataaaaatgtgtgtaaaaaacagctgtttgaactttctgaaacatcaggagtatgaatggagttatgccgaaaatatccaaaagaaagctcctctatatgaaacagaaacagatagtgtatatacacttgatgagttataccgaatgctatacgaaacattaaataagcttccggaaaactatcgcaccgtatttatgaaaagtttctttgaaggcaaaacacatgcggaaattgccgaagaaatgaatctcagcgtaaaatccattaatcggtataaacaaaaaacaatggaactcctgcggaacgagttgaaagattacctcccgctgtttttattattcctgtctcccgagcaactgtaagctctctgctaaaacacggcactctttacgattaatcttcccatttcccgtttgaggaatatgatttaccgtataaatatatttaggacgataataagatgctaagactgattccaatttagtccctagcgcacttatctccatctgcccttctatcaataaagtaacagcctgccccaaacgccgatccggaacggaagtgatcacaaacggtacagggatagacgactgaagtaacctttcgatctcttctgcctgcactttaattcctccgctattgattacattatcctttcttcccagaatcgtaaaactaccgtccggataaatgcgggcaatatcatttgtctgcagagtatcatcgcaaacaagcggagcattaatcatcaaagtattttctgaagacaaaaacaactctacggatgaaaaaggataataacgatcggatgctgctgcgccattcagacggcgaagagcgatgtgagaaagggtttccgtcatcccgtaagttgaataaacagcattggacagatttctgattttttcctctaaagccttgtcaactgctccgcctcctataattaaaatctccgtttgctttaatttctctttctcttcgggtatctgaaatgtattatacacctgcaaaggcaccatagccgcaaaccttaaaggagtgtccacatctgccaatggatgaccggaagcccgacgtactataagattcaacccggcaatcaaagaacggacgactaccatcatcgccccgatatagcgaaggttcatacacaataatgccgtttcaccctgctttaaatccagaaactcacaagtcaggcgtgcactctgtatcatctgatctttgcgaacaagcaattctttaggtgcccccgtagaaccggaagtatgtacagtgatcacaggatcatcattaaaccattcgtttagaaaaagatacaagtcccatatagcagaagggtggtttccctcaccttctgctacaaggctatgtatatcgcccggagtatattcctttccctccagcaacaaacgctgtttttgtcggtcgaatatcatcatttacaaaaccacaaacaatcttttctgatttcaagaggcatctctacattatctgtaaagagtaacccggtgcctaacccttgcggcaatggattctgaaaagtagcacaccattgagcgatagcattcagaccgatattagactccagagcagaagttatccaccaaccgatattcagtttctccgcttctgcaatccactcctcgccaccggctaatccgccatgaagagaaggtttgataataatatattgcggacggatagccgaaagtaatctttgcttttcttcccaggtattatagcctatcagttcctcatccaaagctatcggcaaaggagattcggaagtaagacgtgccatttcttcccattgtccggcacgaatgggctgttctatcgaatgtaagtccagttcggacaagcgtttcaatttctccatcgcatctgttggtgagaatgctccgttggcatctacacgcaattctatttctttagaagaatagtgagagcggatatgttggagtaaagccagttcttcttcaaagttgatggcaccgatcttcaactttatacagcggaatcccgcctccatcttcttctctatctgagcaagcattctattgaagtcacccatccagataagcccgtttatcggaatacctgcttccccacgtgagaagggtgtatcccacaaagcccagcttccttcaaaaaagtgacgaatggctgtctccaagccaaaaaggatggaagggtacttgcatagagcttccatgtccagcttacctccctgattctctacctgccggcagattttagccagcacttcctcgtaatcgggaagatcatcacagctaagatttggcagaggagcgcactccccgatccctacccaattgggaaattcgggagcagtaaaatgaagataccagacttttcgcgttgtgtatgtgcctcgtgaagttccggccggctgcttgaaatgaagcacccgcggaataatgtctattttgcaatccattgtttaagggaacttcggatatttcttaaagttaggtttacgtttctccagaaatgcattctttccttcctgagcctcatccgtcagatagtaaagcaaggtcgcatcccctgccagctcctgaatacctgcctggccgtccagttcggcattcaatccggctttaatcatccgcaaggccaacggactgagcagcatcatttcttccgcccattgcacatactcatcctccagttgctccaatggaactactttattcaccaatcccatatccaacgcttcctgcgcattgtatttccggcaaaggaaccatatctcacgtgccttcttctgaccgacgacacgagccagataagaggctccgaaacctgcatcaaagctacctacgcgaggaccggtctgtccgaagatcgcattctccgaagcaatcgataaatcgcaaactacatgaagcacgtgtccgccaccaatggcaaatccatttacggcagcaattaccggtttcggaatgctgcggatttgtttctgtacatccagaacactcagacggggaacaccgtccttgccgatatagccgccacgccctttcacattctggtcaccgcccgaacagaaagccttgtcaccagctcccgtaatcacgatcacatcaatatccgcttcttcccggcaaatgcgcaatgcgtcactcatttcagccgttgtagtcggagtaaatgcatttcgatagcgttcacggttaatggtgatgcgggcaatcccattatagtaatcaaagaggatatcttcgtattctctgatggttgtccattctctttgtgttgacataatctatttttgttttagttgatgataataatctttcagtatacgtgcatctttatttttattgctgaatacttccatcagaaccggttgttccatggcttccggttgtgtgaaggttttcatcgcttcggcaagctgttcttcattctctacccgttgataaaggaatccgcgttcttccgcccatcctttggcagatgtcttgtgaacggctgtaatatacttgtgcgatgtacccgacatatccagtccgggtaatgtatggaaaatctcccctcctccgttattcagcaaaagaatgcgtagattgggacggacattgatgttccacaaagcattcatatcataaaagaaactaaggtcacctataactataaaatttagtttatccgaaccggcggcatatcccactgccgtggacaacgagccttcgatgccgcttgtaccccgattacagcatacctcaatcgtagaaggaacctggtataactgagcatagcggataacagaactatttgccagatgcaatgcacatgattccggcaatgcttttatcaaagcaccgatagccgacatttccgaatatccgaactccggttcgggaatggtcttgcaataattctcccatacacggggatactccggcacgcggttatccagcaatggagctattttctccagaaactcaaacgggtccatttcgatgacggtagtcagagaaccgtaaaggtcaaccacttctccatcagcagacacatgccaatgttctttaggcggatgctgccgaagatattttttcaaccgcttggaaaccacatgtccgccataagtaatcaataactcgggagtcatctggccggttttctcttcgggcatcgcataaagcgccgcatcaaaattcttcactggaataccgggtactgtctgattaccgatatgctcggtcagccacacgaaatgtttatataacaatttggtatgccgtttctcaaacaagtaaatcaagttcatctgtccgacaataatcatccgcttctgatatctgttcaagcgttcgatcaggtcattgtaatcccggtcgtatacattcagcccctgatagcgcgtaatgacacgtacttcgggaagcgactccaccgtaaactggaacaaaggttcggatataggaatattaatatgtaccggaccttttccatgatggttggtttccagcaaggcttcattcaccaagcggttacagtaccattcatcctcttctgtctgaatctccggaaggtttaccgacttcttcaccaatgtctgaaaaacaccgggctgcggcaatgtctgtcccgccatctgtccaatccaggcagcaggccgatcggcagagataacaactaaaggtatattctgataatacgcttctgccacagcaggatgaagattgagcaacgctgtaccggaagtacagcaaacggcagcaggatgcccgccattcagcgcaagaccaatcgcaaaataaccggcactccgttcatccgtcatagcataacaagtaaaacccggatgagtagacagcgtatgcacaataggtgcattacggctaccgggacataacactactttcgtaattccatgcgcctcaagcagcgcgaccaactggagtatatttttcttgtccgaatacatattgatagtgattagcttgttagtgattcatcattattggagcagacacaagaatacgcctcatggtctgcaatttcttttccgtttcctgccattcatcattcaactctgaagaggctaacaatccgccaccggcatacagtgtcaattgctcgtcttcaatgtgcatgcaacgcagattcacatacaaatctgtgcgtccctccggatcgagccaaccgataaaaccggaataatacttacgatcgtacccttcattttccaaaatgaaccggtaggcttcttctttaggcagtccgcacacggcaggagtcggatgcaggactttcagaaggtctcccagatttttattatctttcaaagagaaatggaaatcagttttcagatgtgacaaggcaccggcataagccggataaggtccgctctctgtggagcgaatgcccagcgaaagaagctgccgacggatataggacgccacataatcctgctcctgacggtttttgtcatcccatacttgcggaagtttaccattctgcaaaggttgagttcctgccagggcaactgtgttccattcatttttttcgcccgacaatataatttcgggggtacttcccagccacacgcccgtctgaggagtataacacagatagatataggaatgaatataacgttgacaagctgcacgaaaaacagctgaaggggaaaactccggattctttccaatagtgagactacgggaaagcaccagtttatcaaaggtagcatcacgcaaggcttcaataaatgtatgaaaacaggtcgcatacttcccagtacaaagggtatgaaaagattcctccggataactttgcaagtcctgctcttcctctgccacgatttccataggcaacggttgtccagtcctgtcggactgtatcaacacaatcggacatgacttatctatacggaacggagcaatcacaaatcctctttgtccattcagttctttcaaatcgaaaatcaagcggacagctccgacatcttctgtcaacagacgaggatacttctccccgggaacacgataaacagcaaagggctgtttccgctgaataagtgcatcaatagttgtcaagttacttttttcgtcaatcatctttttttcatcacactgttgaccacccgtatagaggacaccagtttattggttgaagtaaaaacgtccacattccatacatgggaggaacgtcctttgtgtacaatcgtcgctactgcacgtactgtatcaccttcgtgcgcagaagatatatgatttccgctgacctgcattcctaccacaatttcatccggctgacagagaatcatcgagccgagtccggcaactgtttctcccaatgcaagcgtagctccaccgtgcaaaataccgaacggctgacgggtacggtgatctaccggcatcgtcgcctctacacggtcttcgtcggcatatgtatattggatacccagattacccatcaatgcgtgacgcgcctgtgcattcaactggtccaaaggaatctctgcagcgcgaacttccgctattatcgccttttcgacagccagagccactccgtcttcctcattggaagctgtcacataatccgcacagacctttaccgaatcctgcgaatgccccatcgccactcccagtcctgccagctgaatcatcgttacatcgcacacaccgtctcctatagcgatgacttcttcacgcttcacatccagttcttccaataaagctcccaatgtgttggctttatcaatcgcacacggcactacttccagaaaataaggttcggaacggaaaacatccaaagctccgttcaaccgtctcttccagtgtccttccagactaaccaacgcttcctcgtcatcgctgacaagcatacacttacacggagcaaagtcaattgctacagaaaattcctcttccttgatcactttcaaattattcaagcgagcttcattctggatatgttcattctccggagtgtcagtaatgatcgtatcatcatggtaagtgaacagtgcgaaattattttttcttgccttcttttccagataaggcaacatttccggattaatcctccgctcaaacagtatttctccgttttgagcattaattatctggcaaccattataagaaaggatataacctccataatttccgagttctagggatttggctaaaggcatcagaccgtaagtcggtcggccggatgccaacacgatacgtactcccatctgctgaactttcagcaaagcagccaatgtacgtttactaatttcttttgcatcattgagaagcgttccgtctacatcaagaactaataatttatacttcatggacacacgattttgatttagattacaaaggtaggaaattgagtgaacgactgaaagcggaaagagataaaaattactttaatttcactctttcagatgcatttccaaataatcacgaaggattcgggcatgattataaaccggttctttggatgcataaagcaaagtgatcaccggatgaggtttgataagagtcagaaaatcggcaacagcttgagaagcttccagttccttctgatacattacgacaaaatcattccagtgacccggaatatcttcatgaaaccatctgcgcagtgctgcggaaggcgttatatcttttgcccagtaatcatatttcaaccattcttttttgattccacgtggccagagtttatctaccagcacccgatatccgtcggtctctgaaaagtcttcgtacactcgctttatcctaacttgcaccatttccgtttatatttagttatcataagaataaaccgataaaacggaaaattgtttatcgaaaaagccaaaatcaacctaaggattcctgcgtttttttaaattcgtaaggagtcataccagtctttttcttgaacatactgtacagaataggcgtactattaaatccggcttcatcagctatcgcacgaatggtataattgggatgttgcttcaataactgaatcgcatagttaatacgaagttcattaatatacccgttgaaattagttccggtgttttccttgatcatccgggcgaaacgcgcattattcaaatgtacaatctgagccagatcctctctcgacaattccggagacagatataactgatcctgaacaacaatacgattcagttctttgaaaattttcttattctcatcctcttcctccctactctccactacttcatccggagataaatcgtctttttcggaaaagccagtttccggttccaagtccaatggaacagctatcggatcttccgcatctccatctatgaataattgtttgttctctacttttccagccagtttctcattgataaactttgccagcattttgtttttatatttaacaataatcgtatgacgccaaatccgccatagcacaaataaaatgagacaagtgacacatcccaaaaaagcaagtgatatgtttctgattcttaactgtaaagtctgttcggcaatatattcttcctgctcgtcagctttatgaatagcatttaattccaaagccgcattctgtttatccttgctgttaataccatcaataatagaaataatagactcacgtaatgctgctactttttcaaaatccttcaagcctttataagctttcacctctttctgaaggatactaatatactgcaagttgacagtatcctgctcttgcatcaatttcttaaaatcctgacattgatcaacgactttctgatattgtttagacactagcagataaggtatcgcataggtttttccatccggtgtctgtgaattctctgttgacaaatattgttgataatatttttccgcctgatcatactttccttccagatagcagatatacgacatttttgcatacaagtaagtatattgcagatcaagaaagccttttgttttttccggtaatttagctatatctttaagtagcttttcgcgcttcaacccaacctccaatgcttctttactacgggaatcattgagcagataatccattttcatcccataaaagtatgaaagcatagccatttccaatttggaacttgtaccttgaagcaatttgatagctttgtcaaaatagtcatatgcctcctctttgaaagacaattgccatttattttcaccaatgcaaaacaacagcttactttcagcccctttatccttttctttttgtgctagcttgataccatcaagagcatacctcatactctctttatggtcactcataagcactgctaattctgccaggtcgacagtcatggtcaacaagtgcttagtatctttctgagaaacggaatccagcaaataagactttttggcatacaaaaaagccagtttagtcatatacatattacgataaaccctgctgcgtaattcatgtataatacgcagagggatagtcttcttactttcagctccatccaacaaacttaaagcccgttcaggttctgccatataaattcgacttatatactcactggtatatagcgaatcattctctatagttttgtcggcgaaaaggagctggttaaacacaaacaaaaacaaacaaaaacaaataaccgagcgaatacttttcattataatcccaatgattttactccccaaaagtaaaacatagtttcataaaatgcaagaattgaacatatttgaatgaactaaaataagaaaagttagtgattataaaagtcaggagctatcaagttttccccaccaaccacatacaataaaatactaaaaatcaagcatatgtcacatacataaaacaaaacatctcaacatataaataaactgccgattctattaatgaatctgcataagatcagagcagcacatgaaaaatcgaaccgaccagtctaaataaacaccagacaattattaacccgccacactcatcagagcaaaacagcacaaaaacagaaaatcaaaaaagagaaacacatactgtaataagaaagattataatcccaacgctttatcaaaccgttgctccatacatgcactcaaatccgtcgttacaaactttcctttatagaaaagagaaaagatagtagcaggtgtaggtgcattttgtgcttgtgccatcgtttccaatctgactatcttcaatggaatacctttgttctcagtcacactcactaaagaattacggacatgaaactctgcaaacggacaacgatgtgtataataaacgactacaccttctttttcctcacattctccacttgatactgttccattgaatgacggatcaggagctgccggatttatcttcaaagccaaaagactgaaaccatagggtagtttttctatcgtctcaaacccctgacgtaataaccatttcgcatcacccataaaatgaaatttagaggtaccgaccacagtcaccaagccatccctaccctgtgctttggcatcctcgacagcagactgcaatagtgctttgccatgcccgcatcctttatattttcctgaaacccaaaaacagtttatcattaaatagttaggtgcattaaccggaacccaagctttttcggcaggtccatattctataaatacttttgcacgttcgtcaagccgtctgaaaacatagccattctcaaactcatttttcagccatgtctttttcaactcatagctatccttacatttcttatcggagaaagcacagcaaatatgttctttttcgatattctctttagtcagagtgatatacttcgcttccataatattctgtttattagtatataaattccggttgtccatttcaactacagcaaagatacacaatcgaaagtaataaaacattgtccagtctcgtcaaaatgacacagtagtacggattaaagttcggaaaacagataagtaaataaacctgagtgacaaacttatcaaagaacttattgaccactctgtggaagaagtgatcaaaaaaactccctaagaaaaaacaggaggaatatcgcacaatgatttaacataaagcgtgaaaccgctgactggtaaccatacaaatatccggctttgctgcaattcacaatagtaaagccggatatttaactgtcaaaagcatatatcccatataccacaagctctttccaatgctactagtgaagcggcatatcctttcattgtttccagatactcctgttgcacttcattataagtacgctgggcaaccagtacatcaagaatactcgtttctccccgtttgtatttatataccattccgtcgagcaccttctgcgagtcttcaagtacaccggctttatattgagctatctttttcttttcagcctcatagttgaaccaggcctgggttatctctgtctgtatctgcaattccatatctctttccattatctccgattgggcaatccgaaactttgcagcttttacagctcctttatttatattcgagaatgttagaggaacagatacaccggcagtagcagaacgggacggaggaagaaagccgttccagtttctttcataagaaacagatactccgatatcgggtctgcgttccgctctcgtcagtttatattcccgggtagtaacttcagtacttttttgagcaacaagcaggtcgatgcgattatccagtcccgctttgaccaaatcagacagagcaaagtccctgcttagctcttcccaatttcccaaagggatatgaagcgtatcagcactcatccccatgtgtttattcaacaaaaccaaagcggaatgataagccgcctcctgactgtaaacagtattaagcaaggtgacagtttccagttttgactgccggacatcattctccgtaatctctcccgaaacataacgtaaactatctgactgactcagctgatacatatactcataagaacttttctgtacttcaagtaattcgcgctgaagaattgcttctagaaaaaggtcggcagcctccgccctcaaatcctgaaagccctgttgcaggaccagtttctccaattctgcctgagtccgcgccaacttaatacgtgctccccttttatttcccatttctaatgaataggaaactcccaacgagaaagtctcattacctgcttcaaattccaactccggatccggaaagattttccgggcaattacttccgcatcagcaatactcacattgagtttttcggctaaataactcaggttctttttcgctacccgattcagatattcttcgaaagaaatagactgccccagctttatttcaggcatttgcgcaaaagccggaatgagtacggcttccaccattaacagcaagagcactatattatatcgtatattct

SEQ ID NO: 199 - DNA, 12631 bp, Bacteroides thetaiotaomicron
tggtgacactatccacaccggatagtgtcaccatttttatattataatgtcattatcctgaccggatagtgtcactataattagggctctttatttcagtagaaattcatcgatagctttcttgtaagttgctttgtcagccgctccacggaaaagctgcggatctcctttcataggaatgaatacaaacaatggaatgcttgttgcgttaaacaaggcagcaagttctttctgtttgtctacattgactttgtagattgttattttccctgcatattcctttgccaattctttcatgattggggctgtctggcgacaaggaccacaccagtctgcatataagtcgatgatggcaggtttgtcacctttgtatttccactcttttgatttttcataatcgaagacgtctttcagaaacatttctttgtccattacgacgacttcaccgttacctgttacctcttttttaccttgattggcatccggtttgtcattgaaggcgtatacgataacgctcagcatgacaaaagctaccattgctaatactttcttcattcgctattttccttttatatgtaattttgttcgatgattccttttaattcactactgtggataactccggaatgtctccatacggcttctccatttttgaataaaataaaagtcggcactgcctgtatgcgatatttagtagccaaatcttcatgttggtcaacatctatcttcacaatacgggctttatctcctaccattgttttcaattcttctaaaacgggtttcattgctttgcagggtccacaccattctgcaaagaaatcaactaaaacgggtatcggtgactgtattaaatcttcaaacttttccataatctttcctttcttaaatttaaatatcagtctttgaagactgcaaatataatttctattttattaatataacgggaaaaagctgtttttgttcataaaatagtaattgtagagtcatcttattgtaatctagaaaagggaactttgcataacgaaaaacaaataaataagaaataaactaataatgatagcctcatgaaatttttatttattgtacaaggcgagggtaggggacacttgacacaagctattacccttgaagaaatgttgttgcgtaatggacatgaagtagtggaagtattagtcggtgagagttcatcacgtatcttgcccggattttttaaccggaatatacaggcaccggtcaaacgttttatcagtcctaatttcttgcctgcggcagataataaacgagcgaatctaaagaaaagctttacttacaatttactgcgtattccggaatattttcgcagtatgtgctatattaatcagcggattaaggagacgggggcggaagtagtgatcaacttctacgagcttctgacgggacttacctacgcactctttcgtccctccgttccatatgtctgcgtcggacaccaatacttgtttttacatcagaattttgaatttccggataaaaactcttttgaattgcggatgctgcgtttcttcaccaagatgacagctgttagatcttcgaagaaacttgctttatctttcaatgatatggaaccggacaggggacaacaagtggtggtagttcctcctttaattcggcaggaagtaactgctattcaaccggaagaaggaaattatattcatggatatatggtaaattccggttttgcagatagtgtggaggaatttcatacgatatatccggaagttcctttgaggtttttctgggacaaagcagatgcagaggaggtgacccggattgacgaaacactaagtttctatcagatagatgatgtgaagtttcttaatgggatggccggttgtcgcgcttatgctaccactgccgggttcgaatctatctgtgaagcaatgtatctgggaaaacctgtattgatggttccggcacatattgagcaggattgtaatgcccatgatgcaatgagggcaggagccggaattatcagtgattcttttgatttgaagcctttactccgttttgccggaacgtattctcctaatcgtactttcgttcgttgggtacgtagcggtgaacgacgtattattctggaactggaaaaactggctgcatcacaatcagcaattacttcaataccaacatttactaattatttaccgatatgaaactgaataaaacagattatgtacttgagcgggcgtcagacggcggatattatgcctggttgactgtgaatatgcaatgtaatgcttacggagagtctcctgaagaagctgtgctgaatttgcaggaaacaatgaatgaaatgatagatgagatgtatatggtagaagagtttatttaatggataatggaaaatggataatggataatggagaattgatgatgccattctgcatagagattttccattatccatttttcattatctatttattcaatactcagttcatcaataatgtgggaggctcctgcatatttatcgataataaataaggtatagcggatatctacacaggcggcacgttgtgaggaggggcggaaagcgatgtctccggtcagcccttcatagttgcggtcgaaagctgtgcccactagttgtcctttgctattgaataccggactgccggagtttcctcctgtattatcagtattaacaataaagcagacaggcatttcaccgtctttaccatagcgtccatagtctctggctttatatagttccttcaacttctgcggaactacaaattcccagtttcctggatcttccttctccataactcctttgagtgtagtatgagcgtcataaactactccgtcggcaggttcgtaagaaagtacctgtccgtaagtcagtcgtaaggttgaattggcgtccggatagataggcattcctttttcctgtctcatgtccatcattccttttacccataccttatgagcagcgtcgtagttctgattagcctctttcatggcaatggcagttttcaatattccatctgtgatggagtatttgaaaagtaccatccagtcatgacctatcttatataagcttggttttttgataaacttttcaaagttcttgggattaccaaaaatcgaatattcaaaacaagcatctacaaatgaatctatatttcctttgaaacgtgagtttatgatctcgaaaatattgattcgttgttcctccggaatgtagctggcataagtttgcagcatggttttggcaaccattcgctctacttccgggaagggaacggaggcaaagtatttttcaccggcttgtttcagattttcggtagctgtttttatttgttctttgttttttgacttaagggcagtgaccatttctgttgtagaagggaggcgcataaagtcaagtgctgtgacaagtgcttcgttaagggcttgctggtgatagagtgcatcccgtcgatgagcaacgatagaacgtatttcatcaaatgccttctgataagaatcatcacctttttcgcggccacgggccaagagttcttcttgttgtttacgcttggtatccagtactttgagacgtactaatccttcgttcataccaattgcatttttccagtaattggctgaagatgcatacttacttgcataatggattcgtacggcaggatctttcagcatctgctccatcagaactttctgacgggcaccgcgtacatgttgacgcataaagttggtagtctgcatacgctcttccacttcatcggaaatcatatatcgccagttacgtcccgggaatcccataacaaaggtgaagtcaccttcctgtactccggcaatgctgattttcaaatgttttttgacctgcaaaggaacattgtctctagaatatgcggcaggtttgccgtttttatcagcatagatgcggaagagggaaaaatctccggtatggcggggccacatccagttgtctgtgtcggctccgaatttaccaatagaagaggggggagcacctaccatgcgaatatcgctgtatacggtctttacaaacatataatatttatttcctccgtaaaaagctttaagttcaagtttggttgcaggggtgacttctatattttcatctttagcgaagcgttctgccactttgctcaggtaacttggcgacaaataattagtaccattcggatcttcatcttttttcaactgatcgtttacgtaactggttacatcaaggatacggtcgataaaagtgacggtcaatcccggtgtgggaagttctgcatcacggttcatggcccagaatccttctgtcaggtaatcatgctctacattactatgttgttggatagctccgtaaccacaatgatgattggtgagtaccagtccttcagaagaaatgacttctccggtacatccgccaccgaagtgtacaacagcatctttcagagagatgctattggcattatatacctcttcaacaggaatctccagaccgagttcccgcatggcaactgcattttgtgctttcaggtcagttagcatccacataccttcatcggcgtggatgctaagagttgccagtgaaaaaatagcaaatataatttgttttctcatttattctacgatagtcatttcattaatcagatggccgcagtttcctaatttctcaaggataaacaggacgtagcggatatcaaggttgatacaacgttgcaagttgttatcaaagttaatatcaccactcagagattcccagttaccatcgaatgcacagccgatcaattctccgttttcgttcaatactggactaccggagttaccaccggtaatgtcattggttgacaggaagcagacaggcatatcaccgttaggtaatgcataacgaccgtagtctttcttttctataagttctttcaacttggccggtaccacaaattcgcggtcttccggattttctttttcaagaataccttttgttgttgtgtaatagttatagtgtacaccatctttcggatcatatggttttacgttaccataggtcaggcgaatggtgaagtttgcgtccggatatgaaggaacaggcaatttcatttcacctaaaccgcggatgtaagttttgtggagcagagcaagttctttgtctagctcttttagctgatcaaggagattgccgtattgatcgtatttggattgggcatattgcaaagccagatcctcatcaatagcttttactgtcggctttttgaggaatttatcaaagttagcctgattggcaaaaatagacttatcgtacatatcgtctacgaacttgttgtaatctcctttatatttttgctcgatcactttatagatagcagggcgttggtttgccggaatcatttctgcatagagaggaagcagtgctttagctactttgcggtctacttcatgatcatagtctttgttatggatgcttttgaagttttctttcagaccttccagacgaactttgatcagagagtcgtttttatcaaccaaagcttcccgtgttttagttaacattgagttaccaaattcgatagctccgaagaaaacttcagtcaggcaagtcagttgataattgagaggagctgtttgtgctaccagatcatcgatctttttcacaacattggcatattcggtattgttttgtgcctttgcatattcagcaaatttagcttcctgttctgctttagtgcccaatacgtcattgtcaatgatcgctttgttcattccgatcgagtttttccagtagttactggagcctgcatatttgtttgcatactgaatacggattttatcgctggcgttcatcacttctttcaaaacagccaggcgtgcaccacgaatgcggatacgcggttcattggttgactccatgcgttcttttacttctgacacagtcagataacggctggttcttccggggaatcccatgatcattgcatagtctccttcttttaaacctttgatggagattgacagatgtttcttcgttttcagcggagtattgcttgcgctgtattcagccggctctccgttggcatctgcatagatacggaacatggagaagtcaccggtatgacggggccacatccagttgtctgtttcgccaccgaatttacctactgaagaaggaggagcggcaaccatacgtacatccggatatattttcttgtagaacaggtagaatttgtttcctgcgtagaaaggaagggcttgcggtacaattcctttcttatctttcaggtcacttttttcatagagttctttagccagtccttcaaggaaagcaccggtgaatgactgggattctgtaatctctttggcggcgattttagcattcacaatatctgttatatcttcgatacgttcgatgaaggtgaactttagtcccggagtaggaagttcctgatctctggatgtagcccaaaagccatctgtcagataatcgtgttctacactactgtgttgctggatagaagaataaccgcagtgatggttagtcaggatcaagccttccggtgaaatgatttctcctgtacatcctcctccgaatataccgactgcatctttcaaagagacaccattgggattatataaatcctgggcttccagttttaatccttgtttcttcatcatatctatggaatgttgctgttgcattagttgcaataaccacataccttcgtccgcttttacggtacataccagcagcgctgtcagcgctaataaataaagtcttagtctgttcattactttatgataacaattataaattatgatgttaatattctatttttaaacttccgtcttttagtgctttcatgatgttggcaggagcctgttgattcattaattcttttttcatgaaatccatatagggagctacatgctgaaagtattggtaatatcctttgcacagatagttcagaccgggttcgccgtccgctgtccgactgaagcggttctttggacattctccgttgcaggcaaatagaaagtcgcactccttgcattgggttgggagtgattggtatttcattgttccgaagttatgctgtcgttcactatgcatcatttccaccaaagtttggctatagatatttcccaatttatattccgggaatacgaagtggtcacaagagtatacgtctccgttgaattccataacgccggcatgtccgcaatgcttcgccattgtacatacgcccggttgctcgcccatccagttagccaatgtggaatcgaatatctgtatgaagaatttgcccacatcttcttttacccattcatcaaaaattgtacagagaaagttaccccattgttccggacttacggaaaaatcagccaatgccccttctttaccttctgccagagaggcaagatgacgaccgtcctgatgtgaaacaatgcgttcaacaatcggagcgaactgaatataatggcaatctatttctttgaagaaattataaaagtctaatggatattcggcattgaaatcgttcacaacagccatagcgttccattctactccatgttttttcaggagattgatcccttgcatcactttgacgaaagaaggtttgcccatcttatttttgcgatattcgtcatgaaactcttgcgggccatcaatggaaacccctaccagccagttgttttcacggaagaactcgcaccattcgtctgtaagcaaggttccattcgtctggatacaattgtcaatcgtacgtccgcgggcgtatttcttttgcagctccatcgcctttttataaaaagaaagcggacgcatcagcgtttctccaccgtgccaggtaaaaagcacttgaggcatggtttgagagttgatatactcgtcgataaacttttccagtagctcatcgctcattacatgtttcgggttttctttgtatagattcgccttttccaaataatagcagtattcgcatgcgaggttgcatacggctcccacgggctttaccatgacataaagcggtttggcaaaaggtgcataagttgttgctttcatgactgcaaatttagataaactaaatgaaaaaaatgatctcccacctctgtttataaggattattaaagaaaagagtcttacaagttttaaatattgataaaatgtttcttttaagtccgaatcagttgtacctttgtacccagaatttaatgaaacaatgaacgtgaataagattttgccttttgtgcttttgcttccctttctagcttcgtgtactcataagtataagatagaaggaacatcttcagtaaatggtctggatggaaaaatgttatatctgaagactttgagggatggagaatggacaaaactggactcggctgaagtagtgcatggatcattttcaatgaaagggaaaatcgattctgtacaaatgacaacactttatatggatgacgaaagtgtcatgccggttgtgttggaaagtggcaagatcgttattaccattagcaataccgaccttaaagcggttggaactcctttgaacacagcattgtatgactttattgcaaagaagaatgcaatggaagaaagcatcggtgaactggaaagaaaagaaacccgtatggtgatggatggcgctgatctggaagaagttcatgaacagttacttgcagaaggagattcactgatgaaagcgatgaatcaatatgtcaagactttcatctcggataattatgaaaatgtattaggacctaatgtatttataatgctttgcagctctttgccatatcctattatgactccacaaatagatgatataataaaggatgctccctattcttttaagagtaataagatggtgcgagagttcttgacgaaggccaaagagaacatgcaattgatagaagagcatcaacggatgcaacaaaatgtaggttcgaagaaataaatcttgagttttttgcgtatttttgcataaaactcaagataagatgaaaacgtccttttctattcgtattgcttttttctttattctttcttttttggcagtttcctgtcatagagatacggacgctctcaacatgactttttcaaaagtggaaaagtgtatggatctatgtccggatagtgctctaaacctattaaaaggtattcatgatcctgaaaaattgtggggtgagtcacaagcgacttatgctcttctgatgacgcaggcaatggataagaactatatgaagtttagttcggattcgttgattgcattagctctgaattactatacaataactcagacctccccaataatgtatgcaaaggctctattttatcatggaagagttatgcttgaattggataaggaggaagaagccttgaaatcttttcttgcggcaaaagatgtttatgagagaactaaggatcataaaatgttggcattgatagcagaagaggttggtatgataaatcgaaaacaggacttgtacgatgatgctttgacgaattttagggaagcacttactacatataagcagttaaaggattctctttcggttattagtgctagtttgaatattgctagagtttatttgtttaagtctgaatgggatagctgttccttatattataataacgcattagaaatagcagtacagaagaattatttatctgaaattacaatattgcatgaattaggtatattgtatcgctctatgcaaaatttatcagaagcagaacgttatttcttagctgcttatgaaaaagaaacagatgaagaaaagaaatatatggaatgtttgtctttaggatatttatatatgcaaatggggcagacagaaaatgctagaaaatatttaataatgagtgcgaactcttctaaagcatatacgcagattagtgcatacgattgtttatatttcttggaaaaagacattgataattttgaagaggcaatagtttatcatgaattagcagattccataactaatgctatggaggagcttaactcacgagagttaatagcaagtttacagaaaaaatatgagaatgaaaaactacggaatgataatttgcaaatgaaagtacgatatacgaactttattctgtggggtacgattgcttttttatttgttgttgcatgtatgtgttattattattataaaaatcggaataacaaaaagaaaatagccgagattgaattacagattcaagagaatgaagaagaaatagaacgataccagcaggaaatagaggatattcaaatatcaaaagatcaggtgttaaaggaaaatctgatgttagaagaaaatcgtactaaagtaggagaactcaatggaaagattgttcttttaaccatgcagaataaaactttgtcggaacatctgaaagaactggggggtgaattaaatgttggcatatcttcaggctcatttatacatgcatttcggcttctattggcaataaaagaggggaccttaagaggaaaactttctaatgaagagcgtcagaagttatttagtctgtttgatttgatttattggaattatgttagtcgtttattggaaagagctccaactcttactaaacatgatcttgagatttgctgttttcttaaatttggtttgagtcacgaagagctaagttgtatctttcatactacttctgattctgtaacgagggcaaaaggcaggcttaaaggtcgattaggcatttctccgcaagatgatttggacctttttttgaaggaattctgagaaataaaaaatggattgtccgggtaaatgttaaattgataattaataatatgttgattaataggttgttacttttcattaacctcttgtaatttgtccgggttgatttttttgttttttcgaatacataccgtacttttggcgaaacaaaaaagcaatataattatgaaagtacgttttattttatcttttctagctgcattatttattgcagggaatatgatcgctattgagagtacagaacgggtagagagaaaactgcctcttgtgttaaaaggagaagttccgactacgacaagtcgttctattcctgtaatacctattagtgcgtctgtttctacagatgataatattgtagaaatcattttcacagttcctttgggcgaagtgaaaatactagtggatggacaagtacaggaagtctgtcaggtaacggctcctggacaaacaacttctttctctatagaaggatgggctccgggcgtttataaactagaatttaaagtcgccggaggcggatacgtatacggagaactagtaatagagtaaataaggaactagaccttaacttttatataatgaatagtcatcatacagttgctattggcacttgggaaggtgacaaacagcaatctattgaatataattcttctattgcagtcgggattgattgtccccgtgcaaaattgagagtaagtattctattagatacaatacaagagtatcaggtgagatatatcttttctgacgaggagataagtgaagctgtaaatgaggctgggcttatcattggcgcaaggggtatagcctatgaaggggtattacaacgaaaaccggttattgtagtgggggaatatggttttggaggtttagttactccagatacattgcatgaacaatacaataattattttagaggcaaaatcaatggaataaaagcagagtacttctctttagagcgattagaagaagaaataagaagaggatttgctttgacattccaggaattgcaaatgatgtctaaccagacaataagatttctacataatatatagactttttgatttaatagattaatgcataaagactggttaggtatgcgggggtgcgtgagtatccccgcatttcgtttcttaccgatcctggtcttcgtttgtgatcattcctttatgcttttcaggaagtgcactctcaacagcagcataagcctctgccatagtagcttttatgttttccataccttttcctttaggaggaatagggtcatgaatggtcagaatcatgcgatggcgatgtatccatttgcctgtacgtggcaggatttcaaaagaaccgtcgattgtaacgggaacaactgccagctgcaagtcatctgccaattgaaacgccccttttttgaaatatcccatgtgtccggtgaaagtacgtgctccttcgggaaaaacgactaaggataccccgtctttcagcgaatcttttgcttgccgaatggtctccagtacttttttgggaccggaccggtctacaaaaatgtgtcctgcactttcacatgcttttcctacaaatggtatcttacgcaggctttttttcatcatccacttgaaatttcttccgatgaatccataaataagaaaaatatcgaaggatccctgatgattcggcacaaagatataagaggtcttcccgtgtaatttttcacgaccgtgaatctttacaggaatcaacagaaaaagacagatgagttgtgaccatattttgcccggatagtatccccagaaatgagctcctcctagtaaagagcctacaatggtgacaatcgctgtaagaatagtcaataccaataggataggtaaagcaatacaaatttgataaatataatatagtatct

SEQ ID NO: 200 - DNA, 12628 bp, Bacteroides thetaiotaomicron
tttgtagacagtaataaagaaaggagaagattttatgaagatattaattgtagaagatgaaccctctttaagagaattgatccaacgttcgctggaaaaagaacgttatgtcgtagaaacggccggagacttcaacagtgcattatacaaaatagaagattacgactatgattgtgtcttactggatattatgctgccggacgggagcggtcttgaccttctcgaacgtttgaaagctctccacaaacgggaaaatgtgattattatctctgccaaagattcgctggaagacaaagtactgggactggaattaggagctgacgattatttgccgaaaccatttcatctggcagaattaaatgcacggatcaaaagtgtgatccgtcggaatcaacatgatggagaaatctatatccgtcagggaaatgtaaagatagaacccgataaataccgggtgtttgtcaacgaacaggagctggaactgaacagaaaagaatatgatatcctgctttatttcataaatcgtcccggccgtctggtcaataaaaacacactggcagaatcggtatggggagaccacatcgatcaagtggataactttgacttcatttatgcacaaatcaaaaatcttcgcaaaaaattgaaggatgcaaaagcaaatattgaaatcaaggccgtttatggattcggctataaactgattgtagaataatcgaaaccagaaaggatcatccatgaaacttatatattatatcatttttcgcatcaccctcgccctgactcttatcctgactgtctgggcagtctttttctatgttacgatgattgacgaagtcaacgatgaagtggatgattcactggaagactattcggaaacaatcattatccgcgcattggcaggagaggagcttccctccaaaaataatggttccaataatcaatattatctgaaagaaataaccaaagaatatgcaaagagccgggaagatatccaatataaagactccatggtatacattgtagaaaaagaggaaacagaaccggcacgtattctgaccactatctttaaagatgacgaagaccgttattacgaattgaccgtatccactcccagcatcgaaaaagatgatttgaaaagtgcgattcaagtctggattattttcctgtatgtagctctgttactttgtatcatcatcatatccgtatgggtattttatcgtaatatgcgaccgctgtatatactacttcattggttggacagctatcagaccggaaagaaaaacaaacctctgaaaaacgatacacggatcacggaattccgcaaactgaatgatgcggccacccgttacgtagagcggacagaacaaatgttcgaacagcagaagcagttcattggaaacgcctcacatgaaattcagacaccgcttgccatctgccgcaatcggttggaaatgctgatggaagacgattctttgtccgagaaacagcttgaagagttgatgaaaacccatcagacactgaaatatatcaccaaactaaacaaatccctgttgctgctatcaaaaatagataacggccagttcaccgacaccaaagaggtagacttaaacgtactcctcaggcaatacctggaagactataaagaagtctacagctacaagaacatagaagtaagtataacagaacaggctaatttccatataaccatgaacgaatctctggctattgctttactaacaaacctgttaaagaacgcgtttgtacataacgtagacgaaggacatatccggattatcataaccaaacatagcatcaccttccgaaattccggagagaagcaaccactggatgagactcacatctttgaacgtttctatcaaggacacaaaaaagaaggatctactggattaggactggcaataaccgattccatctgccgtctgcaacagttgaacttgcgatattacttcgaacaaggagaacattgtttcgaaatctccaacaagaactagaagtaaaacaattaataaaacatctgccatccagagcaagacaatgtgctggatggcagaattaatagggtactacctaagattacaccttatgacaatacctgatttggactccgcatatatgattatcgggatcggatttcccttctcataaacataatatatgagattgcaaaacagataacagtcgctgcaatcagccccgtgagctgtggccaaacaacaagcagactctgtcccaacggcagcggactcggaatagccccttgtacctgttccatcgtaagcggtccgatacttctgacggaaggcatcagcagcgttgtagtagcttcattaaacaattcactgggtgccagacgcattaatccaagaataaatttctgataactgataatctgataaggagacgccatctgcgacggacttaatccctttgccactaaattgacaatcatcgtatagaatacgctgaaaaacagccaaacggctacggaagccagcgcagaagtagcagcctgacggaaacggagtgagaataagatggccaggttcaaccaaaaggctacataaaagatactcgttataagaaagaaaacgattctccagaattcttcagccgtaggaggaatgccaatggcaatcaatccgaatcccatcaccaaaaagcccagtacaaacagcataatacctatcacgatcaaagcagccacaaacttcgcattaatgatacaatcacgatgaatgggctgagacagcatacggctcaatgtccccttattctgctccgaattgacagcatcgaatcctaaagcaattcccaacaaaggacctaaaaagttaataaacagcacaaaagaggggagagtcccgtccgaagctgtaaataacttcaagaagaggaacgaactgtccggatcatccggtttgatagccgcaccgatattagtaagcgccgtgtatagcgatcccatacaagtaagtgctatgataccgatcagaataagaaaacgccagcttttgacatgatcggatatttccttatgtacgataacccaaaaaggatgattgactttactcatgcccttcgcctccttcctcaaaataatggttataaatatcagacaattcctgtttcttttctttcagctctgccatatcaatcagagcaagtattttgccgttactgaacaatcctactctgtcacatactttctgtgcctggtccagatggtgggaagaaaacaaaaccgtcagcccttcctctttgctcagccagcgaatcagttcaataaactcctgaacacccgcagggtcaattcccgaagtcggctcatctagaataatgatttcgggattcttaataagcacatcggccagaccaagacgttgtctcataccgcgggaatactttccggttttctttttcagctgatcttcaagccctacgcgcttcatcagctccagtgcttttactttcgcctccttgtcagggataccgttcagccgtgccgtatacatcagattttccagacctgtcatgtcatcatagaatcccacatcttcgggcagatagccgattttccttttcacttcaataggatgagtggtagaattaattccacaaatctcgacaattcccgatgtgggctccgttaatcccatcatcatcaaaatagtagttgactttccggcaccgttcggacccagcaaaccgaagatttctcctttccggatactcaggcgaatatgatctacagcagtaaatttaccgtattgtttggttaattcggtaagtacgatcacttgttcgcccataatttacctccttccatatttacggaacagatagtagacaacaccgatagtagccagaataatcagaacacctacccatccccaaatcatcggagtctttacggcaattctgaattgcgcatctgcattcacttccggagttttggccatcatcgtagttacataatcacccggaagcgctttcttagatgctttcaagatggctacaacagtagccgtttctccggctttcagcatttctatctttgacggttcgaaagctacatcccagtcaaccggcttgttggcagacagttggatatctttcaataaagaagaacctgtatttttaatttccagttcgattcgtttggtatcaccggcagtcacgtcagaacttaataatcctctcggggtggtcagttccatctgataagaaccggtgacaactacttccagttccagttcagccgaagtattgcctgtagcggcacgtacgggaattttataactgccagcttccacattggcaggaggagtgatgtctatacttacattctggctgctgttggcttctacttgtgcggaagttgcctgcttataattaggtttgaaaataacattccagcctctgggtgctttagccatcaacgcatacagttgctgatcggcagtctgattctttagtgtggcattaaaggtgaaagttgatttggaatttccctgcatattgggctggtcggtggtaaactccgtctgataagtaccttgttgtgccacaacgacattcagagggagttgcgcttctccggcagacactacaaaatgatagctgcctctgcttacttttaaaggaacatctacctttagattaaaagttttcttttctttagggagtacggccaactgactgagattccaaccaccggatttcatttcatgtttccagctgcttgataggccactgacggaaagattggcattcaccaacttgtctgtgttgttaatcaggtcgatgctgtagtcaatagacgcccccggtgaaacggagatttttgtgtaaggtgtgtacaagatcacgcttttaggtatagaatcgttagcgtgtgtgttactcatgggaagtattcccagcaaaacagttaataataaaaaacaatttgttctcatagtcatacgaaagttcttatggttgatttaatatgaatattgtcaaatttgtgcctgcaaaaataagcgatgaatttattagttgctgttaaaagaaacaaaagaatacaataagaaagatttcctttgtttttttcagattttgcccaaaattcccaaatcttttcagattctcctctcatctttgcattataaattaaatgataacagtaaaaccaattaaaaaaacaatgattatgaaaaagttagtattcttattagtatgcttgttcactttacagacagtagcacgtgcagatgacgataaacctatccaggtgactcaaatgccacaattagcacaacagttcatcaaacagcatttctctgacagcaaagtggcactggcaaaaatggaaagtgacttcctttacaaaagctatgaagtgattttcacgaatggtaataaagtggaatttgacaagaagggaaactgggaggaagtagattgcaagcacacctccgtacctgttgccattattcctgccgccattcagaaatatgtaacaactaattatccggatgcaaaagtgctgaagatagaacgtgataagaaagattacgaagtaaagctatccaaccgtacagaactgaaatttgacctgaagtttaatctgattgatattgataattaactttcttaaaatctacgacaacaatgaaactcagaatttatacactactgatagcattctgtgcagcatggagcctgcacagctgcgacaacgatgacgatgaatcaattgctgttcctaccccattgcaagaagcattctcgaccaggtatcctaacgtcaagaacgtaaagtgggaaacaaaggcaggatattatgtagcggacttctatgatggatatgaggcatccgcatggttcacaacggatggcaactggcatatgactgaaacggatatcccgtacaccgcattgcccgatccggtaaagagtgcattcgaagcaagtgactataagacatggaaaagagacgatgtggataaactcgagcggcaaggcatcgaaacagtctacgtcattgaggtggaaaaccaaaatcaggaagtcgatctgtattattctgccgacggagtgctgattaaaagcattgcagacacagacgatcatgaaaacgagcaccttccgaccactcaactgcccgccgtcatgaagactttcattgatgggaaatatgcaggagcaagaatcgtggaagtagacgtggaagatgataaaaacgactgggatttcggatttacggaagtagatatcatccatttcgacagtggcctgaaccgcaacgtttccaaagaagtcctgtttgataaaggcagagagtggtattctacctcatgggaggtacggagaaacgaactgcccacagcagtgaccaatgccatcagcaccgagtatgcaggatatcagatggatgatgccgaatactttgagatggcaacagaaacatcctattatcagattgaactggaaggaaataattctccggatatagatattaaagtaaccgcagacggtacgattctcaaataaaataaaatagtgacactatcggttatggtatagtgtcactatttatttttattcctgtgctcgctttctctttagctccgacttagctttatcatcggcaatgctgtctgtttgctgctgttgcaccttttcggcttcttcacgtttccgcttgctgcgcagtttccatttattccagaagaaaaggtcactccatttattgaaatccttcttatacatgataccgactccctgcgtagtaaggtttgtctttgtgtagtaacggtcatttgtttcattataagccttcagacgaatatctcccgagcggttgatcagccattcagcttcgaagtcgcctataaagttggtattcgccatcggattgtcccgatagccgaaattaccattaaccaacaggcggttgttcagcaactgaccggacaggataccttctacttccatatccgtccatcctttatcacccgtgctcagattggtaccgatattccagttattagtctcaaaaacctgagataaggcattattcaactgaccggacagagtagaagagagtaccgatgacatcacgttcgagttctgattgttccgtgcagcatcttccgtatagaacttaccgatacccagcagataaagaatctgcatattcatctgctcttccgtactgatataattgcgcaccaacgtctgaatttcatctctttcattcggaagctcgatacccagcttaatggtcggccgcagtaaaatcccactcagattcatgatacagtttacccgtacattagtctgctgggcaatggaggaaacatccggattcaagtcgttcagtgaagcggagtttaccgtgtatgatgcctgaatatccatattcgcatccaaaggagcgccgttgaaagtaatcgtacttccatctttgatgataaaatccttgcgaatcacttcctgcaaactgaacttatatattccctgactgatccggtaattaccaaacatcttcacatcccctttattataaaactccgtgcgtatgtttcctgttcccttcgcactgatgtagtctccggctatagggtccataataattttcatggtggcatcgggtgtagcatctactagaatattcaaacgaatatctgtctgatgctcttcttcgtccgcctgacgcttctgttgcatctgctcaaaataggaatttacccgaatggaatcctgaatgtttcgacggggcgttttatctacaaactttataaactgggtgctggcagccgacgccacatttccgttgatataggtgaataccgtattccggttggtcgtcatggcgagatttacgtccagtccctgtatcgcattccctgcaagcaacgcatttcccgtagcatataccgttccaaagaatggcatatccgtcgattccttcgtattcatcaagagcatattattagcctgtatctcaaaacggtaatttatattcttgaaatgctggaaacgcagatacccgttcaaggttcccgaatgcccttccatatcggcaatatgcatattattgaatttcaatccggtaggagccaaatgaatcgtatctctaacggcaaagtgggtattcagaatatcaaacttcatggaagcatccgtcataacagccccatctagattcaatcccttgaactttccgtaaaaatgtacttttcccgttccccgtccttttatatcctgtgctattgatttcatataaaattcgaggaacttcaagttcagttcatgggcatcgatattcagatcgagtccgctttccggtttcaacgggtagatcataccgatgactcgcgatggtgacggtgatatatcctgaatggaagcatccagatagattcctcttttctcattatcccaggcgccatatacgttcaaatcacctaaacggccctgattgagcgagaagttcttgacgaagaggcgggtattcatcacaggtttcttgaacacgctgctggcatatgctgttcccgtagcatctccttcaaagtttacgtcatcggatatgtttgcaatatcaaatacgtatcccatattaatgtctttcaggtccacttttacggtatctgccggattgtcggaaagccgcccattgatacgcacataacggtcatgatggctgaaatagaaattattcacatccaccttgcccgagtccaccactacctgcgaaggatgtatctgccaaagtgtatcattcaagataacgtctgtctgtttcacatccaccatcgctttcagcaaaggcttttcacctgctgtacgcaggaattgtgcaacagccgccaactttccgctataagttgctatggcattatttccccagttcagagtcgtgctgactttatcttctttggcctgtgcttccagagaaagattcacggctccattctttttcagactggtcagccgcaccttcgcactgatatggtccgaaggattctcgcacaagatcatacccgactcgataaagttgtttttatattgcaggcgggggaagtagccttccacacgtagccgctgcaaggcatcattaaaataccctttcaacgtagaatgtgtatatacagtcaacggaacatcaaatatcgtagataaaatgtccgtattatatatatgtacatcaaacgcaaaattattgttcgtctctatcggtttcttcggaggcaatatcaaagacggcacataccgacgcatgatattgaaaatacttgccggtaaagtatggtactggaattttcccgctatgtttgccgtcagaaattcagaagtcagtttaagctgattttcattatcctgccgggtagcccgtacattcatgttcttcatgaaatattccttgtccggtgccctgaactccagactgtccacattgatttctccaatcatctcgtcaatggaacctccggtaaaattagcttttaccttcagagagaactccgcatcctggtaatcaggtgtaagatttaaatcattaggacggaacttgtcgacaacggcaaggaaattgaaagtaggaaccttggatgtcacattcacatctccgttcagataaatagacccattcggatcatccagcgctatctttccgttaaatccgccttgcttgtattcgccgtccagcgtaatattctcatatttatatctgctatattccacagatgcgatcaatcccttcaactctacagcaggaagctgtttttcgatatgccgtccatgtacatcaagattaaaggtgatttccccaaatttctcattattcaataacttgcccagttcaaactcttctgttttgacagcaccggaataagcaaacagccccttagccttatcggaacttaactttaagtcggtttttacattaccaagcccggtacgaagctgtccgtaagtaactagatcggtgaagtatccggaaatctctccacggaaatcaatatcccccaaacgttccagaaggggaggtacaccattgtaattgctgctcagattacgcaccaaaaaaccgacaccacgattgttggcggaaagttcggaaagcttcccgtacacatacgcatcctgcggactcgatagttcctgaagcgatacatcccccgatagccggaactggcggtcgtcggccgtaatctccagatgagagcaggtaagctggtcgaccgttccttttacctgcatatccagcgttatcggttccttgaaatgcgccaatataggtacaaaaggggaaatatctttcagagtaatctgcgagggtaacgtacggaaagaaaagtggaccttctccgagaactgatcaaaagccttcagactgtcatacaccaaatgaatagtatccatcttcagtgaagtttcgggcagctcaatggcaaaattctctatattagtccgtttatcattggcaaccaatttcagactcatcttctttaaagagaatccggaagccttttcatcgaagctcagacgcttgataccaagattcaaagaatccctgctcatcgccttcaatgaaatattggctataatattctgaagctggacatgcttggcattaaactttccgggagtcttttcctctgacaatacatgataagccatccttccccgacgaatcaaaacggaattgatacgcaaatccagcgaactttccttttttacagtgtccttggaagcaaaagcatccaatacgaacttaaaattcggaggagagtcgggagtctctttattcagattgatggtaaagccgaataactggacactgctaatggaaatctttcccttaaagaaaggaaggatatcaaacttagccgataagcgggttactttgagcatttccttgccgctctggtcgtcaagcagcacatcatcaatgataatacggtttaatagaccgatatttattttgccgatagtcaggcgtgtattcagcacctcggacaattccttggcgataaacacactcattgctcgctgaacatttggaatattcagcaaaacaatagttccgatatatactcccagtacaataccaactacccagcgtacagtctttttcagcgttctgataagcgataacttttatttagcgaacaaaaatataaaatagttcgttatgaatcgtagttttatcattacttttgcaccgtttaatagtttaaaaacatatgagtgcaataatattaggaattgaatcctcctgtgatgatacgtcggcagccgtaatcaaggatggttatctgctgtcaaatgtggtatcaagtcaagccgtacatgaagcatacggcggagtagtacccgaattagcttcacgggcacatcaacaaaatatcgttcctgtggtacacgaagcactgaaacgggcaggggttaccaaagaagaactgagcgcggtagctttcacacgtggaccgggattgatgggatctttacttgtaggcgtctctttcgccaaaggattcgcacgttcactcggtattcctttgatagatgttaatcatctgacagggcatgtcttagctcattttattaaagcagaaggagaagaaaatatccaaccgaaattcccgttcctttgcctgttggtatccggaggaaactcacagattatattggtaaaagcctataatgatatggaaattctcggtcagacgattgatgacgctgccggagaagcaatcgataaatgttctaaagtgatgggtctcggatatccgggcggaccgatcattgacaaactggcacgtcaaggcaatccgaaagcgtatactttcagcaaaccgcatattccggggctggactacagtttcagcggactgaaaacttctttcctatactccttgcgtgactggatgaaagacgatcccgatttcatcgagcatcataaagtggatttggccgcctctctggaagcaactgttgtagacattctgatggacaaactgcggaaagctgccaaagaatataaaataaaagaagtagccgtagccggaggagtctctgccaataacggattgcgtaactctttccgagaacacgctgaaaagtatggctggaatatttttattcctaaattcagctatacgaccgacaatgcagccatgattgccattaccggatacttcaagtatctggataaagacttctgctccattgatcttccggcttattcccgtgtcacattataaaacagttttttaacgtcatcgtcactttatataataaactattgtcatagaataatttaagtagtgacgattaaagtgacggcaataacaatagtgacggcaaacaccgaaaaaatgtcaccgacccaataggcggtggcataaagaagccttgctgaaaacaaaatgcacctatatataatagggagacaaaggaggattaatgatataagaagccttctgtcttaccctggatttggttgactactataagtatcaactaaaatgaataaaagatgaaaaagagtgacatgacctttagtccttatcagcttgaacttcttggcgatttctatcgttcgaatttc

SEQ ID NO: 201 - DNA, 12620 bp, Bacteroides thetaiotaomicron
ggatgtagatatatcgaacaatatatagtgtaaatatagaaaataatgctatttttgtatcgttatacagaataaagcaactgctttattcttaaaaatcacctgttagaagaatatttttcttatggatacttttgagaaattagataaagtggatttgcagatactccgtactttgcaagagaatgcgcggttgacgaccaaagagttggctgcgcgggtcagtctttcatcgactcctgttttcgagcgccttaaacgtttggagagtgggggatatataaagaagtatatcgctgtgctggatgccgaaaagctgaatcagggttttgtggtcttttgcagtgtcaagctaaggcggctgaacagggacattgcggctgagtttacccgaatcatacaggacattcccgaagtgaccgaatgttataatatatcgggcagttacgattacttgctgaagatccatgctcctaatatgaaatattatcaggagtttattctgaatgtattgggaaccatcgatagcctgggttcgctggaaagtacgtttgtgatggcggaagtgaagcaccgatatggaatacatatttagtgggaagattgatgtatttcctatttttgctactccttgttttcgactcaggtttccggtggattgccgataatgtctctgtataagctgccgtcatggtccttgtattttgcgtattggtagaggcggaccagtatatcactgtaatcaagaatggctgtatttgatttctgtgataaattggtgcccaggatgccactgcctatgataccgggattatataatacggtgtcttgtctgatagagctcattatcagttctgcacaaatatagtctttaatccttgcctcttctagtcgggtcgtgatatatgagttcagatggcttttgtcatgttgagtcataaagccgtaccatagtaaacacttcattcctaactgggtagcctctattaatatatccagataggttaatcccgatgctcctttcttatctatctcataaggatcgatatgaatgaaagaatctttggggagtgatggcagtaacttcatgactccttcgagagaatcggtattatataggcggacggatgtctgtagttccgcttgcttcgcatagcgttccacattgtccaaagcactcttttctatatcgaagaatagaaatttttgtgcctgtcttcctaatacctccattgctaaagccggagaacctaaatagtaccctctctgcatttctgcattttctatcttatagtaaatggagtcttttagaacttgattgtcttcctctaccgctttttctaagaaatagtaaatgccatattgctgttccgaagtctgctgcatcgggtagatggcacaggcagaatttgtttctacatagacttgtggatgctcgttccgaagaacttcgcaaagtatcagatgtttcagtacatccggctgtttgccgaaatgagtataagttgccatgatgctaaaggtttatagtgacgatataaatggtatacagcaaatatacgggataatttttagatccttgcatctgatttccaaaattatcctgtacatttgttatgtgatatgaaccttattttttgaacgcaatgaaatggcaacgttgtaaatagcttcgctctatatggatgatggacaatggtgaaatctgttgttcgagtcttatgtggctaaacaggtcacccgatattttattattttatttcagaaactatataaagaagcaattacaatgaatacaaatatttatccgcgcaccaatgaccttcagaccgtctatctgaatgcagttatcaataatcctcatataaaggttggtgactacaccatatacaatgattttgtgaatgatcctgttcagtttgagaagaacaatgttttatatcattatcctgtcaatggagaccggctgatcatagggaaattctgttcgatagcctgtggagctaagtttcttttcaacagcgcgaatcatacgttgaattctttgtcgaattatccgtttcctatattttttgaggagtggcagttggataagggaaatatcacttcggcatgggataataaaggggatatagtgattggaaacgatgtatggattggttatgaggctgttgtcatggcgggtgtacatatcggcgacggagcgattattgcgtcgagggcagtagtcaccaaagatgtacctccttatacgatagtaggcggaacgccggcccaagaaatacgaaagcgttttgacgaaagtacaattgcacaattgcaggaattgcagtggtgggactggcctgttgagaagatatccaaagttttgctatctatcatgcatggaagagtcgatattctaatgaaattttaatccactattactgtgagttgcatgacacccgggtgttggtatgtctgacacccgggtctcatacatgctgacacccgggtctcagattactctctgtcgcatttgaaaaaaaattagcgaaagtctttcaactcttcctgcaattttttgcggatgaagaagatacggctctttacagtacctagtggcaagtgtagcttatctgcaatttcacggtacttgaatcctgcaaggtgcatagcgaacggaattttgtattctttggcaagagcattgactacacggtgcatttctttgaggtcataggcattttctgtactttcaaaacctgcatcttgtggtaaattcagatggtagaggttgtctgtatgatcgacaaaagtctgattgcgaatcactttgcggtagttattgataaaaacattgcgcataatggtgtacatccatcctctaaaattcgtatcagatatatacttgtcttcattgtacaatgcttttaaagacgtttcctgcaataagtcgtttgcttcatcaatatccattgtaagtttgtaagcgaaacggagtaactcatcctgtgcttctactaattcttttctaaaggtgaaattcttcatgttgattgtttttaagtttgataaatttgtttgttttgacagtgcaagtatatgtgatttctatgagcccgatagtggggaaattgacataaaaccaccgttaaattgttagataggaggcttctgacaatttaacggtggtttttgatagttttggggtggtgctcagacagctaatataccggagaaaacaaccggaaacacgcttcgcgaaatttaaccgaacggttgcgttggagccagtcgcgtagatttagttctttactattattcatatcggtgtgataaatgtctctgacggtctgagcaactttcttgtcgtaaatgaacagattggtctcgaaaagaagttcaaggcttcttatatccatattggctgaaccgactaccaccagttcatcatcgacaatcatcaactttgaatgtgtaaatccattgacatattgatagactctgactttatttcttaatagtttctccacatatgagttagaggcatattgcacaaaatcattgtctgatcttttaggcatgacaaggcgaacgtctattccgctcattgatgcggtctgtattgcctgaagcagacattccgtcggtatgaagtagggagtctcgatatatacattctttttcgcccgcgttatagctgtaaacatggcttccattacattggaatgcattcccaacggttccgcgttgactacttgaattggtacttctccgaagacttcgacattgggataatactccggtgaagacagatattgtccggaagcataataccagtctgccagaaacacagattgcagccccgaagctccggaaccttcaaccttgaagtgtatgtcattccattttccccagggaagtccgtctatgtatacgtcttttacattgatgccaccggtataggcgattctgccgtcgatgatgactatctttttatgattgcggtaattgacacttcgcaggaagcggggaaaactaagcgggaggaacgttttcacttccacgcctgcttctatcatttgcttgaaatattttctgttcgttttattgcatcccagtccgtcgtaaagcagtcgtactttgatgccttgttttaccttattgataatcttctcttttaattcgttgccgatatggtcgtcgccaatagcataatagaagatatgaatatgcgattcggcacagtcgatatcttcgaaaagactgtaaaacttacttttaccacccggatagacagttactttgttacctccgaatactggtgactgttccagattcaatatgagtgattttagttctttataatgatcgggatgtattggctctgtttccacgttggtagaaacggattgttggtgcctgttgaattcttctctccaaaactgaaattttgaacgctttttgcttacattacgtcctacaatataataggcagatatacccagtaatggtaagaatataacaactagaatccagcagatcgtcttcacaggatttttgtcgtcgtaatcaattataatagtgtaaatcagccctaataggaatgcgatatacgctaacaatgtacaataccatatccacctcatagcaactttgttttttttgttttgatgtatgctttacttatgaataaaacaatgtgttagtatctgttgtttgttggcgattgaaaaaaagtaaaacatccccttgatatttattagaacagaagttatatctttgtcctcaaacaatatatgtatgaattttataattgaacccggttctttggctgatatagatgaattagagaggctgtatgatgaattgaacgatcacttgtcagctacaatcaattatccgggatggataaaggggatttatccggttcgtgagaatgcggctgccggtgtggatgataatagtctgtttgttgcccgatgtgacgggaggattgcgggttctgtcattttagatcatcagccggaaaaggcttatgagaatatagtatggaaaatagatgcggattatagttatatttttgtggtacgcacttttgttgtacatccatcttttttgcaaatgggagttggacatgcattgatggatttttcactggagttggctttaaaatcagaaatgaaatctatccgactcgatgtatatgagaagaatcttccggctatttcgttgtacgaaaaatgtgggttcgagtatattgacactgtggacttaggactgggacattatgggctggattggttcaagttgtacgagaaggttatttgaaccgtaaataatataaagtggaggaagctctgacaaaattcatagttcatcaatcatgttggagcttccttcttattataaaagtagttcaagcatttatttatttccgaagatttaaataatgctctttttcatttcaaaaacaatatccttgatacatacattttctgatagattcagtaaacatcggattgtatttaataaatcatcaggttgtatcatttcttcatctttaaaaggtgttcctgcttttttcgccatatcagtattcacccagccagggcaaagagtagtgacacgtatgcctaatggtgctaactcacggtatagagattcagccagcccgaggagtgcgaatttggtagaaccataaatacctccatcggcgaaaccatatttagcggcgcgagatgcgacattaaatatatatccgtttttctgtactttcattatctccgtcaccgttttcagtattccatattgagcaatgacatttatttccattatcttcctgaaattatcaacaggttcgctaagagagccgtccataaacatggcagctgcattcaccaagatatcgacagcaccatatttttgatggatgtctttgatttcagtatctgcctttgtacaatctgtaatgtccaatggtagtacaataggttcttgtacatgtttgttcgatcgcatgatttcatcatgtactttctctaagttctgtttgcttcgggctatcaataccacccgataaccatcagttgccaaacctgctgcaatgacagcaccaataccttgacttgctcctgtaataatagctaatcctttttgcttttccataacctgaaattaaaatgagtttataaattatgatgtaagaaatacagagacggtataggggtaaaaaaagaagcctcggagtattccaaggcttcttacttattatatatttttgcacattctgtttgatatattcggcgcagatgtagcagcaggcaaggctgattcttttgaattttgccctttccctataaatatgccggaatatagggaaatcaaaaacgtctatatgatcagattgttccattgattatgatttcatgtgcaaaagtaggtatatcttgttgaatgagaaagtatttcatcccgaaaataatgaaggttatctatttaaatacttattaatacatctccggtcccaatttatccctcgcttgacaattttggccggaatgcctgcaatgattacattcggttcgttaaactcttttgttacgatacttccccagccaacgatactattatcggctattatcacattcttgccaatttttacgcctatctccttttacgattagcagaaacgttgctaagcagcaattcttccgcactttcttcagtgtcgaaatacattgagatacgattgttgtttcctgtgattgtgatgttggcctgattaataatcttattgaatttgtcattcccatatcttttctgtgctgctttgatttactccgttgcccgatatttgttcgttcctgcaccgttatgaactagttccgagtttacgtagatttactttttatgcttaatggatgtaagattaatgctgcaatgttttattcgtctgacagttgttagacgaaagttcaacagttgtcagacgaataaggttatataaaccgagcactagatgattgcatacagcaaattaattttaagagagactgggattagttcgttacgacgcgtttcagtgagttgttatttaccgtttgaaatatttatttctctctgtgattacatatttccgcttgatttctcttttattatatgtaattttgtaactctgaattaagaatgctctatatgaaactaaaagttttgacaacaaatcattgtgtatacaaaataaatatccggtgaatcactatgtgcagaataatcatcttattaatttcattgatactatcagtgcaatgtttttcacaaacggagtttactacttgtctgtttgacatatccagaaacagagtgataccgatagcggtttatcagccgcagaaagtaaattcaaaaacgaaagttatcatattcagccacggctatgatgggaataaaaacagtaagtcgaaccaaacctattcctacctgacacgttttttttcacaaaaaagtttttatgtgattagtatacaacatgaattgtccgatgatcctcttttagcgatggaaggcgatttcatgcagacccgtatgccgaattgggaacgaggaactgacaatatactttttacaattcaggaatttaaaaacttgaaaccacaattgaattggagcgaactcatcttgatagggcattctaatggaggtgatatgacaatgctgtttgccactaaatacccgcagctgatcagtaaggctgtatctatggaccatcgtagaatgatcatgcccagaactttgaagccacgtttgtatacattgagaggatgtgactatgaggcagatgcgggagtgctacctaccggacaggagcaggagcacttcagaatgaaagtagtaaaactggatggagttacacatagcagtatgggtgagaatggaacggcagaacagcatgacctcatcaatcaatatatctataaatttctgacagaaagataactgaagtatcatttctattttatccggtggttttaaaccggaagcctgtttttcttgtatgcttgctttgttattataaataaaaacagacgaatatcttggttggatgtgaatagtgattgttatatctttataacgtactaattcttcttacaaaataaattccattctctattttataaaagtaaaaatattcattcttctgttgggcgctttttatagtcaaaacgtattcaaattagagtgattaataaatttcaatatcaaatttaaaatcaaagaatatgaattatccaaaagcgatacttctttcattggcgttattggctatgcattcgcttaatgcagaggtagtcacataccctgctggggtcggggtgaaaaccttaaacgatttttctgtggaagtgcgtcagggtagcggaccgtggttgcccgttgacgtttatcctgttaaagttgatagggttgatgaaaaaggtcataacgtagaggttgcctccattgcttatttcgattttgacggaatggtagatgtgcgagtaatcagcaacaaagagagagtcaatagtgtgagagtacgtcctttaagctataagataacaccggattgtgttggagacacagtgacattctcactttcgcgtcctcgcaatctctcagtagaggtcaatggagatatttttcacaatcttcatctttttgcgaatccgattgataaatttcgtccttccgataaagaaatccaaagggctctcaagaaaaaaaaagggtccaatttgatttattttggtcccggtgtgcataatcttcctaatgatactctatttgtcccctcaggaactactgtttatatcgatgggggagctcgtgtttatggcaatatattcacggaaggagcacatgatgtgaatattttcgggagaggcgaggtacaccctgatggcaggggagccggtgtttgggtcagacgttctaaaaatgtcaggatcgacggaattgtggtttcgcaactccccataggacaatgcgattcggtagagttgacgaatgtgaaatcaatcagctattatggttggggcgacggaatggatgttttctcaagcagtaacgtgatattagatggggttttctgtcgtaatagtgatgactgtgccgcagtttatgcttctacgcaaggatttaaagggggaagcaataatgtattggtgaaaaatgcgacactttgggctgacgtggctcatccaatcaatatcggaggacatggagatccgaacggcatggatacagtgcagaacgtcacttttaggaatatcgacattcttgatcaggcagaaaaacagattgattatcagggatgtctggctataaatccaggcgacaatacattggtgcgtaatattacgttcgagaatattcggattgaagattttcgtaacggacagcttgtgaatttcagaatcagtttcaatccgaagtattgtgtctctactggcagaggtattcagaatgtgcttgttaaggatgttacttacaatggatcgggtgaaaacttgtcgatcattgcagggtatgatgagaatcacaagatatctggtatcaggtttgtgaatcttgtggtcaatgggcgaaagattacagacgacatgcctgggaagccgaaatggtataaaaccggagatatggccggtatctttgttggagaacatgtagaaaatctctcttttgaatagaaacgaagcagacagaatgttagaaatggcgccacatgccaaaaactgtcatgcggtcagaaggaaagattatacttcaatttttatcacaatatagataaaaattgaagttttttatctatgttgcagccgattttagaaaaagaagtttggaatgaacaataaatacgaagaacggctgggaacagaacgtatgttaccgcttgtttttaagatggcactcccggcagtggctgcacaatttgtcaatctgctttatagcattgtggaccgtatatacatcgggcatattccgggaattggcaccgatgcgctggcgggtgtaggggtgactacctctctcattatactgatttcttctttttcggcaattgtcggcggcggtggtgctccgttggctgccattgcactcggacagggcgaccgtgtacgagccggaaagatattgggaaacgggtttgttctgctgatattgtttactttgctgacttctgtcattgcatatacttttatggaacctattctcctctttacaggagcttcggaaaacaccttggaatatgcggttgactatctttccatttatctcttgggaacgatatttgtcgaaatatccaccgggttgaatagctttatcaatgctcagggacgtcctgccattgccatgttttcagttctgatcggagccttattgaacatcattcttgatcctatttttattttctggtttgacatgggcgtgaaaggtgctgctttggctacagtactttcccaagcatgcagtgcggtgtgggtggtaagtttcctcttttcccgacgtgcctctctgcctttggagaaacgatatatgggactggaccggaagattatcctttccatattagctttaggagtatcccccttcattatggcaagtacggaaagtctggttgggtttgtcctcaatagcagtctgaaggaatttggagatatctacatcagcgcattgacgattctgcaaagttcgatgcagtttgccagtgtaccgctgaccggatttgcgcaaggattcgttccgattataagttataacttcgggcatggtgacaagcagcgtgtgaaagattgcttccgtattgtgctggtaaccatgttttccttcaatttgatattgatgcttttcatgattctcttcccttcgacggttgcctctgctttcaccagtgatgaaagactgatagaaactgtacgttggacaatgcccgttttcttgggtggcatgaccattttcggcttgcaacgtgcctgtcagaatatgttcgttgcattggggcaggcccgaatctctatcttcattgctctgttgcgtaaagctatcctgttgattccgctggcgttaattttgccgaactttatgggagtaaccggagtgtatgcagctgaggctatatctgatgcgactgcggccatctgttgcacgttattgttctttgggcagttccctaaaattctgggaaggattaaagggaatactttgcgtgtggagtaatcgtttctttgtattttattttttttacttcacagatatgcatggcattacggttgtattctgactgttatctctctctttatctcatttcctgtgcgtaaatgttgatttatccggatatctgtacctgttaatatatagaaaagtgtgtctgtttgccaggcgatggtaccggctatcctctgatataggatttctcttttcattcttattctgtatccggcaaagatacaaaaaggatgtttgtatcctggcaggaggtaaaaggtgaatctaaaccggatatttttcaattgtgtgagtaactgtggaagtcgggcttttggtaagaagcagttgtagcctgcgaatgggcgtatcgttctcgtagaaattaatgagatattcgattttgttacgaagcatcgttctgcaaagcctcgtacagcttaccggtatgcactggagagaatgcctaaagatatgagagcggaagctatgaaaaaatagcttccttttccttcctttactctgcttttctgtttggttttcgcttaataagcagaagccgttccatatcattgaatagttttgtgtcttttaattcaaacatgatccatttgccgtcgtggaaagtggtagctgcatcatagatcatctgtacctcgtttgaaaactgtccccgctgaatttcaaatttggcacgttcatcttttcctaagataaccataaatcccagagtcttttccttcgcatataaagcacagagggttttaccgcctttgcggtatttgtattcatacgtccacgctttgccgccacggttccaaagtagctccatttcgtagctcttctcgatgcgctggcagagtgagttccatacatcataaaggtctgttcctatcagattctctatatctttggaagtcggtatttgaaaaggttctttcatggtatttgctgttttatcatatatgccgcaaagataggatgatcttttagtaaatcgttgtccaatataggcatcctgggttataattattagaagaagttccattttcatctacatttcagtcttttttttaatttttattgcactttttcaaatatagcaatgagattctagaactaagatgtaaagacatattccatacttcacctcaattataattttaaaattcaatctatttgttgagaaaaataaaatatgctgaagaacgttattgtgtgttttgtaaaagacagtatatcaaatagttataattttctatttttggtttaaaaccaacgggtcgttcctttaaaaccaacgccccatttctttaaaaccaagagggcatttctcggtgagaaacggaggattggttagaaactagatataaattcaggataaatatttaaat

SEQ ID NO: 202 - DNA, 12498 bp, Bacteroides thetaiotaomicron
ggtataatatagtaacaaatagtacttatctctctgacgtatagccgaggataggatgctccgatataggaaaaggctgcgaactttatgagttttgcagccttttttgtattataaattcaatccagattctacaaattcctattttaaagtttataataaacgagggggacgtttataataaacgatcacagtatttattataaacccggttgccgtttatgcattgaactgtaattattttcgtatgcttggaagtgtgtaattggaataaaataaaatgctggtaattatagtgaacatgtatggcgtctgtgatctgtcagatatgaagtaaaatgaaagaacaacggctttcttttttcaagtttgtgctttattctttttctaagggaggtgaagacggtgatcatttttgatattcagcagtctggattcttacagcggacagacggttattcctctaaatgcaaaagttttaatttccttccatctatttaagagtatttaccttatctttgttgccgaaataaaatatgatcatgaggaacacattttatattctattggcattggttactttatttctgcaaaaggtaagcggagaagagaattctagttattattttactcacataaatggagataacgggctttcgtcgagtaacgtgaaagcgattatccaggatagctacggttttatgtggttcggaacgaagaatggtctcaatcgttttgacggtacttccatcctgcggatgaactgcgaagatcatcagttaaagaaaggcaataataacatttccgctttgtatgaggatgccaaccgcacactttgggtgggtacggacaggggtgtctatttgtatcatccggcttctgatgtattcacccatataaaccaaaagacaaaagagggtaaaacaatggataactgggtgtcggccatcgtaggcgatacacagggtaatatatgggttattatccccgatcagggaatattccgttataaagacaacgaattatatttttatgaaatcagcaataggagacaatttaagcaggaatctcccaattgtatttgtgtccgtgaaaatggggaagtctggattggcttctggggattaggaatctgtcgttataatccgcagaatgattcgtttgaacagatagtggaggatagggacggacgtccgttggtggggaagaatattaattctatctgcgagtatggcgattggctgataatggctgccaatgaaggggaattgataaaatataatacgaaatcccatgtcttggaagatataaaagtagcaggagccgataatacgttctatactacggtagcctatatgaaaggtaaaatctggctgggaaccttcaatggactgtacgtcattgatgaaaagaagaacgaagtcgtttcgttgaaggaagacctgatgcgttcgttcagcctgtcggataagatgatttattcgatgtgtcaggatagtgaaggagggatatggatcgggacattgtttggcggagtgaactacttacccaaccggaatctgcaattcgataagttcgtacccggaagctccggaaattcactgaataccaaacgtatccgtgaactggcggaagatgtgaaaggcaatatctggatcggtacggaagatgcgggaatcagtgtgttgaatgtagagaacggtgtgataaggcaggtaaaggaccataaatccggaaatcatctggtaactttggcagtagtcccttttcaggatcagatatattgcgggttgttcaaagccggacttgacgttattcaggttccgggatacactgtcaggcattatactccgtcggaactaaagatcggagaaggcagcgtatatgttttccatatagacaggaaaggacgtaaatggctgggaacaggctggggactgtatgttgccgaggctggttcatttaattttgtgaatgtcaaggagaccggatacaactggattttcgatctgtgcgaagggaaagacggttctgtctggattgccacgatgggaagtggcgtgtggagatattcgcctcagaccgactcctataaaaagtatgaaagcaaggaaaatgaacccgatgggttgagttcaaactcagtcagctccgttatgcaggacagtaaaggacgtgtctggttttctaccgaccggggcggaatctgctattacaatgaagaaaaggataactttgtcacctattcaataaaggaaggattgcccgacgatgttgcctacaagattctggaagatgaagaaggaaatctatggtttgggacgaaccgcggactcgttcgctttcatcccgacaagaatgatatacgtgtttttacgacaaaagacgggctgttggggaatcagttcaattataaatcggctttgaaggcgcgcaatggcaaattctattttgggggcatagacggactggtcgctttcgacccgagagaagcgaagacggatgattttgtgccgcctatttatatctccaaattcagtatatataataaggaggtgacagtgcatactgccgattcacctttgaaggaatgtatcacgcataccgatcgtatcgtattgaattatgatgagtcgaatattagtttcgacgtggcgttactcagctattctaccgctgaggctaaccaatattactatcggatggctccgatcgacaaggactggattaaagccgctaccaatcagaatatatcgtatgcgaaattgcctccgggacaatatacctttcaagtaaaggcaacgagtaacgataatggagggcaatttgtcgaacgctccttgtctattgaaatactaccgccctggtggttctccccttgggcatacgtattctattttatctggcttgtctgcgtggtggtatcctggttcttctggtataaacaccggaaggaaaaggaaatggaagagcgtcagaaactgttcgagatagagaaagaaaaagagctgtatgagtctaaggtcaatttctttacggagattgcccacgaagtgcgtactccgcttactttgatcaatggtccgctggagacgttgcaggagatggaaattgccgaccctaagattcagaagaatctgtcggtgattacgcaaaacaccaatcgcctgctgacactgacgggtcagctgcttgattttcagaagataggcgctcataaatttgagatgacgatggaatgtgtggatattacgtcgctgcttcgtgaaacagttgcacgctttgaacctactatatccaagaagaacaaagaactggctcttcatattccggaagaatccatagaagcggtcgttgataaggaggctattactaagattctgagtaatcttttgaataacgctttaaaatatgcccgtcattctatttgcgtggaattgcagagagagacggaggcattccttgtgcgggtgaccagtgacggtgataagataccggcggagattagtcagcagatattcgaaccgttctatcaggcagcgaaaaaagactccgcctcattcggtgtcggcataggacttccgttggcacgttcgttggcatctcttcatagaggcaagctatatctggactcagagcatgaagataattctttcgttctttctgttcctctggtcgaaaataccttgcggtctttgcccaagttggaagagataacggtcgagacagataccctgggtgaaggggtgccggtagaggcggaaatgaaaagttacgttttgttgctggtagaagataatgagaccatgctggaatttatgtccgaacgcctgctggaggtttttacggtggaaacggcaaaaaatggacaggaagcactggaagtgttgaggagcagacggattgatctggtcatcagcgatatcatgatgcccgttatgaacgggtgggagttgtgtaaggagataaagtcggatatggacctgagccatattcccgtcatcttcctgacagccaagaatgatatcgacagcaagatcaacggcttgaagataggtgcggaagcctatgtagagaaaccgttctctttcaactacctcaaaacgcagatcgtatccttgctgtataaccgtcagaaagaacgcgaagcattctccaagcgtccgttcttcccgacgaataagatgcagatgaataaggtggatgaagagtttatgaataaagtgattcgtaccatcgaggaaaatatcatagataccaatctgaacgtagagcatcttgccgagattctgggcatgagtcgttccagtctgctgcggaaaataaagatgctttccaatctgtctcctgtggacttcatccgtttaatccgattgaggaaggctgccgaactgattcatgaaggtaaatacctgattggagatatctgctttatggtaggtatcaactcaccgtcctatttcagcaagcttttcctgaaacagtttggcatgacacctaaagatttcgagaaacaaagtcaggcagacaaagaaaagatagacatgccttcgtgaccgtccgggtgcactataacaaatgatgcacaaaaatgaaacatctgcggaaaatatgcttcagatgtagtctggtgctgcaaaaatggtattttttgcagtgatttttattataccgcctatatatatactcctacttttgccatcgttccggataaggaaagataacccctttcggtgaacggattgatttatccttaaatgtgaactctaatactaatttaaaattctgatacatggaaaaaatcaggcttatctatttgactttgattttattttgctgctgccagctgtcggcacagaataagacagttaccggacaggtaacggcagcaggttccgaagaaccgattatcggtgcgagtgtagtggtgaggggtacttccaatggtactatcaccgatgttgatggaaacttttctctttcagtccctgtagggaaagaacttcagatttcttatatcgggtatattactcaatatgtaagggttcctaagaataataaggtggctgtagtgctggaagaagacagtaaggctctcgatgaagtcgtggtggtagctttcggtacacaaaagaaagagagtatgatcagctccatcgagacgatcaagcccgcagagctgaaagtaccgtccagtaacctgacgactgctcttgcaggtcgtatgtccggtgtgattgcctatcagcgtagtggagagccgggaaaagataacgcagacttctttatcagaggtgtcacgaccttcggatacaaaaaagacccgttgattctgattgacggtatcgaaacgactactaccgagctggcacgtctgcaaccggacgatattgccgcattctctattctgaaagatgctactgctacggcattatacggtgcccgtggtgccaatggtgttattcaggtagccacgaaggaaggtaaggaaggagcgactaaagtgtctattcgtgtagagaactcattctcttccaataccaagaatgtggaactggccgatccgatcacctttatgcagcttgccaatgaagcggtcagaaccagaaacccgctggctcctttggcatattcgcgtgagaagatagacaacacgatcaaaggtacgaatccgtatgtctatcctgccaatgactggagaaaacttttagtaaaggatatgaccgccaatcagcgtgttaacatgaatgtcagcggtggtggtaagctggcaagatactatattgcagcttctttttccaaagataacggaaacctgaagagcaattcgatgaatggtttcgataataacattaatcttcgttcttatcagttgcgttcgaacattaatattaacctgacaaagacgacggaagctgtcgtacgtctttccggtacttttgacgactatcgcggacctctggacggaggagatgtgatgtataagaagatagtccgttccaaccctgtattgtttcctgcctattacccgtcggatgcactgcctacggcgaagcacttgctgtatggtaacgctatccgtgagacggaggcgaactataccaatccttatgccgaactgacaaaaggatataaagactactcccgttctacaatggatgcacagtttgagttaaagcaagacttatcctttatcacgaaagggctgaacatccgtggattgtataatacttcccgctactcttatttcgacgttaaccgttcgttcaatccttattattataatgtaagttcgtatgataaaaagacgaatcaatataatatcggtctgctgaacgagaagtccaatccgacagactatctgggatatagcgaaggctggaaagatatacagtctaccacctatatagaagctgctatgcagtataatcgtagtttcgatattcacgaagtcagtggcttgctggtatatcagcagcgcgaaaagatcaatgcgaacagcggttctttgcagaagtctctgccttaccgtaatcagggtttgtccggtcgtttcacttatagttacgacagccgttatatggcagagctgaacttcggttacaacggttccgagcgcttctataaaaacgaacgttggggattcttccccgcagccggcttggcttgggtaatctctaatgagaaattctggcgtccgatgaacaaggtgatccctaaattgaaactgaaagcaacctacggtctggtaggtaatgatgcgattggagacgagaatgaccgtttcttctatctctccgaggtagatccgaatgattcaggtaagggatattggtttggaaccaactttgacgaaggaaaaccgggagtgacggtgaagcgttacgataaccgccttatcacttgggaacgggcgaaaaaagcaaactacggtttggagcttactttgtttgatgccttgaatattcagctggactactttacagagcatcgtacgaacattttgatggacagagcttctatcccggctgatatgggtctggctgccaaagtacgtgccaatgtgggtgaagcgaaagcaaacggagtagacttgtcagtggattataataagttcttccgcaatgggtattggttgcaggcacacggtaactttacctatgcgcacagcgaatttctgaaatatgaagaacccgcctataacgagaaatacagaagccatatcggtcaatcgttgaaccaatggtacggtcttatcgccgaacgtctctttattgatgaatacgatgtgcagaactccccgaaacaaacctttggcgaatatggagccggtgacatcaaatatcgggatgtgaatggtgacggacagattaccgatgccgacatggttccgctgggatatcctacagtacccgaaattgtctacggattcggtttctcattcggtaatcagcgatttgatatctcggctttcttccaaggttcggcacgttcttccttctggatagatgcgaaggcaacttctccgttccagcacatcaatcctacggatgacgatccttatcatcaggatattcctttattgaaagcttatgccaacgaccactggtcggaaagtaaccgtaacctgtatgctatgtggccccgtctgagtacgacagtgattgaaaataacgtgagaaccagctcttggtttatgcgtaacggtgcattcctgcggttgaaaacgctggaagtaggctacacactgccggaaagctggacgaagaaggcctatatatcatccgcacgtgtttattgcagcggaaacaacctgctcctccttagcggatttaaactatgggacatcgaaatgggaggttccggactgggatatcctattcagagagtcatcaatctgggtgtacaaattaacttctaaaatctaggaaagcatgaaaaatagaatgatataccaaatgaagaataaggtcagaaacctgacatacttccttctgttgattggaggaacagcattgacacaatcctgcagctatctggatgtagtgcccgataagataggaacgattgataactcgtttacaaaccgcaacgaggcggaaaagtatctgaatacttgttactcatacattccgggcaatgacagcccatacaataatgtcgctctgatgggtgcggacgaactctggagttattaccctcttactccgtacaacgactttggcccttggaagattgcactgggacgtcagaatgtcaatgaccctttatgtaacatgtggtatgtatattaccgtggcatccgtgattgcaacatctttctggagaacgtatcagacatgagcaaagtaggagatttgactccttccatgcggaagagatggcttgccgaagtgaaatttctgaaagcatattatcatttctgtctgttcagaatgtacggtcctatcgtgattgctgatgacaatctcccgatttcggctactccggaagaagtgagaaagaaacgtgagccggtagataaggtagtgcagtacattgtagatttgctggacgaatgtctggaagatcttccgagagtgatttccaacaaaggtagtgagttgggccgtgtgacgcagatcgcaaacctgactctgaaagccagactgctggtaacagctgccagtccgttgttcaatggtaataaggattatgcaaactatgtggataaggatggagaacatttgtttaactccaccgaagacccgactaaatgggacaccgccattgccgcgtgcgaagccgccattgaagccagtcaggacccggaattaggattagaattatactcctacaaaagcaacctgatcctgtcggatgaaaccaaatgccagcttagcatccgcaacagcgtaacggaaaagtggaatacagaactgatctggggactttcttcacgttcggacgcacacttgcagagtctttgtatgacccgtgtcggagcttaccccaacaatatgtggggaggacaggaaatgctgaaccctacaatggaagctacgaatctgtactacacaaagaacggtgtcccaatggacgaagataaaacatggaattatgccgaccgtttcaaagtaaagatgcacaccaacgagcaaccatacgaactggcatcttattatgaaacaatacagatgaactttgacagagaacctcgcttctatgccaatatcggttttgacggttgcacctggtatcagtataactgtccatcagacagtgaaaaagacatctggacagcgaagaaccgcgccggacaagcacagggaaaactggggactaacagctatacaaccaccggatactggaccaaaaaactggtcagtgtcacttatgaagttacccagagtggctatacgaccgaaagattcccttggccggaaatgcgccttactgacttatacttactctatgccgaagcgctgaatgagaaagacgatgtcaacaaccgtgaactggctatcagctacctggatcagatcagagcacgtgccggtctgaaaggaatcaaggaatcatgggacacttactccaagtatcccaacagatacaagacacaggaaggacttcgtgagattatccagcgtgagcgtgctatcgaactgatgttcgaaggcagccgtttctgggatctccgtcgatggaagacagccaataaggtattgaacgagaagatccacggatggaactttgaaggtgaaactcccgcagagtactattctcagagaaccctgtatacattaaagtttatcgctccgcgtgattatttctggccgattcatcagaatgacctggtagtcaacccgaaattggttcagaaccccggatggtaatgtatgtctcattttaaaatcagcagaatatgatatcacgtaaatttacaatatgggcttgcggcttgcttttcgttttcggtagttgcgcagaagatatggtaaagcccattgaaaacgacaaagacgctcctggcactgttcaggacgtaaaaacagaaagccttccgggagctgtgaaattcacttatacacttccttccgatccggatttgctgtatgtgttggccaagtatactaataaaacagggaaagtcatggagttccgttcctcgttttacacgaactctgttacggtagaaggttttggcgatacggatacttataaagtagaactgtacactgtagaccgtagcgagaaccgttctcagcctcagatagtggaagtcgttccgctgactcctcctatcctgtcctgctacgagtcgttatcgatggtttctgactttggcggcatgaccttcgagatggacaataagttcaagtccgatcttgctatctacgtctgtacgcccgatgaattaggcgatatggtgctggccgaaacattctactcggcacgtgaagagatcgtttattccgtcagagggtatgatgcagttccccgtcgtttcggcatcttcctgcaggataaatatgggaatgagacagatacgctgttcaccgagctgactccgatctacgaaagggaattggataagacgaagttcagggaaatgtatttgcagaacgattcccgcgtagattcgtacgatggcaagatggaatatgtatggaacggaagaatctccaaagatggtgacagtggtggcgtaggacttcacaccggaacaggcacgaaagacggtccggcagtatttaccttcgaccttggcgtactggctaaactgagccgctttgcactgtgggctattcaagacgagaagcacttctataacgacatgagcccgagacgctacgaagtatggggatgcgctacggaacctaaccccgatggtagctgggatcagtgggtgaaactattggatatggagaatgtgaagccttccggttcgcctatcggtatcctgacggaagatgatatcgaagccgcgaaaataggagatcaggcaaatgttcctctggatatgccgcgtgtacgctatatccgtatcaaatgtctgaagaattggtctaacaattacaacatctgtttcacggaactcaccttctgggggaatgataacgaagaataattcaatgagtgttaaccgactgattaaagcagaaagaatatgaaacaatttatcaaacatacgccctatctgatgtcactactgatgctgttggggattacatcttgcacaaagatggacgaatatctgaaatatacggatggaaaggaaattctttatacgggtattcctgattctatcgccatgtactccggctacaaccgggtggtcttccgcggagtactggcatccgaccctaaaatagccaagataaagatatactggaacttgaaacaggactctctggaacaggatatccggagagaagggaatgataatgtgctgattataccgattcctctggaagaagggacctataatttcgaaatgcatacctatgataaagacggattgcatccttcggttcctttcaaccttaccggaacgtcatatggtgactcctacaaagacgggctggtcaaccgcttggtgaagaaggtagaaaagatagaagatgatgtaacgatcgactggtcgccggcagaaccgacagctctttatacgatggtacattataccgataattcgggaaaagtacaggaactgaagatcgaaaacagcgaagaagaaaccgtcctgaaggattacaagagtatgaccaagtttgatgtgcagacttacttcctgccggatgaaatgtcgattgatacctttaaaacggcagttgtctcttacggagtcagtgaagacattaccgacttgtatctgaagaactacaaacgtccgtttgaaggaagggataagaatgcggataataaatggggaatactcgttgactgggacttcactcccaatatcctgaatcagagtaatggaaaaggcggttggtccgaagactggggcaattattccatccatctggaatcgaaagactgggatggagaaggaatcacgaatggtaaggtctatcaaagttttgaacttccggctggaaattatcaattggagtgtgaactcgaagggggcagtaacggaatgaacggatatctggcagccagccgcggcagcgtattgccggacattgaccgattgaaagaagaagcattgggatatagccagtacggtgactccaatatgggaggaaagcataccctgaccttctctttggcggaacctgctactgtttcggtaggctgggtagtcaccttcggatcgtctacctggatgaaagtgctctatatcaagctgatgaacatagcggatatagccgaataatccggttttcataagcgctcggaatagtggatatacaccatatatgccctgcatgcagggcatatagatccaacgcgcaggacatatatacgctacgagttggacatatagatccaacaaccaggatatatatg

SEQ ID NO: 203 - DNA, 12414 bp, Bacteroides thetaiotaomicron
gtagctatacacttctgaagagtaggtatgtctatatacaaacttacccaaggatacgttaatgttcgtaaacttgggtaagattttatagatattgtttggagaggacttagaattcaccttctttttgaatttaaagagattctacaacaatctgtctttcagaataaccggaagttcgggcattgcaccgctctgcgtacaaacataagcggaaacttcgacagccagcttatgagcttcgggaacagacttgccattcagaatggaagcacagaaagcggcagtaaaggaatcccccgctcctaccgtatcggctaccggaaccttcggcgtttcctgaaaagaaacgactcccggagtaaacacataactaccattgataccgcaagtaagaatcaacattttcagattgtacttggccaacagaatccagcacttatcctgtaagtcgatgcccggataaccgaacatacggctgattgtcaccagttcttcatcgtttatcttcagaatgttgcagcgtttgaaagactcgcgcaatacttctttcgtgtagaagtcctgacggaggttgatgtcgaatatcttcagctgtccgtctatatcgggcattgtatcgaggaatcggttaattgtagcacggctcacttcattgcgttgagccaacgaaccgaaacaaacggcgcgcgtattcaaagccagccgcttcagttcgtccgtgaaaggaatgttatcccatgccactccttctttgatttcgtagcaaggcaccccttcgtcatccagtgtcacctgcaccgtaccggtaggataatccacccgctcaatctgatttttgagttgcttttctttgaatacttccatgatttcatctcccagttcgtcattgcccaccgcacttactacacggctgtcgaaaccaaactgtgaaacatgataagcgaaattagccggagcaccgcctatcttctttccttcgggcaatacatcccataatgcttcgcccattcctacaattatattattcatgatctacagatttaattgttttccaaatataaaattattttttgatacggaaggtatagaacagcaagtaaagtacaccgactgtcatcacagcaatcgcaccattctgccccatagaagtatccgaagcaactcccatagccaacgggaaaacggttcctccgaagagtcccataatcatcagaccggaaacttcgtttttctttcccggcagataaagcaatgcctgcgagaaaataacagagaacacattcgagttaccaaaaccgatcagagcgatacaagcgtaaatcaccgctttatcatggaagatgaacaaccctaccatagcagccagcatcataacaacactgataccgaagaaagatttcggagacatctgacgcaggatgaatgatcccagaaaacagcctgccgtacggaagataaaatagaggctggttgcaaaagcagcatcatccagtgtcatgccgatacgttccatcagaatcttaggtgcagtagtgtttgtaccgacgtcgataccaacgtgacacatgattccgataaaacaaagcaagataaacggtttgccgagcaatgccaggcactgtccgaaagtggaaggtttgccttcttccttctcttcttcaatctgtgtcgcgttgagcagcagaatggcaaggatggctattaccatataaatagggaataatacacgccaccccagatcgaaagaaggaatcgcctgcgttgctccccacatggcaatgtacggtgcaaggaaagaagcgatcgctttcacaaattgtccgaaggtgaggctgcttgccagacggtcaccacgaacgatgttggaaagaagcgggttcagtgaagtctgcatcagtgcgtttccaatacctaacagggaaaaagaaatcagcatcagtgcgtaactgtccccgaagacaggcaacagtaaagaagcaaaagtcacgatcaaactgagtaacacggttttcttctgaccgatacggctcatcagcatacctgtcggtacggagaaaatcagaaaccaaaaaaacaccaatgaagggaagatgtttgcttgtgagtctgtcagacccaggtctgcttttacataattggaggcaatgcccaccagatcaacgaatcccatggcgaagaaacaaagcatcaccgggactagtttggagagagaagcgtttttagtattttccattgttttatctattataatttcgtatattagcacagtaattattttcctttcctattgatcctttttcttttagcctcctattttctttgcttatcacggctgtgaacagaccgtatcacaagggtgataagaccttatcacagtaatgaacaaatcgtatcacgtaggtgaaacgctatctatctcccatacataaggagaacataaaggcatgttaacgcaaggataaaggtatgttagcatgaattaaaaagagcgcagggagaagaaagtcgttttttatttcttcagtttgtaaaccacgaatgaatctactttataggcaccgcctttgctgtagaagctgatatgattataaggttccgaagggaatacctgattggtcatagcgaagcgtccaccgtcaccgaaagcctctacactcgatctgtctacaaacaggcggagtttcatttcatccttatcctcttcaatcgcagtccaagtcagcatcgggaagttttcgttgaaatttacctcgccactcttgcgacggtccatcgagaatttcttctctttcatatcgtactgcatgtctacttcttcgcccttgtcattgtagagacggaaaccgatgatttctgcctgctgattcttaagggacagttctatttcgtaagcaccttcattgttcggaatcaaatctttcacgatacgtgttccgttaaccttgaatgagcgctttttggaaacaccacgcagtttcagtaattcgggagaaggagcggattgaagataaatcccaccgtcgatggcaaagagactcaaatcacgagggatggagttcggactacggtattgagaagttggcacgtcatttgcatattgccagttgctcatccatgcaatggcgatacggcggttgtcgggggcatcgctccaagtaactgtagcataatggtcttttccccagtccatccatttcgtgacattcggctgattgtcacaactaaatttcttgccgtcgaagctaccgataaagtattgagtagcggagtcaccgaaaggaccgtcaccgaggctgcaaagcaatacccatttcttttcgttggtgccctctaccggaagttcgaataaatcggggcattcccatacgttgccgtgagcaccgtatccttcgccgaagctgctttcaaatgcccagtctttcaaattgggagaagagaaaatctgcatttcctgtcccactgcgagcaccatgatccagcgttttgttgcttcgtaccaaaaaactttcgggtcgcggaaatcacgagcttcggatacaagtacggggttgttttcgtatttggtgaaagtgcgtccgttgtcagtgctataagcgatgctttgtacctgacggtcgctgttttgtgtatagatggcgatgattgcgcctgctccgaagccggctgtattgttatgatctaccacggcagagccgctgaagatagtaccaagcgcatccggtgctatcgcaacggggcggtgttcccagtttacgaggtctttgctgatagcgtgtccccagttcatgtttccccatttggagccataagggttgtactggtaaaaaagatggtattcaccgtctttatagaccattccgttcgggtcgttcatccatccgtaaaggggagagaagtgataggtcggacgaaacttttcacggttggtcgtatcgaaggtgtcggagagtttcatttccttgcagcaagcggtattatccggcgaaagattgacacggatcggatcgttggagttcatcttgaacttgaaagagaccgttttgccggaaaagtcggaaaggtctaccggaacaaagtaatctactttatgtatggcgagacgcacgtcgaagtttttcacctctttattattaacgatcatgctgatacgtacatcgggagacgcatcctctacgggcagaagcaggtagttctgggaagtattgacacgtacaaggcaatgaccttctcccagattcttaatcagcaaaggagaatccgccgctcgggttgaaacagaaatagtcatgagaataaaacaaatcagaaaggtctgaagttgtttgacaggcaaaaatacattcatgttctatggtattaaggttgttatacttttgatagttgttacagtgcaaagataggcgcttccaaggttagcgcctatcacttttgtttcaaacgctgtaaaagatgttacttgccggtgtagttttcatcaataagtgcttacctgaacgtctgatacagttatttcacctttataacagcagagtgaccacgggttcttctgcatttggtagatacggttggtgaaagataactggtcgttgatataagtcacgcagacggactggtcactgtaaatcgtcacacgatattcattatctgccggaatattgaatttattatcgaataagtatttggcatcgtcaccgtctttctcaaaattcgctttgccttcatcggcattgacatggatactataccaggaagcggaatccgttccacgtacaaaagagattccgaaacggtccgtattcgaagcggtctttacggtgaaagaaatcttgttatgtactttcagacggttgaagatgacggaggcaccttcgcccaaagtataggttttaccgctttcgatcatgttaccatcttttgccattactttcacttcttgtgcggaagtgtatttacggtcgattgcatcgggtactccgagggttaaagtaccgtcttcgtgttgaatcagacgttgtgctaccagattgcctgcccattcgggttctacatcaccaacatttccattatcatttccggcacgtgtgggacaccaaccccaaatgtagcggtttgttccgtcggaagcggtctttccggcatagaatgcgcggctgtccagcattccttcacgattgtccggccatattccggcatcattggcggtagttgctttcaaatcttccagcgttctgcctttgaaatattgtactttacgcatgaaggaagcctgttccgaataaatcagataccaccagtcccccatcttgaatacatccggacattcgtagaaacgatcccacatcatggtcataaaggttccggcagattcccactctttcaggtcggcagaggtaaattcggcgatatgcccttttccgttcttgcgggtagcgatcagcatgtgatacacaccgtcttcggtctggaacaggaacgggtcacggaagtcattcttgtcataaccatacgtatctcctttcaggtagaaggtacggttcttggtccatgtcttgaaatcgggagaagtagctaccatcactacctgagcattctggtcggaagaaggcttgaacttattaccggtgtagaaggtataatacagtttgtcggcagggttatagatcgttcctcctgtgccgatggcagcatcctgttcgtcacgccctccgcaggaaatcagttcgccgagagattcgtaagtagcaccgtctttggtagccaccccgaaaatgggatggtacgtagcttcggggttcggacggtaatcttgcaggtacatcactttaaagtccttggcaaccggatcatagaatggcatcgggtcacctacaaagccgacctgtggcttatagtacatcgagaagccatgctcatcactcgattggaagtatgtggctgtaccgtcccagtttttctgagtcaagatggggtcagtctcgtcactgcaagcagtcatcgaagctatcagtgcggtaaatgctataggtaagatcatatttttcatcattgttgcttattctttttatttacacaagtagttgattgcattgagagtcatttgctctacgttgtagtgatagtagtcggcagaagcgtctactcccttgccgtaccaatcatagcagccggaaccgatacagagcgtacgtccgctattggaacgcggttcaaattcggcaatgactaccgccccgtcgcctccatgtgccaaatcgattcctcctgtcaggttacgccatgcgttcaggtcgtcataacctccccagtctgtcccgatatgccactgcgctgtgctattggtaatcgcatagccggcatcacaggtatagactgtcgacttgtcgccatctttccatcttaaatcctggaataacggatgtgattcactgccggtaatcaggaagctccatggggcagaggtgatttcgggcgagtcttcgtttcctccccagctattgttcggtacacgctcgtctttagcgatgccgagattggcgatatagaaagtagcgtaacgggtcagcagcagattaccaccattctgatagtagactttaaacttctccgctgccgctttcgcgtcatccggcaaaggaggattgtcaccattgtctgcgtggaaatgccaccagatagcggtatatttacctaaatccacttttccgtccactacatccttgaatgagatatattcggacatcgatacattatccatcatccattgggcagcggctttctcttcgggactcgtcagaagactgacggaagaagccgtaccgacaaaggcagtcggaatcacatttccctgagtaaccgttaccacataaggagttactgccgaacggtaagttgccgtgtaagtgacggggttcgtaaagtcctgaatacttccggatgccggagtcacggtagctccgtccgttacggtaaacgtacctttcaactgagtgatatccactgtcagcggaacgactacagaaatggttttcgataactggtctacctttcctacataagtatcattcaatttgaaggtcagtatcttcgcctcatctctcttcacggtaatcgtgtagctcatttgtacatcgccattcttcaccgtcaaagatacgggaagagaaaagtcgattgtctcaccgatagcgatgctagccttggctccttcggaaagattcatttctgtgaccaccatgcgggtaatatcgtaatcgtagggcactcctactacgattgccttattctgatagtcgacagttcctgcgtattcatccagccggatagagttcacccaaacatctccgtccagacgaaggccggatttgaagtcatcactacatcctgtgactgtaaggcatgccacagtcaccaacaggatagtataaagttgttttatgattgatttcattgtattctttgttttaagatggttagttaccaaccgaaattctgtgtataatttccattacttgcgctgatctgttcgaatggaacaggaagatattcgttcttattttccgtaaagcccgcattcttgtagatagagcaacgggatgcttccgtcacgtaataagcattgatgacatctttggcttctccccatcttacaaggtcaaagaaacgtgagctttccataccgaactctacgcggcgttcccatttcagcattttcatggcttcgtcctgagcgtaagctttcaggtcgtaaggagtcactttgaagttcactccgtagtcttctttataattgaagatcagcatggtgcttccggcagcacggctgcgtacctcattgattaatgagatggcatcggtgatacgtccgtcgttcaactgaatcagtgcttcggcacgcatcagcaatacatctgcataacggatcacaatgtgattcagagaactggcccaataagaacctttcttcagacagtcacaatcgggatctacattctctttgagagaaacataatatccataaagtcccttgctgcggctccagtcatcattcttctggatgatgtaaccttcgttgtacttataaggaaagcccggcatacccaccgtatggaacagacggggatcgacattgtctgtagccacttcgtaattctcattgtcgtaggtactgaacaaaggctttccctgcgaatcggttttgaaagcattcaccagattctggctcggcttgtggaagtcgcagcagcccagtatctgcggagtggtcagtcccattccccaattcaggttaccgttgtaagtaccgtcgttgatagaatactgaatggcccatacagactctgcaccgttttcatattgcggcaggaagttcatgctatagtccgtttccagtccgtaaccacctttagccatgatcaggggatcggtgtatttcacgacctgtttcaggtcttcttcgttgattccggtaagggcattatcggctccgtcctggcggtaagctttatacaggtaagtttttgcaaggtaagcagcagcggctgcctgtgcagggcgtcctttttctatttgtacttccggcaggttgtcgtaggcaaactggaagtcgtctgctatcttttgccattgctcgtcattggtataagtggtattcgacagttcattgtaagcatccggttccatgttttcatcgtttacaataacgatcttcttgaacagctgtttcaacatgaagtgagcgtgtccgcgcaggaatctcatttcggcaatgcgctggttcttcaacggataggtcttttcatccatttggtcgagtgattgcagagctgtattggcacgggtgatgcattgatacagtcttttccatatatcattgatattccagtcggtggtattgatacctttggatatttccagtgcgttgaacacaccgccgtcttctgttcccgaaccgcctttatagcaatcgtcggaacgtacatcataattccagagagagaaggaagagttgatatcatcacctgtcgcccagatggcgtaggcagaaatcaccagattatctacatattcgggagaagcgatctgatcgccggtcacaataccctgaggaacctgacggtccaaaaaatcgtcacaactggttgtcagcaaggtaattccgattgttgctatatatattatctttttcatgatcattcgttttattgatgaagtaagttaaaatccgatgttaagtccgaacgtgatattcacagggatcggataagaaaagttcgggttctccggatcttctccggtaaaattcttgctcttgatggtcagcaggttctgtgcactgcaatagaaacgcaagcggtccattctcatttttttggagataacagcgggaacggtgtatcctaactggatattgcgcagtttcaggaaagaaccgttttctacgaagtaagtagagacacgctgttcattgttcgtatcactgcgggtcaatgccggaatatcagagtttgggttcgtaggtgaccaggcattaagcaaacgggttcccttattcaggaagccgacattggaagcactccaaaaatcgcttttcttcttcacgtcactgattatatccactccctgaacgccttgccagaacattgtcagatcgaagttcttatattccagataaatattcaatccgtagctgaaagagggagtaggatcataaatccagttctgatctctttcgtcaatcacaccgttatggtcaatatcacggtaacggatacggccgacagcagcgccttcttgagtagcatggttgtctacttcatcctgcgacttaaaaatgccatcagcaatgtaaccgacttgtgcgccgtaagtatgtccgactacactcttcacaccattaccaccaaacttgccgttggcagctaccgtttccggcaattcaagaatttcattccgataagtggatatgtttccgttcaggtcgtaagtcagtccaaaggcagtcttgttacgataacccagattaaattcaaaaccctggtttttcattgcacccgaatttatccaacggctgccgccttctcccagcactcctactcctgccatttcagtcaggatatctgttgttttcttgtagtagtattccagtgaaccgtacagtgattgcttgaacaggctgaagtcgataccgacattggtctgtgtcgttgtttcccatttgatattgtcgttaccgatctggttgcgtttgaaaccggaaggaagtacaccgccaccgttagaacctgtgatatcgtatgccgtaccgtagctctgtccgccgaaagaatcggttgtaccatagttaggtgcatagatagtataacgggcaaggttggagatttcctgattaccggtctgtccccacgaagcacgcaatttcagatcatcaagccaggtcagttctttcatgaagttctcctgtgtgatgcgccatcccaaagatacggaagggaaagtggcataacggtggtttttaccgaaccgggaagaaccgtcccgacggagagttaacgaaagcagatatctatcggcataagaatagttcattttgccaaagaaagagacgagtgaatacccctcaccggcaccgtatgcttgtgccgtgccactacctgcatcgggccacatatagtcgggggtaaggatagagaagtcttctttgtatccggagaaatggctgtcgtcttcacggttcaactccatacctatcattacatctccacgatgtttgcctacttccagttggtaggtagcaatggcgttccacatccatttcgtccagtgttcctgcttggcttccactgcgctcttgccattatttgtctgcgttccttcctgataaggataagtgaagtaacgtgcctgcttgttggcatagtccagaccgaaagtggaacgtagattgaatcccttgaaaggagtcagattgacataggcatcaccgaacatacgccagtaagtgtatcggttgtctttattgtattcaagtacggcacgagggttacgacggtcgggccatccgcctaccggtccgccccatgaaccatccgaagcatatacgggaatagcggaaggaatgtccagtgcggtttcaataattccacccggagcctgcacttccgacgtgcgatttaatgtaaaatgctgaccgatggtcaggatatcatcaatcaacttataatcgctgttcatacgagccgagaaacggtcgaagtccgtgtctttgataacacccagattcttgtaatatcccagagaaaagaaagaagaacctttctccgaaccgttgctgacggaaagattgtattgctgaataacaccagtacgagtgatctcgtcaaaccagtctgtgtccgccacaggcattgtattctttgaatccaggtatttggaaagagtcattccgtataataccggattgccgtcggcattatatccccaattgtaagcatatcccaaagcattaccgttcggattttcaccgtcgttcacgtaggcttgccacatagctcgtccgtattgctcagtgttcagtacgttcattttactctgatacatggaggcggaaacagaagcgtcgaaattgattttgatctgtcctttctttccttgtttggtagtaatgatgatcacgccgttcgctgcacgcgaaccgtagatagaagcggatgcggcatctttcaaaacctgaatggattcaatatcattaccattcagttcgtgcataccggctttggtaggaacaccgtcgattatataaagcgggtcgttattgttcagcgtaccgataccgcggatacgtacggtagccgatccactcggattaccatcggcggtgatgttcattccggggacacgtccctgaagggctttcaccggattgttttcaccttgcttctggatttcgtctacttttactacagaaacagcacctgtcaggtcggctttacgctgtgtagtataacctgttacgacaacttcatctaccatctgggtatcttcttccagtagtacattaacgatagcagccgcttttacggtcaccggtttataaccaatatacgtaatctttaaagtagagttgaccggaactgaaagagtgaaattaccatcgaagtctgtaattgttccgttggttgtagctgtagtttcaacgacagaagcaccgataatcggttgcccatccgttttagaagtaacgtttccctttaccgtaatgttttgcccccacagggccgacatgaaagcaaacaggaaacaaacgctgcaaagaagttttttgttcttcatgataccaggcattagtttaatgttattaatttaaaagtacgaattttctcttttcgatgatgcaaattacggttgatttaagtc

SEQ ID NO: 204 - DNA, 12411 bp, Bacteroides thetaiotaomicron
atattatattgattattagttgtttataattgtcgttaatgaaagactgaaattctctgttcttttggttttaaaggaacgaggcgttggtttaaaaccaagaccccgttcctttaaaaccaacggggcgttccattcttaggaacggaggttttcgctttgcgtgctgtcagaagttaacttttacgccggcattaatctttacaccgtagtactccgcctgcatggtgcggtctttggttccctgatagtaacgaagaggctggttcagcaggttggtggcgtctgcatagaacgtggtctttatcttcttgccgaaggtgtagctggcgttcaggtccatgtagctcactgcgtcatagtaacggtcgagagctgccacttctcccatttcgtcgatgaagctcgaagcgtagttgtaggagaaacgtacgttgaaacctttcttttcgaagtaaagggaagcattggctgtatgttcgggtgatcccggcagggacaggtctttctcgttctcacgaccttcgaagttgaagttgttcacttgggtgtgggtgtaggtgtacgtaccatagaaaccgatacatttcagtgcgggagcaatgaagccgaagtcgcgttgataggccagttctacgcccagcaggtcggcgtcgccggcgtttttgggctgggtgaacttcttgtattcgttgttctgataggtgtagtcaccgatgacctgatcgacgataaagtcattgatcttcttgtagaagatacctgcgctgatcagaccgacacttttgaagtagtagtctgcgctgaggtcgagattgtaggagatggtcggggtcaggtcggagttacccatcaccagttcgttgtcgctgcggttgatgttgacacaggggatcaatgcggagtatttcgggcggctcagtgtctcggtgaacgaagcgcggagctttaagtcgtcgttcacatcgtatttgaacaagaggctggggagccagttgacatagctgttcttatggtttccggtaggttcgagggtttctgtctcgtctttgtcgtcggctacgttccagttccagccgttgtatttgatgtgggtggcttccatgcgtaagcctgccatcatttttatcttctttcccaagttctggtcgaagcggaagaaggcggaagttacgttctcacgggcgtggtagttgccggatgattcttcgagcacctgttcgccttccatactgctgaggtcgagtgagcccaggtattctttggatacgaaatcggtcggcttatattggtctcccggcatatatccgtcacgaatctggctggtgaggttgttcatgtaatccttgtcgaaggtgtctttgtacgtatctgcgtaatcatagcagagggtgttgcggtctttggtcttggaggcgtactttgctccgaaccgcaggctgttgccatagatgccgtttgtcagcggaagttcgaagtcgactttgaacttcaggtctttttcgtagatttcctggttgctttcggtcagttccttcactttccatttgcctctttcgccgtccgcttctccgttgtgcaggctgacgtccgtagtcacgtaagggaaacggtcgccggcatctacgacggtaaagccgaggaagtcctgtttcaggctgaagtatctttcgttcggacggtcttcgctggcacgggcgtaggaagctccccagttgacggatagtttgccgaactgatgttcaccgctcagactgaggtccattgtctgttgtaattccagacgggcatttctgttgtcgggtgttcctccttttgtctcgatctgggcggattgctgcatatctccttcgtcgtctagtcctgtcttatccaaatccttataggtgacgcggtagcggttttcccagtcgtggcgacggttgtagataccttgcagcgtcagccggtggttcgggttgatgtcgtagtcgaaagccagggagtagctttggcgttcgcgggtcacgtagtactggcgtttctgtgcttccaccatgactacctcgccttttttgttgacgtcatattcaaactccacatcgtccgatcctgacggagcgttctgataagagatggcggccatcattcccagtttgtcattgaagaaacggtcgccgtaggtaaatcctaagttcagctgtgctttctggctgatccagttgtagccggttcctgctgtggcgctgaacatccgtttgtaaggagtgcttttcgtcaccagattgatggagccgccgatggcatctccgtccatatccgaggtaacgactttgttcacttcgattgtctgcaccatgtcggcggggatgaggtcgagctggacattacgggtatcgccttcggcagaagggaggcggttgccgttgatggtcacggaactgaggtcggcggaagtaccgcggacttgtccgaagcgggcttccccctggtcgtattgtacattaataccgttgatacgtttgagggcgtcgccgatattggaatcggggaactttccgacctgatcggctgaaacgacattggtgattccgaggttgttcttttgtgagttgatggcgcggcgttgtccctggaaggcgccgcctaccactacttcctgcagttcgagcccttcattgagtacgacgtccttttcgagtgtctttcctgccggaatggtgattttcatttcgacgggagagtagcctacgtagctgactttcacggtgtatgtgcccggtgtgagattggcgaatgtataataaccgttgacatcacttgtcactccggtatgtagtttttcgatgtagatggaggctcccggaagaatttgcttggaagtgtctactatgcgtccgcggatcgtaccctgtcgggctacgtttactttttcctctgcaaaagtatttccgcttgtactcatgattaaaagagtcaaagagactaatctgagaaatcgtttcataaatgttagcgtgcgttaattatttgctgcaaaagtagaggtttgacgtttcttgctttttacagttgattgaagaacgcgtaacaaatatgctacgattgtgttacgcaagaagggcgcccgcctgcggacacccttcgatacctaacccgataaaaagttatcttgaatgtatctgagatacgatcaattcattggaatgtcgatacgttcgcccgtaacggaaacggcgcttaaccggaaaccatctttccagcgaaccggaatcgtgaatgtgtctacagacgaaggggcattttcgccgctgcagatgaggatgaatttgccggtttcatctttcacttcgtacgtcactacattggtccagttcttgatcgtgatggtctcaccgttgtaagtcaccgcattatcgccggaacctaccgtaaatgtcttgggagcatgagtggcattctctcctttgatgatggcggttttcgttttatacagttcgtacgtgttatccgaaatgtattctaaagcgacatccggacgggtgcctcccagtgcgttcactttctgtttgagagcgtctatcatgtcttgtgtcacggtcagctgctttttcccgtagtcgtccagttccttgtcgaccggagtcaggaatccccatttggtgaagaagtcgagtaagttcataccggaaatcttggagcaggtatatacaaagtcaagctgaatttctccgtgagtcattcccgtgtagtctttattgcgggcgtattcatatacttccggataaaaacctcctttgtccgcctgttgcaacggagtcctgcccagcactttcccgaaatagagttccagttgccagaagggaacgagcttacagaatacatcgttggcattattctttcccagattctggaagtcggcatgcggacttccggcagcgataatcccactccatgctttggagtatctgtttcggtaggtgattcccatgtcttcgacctgtatgcgggagggctggccgaaaatggtggtctgtatgtactcggacatgatgttgttcgtcacttccgtgttgccgccccacaatactcccggacgggtctgattgcaatgtcctatctcgtgtgccggtccccagcaagcgcttgtcttcagtttctccggactacagatttcattcattgttgttcggttgtaggctgtgtgataggctgtggcgtacatataggacttatacatgacattcagatacatccggtttctgaacatcttgtcgtatttctccaagcccagcaactgctgctcgctgtacacgatcttgtcataaaggtctatcagttcatctcccttggaacctgtgtacgtccgtaggtcactcgtctcgaaagtgaggtgggcatatttccccagtacgtcaaaataccggttggttgctttgttgagcagttccgaccagcgtccgttatgctccgggttttgtgagtcgaagtagccgttcacctttcccgatgcaaaatggattttgacaggggccgctgccggatcgtccagcgtttttgtgacatacatcacgtacaccagtccttgttcgctgatagtaagcttgttgattccctgattcagtaagtaggtcactccgccaaaaccgtcattctcaggtgcatccagattctgtacccgcagtccgatgtcatatccgtgtgtgtctcccaccagtacaatcaggttttcacctgccttgaccgatattccggtcggattgtccaactggctgtaagggttggtcttgtgggtttccgactggatatccggattggggtatgccttgaactcgctgatacggaactctgcgggatacttgcctttaatcatatagtaggctatattcttaaagaacgggtattcgcactgcgctatgtcatcttccgtaataccggttttcagttcactgcaacttgcgtctgtgaagagagtcgaataatcaaagttcacgggattctttgcaaagaactccatctcggcgcacgaagcaaatccttgtccgtcaccggaaccgctttttacgatgaaacggaaagactttgcctgtatcgtttggtcaaatgttactttgcctgccgtagccgaaccttgaaaatccttatcaataagttttgtgaatgtgtgaccgtctgctgaatattgtatttctgtttctttgaatctaccattatttccgttgttgcgcggatggtaaatcaaataatcgacatctgtgactgtttcaaaattataggttaatgtgatggggaaatagttgcttgcgccattactccaactggaatgataaagtgtcgaataatctccgtcaaaagatttttcgatgttgctgccggattgaaaagaagaagccgttccgcttactattttgatcttgatgtcaccttttacgtcttctccgttgccttcggcaaattcgttgagtcctttctgagtaacaaatacggatgcgcttacaggttctgcctgttccgtatcgggatcgatagtcggtaatacttccgttatttcaatgttgccatgacgctgactgtcaagtccggttgctttcaccatatatgtatggggggtggtgactgtggccggtgcacggctggcaggttttgcggtaatccattccggcaaagtgatggctacttctacatttgtcgtcacgtcaaactggatttctccaccgataacacctacctcaaagctggactggtcaaccagaatggctgcttcgtatcccaactggcgtactgtgattgtctttgtctggtcggcagctatcacggtaacggttgctttgcgcacgtaccgttcgtcgctttcgtctacagatattttcagtgccttcccgtctgctgacgggtggcaccaatttttatctgatttgacagtccaggtatccacattggtagtgacagctacattctggctaccggactcactattgaaatcaactgtctcttttccaacggttaaattgggggttgaagagccgtcatcgtcagagcatgccgtagacaggcatggcagcaacgataatagaaagaaaagcagtatatatttcttcattctttttttttattcaagtacgaccattgaacattgatagatttccagttctcctaaagcaaaataaggagtgcccttcgtggtctctgtcacttcgaaccaaagatagcgggaaggttttgacagcggaattacctctgagttgtacacttcgctcactccgtcgggaagtcccgttaaggtagtttccttgtgggtgcctgcctgtgagatatccactgtgttgccatcaattttctcgacgccatcaaaccattctgctggattataactatcacttgtatataggttgatcgttttccatgaactatcgttcgcacggttggtattggtcgaacggaatttaatagcactgacttcttcgcctaaatctactaccagataatgtggcatttctactagtgagctccaccacgagtggaagaaggttgctatatttccgtctaccaggtctttgatcggccgggtaggaaatggagcattcgtccatattttcttatagtccagatctatctttacgggagtgccaaacgtaggacttgccttttctgcttgtgcagttatctgatggatggtgcctgcggtgttgccacgattgaaggcttgtacggtgaagttgatttcaccgtacttttggagcagattgtctattaccagttcattggcatattgactgacttgttttctgtatgactttcctgtggctccgatggtatattctatctgtacataatataagttttcatcggcagggttggtccagctcagggtaatctgtcccggagcgggagtcgctttcagattttcgatgtcgctgggtaccggataggaatctttgtcatcgctgcaagaccagagcatggctaatcctccgataagacatatcgtcataagtatctttttcataatcagattgtttttaataattgttattcatcattgattagtagcccggattctgcaccatgttcgggttcttgcttacttcacctgccggaataggcatcagatactgacggggtgcatcgaatgtacgcttgtcctgtatctccacaatcttggcgaagtcttccattgtctcggcaagaatgttcagaccacgtgccttgacattgaaataagtttctcccattttccagcggcggatgtcccagaaattatgattctcctgataaagctcgatcatacgttcctgtctgacgattttcatcactctgccgtcgggaccgcattggccgtcatagcttgtcaaaggaactttggcatttgcccagctttccagtaccggttttagtccggcgcgttcgcgtactttgtccagataagccattcctttttcgggatatccttctttaccatatcctacgcaggcttcggcatagttcaggtaaagttcggcgagacgtatcacaggccatggatattctaccgttggtccgggggtaccaacggtagcttgtatccctgggtgtacaccttttttgttcaggtatcctgttttggagtagttctgagagcgtgccgcagtgactatctttccgtcatcggctctgacaccgcagttttctgttgccagaaatccggtcaaccacttgtctccttcagaacgctcagcaccccagaatttgtgataagcatatcttttatcgtctgtacgacattcataataaccgttctcaaatgcaacccacgcatagaatcggggttcgcggttcatgttcatgtataatgttctttttcccggttcggcataggtagtgccttcagggatggttacgatatccagtttgttgtttgtattgaattcggggtcttcgtcaatcggtaatccattgactgtgtagaagcggtcgagcatggtaatagtgggggctataccattccacgagccacgtgggaagaaaggtatggatttacgttgaataccataagcacctgctttacgggtttcggggaaaatgacttctttgtagttttcgctatccatgaaagtcatacgaagtgtgcgttctgtcaggttggtcggttccggataagcattacttgtagtactggctatatagagctcgtgaccggctcctgatgcagcctgaatggcatcccatgttgcatctgctgcacgtttgtatttttcttccgaataagtggtcgacatgagctgttcgccgtccgggttcttaaagtctgtgtaatcagggttcccattgaataatggtgaagcggcataaagcaacatacgtgcttttaagcttttggcaatgacgctcgtggcacgcccataatccgaactattgcgtgtggcaggaagtctggtggctgcatcgtcaagtaagtcggcaacccagtcgatacattcatcgtacggacgacgtccaagcatattctctgcgggagtgtcgagtgccggaagttcttttaccaaaatggtcggcccgtaacatttgatcagaaggaggtggaaataggcgatcaggaagtcggcttctgccgtgtaaagatcgacttcctcctggctgatcttaggaacggagtggatattttctttcaacaaatagcattgacgtattccctgaaacagtgtattccaataactgataattgtattgcttgagtcataagaaccttcagcgaattttacgtaactttcggcaaacgggctgatcgtttcgtcaccggtaaagtccatacatgactgaaccatgtttgactgaggcagatatccgtagcaggaatataaatatcgcagtgcagcacggggattggcaaaggcatccttttccgtggctgtttcgtcgggaacgatatccagatagttacaggaagtattcagccctgtaatcaataagaggataaatagatatagtgtattctttttcatatctttaaggtattatttgttgttaatagtcatttggaatccaatgttgaatacgcgctgggtcggatatgaaagaccactgccaccaccctgttcaggatcccacagatcgaacggagcaaaggtcatcagattagaaccgctgatgtataaacgcatattcttataggtatatccgatctcagcattctttaatttcaggaaggcaccgttacgctcccaatagctggacaacttgttgttattgttattggttttgcgtgacaagcgcgggtaagtcgcattggtgttttgattgtcgggactccagcgttcgtctgccacccatgaaagtacgttgcgcagcatactgtcaccaaagggatggaaatcttttaccatgaaggaggttctggctattccctggaagaagaaggagaaatccagattcttccatttaatagagggaccgaagccatatacaatctccggtacgccgggatgttttgcccatacccagtcgtctgtatctgtcaggttatcatcatatccgtaccagtctcttgaaatattgatatatttgatatctcctggaatcactgccgctcccaattgttgttggtggttggcaatatctgctgcatcaatgaagagtccgtcggcaatataaatggcattcttattggcactgactccgatttttgactgccatggatatttcggtgattcatcatattgggtgatttcattatgcgcatatgtgaaagttcctttgaagctgacgaaccagtttttgttgaactgcttgttatagctggctgctaattcaaatccctgattgcgcatagctgccaggttgccgtatactttagtggtagctgtacccatatatgtcggagtggtccctttctcctggaagatgtcgcgacgattttcgcgaaagatatcaaaagtaaggtctaaagagtggaacaattgtaaatcgactccaaaattaatcttttctcctacctcccatgtaatatcttcattggcatagcgttgataaacgggaccattgtaggttacattctgattgacacctgttgtaaatcctttgccgcccaggtcaatttgagacatgtagataaaacggctgccattaatctggtcgttacctaccagaccccacgaaccgcgtagcttcaatttagaaacaacgtttttcaaaggtttgaagaaagattcttcactgatgttataacctgcggcaatggaggggaacagaccgaaacggtgtcctttggcaaaattctccgatccattgtatcctacgttcacttcagccatatactttccggcataagcgtaggaggcgcgtgctgcaagaccttgtttgcgttgaggcaatgaaccgataaagttcccatcgcccggtgtgttgtttacaagttcgtcctggctatagattagcatcgcattgacgtcatgttcaccgaatgtacggctgtaattgaccattccttccaaatagaaacggcggtcgccggaatttgtattctttgcggtcaggtttgtcgtatattcgtctccaatacggcttgttgtgtaggtgtagccaccattgccatcgtcttcgtatccggtcagtgcgaatttgttccacttcccttcacgtttgttctcggaactcgaccagttcttgaatgaagccagtgctttgaaactcagaccttcggtgatgaaatccaacttctggttaaattccagtgctgcaatgactgtgctttggaatcctttgttgtagcctgtagcagcctgagccaccgggttggtctgatagtcggcgttgacacgttctgtagctccccattttatataaggtgtttcaccgtcatccgggaaatatactggaaattcaacaggtgatgtattcatggcattgttaaagatggctcctactccctggttaggagtagtcatgtcacgcaattgtacgttcaggcgcaaggataacttagaagaattgctcaatttggcattgatgttattctggaagttatagcgcatgatttcaatgttattattataggaaaagaaatcctttgaacgatttttcaacataccggattcgtggttgacagagatactggagaagtagtctacacgtttaccaccgccacggatgttaaagttgaacttttcgctgtaagaagcgtctttgaatagttcgtcataccagtttacgttcggatagatataagggttcaatccggcacgtgttccgtcaattctatcctgactgtaaagcacgtcaccgctattgtcattgtttacggcctcgttgaaaagttccatataagtagcaccgtctacgaatttaggagtgctggtcggttgagacatctgtgcttccatgcggaagttgatgatcggcttatccagattcatacccgatttggtggttacaatcatcacaccgttggcaccacgggtaccgtacatcgctgttgcggtagcatctttcaggatagagaagctatcgataatttcaggatcaagattattcaagtcacttgaacttacctgtacaccatccagaataattagtggatcggtgactccgttcatggtcgaaacaccgcgaatccaaaagttggcgccatcagctcccggctgaccacttttctggacggcaataacacctgccagacgtccggcaaatgcagtagacagattggtagaaggtacctttaattcagccggtttaatagattcaacggagcctaccatactggctttcttttgtcctgtaccataagctgtgatgactacttcttccaactgcttggcatcttcattcaaatcgatggataacactttgcgtgaaccgatcttgatttctttgggagtgtatcctacataagaaatgagaataacatccgaaggagcagccataatcgtgaactttccgtcaatgttggtgattactcctgtagcagcccctttgatttgtacggaagcaccgatgatggattcacctgtgttggcgtcgactaccacacctacgatttccgactttttcggtccctgactcttttgctgaacagcctctgctttcgcgcttttcaagataatctcattgttcttgatgacatagtcgattccgctgttactgaatacttttcttaaaatctcattaatgtctccttcgcaatcgtagtcctttttctcgtcattggcgataacaccggacttgaagaagaaagtgtactggctattttcttcaatcagctgaatagcctgttgcatggtgatagactgacccttgagaatgattctctttccttgtgcgccatgagcgtagagagccattggaaggaagcaaatcaatagaacggcatatctgagtatgctgttactaaaatgcatgtttttcatgtttctaaaaggttaatagtgaatatattgataattgattcttatgtattaatat

SEQ ID NO: 205 - DNA, 12403 bp, Bacteroides thetaiotaomicron
taccagtacccttattaccttattatataagaagatttcaaataactatcaatgagagaattcactttctataaggaatcagcacagcatcatctcagattcaattctaattttttcgtcaagaaccttattagttaataaaaaaattaattatctttgtagatattacaaaatataagagacgtatgaaccaacaattcttgaaagaaatagaaatgggctctaaaaatgccctcgttaaaaagaggatcattacacattatatatataatggtagttccactattcccgatctttcaaaagaactagatctaagcgtgcccacagtcaccaagtttatcggtgaaatgtgtgaggacggatatatcaatgattacggaaaactggaaaccagcggtggacgccacccgaatctctatggattgaatccggaatccggttattttataggtgtagacatcaaaagatttgcagtcaatatcggactgatcaattttaaaggtgatatggtagagttaaaaatgaatatcccctataaatttgagaattcgatagaagggatgaacgagttgtgcaaactcattctcaacttcatcaaaaaacttcctatcaataaggagaagattttaaatatcaatgtaaatgtatcgggacgggtaaatccggaatccggatatagtttcagccagttcaattttgaggaacgcccgttggcggatgtcctgtcggaaaagctgggtcataaagtaaccattgacaacgacacccgtgccatgacttacggagaatatatgcaagggtgtgtaaaaggagaaaaagatattattttcgtcaacgtcagctggggagtcggcatcggaattattatcgacggcaaagtctacacaggaaaatccggtttctcgggagagttcggtcacgtcaatgcatacgacaatgaaatcatctgccattgcggcaaaaaagggtgtctggaaacagaagcatccggctctgcccttcatcgcattcttttggagcgtattaaaagcggagaaagctctattctttccacccgaatatccggtgaagaagaccccatcacgcttgacgaaatcatcacagccgtcaacaaggaagatctgctttgtattgaaattgttgaagaaatagggcaaaagctgggaaaacaaattgcaggattaatcaatatcttcaatccggaactggtcattataggcggaactttatctttaacgggagattatatcacccaacctatcaaaacagcggtacgtaagtattcactcaatctggtcaacaaagactctgccatcattacatccaaattgaaggataaagcaggtattgtaggcgcgtgtatgctggcacgcagcagaatgttcgaaagttaaactaccgttactttatgcaaagagttatggtaaaggaagattttaaattaaagctcaaaaaatattcagaatccttttgttttctcaaataaagctgtaattttgcacgccgtaaacgagaaacaaaccgccgctatagctcagttggtagagcaacgcattcgtaacgcgtaggtcgccagttcaagtctggctagcggctcttgacaataaagcgctaactacagaatagttagcgcttttcttattaacccccaaagcaaatcgcatgaaacgaggtaagagcaggagattatttaagaaaaagaagtcacattccaatcaaagattagggtgtatcatcgctatcatcgtacttattcccatttgttacgggctttatctgtattatcagcaatacagtgtccagcacagtagcaaaccgcagatagagacttccgtttccctccccactccatccggcaaagatttagagattcccatttcattgattccccgtcaggagcagatcattcgtcataaaggttatacggtttcctacaataaagatctgaagattccgaattgggtttcttacgagctgacccgtcaagaaaccaaaggaaaagaaaagagaggtgacaacttcatcgccgatcctttagtaaaaggcgccattgcgaccaatgcggattatgcacgttcaggatatgacaaaggacatatggcaccagccgccgacatgaaatggagtccggatgtcatgaaagaatccttctatttcagcaatatgtgtccgcagcatcctcaactgaacagaagaggctggaaaaatctggaagaaaaaataagagactgggcggtagccgatagtgccatcatcatcatatgcggtcctatcatcgacaagccgtccaagaccatcggaaaaaataaggtggcagtgcccgaacgattcttcaaagtaatcctctctccttttgtcaaaccggctcgtggcatcgggttcttattcaacaacagacaggcggtagagcccctttccacctatgcggtatcaattgacagcatcgagaaacttacccatatggacttcttctctcccctgcccgatgaattagaaaatgcagtagaagccaatgccgattattaccagtggccacgctaatagttgacaaaatcagccgaatttcaactattcaccgttgaaaggaatcgctcctatccaaaatcttcctatctttgacgcaatttttaaagttacgtcacaagatgaaaaagaaaacaagaaatatcttattatccgttctgaccggagctctccttctttgcgccattgccggaggaacagtctattattatctctttgctcctcagtttcatccctccaaaaccgtctatgtatatgtagaccgggatgacacggcagattcaatctacaataagatcagacaaaccggtcatgtcaacaaattcaccggatttcaatggatggcgaaatatagaaaattcgaccagaatatacataccggacgttatgccatccgccccaacgaaaacgtataccatgtattcagccgcttcttcagaggttatcaggaaccgatgaatctcactatcggaagcatacggacactagaccggctggcgcgaagcatcggcaagcaactgatgatcgactccgccgagatagcccgccaactattcgattccgcttttcagaccgaaatggggtatacgccggtcaccatgccctgtcttttcatccccgagacctatcaggtatattgggatatgagtgtcgacgacttcttcaaacgtatgcagacagaacacaaacgattctggaatgacgaacgtcttgcccaggcaaccgctatcggcatgacaccggaagaagtctgcaccctcgcctccattgttgaagaagaaaccaacaacaacgaagaaaagccgatggtagccggactatacatcaaccgcctgcacacaggtatgcccctgcaggcagaccctaccatcaagttcgctttacaggatttcgggctgcgacgcatcaccaatgagcatctgaaagtcaactcgccctacaacacttatatcaacagtggtttacctccgggacctatccgcatcccctctaaaaagggcttggacagtgtattaaactacacgaaacacaattacatttacatgtgtgcgaaagaagatttttcaggtactcacaatttcgcatccaattatgccgaccacatggcaaatgcaagaaaatattggaaagcacttaatgaaagaaagattttcaagtaattttgtgataaaacgagccaaaaaggctatctttgcccgatataataacaaactgtgatcaacactaataaaggaaatatatgagcaagcaactcttacttggcgatgaagccattgcacaagctgcactggatgccggactttcaggtgtatatgcctaccccggtactccttcaactgagattactgaatatatccaaatggcgcctataaccactgagcagaacatacataatcgttggtgtgccaacgaaaaaactgccatggaagccgcactgggtatgtcatttgtaggcaaacgcgccttagtgtgcatgaagcatgtaggcatgaatgtggctgcagactgtttcgtcaattctgccatcacgggtgtgaagggaggactgattgtgatagcggcagacgaccccagcatgcactcttcacagaatgaacaggacagccgcttctacggagacttctccctgataccgatgtacgagcccagcaaccaacaggaagcatacgacatggtatacaacggattcgaattctctgagaaaacaggcgaaccgatcttaatgcgtatggtcacccgcctcgcacactcccgttccggagtagagcgcaaagagcagaagccacagaacagcatttcattcagtgaagatccccgtcagtttatcctgttgccgggaaatgcccgcaaacgctataaagtattgcttgcccgccaggacgaattcatcaaagcttccgaggaatctccttacaacaaatacatagacggccctaacaaaaaactgggaatcgtcgcttgcggtatcggctacaattatctgatggaaaactatccggaaggttgtgaatacccggtacttaagatcggccagtatccattgcctaaaaagcaattgctgcaattggttgaatcctgcgacgagattctggtactggaagacggacagccattcgttgaaaaacatctgaaaggctatctgggcattggtatcaaagtaaaaggacgtctggacggcacactatcacaagacggagaattaaatccggactctgtagcacgcgcggtcggcaaagaaaacaaatcggaattcggcgtcccttctgtagtcgaaatgcgtcctcccgcactgtgtgaaggatgcggacaccgtgatatgtacatcacactgacagaagtactcaaagaagaatatccttcccataaagtattcagcgacatcggttgctatacgctgggagccaacgctccgttcaacgccatcaattcatgcgtagacatgggagcttccatcacaatggcgaaaggtgcggccgacggaggtcttcatccgtccgtagctgtaatcggtgactctacatttactcactccggaatgacaggtttactggattgcgtcaacgaaaatgccaatgtcgttattgtcatttcagacaatgagacaacagcaatgaccggtggtcaggactctgcgggcacaggacgtattgaatccatctgtatcggtttaggagtcgaccctgcccatatccgtgtcgttgttccattgaagaagaaccacgaggaaatgagacagatcatacgcgaagaaatcgaatacaatggcgtatccgttatcatcccgcgcagagagtgtattcaaacattagcacgcaaaaaaagaagtaagtaagccatgaaaaaagacattatattatcaggagtaggtggacagggtattttgtccatcgctacagttattggtaaagctgctttgaaagaaggactttacatgaagcaagcagaagtacacggaatgagccagcgtggcggagacgttcagtccaacctccgcatcagcgacaaaccgattgcttcggatctgataccatccggcaaatgcgaccttatcatttcgctcgaaccgatggaaggtctgcgctatctcccctatctcagtccggaaggatggctggtaaccaacgaaactccgtttgtcaacatccccaattatccggaagaagacaaagtaatggctgaaatcaacaaattgccgcataagatcgtactgaacgtggataaagtagccaaagaagtaggttctgcacgagttgccaatatcgttttgctgggcgcaaccattccattcctcggcatcgattacgagaaagtacaagacagtatccgcgaaatcttcctgcgcaaaggagaagctattgtcgaaatgaatcttaaagcactggctgccggcaaggaaattgcggaaaagctaatgcaataactatcacaatcatgagtacacaatactgggaagaagaaattgaaatcatgagtcgcgagaagttgcaggaactgcaacttcagcgactcaaaaaaacgattaacatagccgcaaactcaccttattacaaagaggttttcagcaaaaacggcatcaccggagatagtatccagtcactggacgacatccgcaaaattcctttcaccactaaatcggacatgcgtgccaactatcccttcgggctagtggccggcgacatgaaaagagacggtgtacgtatccactcttccagtggaactacaggaaaccctacagtcatcgtacattcacaacatgacctcgactcatgggcaaatctggtagcccgttgcctttacatggtggggatccgcaagacagatgtcttccagaacagctccggatatggaatgtttacaggtggattaggttttcaatatggtgcagaacgccttggctgccttaccgtacctgccgcagccggaaacagtaaacggcaaattaaattcatcagtgactttaagactaccgccttacacgccatcccaagctacgctatccgtcttgccgaagtatttcaggaagaaggtatcgacccgagagaaacaaccctgaaaaccttggtgatcggcgccgaaccgcatactgacgaacagcgccgtaaaatagaacggatgctcaatgtgaaagcatataatagtttcggtatgacggaaatgaacggccccggtgttgccttcgaatgccaggagcagaacggaatgcacttctgggaagattgctatctggtagaaatcatcgatcctgaaacaggagaacccgttcccgaaggagaaatcggtgaattggtactcactacacttgatcgtgaaatgatgccgcttatccgctaccgcacccgcgaccttacccgtatactacccggaaaatgtccgtgcggccgcacccatctccgcatcgaccggatcaagggacgcagcgacgatatgtttatcatcaagggagtcaacatcttccccatgcaagtcgaaaagattctggttcagttccccgaattaggcagcaattatctgattacgctggagacagtcaacaatcaggatgagatgatcgtcgaagtggaattaagcgatctttctacagacaactatatcgaactggaaaagatccgcagagatattatccgtcaattaaaagatgaaatactggttaccccgaaagtaaaactagtaaagaaagggtctctcccgcagagcgagggaaaagccgtcagagtgaaggacttaagagacaacaaataaatattcaaatgcccgatgtgctaatatgccaacccaatactgtatgatatcagtaacaaatggcatattagcacattatttaattatcagattataatgcaattactaaaaaaaagaattctgcaggacggaaaatgctacgaaggaggcatccttaaagtagatggttttatcaatcaccagatggatcctgtcctgatgaaatccatcggagtagaatttgtccgccgctttgcagccacaaacgtaaacaagatcatgactatagaagcaagcggtatcgctcctgccatcatgacgggctatctcatggacttaccggttgtattcgccaaaaagaaatcacccaaaaccattcagaacgcactaagcactaccgtacactcgttcaccaaagaccgtgattatgaagtagtgatcagtgccgattttctgactccaaatgacaatgttctttttgttgatgatttccttgcctacggaaatgccgcattaggcattctcgacctcatagagcaatccggagcaaaattggtaggcatggggttcattatcgaaaaagccttccaaaatggacgtaaaatactggaagagaaaggtgtcagagtagaaagccttgccataatcgaagacttatccaactgctgtattaaaataaaagatcaataagctgagtcggggttaaaataatgccccttgccttttgtctttttaccatattgcaccgcatgctgagggcacacatgataacatgccaggcaggcggtgcaattctttccccaaaccggtcttctttccttcatcgttatattccctaccggacaacttttttcacagcgcttgcacccgatgcactcactcgttgcatggaaaggtttgggagacatctgataacgaacaaataacggattgatgatcctcgtcttgataaaaggcaaactcccctccttgcatgcaaagacagtttctctcccggttatcagtctactgactttttcaagagccggaaccgcttctgccagttttttcttttccagttccttgctatccacatcaaatccgaggaacaacacatagttattgggcataattacagaaaagcctgcattacatctccatcccctcgcagccaatgccttttccatcacctgccgggtcagccccgtatcgtctccacacgaacacacaaagaacagatattgctgctgataccccttcagaaccagcttccgaataaactcctgtacaatcacgggaggcgcccacgaatagaccggaaagacaaaaccgatcttctcatcctcccgcaaagagaactcccatgtgtcattcttccatgcgtccgggataaaaaacaaatcttcctgttgttctttagaaagctgattagcaatccatttagagttacctgtacctgagaaataaaatatcatagaagagtatataaaaaagccgcatcgacgatgtgatgaaactctgatagaacaagatttgagcgctcgccctctttgtaatccaccggcttaaagctgtcccgaaggatgtggcccgccattgaagaacgaagctttctcggtgcatcagattaatttgaagagtttcccgatccagtcgatacggctaatatttttctatcacaaatgtaataagattctctgagaatagcaagaaaaagaaagaatttgttcgtccactaacattttttttcatcctttctctccgcctaacaaaagaaaagtgccagttatcggatcgataactgacactttgtaaatcctaaactattgaaacttaagcagcttttgctttagcaactacagctttgaaagcttccggatgattcatagctaaatcagccaaaaccttacgatttatttcaataccggctttgtgcaaaccgcccatcaatttagaataagacattccttcaagacgtgcagcagcgttgatacgttgtatccaaagagcgcggaagtttcttttcttatttctacggtcacggaacgcgtaagtcaaacccttttcccaggtgttttttgctacggtccatacattttttcttgcaccaaagtaacctctggttaatttcaaaattttctttcttcttgcttttgaagcaacatgatttactgatcttggcatagttttactttttttgaatgttagcgccgttacttcacgcaacgaacttcaggctaaagcattcggttaatactttaataatactttgtacgcttttgattacttcattgctaagagttccttaacctggcttacatttgttgtatcaacagttgtagagtagcacagatttctttttctctttttcgatttcttagtcaaaatgtgactgtgaaaagcgtgctttcttttgattttacctgttccggtaagggtaaacctttttttagaaccggagttagtcttcatctttggcatcttacttgtttttaaaattattaaatatataatggtgacgcactatacctgcgcgccacgcattcattcttttttattcttcctcgcccgcttccggcttttcagccttctgtccctgagttaccggtttggaagccgccggttttttaggcatttcctttttcttcggagaaagctggattgtcatacgcttaccttcaagtaccggcatctgatccacctttgcaaaatcttcaagatcgttggcaaaacgaagcaataacacttcaccttgttccttgaaaaggatggaacgccccttaaagaatacatatgccttcactttatccccgtcttccaggaatcctctggcatgtttcagcttaaagttgtaatcatgatcgtcagtctgcggtccgaaacggatttcctttacgttcacttttacctgcttcgctttctgctccttctggcgtttctttaattgataaagaaatttagagtaatcaataatacgacaaacaggaggttgagcattgggggaaatttcaactagatccagctctttctcttcagccattttcaaggcctgaaagataggatatactttcggttcaatctcgtcgcccacgatgcggacttctttggcacgaatctgttcattgattctatattgcccttttaaagtgtcattcttcattaaaaacgtttacttcctagtttgatttttttattgttctactaaatatttatcatgaaacggctgcaaagttaccatttatttatcatattctgaacttcttcgttcaaaattttagcaaattcttcatatttcatggttcctttgtcgccttccccttgtctgcgaacagaaacttcaccattttcagcttctttttcacccacaatcaacatataaggaatgcgtttcatttcattatcacggatcttgcggccgatcttttcattacgatcatccacaatagcacggatttcatgcattttcagatacatcttcacttgctctgcatactcattgaacttttcactgatcggcaggatagctacctgatccggagtcagccacaacgggaacttaccggcagtgtgttcgatcaatacagccacaaaacgctccattgatccgaatggtgcacggtgaatcatcaccggacggtgcttctggttgtcagagcccatatattccagttcaaaacgttccggcaagttatagtctacctgaatggttcccaactgccaacggcgaccgatggcatctttcaccataaagtcgagcttgggaccatagaaagcagcttcaccgtactcaatcttagccggcaggcctttttcctcgcaagcctcgataatcgcctgttcagctttctcccagttgtcatcgctaccgatgtatttttcacggttcactttatcacggagtgatatctgagcctcgaaattctggaaattcatcgaacggaacacgatagaaatgatatccatcacacggaggaactcatctttcacctgatccggacgacagaaaatatgtgcgtcatcctgagtaaagctgcgtacacgagttaaaccgtgaagctcaccactttgttcataacggcaaaccgtaccgaattctgcaatacgcaacggaaggtccttgtatgaacgcggaaaattcttatatatctcgcagtgatgcggacagttcatcggtttcaggaaatactcctctccttcttccggagtatggatcggctggaacgcatccttaccgtattttgcatagtgaccggaagtcacatacagcaacttattaccgataggcggagtaattacttcctgatagtcatagcgggtctggatacgacgcaagaactcttgcagacgcaaacgcagtgcagtacctttcggcaaccacatcggaagtcccttacctactgtttcagagaacatgaacaactgcatttccttaccgatcttacggtggtcacgtttcttggcttcttccagcaacaccagatattcatccagcattttctttttcgggaatgtgataccatagatacgggtcagcatcttacggtcttcgtgaccgcgccagtaagcaccggcaacagttgtcagcttgatagccttgatcggcgcagtcgtcatcaagtgaggaccacggcaaaggtcagtaaacgcaccctgggtgtaggtagtaatatgtccgtcttccagttctgagatcaattcacatttatacgtttcgccacggtcgccaaacattttcaaagcgtccgtcttcgaaatactttctctgactaccgcatctttctttgccgacaattcaagcatctttgcttcgatggcaggcaggtcactttctttaatcacagcttctcccggatccacatcatagtagaaaccgttttcgatagccggtccgataccaaactggatacccggataaagttcctgcaaagcttcagccagcaagtgggcgcttgtgtgccaaaatgcatgtttgccttcttcatcgtcccatttgtaaagtacgaaatcagcatcttcattaataggacgtcctaaatcataagtctcaccgttcacgccacatgcaagtacatcctgtgccaagcgcgaactgatactttctgcaatctgtaaaccgttcactccttcgttatactcacgaacggagccatcgggaaatgttatctttatcataatatgatga

SEQ ID NO: 206 - DNA, 12391 bp, Bacteroides thetaiotaomicron
ttgctgttctttatactggcagccagaccagctttaaaggtttgtttatctctttattttcaatactcaaagatagcaaatttctataaatgtcgcaaataataagacaattatttttgttaaaaatagtttataaacaactgattttcaacgtattatctttttccctaaagttttatatatttggggtaagagattaggttttataaacggaatattccctttagggaacatgaagtctataaaaccgaatatccaatgccttgtttttgtaggtgcttcgtagaagcggtggaaaaagcaaagcattggatataccttagaagggtgggtgggaaaaatgcgttagggattgtagcgaaaagcccacagcacagcgaggacttgcagcgaaaagcccgacctgaaaggtaacgccctatttatttcttctattcatcaatcttactttttcataacgtaaatacctatacaaagtagccttacttccaatgtgtaatatcctgcatatttcacctatagaataatcccgattttcatataaacgttttgctgctatagcctttctttttgcatcttccgataatcctataggtcgtcccgtaagtttccctcgttcttttgcagcttgtaatccagccctagttcgttctactattatttcacgttcatattctgccaatgaagcaaaaatcccaaattgacaccttcctaaagcactattagtatcaataccatcaactatgcttttgaatgcaacttttcttttctgcaaacaatcaactatataaactaaatctttcaaagaacgtcctaatctatctagcttccagataacaaaagtatcaccttctcgcaaatacgcaagggctttatctaattcgggtctatcttttactcctgatactttttcctcaaatataagtttgcatccggcttcttttaaagcatctagctgcaaatctaaattctgttccctcgttgaaacacgagcgtagcctattatctccattttatttaaatccaagtttcattaattcaactattcgcgaaactattttaaactagggctttttcccctgttattacctctagtactattataaatcaaaagtacagaaaaagggtcgattaatgaaacttttaaatttaagaatatgagttattcacaatttatcatggctgtatttgccatttatgtagtttactacgctgcaaacatcctgtatgatgctttcctaaagcaaagcaaaaccaatacaggtgaagaagaagaaattatttcaataggagaggaagaagaaatacctcacaaagttgtagatgaagattttgaaacaggctcatacgaaaaagaggatgaaaaaaaagaatctgaacaaaattatgtatctgtaaatgaatctattgaaatggatgttgaaacacaaggtattccaatggaacaacttcttgctaaagggaaaagtatgttttcacacgtaaattttaataaataaacaaccaaattttattcaaatgaaaaagtttttttcaaaaatcgctcaaagagcattcgctttagccattagcacaatggtagtaactaacacttttgcacaaggtgctgccggaattgatgcagccagttctgaacttgcaacctacatggaccccctaggaaacatgatgatgatactaggaggtctagtaggattagttggagcagtgcgagtttatttaaaatggaactctggtgaccaagatgtacaaaaggctgttatgggctggatggggtcatgtatctttctagttgtatcaggtgttgtcgtaaaagcattcttcggaatctaatatgtcgaaagagtatccaagttacaatgtgtataaggggctgcaaaagccccttattttcaaaggatttaaaggcaagttcatatatatcggtggagcttgtattattagtgctttacttttatgtgctattgtttctactctggcttcttttatgtggggaggtataactcttgtaatagttatgtttggagggttaggaataacatcgcaattacaaagaaaagggcttcacaggaaagataaacgaaaaggcatatatatagtatcacgcacttttgtaagagatagaaaaaaataaagcttatgaaaaagaaaagtgaatttgaagctccttatattggtattgaaacaatagacaatactcctatattctataaccgaaggggcgactattctgttatcattaaatgtgaaaatcctataatacagtattcagcagatatggatgcttactatgattttcaccacttatttactaatatcctcaaagtattaggaaccggatatacaatacaaaaacaggatattctatgtaaaaaatcatttttaccaccccagaataggaagaacgactatttatcaaatcgttattttgaacattttaagggacgaatatatactgatatttctacttatcttgttattacaggagaagtagaaaggtctaaattcttttcttttgacccccgaaggtttgatacttttattagaaacatcacaaaagtattaggactattcgctaacagaggaataagggctaaactattaaatgaaaatgaaatagaaatatatataaaaagatttctatctatcaatttcaatcagcaaacagtaagcctaaaaaacatcaaagcgagagaagaaaatcttataataggagaaaaaaacgtacagtgcatttctcttgtagatattgacgaagttaatttcccttctgttataaaaccatataaagaggtcaatattgggctaaggtttcctgttgacttactttcttttttgcatgagacgccaagtatagacacaattatctataatcaagtaataaatattccagaccaacgaaacgaagcaaacaaattagaaggcaaaaagaaaaaacataaaggaatgcctgaccctgcaaatgatttatgtgtagaagatatagaacgagtgcagtcggatattgccagagaagggcaaatgcttgtatatgcacattataatatcattcttgctggtcttgatgatattagtaaggctgtcaactatgttgaaacatctctttttgattgtggtattattgtgaataaacaatgtttcaaccaattagaattatttgaatgtgcactgccgggaaacgcaatcaacctaaacagttatgacaaatttctaacaacttccgatgctgcaatttgtcttttattcaaagaaaaattacaagtaacagaaaacagtccttttcttacttattttactgacagacaaggattgcctgttggaatagatatgtccggaaaagaaggtgagaaaaaatatacaaataactctaacttctttgttttaggtccaagtggttctggtaagtctttctatgtcaactccaaagtaagacaatgggttttagataatactgatattgtattggtagatacagggcatagttattcaggaatgtgcgaatactatcatggcaaatacattacttattctgaaagcaagccaatatctatgaatcctttccgaattactgaagaagagtataatgtagaaaagaaaaactttcttaaatcattaattttcctgatatggaaaggtgcaaatggtgaggtcaaaaagcaagaagaagaaattatggatattaccatagaaaaatactattctttctactttcatccttttaatggttattcagatgcggaaaaagaagccatacgtgaaaatttactactcgaatttcaagtcaatgaagaagaatttgaaaacgaaagggaaaaagaagaacgcaagatactttccgaaaaaatagagaaattacagcaactagtagaaaaaggagaaggcggagaaaaaaccaacgcagaaaaagcgatacaaaacattctcatcgaaaaaggatttacacgccaagagcttgataatcctgaaactagattactttctataatagaaagacgaatccagaagaaagaagatatattgaaagaaataaaagttgaaagcctatcttttaactcattctacgaattttccctacgcattatacctatcatttgcaaagagaacaaaattgattttgatattactaactataagtttctattaaaaaaattctataaaggaggacagttagaaaaaactcttaatgaggattttgatacttccctttttgaagaaccctttatagtttttgaaattgatgcaattaaagatgaccctgaattatttccaatagtaaccttaattattatggacgtttttattcaaaaaatgagattaaaaaagaacagaaaggcattaataattgaagaagcatggaaagccatagctagccctatgatggctggctatatactctatttgtataaaacggttcgtaaattttggggtatggcaatggttgttactcaagaactggaagacataattagtaatcctgtagtcaaaaactctataatcagcaactccgatattatatgcctattagaccaaagtaaatttatagacaaatatcaagaaatagcaaatcttttatccctaacggaagtaaatcaaaagcaaatatttaccataaatcaacttcccaataaagaaaaccgtaatcggtttaatgaagtatttataaaaagaggaaactatggaaatgtatttggagtagaggtttctctgcacgaatatttcacatttactacagaacgaatagaaaaagatgctgttggatattatcatatcatttatgatagtttccaaacaggattggataattttataatagacctaaaatcttccaaattaaaaaatacggattgggttttacaagtcaataaggtactagggtatcactccgatgaaggaagcctaaaagatatacttaacatcataggagaacaaccattatataagtatatcctagacaaatacaaaaggattacaaaccgttaaagataatatcatgaagaaaatcctatttattttagtggtagcatctactttaacccaagttgcatattcacaaaaggcagtcttggatataacctgtatggaaacacttatagctaatcataaggtgcaacatacttctttctctaaagtgaaagagaatgaagctcaaataagccttatacaaaagcaaatcagtgaaaaaatggttcagattgaatttttccaaagcaaattttataatagcctaaaatctgtagaagccatcataaaaacaggaaaagatattatctactgtactgatattgcagcagatattggtaaatatcaaaaacaaatggttgaacttgctgtaggtgacccggctttattattggtgtcagcaaaaacagagctagaattagttaatcgtactgcggatttgacacaatacatttatcaggtcgctattgtcgggacagatgtaaaccttatggacaataagcaaagaatagacttgcttaagtatgttattaatgaactaagaaacatgagaggtatagcatacgctgtatgccgacagatgaaaacagcaaaaagaaatggagtattacaaacattagctccgggagtgtttaaatacaaagataatcgttcaaaattagttgatgatttattacagaattataaagtaaaacctaaaagataatatgaaaagagtgcttttatttttttccctaatgttgattattggtacttctaatgtctattcccaaatgcctgtaaaggataaagggaaatggagcgtacttaataatatggaatttatggatagagtacgactacaaccagaatggtatcactactggatatggtataaaaaggttttgggtattaaaattcctttgccgggcttagggttacacgacaaatacggaaaggaagatagacgtaatttccagttacaagaaattcccatgatggcagccgtagagtacaataaatcagaaacagaaaaagaagggtataatgtcgataccatatatagacaggaactcttcaaatttggagataaagaaattgattatcaatatactttaactaaaaatcgcagaaatgatattcttaatgatataaataaaaaacttgtcgaatattcttctaatggcggtaataaagaacacgttgaagttataactgatgaagttactagaatcaaaaagaacatagatataatccatgattcacatatgagtaactctaaaaagagagaagcctatttaggttttgataaagaactaatagaagttctttcattaataacaagattgaataatataaataaaacaataatgagccatgaatgagttaatagataaattcttatttgaattatttgatggactaagagataaaacaactgttctgttcggagaatttattgcggatgcgcaagcattggcagcaatctttatgttattatattttggagtagaaagcttcaaaatgatgagtggagataaaaaattagagattatcccattattgcgtccattcgcactgggattggttcttatgttctggattccctttattaatctaatcagttatcccggagaattattaacagcacaaagcaaggctatgtttacgaaccagatagacgaagtagaattactttctcgtaatagatatgcactcattgatagcgtagcagtagagttattacatacttcattagaagttgaaagagccgaaaatgaagttaaggataagaaatggtatgattttagtatagacttttcagctattggagacaagatagctggattatatgtatatgtagtcgctaaggttaaaatgataatgtttaatatcattgaatttattgtcgttactttttggcaagtatgtacctattttgtctttttcctacaaatcatattcacaggaatattagttattcttggtccactagcttttgcattctctgttttacctgcatttcgggatgcttatatacaatggatagctcgttttgtcagtgttagtttatattcatgtattgcatatatagtattatcaatttctttagtagtaatgcaatatgggatagaaagagaaattgaaattttagaatatgcgcttagaaatgaagctgcatttgtcatgtatgtcggaatgacctctggaggtgtcaatagcttccttcttacagcattacttggagcatttgccatgcttacaataccttttgtttctacatggattgtaagtacaactggagtagggcaagcagtaggaggcatggttggaggagcagccatcgcaaccaaagctgtagcagctccggctacaggtggagccagtgcagctatgtaaaaagattcattaaattttaaattcacataatcatgattattaaaaacttagaaaataaaatcaaattagccggaattttatccattggctgttttgcaactagtatagttatttcaggtatggtactagccttttgtttctctttagtgaaagctgaaagaaaaaaaatatatgttttggataatgatgtccctgtactagtgaaacaaactggtacagaagtcaacttggaagtcgaatgtaaaagccacataaatctattccacactttatttttcacattaccaccagacgatgaatttataaaatacaacatggaaaaagccatgtatctaattgatgatagcggattaaaacaatataataatttaaaagaaaaaggatatttcaacaccatattagcgagttctgcaacagtaacaattatgacagatagtatcaaggtggacatgaacaacctatcttttgaatactatggcatccaacgtatagagcgagaaacttctattctaaaaaggcaacttgtaactacagggaaattaagacaaattccacgtactgaaaataatcctcatggacttattatcacagattggaaaacgatactcaacaaagacctagattataaagtaaaaaagaatttctaatgaaactgtttaaacataaaaagaatgatagaaaagaaagtatcaagactaaagccgaacaagctacagttgttcttcttactaaaatatttcaaaagttcggagttaataacgcttgtgaacgcttattagcgtgggctgccatacaccgtaaagccatgtttggaattacgatttcattcctttctttcgtcacaattctatcattagtaatgcgtccagaaagaaagccaatgcaagtcttcaatgaagaaaaaagcaaagtacaaattaacattgatagtaacctacaaaaaaaacaagtaggagttcacgacttgttagaagtgattaaaatgcaaaatgaaattaatgagctaagaaaaaatgggaaattaactccagaagacacagtacgaataaaagatttatacaataaattaaataaatagcgtatgaaacagattgatattaaaaagcctaagtacatcattccgatactcattctaccttttattctagggataggatggctagttaaggatatgataaactctgccccagcagaagaaactacattagtagaaacggaagaattaaatcttgatattcctgatgctaatttagaaaaaagagagataaaaagtaaatttgaatcactcaaaggagctttcaataaatcttctgattattcatcaatacaaaccatagataaagaagaagaagttagcgaaattgaaagttctggttctctttactccaatgatgaaataaggcaaattgacagtttaaatcaagcttctagaatccgggaaaaggaattggaacaacaaataaaaggatttcctactatagatgaatcaagtcaaatagaaactagaaaagctcctgaaaaatccaagatgcaagaagaaatggagctttttaaaatgcaaatggcttatatagattcattgcaaaatccacgtcctagaacacctcaaaaaaaacaggatgaaaagccaaaagaaatggctatagaagttgtaaaagcgaaaaatcccgcagaagtatattttaatactgtagggaaagaacaaaaaacttcactaatcacagctatattagatgaaactctaaaagtaacagatggtagccgagtacgcatacggcttctagatgatataatgattaatgatgctcttttaactaaaggtacttacctatatgggaatgtatctggctttaaagcccaaagagtacacattaatatttcctctataatggttgatggcaaacaaatgaaagtagatttatccgtatatgataatgacggacaagaaggtttctttgttccttcatcagcttttagagatttgagtaaagatgttggagcgcaaataggaagccaaactatacaaatgaacagccaatcagaaggagtagaacaattcgctttaggtgctttacaagatgcttaccgtagtacaacccaagctctttccaaaaacatcaaaaaaaacaaagccaaattaaaatataacacacaagtttttttagtaaacaacaaagataaagaacaataatatgagaaagatttttattgcattatgcacaatgatttctgttattacaggaaatgcacagaacacccctattggagaaaacatcgagcttgcaggtgaaaacccagaagaactaaaggttatatacgtcaacaaagatgtttcaacgcattttatagctatggaagatataaaatatgttgatatatcagtcaatgatattgttggcgatattcctactggtaactctcttagaataaaacccacaaaagaaggagctagtggagttatcaccattgttacagaaagatttttcgtacaatatatgctagtatatagtagcgatttagcaaaagcatacactcgctttaatatcccttatgctgatttacgtagctatatgaatccagaagtgaacttaaccaaagcacaaatgtatgattacgcacatagaatgtttatttcaaaaaataaattctatgatgtttccagtaaaagtaacctaatgaaaattgtactaaacaatatctacacattagataagtatttctttattgatatttctatgattaataaaacaaaaatacgatatgatatagaccaaatacgcttcaaaatagaagataaaaaacaaacaaaggctactaattttcaatctatagaaatacttccattgatgcaagttaataagaatcttgttttcaagaagaactatcgaaatatttttgtctttgaaaaatttactttcccagacgaaaaagttcttaccatagaaatatctgaaaaacagatttcaggacgtactataacattaagaattgattatgcagacattcttcatgcagatgcttttactgaataaaattttacgattatgaaaagaatagcatttcttgttatcaccttattttttttcctaaagtcaatggctggtgatggtgataagttttttaatatttcaggaggttggcaatggaaaaataccgtcaatgcagttgtagggctggagtttgaaggtaaatatcacaatgcttatgaactatatattgatttagctacagcatatgataaatgcccggtatgtaataaggtatgctctgatagtttctggagctataaaacattcggcataggtgcagcatataaacctacaatctcacgaggcaaaaacagtaatttaagatggaggtttggagctgatttaggagctaacagaaaagggtttcaggcttccattgatataggtttagaatatagctattcatttagaaatggaatgcaagtttttgtaatgcaaaaaaatgattttgtattttggacacgtgaccatttccgaaatggattattagtaggtgtcaaatttccaataaataaataagtatgaaaaaaatatatataattctattatccattataggggtaatatcatcatgtacaaaacacgaagatattatagacacatcattacagccgggtagtatcttatgtagtgatggaagtatagtgcatccctcgcttttttcacccagtgaaaaagaagccattggagttgtattttggtgtaatgatgggaataatccaaatataaaagaaaccgcttatgccgtttcattagaagatttagaagaaaatcctttaatagacacagacgaggatatagctaatgtttcggaagatgaaaacagctttgatggagcagctaatactgccgcaataatgaactttgctataaaggatagtttagcttatccagcagctcaaaaagctatagaatatgcgccaaaaggtgttacaggttggtttattggctctatcgcacaaaacaaagcaatctctaataatcttgaaaaggtatattcttctttctcaatcattggaggaacgcactttgatggttggtactggagttctacagaagatggagcaggaaaagatactcctaaagtgtttgcactaatttcttcattaacaaaaggaagagcaaccagtacaagcaaaagaaattcatttaaaatcagacctattatagcaataagataatcatgaaaaagaaaataattatactagcagccttcgttattacattttttaccgcatgtacttcaacgcatatgataactttcagtaacgctgaactaagcgacaaagaaaaagacatgatagaaaataatagcaactattcaaccgcttcaatagttggtggaagtgcaaaattagttaaggaagaaagagataaagctatccaagaaaagatagaagctagaagaaataaactaaaagctattgatggcttatcaatctccagctataaggataaaaatggaaaagaacaatttaaagcaacagctcaaagtgaaatcttattcaaatttgattcatatgaattaaatgaagaagctcaaaaaatgctttctaacctatgtaatatcattactgaaatacccaatactaagattaaaataattgggcatacagacaatataggagaaaaacaatacaatatcatactttctaaaaatagagcagcagcagtagggaattaccttagaaccgctggtatagaaacaaacaacataacagaagatgggaaaggatatagcgaacccattgcagacaatacaagtgaagctgggcgtgctaaaaataggagagtagaaatatttatcacaaatgatgaatattaaaaagagagattgctattaataaagaccgggaggtaaaactctcggtctttgttttataatctgaaaagaaattgataccgaattttcattcctggcacaccctgtagaacgaccttttgataccaaatacaaaaagttgccggaagccggacacaaaaaattgataccataaaacgatagggaaaaagaacaggaacaa

SEQ ID NO: 207 - DNA, 12145 bp, Bacteroides thetaiotaomicron
taacaaaagtaaacctatttagatattaaagtatattgagtaaactaattcagttataacaaacgaagttgtcaactaaaaccagtacacatcaataacttatagtttcctatcatttcttggaatggaaactgtcgtttcccggtgagggaacgggcgttccttttaatggaaacgaccgttccttttaaagggaactgccgtttcctccgaggaaactaacgcttcatcgaggttgtcaactaaatccaatacagtacagacaacaaaagaggggctatcagacattaacacgctgaatatcaaaccacaacatcaagtaaaaagtgtattaaagcatggatatagagtgagagcaaatgcctgctcccacactgctacaacacttgctacaacagctgtaacaacgatgaataagacgatacaagcaaaaagtgagagcatgggagcaaaacacgtgtttaattcatagtaagcagaaaatatactcgccttgaatctactcttattatttgcctgctattgatgcttcaatcatttgtcttagcaaaccggttgtgcttgattcagcatgaagcaagcattcccggttaccgaacacaaaaaaaagaataccaaatggcacacgaacatccacccctaaatcaatcaatctatctgccatattggcatttttctatcttgtacacttatatattacaggagaaatctcatttcaacgcttgcataccatgcatatataaaatcactgttaaatcactgctaactctcaaacaaaaacatctcccgtctgttacatacccgacttgaatatagtaacctaaacttttaaattatggctagagaaagcgtaaaaatcttacaaggaaagcttgatgtagaaagcttgatttcacagttgaatgcagcattgtccgaagaatggttggcatattaccaatactgggtaggtgcattagtagtagaaggcgccatgcgtgcagatgtacaaggcgaattcgaagaacatgcggaagaagaacgcagacatgcgcaactgcttgccgaccgcattatcgaactggaaggagtacccgtattggacccgaagaaatggttcgaactggcaagatgcaaatatgatgctccccaagggtttgattctgtaagtctgctaaaagataatgtagcttctgagcgttgcgcaatactgcgttatcaggaaattgctgactttaccaatggaaaagatttcactacttgcgacattgccaagcatatccttgctgaagaagaagagcatgaacaagatcttcaggattacctgactgacattgccagaatgaaaaaatcatttctcgacaagtaatttccgactcgtcagagaatgagcgaaaggcagtcttaaaaagagaatatcaaaacattctctcttcaagattgccttttttcacaaatatatgcgaaaacgaccccgaagtttatactcctttagtctccttttgaacaattttcgtcctgaatggaacaccgcatttcagttgattcctcctacatttgcaaccacacttaatcataagtgcatagaaaataggtataaagagtataaaaagaaaagactatggcaaatcaattatcaagaactgatagttcatccaatcaggatatcagacaacgattcaacgtaaaaaaaacaatcatcggagttattgttttattaataggattatgtcacttacctgaagcgatcctcctcattatggacggcatttctttagatagcatattatatcttatcggcaatatattactctgtctgcttggcatataccaacttaaattccgttccagggaaatgagatatctgctgactaaaagcgtggtcaaagagaagaactattctttcaatctgaaataccttgaaccattgaaagaaatgatcgaatcaggcaatttttctaacaatatcaatattgagaaaggaacaggcggaaatcttcggctggatgtcctcatgtcggctgacaagaaattcgcagcagtgagattgttacagtttatcccttacagctacattccggtcatggatatgcaatatctgcggaatgacaagatcgccgctctggagaatttcctggaacactctaaataagggtccgttttattttatccatccccacttttatgtaatagtgcgataaaaaccaaactattttcaaacaaatcaagaagaaatctttcttttttcgtatttttgtcccaatatgcacttttaattcaagtagacaacgaacatcaacgaaaaagaatgagagtaattgatttaatacataacagcgaaaaaacagctttctctttcgaaatccttcctccactgaaaggtacaggcatcgaaaagctgtatcagactgtcgatacccttcgggagtttgatccgaaatatatcaatatcaccacgcatcgcagcgaatacgtatataaggatctgggcaacggacttttccagcgaaaccggctgagaagacgcccggggactgttgccgtagctgccgctatccagaacaagtataatataacggtggttccgcacatactgtgcagcggcttcacccgtgaagaaaccgaatatgtactgctcgacctgcaattcctcaatatcaccgatctgctggtacttcggggagataaggccaaacatgaatcagtattcactcccgagggcgacggataccatcatgctatcgagttgcaggagcaaatcaataacttcaataagggaatctttgtagacggttcggagatgaaagtaaccaacagcccgttctcctacggtgtggcttgctatccggagaagcacgaggaggctcccaacatcgaatccgatctcttctggctgaaaaagaaagtagaagcaggtgcggaatatgctgtgacacagttattctacgacaataagaaatacttcgaatttgtagagcaagcgaaggcagcaggtatcaatgtacctatcattccgggcatcaagccattcaagaagttatctcaactcagcatggtgcccaagacattcaaagtagacttgccggaagatttggtcaaggaggctttgaaatgcaagaacgacaaggaagccgaacaggttggtatcgaatggtgtgtcgcccaatgcaaagagttaatggcacatggagtgccaagcatccacttctactccatcggagcagtggacagtatcaaagaagtggctaaaatcatttattgatatgtttttcagagacgtaatcggacaagaagaaatcaagcaacgactcattcaggaagtgagtgaagggcgcataccgcatgcccaactgatctgtggccccgaaggagtcggtaagatgccgctggctatcgcttatgcccgctacatcagttgcaccaaccggggtgagacggatgcctgcggagtatgtccgtcgtgtgtgaaattcaataaactggtacatccggacgtacatttcgtattccccatcgtgaaaagttctaaaggaaaacgggaagtgtgcgacgactatatcgccgactggagaccattcgttctgaagaatccgtacttcaacctgaatcactggctgagagaaatggatgccgagaatgcacaggccatcatctacgcaaaagagagcgatgaaatcctgaagaaactcagcctcaaatcgagcgaaggaggattcaagatcacgattctctggttgcccgaaaagatgcatccggtatgtgccaacaaattattgaaattgctcgaagagccacctgagaaaactatcttcctgctcgtatcggaagctccggaaatgattctgcctactattctgagccgtactcaacgcatgaacgtgcgaaaaatagacgaaccggccatcgaccgcgtattgcagtccaaatacggtatccagcctgccgacagcctttccattgcccatctggcaaacgggaactttatcaaagcactggaaactattcatctgaatgaagagaatcagctcttcttcgacttatttgtcagcctgatgcgattgtcctatcaacggaaaatcagggaaatgaagctctggagcgaacaggttgccggcatgggacgtgaacgccagaagaactttctggaatactgccagcgcatgatccgcgaaaactttatattcaatctccatcagcgtgatctgacatacatgacaatcaacgaacagaatttcgcctctcgctttgctcctttcgtcaacgaaaggaacgtaataggcatcatggatgaactaagcgaagcgcaactgcatatagaacaaaatgtaaatgccaagatggtatttttcgacttctctctgaagatgatcgtactgttgaagcaataataaatatataaactatggaatataagcttcataatgggagcggcggtctttgctgcaaaggatgctcccgacaagataagaaactgaacacttacgattggctggcagacataccaggcaacgcggaagagtgtgatatggtggaagtgcaatttaaaaacacccgaaaaggctattaccgcaacagcaataagatcaaactggaaaagggagacatcgttgccgtagaagctgctccgggccatgacatcggcgtcgtgaccctgacgggaagactcgtcccgctgcaaatgaagaaggccaacttcaagactgatgttgaaataaagagaatctaccggaaagcaaaaccggtggatatggagaaattcaacgaagcgaaagcaaaggaacatgcgaccatgatccgtgcccgccagatcgcactgaacctgaacctggatatgaaaatcggtgatgtggaatatcagggcgacggcaataaggccatcttctactacattgctgacgaacgtgtggacttccgccaactgattaaggtacttgccgaagctttccgtgtccgtattgaaatgaaacaaatcggtgcacgacaggaagcaggacgtatcggaggtatcggtccttgcggacgggagctttgctgcgctacttggatgacgagctttgtatcggtatctacaagtgccgcccgctttcaggacatttcactgaatcctcaaaagcttgccggacagtgcgcaaagttaaagtgttgtctcaactatgaggtggactgctatgtggaagctcagaagcgcctcccttccaaagaaatcgaactggaaacaaaggacggcactttctacttcttcaaggctgatattctgagtaatcatgtttcttactctacggacaagaacttccccgccaatctggtaacaatcagtggaaaacgtgcctttgaggtaattgccatgaacaagaaaggaatgaaaccggatagtctgctcgaagctgaagtgaagcaagaatccaaaaagccgattgacttgctggaacaggaaagcctcacccgcttcgaccgtaaccgaaataataaggacggaaacaacggtaaccggaacaagaagaagagaaaaggaaataatgacaaccgcccgcaggcacaggccgaaagtggaaatcgtccgcagcaacctcagaggggggagaacgagaatcgtccccaaccgtcagagaacggcaacagaggagaaagaggagacagagaaaatcgtccgagaaacaataacaataataaccggaacagaggacagaatcaaggacggaataatgagaacagacgtccggaaagaggacagaatcaggaacgtccacagaatccgaaccgtccgcagaatcaagagcgttcacaaaatcaagagcgtccggtaaatcaggaacgcaatcaagaacgtaatcaagagcgtccgcagaatagagaacggcaacccaaacaggaacgtcctcaaaatcaggaacgcccgcaggaacaaggaagacaacccaaccaggaacgtattcccagacctgaaagaaattcgaatcaagagaaaccgcaaaataatgaaaagcctgctcaggaatagcttattttgtttattcggtgcctgcctcatggcagcctgtaatgaaaataccgtgtatcactcctaccagtccctgcccaatgagggatggggaaagagtgatacactctcttttcagtgtcctgttacggacagtattcctggtacactcagattatttgcggaagttcgcaacagaagtgaatacccttaccgcaacctttacttattcattcatgagaatctgctcgactccacagtatggcgcactgacacgatagcggtcaacctggctgattccacaggaagatggacaggcaatgggtggggaagtatctatcaaacagcagtttttgtcaaatctgtccgcccgctgcatcccggaaactacacagttaagattgtgcacggaatgcaggatgagaaattaaccggactcaatgacgtcggtatccggattgaaaaacaaggagaatagattaaagccttctgcctcttccggcatccagcctcaggaagataaacaataaaatggtgaatccccacaaggaagaacctccgtaactgaagaacggtaaaggaataccaatgaccggagtcagcccaagcaccatcccgacattaataaaaagatggaaaaggaagatactgacaacggaataaccatagacacgtgcaaaaatggaagtctgccgctcggataaagcaatcagtctcagaatcaatataaggaaagccaacaggacagcagccgaaccgacaaatccctgctcctctcccactgtgcagaagataaagtcagtatcttgttcgggcacatatttcagtttcgtctgtgtgccattcagaaagccttttccagtcaatccaccggaaccgatggctatctttgactgattgacattatatcccgctcccgtcaggtcttcttccataccgagtacaaccttgatgcggatttgctgatgggattccaagatattatcaaatacgtagttactggaatacaggaagccgatagagccaatggcaaacagagcaatcaggaaataggaacgttgacgctctctcaatgccagatagagcagataacctatcacaagaacacaaagcccccattgcacccataccagactaaagtgtattccgtattccgatattaaatatgcgataagcagaatgatcaggcttcctccgataatgttccgtgtgggttcccactttttggggtacacccataccattcctccggcaaacaacagaatcaataacaacacgataaattcgcccaacggtgtgggagtatcggcaataaagacctcgtcaaaacggatgccgacaacaaagtaaatcactgcacacaaaccggcaaaaagcactacaccgggcattccttcccgataaagcaccaaaaagaaggcaagataaactaatgccgaccccgtctcccgctgtccgataatcaggagcatcggaagaagaatgataaagcccaagacgaaggcacacttttctttctttatgctgaatgagtatgagttcatatatttcgccagcgccagtgccgtagcaaacttggcaaactcggcgggttgcaagctgaccggccccatcaccagccacgaacgcgaccctttcgtatccggtgcgataaagatggtaacaataagcagcacaatcatccctacatatataatgtacgcgaacatatcatacatccggtcttccagcatcagcaaaacaaatcccagaccaaaggagcagataatccatacaaactgctttccggcacgggtagagaaatcaaagaagtcacgatcgccatagtcatagctggcaccgcaaacgctgaaccatccgccgacaatcaaaagcagatagataccaatcgttacccaatccagtgttttccacaaactatcgttcctcgttaccatataaaatgattctgttactgatttcttctgctcttaactcattctcgggcgacaacttccctttcatatattgttccatcatcaatgcaccgatcggcactccataagtcgctccccaacctccattctctacatatacggcaatggcgatcttaggctggttcatcggagcaaagcccataaacaccgaatggtcatgtccgcgattctgcgctgttcctgtctttccgcaggcttcaagttccggcaccatcacggacagcatacggcaagtacctccggtggcagcagcacgcattccttctaccacagattcataatgtcttcgctctatggttgtgttgcgtggatgtcgataaatgctatccaactgcgcatcctgaatttccttcacaatatgtggtgttgtaaaatgtccgcgattggcaatcgttgcccctaagttagctatctgaagaggggtagacagaatttcaccttgtccgatggagatactgatgaccgtcagtccgttccagtgtccacgataagccttgtcataaaattgcgcgttcggtatcaagccccgtttctctccgggcaaatcaactcctaacttatagccgaatccctgagaaaccatgtgatctttccagactgtgatggcattctgcggtgaaccgtacttgcgatcgccgaacatacggaacagcccccaacagaaataggagttgcaagaagtcgcaatagccggaatcaatggcaaaggtgagccgtgagcatgacatcccactgtcagacgcccataatggaaaccacgagaacaggggaaagaaggactttgctcggtaatgattccttcttgcaggaaggtcagtccctgtgccgtcttgaaagttgaccccggaggatagactcccatcaacgcacgattgagcaacggtttctgtttatcgcgttgcagcatcagatggttcttgccacgctgacgaccaatcatcagatgcggatcataattcggagaagaaaccagacaaaggatttctccggtttccggttcgatagctacgatacttccaatcttatttttcaataaccgttcgcctaatatctgcaaatcgatgtcgagactcagagtcagattcttgcccggaatggaaggacggtcatactctccgtccatataacgtccctggatacgtccatgcgcatcgcgcaacagaatctctactcccttttctccacgcaggtatttctcgtacgatctttcaactcccagttttcctacataatctccgcggatgtagtatccctcttcatccgcctccatatctttaacggatacctcaccgatatcccccaaagcatgggcggcagcattgtatgaatattgccggatcgtacgccgctgaatataaaaaccgggaaacttgaacagtttctcctggaagacaccgcactcctccgcagagagttgtgacatgaacagctggttggtatatcgggaatatcccggattgcggcggcggtctctcatatcactcatgatcttaaggaactgagcacgagtaatgcccaacgactcacataaatcgagtgtatccagattttcgacctctttcgggacaagagtgatgtcataggccggctggttgaataccagcagtttgccgttacggtcgtaaatagcaccccgtgagggatattgaattttattcaggaaagcattgctgtcggcattcttcttgtagtcgtctgtcgttatctgcaatacaaagaggcgtatcagataaatcaacacaatagttaaagcaatccccccgataacaaatttccgcttttctaatctatagtcttttgccattcctatctccttattccttctacagcaagaatgcaggttaaagtcagaagggtgcacgaaatcacccgcaataacaacagccagatgctggtaaatgagaagaactcaatgctgagtaatgccaggctatggacaaaaacacttgccgtggtatatttcaggaaaggagtgatgcccatgctcttgaaagaagggatgatactgtccagattgtcacgcggagtaaacaggcgcagcaaggacggacgaaggaaagccagcagcacggttgccgcagcattcatccccggagtatcggcaaagatatcaatggttagtccgaagaagaaagcccacaacatcaactcattccgggaagttccggaagcgaatttcagtataaagtaaatgtagagaaagggagtagcatatccggcaatatgtacgttattcaggatcagtacctgaagaagtaccagcccgataaaccatccgattctatgtatataggtaattatcattatttcacagccttattttccagttctttctgttcctgctgaccgttccgggctatcacccgcacatcactcaccttgccgaaatcggtagccaacttgattttcagcaaataagacaatccgtcgtgcgagtcggacatatcatcgactgttcctaccatgattccttcagggaatacggtagagaagccgcttgtcaccaccgtatcacccagattaaactctgcatgacgaggcaaatctttcagatacgcataacgggaatctccatgctcccacttcagataaccaaagtagtcacttccgacaatcttgcaactaatatttgacttgctgttcaataccgaaatcacgagtgaatacgaagaggaggtttcatagacaatgcccactattccgtttccgtccaccactcccatttcgggacggatgccggaagaagaaccctgatcgagcgttatataattatccgcctgattcagactgttcttaatgacgtgtgccttgaacaactgataatctgtcagaggtatctccttgatgctgtttacagtgaccgaatcaacctgatgctcccgcaacgccttttccagattagtgatctgctgttcgagcaccatattacgatccagcaagtctgcgttgaccgatttgagatggaaataagagcttattcctcccgaaacttcataaactgcccccacaacgacattggcagatgtaaaaaaagtactctgctgatagttgttgaaccgaaataacaaaacaaaactggctacctctaatacgatgaagaggaaccagtaattgtatttcaaaaggaagtttattaaattccgcatgaataatgatccgtattatttatctcatcaagaaagagaaacggtctacattctttaatgccacacccgtacctttggctactgcgtgcaaaggatcttcagcaatgtggaaaggtatgttaattttatctgtcaaacgcttgtccagtccgcgaagcaatgcaccaccaccggcaagataaataccgttgtgtacaatatccgcatacagttcgggcggcgtattttccaatgcactcaagatggctgtttcaaccttggagatggatttctccagacagtgagccacttcctgataacatacgggcacttccatcggaagagctgtgatacggttcggtccatgaacgatgtaatcttccggagcgtcatcgccaagctcggtcagtgcggcacctacgttgatcttaatacgttctgccatacgttcgctgactttcacattatgctgacggctcatgtattcctggatatccgcagtcagatcatcaccggcgatacggatagagttgttggaaacgatacctcccaaagagataacggcaatttccgtagacccaccacctatatccacgatcatgtttccttcgggcgcttctacatcaataccgataccgattgccgcagccatcggttcgaatatcagatagacgtcacgcccaccggcatgctcggctgagtcacgaacggcacggagttctacttccgtacttcccgacggtacaccgatcaccatacgaagtgacggcgaaaacaagtgattacgagtatttacctgcttaatcaaaccgcgcatcatttgctcgcaagcatagaagtcggcgatcactccatccctcaacggacgaatagtacgtatattttcgtgggtcttttcgtgcatcaacttcgccttttccccaacggcgatcatcttatctgtacggcgatccaaggccacaaccgaaggctcatccaccacaattttcccgtttgtgatgatgatggtattggctgtccccaagtccatcgctatttcttgtgtaaaagagaataatcccattaatataaagtattaagtattaagt

SEQ ID NO: 208 - DNA, 12023 bp, Bacteroides thetaiotaomicron
atatctatatcggccgtttgcgagaggagggccgctattctacagcgcacgtctatcagaacgcccttctttcttttagcaagttttgtggtgtccatagtgtgtctttccgtcaagtcacccgtgagcgtcttcgctgttacgaacagcacctttacgaatgtggtctgaagcccaatacgatttccacgtatatgcgtatgcttcggagtatctataatcggggtgtggaagccggcagtgctccttatgtccaccgcctgtttcatgaggtctatacgggggtggacgtgcgtcagaaaagggcgcttcccgtcgtcgctcttcgcaggcttctttatgaagatccccagtctgaccgtctccgccgtacccaggctatcgctgctctgatgttccagttctgcgggatgtctttcgccgatctgagccatttggagaaatccgctcttgatagcaacgtgctgcgctacaatcgtgtcaagacgaagactcccatgagcgttgaggttctggacagtgcacaggagatgctcgaccaactccggaaccggcagtctccccgtcccggctgtcccgactaccttttcggcattcttcacggtgataagaagaggaaggatgagagagcctaccgtgaataccagtccgctctccgaagattcaactactgtctgaagtctctggcaaagcggctgcgtctcaacttccccgtcacttcctacacgcttcgtcattcgtgggctactactgccaagtaccgtggtgtccctatcgagatgatcagcgagtcgcttggtcataagtccatcaagactacgcagatttatctgaaaggctttgaactgaaagagcgtacggaggtgaaccggatgaatttgtcttacgtaaagcggtgcggagtaggtcagtgtatctgatttagaagcttgatatacagtgtttatcggtgtgcgttacttcttaggtaacggaatgattcatggcgcaaagatggacatatttatgaaaatacgcaaacaaaaatgaaattaatttcggaaaatgaatcaaatgcaggcataacaggcggaaaatgacaatatccgtgttatgtcttttttttattccaattcatgaaaaacaccttcacttctgctttatttcctgaataccagtcctcttctgatgttttcgttgaaaaaagttcccttttctgcttgccctatgcttgttcgttacctaagaagtaacggataaacatggggtaaaaaaatatgattttaagaaaaaagaaatcactaaatgctgggcctattaatgggacaggggaaggcgtagcacactcaaaacgctggtatgttgctttggttcggatgcaccatgaaaagaaggtttccgagcatctggacaagatgggtatcgagaatttcgttcccgttcaacaggaattccaccaatggagcgaccgtcgcaagctggtcacctccgtcttgcttcctatgatggtcttcgtacacgttgaccctaaggaacgcatggaagtcctgagtttttctactgtcagccgttacatggtgatgcgcggcgagagtagtcctgctgtaattcctgacgagcagatggctcgtttccgtttcatgcttgattattcggaagaatcgataagcatgaacagttctcctttggctcgtggcgaaaaggttcgcgtgatcaaaggtccgttgacgggtcttgttggcgaactggtcaatgtggatggtaaaagtaagattgctgttcgcttgaatatgctgggatgcgcctgtgttgatatgcctgtcggttatgtagagccgattatggcggctgtttaaggcaagggatatggatgctattattttacaagaaaatatagagggtttattaagtttggtacgtatgctgcttcctggtggggggagtgcaggctgcgtgtatttggatgatctttcagcattacaacgatccatccacgaaaagattaacgatttatattctcaacggggggagacaccggagcaggatgctaccctgtgtttggccatccttcagggatataatgtgtcgatgtacgccaatccggaagacgaagaaagaaaacaggctgttttgacccgttctctgtctcttctcgatgttcttcccccttctcttcttaagcaacagttatctgccgtctgtcatgggatgcaggaactgtgtgaaatcaactgaaacttttttatttgtcaatgaaaatacaacgactttttagcattctactcttctgtttgatgctgggaagtggctcgcttatggctcagtccatgagtgactcacaggtactggaatatgtaaaagacggcatccgccaaggcaaggaacagaagcagcttgcttccgaactagcccgtaagggtgtaaccaaagaacaggcaatgcgtgtgaagcagctatacgagcagcagaacaatgtaaatacctcgaaatcaacgggcacggacatcaacgaatcccgcctgcgtgaagagactaagaagaatacttccgatatgctggaggatcatccgactactcaggaccttgcccgtggtgatcaggtcttcggacgtaacatcttcaatacccgcaacctgacgttcgagcctagtgtcaaccttgccactcctgccaattaccgtcttggtcccggtgatgaagtcatcattgatatctggggtgcgagccagaacacgatccgccagcaaatctctcctgaaggtactatcaacattcagaagatcggccctgtcaaccttagcggtatgacagtctctgccgccaatgactatctgaagaacgccctgaataaaatatataacggtctgaacaacacgaccgatccaacttccgacatccgtctgacgttaggtaatatccgtactattcagattaatgtgatgggagaagtcgtacagcccggtacctacgccctttcttccttctctaccgtcttccatgcgctttatcgtgcaggcggtgtgagtgatatcggtagcctccgaaacgttcagttggtacgcaacggaaagaatattgccaccatcgacgtctacgaatttatcatgaaaggcaacacacaggatgacatccgccttcaggaaggtgacgtcgtgattgttcccgcttatgatgtattggtaaagatcagcggcaaggtaaaacgtcctatgcgttttgaaatgaagaaagaagagaaccttgccactttaatcaaatatgccggcggctttgaagccgatgcctacacccgttcattacgtgttgtccgtcagaatggtgaggaatacgaagtcaacacagtcaaagatatagattacaacatttataaaatgcgtaacggtgacgtagtaaccgccgaagccatccttaaccgcttcacaaacaaactggaaatccgtggcgctgtctatcgtcccggtatctaccagctcagcggtaaactgaacacgatccgcgaacttgtccatgaagctcagggtctgaccggtgacgctttcctgaatcgtgccgtcctctatcgccagcgtgaagacctgaccagtgaagttgttcagatagacattaagtctatcatggacggcacttccccaaaccttgccctaatgaagaatgacatcctctacattccaagtatccatgacctggaagaccggggtaatgtcacagttcacggtgaggttgcccaccctgattcctatccttatgcggataacatgacacttgaggatctgatcattcaggccggtggcttgaaagaagccgcctctactgtccgtattgatatatcgagacgaatcaagaatcctcgtagtactgcggataatgatacgattggtcagatgtataccttctctttaaaggatggttttgtaatagatggtcagcccggttttatccttgagccttatgatcaggtttatgtccgtcgcagtccgggctatcaggcacaacagaatgtagccattgaaggtgaaatccttttcggaggaaattacgccatgaccagccgtgaggaacgtctttccgatttagtgaataaagccggtggtccgaccaattatgcctatctgcgtggtgcgaaactgacccgtgtggctaacgctagtgaaaagaaacgtatgggtgatgtaattcgccttatgagcaggcaattgggcgaagccatgattgactctttgggtattcgtgttgaagatacttttacggttggaatagatttggaaaaagccttgagcaatcctaaaagtaatgccgatcttgtcttacgtgaaggtgatgtgatctccatacctaagaatactaatactgtaactatcaatggtgctgtcatggttccgaatacggtttcttatatgaagggaaagaatgtggattattacctgaatcaggccggtggctgttctgataatgcaaggaagagtaagaagttcattgtttacatgaatggtcaggtgacgaaggttaagggtagtggtaagaaacagattgagccggggtgtgagattattgtgcctggtaaggctaagaagaaagggaacatagctaatattttaggttatgctacttccttcagttctttgggaatgatgattgcttctattgctaatttgataaagaaataaatgacctattatgattgaaaagcaatcttatcaagaaccgttttctgaagtggataaaaggaaagatgatgaaatggaaatagacttgatggctattttttataagattattactgttcgtggagtactatgcaaagctgctggagtgggagtaataattgctatagtggtggcattgagcattcccaagcaatatacagtaaaggttaccctttctcctgaaatgggtaatgcgaagggaagtaatggtttagccggacttgctgcctcgtttttgggagatggggctctaataggggaaagcacagatgccttgaacgcttctctttcagcagatattgtttcttcaactccttttttattggaacttttagaaatggaagtctccgtttctaaaaaggatgataaaatgactttggggtcttatctcgatgaagagtcatctccttggtgggattatcttataggttttccgggcatagtaataggaggagttaaatcattattcggagaagatacggttcctgccagtggagggcggcaaggaactatcgaattgacgaaagaagtaaatgagaagattaattttcttaaaaagaagattagtgcatccattgataagaaaaccgccataacgagcattacggtcaccttacaaaatccgcagatcactgcggttatagcagattctgtcgttcataaattacaggaatatattattgggtatcgaacttcaaaagtaaaagaagactgtgcgtatttggaacggttgtttaaagaacgtcagcaggaatattatgctgctcaaagaaaatatgcggattatgtagacgcccatgataatgtggttcttcaaagtgtacgtgctgagcaggagcgtttacagaacgacatgagtttggcttatcagatatatagtcaggttgctaatcagttgcaggtatccagagccaaagtacaggaggaaaagccagtctttgcagtagttgagcctgccgttgtacctttgaaaccttcaggtatgggactcaaaatttatattttattatttgtgttcctgtccgtatctggtactctcgtgtgggtgttttttggcaaaagtctgctggctagcttgagaaaagaactgaaaaataaggagatagaacaggataaatgatgctaaaacgtcgtttacaacattcttacatcaattaaattcacttactatattattaaacgaatgatacgtacagctatgataatggctgcgggcatgggaacccgttttggccaatatacagaattgatacctaaagggttcgtcaaagtgggaggtattccaatgatagttcgttctattgatactttgttatcatgtgacattgagcgaattgtaatcggtacaggatataaacaagaagtttatgaagaattgaagacagactatcctatgcttgaaacctgttttagtcctcgttatgctgaaacaaatagtatgtatactttatataatacgcgggagattctgggcaatgatgattttttattgttagagtcagatttgatttttgagaaacaagcaataatgagcttattggagtgtcctgcggcagatgcaatgctaataactccagtgacaaagtttcaagatcagtattatgtggaacatgatgataattttcgcctttcttcatgttctgtcaataagaataaactaaacgctaaaggcgaattggtcggcatccataaactatccggttccttttacaaaataatgtgtgctgattatgcgagtattgttgatgaacaacccaatttgggatatgagtatgaattactacgaatatcttgttctcaatctcctgtttatgtgcataaagtagaagggctgaaatggtatgaaatcgatgacatatcagatttggaatatgcagagaaatatattgttccgtattgttaattaaaataatatatcaaattatgagtaagacagtttatattgggatgactgcggatattatgcatccaggacttatccgcattattaatgaggctactaaatacggtgatgttataattggtcttcttacagataaagctattgcggagcataaacgccttccttatctgacctatgaacaacgaaaagaggtagttcagaatattaaaggcgtatgtaaagttgttcctcaagaagaatggagctatgttgagaatctcaaacgcattaaacctgactatataattcatggtgacgactggaaaaccgggcctttacgtgaagaacgtgtgcgcgtatttgaagtgatgaatgaacagggaggaaaggttatcgaaattccatatactttgggaattaattcatcttctttggataaagatattaaggctataggtacaacccctgatgtacgtttaaaatcacttcgtcgtttgataaatgccaaacccgtagttcgtattttggaagctcatgatggactatgtggcttgataattgaaaatcaggaaatattaaaaggggataagagggaagtatttgacggaatgtggtctagtagccttacggattcaaccagtaaaggtaaacctgatattgaggcggttgatttaactacccgattgcaagatttgaataatattctggagtgtactactaaacctattatttttgatggagatacaggtggtaaaattgaacatttcgtatttacagtacgcactttagaacgtcatggaatttcagctataataattgaagataaagttggattaaaaaagaattcattgtttggtacagatgttattcaaactcaagatacaatcgaaggtttctgtaataagatcaaagcaggaaaggcatctcagattactgatgattttatgattatcgctcgtattgagagccttatagcgggaaagccggtaagtgatgctttagagagagcttttgcatatgtccaagcgggagcggacggtattatgatacatagcaaaaataagtcgggtgaagatataaaagaattttgtttggcgtttcgaaaacagtatgctcatgtacctatcgtggttgtgcctactacatatgatcatatttatgagtctgaattgtgtgattggggtgtgaatataattatttatgctaatcatatgcttcgtgccgcttatcctgctatgatgaatgtcgcaaagataatattagagaatgaacgtgctttagaggtgcgcgaactgtgtatgcccataaaagaaatattggaactgattccaggtactaaataaaaagaggaatatcattatgttaagcgtagaaaaagtttatgaaacgtttctgagtcatgacgttgatttttttacaggagttccagactcattactaaaaaatatttgtgcctatatcacagaccatacttcacgtgagaaacatatcatagctgctaatgaaggtgcggctgtaggaattgcttcaggttattatatggcatcaggtaaggttcctgtggtttatatgcaaaattccggcttgggtaatactgttaatcctctgctgtctcttgcagatgaacaagtatacagttttccaatgcttttgatgattggctggcgtggtgaaccgggaacaaaagatgaacctcagcataaaaaacagggtgaggtaactttagatttgttgaaagcaatgcggattccttatataattcttgattcaaatgagaatgatgcatttattcagctccatgatatcatacaatcagcaaaaactaagaatattcctcatgcaataattattcggaaagatgtttttggcaaatataaacttcaaaaagagttcggatgtaattatcctttatctcgtgaggatgctttgcaaatagttgtggattatctgcctgaaaattcagtggtcgtttctactactggcaagctttctcgtgagttatttgaatatcgagaaatgaaagagcaaggtcatgaacatgattttctcacggtaggctctatgggacatagttcatcaatctctttgggtattgctatagcaaagcaagatagacctgtttattgcttggatggtgatggagcatttattatgcatttaggggcaattagtaacattggcgatttatctcctaaaaactattatcatattttgtttaacaatggtgctcacgagtctgtaggaggacagcctactttaggatttagtttagatattccggctattgtccgggggagcggatataagcatacttatactgtttgtacaaaagttgaaattgaagaagcaatgaagcagcttccaaagttatgtggtcctgttttgttggaaataaaggttaaaatagattctcgggagaatttgggacgtcccacgactactcctatagagaataaggagcattttatggattttttaaaataaatatattcgatgaaaatagaaagaaaaatattattaaatcctgggcctgccactactactgacagtgtaaaaatggcacaagttgttccggatatttgtcctcgcgagaaagaattcgcaggtatgatgaaacaacttcgggacgatttggtcagagttgctcatgggaatttggaaaaacataccgctgtattattttgtggctcaggaaccatcaatattgatatatgtctaaattctcttcttcctgaagacaaaagggtgcttatagtgaataatggggcatatagtacccgtgctgtagaagtgtgtcaatattatggtttgcctcatattaatttggaattttccgtttacgaacgtcctgatttatcggtggtggaaaatgtgttgcaagaaaatcctgatatagctatggtttatactactcatcacgagacgggtacaggaattctgaaccctattcgcgagatgggcgctatagctcataaatatcaggctaaatttgtcgtcgatactacttcttctttgggcatgattccttttgatatagagaaagataatgtggatttttgtatggcatctgctcaaaaaggacttcaagcgatgacaggtctttcttttattataggcaatgaggaacagattaagttttcaaaaaaatatcccaagcgttcttactattgtaatctttatttgcagtatgagaattttgagagaacaggtgaaatgcattttactccaccggtacaaactatttacgccactcgtcaggcattaaatgaatattttgaagtgggtgaagaagctaagtttgcccgtcacaaaagagtttttgaggctattcattcaggtataaatgaaattggtcttaaaagtgtaataaagcgtgaatggcagtcaggactggttgtctcagttcaatacccagaagatcccaactgggattttgagaaaatacatgattattgttatgagcgtggatttacgatttatccaggtaagatatcaactgaggatacttttagaatctgtgctttaggagagatagaagtagatgatattgagaacttctttaaagtactaaaagctgcattaaatcattataacgtcacattaccgatgtcatgattgcagaaatattattgaagattcgtcatttttatttttcccttcgtggtatacacttccatccggaaagtgttatttctggagtgcctattcgtagctttcgcttagtaggcaaatatggcaatattaatttgaggtgatgcattaggagttctttattcttataaaaaggcatcggtagttataggagataatgtttgtgtagggtaatttgcttttagtgggagagaccatattagaattgcggtaaggggcgaagaagataataaccaattagtgagaatattggaaaaatataattgatatcggtaaatgtagttgtttttatactgtatttaagtaatggaaaatctaaagcagaaaactgtatcaggaataatgtggagcgctatagaacgtttctctttacaaggagtacagtttataattcaaataatattagctcgtttgttactaccatcggattatggtatgatcgggatgttagctatttttcttcaagtcgctcaagtatttatagatagcggttttacaaatgctttaatccagaaaaaagatagaactgaagaggattttgccactgtcttttattttaatattcttgtcgcagtattattctatggtatattgtttttttcggcttctttgattgcagacttttataatatgccgactttagttcttgtaattcgttttatagcattgtcgttgataataaatgctttatcggctattcacagaacgaaattaattatttctgtaaactttaaaactcaatctaaaatttcattaggtgcagcttttatatcaggcgtgattggaatatggatggcttatgtcggttgcggggtttgggctttagtttggcaaactctcttaaatagtataattttgacaattttgttttactgtttagttcattggaaacctttacatactttctccaaaagttcttttgaaagattattcaatttcggatctaaattattgatctcaagtcttatcaatacagtatatcgtaatctgtataccattgtaataggaaaaaagttttctgttgtagagcttggttactatacaagagcagaacaatttgctatttttccttccaataatttaaatgctttagtttctagagtagcgtatcctattttaagttccattcaagatgatgataaatgtttaacaaacgcatatcgaaattatatcagattatcctcatatataatttttcctttaatggtaggtttacttgttttggctaatcctattattagtctattgttaacagataaatggtctggggttgttattcttttacagatattatgtttggattggatgtttgatcatttgagccaaattaatttgaatttattatgggttaaaggaagatctgatctgtcgttacgtcttgaaataataaaaaagacgattgctatattcattctttttgtgtcaattccatttgggcttgaggtgatgtgttggggtagagttatttactctctgatagcgacatatttgaatacatattatactaattctcttattgatttgaccttaaagttgcaagttaaagatgtatttccaagtttaatactctctttcataatgggggggatcgtttttatatgtatttctttctttgaaactgatatagtaaaaattgtgattggatgtattactgggatgtccttctatattttactttcttttctttttaagctagattcttttttttgtattttaacattgatcattaaaactaaaaacatagatgaaaatattaaaaaagatttttcaagtaatagtaaagataattaaccattgtgtgccagttg

SEQ ID NO: 209 - DNA, 11901 bp, Bacteroides thetaiotaomicron
attcttcgccgcccttgcacacatccaaaaactaccttaagaagcatttgtaaatccaaaaagaaaaaattatatttgttgtgatttaaaagaaatagaaaccagacagagtttaaattacactcccaacgcaagggactcacaatacatacgcatttgccggtctactcttatttgttacttcccggacgttctcaatgaaacatccggaagattagaactcccttttcaggttccgaagcagttcttctttcctcgctttatacttcttggaaagaggattgtacgagtaaaggttggtatgtttcaaacgtatctcgtctgtctgttcctttcgccgctcttcccgctcttccacatcatccggatcttcggacttacgtcttgtacctctcctgctaaacaactgaaacttggatgtaccccgaagctgacgaatcagcatcttgataatccggacaataatctcttgttcctgttcggaataaggcctatctactgtctctgtataggagagataataaactttcagttcttcttccagctcttgcaaaaaatgcatccgctcaactctggaaaacttctttctaccagtatgcaaatcttttaaaatcttcatttagtctatctttttttaagtctgataaaagcgtgagtcctttaataagtacacttatggggcatgggacacttaaaagagagtccgactatttcaatataacagagaagaaaaactaatatttcctgcaagaatcatttcttaaaagttatccaaaacggaaaactttctgtatcaggcagaaagaaaagtttcccgaaatttaatgttaaatcctatccaagctatcacaatatcctttatctttgtatccgatttcggaactaaaaagaggtttagtcaatgagggaacgctgtgcaaatcggcgacagtacccgctgctgtaattctctgtgaatccgcacactatgtcactgcatcggcagatgtgggaaggcgctgcgggggagggataagtcagaagacctgccggagtcaaataaacatattattaatcactttcgggagttaaagttatgaactacgcggaaatttgtatcatcaaacgggatggtaaaagagaagatttctctattagtaagatcaagaatgcgattggtaaagcattcagtgcaacagggattcagaacgagcagcaactgattgctgacgttacgatgagtgtgatcagtcagttcactaaccccacgatcaccgtggaggaaattcaggacttagtagaaaaggcattgatgaaggtacgccccgaagtggccaagaagtacatcatctaccgcgaatggcggaacacggagcgggacaagaaaacccagatgaagcacgtaatggacggcatcgtcgccatcgacaagaacgacgtgaacctgagcaacgccaacatgagcagccacacgcctgccggacaaatgatgacatttgcatcggaagtcaccaaagactacacctataaatatctgttgccgaaacgttttgccgaagcgcaccagttgggcgatgtccatattcacgacctcgattactaccctacaaagacgactacctgcatccaatatgacatggacgatctctttgaacgtggcttccgcaccaagaacggcagcatccgcacgccgcaaagcatccaaagttatgctacgcttgccaccatcatcttccagaccaaccagaacgagcagcacggcggacaggcaatccccgccttcgacttcttcatggcaaaaggagtggcaaagtctttccgcaaacatctggcttcgttcatcaatttttacgtggcgatggagaacggaacacaggcggacgaaaaagcaatccgcaccttaatcaaggaacatctgccttctatcaaatcgaccgaagcagaacgcgagacattgcgcatcgccctgatagccctgcaaatcattatagacaaggaacacctgacacgcatcgcagaaaaagcgtaccagcaaacaaagaaggatacgcatcaggcaatggaaggatttatccacaacctgaacaccatgcactcccgtggaggtaaccaagtggtattcagctccatcaactacggaacggatacttccgccgaaggccgcctcgtgatcgaggaactgctgaaagccaccatcgaaggactcggaacacgtggcgaagtccccgtattcccgatccagatattcaaagtaaaggacggagtttcttactccgaaaaggacttcgagaaagcgatgaaggcggaaaacatcgaagacgccatgcggggaacttacgaagctccgaacttcgatctgctgctaagagcttgtcagactacatcgaaagcgcttttcccgaacttcatgttcctggacacgcctttcaacaagaacgagaaatggaaagcggacgatccgaaacggtatatctacgagttggctacaatgggatgccgcacccgtgtatttgagaatgtggcaggagaaaaatcatctttgggacgcggaaacctttcattcaccacactgaacatgccgcgtctcgccatcgaagcacgcatcaaggcggaaaatctgattgagggtgaacgcaacaaggatgccatcgaacagaaagcgaaagagattttcatggagtcagtccgcaatatggcgactcttgtagccgatcagctgtacgagcgctaccagtatcaacgcaccgcactggcacgccagttccccttcatgatgggaaatgacgtatggaaaggcggcggcgcactgaatccgaacgagcaagtgggcgatgcgttacgcagcggtacgctgggcatcggctttatcggcggacacaatgcaatggtggcactttacggagaaggtcacggacacagccagaaggcatgggacacgctgtacgaagctgtaatggaaatgaacaaagtggtagacgaatataaagagaaatataacctgaattattccgtacttgccacacctgccgaaggactttcgggacgtttcaccaagatagaccgccggaaatacggcaaaatccccggcgtgacggaccgcgattactacgtcaattccttccatgtggatgtgaaggaaccgatcagcatcaccgaaaagatcaggtgcgaagcgcctttccacgccattacccgcggcgggcacattacgtatgtggaattggacggggaagctcagaagaatgtacgtgccattgcgaagatcgtaaaggtcatgcacgacgagggcatcggctacggctccatcaatcatccggtggatacctgccacaactgtggatacaaaggagtaatcttcgataaatgcccggtatgccaaagcgaaaacatcttacgtatgcgtcgcatcaccggatacctgacaggtgacctcagctcctggaactctgccaaacgggcggaagaaaaggatcgtgtgaagcacttataaaagttgagagttgagaagggagagttgagagttggctgcgctgtgtgatggcgggcggggctttactcttccttcttgtatattatttatacccatttatttttattttaagatgaacactctcaattctccactttcagttctccacttattatcgacttatcccgaaacgattgttgacggtgaaggcatccggtattcgatttatcttgcggggtgttctcatcactgcgtcggctgtcacaatccggagagctggaatccgcgggcgggagaactgctgacggaggaaaggattcaatcgatcattcgggagattaaagccaatccattgctggacggggttactttttcgggaggagatccgttttataatccggaggctttcctgcttttcgtcaaaagggtaaaggaggaaacggggctgaatatctggtgctatacgggatatacgtacgaagagattctagctaatccgcgtttgaagactgtgctcgactacatagatgtgctggtggacgggcgtttcgaacaggcgctcttttcgccttatctggaatttcggggaagcagcaatcagaggatattgagaataggtaataagtaataggttataggtaataatggtgggggaggttttgtattagtttagtgcggggggagctgctgcgaattgttgtgggcgtggtctactatgaactgctgcgggcgttgtctcctgcgctaaaaaaacttatatttcaaagaagattgaaacacgtacttctttgttttgtttacatttacagacaaaataaggttctacaagaataagttttttatgatacaagccaataataccacttctatagatgaaaccgatggactgccaatgccgagacgtatctgggcggtggtttccatcggatttgcactttgtatgtcggtgctcgacgtgaatattatcaacatcgtactccctacgctttcgcacgatttcggaacttcgcctgctgtaactacatggattataaacggttatcagttggcgatcgttgtttcgctgctgtctttctcttctttgggggagattatcggttatcggaaagtgttcctgtcgggcattgggctgttttgcatcacttcgctgatttgcgccttgtccgattcattctggacgctgacgattgcacgtatctttcagggattcagtgcgtcggccatcacaagtgtgaatacggcgcagttgcgctacgtatatccgaaaagccagattgggcggggaatgggaatcaatgcgatggtagtggcgatatcggcggctgccggtccgtcggtggcaagcggcatactttcgatagccagctggcactggctgtttgccatcaatgtaccgctggggattacggcactgctgctgggaatcaagcatttgccgagacaggaagagcggtcgaagcggaagtttgacttcgtgagtgcgatagccaatgcggtcacattcgggttactgatttatacgctggacggatttgcgcatcatgaggagatggatttccttgtgctgcaattgatcatattggccatcgtaggaacgttttacgtacggaggcaactgactcagacgactccgttgctgccactggacttattgcggataccgattttccggctttcgattctgacgtctatctgttcgtttatcgctcagatggcggccatggtatctctcccgtttttccttcagaatacgttgggtcacagcgaggtcatgacaggattgctgctgactccgtggccgttggcgactcttgtgacggcaccgttggcaggttatctggtggaacgcattcatccggggatattggggagtatcgggatggccttgtttgctgtcggacttttttcactttcggggcttactgccgaatcgtccgatatcagtataattcttcgtctgatgctttgcggagccggtttcggattgtttcagacacccaataacagtacgattatctcttccgccccaacgaaacgttcgggcggtgcaagtggaatgctggggatggcacggttgctgggacaaacgttcggtactacgttggtagcgttgcttttcagttttgtcgtgcacgaccggagtacggcggtctgcctcatggtcggaagtgggtttgctgttgtggcggcgattgtcagcagtctgcggttgtcgcaaccgtctacgctgaaaagagaaacgaatcagtcatgacgaacagaaatttctgtcatccgaagcgaaaatcatgggagaagaaaatgggatcaatccggaaaactggttgtttccagtttgtttctttccgaacggaaaatgaatcaaacagtagtatctccattgggggtgactaaaaagtcgattctatctcgaatctcctccttcgggaagagtggtcgaagaccgaggtggtaggaaaaagaatgtttattcctatttctttgtaatgatagggttatgtgttcacctaccacctccccctacgggtactcctccttcccgaaggaggagatttaagatactattgactttttagtcagccccattcaagatactattgattatcatttagctcaaaaccgtgcgatatagagcccaaccagctttttggctaacccagagaatgttaatgatttaacattcgtctccgggcatccagagagcccaaaggagaaagggcgtatcatcgttggcagactaaggcatttatcgtatatagaaacggcgctttaacgtagtgttaaagcgccgtttctatatatgataaatagtacgttctattttactgtatttcagcaatatacattgcttcatcgccgacgtcctccttttatccgccagcagtccgctgtcgccgggattgctgttctgacaacttccggtctgcacgcgggaagacggatgtgtatgccttgccggtccctgcttagaagaagaacctcaatatgtcattgaagtttgcccaaatcagcaagccgaacagaagcaccataccggtcatctgagcgtactccataaacttgtcactcggtttacgacgggctatcatctcgtagaagaggaagagcacgtgtccgccgtccaatgcggggatcggaagaatgttcatgaaggcaaggatgatggaaaggaaggcggtcatgtaccagaactggtgccagtcccacgtagcagggaaaatgcttccgatagtgccgaagccgcccaactgtttggctccttctttcgagaagagatatttcatgttgccgacgtatcctttcaatgtcttcacacccaaagatacgcctgcggggaaagattcaaagaatgtgtattcctttttcaccataggcaacagacgatccgttgtcagactggcaactacgcccatcagataagcggaatccacacgcagggaagtcgtatcggtcacaccgccacgcacatacgtcagcgtaatcagacgagggtcgatgctgtctttcagaagtgcttcggcgtttttcttgcgttccgccatcgtctgcttgaaatcagagaaggagatggattttccgtccaatgcgatgatactgtcgcccggcagaatgcctgcctgcgcagcgggagaattaaccatcacgctgtcaatcacatacgggaaacggaaagaagcgaaacgaacgctgtccgccatcaggcgctgcatcatgtcttcgggaatgtagacggaggctttcttgccgtcacgaagcactgatacctcacgggcatcggctatctgactcagcatatcgccgtcataacgtacgaaaggcacattgtcggcagacaaaaggatgtcgccatcctgaaaaccgaccgctttcgccgtttcgttgaagtccataccaaggggagcttcttggacctttatatactggtcgccccaagcgaaaagaatcattgaataaataaagagcgccaacaggaagttgaacagcacaccgcccaccatgatcagaagacgttgccaagccggcttggaacggaactcccaaggctgctcaggctgtttcatctgttcggtatccatcgactcgtctatcattccggctatcttgacgtaaccgcccagcggcagccatcctactgcatactccgtatcacttctcttgggtttgaacttgaacaaggtaaaccacgggtcaaagaacaagcagaatttttctacacgcaccttgaacaaccgggcaaaaaggaaatgcccgccttcatgaataataacgagcaaggataagctcattatcagttgcagggcacgaattaaaaatgtttccatatagtctatttacaatttaaagcctcatccaaaccctctgctcataagaggaaaaccgaggcgctttctaatttatattacttatttatatttttcattgttcacgaaatcagctccggtgctatcacggaatcagctccgcagctattctccgcgcttcagcgtcggtagccacatagtcgtcgtaagcaggagcggctacaaacgcggcacgttccattgtcttttcgatcacatcgctcataccgaggaagctgatgccgtcccggaggaaagcggctaccactacttcgttggcggcattgacaatgcaaggcatatttccgccccgatacatcgcctcgtaagccagggcaaggttgcggaaacgcttcgtatccggttgctcgaacgtcaggttcgtgcactgggtgaagtcgagcctgtcgaaagaagagcagatacggtcgggatacgagaacgcatactggatgggcagacgcatatccggcatgcctagctgtgccttgacggcaccgtcctcaaactgcaccatggaatgaatgaccgactgcggatgcaccaccacctcgatctggctgggctgcacgccgaacagccatttcgcctcgatgacctcaaagcctttgttcatcatggatgcggagtcaatggtgatcttggctcccatctcccagttgggatgtttcaatgcctgtgtcttggtgacggacttcagctgctccagcgtgcaggtccgaaacggaccaccggaagcggtcagtatcaccttctcaatcgggttcccgacttctccagctaaacactggaagactgccgagtgttcagagtccaccggcaaaatgggagtgtggtattgctgtgccagttggttgatcagttctcccgccaccacaagcgtctccttattggcaagcgcaatggctttcttggcacgaatggcgttgatcgtcggcttcagtccggcatagcccaccattgccgtcagcaccatatctaccggtccggcctccacgatctgacagaccgcgtcgattccggcatatactttgatcggaaggtcgctcagcgcttccttcagttgggcgtacttttcttcgttggctatcaccaccacttccggctggaacttgcgtgcctgtgcaatcagcagttctacccggttgttggccgtcagggcataggcttcgtagaggtcggggtgttcttcgatcacctgcaacgcctgcgtcccgatagagcccgtagagcctaaaatagctatttgtttcttcttattcttcttttctgaatccattattatctaattcctctgtcacttgtcacttataatcgtatatcccacttctcgtcattggctttaaaacacgatgtatttctccggattgacaggatgtcccttgtaccacagttcgaagtggagatgcggccctgtgctgagcgttccgctgtttcccaccagtgcgatggcttcgcctcctttcacgcggtcgccttcttttttcagcagcgagccgcaatgcttgtagatcgagacgaaatcctgactgtgctgtacgcctatcacgtaaccggtttcggcggtgtaggtgctcagaaagacggtgccgtccatggttgccagcacgctttcgttggggttggcagcaatatccgttccaaagtgtttcttatcggcattgaaatggtcggaaaccattccacgggtcggacgatacaggatcagtccgttgacatccggctgcgaaacgatcgtagtcagattatatttttcattttcttcgtattggcggcgaaattcctcttcacgtttggtacgttccatcagggtgtcttcgcgggcggcggtcagcgagtcgagcgtctgcacgctgtctatgggcacttttccgctgaaaatatcctgtatgttcatgatgtagaggttctgcctgttgagcagttcctgcaaggaatccacgcggagcgcgttgtccacgatctgactgcgaacttcactgttcatatatccggggagatagttgcgcaaaggggtgaaggcaatgatgcaggcggcaatcagaaaaagcaccgccagcacggacaacagcaccgaaagcccgttcagcttggatacccgaagccccacgatttcttcaagcgtattctcattgataatggtgagtttatacttgaacttgaaattgttccaaaatgctttactccgttttcttggcatctttattaattattaatcttcctccaaatcttccaaattcaacaatccttcgggaagctcgactgtgatgagcttcttttcctgattgatttccactataaattcttcctgtgcagggacgaggagttcttctccgtcctcctgttcgaccacaaaaagggtgttcaccgtagcggtatccacttcgaccacttcgcccagctcgccgtgacgaacgtcttccatgcggaaaccgacgaagaagttccacgacagttcgccgtcttccgcctcttccgcgtgcttcaccgggaagtagacttcgacattggtgaacatacgcgcgcgttccgccgtatctatgccttcaagcttcaccagtgcggtggagtccgaacgaaaacggtattcttcgatgaaaaacggtacgaaaataccgtcgagcaaacagatcagataatcgcagtccacacggtcgaagatatcgtccgtgaaggtaaactgcaactcgccgtgaatgccgtgcggcttgttgaatagtccgattttatatacttcttctttctttatcatattcgagtgattctggcgccgatggcgttaagtcgtccttcgatgttctggtagccacggtctatctgttcgatattgctgatcgtgctggttccttcggcgctcatggcggcgatgagaagggcgatccccgcacggatatcgggcgaagtcagtcgggcgccgcgcagcttgaagccgtggttatgtccgattactacggcacggtgagggtcgcaaaggatgatctgagcccccatgtcgatgagcttgtctacaaagaacaggcggctttcgaacatcttctgatggatcagtacgcttcctttggcttgggtggccactacaagcatcacgctcagcaagtcgggtgtcagtcccggccagggggcgtcggcaatggtcatgatggagccgtcgatgaatgattctatttcgtatgtttcctgtgcggggacgtagatatcgtctcccctctgctccagtttgatgcccaaccggcggaaactttcggggatgatgccgaggttctcgtaggaaacgtttttaatggttatttcgcttttggtcatggcagccatgccgatgaagctcccgacttcaatcatgtcgggcaatacggtatgctgtgtgccgtgcagttcttccacgccctcgatggtgagcagattggaagcgatgccgctgatctttgctcccatccggttgagcatacggcagagctgctgcaagtagggttcgcaggcggcattgtaaatggtggtagtgccttttgccagtacggcagccatcagaatgttggctgtaccggtcacggacgcttcatcaagcagcatatagctgccttgaagcctgtcggccgttatctcatagatgccccgcgactcgtcataacggaagtcagctcccaaattctgaatccccacaaagtgggtgtccagacgacggcgaccaatcttatctccgcccggcttcgagatcaacgccttcccgaaacgtgccaccatcggaccgatcagcatcaccgacccccgaaggctcgaacacttcttcaagaacttatcactctccaaataagccagatcgacgttctccgccttaaaactgtaagtatcaatgccttcctttgcaaccgtcactcccatctcccgcataagctgaatcagattgttgacatccagaatgtcaggtatattgttcaccgtcacttcctcagcagtcagcaacgtggcacagataatctgcaaaacttcgtttttggccccttgcggatgaatctccccgctaagccgatgtcctccttcaattacaaatgaagccatttattttaagtattaagtaataagtattaggtattaggtattaagtattaggtattagac

SEQ ID NO: 210 - DNA, 11859 bp, Bacteroides thetaiotaomicron
ggtaatattggggttacaacagagaacattttccctatcatcaaaaagttcttgtacagtgaccatgaaatttttcttcgcgaattagtgtctaatgcagtagatgccactcagaaactaaatacccttgcttccattggggagtttaaaggtgaactgggcgatctgacaattcacgttgaattaggtaaagacactattactatctccgaccgtggtattggcctgactgcagaagaaatagaaaagtacatcaatcagattgcattttcaggagcgaatgattttctggaaaaatacaaagatgatgcaaatgcaatcattggacatttcggtttaggcttctattctgcctttatggttgcaaaaaaggttgaaattatcaccaaatcctacagagacgaagcacaagctataaaatggacttgcgatggtagccctgaattcactattgaagaagtagataaggcagatcgtggttcagatatcatcttatatatcgatgacgattgcaaagaattcctcgaagaagcacgtgtttctgagcttctgaagaaatattgcagcttccttcctgtccccattgcattcgggaagaagaaagaatggaaagatggaaaacaggtagaaaccactgaagacaatattattaacgacactactcctttgtggactcgtaagccgagcgaactgtcggacgaggattataagtcgttctataccaagttgtacccgatgtcagacgagccattattttggattcatctgaatgtggattatccgttccatctgactggtatcctctacttcccgaaagtaaagagcaatattgagctgaataaaaataagattcagttatattgcaaccaagtatatgtaacggattccgtagaaggaattgtaccggacttcctgactttattacatggagttattgattccccggatattccattgaatgtatcccgttcttatttgcaaagcgactcgaatgtgaagaagatttctacctatatcacgaagaaagtttccgaccgcctgcaatcgattttcaagaacgaccgcaaacagtttgaagagaagtggaatgatttgaaaatatttatcaattacggcatgcttactcaagaggatttctatgagaaagcgcaaaaattcgcccttttcaccgatacagataacaaacattatacatttgaagagtatcagacccttattaaagataatcagacagacaaagatggaaatctgatctatttgtatgctaataataaagatgaacaattcagttatatcgaggctgccaccaacaagggatacaatgttctgcttatggatggtcaattagatgtagctatggtaagtatgctggaacagaagtttgagaaatctcgcttcacccgtgtagacagcgatgtgatcgacaaccttatcatcaaagaagacaagaaaaacgagacactggaaggagaaaagcaagaagctatcacaactgctttcaagagccagttacccaaaatggataaagttgagttcaatgtaatgacacaggcattgggagacaattcagctccggtgatgattactcaaagcgagtatatgcgtcgtatgaaggaaatggcaaatattcaggccggaatgagcttctatggggagatgccggatatgttcaatctggttctgaactccgaccataagcttatcaagcaagtgcttgacgaagaagaagcagcttgtcaccctgaagtagctcctatacaaacagagatgaatagtgtcagcaagcgtcgcaacgaactaaaagacagccaaaaggacaagaaggaagaagatattcctactgcggagaaagatgaactgaatgagctggataaaaaatgggatgaactgaaaaataaaaaagaaggcatctttgcaggatatgccagcaacaacaaggtaatccgtcaactcatcgacctggctttattgcagaacaatatgctaaaaggtgaagctctgaacaacttcgtgaagcgcagtattgagctgatttaataccgcccctttatttataacataaatcaatgaaagagcattcaacactaaaacgtgttgcaatgctcttttttcatcataaaacgaacgctaaaatatcgataaattggaaagtattgcatatatttgaacactaaatgataaatacttcaattgtttgatttgggttatgagaaaaatacttttagtgttaattgctatatggttattcatgccgactgtctgcgcccaaaaagtaggtcttgtcttaagtggtggcggtgccaaaggattgacacacatcggcatcattcgcgccttagaagaaaataacattcctatcgattatattacaggaacttccatgggggccattatcggctctctttatgcgatggggtattctcctgatgatatggaagaattattgaagtcagaggactttaaaagatggtattcaggacaaatagaagagaaatacgtataccacttcaagaaaaatgtcccgacaccggagttttttaatatccgtttctcattcaaagactcattaaaaaacttcaaaccacaatttctgcccacaagcgtagtaaatcccatacagatgaatctggtttttgtagatttgtatgcacgcgctacagcttcgtgtaaaggcgatttcgacaagttattcgttcctttccgatgcatagcttctgatgtctacaataaaaagcaactcgtaatgagaaacggagatttgggagatgccgtccgagcttccatgagctttccctttatgtttaagcctatagagattgacaatgtgctggcatatgacggaggaatctacaataatttcccaacagacgttatgagagacgattttcatccggatattataattggaagtgtggtatctacaaaccccaccaaacccaaggaaaatgacctcatgagccagatagaaaacatggtcatgcaaaaaaccgattattctattccggattcaatgggtattctgatgacattcaaatatgacaatgtcagcttgatggatttccagcgaatagatgaattgcatgatatcggatataaccgaaccataagcatgatggattctataaaaagccgtatacaaaggagggttaatttggataatatacgtttgagaagaatggtataccgaagcaactatccggaattacgctttaaaaacatcattattgatggagccaatccccaacaacaggcatatattaaaaaagaatttcatagctctgacaataaggaattcacttacgaaaacttgaaagaaggctatttccggctgctttcagacaacatgatttccgagatcatcccgcatgccgtatacaatccggaggatgaaacatatgacctgcatttaaaagtcaaactggagaataattttgccgtacgattaggtgggaatatttccacatccaactcgaaccaaatttatctcggtctcagctatcaggatttaaattactatgcgaaagaatttctttttgacggtcaactcgggaaagtctataataatgcgcaattcatggctaagatcgacttttctactgcgatcccgacctcttaccgctttatcgcatctattactactttcgactattttaagaaagacaagttattttccaggaatgacaagccagcatttaatcagaaagacgaacgcttccttaaacttcaggtcggactaccttttcttttaagcaaacgagctgagtttggaatagggatcgccagaatagaagacaaatatttccagagaaatatcatcgattttgagaaagacagattcgacagaagccgttatgatttattcggcggctctatcagcttcaatggaagtacgcttaattcacggcaatacccgacacaaggctacaaagaagctcttgttgcacagatattcatgggacgggaaagattctatcccggtgaagagaccaaaggagttcaaataaataaagaacaccattcctggctgcaattatcatatatgaaagaaaaataccatacaatgagcgaacactgggttttgggatggtatttaaaagctttgtacgcttccaagaacttttccgagaattatacggcgactatgatgcaagcaggtgagttttcacctactctacatagcaaactcacctataatgaagctttccgcgccaatcaatttgtgggagccggcattcgtcccatctatcgcctcaatcaaatgttccatctgcgaggtgaattttatggttttatgcctatatatccgattgaaagaaactcattaaataaggcatattatggaaaagccttctctaaattcgaatatttaggagaaatttctgttgtgtgtcaattaccgttcggagacatctctgcttatgtaaatcattatagctcaccgagaagggagtggaatgtcgggttaagtatcggtttccaactgtttaattaccgtttcatcgaataattttctacaaaaaaaagtcgccgaatgcttgctaattcgggaaaagtacgtatctttgcacccgttaaaacgaaacaatggtcgcgtagctcaactgaatagagtagctgactacggatcagccggttacaggtttgaatcctgtcgcgatcacttttttcggaaaaacagaatggccgcgtagctcaactgaatagagtagctgactacggatcagccggttacaggtttgaatcctgtcgcggtcacttctaccaacatttaacaaggtcgcgtagctcaactgaatagagtagctgactacggatcagccggttacaggtttgaatcctgtcgcgatcaccaaaatcctctgcattttttgtggaggattttgttttttaccccattccatcgaagaaatccggcatcacgagaaagaaaattaaacggtcgttttaccacaaatgactgcaacttttgcataaatcaagcgattgtgttatctaaatcgagcggtcatttcggcccagtccgatattttacatcaaacgaccgtataattatgtacaatcaataggatgttttataaaaacactttaatagttattttcaaacatcaagaagtttattttcaaacattgggaagtttaaagagtgcatggcaacgtatgttgaaacatgcactttcatcttcaccttttgctcgaaagcactataaacaagtagatacaggatgaaggaaaagcgtttcacttttatactacattaggttatcaaatatgctattaggttatcggattttgctattagctaatcaaattatgctaatagcaaaaaaatagaaagaactaaaaaaatcccccttcaccttgtatctgcctgttcatgggagacatgacaaaaaggtgaaggaggaatacctatttataaaatgtatggagaatcgatacttctcagtatatcagatcagcatttaatattcagttcgttcaagactttacgtattgcctcaaatgtcgtaattcgagtcggaaccaacggcaatcgaagtttattttcaatcatccccattgcattcagcatagattttactcctgccggatttccatccacaaacaaaagatcaaatagctcagtaaatcgatgatgaatagtgagtgcattagcaaaatcaccttgaagcgccaaacgtgtcatacgactgaattcacgcgggaaagcattgccgattacagagatcactccaacagctcccaaggttattaatggaaaagtaataccatcatcaccggaaataacattgaaattatccggtttattcttgataatgtcatccatttgagtaatattaccggaagcttctttaatagcgattacattactaaaattacgggcaatgcgcaaggttgtctcagcagtcatatttactcctgtacgccccggcacattatatagcacgataggaagttccgtagcttccgatatggctttataatgctgataaattccctcttgcgatggcttattataatatggcactacagacaatatagcatcaactcctgtaaaatcgtcatttttcaatgtttctactattgcgcgtgtattgttaccgcctacacccagcaaaataggaattcttccgttaacgcggtcaatcaccatctttttgatggttttcttctcttcctcggtaagagtcggtgtttcggctgtagtccccagcacacacaagaaatccgcattattctgcaatagatagtctaccaaacgcatcaacgcatcataatcaacgctttcatcctctttgaaaggagtaatcagtgctacccccattcctttcaatttagtctgtatcatgagttttaattataatctctaattttattaggcgcaaaagtacgaatatttttcatatcttacgatataagtttcagaaattcgtcctcgcttagtatggttactccaagtttttttgctttttccagtttggctggccccatattgtcaccggcaaggataaaactggtcttagcagagatacttcccacattcttaccgccatttttctcaataaggtctttatattcgtcccgtgaatgatgcgtaaatacgccgctgatcacaatagactgaccggctaatttatccgtatatccactcatatcttcttctgtacgatagagctgtaacccagcctcttttaacctgccaactaactctcggttagactcatttgagaaatacagaagaatgcttcgcgctattttttccccgatttcatcgatacttatcagcttttcaaggtcagcctgttgcagctcgtcaatgtctccgaacgacttggctattttctttgctaccgtctcgccaacaaaccgaattcccaaagcaaagatgacgcgttcaaaaggaactgtcttactctgctcaatccccgtaataatattctcagcagatttttctcccatacgatccaaccctttgatatcatcggctttcaattcatacaaatccgccgtattatgaatcaatcctaaacgatagaacatatccaccgtttcaggacccaacccatcaatattcatggctttccgactaataaaatgctctattctacctttaatctgagggggacatgcagtttcattaggacaataatgggcagcttcgccttcatatctaattaatttgctgccacattcggggcaattggtaataaacctgaccttctcaccaagcataaagctacgggcatctttatccactcctgtaattttaggaatgatctcgccacctttttctacataaaccatatctccgatatgcaaatcaagcccttcaataatatccgcattatgcaatgaagcacgtttgacaatcgttccggatagctgaacagcatctaagttggcaacaggagttacagcgcctgttctgcctacctgataagttaccatattcaatcgtgtcaatgcacgttctgcctgaaatttataggcaattgcccatctgggtgatttcgccgtaaaaccaagattcttttgttgtctcagactatttaccttcaagacgattccatcagtagctacaggcagattctttcgttctacatcccaatgattgataaattcaaaaacctcttccaacgtctggcatttacgcgtcaaatcagagattttaaatccccattttgcggcttcctgaagattttcataatgtccgtcacaaggcagattatctcccaaaagataatataaatacgcatccagcttgcgagaagctacaatagaagaattctgaagcttcaatgttcctgaggctgcatttctcggattagcgaaaagtggctcctcacgtgcttctttttcgcggttcaactcctcaaatacttcccagggcataagaatttccccacgaatctcaaaagaagaaggataattgtcaccatggagcacaagtggaatagaacggattgtctttacattatctgtcacatcatcgcccttttctccatctccgcgtgtaacggcacgaaccagttttccatcttcgtaggtcagagaaatggaagtaccatcatatttcatctcacagcaaatctcaaaatcctcattcaacgcttttcgtacacgctcataaaaatctgtaacttcgctttcagagtatgtatttgccaaagacaacatagggtatttatgcgcaacctgcgtgaaattcttgctaatgtcactgccgacacgcatagtgggcgaattttcatctttatattccggatgtgccagctccagatcctggagttcacgcatcttatcatcaaactccttatctgaaatttcgggagcattcaaaacgtaataattatagttatgccgatgaagttcagcacgcaattcctctattttttcctttatatccatatttcttcgattgtttaaggcaaaaatacaggtttatctttgaatatttgtacttttgcgaaaaattataaagattatgcgtattgacattataacagttttacccgagatgattgaaggcttcttcaattgttccatcatgaaacgagctcaggataagggacttgcagaaatacatatccacaatctgcgcgattataccgaagacaaatatcgtcgtgtcgatgattatccttttggcggattcgccggcatggtcatgaagatagagcctatcgaacgctgcattaacgctctgaaggctgaacgcgactatgatgaagtgatttttacgacccccgacggagaacagttcaatcagccaatggccaacagcctttctttggcccaaaacctgattatcctttgcggacatttcaaaggtattgattatcgtatccgtgaacacctgatcaccaaagaaatcagtatcggagattatgtgctgacaggaggcgaactggcagcagcagtcatggcggacgcaattgtccgtatcatccccggagtgatttcagatgaacagtcggcactttctgattcttttcaggataatctgttggcggcacctgtatatactcgtcctgccgactataaaggctggaaagtacccgatattttgttatccgggcatgaagcaaaaataaaagaatgggagctacagcaatctttagaacgaaccaaaaaacttcgccctgacttactggaagactaaaaatatatgtaaataaaaacgacggtgaaaaatatgagaattttcaccgtcgtttttatttatgttctataagaaagacaaatctgttattttactcttcgcactgggaatctcttttcatctatcattccggtactgattttattcagtatacttaaaaagtaaaatagcatttttctttcgtattatatgcgaagggttattgtatgttttcaattatacctcaagcgcaccaataatttcttttactgacttacatccgtgtctttccaagtaattatttataccatcttcaactttgattgtaacagccggatctataaaatttgccgtaccaatctggatcgcagaagcaccggcaagcatgaactcaacagcatctttccagttcataatacctcccaagcctatgacaggaatatttaccgcctttgcaacttgccaaaccatacgcaaggcaatcggtttcacagcagcaccggacattcctcctgtcactattgacagaatgggacgtttacgttccgcatcaatagccattcctagcaatgtattgattaatgatacactatccgcaccactttcttctgctgcacgggcaatttctgtgatatcagtaacgttcggagagagtttaacgataagtgtctttttgtaagctgcacgtaccgcttttactacttcagaagcaccttttgctgacacaccaaaagccatacctccttgctttacattggggcacgagatatttagttctatagcaggaattttgtcaagttcattaatgatctctgcagttttcacataatcctcaatagcagaccccgacacgtttacaatcatattcgtttgaatgtcttttatacgaggatatatctgttccacaaagtagtcaacccccttattttgcagtcctacagcatttagcataccggaaggagtctctgccatacgaggatatgggttaccttcacgtttgtgaagagtagtaccttttacaataataccgcctattcgcgctatatcaatgaaatccgagaactcttcaccatatccaaatgtaccagatgcagtcatcaccgggttcttcatctgcaattcaccaatgtttacacttaaatctgccatagtagtttatttatattaaaaacaggaccttctttacatacacacaaatgtccttctgtcgtattttccacacaacagagacatgctccaattccacaagccattgtattttccaaagaaacttcacattctatctgattacttttggcatattttgccacagccatcatcatcggtttaggaccacaagtataaatctgctcaaaatgtacctgatttaatatagaatgctgggtgacgtatcctttttctccgtgacttccgtcttctgtagtagtatatacctctccatatttagcaaattcttccagctgcaacaagtctttattgctacgagcccctaaaaggaaggtaggtttatgaccatttttcgccaattgttcacctaaatataacataggggctgttccgacacctccgcccacaagcaaaagcttatcagaaggcttttgaggcattgtatagccattccccaaaggaagtactacgttgatcacatcgcccgaatttacttctgctaaacgtcttgttccgtctccaatcaactgaataaggaaccacacttcgttttgtcgcttgtctacaaaattaatagaaataggacggcgtaaaaatgtagtagatgaaccgtccacccgaagttcggcaaactgccccggcaacatctcgggcagcaatgactgagaagtcaatttcagcaatacatagtttgcattcaatctgatattctcagtaactgtcagatctaaaataaatttcttcatgtatggatataaaagtataaattcgtattccggtgcaaagatacaggaatttgctcaaaccaccgattttacctctcatttttcaggtcgaaaggtttcataagtattatcatcaaagaatattcttatttcagtgatttttctggcaggcttttctatgtacctaatctcctgttttacaatctctttaggtgcattttcggctgttcttaatgccatttccttgcgattttccggattaatcgtctctttggacggatttacaggattctcatcaaacaaagaaggctgataatctccattggaagaaaccgtagaagcatcttctgcagatgttatcatttcgcctttaccataaagcaaccattcaagatttacataactataggtctgatgtaccttcattacaacctccaagcttggtttattccgatcattcaaaatatgtgagagagtagattgctgaactccaattgtctcagcaaaaactcttggaggaactttttctctctccattatcattctaattctgtcttttatctccatacagcttctttcttgttacaattgtatgtattaaacgttggtttcacaaaaatactaataaccactacggatatacaaaggtaaatattacaaatcacaaatgcaaattacaaatataaaaatattaatattacagatgtgtagcgatcattacgattggactaatacgtttgtaaaacacaaaataaaacataaaccacgatgacatttcagatttaacaaaataacatattacattgatttataatagaatatata

SEQ ID NO: 211 - DNA, 11784 bp, Bacteroides thetaiotaomicron
tttcaaatatacacttatattttgttgtgatatttaatactgcaaatgtaaatgtatcaaaacaccctctttttttatatcactcgttaaacatgccaatagccccatccgcagaaatcatttcagccgttatttttaacctgcggcaacgactgttgttatagaacctcacctgagcattccctgcttcatccggcatcacttccgggttccagtataatgtgcggcgatagtcctcttctttgggaagaacagaataatcgggatgataaaactctacaggttcgctatagccatccaaccaagtttttctgactcccctgcctccttttacgggaatctctccttccggataggtttcaataaaaacagcacaaccatatatttcatctacatccatcggagacatacggatgtcagcataacgacatcttgccgataactcctcgttgatataaatagacttgatagccaccaggcgaagtgtccggtatcgggtctgatctatttcagtagcctccgttcgtttatagtttatcacatacaagggagagcgacctttgtactgcaaccattcctcaccaccactatacctgcgtatgaaattgggattcatacggacaagtagctcgtggatatcttcaccgatataacctcccttatccaaaatatcatccatctccgaaggtacatcgtagtaagcaaccgacttcgaacgattttcataaatatccttctcacgactccatttcttagccttcaccaccacttcacccaaacggtgatttttctctctcataccccgttttgacagagaatcttcataagcatccataaaacgattataatcgatatcatcaccaatcacagtatctgtctgtagttcctgttctgctcccggtttatctctgccggacaggcttatctgcatttctcccagcggatattgtgtaggttgagggctgaagactctgtctaatacaatccggtggtctttccgcttacctttctccatcacagaaagaatcagattccacttgccaataatatcggtaataaaagcaaaacgtcccacactgtctgtttcaaacaggttaagagaaagcgctcccggcgaagtttcctcatctccccgcttcgccagaaaagaagagacttgtatatttggtttaggcttacctctaacaaatgaaacaacttgtccatgcacttcaatcccttgttcgggcatgtacttcaattcaaacggttccacccccgactcgtatttccatgcataacgccgccatccctgcaccaacaacaagtgatccaaagctgttctgtgctctttatcatccgcttcgaaataatagagcggacgatgaacgtagcctttaatctcagacattaacaataagtccgctaacatagaatgccggctttccacttcttcccatccgtcacgcacagatactgatatcggagcggacacaggcttacccgccgtgtcacgtactgaaaagtccaataagacacgatcaaacggctgataatcctctttgtttttccggacactgattgtcaatggctccggttttctcataaagataaggcggtcggcaataatctgtcctgctgtatcaaacaatacgatctgtgccacccctgccttccattccgtcttgtcaagtttgaaagagacaggtgtatttttccggatgttcaacagacaataattaagcagtttcccatgaccaagcacagctaagcctaagacagactccggtgtatgcggattcttttgtacactgactgctatactgtcttccgaagaaagattatcaacttgcaagacatatccctgcaaccgggcttccggcaaatcaaaacggtactttttgccattcaactccacctcagccttatgattctctccgttcgtaggagtatacacaaaggtgccacgtccttcgtgtacagtggcaaaggaggcgatttctttcttttcccggttgataaccgttccggacagtgcgatcggatttccataggcatccgttgcctcaaaagcaacgcgggaaggaatgccttcgaccaaatttcctccttcaggaaaaaacttcagattgacttttttctccttagccgtttttttccgtacctgcggatatttataaacagcatatctctgtatgttcttttctttaaaatcaccagctgcccgtggcttatcaaataccggaagaacccgggagaaaataacctcctctccaaagttcaacatatatttcgtgtaagcacgaacctcataaaaaccggaataaaaaggtaattgtgttaattcgaaactaccgtggcaacggccgttcctaacaggcaatacacgtttcgctatgacttccccacccggattcaacaattcgacataaagggttttactcaaatccgacgggcggttcagttcagatgtcacaacataacactgaaaccaaacagggtctccctgataataactggtattgtcgaaatgtaaatagactttttcctgtggcagcatttctccaaaattctgcactgcttcaatatagcccgataatttacgaacgatactgtccggcatctgggcttgcaaagaaaatggcagtgccgacaagaggaatagtaagacgaggatagccctgttcatcataattcatctatttcaaattcgtgtttaagattagatctgtcctactccggagagaatctgttctccagtgattaccagccaaatataggaaaaagaattgaaaaattgggatgatttactcatttttatatgctataccatatcatctcccgtcttggcaaatgtaacacgaatcgtcttatgaaacggaatgaaacgcgagataacagctattatgaccgatatcaccaacagataacctaatatttctttcagtgcaagcaacagactctgctcctgcaaagttccataaagagaatgggtagctatctgtaccgcttcatcatatctatgtccttgtgcaagcgcattattcagagattgagtataacgggacgcagccagcgggtcggcagtcgtgatagtctccgacaaagaatatatatatttctgttgcagacgatacagcatattgctgtaaaaagaagtagccatgataggtgccagtaccgaacggaagattatcagaaagaaagcattcgacaacaaaaacttcgggttcaaatcttctacggcaaacaaggcaaaggctataatcaaagtcaacatacccaatccgcgaaaaaagatgggcagatataacatttcatacgtactgttcggcgcaatgccaaaataaagaacaccaaagaaaataacaaaacaactcattccgcccgctatcagaaaccggaaacgccaacgctgccaacgaaaccaccagaaacagataaaagctccgattacataccccgggagcaaaaagatataaagagaataggtatgcgtgctgtctactttcaggatgatgctcaggtaattggtcaataatgtggtggatgtactgaaaaacataacaagcatcatatagaaatatccgatgattgctttaggctgaaacagaggggcaagacttacatagggattcttcgaatggtgctgaatccagataaataatgcgatcagtataggagaaattacaatataagcacaaagtttggcagaagccatccaatccagaactttcccataattgatgacgtaaatcagcatcagcagccctaccgaaatgataaacatctcccgaatatgcaaatcggataacggcaccgatttaatcgggcggttatgccggaaacagatgataacaaacagaacagaaaccagaatcaaaagcatcatgaagtaatacatatacttccagttatagtgatatgccaattgcgcagtgaccaacatggaagcctgtccgcccccgtacactaatggataaaaataagaatagaactcgctgcggatattcttcgcactgaaaatcttctgtgcataacgaataaaccataacatcagaaaacctttcagaaagccgatagcaaaactgcaggcaatcagaatatcggcattctgcgaacgggcgcaaatccaactcaaaaagaactgcaggagcaagtctatcagcaagagaaacttgaccgaaacggctgccagcactttaggaataataggataagcaatggccatgcctgccgaagccgcataatatcccatcgttatatcttccgaattggttccaagcgtattcgatacttcgagcatgcttccggtatacgaaccattcagcatggtaaccggaagaataacaatgaaaatgcaacagaaccccaaccaatcgggcacccaggaacgaacgggtactcccaactctttcattgttatcatttgcgcaaagcttctgtttcaaccatcatacccgctcttaattgtgccatttcttctgaagagatattctccagttctatccgtaccgggatacgctgttgtacttttacaaagtttcccgcggaattgtctgtgggaaccagagaatatttcgacccggttgcctccgagatagcagtgacttccccgttaaaaatcttcccgggcaacgcatctactttaacacgtacctgctgaccaatatagatattggcaatctgtgtttccttataattagcagtaatccatttatccttgttgcgtaccagataagagatggtttgccccgtctggacatactgtccgggttctaaggtgcgcctgcccatatatccatcgtatggagcagtgagtaccgtataagacaagttcaatttagccaaatccaaatccgcttctttacgcaagataccggcttgaactccggttgtctttttactcgtttccgcatattgcgacaaagcagcctgtttttgtgcgactaatgcctgatagcgtgcctcagctgcttcatacgcggctttggtctgctcgtactgttgttccggcaccgattcttctttcagcaaacgttcaaagcgatgatagtcctgttccaattgccagagcttcgccttcgcttcggctatattggcatcctgcacggctatattagtatgggaagtttcgatacctgagtgaagaacatcctgcaaaccgtgcgcatccagcagagctgcttcggcttccttcactttaatttgatattcacggttatcgagcactaacaaggtatctccctgacgcacatattgatgttccttgaaacggatatccttgatatatcccgaagcacgtatatttaacggagcaacgtattggtctacaaaagcatcattggtcacttcgtagttaatgtaacgccaaaaataagtaatagtccaccagagcccggagacagccaaacatacacacaccatatttaatatgatgttgcgagctctcatttttttaagtttccgttttttttcctttaatgttgccataaccctaatatattatagacgaccacaagccttctgaagttgataataagtataaatcacacgagtgcgggcagtgaccagctgcaactctacattcaaacggacagagttggcatccagcaagtcagtcagaatagccaactgattcagataacggttctgcataatacgatagttctcctgcgcctgccggacagacaactgtaaggcttctacccgttgcaaagcttcctgatgccgcagaaaagcagtgcgcacatccatacggattctctgcatcttctgctcttcatcattcttacgcaaagacaccatcagtttgctttcctttattttatgactgtttttgtagattgaggataaaggataagaaaccgacagtcctacattccagttattgttgtacatatccgtcaatgtacgcgaaacagggcgtgccagtgtatttgaggcatacagcgatatgctgggaagagacaacgactgagccaaccggatctcgttccgggcaagttccgtttgttttctgagcaatttcattgccggatcatttgtgtaagcaagggtgatatagtcgtcatacgcttccagagcaactgcctgatgcagtagggtcgtatccggtttcagtaacaggttctcatcctgtcccaataaaatatccagctgctgcgacacgagtacgatgctattttccgtttcctgcaaagacaaacggtcgttcgtcaactgcatctcgctgcgcaatacatcattattcgttatcaccccctcctttttcatccggcgaatatcccgcaggcgtaattcggattcctcaatgttccgcatcaatatctcatgctgcttgaaaaggctgaacagattcatgtattggttcagcaaaccaagtttgatttccgcctggtctgttaatgtctgcaactcggcaacttgtttttccatctctgccttatggatagtcctccgaatcttgccaccttgatacagtggttgggaaaagtcgatggcgtaattctgtgaccagtccggaatatccggatatgtcgggccggacaatccccgttcccaaacgaccggctgtcccacaaaacctcctttcaatcccacttgcagatcgggcagtgatgatgtgcgtgccgtccgtgtccgttcttgcgccatggcttctttgagcgcatccgcctgaagctgcaaactatgctgcaccccccgttcgaaaagctggtctacggaaagaaataaagaatccgtctgcgcctttgccggctgaccggcgaacatcaggcagagcggccccatcagatataccctatacgttttcaagaacatcgtatactccctttaattccgataacatgagttcaatgctttctatgccaatcacctgttctgcgtatacataaacctgatccagtatgggacgaatctgttccttaaactcctctccttccggagtcagataaacctgtttgttgcggcggtctgccggatcttccttccggtggacataccctttcttctccagattgttcatcagattggtcagacatgctttgtcttttgcgatacgttcagccaatatttgctggctaatgccttgttcatgccataaacagctcagtacctgaagcatttcgaatgtgatacctgcgttgttctttctcagtgtccgctgcatcgacctacgaaaagccatgcgggtacggaaaacctgtagcatgagttctctaaactctgctccttctcttatcataaaagtactttttaccttttccgggcgcaaaggtatgtatttctaccgaattagtcaaacgtttgactaatttcatgtaaaacgactctataaattgttccattcacccacactaatctcttattttcaaaataaatgagcagaatctttgttcatctgaaatcttttattttactttgcatcacaaagtacttttttatatgaataaagataaagcattagaatcagtaaatgagataaaagagttgatggaaaagtcctccaagtttatctcgatcagtggattagcggctatcatggccggagtttacgcactagcgggtacatacatcgccacttgccttgttaccccggacacaacattaatcacagccttgaagctgatgattatagtggccatccttgtattggcagctgccaccgtcactgccggcatactgtcttacaacaagtccaaaaagctgcgacaaaagtttttcagcaagctgacctatcgggcattatggaatttttcacttccgatgctgaccggaggcgctttatgtatttctctgctgctgcatggatattatgacattttatcctcggtcatgcttttattctatggactgactttggtcaatgtttctaaatttacctatgccaatatagcttggttgggatacgcttttatctgtctgggagtcatagatagtttttgggaaggccacgccttactgttctggacgataggtttcggtggatttcatatcctctatggaatactgttctatttacattacgaaagaaagcagtcataaatgatagaagcatttcaaaatataaataaggcattcgagagtaaggtccggctaggaattatggctgttctgatggtcaatgaggaagctgatttcaattttctgaaagaacaactctcactgacagacggcaatctggccagccacacccgtgcgctggaagaactcggctacatcgaatgcagcaaaggctttgtaggacgaaaaccgcgaactgttttccgggccacaaagcaaggcagagaagccttcaaatctcatattgaagccctggagaattttctaaagtcaacataataattcactaaacactattatcttatggacggtttcaatgaaaaatcaactgagcaagtgcaggaacaacaaccgctgggatgcctccgccgcttctctaaaacaatcaaggtcatcattatcggaggattaatcattcttctgatgataccgatgttcatgatcgaagatcttatttccgagcggggacgcacgcaggaagaagcaattaatgaagtaagcgaaaaatggagccttgcccaaaccattaccggcccctatctgaatatccagtatccggtaacgacagagaacaacggggaaaagaaggtatcaatcaaggcccttttcttgtttccggacgaacttctggtcaatggacaattgaaaaccgaaatactcaaaagaagtatttatgaagtgaacgtgtatcagtcggaactgactttgaaaggtttattcagtcccgaagagctgataaaaagcagggtggatatggaacaactgcaatttgacagagctgccatctgcctgaacctgacagatatgcggggcatcagtgagcagatcagtatcacgctgggagattcagtttacgtctttgaaccgggaatggataacagagggataggcgctacgggagtacacgccattaccgacttatccgatctgaagaagaacaagaaactgccttatgagattaaaatcaagctgaaaggttcgcagtccatcaactttatcccattgggtaaaacgacccgtgttgatttgaaagccaactggaatactccaagttttacaggaaactacttgcccaacaaccgcgagattacagaaaaagaattctcggcacaatggcaggtactgaatctgaaccgcaactattcgcaggtcctgatgaattacaacaataccaatatcaaggatattgagaactccagtttcggcgtcaacttcaaaataccggtagagcagtatcagcagtccatgcgttcagccaaatatgctattctgattattctgctgacgttcggtgtcattttcttcactgaaatcatgaataaaacccgtattcatgcgttacagtatttgctggtaggtttagcactctgcctgttctatagtctgctgctctccttctccgaacatatcggctttaatcctgcttatttgttatctgcggcactgactattatattagttggcggatatatgttgggaatcaccaaaaagaagaaaccgtcattgatcatgtccggactattaagtgtactctacctttatatcttcgttttgattcaactggaaacctttgcattattagcaggcagtttgggactatttatcattttggcaatggtaatgtatttctccaagaagatagactggttcaatgagtaaaattaattatggtgtagtaattaccatgattgaaaatagtgtcactatccgctcgttatagtgacactatcacagagacatagtgacactatcgtgacgggatagtgtcactatatttaagccgttaatacaaccatcctatcaggaaccggcacaagacatcaccaccaataattcctataagtgcgactgtccataacttccattgtttcaagttacaagacactttcaaggcattaaacatccaaatcaaagtaagtatcagaaacggcaatcccaacagtgtaagaatcattgccaggataaaataaggctgtgccagcatttcttcgggagacatattcatgttcatttgtgacatcatccgcatggccggcaacaggctgatcagattcattccaagcaacggcagctgagcaaacaaaacagtacccagtacatctatcacacgaatgcgggaatgagacagaaaaagacctcccagataaaagagcagtgcaggaatcagccacacaatcagatgttccgccagataacaccaccaagccggattgggggccggtccaaaatgaagcaaaccatgataatgataacccgatatccaacacaataaggtagatactattaagcccagaaagccccatatcaacgcttgaccacctgcaatccgaataaacggattcactattaattttactttgtttttcatcacatatccattttagttagtttatctattatatcgtccaacatatttcgaactgtagggtagctgactcctatgttcttcgccatatctttcaaactgccgcttgactttacaaaatcaagaacaaattgctgctctttctccgacaggcgcgccagtaaaggcaattcaaaattgccacaaacttccgtattgcattcttcacaaaacaaccgtcctactttcaatggagcatcacaggatggacattgcaatggtaaccgtttctttacttcattcatatcatcttcatttatgatgcaaaagtagagataaattcgaataaaaacaaacgatcacatcaataatattaatatagaatttaattttattcattattgatttaattataatcatttttatattcattcaaagaagaactttccattattattcaccatatctctgtttttttctatctttgctttgattaaaaagataaaacgatggaaatactatatataaaaggagatgccacagcaccgattggttcaggtgtcaaagtgattactcatatttgcaacgatatcggaggatggggaaaagggtttgtactggcactttctaaaaaatggaaaatgccggaagaagcctatcgccagtggtacaaatcacaggaagaatttactttgggagctgtacagtttgtaaatgttgaaaataagttatatgtcgccaatatgataggacaacatggcatttataaagacagtaaaggactccctcccatccgttatgacgccgtccggcaatgtttgaaggaggtagccctgtttacaattgcccacaaggcaagtgtacatatgccccgtattggctgtggactggcaggtggcaagtgggaacttatggagcaaatcataaaagaagagcttatcaccaaagaaatagctgtaaccgtatatgatttataaataaaatcagagctatttggtgaataacccgcttttcttatgaaacacttgacaaacggcttttaatgttgtatctttgaggaaagaaaactaaaaaagaatgagttttattaaaaaaatagatacataacacacacataaactgatatctctttatatcagagcaaccatgatatggggcaatagtcggatgattattgccccattttgtttatattttcgcttaattcattttatattttcttccaaaactcaaaaaatagtttttaataaactcgaataccgtttctaataaacgtgcaaaaagtttattagaaactgaaactgcgtttattaacaacggaaataataaatgtaagaataatagacctctcttttcagatgaagaaactatcaatattacgggctcttctattg

SEQ ID NO: 212 - DNA, 11776 bp, Bacteroides thetaiotaomicron
aaatacgacgaatattaagccttattacctaattactgaaaaaatagtcgcatagacaaaaaaagaggaacgactattttatattaaaaaaagaaggggatgtgccttagttttgacacagccccatgagtaaggcagtaggaagttatctgccgtaagctcaatcacgcggctaaaggcttgattagtggtgaaagcatctatgcccactttcatcagataatcactggaataagtcttttcgttggcagccaggctggatttactattcggcatcagattgatttcttttaccttatacattttcttggcatccaatccctgtagtttaacaggcaatagttagtttgcgggcataaaaaaaggctatctatcccagacagccaatcttttgttaaccttaaatctaatactatgaaaaacacactacaaagatagggacttttcggctatctccaaattttcggggcaaagtgaggcgctttataacatggtttaatagaaataacgggtttgttaacgattaacgtaataagactaaaaattaactaacgagctattggcctgatgctcttttgcaggattctcaaaagacttttttacttgttttaccttcgtttcattgagagttatcgcatcaatcggcaagttggattttttttctcttttgcttgcttttttcgtttgatttccatacttttagcctccataaaaccctttaataattaattctatggatagcattcttttctggctggttccggtcgcttcagtgttagccctctgttttgcttattacttccataagcagatgatgaaagagagtgaaggtactccccaaatgataaaaatagccgctgcggtacgcaagggagctatgtcttatctgaaacaacagtacaagattgtaggttgtgttttccttgggctggttattttgttttcaattatggcttatggctttcatgttcagaatgtgtgggttcccatagctttcctgacgggtggtttcttctccggtctttccggtttcctgggtatgaagacggcaacctatgcttcggcacgtacggcgaatgcggcacgcaattcattgaactccggactgagaatcgctttccgcagtggtgcggtaatgggactcgttgtagtcggactggggttgctcgatatatctttctggtatctgttgctgaacgcggtgattcccgccgacgcactgacaccgactcataaactttgcgtaatcactaccacgatgctgacgttcggtatgggagcttccacacaggcgctctttgcccgtgtaggtggcggtatatatacaaaagctgccgacgtaggcgccgaccttgtgggtaaggtagaagccggaattcccgaagacgatccgcgaaaccctgccaccattgccgataatgtaggcgataacgtaggcgacgtggcaggtatgggagccgacttgtacgaatcttattgcggttctatcctggcgactgccgcattgggtgctgccgcctttatacattcggcagatacggtcatgcagttcaaagcagttattgccccgatgctgattgctgcggtaggtattctgctttccattatcggcatcttctccgtgcgcaccaaagaaaatgcgacggtgaaagatttgctcggctcgctggcattcggaacaaacctgagttccgtgctgattgtggctgctaccttcttaatcctgtggctcttacagttggacaactggatttggatttcatgcgctgtcgtagtcggcctgttggtcggcattgtgatcggacgttctaccgaatattatacttcccagtcgtatcgccctactcagaaactgagtgaaagcggaaagactggacctgccaccgtcattatctccggtatcggtctgggtatgctttctacggctattcccgtgattgcggtagtggtgggtatcattgcctccttcctgcttgcttccggtttcgatttttccaacgtgggtatgggactctacggtatcggtattgccgctgtcggtatgctgtccacattaggaatcacactggctacggacgcttacggcccgattgctgataatgcaggcggtaatgccgaaatggccggtctgggtgccgaagtccgcaagcgtaccgatgcgctcgactctttgggaaatacaaccgcggcaaccggaaaaggttttgctatcggttccgctgcattgaccggactggctttgctggcatcctatatcgaagaaatccgtatcggtctgacccgtttggggacagtagacctgagtatgccgaacggcgatgttgtctcaaccgccaatgctacctttgtcgatttcatgaactattacgacgtgacgctgatgaatccgaaagttctttccggtatgttcctcggttcgatgatggcgttcttgttctgtggattgacgatgaatgcggtcggccgcgcagccggacacatggtagatgaggtgcgtcgtcagttccgtgagatcaaaggcattctgacaggagaagccgagccggattatgaacgttgtgtggctatctcaaccaagggtgcgcagcgcgaaatggtgattccgtcgctgattgctatccttgcgcctatcgctaccggattaatcttcggagtgaccggagtactgggactgctgatcggcggtttgagcacaggttttgtgctggctatctttatggccaatgcaggcggtgcgtgggataatgcgaagaaatatgtagaagaggggaactttggaggcaaaggcggtgaagtgcataaggcaaccgtagtaggcgatactgtgggcgacccgtttaaggatacttccggcccgagtctgaatattttaatcaagcttatgagcatggtagccattgtgatggcagggcttaccgtcgcctggagtttgttttaactaaaagaaggtttgtttattgaagagggcgatagccggagataagtccggttatcgctttctgattatatagaaccgggtaaacaccttttttgcgcacttaatcacttttttccggcagatgatcctgtttcggggcatttcatgcaaatactcgctcaaagccattttctcgtctcttattatttagatacttttgcaagacgatatattataagttataaaggggaaatggaagaaatctatcataatggctaaggggaaaggctgatgttatcaacgaacaaaatctgtaaaacgaatggtagggtgatggttccggtcgtcaaggctgtgaaccggtagaatatatttggggaacaattgcttgtttgtgtgaatgaatgacggaaaaaggggactttgaatgaggtctccttttttatttcctttatctttgtggcaaataagaaaaaaagaataagtatgctactaccttatttaaataaagacctgatagaagccggctgcgatgaggccggccgcggttgcctggcaggatcagtgtatgccgctgccgtcattcttcctaaagatttcaagaatgagctgctgaatgattcgaagcaactgaccgagaagcaacgctacgcacttcgtgaagtgatagagaaagaagcgctggcatgggcggtaggagtggtgtcgcccgaagagatagacgagataaacattctccgcgcctcctttctggcgatgcaccgggctgtcgatcagctctctgtccgtcctcagcatttgctgatcgacggaaaccgtttcaataaatatcctgacattcctcatactaccgtgataaaaggagacggaaaatacctctcgatagccgccgcttctatactggctaaaacctacagagatgattatatgaatcgtcttcacgaagaatatccgttttatgactggaataagaataaaggatacccgactaaaaaacatcgtgccgccatcgccgaacatggaacgaccccttaccaccgaatgaccttcaatctgcttggtgacgggcagttgaacctgaatttctgatatttccttttgtttcactttctacatatttttgcagaataagcacgaattttctccaaatagccatgaaaatgttcggtttatgctaaaaaagtgttgacttgtgcttttatttgttacttaaatgctatatatttgcattcgataacaagaattaaaaaaagataaaatcatgacaacaagcagactttatgcatctaagaagttcatgggggctttacttcttatgatgggttttgttttacctgccaatgcgcagtttttacgtacttcatattttatggaaggtactcattatcgtatgcagttgaatccggctttggcaccgactagcggatattttaatattccggcaattggttcgttgaatgtatcggcaagttcaaattctttgggtacacaagatattatagatattattgataatagtgatggtttctataataatcagaaattcatgaatcgtttgtctaatgataaccggttgaatgtcaatgtcaatacggatattctctctttcggatggtataaaggaaagaacttttggtcggttaatgtaggtgcccgtgtagatttaggtgctcagatacctaagtccatgtttagcttcttgcacgatattgatcaagatggtttcagttggaataattcaaaatttgatattggaaaggaagaattgaatataaatgcttatactgaagttggtattggttatgcccgcgctattaatgatcgcttgtcagtaggtggtaaatttaaggtattacttggtatgggtaacttgaatttgaaggtagacggaatgaatgtagatgcgaatttgccactaaacattaacgatattactgatgtcaatcagattcgtgattatcatgctaaaatgaaagtaaatgcgcgtcttgagagctctttcaaaggaatggatttggtggaaaatacgagtgatcctgatcctcggaaacactatattgatgattttgattttaacggatttggcattgcaggttatggtggtgccatcgatttaggggcatcttataagattcttgataatttgacagtgtctgcttctgtgttggatttgggttttatcaagtggtcaaaggggagtacaagtgttgcaacagctaaaggaagtatggattatgatggcaaagactatgcacttactccggaagggttagaggatttccagcgggatgcccaagattttatgaatcgtgtggaaggtggggatgttttgaattacgaaatgctccaactgcaaaaagaagatgttgttgagtctcgtaccacttctcttcattctacagtagtaattggtgctgagtatgaactgttggataaatggttggcgattggtgctctttccactacccgcttcactaagccgaaaactcagactgaaattacactttcggctaatattcgtccgaaaagttggttgaatgcggcaatcagttattctatgattcagagtgctggtaaatcatttggtttggctgtgaaacttgggcctttgtttatcggtacggactatatgttctttggaaaaagtacaaagacagtaaatggatttgttggtatttctgtgccattgggcggaaagaaatccagtaaagaaggataaaataatttctctctcttaaacattctctttttaatattctctatcgaacaaaaaacgtattgtgtgcagcctgtcatcgctgaccttgaattcaggtcttaagaatgacaggctgcttttttatgtctctgacgtaaagggagatttagaactgcttgaatggcagtcgcttgaattagaaccacttgattttccggaatacgataaacgctaatgtcgacagcacgacagagcacaggataatcagtgcaaaggcatacggcatctcttccagatggatatccacattcattccgtagaaactggctatcaatgtcgggatcatcagtgtaatggaaaggctggtcatgcgtttcatgatggcattcacgttgttggagatgatagaggcaaaggcgtccatcgttccggtgaggatatcgctgtagatattcacggtattaaatgcctgtttcaactcgataatcacgtcttctaccagttccttgtccagaaagtcagtgtcctgaaagatactttgcagctttccgatcattacttcatttcctcggatggaggtgttgaagtaaacgagtgttttctgcagtctcatcagacggagcaggtcttcgttgcggatactgcgttccagttctttttcggcggcgctgatatccagatttatctgtttcagatatttcagaaaccatacggcagacgaataaatcagccggagaatcagatcgagtttgttgcggacttcgattccctttcggcgggtgtgttcgatgaagtccggcagcaggtctgtgttgtggtagcagactgatacaatgatttcattgttggtgatgatgccgatgggtacggtgccgaagggaagactttcgttctgaccgttttgcatcgggatgcgcagaatcgtcaatagccagttgccttccgtgtcggttcgcggacgttcgtctgtatcggctatatcgttcagaaatgattcgggtacgttcagggttttagtcagaaactcaaagtcatcgttgtccgggcatactacgtttacccagcagttaggaagccattgcggtttttccacaaagccagcttcacaataaagatatgttctcatcttattgcctcctttcgtttgtttacacgagcagaggcatcagttttcaatgactctgatcgctttaattaatactataagtgcacgttcgcgggtttgaatcgtccatttttctatgatttaatttaaaagcgatacaaaagtacggaaaattaaccgaggttccgtcttttgcatcgctttttttaaattttcttgttgtttatggtctttcagtgtgcggggagttcattggttgactatggtaaaatcacttgtaagatagtgctgaagttcccgttagctccttatatagtagactttccttataaggaaagttgggataagctaccgatatcattagttgttcacggccgtggtaagagttgctcacggtcgtggcaaatgctgctcacggatgtgatcaagtcttgtcacggccgtgaacaggtaaagatgccggtagcttacagggaaaacgcattatactttttcttttatcttttatacatttatcttacatgaatatcgtcttttcatcttattaataagatatttatctttcatttacaatattatttaagtacatttacgtgattataaatcacaattaaaatgaagcaagaaactaaaagaaggattgagatcagcaacctacatgaatttgctgattcattaatattgatagataaccggatagagcgttgtaaaaagcatcaggccagtaccattgttcttattgccatttctgctgttatatgtggcgctgatacttggaattcaatagaagactttggtaaaagtaaagaatctttttttgcagccaagctttccaattttaatggcatcccttctcatgatacatttaatcgctttttctcggcattagatcctttaaaatttgaagaatcttatagacaatgggtccaaagcattctcaaatgttattcgggtcatatagccattgatggtaaaaccatacgaggagcctatgaatccgaagaggacaagcgtcgtcgtaaacaaggagtacttcctgattcgaatacgggaaaatacaaattgcatgttattagtgcatttgcaacagaactgggaatctcccttggacagttatgcacacaagaaaaggaaaatgagatagttgtcattcctgaattattagatatgttgtgtataaaagattgtattattacaattgacgctttaggatgccagcgtacaattgcagagaaagtcataaagggagaaggtgactacatttttatagtgaaagataatcaaccgaaattaaaggaaacagtactgtcagcaacagaaagtattgtatcaaaaggtacaacagtacgatttgacaaatatgagacgcatgaggaaggacatggcaggaatgagtcgagaatctgctattgctgcaacgatcccggttttctgggagcagatattagaaagaagtggaaaaatatacggtcttttggatatattgagaataccagaaatacaaacaaaggcactacagtggaaaaaagatgttttatatcttccttggaacctgatgcgcagaagatacttaaaaatagtagagaacactgggaaattgagaataatctacattggcagttggatgtcaatttccatgaagacaataccagaagaagaaatatatcagcattaaacttctccgtactggcgaaaattgcattggccacattgagaaacaacaaaagagagataccaatcaatagaaaaagattaatagcagggtgggataatgaattcttatgggaacttattttacatgatttataatgcgttttccctgcggtagcttaatggaagtataaaggcatgatgagctaaaagcattggtagcttatcgtatttgtggtataaggtcaagactcggatgaggcgtgataggtgtaataagtaataagtaataggtaataagtaacaggtaataggtaacaggtgataagtaacaggtaataggtaataagatggggaggaaatgacaggtaataagtcatgaaataggggtgaagtgacaataaaaagcatgatttacggctattatcaccttattatcaccctattgtcaccagctattatcatcagaagtgtattcattatcagcttgttatctccaaaaggtgataagtgacaatagaaaagcattttatttctagagagtatctgtcatgctgaatttgtcgaagaggaaggcaaaagtcaatagtaactgaaattgggctgactaaaaagtcaatagtatcttaaatctcctccttcgggaaggaggagtacccgtagggggaggtggtaggtaaatacataaattattgttattcaattataaagtatgcctaccactccggttttcaattgggaaagtggctactgacctttgatcttatccttaatgtgcattcttgtcaaagtgtcacaaccagactcagtcgggattactgatcattctctccctgtccggcagacccggaaacggggaagtgctcctccaaatactttctgattctatgcgtccccagtttttccttggagatactgccgtcttttagcacaagttcatagtgcggaatgccgttgaagcggaaaagttggcgcagataattgaactctgagtcggtgacataatagctggcttctcctttcagattcttttccacgtattgcttatatgcaccggctggtgagtctttctgtccggtgatatagatgaactcgaactccggatgatctttgtattttttgcgcaggtctgccgtcgcttctattcctgcgcgacaaggtccgcaggttgttgcccagaagtcgacgaacaggacttttcccggatgattcttaataatgttgcggaaaacgtcggtggctttgccttccggaagttgataggaattgactttttccttcggatgcgttttggcgaacagatattcggcctcttctgccaattgtgggtgagtgagcttttgcttgatgctgtccacatactcacgggcaatggaacgtgtcttgatattctgcaggctgaaacccaggttgcggactttggctatttgccaaagcaaaggatcgggcacatcatatagccgggcaagaatgctgtctttcttatgaccggttttttgttccatcgagataaagtttctgtccatgtcttgctctgactgcttgtttttatactgcttgtcgatgtactccaggactagtttttcttctttttcgtataagcctgtcaccttgtcattctcttcttgaagttcttttaaggggattctgacggttgttcctgccagtttctcctgtttcagtctgattgcctcctgttctgcattcagttttactcctctctctttaagaaaagcgagaagcgattcttccggatacgtgtaagagatggtatcctttgctttcggtgcatgataattataggctgttctgaaggcgtccatatattcaaaccggttgataaaagagctggcattggcatcggcgagcactgtttcatcattcagcggcatcttcttcaagaagtcgtaataagaatcttcttctttcactttcaaggcttggttggctgtatcctgcttcgcataataatctctgctcatcagaaagtcgaagaataagcctcctgcctgcaggtctgccttattcttgatcagacgggcagcttttgccgatgggcggcaaatctgaataagtgaatcggctgtatgctcccatcgggcgacaatcggcttcatgtgctcctgatattggctgggagtcagtttgttgcgcgcgttggataaatcatcgtaacggtaggggatcagcgacttgaattctttcagcagataggagagggaagccgacgggcccatgtaggctgtattcttgatcgggaaataatagtcgcgtgcacggctgcgtgccagcaatgcttcccagtcgatatacatggtaagcgtctgtccgggctcgatatagaatggaatccagttgttgtcaagcgtgaccgactgttccacaggatgcttgatgacaaacttgcacaggaagctgccgtcttcgtctatctgaatcacagtcgggtagtcctggcgggtgatatggttggatagatagatgagtccggtgtcgaatcccagccggcggtcgtagccgtctatatacccttgcagacaggtggtgtctgtgtggaagaactgctggaaacctgtgtcggcagcgattgtctttgtagctcccctttgccgggtatacagctgattcttttctccgttcacttgtatctgacagcttccgtctttctgcggggtgaccagcagggtgcgtatgtctccattccgcttgtccttgacggtgatttccacccgcttccctttcttgcggatgttttcgttggtaaatatccggttgtccataatcgtaacagaatcgtagataccgtattcccaggcgtttaaatcatctgccttgaaccagtttcccttgattgccgccaacggcgaaacgtttttgccggaggacggtactaaagatatgtcatacgtatttccttccgtatcgctcggactgaggagatggatgacctgcgtctcttccggcagagcttcgaaaacgagcacatagtccatctcgcccgaatcgggcatatacacttccttattgagctcaatgccttccgcactcttgaactggtatttcttgccggtggctgcatcttccagataactgtctccttcttcctttatccaccagtgcggacggaagatggcgtgaatataaacacgcgtgccatcgggcgtgcgttctatacgggtgatattgccaatacttcccgaacgggctttgaatggcggattgtcgacggtttgtgctgtgagcatacccgacagcatgagcatcatgcagagtagaatcgttttcataatattaaattttgaataaatgcatttagtagttccttatacaaagaaagaaaaatatccatagctccctctctttttcccttttaacttaacatagattaaacgtttacgtaatcatc

SEQ ID NO: 213 - DNA, 11539 bp, Bacteroides thetaiotaomicron
cagatgtattcttgttaagtacaaagaccgtttagacaatttgtctttcaataacggcgagcatgataatttttactataaaatgatttattacttgcttgtcaatccatacaccaatccttctgcaatgaataattaccgtgtgtttttagatataaaagatacgaaaggacgtgcaaaacttaataaaatccaagaggtattctctaataagtttcatggtaaatcgccttttctttcttttcagcatatacgttctcacgaatcacaatttatacagttagcggattttttcataggtgcagtaacttataaagcgagaggccttcacttgaagaaagatggcagcctggcaaaaaaagaactgatcaactatattgaaatgaaatctggttatgttttggatgaaggcacagaaccgggagaaatcaaatttaatatttttgatcaccaacctcgtaagcgcaatgacagtggcagatgaattaggagctttaaaaccgtattttgcagacggggttgcggaaacggaacaggaaaaaatggatgaactttatgccatttttcatcgggatttttttgagaataccgtaatcattgatggtattcctttaaaagtgaaaccgtatttgtataaaaatagcaaaaaagacaatcttcccgttgattttgaacggtactatgagaagtttgttcacgtgattactcgtactatcaaaggtggaaggtataaaacttctgggaaaatacgggagtttcgtgaagaaagagccaatagggtacattggataagacctattttagagaataaagaagataagcgcattacttattttcagtatattgaagatgacggaactcttcgtgactattattggtacaggggcaaacaatatattgttatagttgaatacatacaaccggattacgcattaattacaggattctgtgttgattgcgataatcaaccttattatcaaaacaaatatataaacagggaaaaataagggcataaaaaaaccgcatttacggtaatgcgggcaaccaagtccttcgttcttcgagcgatgacactgcaaatatagatattccttttgttctaaacaagggtttgagtatatataaggaataatatatgtttttttaacttcgtataagttgaaattttaccgccgtaaagtttacaacggtaaaattttggttatatgtatagtataaaccccacttcgctgcttcgttggaagccggcggggtggggttgtttttatggcttcggttacaggaactataacttcagcttgggtttgggcttttcgggctggtcaggatcgggatcgtctttgttgccgagtttggggacacctccgatgacgagcttgccgtcgagtgtatccattgcctctttgatgctgatgctttggggcattccgcttagtttgggcgggatgcgctgcctgtcggtaaggaagtcgggcatccggtggacataaggctcggctgggggcgtgtcctgtgtggggacactgttcggtgagggactgccgggcggagcatcggcgacgggtatgccggcgacggggacatcatcctgtctgtcgggtgttaccggttgggagggcacgacttcgatcactccgtcgttgttcttttcctgtgaatccactgatttgagggagagcagtatcttacggtcaagggcgacaaggtcggctttgagctgcttcagctcgtcctcctttttccagacttccccgacgacctgttccaggacggggagttccttctcaatggcttcgttgtccctcgtgtatttctctatcaggcgggggatgctgtcgaaagcgttgatgaagttctggcaggcggttttcggatcgaccgccagacggccgttgttgtagttgtagaggaagttgccttcgccacgcacgaaaaaacggttttcgcagaagtccagaccgtccttgacggtggtatcggtcttgacaacgatgtcgaaaccatagagcgagccgatgaccttcggctggccgtgcgtgcgttccctgtcctctatctcgtggagcttggcggcaatcactttcggatcatcgcttgccacgccgtcaattttcaaggggttgagcctgttgccctccttgtcgtactgcatacggctctcgatggcggccttgtccttcctgacgcgggcgataatgtcatcgttacttgcccggttcgccaggaaagtttccagtttgatgcgtgattctcccttgccacgctggaaggctttgcgctcgccttccatgccggcaatccgtttctccaaccgtgccttgtcgagcaggtcggtatttccggagagcaccgccacgtattcggagaagggtatgcctcccttctcgtccatgcctccctcgtcgatggtacggcagcccatgttgttctgcttgagctgggtgatgaaaagctgcttgttgtagagcaggttgaacttgtagctgtcaagcgacttctccacggcgtagattattacgtccaccttgttgtccgcatagagtttggccacctcgtttcccttgcggataccccggccgtcccgctgctgcaagtccgaaggccgccacggtgcgtcgaggtgatggatggcgacacaccgcttctgggcgttgactcccgtgcccagcatttcagtagagccgaagagaacacgtatctttccctcgttcatcgcctcgatcatcgccttgcgtttcttctcggtcttggcttcctgaatgaaacgtatctggtcttcggggatgccgtgatcctccaccagtttgcgcttgatctcgctgtacggattccactggtcgggcttgtaggttcccaagtccgagaagacgaactgcgtccctttgtgcccggcgtatttattgtaatacttcgcaatcatatcggcgcaatgggtggccttgttgtccttgtcgtcgccataggacagcggatcgatgagccgcatgtcgagcgacatctttcgggcgtagtcggtggcgatgagcatcttcgctttctcctctctctcgttcagtggcggtcgtccgagtacggtggcattgccggtcttggcgaactcgatgagcttctgtatgaactccttctggtcgggcgtcagcggtatgttgtgcagtatctcgttcttctccggccggtcgatgccgatgtcggctgcggtacggaagtcggtaatttcagaatagaacgaggcaagttccggaaccttgataaagtaacggaaacgctctttctgcaccacctcgttggtgacggagaactcgtaatcgacggactttcgggcaaataccgccgcccatgcatcaaaggagttgatcccctgacgctccaactccttgggacgcaggtacttgaagagcaggtacagttcggtcagcgagttggaaatagtggttcccgacaggaaggtggctcccaaatccttgccggtgcgctgctggatagtacgcagggcgaacagcatgttgagcgcacgttggctgccctcgctgtttcccagccccgccacacggtcgtgccgggtggtgaacatcaggttcttgaaccggtgcgattcatcgacaaagaggtggtcgatgcccatgcgcttgaagtccgccacgtcgtccttgcgggtctcgatctcgtggagcagccctttcagtctggcctcaaggttcatcttacgcttctccatgcccttgatctgtgcgttgcttacttccgcaccctgctggtagaggacttcgagattctcttccacgctgtccagctcctgctgcaagatgtcacgctggatttcgggggactgtggtatcatgccgaactgctcgtgcgagaggatgatggcatcccagtcgttgttcttcatctgatggaagatctcgacacggcgttccggcgtgaagtcctccttgccgggatagaggactttggcgttggggtaggcggtggcgaaagtctgtgcgatctcgtgaatattcgccttcaggccggtgataaggggcttgttcgccagtcccagacgtttcatctcgtaggcggcacagcacatgatgagcgtcttgccgccgcccacctcgtgatcggcgatcccccctccgttctgcttgagcatccagatgcagtccttctggctggggtacaggtcgggaatgcccaagcccttgaggtcgaggccgggaaagctctggtgcgatccgtcgtacttgggacggacgaagcaattgaacttgcggttgtacatgtccgccattttccgcttgaactccggtgactgctccatgagccagtcggagaagccgttacggatctcgtcaatcttgctgttggcgagcaaggtgacttcgggatcacgtatcttcatctcgttgcccgctttgtccaagacggttttggtgatgttgggcgtggtgttgtggatggcatggcgcataagggcgatgccgttgaagatgcggctttccgaacgcaccgaatattggttcatgatgcgtggggaggtcatgtcggccctgatgctgtactcgtcgctgctggcggtatagcggacggacacatctgtatcgaacagccatgaggcatagcggctgtaaaccgccgccggtatccaacgctcgccgaaattaaaatccagatcctcgaaaggtatgggcgtgggaagcgactgccgcaaggcttcgagagaaatacgggcctcgccgttgtcgggatgcgactgcaaatattcttcgatatgttcggctttggccatgacgttgccggaaatgaaacggtcggcaatctcgtagttcttcgagaggggattgtaaaatatccgcccacgcagttcttccaacagggcggactgcgacttgtcggtcagggactccatgtacgacatgttcacgttgccatacttgttgagcgaggcggtgagcgcctcgtgcacgtcgtcggtatgggtgatctcgttgatgttgtacgaaacgggatggtcgaagatgtcggccttgaccgcccggccgtcgatgtaacgctccagcgacagtatctcacggttgcccgcatccatgcggaacaggtcgatgttcttcttgtcgttcaggttgccgaactgacggatgaaatcatcgtaaagggtgttgagcatggtgcgcaacgccggattttcggcatggatggcggcttcgttctcgtacaggtgatggtaggtgtcacgtatctcgatgtatagcgacgcacggcgtcgctggcgttcgggcagatccaacgggttgaataccggtgcggcctcgccaatggcggaaaggtagcctatctgcccgtcgtcgtccacaagagagccgttacggtggtgcccctgtaggtcggccggataaggacggggcttcatgcgctcctgacgtgcggcctcttcctcctgccggtggcgttcccgttcctgacgttcctgctcctgccgctctttctcttggggagccggttcggtcgggacggtctgcatggcggaatgttgctccaacggcggtatatcgaagagggacaattgtccggagtcctcctttttgcgccttgttttccttttcctgacttgtgaacgttcctcttgggtgaaaccgaaaaggtcgtatagggacatagccggctccggcgtggtctttgcggcggttggccgggcatccgttgaaggctgctccggcgtgggagtccgacgctccacctgtaccgtctgttgatccgtagaagtggaatgtccgctcacgtcaccggaccggttgatttcccgcacctgtgcgatgcgttgctgcatggtttccgccggacggctcaccaggttgcggaactcctgcacgggtgaatggcggagatacaggtccaggtcgagctgttccgagaggttgcggtcaaggaaatacttcatgtcggcggcgatggcttccatacctccgtcatgcagatagatgcgtgccggcttgccgtagggatcggtaccgacatggccacgtgtatgcacgatggcggcggtatgctcgaaatactcgttctgcgtcgtcccgtcggcctgcgtgccgacttcgacgaaagaccgttcgagcggggtgtattccctttgggaaagtgtgtccttctgcaagatgaccaggtcgctgcccacctccgtaccggcataatctgtaaagaggttgttgggcaggcggacagccgataacagccgggattggttcatcaggtattgccttaccggataggccatagcggagttcatcaccccctgcgaggtgatgaaggcaaggatgcctccctcacggacggcatccagccctttggcgaagaaatagttgtgcaggctgttcagcgcaaaacgcctggccgtgccgttgtcgaaggacgggtcgaaaacacgtatgtcgccgaaggggatgttgctgctcaccacgtcgaaatagccgttgcgatgcgggggcagttcctcgaagcccttgatattgacctgtgcttcgggatggagccgggcgaggatgcggccggtaagcaaatccttttcataggcgacaatttcgggggcgttgccggctgcggagtggaattgcggttggaaggctgaaacaaaattgccggttcccgatgaaggatcgaggaaacggccgggcgacactccgtgttcgcccaaagaagaggcaatggcattgacaatcgccggcggtgtgtagaaagcggtgaaggtggatgccttcacgctttccaccagccgtttgtattcacgttcgtcagcggctccgtcatgcaggacgttgtgaagttccgtaaccagggggaacagttcacggtcggcctgtgtccagcggagtatgtcggtgagtttcccgaaaggggaaagaaccgccttgatgcctccgaacccggagtaggcggcgagtgtgcccgcttcctccggtgtggcggtgcgttgttccttctccaaacggaacatcagccggattgcctctatattgtccctgagatgtgcctttttattataagccattctcttccagccagattacaaccgtacctgtcagctcgtcatagagctgctcgaactccgggctgaacatgaaatcatccgagagcgtatagccggagaagaccttccggcattcgggaagcaactgcaaggccacgctgcgtgcgctgccttcggggacttcggcggcgaactcgttccagaggacggtgaccagcgtgtccaaaggtgagaaatgcaacccctgaaaaagcagggcgtttgcctgttgcgccgcatcgtcgtaggtcaggccggaacggatggctgcgctgaaggcttcggcggcctgatcgctgcgggtggtgacgaaagactcgtcatccgccaagtccggatgcgactcacgcaggaaggacaacagggtaagacggtagtaagataattcatccggttcttccgctacggataccggcacattggatttattctgattcatataattatcggattattaagtgatacaattcggacgggttatttcttcctgccgcttttcttttcctgcggtttcctgtccgggaaggagtaacttatggtaaagtcaggattaagcaccagtgcggcatcgaagctcttgccctcacggctcttgaagcctttgacaagaggagtgcggcctttggtcgccagctcgatgatctgtccgtcggtcagtatcttatctcccttgttacggaacagggtgaagctgcaatcgacatcggcgcatttggcaaccttgtcgaagaacaggatgcggctcttcctgcacttgggacaagtgcattgctctcctgaaggagcgacatcaagggtggcggccagcagttcggtaacgatctgtgcggtatagacctctatgttccggcggaaagagagggcatcggcctctccggtttctattttggcgagggtgttctcccacgccgctgtcatttcgacgtcggcaatctttttgtcctttaccgtatcgtaaaccgccagtcctttttcggtaggcacaaggttcttcttgtcccggcgtatatagtcacgggcaaacaatgtttcgatgacagctgcacgagtggccggagtgccgataccgatctcacggattccggcacgcagttgttcgtcgctgatctctttgccgcaatgctccatggcggagagcagtgaactctcggtatgcagtggtttgggcttggtctgtttctccactgtttcggaggcgagcagtggcagggtttcacccgtttgcagtcccggcaacgtggtttcctccgcctcctcttccggctcgccacacacggcacgccaaccggctgacttgatgaccgcactcttgagggtgaatatctcaccgcctgcggacaaggcaacttcggtcatttccttgacgcaacatggcaagaaggcttcgagcaggcgtgcggcaaccatttcatagatagcctgctcgtcctgcgacagaccttcgggcaggttctcggtgatgagaagcgcatggtggtcggtgactttggcatcatctaccggacggcggttgagcggtgcgtccggcaagacggatgcggtggcggtgaaacgtggatattgccgcaggagcattatgcgcgaggggatctcgtcgaaaacatcctcggatatataacggctgccggtacgtggatagcttagcactttcttctcgtacaggctttgcgcaagcgtgagcgtcttgtctgcggagaagtccagtttgctgttggcctctttctgcaaggcggtcaggtcatagagcaacggcggctcttgaacggcctccctgcgttctacggaagtgacggcaagcataccgccgtccttaacctcacgaagcttggcggtggctgtgtcgagatcatcgaagcggttctgtgagagtgcggaaaagtcgatgccgtttttagagaccgaaacctttatccggaaatatgtccgggactcgaactgcctgttctcccggtagcgtgagcagatcatcgccaatgtgggtgtctgtacccgtcccagggagaacacgccctgtccggcggcaaggctgagtgcctgagagctgttgatgcccacgagccagtccgcctcgctgcgggctttggcggagaggtaaaggttgtcgtaaaggcttccctccctgagattccgcaatccctcacggatggccttgtcggtgagcgaggagatccacagacgggcaaagggtttggtacaaccgagatagttgtacacgtaacggaaaatcaactcaccctcacgaccagcgtcggtggcgacgatgatggactcgcacctgtcgaacaggttccggatcactcccaattgcctgacgactccgggatcgtccttgtaagccttaccctctcgcacctgacggggaacaagcctgaactcttgtggcaatatgggcaggtgttcccgacggaaaccggagagaccgtaactttcgggcatggcaagaccgaccagatgcccgaatgcccatgccacggcatatccgtcccccattagatacccctctttccgttggcgtgcgcccactacggacgctatggcctgcgccacgctgggcttttctgcaatgataactttcatatataatgtattatttatgtgaatggttaaatggatactcctttcttatcggttttctgtaccgggcggttccggctgacggtgttttccggcttcgtgctgtcctgacggacggccgcctgttgcgactgtccctgctttttgctcttgtccgggttccatttgaagaaatcgaactttgcccgctcgtggttgacacggacgaaagcactgaacaagtttccctcgttgtcggtcatgttcttgatatggactgtcttgccggcggctaacttctcccgtacctcgggtgtcagcccgacgcctttgagcacctgtggtatgaccagttcacggcttcgcatctgtgtctctgattgcgcctgtttgcgattcagtcccctgaagtcataagtgaagccgcccttgcagacgttatactggaggcgtgcgtcgtaatatccctgtttcttttcggaccacatgttctcaaccagcacggactcgccccgtgccagccttgtggtctggtcgtcggagagtcgtacccggttcacttcctgcggtatggtgatttcactgaccggaacatggtgcaggcggttggttttgggattgagcgagagcagacacgattcacgcactcctccggtaagttccagctcaacgacacaaccggcattgttgctcttggaaagattctctttcacttcgggagaaagctccgtacccatgtacggccggtccagttcgggataccgcttgcagcattccacgttcaggaccggtttgccgccggctgattccaccagacgaatgcaggccggcgtttcaaagtcgataccctcgaaggagatcctgatgtcgaggactgcggactcgtggccgttcagcaggcgttgtatgcccgtttcgcccaacgattcgggagttacgcccatgcgtgcgagctgctgccaatccacctcgtccactccccaacgggtggtctgttgcggagtgtcgcctgtgatgctctgctcctgtgccggttgccggatgtcaatggcgtaactggaaagaagctgttcgttctctttgggaaacttgaatatttccaccagctctttggctgcggataacatttccaccggcaggtggtagaagcggaagtccgacggtcgatcatactggcggttcatgttggagaagaacgttccgatcacggactcgttgcggtcgatgtgcagaaaagtctcggagggctttgcctgtgccagcggtttggtgcggagtgaaccgtcaggctcaataccctgaacgatgtgcggcgtgttaccgtcggaggcgttggtgactaccaatgcctcgttcttgaaatctttgagattgtccataaatcaatcggattaaattgtgaaacaataaagttaattgcggtacgaaggtaggcttaagtggttgtaggacgagagggaacgtgacgatcgggtacaagtggctaccggttggcatgaaatgtctcctgtttcctattctgtgtgattcgttttatacatcgcaggcaacatcaagacgttgcggaagaatcattcatcggatattttagatgatccgaacgggcgggccggaaaagaacggtcccgtttttgagtacatgacagagaatacggtggggtaggaggattatcaagaaaagtatcccatgggtatcggccagctttttttgatattgtgacctttccgggagtcatgaaatgttttccttcgagataaaactaagaatagttaatagaataaatgcttaaacaacagcaaatatatccttgccttatttatcagggtagtaccatactgtaattttggggatggctattgttgctttgtctgtatttaattattgaccaatgggagattctcacagcttttctgcctttttatttatacaactttttatttcaa

SEQ ID NO: 214 - DNA, 11147 bp, Bacteroides thetaiotaomicron
atataatatgtttaactaaatatctcatgaaactatgaatcaacaacacgatcctccacctgttttttaagtatgtaatgatccctttttactttttattttatttgaattaaatttaatatcttatgaaatctaatttatttatgaagcgaaagcttgaaatcggactatctttattaattggaacgtccgtttttggaggatgcaataatgacttggctccgatacgccaaagtcagacttttcctcccaatttgaatgcaccaactgtttttgagagtttctctcctgatagtggtggcgtaaagactcaattaattattcgtggacagaattttggtacggatactgcctatctgaaagtgactgttaataataagcgtgctgctattgtaggagtagcggatgatgtaatttacgctattgttcctgcgcgtgctgatactggttatgttcgtttatttgtgggcaaagatgataatgtcgaagaatatgcttcccaaacaaaatttatttatcagtttaaacgtaatgtaacaactttgatgggtagacaagggcaaagtgggcgtgatgacggaccatatgctgaatgtaaactacaacgtccttggtttgctttggcggataaagatggtgccttgttttttattgatgaggggcgtggacaaaataaaaatggtgctttgcgccgtgctcaggaaggctgggtggaaactttggtgcaaaattcgagtggtccattccaaagtcctacctgtcttgcgtttaatcccaagcaggacactctttatatttctaatatgtcctacggaagtgatataaaaactagttttaacatactatatgtaacacgtgaaggtggttttatggatgtgaaagggctatgtaagtttgaaaaagcagaaacgcaaggtttagctgtgcatccacagactggtgaaattttcttttgtaataaatctggtggatatatttatcgctttaatggtcccgattatgaggattatgaaccattattccaaataaacagagcagataaaatagatactcgtatggtttttaatcccgaaggtacggctttattcgtggtagtttgtaacagacattgtatctataaagttccttataatgcattgactcatacttttggtgagcctgaactattcgcaggtggctgggatgaatccggttatgtcaatggtagtggggtgactgctcgtttcgataatccgagacaacctgcttttgatcaggatgggaatatgtttgtccctgaatatggacgacatactattcgtaaaattactccaacaggtgaggtgtctttgtatgctggattacctggtcaagcaggatttacggatggtcttccagagaaggctagatttaataagcctgaatgtgtgacagtttatttagataattcactatatgtagccgatagagataaccatcttattcgtcgtgtaacagtggaataataatgtataaaaagatatattcatgaaaaatacacagaaatatttcatattacttttgatgttgatattacttgttccaagcaatatatggggacaagaaacaaaaaaggaaattatagtcaaaggtgtagtggaagatgatttagggccgataattggtgcgtcagtcgttgctaaaaaccaggcaggtgtgggagtaatcacaaatactgaaggtaagttttctttgaaagtgggaccttatgatgtattggtagtgacttttgttggttatcagccatatgagctgcctgttctgaaaatgaatgatcccaataatgtaactataaagttattggaagatgttggcaaaattgatgaagtggtaattacagccagtggacttcaacaaaagaaaactctgactggggcaataaccaatgttgatgtaaaacagttgaatgctgtaggaagtagtagtctttctaattcattggctggtgtggttcccggtattatagccatgcagcgtagtggtgaaccgggtgaaaatacatctgaattctggattcgaggtattagtacctttggtgcaaaatcaggagccttagttcttatcgacggagtagaacgaaattttgatgagattttgccgcaagacattgaatcgttctcagtactgaaagatgcatcagcaactgcaatatatggtcagcgcggtgcaaatggagttatcttaattaccaccaagcgtggggaaaaaggtaaggtgaaaattaatgtaaaagcaggatttgactggaatactcctgtaaaagtgccagagtatgcaagtggttatgattgggcgcgtttagccaatgaggctcggttaggacgctatgattccccgatttatactcctgaagaattggagataattagatcaggtttagatactgatttatatcctaatattgattggagggatttaatgttgaagagtggtgcacctcgctattatgctaatattagtttttcaggtggtagtgataatgtacgttattatgtctctggacaatataccagtgaacaaggacgttacaaaacgtttagctctgaaaataagtacaataccaatacgacttatgaacgatataattatcgtgctaacgtagacatgaacataactaagacaacagtactgaaagttagtgtaggtggatggttggtgaataggactacgcctactagaagtactggtgacatatgggaggattttgccaaatttactcctttgtctactcctcgtaaatggtctacaggacaatggccgagagtggatgggcaagatactcctgaatatcatatgacacaaagaggatatcatacgaaatgggagagtaaggtggaaactagtgtaaagttagagcaggatcttaagtttattacgcccggtttgaagtttgaaggagtatttgcttttgatacttataatgagaatataataaaacgggagaaaaaagaggaagtatgggaagcccaaaaatatagagatgaaaatggtaaattgattttgaaaagagtggtcaatagaagtccgatgaatcaaaataaggaagttaggggtgataaacgatactattttcaggcgtcattagattataaccgtttatttgctcatgcacatcgtgtcggtgtttttggcatggtataccaagaggaaaagacggatgttaatttcgactccagtgatttgattggttctattcctcgtcgtaatttggcttattccggtcgttttacttatgcttataaagataaataccttgctgaatttaactggggatgtactggttcagagaattttgaacatggaaaacaatttggtttctttcctgctgtttctgccggttatgtaatttctgaagaggcttttatgaaaaaagcattgccatggatagatcaatttaagatcagagcttcttatggtgaggtaggtaatgatgtattggatggtcgtcgattcccttatgtgtctcttatagatactgatgatggaggatcatattcatttggggaatttggaacaaatagagtgcaagcctaccgtattagaactttggggactcctaatttgacttgggagatagctaagaaatatgatgtaggtgttgacttttctttttttaatgggaaaattagtggtgctttagattggtttttggataaacgtgatgacatctttatgcagcgtaaacatatgccattgactaccgggcttgctgatcagactccaatggccaatgtcggaaagatgaagtcttatggatgggaaggaaatataggatttactcaatctattggtcaggtgaatctccaacttcgtgccaactttacttatcagactactgatatcatagataaggatgaagcagccaatgagttatggtataaaatggataaaggctttcagttaaatcaatcgcgtggattgattgctttaggattatttaaagatcaagatgaaatagaccgtagtccgaaacagacaagtaacagacctatccttcccggtgatattaaatacaaagatgtaaatggtgatggagttattaatgatgatgatattgtgcctttaggatatcgggaagttccgggattacagtatggtgtcggtttaagtgctaattggagaaattggaatttgagtgtacttttccaaggaacaggtaaatgtgatttctttattggcggtaatgggcctcatgctttccgtagtgaacgttatggtaatattttacaggcaatggtcgatggtaatcgttggatacccaaagaaatatcaggcacgactgctactgaaaatccaaatgcggattggccgcttttgacatatggcaataatgataataataatagaaaatcaacattttggttgtatgaaagaaaatatttgcgattacggaatgttgaagtcagctatgattttccacaaacttggacgcgtaaattttttgtaagtaacttacgtctaggctttgttggacaaaatttgttgacatgggctccttttaaaatgtgggatccggaagggactagagaggacggatctaactatccgataaataaaacattctcatgttatcttcaaataagcttttaatcttttgaaaaaacagatcatgaaaaaactagtatattatatattgttatccataagtgcgttatctttttcggcatgtaccgattatattaatgtggataaatatttctacgatcaggtatcattggattcagccttttccaaacgtatttatgttgacggatggttatccagtgcttatagtgtaatgaataagctaggtgaatacaaggaaccgtttcgctgggcaagtgatgatctttaccatcctgatatgaaagaatatgtggaaggaagttatagtgctgataaaccaaagggtgatgaaaatgctggtgagtctcgtttatggaaatattatgaaggtatccgtaaggcatctactttcttggataatgtagaccgttgtccggaactaactatggatgaaatagctgatatgaaaggacaagcccgctttttacgtgcttattgttattgggctttgatacgtgtttttggaccagtacctcttattccgcttgagggactagatgctgacctttcgtatgaagaattgtctttgccacgtactcattttgatgagatagttagttttattgatacggaacttgccgagacagcccgcttgttacccatgagaagaactgtcaacaatttggggcgtcctacacgaggtgcggctttaggacttcgtgcacgtgtattactttatgctgcaagtcctttatataatggaaatctcgatttcttcaacgtagtagataataaaggaaaccagttgatttctcaaacgtatgatgaatctaaatgggcaaaagcagcagctgctgccaaagatgtaatagaactggctaaaacctcaggtttgtacgagctttacaccatagctcctaaaattgggacattggatatgtatcgtccgccggtgcatcccgaatattctacaaaagattatcctgatggttgggcgaatattgatccgttactttcgtataagtcaaattttgatggttcagttcaaggttccaagaatccggaattgatttttacaagaaccagtgatggaacggggactattaatgattggatgtatcaagctttacccagaacaataagtggaaataaccgtttatgtgtcacacaaaagcaagttaatgcatacgcaatgaatgatggacgcacgatttcggaagctgcaaacacgggtgattatgtgacgacaggttttacaactgaagcatattcggaaaataatccatttctaccggctaaagttagtcttatgtacaataaacgtgaacctcgtttttatgcatctatcgcatataatggttcggtatgggaagcagccagtgcttcggaacctcgatatcgtaatcaacagatcttttattatcgtggaactgaagatggtaaacaaggttttaaagaagaatgtcctcttacagggatgactttgaagaagttttataattcggaagactccagaacagatggtggttatgttatagaaaaaaccgaaatgactattcgttatgctgaaatattgctgatttatgcggaggcattaaatgaattatcggagggggaagtttatcatttaaagacctactctaatgaagatgtagaaataaagcgtgatgaggatgagatgcgttatgctatcaagcgtattcgtatgcgtgccggagttcccgattatacgaatgagacttataaaaatcaagcagattttcgtgtaaaactgaaaagagaacggcaagtggaattgttaggagaaaacagtatgcgttattttgatctccgccgatggaaggatgctttgacagaagaaaatcaattattgcagggttgtaatattaatattagtgatgatgatacttatattgcagacttttacaaggaaactccagtctcttcagtacataaagtctttgaacagcgtatgtatttattcccattcccgacatacgaattaaagcgcaatgtaaatttgacacaaaacccgggttggtaattaaaacagtatcatgttatgaaaaaagtaatgattaaaaatataataaacagccttttactcgttgtcgttttgggagtatcttcttgcaatgatcaattggctgatgaattgtttgaaaaaagaacatatttaatagaaaatggctggaaagattatcaactcgaagtagatgatgacaataccgctatattaccggtttactttggtataaacggcacatctttgaatgataaggatataactttgactttagatgtagatcctgatacacttgaaagatataattgggagaaatataaaaatcagaaagaactttatttaaaactattaccagaggaatcttatacttttgatgcaagctcatggactattccaagtggtgaattaaacacgtcagcatatataaagatttcattggataaaataaaagaagttggtagtttatacaatgattatgtattgcctctcagaataaattcttcagtaggagagccgatagggagaagtaagtacacgaaagtattggcacatattgcttttaaaaatgatttttctggtcagtacacaggaaaaggtgtcataaagcaaatagggacaagctttacaacggatataaccagcaccaatatctatgctatcaatcagaatacatgttatatgtttgttggcgacaagactcgtgaaaaaacaacgaattatctagattatgttgtcgaaattaccaaagatgacgaaacaggtacttttgtgttaacttctccagtggaaagtttgaagtttaaatcttattcatctcaaataagtcgtaaatatacattgaattatggtgatgacagatattatatagaaattacaactgttgatttttcttatgaatatcaagactcatcttataataatgagcctgtgctaatgaattttcaaggaagttttacgatgactaaaaacgtatggaaatatcaatatccggatgtggatgtagaagattaagccatggttgctggaatgaaaatatcagtggctattctaactgtttgtttaaaccctaaattttgtatatatgaaaattgtgaagtatatagttatcgtatcattatttagtatttctgcatgtagtgatgatgatgataaaaaaaacaatgagcgacctgggaatcttgtagagttacaggttgatgtaaatgagattaatattgcgcaaggagatacccgtactgtaaacattacgtcaggtaatggggaatatgttgcgacttcggctaatgaagaagtagttgtcgcagaaatagatggaaatgtggtgaaactaaccgctgttgaggggcataataatgctcaaggagttgtttatgttagcgataagtatttccaacgcactaaaattctagttaatacggcggcagaatttgaattgaagttgaataaaactttgtttacgctttattctcaagtggaaggatctgatgaagctctcatcaagatctatacaggaaatggaggttattctcttgaagtgattgatgataaaaattgtattgaagttgatcaatctacgcttgaagacacagaatcatttatggtgaaaggcattgctcaaggtaatgctgagattaagattactgaccaaaaaggaaaagaagcttttgtgaatctgaatgtaattgctcctaagcaaattacgactgatgctgacgaaaagggcgttctgataaattctaatcaaggatcacaacaagtgaagattcttacaggtaatggagaatataaggttcttgatgctggtgatgcaaagatcattcgtttggaagtttatggtaatgtggtaacggtgaccggaagaaaggccggagagacttcatttactttgactgatgcaaaaggacaagtttcacagactattcatgtaaagatcgctcctgagaagcgttggtatatgaatttaggaaaagagtatgcagtttggactcactttgcagagatgactggtgagggactagaggctgtgaaagttgaaactaacggctttaaacttaaaaaaatgacttgggagctagttgctcgtatcgatggaactaattggctacagacctttatgggtaaggaaggctattttattcttcgcggtggtgattgggaaaataataagggtagacagatggagttggtaggtatagatgataaactaaaactgagaactggacatggagcctttgaactcggaaaatggtctcatattgctttagttgtagattgttcgaaaggtaaggatgattacaatgaaaaatacaagctttatgttaatggtaaacaagtaaagtgggacgatagccgcaaaaccgatatggactattctgagattgatctttgtgcaggtaatgacgggggtagagtatcaatcggaagagctagtgacaacagacgctttcttgatggtgctatactcgaagcacgtatctggacggtttgtcgtacagaggaacaacttaaggctaatgcatgggagcttcatgaacaaaatcccgaagggttattagggcgctgggatttctcggctggagctccgacatcttatattgaggatggtaccaattcggatcatgagttgctgatgcatatttcgaagtatgatagctggaatgccacagaatttcctatgagcagatttggggaagctcccattgaagtaccttttaaataacttttaaattcgaagaaaaatgaaagcaatattcaagctgttgatattgaactttttgactctgtttatctttccgtcttgcagtgatgatgataagtcaaagtctgaattgaatgaccccatcagtggcaatatttctccggtaggttcatttgcggtagaagctaccaataacgagaatgaacttctggtgaaatggaccaatcccagtaatcgcgacgtggatatggtagaactctcttacagggacgtggaagcgagtttgtctcgtgctaccgacttctcgccgggacatatcataatacaagtagagcgtgatgtcacacaggaatatatgttgaaggttccttattttgctacttacgaagtttctgccgtagctatcagcaaagccggcaagcgatcggtacccgaaagccgtgtggtgatgccttatcatgaaaaggtggacgagccggaactgaaactgccggaaatgctggaccgtgcacattcttacatgacttctgtcattggatattatttcggcaagagttccagaagctgctggcgtagtaattatccttatgatggaaaaggttattgggatggtgatgcgttggtctggggacaaggcggtgggctttcggcatttgttgctatgcgtgatgcaaccaaagagagcgaagtggagaatctttacggtgcaatggatgatatgatgttcaaaggaatacagtatttctgtcagctggatcgtggaatcctggcttattcctgctacccggctgccggtaacgaacgtttttacgatgataacgtatggatcgggctcgatatggtcgactggtatacggaaacgaaagagatgcgttatctgacacaggcaaaggtggtatggcgctacctgatcgatcacggttgggatgagacttgcggaggaggtgtacactggagggagttgaacgaacacactaccagcaagcactcttgctctaccggacctactgctgtgatgggctgtaagatgtatctggcaactcaggaacaggaatatctcgactgggcgatcaaatgttacgactatatgctggatgtattgcaagacaagtccgatcatttattctatgacaatgtacgcccgaataaggatgatcccaatctgccgggtgatcttgaaaagaacaagtattcctacaactccggacaaccattgcaggcggcctgtctcttatataagattaccggcgaacagaaatatctggatgaagcgtatgcgattgctgaaagctgtcataagaaatggtttatgccctatcgttccaaagagctgaatcttactttcaatatccttgctccgggacacgcttggttcaatacgatcatgtgccgtggattctttgaactttattctatagacaatgaccgtaaatatatcgatgatatcgaaaagtcaatgattcatgcgtggagcagtagctgtcatcagggtaataacttgctgaatgacgatgatctgagagggggaactaccaagaccggttgggaaatactccatcagggagcattggttgaattgtatgcccggttggcagtattggaacgtgaaaaccgatagttgaacgattcccgttcagggaacatatgaacataaaaaagccatccccggaatagacaaagtagggatggcttttttgtagtgtgcttatttaccgtagattaacatttatatcaaatgaaaatggtggagttatttcatttggggtacaagtgggtatagtgaataacatagggtcaaaggatatataataccctcctggagtacggttggtaactgatatactacacccatgataatta

SEQ ID NO: 215 - DNA, 11119 bp, Bacteroides thetaiotaomicron
ggcaatttacactgatatgaatattttatttattataatagcttttgtaatttccgtttgtgtagctagactgataattccacgcattctgttaatttcctttcggaaaaaactatttgatattccagatgagagaaaagtgcataaacgtgcaattccacggttaggaggagtttcgtttttcccaacaattttgctctcttgtagtgtggttcttgcacttcgtgctttgacgggatatggtatttctatattatttgctacatatattttacctgaatttttagtcttgatttgtggaatggttcttttatatctaacaggtattgcggatgatcttgttggagttcgatatcgtcaaaagtttatgattcagcttatttgcgcatgtttatttcctatatcggggctttggataaatgatttttatggtttgtttggtatctatcagttatctgcttggtttggaattccttttactatattaactgttatttttataacaaatgcaataaatcttattgatgggattgatggtcttgcgtcaggtttaagcagtgctgcacttttggttctgggttttttatttatagataaaggattatggatttatagtatgcttgcttttagtacatttggagttttagttccatttttttattataatgtttttggtagtgcagaacatgctcggaagatttttatgggtgatacagggagtttaactttagggtatattttgagttttcttgctataaaatatagtcagagtacaaatttaattcctgaaacacaaggggctattgtgattgcttttagtacactgattgttccctcttttgatgtaattcgggttgttattgtacgtatttgtaatggtaagagtccatttgaacctgataaaaatcatattcatcatcaatttttagcaatgggatttactgttagaaaagcaatggttctgattttatttatttcatgtgtgtttagcggaatgaatattttgttgatgccttatgtaaataatacaatgatgcttatggtagatattgttgtatgggttgggcttaatttgtggtggagtggagtgagaaaaaagcgatgccatggagttggtaaatagaaaattgagagttgttttaagtgatggaagttataaagactaatatagagggagtcgttattattgaacctcgtatttttaaagacgatcgtggttatttctttgaatctttttctcaaagagaatttgaggaaaaggtttgtaaaacgacttttgttcaagataatgaaagtaagtctagctatggagtattgagaggcttacatttccagaaacctccttttgctcaaagtaaattagtgcgagttataaaaggagctgtgttagatgttgctgttgatataagaaaaggctctcctacatttgggcaatatgtatctgtagaattaacaggtgaaaatcatcgtcagttttttatacctcgtggatttgctcatggatttagtgttttaagtgaagaagtgattttccaatataaatgtgataacttctattctcctcaaagtgaaggggcaatagcatggaatgatccggatttgaatattgattggcgtattcctgctgaaaaagtggttctctcagagaaagacagtaagcatccaaggttaaaagattggcagaatatgttttaggatattactccaattacctgcaattcagttcttagaattgaaataaacgacgattgggagcgtattcttgaacgaatgcaccgataaaaagaaaaaaacattgagaagattgtattgaatcttctcaatgtttgaatccaatcattaagaagattttttcaaacttcccaatgatttttgtaagctttcaaagtgacataatgacaaaaaggacatatggcctcttttataaattcttatgatgcgttctttaaactactttgctgatttttaatttattgagtgccttttatggactgtttttatgtgattgccgaaattgtattttacgcgagctagattgttgctttgttgatgaacgcttccggtagtttaccaataaagtgttggatattatgcgaattatttaaaggatgaagtgtggaagatagtatcaaggacaataataactggttatgctcataacaacaggaaatcaggcagatatttgtacacgattttaggagaacatggcctttgctttctgttttttaccttgctggtccgcttctttttcctcattgctatcttcaaaactatcatgtgcctttttgtccttttgtctttttgagagagaaggataaagcgaagtgtcgaatgcggatgagtgcatgcaactttttgtaaaccagattataacatgctatttatttctcggatagggaaaacggaatcctcaaaataggttgtaatatcgcgtaatatgcttttgggggaatatttttgtggcaggtttcgcaagcgaggagatttcattgatcaacagttaattggtttaagaaaatgtgctacaaaaaagctagctggtttcttttttgttttctattcttgatagaagaggtgattttttgacataaaagctttctttatttaatttattttatatctttgctagcatatcaagattacaatcaactatttattcacataaacttaataaaattatgttcaaagctcctttttcttttgacggtcgtattcgtaggatcgaatatttcctgtctggtattatcggtggtatcgtttttggtgttgcctattctctcggtttagctactttgtttcttggtgcggctgccggttccgcgggtggttccctgtttggtatcttgattggtatcgtagcgggaatagcctctatatggttctctttggcgcagggcgtgaagcggttgcatgacttgaacaagtccggttggttgatactcatttgctgtgttcctatcatcgggtgggtattcagtctctacatgttgtttgccgatggtacggtaggtcctaatcagtatggtgaagatccgaagaaccgtatgccatatcagccgcagccaacttctgtaaatgtaacagtgaatgtgtcgagagaaactcctgctgaagcacctgccgaagaagaaaaaacagaaaaagccgaatagtctttaataagcagaaatatggttgcctcttgcaaaattcgttttgcgagaggcatttttttactacctttgaggattggtaaacagaaaaaaagaagataaatatgaaaaaagtaatttgcagtgaaaaagcaccgggagctatcggtccttatagtcaggcgatagaagccaatggaatggtattcgtatcgggtcagttgcctatcgatgcggctaccggaaagatggcggaaggaattgaagaacaggcacgccagtcgttggagaatataaaacacatcctggaagaaacagggctgacaatgggaaacattgtaaaaacgactgtattccttcaggatatgtctttctttgccggaatgaacggcgtatatgctacgtattttgacggagcttttccggcacgttcggctgtggccgtaaaggctttgccgaaggatgcgttagtggagattgagtgtatcgcggttcgctaacaaatcggcgacaataaaactgctgcctcccacgaagatgaagtctttaggggggcagttttcttttgctgcccgtacggcatccactacggtagggtaggaggtgcctttcagtcccgcttccgaagccattttcatcagctcatcttccggcattgcacgtttcacgctcgctttggtgaaatagtaggtggcgtctttcggcaacagttccagaacactgctgatatccttgtcgctgaccatgccgaatacaatatgcaattcctgatgcaacttttcgtgtatatacttcaattgcttgcgaatacttttaaagccatcagcgttgtgacctgtgtcgcagatgaggtcaggatagctttggagtttctgccagcgtcccatcagaccggtcatctcgcatacattagagaatccggtatggtaatctttattacagatttcatatcccaggttctttaaaatatccagagctgccaggattgtgagacaattttctgtttgatagagaccgctcagttcgtagtataatcccgtcataaaactggaattatgaatggatattgcgtcttttcttttatccatgattctgtctatcgcacgtatggcgtcagccgggttgataagagagacaaattgcatcattttcattggaagcgtctgtatctgctgaagttttatttcttcctccaataattcctgcaaatcggctctggactccttcaggttatcatatgacaaatattgcacatgggtgaaactctttaattcttccgagaaggtgatgaaggtattcattgccttggctttcatcgtaaatactcttttcactgttccggatacttttcccactactaccggaacatcttctttgataattcctgccttttctttggctattttagtcagtgtgtggcccagatattgcatatggtcgaaaccgatattggtaatgacacacagatcgggggtgatgatattggtacagtccagacgtccgcccatacccacttcgattacagctacatctacctgctggtcggcaaagtagcggaatgccattgctgtggtgagttcgaagaaagaagggtgcagaggctcgaagaaagaacggtgttcttctacaaagctgactacataatcttcgggaatcatttcaccgttgatacggatacgctcgcggaagtcaatcagatgcggggaagtaaatagcccgactttgtatcctgctgcttgcagtacggctgcgatcgtgtgtgaacaggagccttttccatttgttccggcgatgtgaatcgttctgaattgttgatgcggatgacctaaatgttcgtccaatttgtgtgttgtctctaaacccggcttatatgcttttccaccaatttgctgaaacataggtgtactttcatataagtactttaaagtgttctgataatccatgttttataatatttaactccgggcaatctttattgctcgcaaaattgtttatctttagaaccatcaattcaaccgatagcgggggattgatgaatcagactgcaaatatcaacattaaaatctaagaaatcatgggaactaagaaaaattttgtaattgacacaaatgttattcttcacgactacaattgcttgaagaattttcaggaaaatgatattcatctcccccttgtcgtactggaagaactggacaagttcaagaaaggaaacgagcagataaatttcaatgcccgtgagtttgtccgggaactggatttgctgacgagtgacgagctgttctcccaaggggtgagtttgggagaaggaatgggccgcctgtttgtagttcccggaaacgtggatgctcccaaagtgcatgagtcttttccggtgaagaaacccgaccatctgatattggcagctgttgaatacctggcagccaaatatccgaaaactccggctatattggtgaccaaggatgtaaacctgcgtatgaaagcccgttctatcggtattaccagtgaggactatatcacagataaggtatccaatgtcgatatattcgagaaatccaatgagatctttgaaaatgtagatccggcattgatcgatcgcatctattcatctaaagagggcattgatctgagcgaatttgactttaaggatgtcattcaccctaacgaatgcttcgttttaaagagtgatcgtaacagtgtactggcacgctacaatccttttactcattccatttgccgggtaacgaaaggacgtaattatggtattgagccccgtaatgccgaacagagtttcgctttcgagatactgaatgatccgaacgtcaaattagtggcattgaccggaaaagcgggaacaggtaagacattgctggctttggcagctgctttaggcaagttgactgactataaacaggtattgctggcacgcccggtagtggcattgtccaacaaggatatcggtttccttccgggagatgcccaggaaaaagtggctccttacatgcagccgctattcgataacctgaatgtgatcaagcgtcagtttgccgccaactcgaccgaagtgaagcgtatcgaagatatgcagaaaagcgagcaactggtgattgaagcattggcttttatccgcggacgtagtttgagcgaaatgtactgtatcattgacgaagcgcagaaccttaccccgaatgaaataaaaacgattattacccgtgcaggtgaaggtacgaagatggtattcacaggagatatccagcagattgaccagccttatctggatagccagtccaatggtcttgtgtatatgatcgaccgtatgaaagaccagaatatctttgcacatgtcaatctggtgaaaggggaacgtagtcagttgagtgagttggctagcaacttgttataaaaatgaagaattaagaatgaagaatgaagaatccgctagcgcatttatgctgcaagtaattcttcattcttcattcttaattcttcatttccccaaagttcttcatttttttaggcttctttctttccgaagtacttcaggaattgggtacgttcgaatgtattgataccttgaacgtctttaatattcagctttcctttgaattgagcgatatttttgaaacctttgcgttccatccatgcggagaggaaacgggtggattctccgataaatgcattcgtattctgatagatagcactgcaaacttctacggctgaagcaccggcaaggattgcttttactaccgcttccggattggcgacaccaccggaggctgcataatcgattttgtttaccactgaagaagcgattccaatccagcggagaggagtggcaaggtcggcggaggtgctgaacacttcaccggatacttgttccatattctcaatgttgatgtccggctggtagaaacggttgaaaagaaccactgcagctgctccgttagcatatagctggtcgatcagggctacggggttggtcaggttgtcacccagtttcataataaccggaatggttaccgtttgtttgatatgacgcagaatgtcaatgtgacgctgctcaaatgagccatacgtatattgtacatccgattgcaatgccagaatattgatttccagtgcatcggcgccggcctcttgtatctgtttggcaaagtctacccattccgagtctgaatagcagttgatgctggctatgataggaatagaacactctttcttactttccttgattaaagtgagatattcagctaatttatgttcacggatatattcttccagataatcacttgcttccggataaaaagcggggtctttcagttgatccgcttccagcataatttgctcttcaaacagagatttcagtacaatggcacctgctcctgcttctgccagtctcttattcttgccggcactgttggtcagtcccgagctactgataatgattgggtttctgagagaaagccctgcgaaagtagtttttaaatcggtcatggtaataatgattgattaagtattatagtttctttctccgaatatcttgcttccgacccgcactaaagtacttcctgctgcgattgcttcgtgatagtcgtgtgacatacccatcgacaattcgcggaaagtatccgaatcggcaaaccagtttgcttttatttcctgaaagagcctattcagtaaacaaaattcccggttaatttgttcaacatcgtcggtgttgcttgccattcccatcaatccgcagatgcgtatgtgagacagttctttccattcgccggcatgcagcatgtctttgcattcttcggggctgaaaccgaatttggtttcttcttgggcaacgtgaatctgtatcaggcagttcacgatacgtcccgccttggctgcttgcttgttgacttccgccagtagcttataagtgtcgattccgtgtatcatttctacgtagggaatcatgtacttaatcttatttgtctgcaagtgcccgataaaatgccattcgatgtctttcggcaaagtttcgtatttagctgtcatttcctgcactttgctttctccgaaaatacgctgtcccgcctgataagcctcttctatcgcttcattggggtggaattttgagacagcaaccagccggactccttgtgggagttcggccagcacttgctttagattgtcagcaatactcatggttacttatgcttttgacggatcaaattccggtttgtcattcggtccggcgctataaggatatacatccatcagcggagtttctgataccataccgatttgatagtcagccattgttcctttcatgccctcgtccagtttcttcactgcgtcgcgcaagtcggcagcctgaaccagcacttgggtagaagtctttttctcggcaccgcttttctcgtcaagggtgataaagatcagtttgcacttaaaccagcggtcagcgctttcttcatcgctggggaaaagttcgctatagttggcacgtttgatgtccgatactgtaaattctcctgtgataaatggagtcatctcctcgataatacgtgcttctgcttctgtaaagctgagtgcatctaccagataaggttccgtcactttcttctgcattccgttttccattgttttctcgtaacggattttgcactcaaaccaagtatgcattgccataatttttcttcttttttagtttattgattcgtgtaaattgcctacaaagataaacaaaatacgaagtaactgccgaaagatttttattttcttttatgcagatttctcaattcgaacgaaagcatgacgcggaaaagtccgatgatgaagaaagtaaaggagatcatgtagactacgtataatgcgcctactgccggttgccacaatatgatcagggcgcagataatggcaaggatgccgaaagccatgtaccagccccagtcgcgagtgccgtaacgtttgaggtcgatggagtagccggtggaggagaagccccggaacataagccagaaggcgatgataaacggaatgacttccatgctgaccatcggataggcgatcaggtaaattcctaaaataaggtcgatgattcctcccaccagataccagccccaactgggtactcccttgcggttactgagagagaatatgatttcgagaataccgcttatcagcatcgatatgctgaaaacgatgctcaatgcgacatagctgctgaggggtgagaacataagccaaagggcgacaatgatatacacaattcctaataaaagagaagtccaccagttttttactgagtgctggatctcgttgaatacagtttccatacgttttaaattttaaatgaatactctgtgaatttgtggaggaataacaaattgattttagaaaaggttttcgtgtgaacatattccggggataagttgtttttattataaagtaattttaaaatgtaaatgcaatatggcaacaacaaatttcaaaggacaaccggtgaaactgatcggtgaatttatacaagtaggtaaagtcgctcctgactttgagttagtaaaaactgatttgtcttctttctctctgaaagacctgaacggcaaaaatgtaattctaaatatttttccaagtctggatacgagcgtttgtgcaacatcggtacgcaaatttaataaaatgggagcaggtctcaaagatacggtcgtactggctatttccaaagaccttccttttgctcatgcacgcttttgcacgactgaaggcattgagaacgtaattccattgtctgacttccgcttctctgacttcgacgagagctacggactgcgtatggcagacggaccgctggcaggattactggcacgtgcagtagtcgtgatcggtaaagacggcaaagtagcttatacggagcttgttccggagattactcaggaaccggactatgacaaagcattagcggcagttaaagaataagtattaagtattattccatgcggttggtaccaatagtacaataagcggcttcgattaatacttaatacttattacttaatacctaattacttttttcctaaacctcaaccacatggacaaaattcgatttttcttcatcgccctgttaggcatgggcgctgcccacttgtcggctcaaaccgccgatagtacaaaaacttcttcctggacaacggaaggttttgccggactcaaactgacgcaagtaagcctgaccaactggtctgccggaggtgataactccgtcgcttttgacttgcaaggtacttatcaagctaattataaaaaagggaagcatatatggaataaccgccttgaactggcttatggattgaataagacaggggaagacggcatgagaaaagccaatgataaaatatatttgaataccaactatggttattctatcgcgaaaaactggtatgcgagtgcatttgccacttttcagacacaattctcacccggatatgactattctgtcaataaggatgtcgctatctccgaatttatgtcaccgggctatttgaccaccggtctgggatttacgtatgatccgggaaagattttcacggttgtattgtctcctgcttcctggcgcggaacctttgttctgaatgaccgtttgtctgatgaaggtgcctttggagtagatcccggcaagcatctgttgtcgagcttcggtgctaatctgaaaggggaggtgaaatatgaattcttgaagaatatgactgtatactcccgtctggacctgtattctgattatttgcataaacctcagaatatcgatgtcaactgggaaatacagataaatatggcaattaataaatggttctccaccacgctgaccactaatatggtatatgacgatgatatcaagatcgttcaaaaagacggcagtaagggatctcgcctgcaattcaaagaggtgttaggcgtgggagtgcaatttaatttctaatttaggtattaagtattaagtattaagtattaggtat

SEQ ID NO: 216 - DNA, 10936 bp, Bacteroides thetaiotaomicron
atatatagtatatggttgtacataaccctctatcaatcaattgtatatatacaaaatagacattattactctctattacaaaatagagagtaaagagtataggggaattatgtatagttaatgtgttgtatgttagatgattatgcgactaatttgcgcatagaatagtatggctgtaaaatcaggccggatgattcttgtttaatgaaaagtagaaaacgacagcactcgtttgttggaaaaagagaattatgggatgaattatttttttatagcaatagcatttttagttgcggtatttatggggtggattatcactcctcagattttgctcgtagcttttagaaaacgactgtttgattctgtaggtggtcgcaagacccatagcggtatagtaccacgtttgggaggagttgtgttcgtcccggtgcagtgctttctattagtgctatctatgttttttatgtataaactagaaataacgtcctatcttcaagacccatttatacctttccaatttttattgttgatgataggtttgctcattttgaatatggtcggagtgatagatgatttgattaggattaactatcgtagaaaattcgtagctcaaattgttgcttcttcatttcttccgttatccggactctggattaatgatttgtatggactactcggaataactactttatctccttggattggaatgcctctgacggtgtttgtggcagtctttattattaatgccgttaacctgattgatggaatcgacgggctctgttccggtttggtcggtatgggggctttggtttttggtttcttgtttatttataatgcagcatggttacatgctgtttttgcctttatcaccgcaggggtgctatgtccttttttctattacaatgtgttcggcaaatcgaaaggaagacaacgaatttttatgggggatactggcagtctgacgctggggctctcgatggcttttctggcaatcagctatgcgatgaataatccgttgataaagcctttttccgaaggagcgatagtagtttctttcgctacattgattgtccctctttttgatgtagttcgtgtggtacggatacgttattttcagcataagcctctttttatgcccgaccagaatcatatacatcataagtttctgagagtagggatgtctcattatgtcgcaatgattcttattctggctttggcattgttctttagcttcttcaatattgttgcggtagaatatatcagcaacaacatcgtgatttttatagatatcgtactgtggattgctttccatttatggttggacaggcgagagcttatccgggcaaaacatggggtggcaaataattaaatttaatgatatgaaaatagctattatcggtggttccggattcgtgggaagtcgtttgatcgggctgttacagactgttccgaacattgaactgctcaatattgacaagcagcagagtgaactttatcctcatctgacacaaatagctgatgtgcaggatgtacagaagctgacggagttgctggcaggaactgatcttgtggttttattggctgccgaacataaagacaacgtaactcctgcatcgctttactatacggtgaatgtggaagggacacgtaatacgcttcaggctatggaaagtaatggagttgcccgtttggtattcaccagttctgttgctgtctatggattgaacaaagataatccatcagaattgcatccggccgatccgttcaatgattacggtcgtagtaagtggcaggcggaatgtatgctgcaggagtggtatgatacgcatcgggagtggaacattcatattcttcgtcccacagttatctttggagagggcaacagggggaatgtatataatttgttgcggcagattacttccgggcgatttctgatggtaggagacggtgaaaaccggaagtcgatggcctatgtcggtaacgtagttgcttttatcgcttttctgattgagaataatatggagggatatcatgtattcaattatatcgataagccggatttcacaatgaatgatttggtgtatcatgtcggggaggtgttgaataaacatattcctactacacattacccctattggttaggaatgttgggtggatattgctttgatgctttggctaagatgacgggaagaaaattgtcggtgagttctgttcgtgtgaagaagttctgtgcggtgactcagtttgattctgttaaagtacagtcatcgggttttaagccggctttctcaatggaagaagggttgagacggacgttgcaatacgagtttggttcaggagctgaagaagctattaattgataaactaggctttttcctttttacaggatagaaaagaaggaaaaaagttagatagataagacataaaatttttcaggtagccgtcatgtatgtgactggcgggagcggagcgcgcttggagggtaccttattgtgactttaaatgatagaattggaggagttattatggatgaaaaaaagtgttggttggttgtttgtgtgcagagtaacagggagaagaaaacctacgaacgtctgtcggcattgggatttgaatcttttcttccgttacaggaagaaacacgtcgttggagtgaccgaagcaagaaagtgcagcgggtcgtgattcctatggttgtttttgcccggatagctccttccgaacgtatttctgtgcttcgtcttccctctgtaagccgctttatggtattgcgcggagaaagtgctccggcaatcatcccggatgcacaaatggaacgtttccgctttatgctcgattattcggaagaagcggttgagatgtgttcggagcgtatccagccgggcgaacaggtaaaagttatcaaggggccgttgacaggattaacaggggagctgataacaatggatggaaaaagtaaggtagccgtcaggattaatatgctgggagctgcgatggtagaagtgccggtagggtttgtagagagaatatgatactgttaggtaattactactaagaaaaaacaactgagattacaaaccatgaaggaacagcagattacagtaacttcccctttattaccatctttggaggagttaaatgtttacttgcaggatatatggcaacgcaaatggattactaataatggatattatcatcagatgctggaagccgctttgtgtgaatatctgggtgtaccttatatcagtctgtttaccaacgggactcttcctctaactgcggccttactggcaatgcgtattacaggagaggtaataaccacgcctttcagttttgttgctactacacattcgttgtggttgaatggcatcaaaccggtatttgtagacatagaccctgtaacttgtaatcttgaccctgataagatagaggtggctataactcctaatactacagccattatgccagtgcatgtgtatgggtatccttgtgatactaagagcattcagcaaatagcagataaatacggattgaaggtaatctatgatgctgctcatgcatttggggtggagagagagggagaatctattttgaatgcaggtgatatgtcgacattgagctttcatgcgacgaagacttttaataccattgagggaggtgcattggtacttcacgatgaacatactaaaaagagagttgattacttgaaaaattttggttttgtcggtgaaacggaggtggttattcccggaactaatggcaagctagatgaagtgcgggcagcttacggattactgaacttaaaacaggtagatgctgccattgaagcacgctgccaggctacaactaattatagagaagccttacgtaatgtttccggtatcacatttatggatgatatatccggagtgaagcataattattcttatttccccatatttgtggatgaagaacgatatggtatgagccgtgatgaactctattttaagatgaaggaatataatgtattaggacggcggtatttttatccgctgatcagtactttttctacttatcgtgaattaaagtcagcaaggaaagaaaatttgcctgtagccacaaagatggcggaacaggttatttgtttgccgatgcaccatgcattgagcgaagatgatatggagcgggtgttacggctgataagaaagtagaatatgaaacttggtgtgatgcaaccttactttatgccttatatcggttatttccaattaatgaaagctgtagataagtatgtggtttatgatgatgttaattacattaaaggcggctgggttaaccgtaatcatatactgatcaatggagagaaagaaatgttcactgtgactttgaagaaagcgagtcagaataagttattcaatgaaatagtgataggcgatgattttaagaaacttatgaaaacactgcaactgaactattccaaagctgttaactttgatcagacgatgactctgatgaaaagaatcatttctttctcagataagaggcttgcggcatttatagcaaatagttttcgggaaatattcagttatttgtcaatagatacggagatattgatgtcctcagatattccgaaagataattctctgagaggaaaagataaaatcttgcagatatgtgaaatattgggtgctgatacttattataatgctatcggtgggcagaatctttatgataaaaaggaatttagtgaacatggaattgtactgaattttgtagatacaatcccaaaagtatattctcaattgcgtactaaggaatttgtgccttatttgtcgatgatagatgtattaatgaataataccaaagatgaagtcaatgatttattggattctttttgtgtaagatattgaaattgcttagatatgaaatcttttaatattgtagtgtgtgcgtctggtggtggaggaaattttcgttctttgataaaatatcaatgtgattatggttatcacatttcgttactgatagtagatagagagtgtcctgctattaagatagcaaaggaaaatgggatatcatattccgttttagaaaagaaagttttaggcaagtctttttttgaggagtttgagaagattgtccccatagatacgaatttaattgttttagcaggatttctaccgattatacccaaatggatttgtgaaaagtgggaacgtaaaataataaatattcatccttcactattgccaaaatatggagggaaaggcatgtatggggttaaagtgcaagaagctattttgaggaatcatgagaagtatgccggctgtaccgttcattatgtggattcggaaatagacactggcgagataatagctcaaaaaaaaatacttgtgatggagaatgagtctgcatgggaattgggaggcagagtttttaatgaagaaataatattacttccgttggctattaaacatatacgtgaagcaatgaaagtgattccttaagattgaatataagtgtattatataatattatacgattttcgatatgacacaatgcccattggttagtatttcttgtctgacctataatcatgctccgtatttacgtcagtgtttggatggttttgtgatgcaaataacatcttttccaatagaaatcttaatttatgatgacgcgtctggagatggtactcagaatattattgaggagtatcagaaaaaatatccggatataataaaaccaatatatcaaactgagaatcaatattcaaaaggtgtgaaggttggttttgtttataattattctcgggctaaaggtgagtatatagcattttgtgagggggatgattattggactgatccttataaattacaaaagcagattgattttttagaatgttactcggattatgttatttgttcacatcgatacagaatatgtttaaaagaggagaaggtgatgaatgatgagatcaaaccgattggcgatttatctgatgggatgtcttttgatttgtctttcttgattcgtggaggttggttatttcaaccattaagtgtcgtataccgaaagtcggcattggatttggatacatactcgaaatatgcaatatatatagacgttgccttgttctatgctattttgaaaaatgggaaaggatattgtatgcctgatgtaatgggagtatatagaatacatgaaaaaggggtatggtctggactcgacttaaatcatcaaaggatcttttctttgaaagcaagagaagctatttatgatgtggagaagacggatgaggctgcaatgttcatcctctcacaattctctcgtccaatgggacggtttctggttgtgaaagagtgttctatgtttatgagaatcacgaagatattaatttcccattttggtttacgttttgtattgagaatgtggtttgatagactattcttaaataaaaagttgtgcgtgaatgagttttatcagataaaggatttctgcaaaagaaagaagaatggataacattataatagtattaaattcaaatctgttactaaaatgaatatagcattgattattgcagggggatccggcaaccggatgggacaagatattccaaaacagtttattcatgtggataattgtccggttattgtacatacaatgttagctttccaaagacatccggacataactgctgttgctgttgtttgtttaggtggatgggaaactgtgttgtcttcatacgctcatcagtataatgtatcaaagttacgttggatatttgctggggggataaatggtcaggaatcaattagtaacggcatatacggtttaaaaaagaacggtgtcaaaaaggatgatctggttttgattcatgatgcggttcgtccactggtatctcagagtattatatcttccaatatcgcaatttgtaagcagtatggttatgctatcactggtattcagtgtagggaggctattttggaaagtgatgatggcttttgttctgtgacaagtattccgcgtgataaattgataagaacgcagacaccccagacttttcggttagaaaatattataaatgtccatgagcaggcaaaatcaaaaggtatcataaactcagtatcttcttgtactcttttggcggaattgggcggatatgaaatgcatatagttccgggagaggagcgaaatataaagattacgactacggaagacctggagattttcaaggttttgaggcaaacgtcaaaagaagactggctgaaatgatgacttattatgacgatatcagaaaagtgcaggatttgcatctgccgtgggaaattctgactgatataaatattctgattgtgggggcctcaggtctgataggaagggcgttggtggatactctgatgcagttacccgataagacgtttcatctatatgcaggtgtacgggatttggtttatgcgcaaagttgtttcatgcgatacaaggatgatgaatctttcaccttgatacaatgtgatgtgacagcattgattccatttgatattgattttcactatattattcatgcagcgagctatgcggggccggccgcctttcataatgatccggtcggggttatgaaagcgaatatattgggagttgacaatctgttttcatacggagagcaacacaatctaagaaggttgttatatgtttcttccggtgaagtgtatggagaggggaatggaattccttttcgcgaagaagacagtggttctctcgattgggcttccttacgcgcatgttaccctgcggcaaaacggactgctgagactttgtgtattgcttatgcagctcaatttcagatagaaacagttatagcacgtccttgccatatttatggacctttttacacttcaaaagatgatcgtgcctatgcgcagtttatacgaaatgtattggcaggtgaaaatataatattgagaagttctggtttgcaacagcgttcctggtgttatgtggttgattgtgtgtttgcacttctttacgttttgctaaaaggaaaaacaaagaatgcttataatatagctgacgtccggtcgaatgtcagtatccgcgaatttgcggaaatgatagcactgaaaagtgaacgagaagtaattttcgatttaccggataataccgggaagaataaacctattatatcacaggcgatatttaatactgagaaaataaataaaataggctggttcccccaatggaagcttgaagaaggcgtttcacatacacttaatactttaatatctgttgatggaacatatatataagttgctgcgctcttttaaatgggactgtgctaaatatctctacaagaatactctgaactttaaagttaagagattaagacgaaagaaaaatataagagttctgtttgctgtggcggagagtgctacctggaaaagcgattgtctttataaagcgatggcggaacatcccagatttactccttctattcttgttttacctgatgaacagaaggaaaaaactctgttgaaagaagaagttgattcatgttttaatttattttgtagaaaagggtatgcttgtacttatccttatcaaaatggaaaactgattaatattcggaagaaattgaaaccggatatcattttctatcaaaaaccttatactttttatcctaagagtcttttgtattataaaaatatgaatgctttattttgttatacaaattatgcttttcatagcttactgacagattgggctaatgataatgaattctttagattgatgtggcagaattattatgaaaatgagtctgctaatgttgatttgaagaaaaagtttgcagggatattctcaaatatcgtagttacgggcttgcctgtaacagacttatttctgactgagaaacatgaagataagtggaaaaaaacagataagagtcgtaaacggattatttgggcaccacatttctcaatatctgatggtggctgtttgaactattcaactttcttatctattgcggaagaactgttagaatttataaagaacactcaattacctgttcagatggcttttaagcctcatcctttgctaaagagtcaactatataattattcttcatgggggaaagagaaaacagacgagtattatgcggcatgggaatttctgccgaatgctcaattggagaccaatgagtatgttgatttgtttatgacttcggatgccatgattcatgattgtggctcttttacgattgaatatcatcatacattgaaacctgtaatgtatctggtcaatggaaaagagcatactgcaacgatgaattcttttgccaaggcagcctatgacctgcattataaggggcagactatccaagatatccggaattttatagaatgtacagtattggaaaactctgattacttactagaaaaaagaaaaaacttttttaagtcgtacttattgccgccccataatcagtctgccacagaaaatataatccatgctattttgggaacaggatattataccgaaaaaaaacagaggtgaatagtgatattcgttcaatgggcatttccggtgtgaaatgggcttctataggacgtttctcttcgcagggaataagttttgtcctgggacttattttggcccgtctgcttttgccttcagactatggtatgttaggaatgcttggagtgtttactgcttttgccggttcatttatagattgtggatttggttctgctttgatacgtaagttggaccgtacagagatagattgttctactgttttttattataatctgggagcgagtttattggtatacatggtcatgtttttgggagctccttttatcgcggacttttataagcagcctttattgactaatgtaaccagaatagcctgtctgacaataccgataggtgctctatgttcagttcatagtaatcttttgtattgtcagttgaggttcagagatatcgcgataggtaatatactggccacttttttttcaggaggtataggattattattagcatataatggttatggagtttgggcattagtatgtcagggaattattgcgtctttggtaaattgttgctatttatggagaatttcctgctggaaaccattgtggatgttttctaccagctcttttaaagaattgtttggttatggcagtaagttaatgttgtctggttggcttaatacaatgtattctcagttgtccccgttgattattggacggttctattcttcctccactttgggttactataccagagcgcaaagttacgtggatttcccgagtagtaatataatgggaattttgcagcaagtcgtttttcctgttctgtcgagattgcagaatgaggatgaacagttaataggaatttatcggaaatatattaaagtttgtgctatttttattttttgtggtatgaccattttggcggcactggctaaacctttgatacttcttttacttacagataagtggttgccatctgtcccgatcatgatacttttatgtttttcttttatgttctcatttgtgaatacaataaatttatctcttttacagattaaaggaagatcggatctatttttgaaactggaggtcgtgaaaaaagctatttctataacaatgattttgttgagtgcatcttggggaattatggcgatgtgctggtctatggttatatatacccaaattgctatttttattaatacatattatactggaaagctatttcatttagggtatcgggaacagctgacagattttctaccttatttttttatggcacttttagctaatatacctacttatatgctgacatatacatctttgtctattgttacacagattttattgggcggcttaatgagtttatctatttatatattactattgaaaataaagcgtgatgatatgtatctgttaat

SEQ ID NO: 217 - DNA, 10830 bp, Bacteroides thetaiotaomicron
acctaaacattataaaagatatgaagaaattaattcctattttattggcggtctttgcactcgcttcttgcgaaaaagacccggacatgggtaagctggatgacaactatctggtatacactaactacgacaagcaagccaacttcaaagacttcagcacattctatctggctgacaaaatcttggttatctctgacagcaaagaaccggaatatctcgaaggagaaggcgctgagcaaattctggctgcttatacagaaaatatggaagcaaaaggttatcaaccggctgccgataaagaaagtgccgatcttggtattcaagtaagctacatcgcaagtacttattatttcaccggctacacacaacctgaatggtggtggggatatcccggctactggggacccagctactggggtaactggggcggatggtactatccgtacgctgtgacctacagctatagcaccaactcattcattacagaaatggtgaacctgaaagcagatgaaggtgaaggcaaaaaacttcctgtagtctggacaagctatctgactggatttgaaacaggctctaaagctatcaaccgcactcttgctattgaagcagtgaaccagtcattcactcagtcaccttatcttactaacaaataaacaactacaactgttatgaaaacaagaaagaatatatatttcaaggtagtggcgctagcagccattgccatcgcctttgccatgccggctaaggcacagctatcagacaatggatatgctaatatagactggcagttcaatgttccattgagcaataattttgcagacaaagccagcggttggggtatgaactttgaaggtggttatttcgttactcctaacctgggtctgggtcttttcctgaactatcacagcaaccacgagtatattcctcgcgaaacattcaagataggtgcaggtgacgttacaactgatcagcaacacacaatgttccagttgcctttcggtgctgccgcccgctaccaatggaatcgcggtggagccgtacaaccttatgtcagtgcaaaattaggtgctgaatatgctaagatccgttccaacttcaatatgttggaagccagagaaaacagctggggattctacgcttctcctgaagtaggtgtcaatgtattcccttgggtttacggaccgggtctgcactttgctctgtactacagctatggtaccaataaggctgatgtactgcattacagtgtagacggactgaacaacttcggtttccgcgtgggtgtttcattctaacccgagcaactacttgattttacattaataagcaagagcccctctacttcggcagaggggctcttcattttttatttgctttgaatcgctttatagatcgcatcctgtatctgttcgcgaatttccagacggcttaacttccggttggttacgtccggataaatccggttgctcagaaatacataaaccaagccattgtcggggtctacccaggcacacgttccggtaaatccggtatgaccgtatacttttgccggtgtatgctttccgcaagggctcttttccggattacgggtatccggtttgtcaaatccaagtccgcgacggctgattttggaaacttccgttgtaaacaactggcaggtttccttgcttaaataacgctgtccgttcaactcaccaccgttcagcaacatctgataaacctgtgccacttcacgtgcattcgagaacaatccggcatttcccgaaacgcctccctggaaagcggcagcctcatcgtgcacaaatccctgaagggtagtcttacgcaagaagcgatcgacagaagaaggtacaacttccgatttcggaaagcggcgcaaaggaaggtatcctgtacgttccagtcccatcggttcataaaattcacgttgcaagtaggcatccatcggcattcccgcaagtttctcaaccaaaagacgcaacaggataaaaccgacatcgctgtatcggtaagttttaggtttcatcggtgcgtctgcaatcttcttctccatttccttgaagaaagaaggattcagccacagactatcacagatttgcaaggtgtaatctccggttttaacctttgaaacatattcctttttaaatgcaaaattaggattcgcccatgtggaagttcccaactgcaacggatgccgtgcatctttgcgggacatgaacagtctgccttcataactatcttcatcgatggcttcccgataaaaagcaattccgggcggcaagccggactgatggtaaagcagttcctgaatggttatgtctttcttgttagtacgctgaaggaaaggcagatagtctgcaattctgtccgtcagattaaaacgtcccttatcgtaaagtttcattaaagcaagcaccgtaccagtagtcttggagagtgaagccaagtcatagatatcggtcggctgcacacgtgcgcttcccgttccggtgtgagtgccgaatgtcttgtctaccatcacatgaccctctttcatcacgatcacctgacaaccgggataagctccctgacgtacaccgtccaaagcgatcgaatcaattcgttgcagggcgacagaagaaagcccatgttcttccggaataaaatgcaaaggtgttttcggagtaatcgtgacaccgtctcctgcctgaaagagttctccaagactggccgataatcttccgtccgccgtagctttggcaaagagcacatccgccacctgccgctgcacatcttcattagggctgtgtcccagcaccactgccgaggcacgggcaaccgcacgctgtatctgcaacatcatcttaccctgcgtaaagaaagcatagatgaccggagcttcagtagtaaatttaccgaagaaggtctgataaggtgacagcttctgttcacttacggcaacaataatccgtttataggtagccaatgagtcccgtaaccgctgattcgcctcttccgtcataccgggacgaagacggaaacgtgacaaagaagtgtatttcgacaactgttccgccaatgcattggtttcacccgcatcaccgacttcaagcaatgccatcgtttctttttgattcgtatgcaaaggaagaacatgattttcattattcagcacagtaatcgcagccagattcaaccgacggattaaatcacgtgtctgaggagtattgatccgttgtcccaaaccggatagctggacaaacggtttcttttttagtccgagcacatatttataagtcagtactttgcggcatttctcttcaatatcttcgcgtgtcaattctcccttatcaatggcatcgagtacggcggctatctcctccttcaggttccggggagccagtaccatatcattccctgccttcagtgcctgcagactgacatttccattccccgaaacacctttcatggcaagtgcatccgtgaagatcagtcctttgaaagcaaattcttctgtcagcagatcgtaaacgatattacgggataaagaagaaggaagtccgcctatcggttcaataaccggcacttgcaggtgtccgaccatcataccgctcaatccggcacggatcgcttctttaaaaggatggagctctacactgtccagacgttcgcgagtgaagggaagtaccggaagcgttttgtgcgagtctacatccgtatcaccatgtccggggaaatgcttgcagacggatagtacgcctccgccttccagaccggaagcataagctactaccttatccgccacccgtacggggtcttcaccgaaggaacgggtattgatgaccggattcttagggttgatattcacatccgccaccggagcaaagttgacttgtacacctagctgtacacattggcgtgccatctcgcgaccatattcatagattaatttattatcctgaatacatccgagcaccatatttcggggaaagacaggagtaccacgcagacgcattgccagcccccattctccgtcaaaagtgatcattaacggtaactttgccatgcgctgggcccgattagtcagttccgcctgggtctgcatcttcccaccggaaaacagcagtccgccgactttataggtatcgacggcatccttcagcagtatctggttgcgcttggtatctaccggagcaatcgtatatataaacaactgaccgactttctctttaagcgtcagcttattcataatggagtctacccattgttgacaacggacatcttgtttagctttataaagtagtaaaggttctacgggagtatctattgcttctcccctggccttgacaggaagaaatagcaggatagccagtatatatgttagtaatctcattttttattcaaggtcaaatctagtcgtccaacataaattccattctttccggtgtgcataacggggacatttttcccgtctatgttcagataattcttggggctttccataaaggtatgagaatgcccacccagaataacatcgatattacgggtgttggctaccagcttctcatccatctgaatacccagatgtgacaggcatacaatgacatcgcatccttcttctttcagttgtgcggcaatgtcattggatacggcgatcgggtctttatagaattaccccttcgcatttattggcctgtatcagtccttccggcttcgctcccaacccgaaaactccgatcttcaaaccgaaacgatccagaatgacataaggttttacgatatctttgagtactgtggcatcaagatcatagttggcacatactaccggaaacttggctaatttaaatagacgagccatgttgtccaaaccgaaatcgaactcgtggttaccgattgtcattgcatcgtatcccatttcattcatcagggtgacttctacctcacctttaaacatattataataaggagtgccttgcgagatatcgccgcaatcgaacagcagtacatccggattttctttgcggaactgctgcaggaaacttgcccgacggacaaatccaccctgaccgtagttccggtcgccttcctgagtcataggttcaatccggctgtgtacatcactggtttgcagtatgattagtttttttgtttcctgggcagttgccaatgcaggtagtaaaaggaggaaaagcatcagccactttccggttcttcctttgaatatattcaagacggaagttatatgattatgagttgtcataggatactgagatttcattgtaaaccttggttatttattctcttttcatttttttatttccggtcggatgccggaacaacggtgatacgtccatccagtttagaggtaatcttcttgcctgcagctgtctgttgccttacgtagtcgaggaacagtccgcgcaatgtcaatccatccggacattcacgcttatccgcattgataaagggagtgagtccgtcgtttccgtccgccagatagtcaatggtagctacggtatagtctttgtcatcttcgatctctttttcctgtacggttgctttcagaagttttccgtcttttgttatttccagatgtgctccgctcagtccttcaccgtgcaaagaagctatgacttccatcagtctttttatttccgtacctttcatcgtcagtacgcagagagaattttcaaaaggaagtatttcgaaaacagcatcgactgtgatattaccctgtggaagtatgttgcgcaaaccgcccatattcatgattccaatatcggcaggatgcttcagtacacgctctgcagagagtcgtagcacttcggcgaccaggttggaaagcaagctctcaggacgtcctttgtccatcgtcatctcgctgacgccaatcacctcatacatcatcttatctattttttctttgtagggtttaagcagggcggcagccttttcgtcgggatgagcatcccaggttgaatccatacaaatccgggttccttctatctgggcaacttcataatttgcctgaacttcacgggtagattggcaggaagtgaataggattagtcctgtcagaatagctcccgaagtatactttacgtaatttcgtttcatcttctttcttttgtttatgctacaaatgtacattttatattttaaagtcatgcggaagaagaagaaacttatagcaagtttagtcctatttcaaggggaattagctgcaaaatgcacttaaaaatgttaattgaaagtattctgaggcagggttgatttaattaaaaaaaggacgttcccagggaaaaaggggaaattaggaacgtcctttgaatagagttagcgaaaagtccggtctttcacaagtacagacctttcctctcttcactaaaataaactaaggactatagtggggaaatccttagtggggaaaaacgactatcagcttcttcacaggagcgcataatcgcaaagtagtcgcattcggtacttactgtatcaatgatatttctacaccattagaaattcttttgtaccgatgaagcaacatattttttagaatatcttcttataatatcttgttaataactttgtttattcggcgatacagatactcacacgattttcttctggtgctttatatggctgaacagtgtctcctttggaatcaaccataattctgtcagtggttattccttttgccttcaaagcatccgcaacattgcctgcgcgtttttcagacaacgacttgttgattttaggattgcctgtatttacatcggcatagcctgtcactttaacctttgcagccggattgttttgcagatattctaccaacatatctatttttgacttttgatcgtcttgtatcttcgctgagttcaaagcaaagaagatatcctgtttcattggctgtactacaacttctttcttcggctgtggctgttctaccacgggaacaggcttcggttgttccactactacaggttctgcctcataatatacaggtttagtttccgtatagcctttaccgaatttaatattcaaaccaatgagagcattgaactgccagtcagcatttcctgccttctttgagttgaacttgtcggacaagacatttgcattaccttcgatgttgatggacaagcgatcattcagacgcagattacatcctaaacccatgcgcccagcaatgagaaactttccgtcccgccaaagatattccatctcataggttcgtgtatccagtgcattcgcctcatcgttatcaaagccacgatttaatcctcctccgagaaagacataaccattgaatacacgtttgggattaaaaccacaaaacaatgtgctaagatcagaaacgatgtcaatgttaccttgcaaatatttgtactggtaatcctgttgcggagaaacccagcctccttttgcctgccatccgctgacaccaacacgtgcccgccatgcaggagcaaactgataacctacgtttatcgctgctgcaggagatataagatcactaaacttagcttcgccaagtgtgtgagcagcacctacttgcacttgcataaaccaatgaggtttgaattcagttttaccttcttcttttattctttgttcttgtgcggaaatgactgtactacttaatagtaaggcgaatacaggcatccacaatttctttatgttcatgcttatcttttctttttaatatgatactgcattaactttattaaagaagggtatccttcttttgaaaaagatacccttcttatctttgtcgatattgctatcgtgagagatcaatcaattactggtgagtcggagtaattgttaatgttactgtgctggttacttcaccgaacgtatatttaaccgttacaggaataaacagtttgaatggtgcatttatagtaaacttaccgtttgcataaacaaggtcaccatacgttatgtcaccacctattttctgaagatcacatgtgtaattaattgacatgttaggtgcaacgtccttcaacagttttggtgcagcttcgcttgcattcaatgttgtcatgatctgatccttatcaattgaaattgcactaccagtaactccataataagtatagaaatcgataggcgctacagcaaacgcttgacctctccagtctgtcaaaccaagtaacttgctcatgtcgatcttagcagttcctgtagttgcatcctgcaattcggcagacttcaagtcaactacattgataggacgcaagaacttcacatcaaatttgttaccagtcaacggtaagatttcatcgcattcgttagttaccacaatttcaatacctacagtgaacggatccacgttgtaagcagacttattcaacaatgcatgtgcattctcgtcagccttattgtaagtaataataccgtcagcatcaattgtagcaatcttagttgcagtagcactattcttgctagcattcaattgagtaccgttagctgttacagtgaatgtgtatttatcagttccgatagttacatccttagctcctgagaagataaacttcgcagtcaacttatccttcgtaaatgatgggaagttcgcttctgtaacgtcagaaacaacaaccttacgaccttcaaatacatcaaacagatcaagtttgaagtctgttactgctacagtaaccggttctttcacatcagcttttacataagacttatcaggtgaccaagcttcagtaatcttctggtcattcttaattactccactaggcattgcgatgcttgctttcatcgtaattgtgatatctccacgagttccgtctactgattcataagtcacagtagcgaacatctctgtcttcgactttttaacaagagccaaagcttctgccggagttactgtccactctactactgtagtagcaatagcttcaggatccgttacttctgttactgttcctgtacttccttcacccaaagcgatagcacctccatcatctttcttcaatgtatatgctgtatggaagtcaggcttgttcaacttcgcttcagcataaacatcattcatgttgaggtaagtcaatttggcaacattgttctcacaaccatagtaataagtatctttagtgaatactttaccgaatccgtcaattgtacccttaacaatctttgtcttaatccatcctacagcaactacctgattaggaaccttagtggtatctaccaattctacacgtaacaatggctcgcgatgttcagttgcttcagaatcctgacctttatattcagggttaataatacctttagcagcatcactaccattaaagaatgagttctgttctgtctcattattagctccaccaatgtaattggaagcagtgaagacatatttcagaccgttatctttaatattagtcatcttaactaattcagtaccattgttttctttataataagtagagattttatctgctaatttaagtgtaccatctgtagctacagtgtaatctgcatttgcatcaatagcttcttgtgccttacctgcattagcattaggagtagaaccagtacgagaaatgctttgtccatataagattacgtcttctgcatcaattttggtttctagaacgaagtcgctcataagtaccttatatatactagcgtaatcagaggtaattactttagcttcgtcagcaccaatagctttggtctgagcctgcaaagcatatacagctaccttaccagaattcagtgccggtatcttttctgcatctgcatccattgcaactttaagataacgttgtccgtcttcggttacgacatctgatttctttatattagcagttggatccattgcagcagcacgagaaactggataataatccttatcgcctgaaaggaatttcaggctttcaatctgtgccattgaaacgctagccggattcatgtggtaatatgcccagatttgcggagtaatataagaaagtgtaggattagacttatatgtttcaccggtttctgacggtttagcgtacgcattttgagaccatgcattataagtcaagttgttagctttcaatgcagagattccacccacatagcaagtgggctcaaatactaatcccttcaaaggtatagcgtctatgacagagaattcaccagtaacttctttaccgttttcgatcgttacaattctatatcctgtaacgactcctttttcatcaaggatagcagtaatagatccttttgcggtctcaggaatcgcaacagaagtttttgtgccatcataataaacatagccatcttttacagtcagtaacaatggatcaaattccttatacgtcggaatttcagggatttcaggaatgtcgatagtaccagaactaacttctttaccatccttcttcaaagtaatcttaccatcctttgtcacatcaagagtatacgatggcaattcttcaggcattggtatagtgtactctttactatccgcaccagtcactgttaatttgcctgtagatgcatcatacaccacagacttcacatagcctcccacttgagcttgcaattccgagagagttttttcaattccatcgactctggcatttaccgcatcaatgtcatcatcgtagtctttacaacctacgaacgatgcaccggtagcaagcgccaacgctccgaaaagcatcaccctaacaaattttttcttcataactacttaaaaattacattaataatatattattaaacactaagttcaaataatactcgcccgttacttcttaggtaacgggataatacattttcccactccgacagaagcgtctgcgggccattttcaataaataagttatgatatttttaacc

SEQ ID NO: 218 - DNA, 10764 bp, Bacteroides thetaiotaomicron
ggtttatatttctcattattataataatcaacactttatataaagaattagttctgcaaagactttgcaaatttcgtacatcggtatgcaaactcaagaagtagcgattaagcctaatttaaaggtagtacttaggtcggatgctcaacagatcgatgaagttgttgttacagcaatgggtattaaaagatctgaaaaagcattaggttatgctgcaacttcagtgggtggagaaaaaattgcggaaagccgtacatctgatgtgatgtcaagcttggcaggtaaaattgcaggtgtacagatttccagcacttcatctgaccccggagcctctaattcggtcattatccgtggagttagctcactctccggtaccaaccaaccactatatgtcgtggatggagtacctttgaataactctaccgtatactctacagatggcttgaatagcggatatgattttggaaacggtgccaacgctatcaatccggatgatgtggcaaacatgactattttgaaaggtgctgcggccactgctttgtatggtagccgtgctgccaacggtgtagtcatgattactaccaaaagcggccggaaagaaaaaggagttggaatcgagtataacggtggagttcagtggtcaactgttctgcgtctgccggaatttcaaaatgaatttggtatgggatggaacggcaaccatacagaattggagaacggttcctggggacctcgtttcgatggttccatgcagttgtggggtaatgtgtacaacaactctcagaaactgaaaccttatgtggcaatgcctgataacatcaaagacttttttgatgcgggattcagatatagcaacagcctttcattcaatggagctacagataaaagtgattattatgtatcattctctcagatcagcgatgatggtatgatcccgacagatgctgacagctacgataaatatactttttctgcacgcggcagccataaggcaggagcgttgacattctcttcttcactgaattacgcttatcaaaagaataactttgctactacgggacaaggtttgtccatgctaaactctttatatcagacaccaagagatatcagcataataggactggaagaccagaatgatccgttcaacactccgggatattattataccccctacggagttatgaacccttattatattttgaataactatttgaatgaatatgaatctgaaagattctacggaaaatttcaattggattatgaattcctgaaatacttcaagtttacgtaccgtatgggcttggatactacaacaggacaaagtgacaaaggaaaaccgaatctgtacgctctttattatgaaggtactcctaatggagaaggtcagggctccagcagtcctttctctggtgaaaccggacaatattctgagcagataacccgtcgtcgcgagataaaccaggatattatggttaatttcaatatgccggttaacgattttaatatcaatgcactggtcggtttcaatggcaatgaacgtaaagtctcttatcaatattcagaagttaatgatttaacgattcctacatggtttaatctgaagaactccggcaaaactcctatagtagaacagcacatggaactcagacgtctgatgggtgttttcggacagtttgaaggttcatggaagaatatgctctatttaacggttactgcccgtaatgactggtcttctactcttccaaaagaaaatcgcagtttcttctatcctggtattaccggtagttttattttcagcgaattattgaatgacaatctgcaagatgtgataacttttggtaagatacgcgccagctggggtaagacaggtaacgatgctgatgtgtatatggttaatcctgtgtatgcacaatcttccaatagaatacctttcggttctctgactttccctctaggaggtgtcaacgcttactctgcaggaaatgtactcggaagtaatacattaagtccggaaatgaccacagaatctgaagtcggtttaaatatggctttcttcaaaaaccgcctctcttttgacgtatcttattataataggaataccgataagcagattttctctttggctatggaccctgcttcaggctatacagcacagaatatgaacctgggtaagattcgtaaccgtggtatagaactcctgatcagcggcactccgataagaacaaaagatttcagttgggaactgacatggaacttcacgaagaactggagtaaggtgatcagtttaccggaagaattgggtggcattacaacgatttatggtctcaatggaggtaccagtatgtacgctataacaggcatgcctgttggtgttttcaaggctcaggtagccgaacgtgatccgcaaggacgtattgtagtaaattcatcaacaggtcttccggttgaagccagcgaattcggaatctgcggagatatgaataacaaatatcaaatgggtgtttctactaacttgaaatataaaggtataagcttaggcattgattttgatatccgtcagggcggagtgatgtattcacgtactaaagatataaactattttaccggtaacgcgatacagactgcctacaatgaccgtaatcctttgattgttcctaactcagtaaataaaatagtgaatggagaaaacgttacttatgtagaaaatacaactcctattacaagctctaacatttataaatactggggcgacggtggctctgatatgggaagctgcttcctggtagacaaatcatacgtcaagcttcgttctgttgtattaggttgggacctgcccaaaagatggttggcaaaaactcctttccaggcagtaaaagtgtctgcatatggcaataacttatttgtctggactccatccagcaatacatttattgatcccgaaatgacttcatttggtaacgaccttgaaggtaactatggagaatacacggctaatcccagctcacgtcgtttcggtttcaacttaatggttaaattttaaacaggaataaaaatgaaaaaaatattattatatgcatcattagcaacaacagcattgtttgcaggttgcgacctgaacatcaatgacgacccgaactacccgatgaatgatcaggtgacggcggatttgatattcccctctatcagtgcttccattgcttcggcggtaggcggagaaatttataattacgctggctttttcgctcagtactatgaacagaaaccggagtcgaatcagtataacactctatgtgaatatacatttaccgaatcttcccagcaaatggattattcttatagaatcctgtttgcaggagctttggaagatgcaaagcaggtgctggaaaagaccacaaaccctgccgaccgattcgctactaccatactaagagcatatgcctttcagataatggtagataataccagtgactcaccttattcggaagctctgcaaggtaatgccaatgccacacctaagtgggatacgggtgaaacagtatataaaggtatattaggtgagatagatgcggcagaagctgctttggatggaagtggtatggatgtgccggatttgatattcaataaaaatatcgctcaatggaaaggttttgccaatgctcttcgcctccgtatgtatctgcgtttcattgatgccaacatagatgcggcttcgtatacagagaaagtgaagaccttagtacaaaacaacgaattctttaccggtgacgtgaaattggattgtttcttggatgaaacagacaaacggaatccatggtataatacgaatgcggtcggcttgaccggtaatcattgtgctgcctatccgttagtatcttatttaagcagcacgggagaccctcgaatcgcttatggtattagtaaaacagatgcggatggaaagtatgtcggtcaacttcccggaggaaaaacacatatgcaaagcattctgggtactgacaactggaaaaacaaaaacgtaagtgcgattgattactctatcggagccacaaaacctgtctatttctttactcaggctgaattacaattcctgatagctgaggtatatgctcgttttcacaatgatgatgcgaatgcaaagagtgcttatgaagcaggtgtaactgcagactttgccgttcgtggatttgcaggtcaagagaataccattttggaaggagcgtgtgcatggtctgctgcttctacacaggcagacaagttaaacttgatatatatgcagaaatgggtatctcttttctacatggatcatatggaagcatggagtgagattcgtcgtacagattgtccgaaactgtcttcttattcagcagcacagatacaggctagtgagtcagtatacactccgggagagttagttgctccatggactaatggtctggaagcgggtggactgatgaaacgtatgacttatccattaagcgcacgtcagcaaaatgtgaatactcctgcaggggtaccgggaagtactccggtttggtgggatatcaaatagtaaccaataacttagtaagttttacgtatgaaaaatataatatacagcatattagtatgtttgccgtttgtctttggagcttgcgacaaatcaacagatgacacttctaaagtcacctattttgttacgttggaaagagagggtgatgaaaagatcgttttagaaaaagggcaaccctttgtggagccgggatattatgcggaaatgaacggagaagatattactgaatctgttcagataaaaggtagtgttgatgtcaacactccgggaatctacaatttagtatatgcggcatacaacgaggacggttttgccaaaacatttacacgaacagtatatgtggcagataatactgcttctcctttgaaatccggaatttataccgtagccgaaggaagcaaacgtaccgccccttctgtggtagctttcagtggatatgagattgtgattttccagatggaaccggggattttttatatcagcgatttcttaggaggctggtatgaccagcgtgctggctatggaccggactatgcaatggttggcaaattcgaattgaatgatgataataccattactcctctggaaagttatgttgcaggttggggagattccatggatcaaatgactaatacattattggaccctgcgactgggactctgaaatggactgttgcttatgccggtcagctatcttttgacattatagtaaaacaataaaaatacgattatgaagaaatatatgatattacttttagcttcactggcttttacattcgtggcatgcgacaacgatacagaaccaggtggtactgctgttgaaaaaatggcaggagactggtgggtgacagtgaatgcatttattgacgggaaagaagtagaagatcctttcggagcaggacatctgcaaatgagtacttacaatacagccagcaacagtgaaactgaaatgtggttggatgatttaggaaacttctgggaatataaactgaaagtaaacgtgaattatgcagcgaggactttctcgacaacaggctttgtggataatgtaacatatgaatccaaagtgaaaataactgatggcaaggtactggaaaaagctgccacaactcctagtggtatgcctgctgacagtatcgtatatatggtacaattcgacgacgatgaagatggattaacttataaagtttcaggcttccgtcgaacaggtttccctgctgacgatttttaacagaagagtttaaatatagagagggctgttccaatgatcggagcagcctttttgcaatctaacctcaactaagacagatcaatatataagcagtctccaatatttacaatatttccttgcctttaaaagaaaaatgaatgggacaatgtttttaattagcaacatccattacctgattaattgtatacaaataaaagcgcctcttatagcatgatactattttttgtttataatagctccttgttttatagatataatattgattataagataaatagttttcatttcggtagagaagtggtattacataaaagagagtaaaacattagctgaattagggtaattaactgtcaaatagatatataagctatttctgcttgataaaatatcgactggtgttactgatttatcccctatatacctaactgattatcagttatatataaatccattagttctgcaaagactttgcagatttcgtatattggtatgcaaacacaagaagtcgtaatcaaacctactttgaaagttttgttaaagtctgattctcagaatcttgaagaggtagtggtaacagctatgggtattaagcgatctgaaaaatctttaggttatgcagtatccagtgtaaaaggagatgagataactaaagcgcgtgaaagtaatgtgcttaattcattgtccggtaagattgcaggtttgcaaattgcacagtcgtctggaacggtaggtggtagttcaagtatacagattcgtggtgcttcctctattggcacagtttcttcccctttatttattattgacggacttcctattgacaatggttcttacaatcctgacagaaccaatggtatagtcgatgtaggtaaccgtgcaggagatatcaactctgacgatattgaatctattaacgtattgaagggtgcagctgcaactgcattgtatggagcacgtgcaaaagacggtgcaattgttattactactaagaaagggaagaagaattcaccggtatttgttacggtaaactcttcaacacgatttgagaatgtacttaaattgcctgatttccagaatgagtatgcacaaggtagctacggagtatataatgtaaaaatgctgaatggatggggaccgaagatttcatcggtacaagatcagcaatttacagattataaaggagataaagtgaccttgaaagcaaatcctgataatgtgaaggatttctatgaaaccggaatgagctatattaataatgtgtcagtagccggaggtggtgaaaaggctgatttccgtttgagctttacttctactaatcagaccggtgttgtgccaggttctgactataacaaatatgcattctctgtgaatgcaggtatgaactttactagcaacttcacaggacgcatctctgcccaatatatacgttcagattctgaaggtcgtccggcacagggggcaaatgatagcaacttgctgattcctttaatcaatggattgccaagaacgattgatattcatgatattaagcagaactggattgatgaaaatggcaaacaggttacgttggatccggaaggcaaaagtaataatccgtactggattattaataagaataaatttaccaataatctggatcgtatgatcggtaatatcacattgacttataagccgattgaaggattgactatcactaacaatgccggaactgacttctatacagaaggaagacgtaaactttacgcaaagggtactgtaggagccttaaatggtaagtttcagacttggaatttgtataaaagaattataaataatgacttaatggtttcctatgagaagacttttgccaatgattatcattttaaggcgatggtaggtcataatctctatcaggaagaatggaagaatgaaaatgtacaagctcagaacctggtagttgacggattgtatacatatactaatgcgaaatctactactccggtgaattattatgaaaagaaacgtcttgtcggtttatacggagatattagcttgggatacaaagatatgctttttattaatgtaacaggacgtaatgactggtcgtctactctgcctattaataaccgttcttatttctatccatctatcagcggtagctttattttcacagaattgatggagaataaagacatcctgaattacggtaagattcgtttaagttatgcgaatgtgggtagtgacgaagatccgtacaatttggcatttaaatatactccagctagtacttactttttgcaatatctgggtaatgtcaatactttcccacacatgggactggttggttttaccgggcctcgtgttctgccgaatgaaaacttgaaacctcagaaccaaagttcattcgaagtcggagctgatttacgtttttttggtggaaagattcgtttggatatgacttattatagcaatatcacaaagaatcagattgtaagtattgatgtcccgttatcaacaggttactttgctaataatatcaatgccggaaagattgccaataagggtgtcgaagtaactttgggcttgactcctgtagaaacacgtaactttaaatgggacttggatgcaacgtttgcttctaataagcagactgtagaagagttggctgaaggacttgatgaatatacattgactagcggattgagtggtttgcagattaaggctgccaaaggtgattcgttcggtttgtacggtactgcctggaagcgtgatgatcaaggtaattatgtaatcaactctaagacaggtttgagagaaacagtcaataacgtacgtttgggagacgtttatcctgactttacaatgggtatcaacaatacacttacttataaagggctgacttttagtttcttgattgatatccgtcatggaggttccttatattcggaaacagtagctaatttgagaagcagtggtttggctgcagaaacagtggctcaccgtgaagatgcctcttttattgaaccgggtgttattcttcaggatgacggaacttacagacctaatgatgttccggtgaagagtatgcaggactactggcagcatgtggcgaactccagtaataatgaaggaaatatctataatgcatcatttgtgaaacttagagaagtgcaattgtcctatagttttccgcgtaaatggtttaagagtttctttgttaaatcattggatttaggcttcgaggcacgtaacttatggatcatcaaagatcatgtgccgcatattgatccggaagctaacttcttcggtccttctcagatcggaggcggtgtagagtttaacagtatcccttctaccagaagtttcggatttaatctcagactaacattgtaagaattaaacgaacatgattatgaaaaagaaaatattagcatatgcattgagcgctttgacatgtgggttatttacttcatgcagcgactggcttgatatcaaccatgaccccaatactgccgagaaagttgatcccggatatttgtttaactatgtagccgtaaactgggccggaacacgtaccggtggtgacttctatattccgttatcaatgagttcacagtgtcaggttgatggtggacttgattatggtggctgggatgaatcggtatataccatttccccttatagtacaggaaatacgtggaaacattactactctgtcggtggtaataacttgatgctggctattaaaaatgcggaagaagcagatccggtgaatcacaatgctattgcacagtgtaagattctgttggctgaacatatgtatgaagcgacgatgctatggggggatatccctttcactgaatcttggaacggaacaattaagtatccgaaatttgattctcaggaaagtgtattgaatggggtgttgtcattgcttgatgaagcactgcagatcatggatttgaatgatgccaatgcgattgatgaatacgatatctattataaaggtgatatgaataaatggatgactttggccaaatctttaaagttcagaacactgatggttatggtggacaaagatccttctaaagctactgccattggtacgttgttacaggctggaggcatggtatcatcagcatcagataatttggtgttcccttattctgcagaaccgggtaaccagaatcctaagtatgaacttatagaattggttggcggtacacagatattgttttttgccagcaactatatgctgaagccgatgcaggaacgtaatgacccccgtattccttgttattttgaaccgggtgccgacggtgtatatagaggcttaggtaaccgtgaacctgctgttactgatgacaaagataatatgttatcatctgttgtgagcagttatcttttcagaaaagatgcaccggagttaatatactcttgccaggagcagttgcttctggaagcggaagcttatgcgcgcggtttgggagttgctcagaatttgtcgaaggctaatgaattgtataagaaaggcattcgggaagcatgtgcattttatggagtagcggaagcggatattgatacatatgttacaggtttgccggaattgacagcgctgactcaggagaaagcactgtatgagattcatatgcagcagtggattgatttaatggatcgtccgtttgaggagtttgtacagtggagacgttctggtactgctggaaatgaagtcccgaccttacaagtgccggaagatgcaacttcaaaagaactgatcagaagatgggagtatagcccggaagagatgactgctaatatcaatgcaccgaaagaatctccgaaaatttgggaaaagttatggtttgatttataattgaattacactactgtcccgtaaaagtggataaatagttctttgaaattattgaaatatagtcaattacacggttttttgaaatgaaacggacttgattttgcaactttgcagtctaatacaaatggctgctat

SEQ ID NO: 219 - DNA, 10564 bp, Bacteroides thetaiotaomicron
ataaataataatcaattaattaatcttaaaaattagacacacaatgaaaaagttatttgcaattgttgctgtgattggggcctttacatttggctcaattcaacttgctcaggctcaagacgctcctgcagcagaacaaactgaacaacaagctgctcctgctgctgctcaagctgctccggccgctgctcctgctgcagaagaaggtggtattcacaaagaaatcaaagttaaattcatcgaaggtactgcatctttcatgagtttggttgctattgctttggttatcggtttggctttctgtatcgaacgtatcatctatttgagcttggctgaaatcaacacaaaaaaattcatggcatctatcgaagctgctttggaaaaaggtgatgttgaagctgctaaagacatcgcacgtaacaccagaggtcctgttgcttctatctactaccagggtttgatgagaatcgaccaaggtatcgatgtagttgagaagtcagtagtatcttacggtggtgtacaggctggttaccttgaaaaaggatgttcttggatcacactgtttatcgctatggctccgtcactcggattcttgggtactgtaatcggtatggtgcaggcatttgataagatccagcaggtaggtgatatctctccgacggttgttgcaggtggtatgaaagttgccttgattacaactattttcggtttgatcgttgctttgattcttcaggtattctacaactacgtacttgctaagattgaagctcttacaagcgaaatggaagactcttctatctctttgcttgacatggtaatcaaatatgatctgaaatacaaaaaataattcgaaatgagtaagttatcatataaagtatcgtattacgcactgtatgcgatgtttgccatcatcctcattgtcctggggcttttctacctgggtggtgatgctcaaggagcagatgtcattgcgggagtagatcctgaaatgtggcaaccggcaaacacaaatgccttactgatgctcatttatgggttatttggtttggctgttgctgctacagtagttgctgctgtattccaatttggagcagctttgaaagatagccctgcaaatgcaattaagtcattgcttggtttggttcttttggttgttgttttagtgattgcttgggctgcaggtgatggaacaccgatgaatatcccaggttatgacggtactgacaacgttcctttctggctgaaattaactgatatgttcctttattccatctacatcttgttgtttgtaacaatcgttgcaatcattgcaagtggcataaagaaaaaaatatcataatcaattgaggatactcaatttaataagtaattacaatggcaagaggaaaaagaaaagttcctgatattaactcaagttctacggcggatatcgctttcttgttgctgatcttcttcttgattacaacatcaatggatacggaccgtggtttggcaagacttttgcctccaccacccgaagatcaagatcaacagaatacagataagatcaaagaacgtaacattttgcaggtatacctgaataaggatgatgctttgatgtgcggtaatgattatatcggtgttgagcaactaagggaaaaagctaaagaatttattgctaatgccggcaatgcagagcacatgcctgaaaagacacagaagaatgtggagtttttcggtacgactctcgttaacgacaagcatgtaatttctttgcagaatgaccgtggatcttcttatcaggcatacatcagcgtgcagaacgaacttgttgctgcatacaatgaattgagagatgaactggcccttcagaaatggcaaagaccttatgcggaattgaacgacgaacagcaaaaagcaattcgtgaaatctatccgcagagaatttctgaggcagaacctaaaaaatacggagaaaaaaggaagtaagtaatgggaaaatttaataaaactggtaaacgtgaaatgccggcattgaatacttcttcgttgcctgaccttatctttactttgttgttcttctttatgattgtaacaacaatgcgcgaggtaacattaaaggtacagtttacacttccggtaggtactgaactcgaaaaactggagaagaaatcgctggtaacattcatttatgtgggtgaaccgactcaggaatatcgtgcgaaaatgggtactgaaagtcgtattcagctcaacgacagctatgctgaagttggcgaagtacaagacttcattttccaggaacgtgcaagtatgaatgagggtgaccaagctaagatgactgtgtctctgaaagtagaccaaaagactaaaatgggtattatcacagacgtgaagaatgctcttagaaaatcttacgctttgaagattaactattcttctactaaacgtggtgagaaataattagttaattgatatatagagaagggcgtccaagcaattggacgccctttctttttagcttctcttttagcttctctgtttattattcttcggcagaggcagactttatgtctgaacttcgtctgccggatatgatctaaaatctatccgaagtatgtttcttccgattcttttgtttctttattctttgactccgtaaacgattgtatggagtttatgtcttatcccttcataatccttttctgcatccaggttgccgtgtaccatgagatacataggcaggaaatcgtctccttctttatacggcggctggtagtagtctttttcccacagtgtaaatccgtggcgttggtaaaagttgatacggcgtttggccatctcctctaccgggcgttctacttccagtacaatggggcgtttcagaaactcacataaatgctctaatgtgcgttttccgtaacctccgttgcgcaatgccggattggtagcgaagtgttctacgtaatagaattcatcgaaatcccaatatgtgataaagccaatgggcaggtcatcgtcaaaaatgatattattatggaagttacctatccggtctgtatattcgcgaagatgttccagttcgcgatattcttcgggtggaaacgattcgacgagaagctcttccataaatttgtaatgttgtacgtccgatgtggtgatcggttgaaatctgatcatacggtttgggttttaagtttgacaatattgttttttgttgctatacccggtattgctataccaaatgttatactctatcgggtgttatattatatcagttatatgatactatgagatgttactatgtcaggagtcagacaggaattctaaaagaaaaagaattcctacatctgcctttaattaagggacatagaactcaataatccgctggatagcacgctggcataccgggcagaactcaggatattcgttcgttttcatgcgacaattgaatgccggacggtaaatacctttggctgagtaaccgccaccttcatatacacctaccggatagttttgatgttgtgctacaggtgtggggacaggcgtattcggtgcaagcatatcttcccatttcaaggcaaaatttacccgtgtactgatgttctgttcccacggctctacatccagcggatacgtgtccgtcattacatcgtcatcataaaaatactcatccgccaagcctccgaagctatgtccgaattcatggaccactacaggcttgaacatcggatgatgagcggtagtcagcgtatatgagttgtaaattcctccgcctccgtacacatccgtattggcaaggataataatatgctcataaggaatgccggccaaagcgttgtggatggccttcacccgacttgtagtcaggtaacggtccgagtaaaaagtatcgaaatgagaatgaacagccgtgtgtttccattgattttcgcggggaacactgactccgctgtcaatcgacggactggctacagccactatgttgaacttgtttttcatcgaccggaacggttcgtgcgaaaacaggctctcgcaggctttctgcgcatcctgatagaataaatccatttccttttccgtgtagccttctgccaggatagcgacatctatgcactctttttcgttaccgctctgaagcatataccggtgtggagtgacgtgcgatgttccccgtttatgaatcaagatatcgtccggacggacaatgtgcttgaagctggtcatcacttccttgcggggagagaacagcacgatttctacctctgccggctgtttggggtagggaagcaagaatgtattttcgaagcctttggctgtctccttggcttcgtcggtggacagccactcttgaaacagagaagaaaaggaagtcttgtagatacactgtcgggtggcgagatctctgacgataatttgcccgttgccttcgagcggaagttcggacaaatgatgttcacgacctgcccaggagggaagctgagacagctcgtccagatagatcgcttgctgcttattgtttccggtgaagatataatctacccgcaacgtcttattctgaaaataatctgcaaagttttgcgcataacttcctgccgaaatcaggaaaaaaagaagaatactgcaaatttgtttcatataaatagtatatttatgttttttacaaaggtacaaactattgttgacttattcgatatttgcaaataaaagtaataaatcatagtatttgttgccgaaaaatagctaactttgcatgaaagattcattgattaaaacaatttgattcaaaaatgggacatcatcaattagatgctttagatgagcaaattctgaaattaatagcagggaacgcgcgtattccttttttggaagtagcaagagcgtgtaacgtttccggggcggctatccaccagcgcattcagaagttgactaatctgggaatattgaaaggatcggaatatgtgatcgatcctgagaagataggatatgaaacttgtgcttatattggtatatatctgaaagatccggaatcctttgattctgtaacgagagctttggaagccattccggaagtagtagagtgtcatttcactactggtaaatatgatatgtttatcaagatttacgctaagaacaatcaccatttgctgagtatcatacatgataaattgcaacctttggggttggcgcgtacggagacattgatctctttccatgaagccataaagcggcagatgccgattatggtcgacattgaagacgaagattaatcgtacagaataaaatagcttactgtttcacgtaatctacaaaagcatacgggcagagatgtttctcatccacaggatgagcttctctgcttttttcgtgccattgagccggagatacttccggaaagaaggcatcggcttcgggagcaacgtcatttatttccgtcagacaaagttcgtcggcaagaggaagtgcctgctggtagacgcttgcgccacctattatatagacgtgctcatcttccttgcagctttgcagggcgacttccagcgacgggaagacttccgcaccgggacataccgtatccggacgggtggataacacaacgtttctgcgattgggcaacgcacctttcggcagcgattcgaaggtttttcttcccattatgatggtgtttccggtagtcagtgccttgaagcgtttcaagtcgttgggcaaccagaaaagcagtttattctgaaagccgatcgccattcggcggtctacggcggcaataattgatattttactcatggttttataccgctactattccggcaatatgtggatgcgggtcgtagttcaccagttcgaagtcttcgaactggaagtcatagatactcttcacatccggattaattttcatttgaggcaatgcgcgtggttcgcggctaagctgcaatttgacctgatccaagtggttcagatagatatgggcatcgccaagtgtatggataaattcacccgctttcagtcctgtcacctgcgccatcatttgtagcagcagtgcatatgatgcgatattgaacgggactccgagaaatatatccgcgctgcgctggtaaagttgcaggctcagccgaccgtctgccacgtaaaactggaagaaggcatgacagggaggcaggttcatattctttaaatcggctacattccaggcgctgacaatgatacggcgggagtcgggattgtgcttgatcgtctctaccgcttcgctgatctggtcgatgaatccgccgtcgtagtcgggccacgaacgccactgatagccatagatatgccctaaatcaccgttctcgtccgcccattcgttccagatgcgtacaccgtgttcttgcagatatttcgcgttcgtatcaccttgcagaaaccagagtaactcgtagatgattgatttcagatgcagttttttggtggtcagacacgggaaaccctcgtcgaggttgaaacgcatctgatgtccgaacacactgatcgttccggttcctgtacggtcacttttctcagttccttcagttaatacgcgattgagtaaatctaaatattgtttcatagcgaataattttccaataagttggtgcgatgcaaaattacaaaaatggcgtgaataaattggcaaaccatccgacgaacttcttccacggtgagcgctttttccagaattccggtgttagctgcgtacagtgttctatatcgttccgaaacatttcgttcagttcgcctgtaatttccttgttaaagatgaaagcgttcgtctcgtagtcgtaccggaggctgcggctgttcaggtttgcggtgcctaccgtgcagaaaatatcgtcgaccatcatgattttggaatggtggaaaccgccattgtacatatagacggtggccccccttttcatcagtttgtgaagtttgtagagggcggcgtccggagtaaacgggatgtcggaggcagaagaaaccataatcgtgacatccacacctcgttcgatggtgcgttgaagcgccttgttgatggaggatgtgggcacaaaatacgggttgacgatgtgcacgtttttctgtgccgaatagatcgacatggcataagcatgactgagcatacggctgtttttcttcggtgtgcggtctacgatggcgacgactacattggtgctgtccgactgctccttgtgcttggggaagtatgcttcgccgccaatattttgtttagtctccttgttccatatggtaagaaatatttcttgcaggtcattgacggcatcgccttctattctcatgtgcatatcacgccatgtaccgattttggggagtccgttgatgtagtagtcggcgatgttcattcctcccgtataggcgacttcaccgtcgatgacggctattttgcggtgatcacggtgtgccgcatgattgatgtagggaaaggtgaacgggtcgaacttgacaatctcgattccctgctctcgtatttttttgagatgtctcttcttgagcggtttattgttcgaccagttgccgaacgcatcgaacatggctcgtacttccacgccttctttcactttttcggccagcaggtcgaacagcgcattggctatagagtcattgcggaaattgaaatattccagatggatgtggtgtttggcgtcgcggatggcgctgaataaatcaatgaatttttctcgtccgcttttcagtaatctgaccttgttattgtcggatataggaatccctgactccgataagaaacgtaatacaagggagtcacttgtcagagctatggagtctctgggatgcgtcatcaaactgtcgatgacatctgcctgagcacggaataaagacagaaacagaaataaaagaaatatacgtagtttcaaaactcttctcgctattttagtttacaaagtaacaaagatacaacatctatgtttggagctatcgggagaggagagcaaatttattatactttaacagaagaaatgaacaagaatctcttgatctgggggattatattcgttcgatacatctgaactgtctgctgtgttccctgccgttgtcacacttgtgccaacggcgtggcactgctgtgccagtgcggtgtcacaactgtgccaagtccttggcacagttgtgtgacaagcattgttatgccattgatactactttccgtccggccatgaacagcaggacgaccgttgcaatgatgattgatttcggatcgagactggttgcgccatggttgatcatgccgataagtacatctttcagcgttccccatacggcttccagtccgcccagcgtgacgaagagcgtggctcctactgtcattacgaatacagtccaaaggcgtgccaaccggttgctgcggtcgggcaagtggtgcatgacgcggcggctgaatccgttgtcggctatttcccgcttgttttctgcgaagaaatctttcagaagtttatcattatctatttccgtcataaccgtttctttttaaatacgttgctaatttttcttttccacgcgacaggtggcttttcaccgtccctgccggtattcccgttattcctgcaatcttgtcgatgcttacatcttccatgtaaaacagcgtgatgcaggttcgttccacttccttcagcgatttgagtgactgataaacatccattgtctgccctatgttcgcttgttcggtgcagttgacggcgtctacttccctggtatccaggtctgccatctccttccggctgcgaatataatcataaaaaatattataagcaatacggtatagccatgtggagaaactcgacaagttacggaaagaggccagattggtatatgccttgatgaatgtatcctgtgccaagtcgtcactcaattcgctgtcaccgcaagtcagatgcaggaagaagcgtctgacaggcgactggtatttttgtaccaactggtcgaaggccctggtgttcttgaacaccacgacctgtgcgactagcgatatatcgttgagttggctcatctattttcttcgttcttctcttcgtcgttcttctccgagatgatgatgtcgttgcttctgatggcggtttctctgttcttggtattctcgttggcgtgttgcttgtagccgatcagccattgtcccagtcccataaacatgacgagcagtccgatagcgccaattccgaattcaccggtgatggcccagaggaatatgaagagcccgatgcctgtaaaggtatttttgattccttgtgtacgttggtctgtcgatttgttctcccgtatgaattcttccggaagaggctgaccggctgcgagagcctgttcagcaagacggtagcgtgctttccggttcttgtagcggaagaagaagactacaaatatgatgaataccggcattccgaatatggcaatgatgctgatgatggctaccagaatacctcctccgactgcatctccgaaattattgaacgggaagtcatcgtcgtcagagctgatggtgaagctcgcttttccgtgagagccgcgcgaggagctactcactttgcccgtatctacacttgtcgtgtcggcgtcttcgtcatcgatgccgatcacagtgacggccgtgttgccgacattaaccttggcatccttgcctttccctttcgttacggtcacttttacgtttccggtagagtcgttcacaatagtcgtttgtttctgggcgtttgccagagagaaaatggtcatcatgaccagtaaagcaattaaaatccgtttcatatattaattcttttatttgtttctttgtctgttagacgtagttcgtatgtcagaaagttgcaaagagacgaaatatttttgatatttgcaggaattaataaatgaaaaatgaatttacccacttcttttatcgactatacccgtgccttactgggcaatgaagaatatgaaaaactggctgccgccttgcagcaggagcctcccgtcagcattcggatcaataaattgagaatgaaggaggaaggattaagttcgctgacagacagttctgctcatttttccttcaacaaagttccctgggcatccgatggctactatcttgacgagcgtctgacttttacgttcgacccgttgtttcatgccggttgctactatgttcaggaggcttcgtccatgtttgtggagcaggtgctgcggcagtatgtcgagtctccagtggtgatgctcgatctttgtgcggcgcctggaggaaaatcaacccatgcgcgtagcgtgctttcggaagggagtctgctggtggcgaatgaagtgatccggaaccgttcacaggtgctggcggagaatctgacgaagtgggggcatccggatgtggtggttaccaacaatgatccggctgatttctcggcacttccatctttcttcgatgtcattctgaccgatgtgccttgttcgggcgagggaatgtttcgtaaagaccctgtggctgtggaggaatggagcccggagaatgtagagatctgctggcagcgtcagcggcggattattgcggatatttggccctgtctgaaaccgggcggcatattaatatatagta

SEQ ID NO: 220 - DNA, 10476 bp, Bacteroides thetaiotaomicron
tctataagaaacccgagcttttgctaattagtgttataaaaacacctatttaagagaaataatttgcagatttcgcaaaagcccgtatctttgcactgtgtttttcatagtattagatttaaggttaacaaaggttggagcaaggcgttgctcctttttttatgcccataccccatcttagcatcttccaatcctacaaaaataccccttgaaatcttatcaaagggcattttttatctacactctatctataattaaagcgctttttcaatagcctgtttaatgagtgcttccatgatatcatatccttctcctgtaggatgtaccccatctttcgtatattgaggattcaaggccttattctcgcccaccaccattggctgataataattcacaaacggaattttattagctttggcgtaagcttctatgcgggcattcaatgactgaatcttttgaggagcatctttaatctcccgtctccacggaaattcagcagccggcaatactgaagtcagaatcactttgattttatttgccttcgccagttctgccatagatgcaatatttccgaatgtataatcttcattataagcacctgtattttcggctacatcatttgttcctgcattaatgacaaccaatgccggagaaagattgatcacatcttccctaaaacgaagtaaaaactgataggacgtctggccactgataccacgaccgatatatccatttgttttgaagaaatcaggatgtgtcctcacccatccttccgtaatggaattgcccataaagaccactcttttttccttctttacaggttgtgcaagtgctgcattctctgtcgcataacgcttgtaattagcgaactcatgtttctgtgcataggtctctcctactgagaaactcaaacaaacgatggccaacaacatccattgacccagtcttttctttttcatatacatatataaagattagtaattcaaattggttgcaaagataaaaaaactctttatatgaacgatcaaataccgaatatccgttaagcggaaagggaaaattcttaatctatgttatataacataagatttttcttggttaatttgcaaagttcacagaagtccgtatctttgcaatgtgtttttcatagtattagatttaaggttaacaaaggttggagcaaggcgttgctcctttttttatgcctatacgcttggtttcctaaaaaagaatggtatttttgtgaatcataataccctaaaaaaacactgtcatgaaaaagctcattacccttttctttataagcatacttagccttcaggtttattgttccgcacaagaaatattaaaagtggattatccggccatcaaagagtacgtgactaatcacaatacggaatttcaaaagctcatgcaacgttttgaagaaaatgatactttactcacccggcaagatcatgccatgctatattacgggtattcattcacaccagcttacaaaggaagtatggatgattttcaggatttccgaaagttgattaaagaagaaaagtatgaagatgcttataatatcggcaaagaactactaaaaaagaatccggtatctctccaattactatataatatgtacggaatagccggtttgctccagaaagatatccgggaaataaaacactattcaaaaagatacgcagccttgcttactatgattgcgcttacaggtgacggtacaagcgaagaaaccgcatttaaggttatctgcgtaaatgacgaataccaactgctgaacatgttattcaaaatggaaaacatgaaaggtcaatcgctagtcaataaatgtgatctgatagagtttgataaatgccagtactatgaaggaaatcaaatgtatttcgacattagccgttcccttgattatatgagtgaattattcggaaaatgaaaaaaaaactattctatatcacactgataattgccatactttgtgttatcagtatctttatctgcgactggaccatcaagaagaatgcagcctcctgcatctatactgaaatcagtgatattcctgcaaacaatgtaggtctgcttctcggcacctctcctaagctgaaaagcggaaataacaatttatattttgactatcgcattgatgcggcggttgaactgtacaaggcaggcaaaattaattatattcttatcagtggagataatcgcaaagaagattacaacgaaccggaagaaatgaagaaagcgcttatgcaaaaaggtgttcctgaaaagtctatctatttagattatgccggttttcgtacccttgactctgttgtgcgtgctaaagaagtattcggtcagacccgtctgaccatcatttctcaacgatttcacaatgagcgggctatttatcttgccgaaaagaatgggattaccgccatcggttttaatgccagggatgtagacgtctatgcaggattgagaaccaatatcagagaattatttgcaagggtcaagatgtttatcgatttagcgatagataagcaaccgcatttcctgggagaaaagtacaaactgccatccggcaaataagaaaatatcaaaaacaaaaagttattgaaaaatttatggaacaacaacctcaactcaatgatcacaacaaacaggagtatcctcctatgcatacagcagagcatttactaaatgccactatggtaaaaactttcggttgccctcgctcaagaaatgcccatatagaaaggaaaaagagtaagtgcgactatattcttcctacttgtcctacagatgcggagatacaagcgatagaagataaggtaaacgaagttatcagtcaaaatctgcccgtaactgttgaatttatgactcatgagcaagctaaaggcatcgtagatctgagcaaacttcctgctgacgccagtgagactcttcgcattatacgcataggagattatgacgcctgtgcctgtatagggttacatgtatccaatacctcagaggtaggaactttcaaaatcatcagtcatgattataatgaagaaaggcaaactttaaggttaagattcaaactcattgaaaaaaaaatagattatcaaattaatatctatattatataaaataaatatactgcggttacattttgtcacaaaacaggcaaaattggcattattaaaatgacaaatagacattttcaatctcagttttcctttggcataaggtttgcactaatagcagtgaacgacggttcaaaagcagacggcaagagtcgggatacccccctctgcggaaagcagcgaaccgaaattcaagagtgaataaaccgaatgtttaactaaaagataggagactaagattatgatgcctgttagaagaactcaaagttggttaccaagtatttttaacgatttctttgataacgattggatggtaaaagcaaatgcaactgcacctgcaatcaatgtttttgaaacagaaaaagaatacaaagttgaactggctgctccgggaatgacaaaagaggacttcaatgttcgcattgatgaagacaacaacctcgttatctctatggagaagaagactgaaaacaaagaagagaagaaagaaggtcgctatctacgtcgcgaattctcttattctaagtttcagcagacgatgattctgccggataatgtagataaagaaaaaatttctgccgcagtagaaaacggagttttgagcgtccaacttcctaagatttctgaagaagaagtgaagaaggccgaaaagcaaatcgaagtaaaataatacagtaaccacgattcatcccaaggggtgaaaacaataataaaaacagctcttttccaaccaataaggataagagctgttttttatataatcaaattctcaattattgatttttccgataactgatcaccgcccaggtattgaaacccagtgcaaaaagaagcaggactcctatttcaggcagcagttccaacaagctgcttcctttgaggtataccatacgcattccttccataaagtacttcaaaggattgaaataagtaatcacctgtgcccattcaggcatactgctcaccggagtgaataatccgctcatcaacatcagaatcagcataaaaaagaacattacaaacatagactgctgcatagttgccgaataattggatataacgagcccgaaaccggacataacgaatacaaacaaaatcgccaaaaaataaatcacgatgaaatgccctacaggagttattccataaagcagccaggctaacaaaaagcacaaagtcaatacgataaagcctgtgatccagtaaggtaaaagtttagccagaataaaagtaaatttcggtacgggagtcacattaatctgttcgatcgttcctacctccttctcactaaccacattcagggcaggcaaaaatccgcatatcaaagtcaacaacattcccatcaaagcaggaatcatataaagtttataattcagattcgggttaaataatccctgcgtatcgatacgaatggaaggggcactgcccgacgcagatatggcatcaggatattctgcacgtaactcggctgcatagttcttgataatagtgcccagataagaactgcctagccctcctttcgttccatttaccgaattggctgcaatcagtatatgggcttctcctttgttcacccagtcccgctccaggtgcctggggatctccattataatatccgctgttccctgttcaatattccgtaatccatcctcataagatgccggcacttccgtcagacggaaataggtagaagccgcaatcttattcaccagccgctgagaaatcaccgaatgatcgttgtctacaatattcagctggatattctttatttccagattcacagcccatggcatcagcaacatgatcatgcagggaaagataagaatcaatctcggcaggaacgaattgcgaagcaactgtttaaactctttttctatcagaaattttatcataataaattcctttattccaatcgatatttaaatttcctgatactgatggtaataagcactactgccatcagcaacaaaataccaatctctttaagtaccagcacaaccggcactccttcaatcatcagtttgcgcacagcctgaatataccagcgggcgggaataatatccgatatggcccggagaatcaccggcatactttctaccggaaaaatcattccggacaaaaccatggtgggcatcatcaatatcattccggatgccagcatggccgccacctgtgtacttgtcacagaggaaatcagcaaacccaaagccagcgacacgaaaataaagagcaaagacaccatcaccaaccagaacaaactccccactaccggcacatccagtacaaagactgaaagcagcaaaatggttgtcagattgacaaaagataaaacaaagtaaggtaccgccttggccagcacgataaacaatggtcttaccggagataccagcaatacttccatcgtgcccgtctccttttcacgaacaatggaaatagaggtcatcatcgcacaaatcagcattaaaatcagccccatgactccgggcacaaagttgtaggcactcttcatctgcggattatacagcaatttgacatctggagtcaaacgcgaaacgaacacattgggaggcaacatctcctgtcctgccgaagaaacaatgctggctgcataattactctgcgaggtagacatattgggatcggttgcatcgactatcagctgcacacgggcatcccccgtataaagtccgtcggcaaaacgctctccaaatacaattgccatatctatcttatttttccggaaggcagtttccatctcctgtggagaatgaaaacgggtggtaaccgtgaaatattcactcgcatccaaccggtctataattttccttgttaccacatcattcgaaggatcaagaactgccagccggacattcttcacttccgtactgatagcaaacccaaacagaataatctgcacgaccggcattcccaacaggatcagcatagtacgccggtcacggaaaatatgataaaattctttctttacgaaagcaataaattgtttcataatcaatccgctttacgcaccgcatggcgggcaagttgttgaaacacatcatccattgtctccacaccaaactgttctttcagccgggccggcgtatccagtgccttgatctggccgtccaccataatcgatatccggttgcaatattccgcttcatccatatagtgtgtggtaacaaatacagtgattccacgatcggcagcctgataaatcagctcccagaactgcctgcgagtagcaggatcaactcctccggtcggttcatcaaggaagactattttcggctcatggaagatagagacagaaaaggccagtttctgtttccaacccaaaggaaggtttttcaccaacgtatcccgttcgtctgcaaatcccaggcgttctaacaattcatctgtcttttcttcaatctccatctccttcatcccataaattccggcaaagagacggatattctcccagactttaagatcctcatacaaagagaatttctgactcatatatccgatatgccttttgacttgttcggcttcccgaaagatgtcatagcctgccacctttcctactcccgaagtcggacggctcaatccgcaaagcatacgcatcgcagtcgtcttacctgctccattggctccaagaaaaccgaaaatttctccccgctgcacttgaaaagagatatgatcgactgccgtaaaatgtccgaaggatttggtcagctgctccacctcgataacaggagctgccatctgttgcgcctcctcccgttccaagggtggcggacaaagaatggaagcaaacttctgaagaatccgttcgggcgtatcgattccgtgcacctgcccgtgattaataaaagcaatccggtcgcattgacgagcctcatccataataggagtggaaacaatgatcgtaatcccctgttttctcaaattacggagcatctgccaaaattctttccgagacacaggatctacacccgtagtcggttcatccagaaataaaatatcaggtttatgaatcagggaacagctcaatgccagcttctgcttcatacctcccgacaaagcgcctgcccttctttttttaaaaggctcgatctgctgataaatatctttaatcaaatcatagttttcctgtatcaacgtatgaaataccgtagcaaaaaattccagattctcttctacggaaaggtcctgataaagcgagaaccgtccgggcatatatcctactttcgtacgaatctgtttgtaatccgtcaccacatccagtccgttgacagttgccgtacctttatcagccaacagtaaagtggtcaggatgcggaataaggtactcttccccgccccgtcaggaccgatcagcccgaaaacttctccctgctctaccgcaaaagaaacctctttcagtgcctctactttcccgtagctcttgctgatttcctttacaacgactatgggttctcctttttccataccacacctccatacataccaatcttcaacgaaccgtcatttttcacggcaatcttcactgcgtataccagattggcacgttcatttttagtcagaatcgttttgggggtaaactccgaacggtccgaaatccaagtgaccacaccgggataggctttctgttccgaatttccataatcggaatacaccgtcactttatcccccaatttcacttgggacaattgctctgaagtaacataagcccgcaaatacatccggtctacctcacccactttaaacaacggtttgccaacggatgccagttctcccccttccgcatattttgccagtaccgtaccttcaataggcgactgaatatggcacttgttcaactggtcttctacctgtgccacttgtatactgaccgaattcccctgttccgtcagactgttcgtactcttcatcaatgaggattcctgagcaatcaactgctgctgaagcaaggttacctgtgcatcccagtcatccagttgtttctgattggcagctccggcagcaagcaggttctctacccgcttcttttccctttgcgctgtagtaatttgctgtttggtagcggctatctgtttggccagatcgggacgctggctttccaccgatttcatgcttgcttccagttgcaactttttcagatatagctggacagtatctaccagccctacttcttcgccggctttcaatcttgttccttcttccacttccagttgcagcagttttcccgctgcttcggcggaaacgatcacttccgtagcttcaaaggttcctgttgcatcataatcgggcgttccgtttccacaggcagaaagcatccatactgccatcccgtatattcctatttttgtcattcgtttcatatctgacagatttttattaatgattagtagtatatttcaattgatagatacccatcaaccgttgaatctcatgcattgccttcgcctgacgggcaagactctcattcgtgagttctctgagcatttctgttactgtcaacgtaccattcgcaactttggcttccgcagcccgacgaatattcgtacgcaaccggataatttcatcatcatcctgcatctgcttctccaacgaacggacagactgatcctgctgcgtcatttccagtctcgtattaaaaagaaacacatcccgattgctgtccagttgctgccgtttgttttcaatcacccgacggtcattcttcaacgtatacagacttccgaaattccatgaaagccggacacctgcaatataataaggagaaaattcattcttcagcatatttaatcccggattaccgtaagctccctgcacaaacaatccgaaatgaggaagatggcgcacattcaaggctttctcttgtacctgcaaaccggctccctgtgcgtcaaaccacgacagttccggtcggcgaatctcactgacagccgacaattcgttttgaggaacaggcttctccaatactgtctccggcgaaagcacctctcccatcaataacgaaagcatcttcaaataggccatacgggaagaagtcagttccacccttttctgacgggtattcaactgctccactttcacagcatccagatcggcctgattggctattccattttccacataagctgtaatctgacggaagttccgtcccagttcatcttgcagcaaggcattctgagccaactgctcatccaacatcaggattccaaaatacagatcattcacacggccattcaacgcatacatatcgacgttcaacttttccctgtcaatctccgcttccgccgtagcctttttcttctgcatccggattcctccgccatcccatatctgttgctgtaactccagcatcacctgatactggtctttggccatccctttgatatccacaccgggaatggcaatgggtaactccgtcacatcactttgataagacgcctttgccgaaagagcaaactgaggcaagtatcccctcgccgcattttccagattatattctttcgtcttctccactaaatcatattgacgcaccaacggatagttatcctgcgttttttgctgacattcttctaatgttatatgcccggtctgcccatacattccgggcatgaacagtaaaagcgaaagactaaaaataattcttttcatacgcattttttctatgaattcttcaaaagacaaagatagacctttaagtaatagtttcacattctgatagttggaaaatatgtcccaatagttcgattcatcctaaaaaaagagaagattcaagggctatttcttatctttgccggaaaagaactgagaaaatggaacagaagaaaccgatggaattaggcctccaactgttgaaggatataaatatagtacgtcacaacgaatttcgcttcatcaatgccgaattcggatttgtgacaagtttctctaaaatggaaacgactatcttcagtgtcggacaaccgtaccggctacaggaaggccgtattgctattgtcactaatggctcggcacgtgttttaatcaatctgatcgaatatattttcctgcccgaccatatatccctgatagctcccaactctatcatacaaatcatagaagtatctcacgattttgatgctcacatgatggcagtagacctgaactttctgccgatatccggaaaggaagaattcttcacccatttcctccaacaaaagaaaaatctcctgtttccactgtctaccgaagaacaaatacagatagagaattttgtgacggtcatgtggagtgtattgcaagaacctgtattcagaaaagaggtcattcagcatttactggtaggattactatataatatagagtatatagc

SEQ ID NO: 221 - DNA, 10355 bp, Bacteroides thetaiotaomicron
tcataatgtattcttgtattttctatataattcttcttgcgaacggaaaacgacagtggctgtctctgcttcggcaagggcaggagtgaagtctttgcagagtgtggaaggtcggttttcccaaggtcggttttctccggtcccgtctacgatacgtcctttggccgtatcccgatatccgtagcagacaattcgttttaagtctgcctgtatttctttgtcgtacaccggagccagtacttcgatccggttatcaaggttgcggggcatccagtcggcagaaccgatataatatttttcttctccgccattggcaaagataaagatacgggagtgttcaagatatcggtcgataataccgttgatatggatattttcactgatacctgcgatgcctgtcaccagcgaacagttgccgcgtactaccagttccacttgaactccggccgtcgaggcttcgtagagtttttctataagcgcacggtcggtaatatggtttacttttgccagaatataggcttctttcccttgttccttgttctttatttccttgctgatgagagcaatcagacgtttgcgcatatcgttgggtgaaaccagtaattctttgaaattgacgggagtgtatggtttctcaataaagtcgaaaacggcattcacttctcgtaccagcggacgatgggcggtcatgatggtataatcggtatacatacgtgcgtttccttcatgaaagtttcctgtgctgatgcaggcaatgtctccgtgacgggtaccgatatgtaccagtttggaatgaatcttcagtccctccactccgaagataacgtggatgcctgcgtcctgcattcttttgctccagttgatgttggatgcttcgtcgaaacgtgccagtagttcgatgaccaccgttactttcttcccgtttttggctgcgcagatcagtgctttgatcacttttgattctttagcgagccggtaaagtgtcatcttgatactttttacttctttgctgatggctgcttcacgaagtacgcggatgaaagtatcgaagctatggaatggataatgcagggagcggtccttctgacgaatcaatgtgagcaggctttctttgccgtttagttcgggcttgaaaaccggttcccagacgggatactttaagtcgtagcgaccgcacaccggaaatttcatcaagtctttgaagttatgatagcgtcctcctgccacacgggtgtcgtttttatccacattcagccggtcaactaatcttttcagtaaatctttgggaatctgttcgtcataaacgaatcgaatcggttctcctctcttccggcttttcactccttttgaaatcttctgaagtacgcctgtccgcaggtcgctgtctatctccatttccgcgtctttggtgaatttaaaggtatatgcctcgtaatccgtatatttcatgccgacaaaaatcaacggcagacaatagcggatcacatcatcgagaaacatcagatatgttttcccctccgagtccggcaattggataaaacgaccgtattcttcggtgggcaattcgatcactgcataatctttctcttttatttttcctgtttcgtctttacgaagcaggcggatggcgagataaatatcttcgtcagtctggtcgtccagcggtcgggctccgttgaggaaaagaggggtggtggagccattcagtttattgcgatagaaggaggtgataaatgtcttttggtcatccgtcatttcggtgtctttgatgacgcagatgttttccttcttcagttcttccatgatggaagcgaaagtttcttcaaattgttcgtagaagcggttgtgtagtttgcttatctgcttcagtgtgcgtgtagccgtttcttgttctttctgtatgtttttatctgcatattcgatgatccggttcagcgtagctacgcggacgcggaaaaactcatccagattattggaatagatgccaagaaaagtcaggcgttccagaagaggtacttccggacgggcagcttcgagcaggatacgctgattgaagtacatccagctgatgtcacgttctacataagggcacttcttttttgtttcgcttgatttcatgatgaaaaacctgtttattaattttctgcaaaattatctaagtgaggtgtaatggctataacgattttgttacgaacttattacaatctacgtttgttatttttatatgtgaatagaaacacttatattcgcaaaagtattgaaatggacttcgttaaaaaatatagaatatatgaaaacaatgaattactctctgattcgcattttgtttgcgcttgtcataggtctggtgttggtactttggccgaatacagcagctagttatattgtcattacgataggagtggcttttttgattcccggtgtcatcagtctttttagctttttcggacggaaaagatcggaacatgaaccggctccccgttttcctattgagggaatcggcagtttgttattcggactttggctgattgtgatgcctgagttttttgcagacgtcctgatgttccttttgggctttatcctgatcatgggaggtgtgcagcagattgcctctttgtcgatggcccgtcgttggacacctgttccggggattttctatctggtgccttcattgattcttatcgcaggtgttattgcgctgttcaatccgacgggagtacgtaatactgctttcattattatcggtatcagtagcttggtttattctctgtccgaactgatcaactggtttaagtttgcgcgccgtcgtcctaagactccggttacgcctcacgatgaggatattgaggatgctaagattatagaataaaaaaagaagaggactaccgtcacggtacccctcccctgcaaacttaaaacaaccaacaaaagaaatagataatttctatcttaatgctgaatgaagatattctccattcagcatttcttttttatcttacaaacaacagttctctgtatttcggcagtgtccacatctggttgtctacgatcagttccagcttgtcaatgtggtaacgaatctcttccagtgccggaacgattgtatcgtggtaagcgatcgctttttcgcgttcgctttcgatcttgttcgccacttttcgtgcttcaatcattgcatctacgtgttctttgatgaaggcggtgcggtcggcgatttcttcgatcagttccagattcttggcagatagtctggctgctttatctgccggaaataaggactgcattttatagacattattaatcagatccgtctgatattgagtagcgaccggaataatgtggttcattgccaggtcgcctaatacgcgggcttcaatctgaatctttttcgtgtaagtttcccattttacttcgttgcgggcttccagttcctttttcgtcatcacaccgattgcttcgaacatagcaattgtctccggtttcagatagttgtcgaagataacgggaacacttgtttcacagtccagacctcgacgggcggcttctactttccattcgtcgctgtaaccgttgccatcgaagtggatagccttacattctttgatatatccgcgaattacttcaaggatagcggaaactttcggttctcccttttcgatcagagcgtctacatcctttttgaatttcatcagctgttctgctacggcagcgtttaatgcaatcatggcacttgcacagttggcctcagagcctacggcacggaactcaaaccggtttccggtgaaagcgaaaggagaggtgcggttgcggtctgtattatcaatcagcaattcggggatttggggaatatccagcttcattccctgttttccgctaaggttgatcagatcgtctttggtactgttctcaatatgatccaatacctgtgacaactgtttgccgaggaaagaagaaatgatagcgggaggtgcttcattggctcccaggcgatgagcgttggtagcgctggaaatagaagctttcagtaatccgttgtgacggtaaactgccatcagcgtattcactacaaatgtgacaaagcgcaggttatcttccggcgtcttgcccggtcccatcaacaggatacctgtatccgttcccagtgaccagttattgtgcttgccggaaccgttgacacccttgaacggcttttcatgaagcaatacacggaaaccgtgacggcggctgactttacgcatcaacgacatgatcagtaggttatggtcatttgccaggttacattcttcgaagataggagctaattcgaattgattcggagctacctcgttatgacgggtctttacaggaatacccagtttcaacgcttcaatttcaaggtctttcataaatgcggccacacgggtagggatggcaccgaaatagtggtcttccaactgctggttcttggcactgtcatgtcccatcaatgtgcgtcctgtcataagtaagtccggacgtgcggcatacaaaccttcatctaccagaaagtattcctgttcccatcccagataggcaacgaccttctttacctcaggattgaaatagtggcagacggcggttgcggctttatctacggcacgcagagctttcagtaacggtgctttataatcaagggcttcacctgtatatgcgataaatacagtcgggatgcaaagcgtatcatctacgataaatgcgggtgatgatgggtcccatgcgctatatccgcgtgcttcgaaagtattacggataccgccgttcgggaaagaagaagcatccggctcctgctgtaccagcagtttgcctgtgaactcttccatcatgcctcccttgccgtcatgttcgacgaaagcgtcatgcttttctgccgtaccttcggtgagcggtgcaaaccagtgagtataatgagtgacacccatttcgacagcccattttttcattccggcagctacttcatcagcgatgctgcggtctagcggggcaccattgtcaatagcgtcaatcagtgcgttgtataccttgcttggaaggtacttgaacattttttccttgttgaacacatacttaccgaagtattccgaagggcgttcggcaggtgttgctacttcaaccgctttcttcttgaaagctgtctctacgactctgaatcttagttttgacataatacctaatttgatttgttgttaaatatgttagagtaaaaattccttttttagcttagttataagcagattctccgtgttcgtagatgtcgagaccttcttcttcgacacgtgccggaacgcgaagtccgtgaatcttgtcgagtactttgaagataatgaatcccatacctgccgcccagactccgacaacaaccgcaccgaaaagctgggcacccaaaaagccggctccatgtccgtagaacaacccttcactggtagaaaacaatcctgtgagcactgttcccaagaaaccacaaaccccgtgtacggaagaagcaccgacaggatcgtcaatcttcaataccttgtcaataaagtcgactgcaaatatcatgactacaccacaaatggcaccgattaataccgctcctgagggagctacagcgtcacatccggctgtgatacctaccaaacctgccaaaacaccattcagtgtcagtgataaagacggtttgccatatttcatccagctcatcgccagtgcaaagaagccaccggcacaagccgccagatttgttgtcagaaatacatgtgagatggccattgcatccgcttcggtacttgctgccaactgtgatccggggttgaatccgaaccatccgaaccaaaggataaatacacccagtgcggcaactgtcaggttgtgtcccggaatagctcttgacttaccgtctttgccatatttaccgatacggggaccaagaatagcagcgcctaccaaagcaatccaaccaccaacggagtggacaatcgttgaacctgcaaagtcatggaatgtcgttccgaaaagattcatcatgaacgaaccttcttctccgttcatcagccagccgccaccccatgtccagtgaccggaaattgggtaaattagtacactgataaagatagtatagaccagatacatggagaacttggtgcgttccgccatcgctcccgatacaatcgtggctgccgttgcgcagaatactgtctgaaaaaccagaaatccttctctgggtaaatcactgtcgaggaatgacagatcaaagaagtgtggcattccgatgagacctcccgcaccaaacatcagaccgaaaccgatgaaccagtagagcaaggaaccaaacatgaaatccacaaagttcttcatcaaaatgttggcggtattcttgactctggtaaaacccgcctcaaccaatgcaaaccccggctgcataaaaaatacgagcattgccgcaagcagcatccagactgtattcaatcctaatgccagttccccgattgtatcgggagttgtttcggcagaagcagtggcggtttcagcaatttcaggtgtagttttgacttcagtaattgtctccgtagttgtcataaaagtatctgcatcaactgcttcctgtgcaaaagcactggttgcgaaacagcagaaaatgaacatagcagtggctatccacagctttgtgaagctgtgtctcttatatgttttatccataatgattatcttatttaatacctgtttttataatattatcatccgaaaggaaatctggccccggcaccttgccggttgccggttatcgttcctgttcggcgttatagagagcgatgtcgccacgttcggcggtgcggatgcggatggcgtcctcgataggaatgacgaaaatgcgtccgtcaccgatctctccggtttgtgcggctttgatgatagcctgtacggtcttttctgcatttttgtcgcgtactacaatagaaaccagaatacgttcgatggtgctggtatcatataccactccacgatagatacgtccttgccgtgctttaccgatccctcttacatcgtagtaagagaaccattcaatgtccgcttcgagcagagcgtctttcacgtcctcgaatttggttttacggatgatagcttcaatctttttcatataccttaaatattagtgttgacctgtaaaaagaagaggtatagggaggtggcagccatcgcaggttaccatacaacaaaccgataaaatctaaactctaactaccttcctgttccctatacgctctttgactatataaactctctctctcttaaaaacttaatccgaatgtgaagtaagcgccttccgtacgtggatttactgatactttggcaaatgccggaaccgagaatgaatcagtaaccctgatctccttgacagctccgagactgatgtcggaaacgcagaacccacttgtgtatccattataaaaagtcgtctcccaaggtaccattcctacatctactgtccagtcaagtcctccaaggctgaacggtgcactaagtgcgaggtaggaagaataagcccttttcccgttttctttaactccgtcggcacctgcaaagttcgtgtaccagttgattgccagcggaccaaaatcatatcctacctgtgcctcaaatacatgagcggttgaatgagcgccatatttgaaatacttgttggtaggtacctgagtgttgaaccagtaatccgttaccgagatgctgaaaccaccggttgaataaccgagagtcaaatcgaactctttagtatccgatgactcaaaccctaccgatccccatgctccgagtgaaagtcctttgtaagagattcctaatgaaggctgaatgctgactccgcctaaatcctgaccacgccagatataaccacttaccaagtctgctcctacggaggcttctactttatcctgcgccatcatattggatggcacaaggccgatcagtaataacgctgctgctatgcccctcaattttttgttaatcgtcgttttcatcgtctttttacctttaatagttagaaaaatgtggatgtacggtccagtgttatatagtagcgcgcaaaatactatcaaagccagttctttattcttctcattgcttccatacaatcattgtgatcgccgaatgctgtcagtcggatatatccctcaccgctggggccgaaacctacaccgggggttcctactacattggcttcatacaacatctgttcgaagaatcgccaggaagagagcccgttcggggttttcacccataagtatggagcattgacgcctccgtatactttcaatccggtagcttccagtccttccttcatgatcttcgcattgctcatataatagttaatcgtttctttaatctgtgctttgccttctgtactgtagacggcttccgctgcacgttgtgtgatgtacgaagtgccgttgaatttagtgcactggcggcggttccataatttgttgagtggaatccggtcgccttccagtgtggcagctgtcagttctttcgggactacggtatatccgcaacgtactccggtgaaaccggctgtctttgagaaactgcggaactcaatagcacatttcttggctcctttgatttcgtatatggagtgggggacatccgcatcctgaatataggcttcgtatgcggcatcgaacaaaatcagtgtatcatttgccaatgcatagtctacccacttttttagttccggtttggtcagtgtcgtccctgtcggattgttcgggtagcagaggtaaacaatgtctatccgtttgtcgggaatctccggaatgaagtcattctcacttgtacaaggcatataagtcacattgctccatttgcctgttccttcttccagcactccggcacgtccgcacatgacgttactgtcaatatataccgggtaaatagggtctgttacaccgacactattgtcgtggcgaaggatatcgccgatatttccggtatcacttttggctccgtcgttgacgaatatttctgatggtgagaaatgaatgccacgtggagcgaaatcattctttataatagcttcaatcagaaaatcgtacccctgctcaggaccatatccgcgaaatgtatctttacttgccagctcttccactgctttgtgcatagcctcgatacatgctttgggaagcggctgagtgacatctccgatacctaaccgaataatatcctgcttcggatgcgttattttgaatgtatttaccttcttcgctatatccgagaacaaatagctccccggtaatttcaaaaaatgttcgtttactaatgccatattgttattgttttaagtttctgcaaaacctgttacctattacctaatacttattacctatccctccatctccccatcaaaaactttagttgccggtcctgtcattaatatgtgtcccgttgcttcttcccactcgatggtgacggttcccccatccattattatatcacattttcttcctgccaatccatggagaacagcggctacagccgtggcacaagcgcctgttccacaggcctgggtgattcctgaacctctttcccaaactctcatccgaatggtgtctttacctacgatctgagcaaactctacatttgtcctgtccggaaagagatgataattttctaactgcggaccaatttccggcagattgatttgggtaatatcttctacaaaagttaccagatgcgggtttcccattgatacccgggtagactgaaaaggaaattgatcgccgaaatctaccgcttccgtttccagaggactacccatatctacagtgactgccgtcacctttcctccttctacatgtaatttcagaaccttaatgcccgaacgggtgtcaagcgtgatttcctttttggcagttaatccgtattcgtatacatacttgcctacacaacggcttccattgccacacatcattgcttccgaaccatctgcattaaatatacgcatactgaaatctgctttgtcagaactgccaatcaatataagtccgtcacttccaattcccgtatgaaacttgctccattcgattgctttcttttcaggggctgctatcggatatcgggtagtatctacatatatgtagtcattacctgctccatgcatttttgtgaacttaatcttggttgtcattttgttctttattaattggttgttgtatccttttgttttattacaatgcaaagatatgactttttgatttaacttttgatgaaaagatgtctaatctctatttattttatacgatcttacaatcgcgggaaataaagccatgttttgttataaattgaaattatgcatacctttatat

SEQ ID NO: 222 - DNA, 10339 bp, Bacteroides thetaiotaomicron
gtattaggactccttttaatcttttgtttatatattaattaacatacgtcacatgttaaccgcatctggaagcaccgcaagtggtacagatcagacagccttcctggtagaccaaagtttcattaccgcaattcgggcatttctttcctttggcttccgttccgtcctgaatatatttcttcaatgcacgttctacaccgttcttccaagtgttgatgctctcgctgttcagttgcagagaacctaccagcttgataacctgctcgatcggcatccggtaacggagtacgccggaaatcagttttgcatagttccagtattccttgttgaacttctctgacaatccttcgatagtcgtcttgtatccacgtttattttcgaactggaagtcgtaacgcttggttccatcctcgtctatattcttgataatacgtccgctggttacgcttttcggcaacaggataccttcgtcgtcatcttgcaaaccggtgaatatctcgtaaggatgtccatccagcagtcctacgaaagccacccatttttctttgttattctggaaacgaaccacgtcggcttccagtactcttgggcgtgtttctactaccgtaggcggtttgcaaggaggaagagtttctttcttatccgatttggttgaaatcaatactccggaacgtgagccgtcgcggtataccgtacatcctttgcaaccggatttccatgcttctacatacaggcggttgacaagatcctcgtctacatcgttcggcaggttgatggttacgctgatagagtggtctacccatttttggattcttccctgcatctttactttcatcaaccagtctacgtcattggaagtcgctttataataaggtgacttagccaccagctcgtcaatctcttcctgcgaataacgcttggcgggatcgtatccgttagcttccatccatgtcacgaatttatgatggaatacgatatattcttcgaatgcgtcgcctgtctcgtcaacaaagtcaacgtgtacattcgtatcgttcgggtttacttttcttctgcgcttgtaaacgggcaggaagaccggttcgataccggaagtcgtctgtgtcatcagactggttgttcctgtaggagcaatcgtcagacatgcaatattacgacggccatatttcttcatttctgcgtacagttccggatcagcctcggcaagacgctgaatgaacggattgttctgttcacgctcattgctgtatatttcgaaagcaccgcgttcttttgccatttcaaccgaagaacgataggcaccgagggccactgtcttatgtactttttcagagaattcggttgcttcttcggttccgtagcgcagacctaaagcagcaagcatatcgccttccgcagtgattcccacacctgtacggcgaccttgaccgctcttcttatatatcttgttccacaagttgcgttcggcatgttttacctcttcgccttccgggtcttgatcgatcttttccatgatacgttcgatcttctccagttcgaggtcgatgatgtcgtccatgatgcgttgagccagcgcaacgtgttttttgaacaattcgaaatcaaaataggcatccggtttaaacggatttactacataagaatatagattgatagccagcagacgacaagagtcataaggacacaatggaatttcaccgcatggattggtagatacagtcttataacctaaatctgcgtagcaatcgggcacagattcacggataatcgtatcccaaaataaaacaccgggttctgccgatttccatgcattgtgcacaatcttcttccataatgtggaagcatctatttctttagtggtagtcggatttgccgattcaatcggatattgttgtatataaggtttctcgtcaactgccgcctgcatgaaagcgtcgtccagctttacggaaacattggctccggtaacttttccttccgtcattttagcgtcgatgaaggcttccgaatccggatgcttgatagacacactcagcatcagtgcaccacgacgaccgtcctgagctacttcgcgggtagagttggaataacgttccatgaacggaacgagaccagtggaagtcaatgccgaatttttaacgggagaacctttcgggcggatgtgagacaagtcatgacctactcctccacgccttttcatgagctgtacttgttcctcgtcgattttgatgatagcgccataagagtctgctgcgccgtctaccccgattacgaagcagttggatagtgaagcgacctgatagtcattaccgatacccgtcatcgggcttccttgcggaacgatgtacttaaaatgatccagcagatcatacagttcctttgctgtcagtgcattcggatactttgcctcgatacgtgctacttcattggcaattctccaatgcatatcttccggagatttttcatagatgtttccgaaagaatcctttactgcgtacttgtttacccaaacccttgcagcaagctcgtcgccttgaaaatatcgtaaagattcttcgtaggcttcgtcataagaataaatttgtttttccacgatccaatgtgtcttagattttattatttaataagtaatgtgtagaagtttacttatcagtaacaaatgtggctgcaaagctaagaatgtttttttatctatcaaaataaaaatgcaacattttatcaacaggctttaagttttccgtttgttattgttaagtctttgattaacagataactttgctttttgttcatggctttaagttttccaaaaagaaaattagattatttcattgatatggcaaaataatatttctttttgtatctttgcaaaaaaaagatatgtttgaaaccgtaaagaacagaagaacaatccggaaataccagcaaaaagatattgctcctgatttgttaaatgatttgctcgaaacctctttccgcgcttctacgatgggagggatgcaactttatagtgttatagtgactcgcgatgcagaaatgaaagagaaactttctcctgctcatttcaatcagccgatggtaaaaggggcacctgtcgtgcttactttttgtgccgatttccgccgtttcagcaagtggtgtgaacagagaaacgctgttcccggctacgataatttaatgtcttttatgaatgcgtctatggataccttgttggttgcgcaaaccttctgcacgttagctgaagaggcaggcttgggtatctgttatctgggaacgactacttataatccgcaaatgatcatcgatacacttcaactgccgaaactggtattccctattacgacgatcacagtcggctatccggacggtactccggcccaggtggaccgcttgcctctcgaagctgccgtgcatcaggaagtttaccatgattatactccggaagacatcgatcgcttgtacgagtataaagaatcactgccggaaaataaacagtttatagaagaaaataagaaagaaactctggcacaagtatttacggatgtacgttatacaaagaaagacaatgaatttatgtctgagaacttgttgaaagtgcttcgtcaacaaggattctaatgataagtaataggtaatagctatgcggactgcacttgtttatgcagcttcgatattacctattacttaatacctattacttgaattatgctttcttcttcagcaacgactcaatctcctgtacctcagcctgaaagcttttatctacttccagttgaccttttacagtcttgcaagcatgcagcactgtcgcatgatccttattgccgatgaacttaccgatttttgaagttgagaaatccgtataattcttagccaggtacattgcaatctgacgtgcctgaaccacttctctttttctggatttggtgtgaatagccgatgcttccagatcaaagtgcttgcatactactttcagtatatcgtcaatggtaactgcttttgtttcgttgtgaactacgccgtgtacaatatgttgggctaaatccaagtctatttctttgttgaaaatagtagagcgtgccataatggcgatgacgataccttccaggtctcgtacactctcatttacattttcagcgatatagtcgatcacttccggtgggaattgcagaccgtcgcggtgtatcttgttccgcaggatgtttttgcggagttcgacagtcggtttttccagttctgccaccattccccatttgaaacgggtcaacagacgttcttccataccctgcaataataccggggcacggtcggaagtcagtataagctgctttccgttttgatgtaaatgattgaagatatggaagaaagtattttgagttttcgttactccggcaaattcctgaatatcatcaatgattaatacatcaattgtctggtagaagttgataaagtcgttggtcgtgttattacgtacggagtctgtatattgcacttgaaacagatgtgccgaaacatacaatactcttttatcggcatataattctttgattttagtaccgattgcgtttgccaggtgtgttttccccactccggacgctccgtaaaggaacaatggattgaaggcagtacctgctggattttgcgcaaccgcttctgctacgcttcttgaaagtttgttgctgtatccttctataaagttctcgaagttatagttcgggttcaagtgcgggtctaagtcctgtacggcaggagctttcaggaaactgggcgccttgttgccaccgacgatgcttttaggagtaacagctgtagaacgattgcttgcttcgagattcacggtttgattcggaatcgaagtcttgtcgaccatgacgttatacattaacttggtgccttcgccaatagctttgtacaatgtctttcgcagcaaatccacgaatttctcttccagtatttcatagaaaaactggctcgggatctgtacgatcaatgttttgtcctcatattttaatggaacaatcggggcaaaccaagtattatatgtcgtctctggaacattgtctttaattacttcgagacagcggttccaaagtacaacatgatttgattcaatcatagtgactttaatacatttattaaattaagcgaaacttctacgtttgcaaaattgggaatcttatttggaaaaaacaaattagctttttcttgtttttctcgggcaaacaataatgtgtttactttcaatgacttatagaattgtgttggaacactgtctgtttcccctctcttgcaaaattataagtatctgtattttagttgtttatcgttttattcttgctcttttatacttcccgcacttgtttgtacgggaatattatttcggtctgtagatagacttttgcagaggttatactcccttttatataccgcctgcttatttagataaaatctatataagaaagatttgctacttgtctttcttcccgaataaagagaaatgaacgtaccgtttggggtgtgctttcaggtcttccagtaagctcgccgcattctctgtggtagcgttcagattgttatataaagcagggtcgttgaagagcagtccgatagtgttatctttgctgttcaacttctctgtaatcatttttacgttagcgagtgttgcgtcaactttttggaaaatggcgctgtagtccacttccttcaagttaccgctgatagctacaaaattatctccgatggtattgagcttgccggtcagctgggggatgtccttgctcatgagtcctttcatctgagagctgactacagcaagattggcggtagtcgtttcgatagagtgcagcgtagaagggatgctcttgtcacctacgatgttgttcagtgaggtgaggatggaatccagtttcggtaacatactctcaatttggggcatgagtttcgctacgctttccatcattccgttgttcaatgtgccggggatggtgtcgcctatggcatatttctcacgcgggttgttggcgagaagaatattcatgcgtacgcctcccatcagttcggatacaagttctgcgctacttcctttcgggatgcggagttcggtgtccagttcgacttcaacgatcacatttccgggatttacatagtcatattcgatgtcgcgtacaatacctacacgaacgccatcagcaaaaacagggctcgacttggtcagtccgtttacattctgaaacttggcatagaaatagcttgaaggctgaaacatatgtatgcctttcagccaattaattccatagacaagcacgcataatgctacgatacctgcaattcctattcgaacttcttttgtaatgtacttcattttattttctatttatttcttctttttttaaattcggctatcgcttcgttgacattcatcttttcgccgtttcggaaggcgatgatgaatgcgtctttgaactgtgccgagatagtacgcttggtgcgtaatactttattgtaatcactggaagcgccatacgtatatttgtacagtcctttttctttgtaataatccacatccttcagtcctttcagtcgtttgtcattcttagtaagaggctttgaggaggtgagtatctgtatcttaaacgttatttcgctgtcattggttgcgctttctgagacaataggccgtttgggagctgtttttgtggcggtggcgggtgttgtacttgcttcggccatcagttccctttgttccggagcgcttgttgccggttcttcggttgggataattgttttgctggctccggtcaggcgtatctcctgttctcttttgtagtttaagaatgcgtggtagatgcctttggccattgtgttggctccggcttccgagttgagatagcgttcttcttccggagttgagatgaagcccaattctaccaggatacttggcatggcgcttgctttcagcaccaggaatccggcttgatgcactccgcggtctacccgtttgcaggtatggcggaattgcttctgtacaagtgatgccagatgtacgctttgttccatgtatttatcctgcataaattcgaagataatgtaggattccgccgagttcgggttgaagccggcatatctggtctggtaatcgctttcgtataggattaccgagttctctcgtttggctacttccagattggcatcggatttggccagacccagtgtccatgtagaagctcctttggcggtgcggttttttgccagagcgttggtgtggacagagataaagagatcggcttttgcgttattggctatttctgcccgtcggtccagggggataaagacatccctgctgcgggtatagatcactttgacgtcatcgcagttttttttgatcaggtttcccagtttcagtgcgacgttcagattgatgtttttctctttggatattttcccgatggcaccggggtcgtgaccgccatgtccggcatcaatgactactacgaaatctttcccccataaattgccgatacataggggagaagcaagtagccagaggcagattgatatatataatatgtaggttctatgcggtttcatatttaaatacggtgcaaatgtagtagaattttgcagaaaactcatgatttacacttaagttttgtgtttttttcggtttaatggtagcttttctcccgaaatctctgttactttgcacctccaagaaaaaatatacgacgatgcttaagtttttgaagaattggacgttgcctattgcgatgctggtaggtgctgtcggttatccgatatttatctacttttcttttctgactccctatcttatctttacgatgttactgttgactttctgtaaggtatcaccgcatgatttgaagcctaaaccgttgcacgcatggttgttgctgattcagatcgggggtgctttccttgcttatttattgctttaccgtttcaataagattgtagcggagggggtgatggtatgtattatttgtcctacggctacggctgctgcggtgattacttccaagttgggagggagtgcggcaagtctgactacttatacattgttgggtaatatcggtgctgctattgcggtgcctattctcttccctttgatagaggtaaatccggatgtaagtttttggggagcattttgggttattttgagtaaggtgttccccttgttgatctgccctttccttgcagcatggctgttgagtaaattcctgccgaaagtgcatcagaagttactgggatatcatgaactcgccttttatttgtgggcggtctctttggctattgtgacggctcagaccctgtattcgttactgaacgatcctgcggatggtttcacggaaataatgattgcggtcggtgccttgattgcctgttgcttgcagttctttttgggaaagactatcggctcggtctataatgaccgcatcagtggcgggcaggcactggggcagaagaatacgattcttgctatctggatggcgcatacttatctgaacccgttatcgtctgttgctcccggttcgtatgtcctgtggcaaaatatcatcaatagctggcagttgtggaagaagagaaagaaagagataaaatagtgaatataagatattgatatttagttatttgttgtttgtatctctcttttcctttgtttttcctattttcctacttatatagaggagcgtatagatagctatcattatggttcaacagaatatgattcggctgtaggagcattgttccttccatgaacagcaaaatatgtatgctggcgaaaagagaaaaacacctttgttttcttttcgccagcattatttttgtacttttgtcgcatataacaaaacgcaaatggatataaatcagaattatagagaagcggtaaagaccataaaagaagctattctgcgcagccagtaccgtgcagccacatcggtgaacaaagaacagctatctctttattacggcatcggacgttacgtgtcgaaaaattcccgtataggcttttggggtaaaggagcaatagagcaaatatcttctctgttgcaaaaagaattgccggggctaaggggattttcaacttcgaatataaagaatatgcgagttttctatgaagaatgggaacctgttctaaatcgccagccactggctggcgatttggtattagatgaaaaattgctgttgagcgtaattcgccagccactggctgatgaatttaactggtcagacttcttttcaatcggctttagtcatcataccgaaataatatccaaagctaaaactttggaagcaaggctattttatatacatgagtgcgctattcgctattggagtaaatacactttaagggattacttaaaagcagacctgtacagccaccggggaactttgcctaacaatttcgcacaaacattgcctgatactaagcaagcgctaaaagctgtttgttcattcaaagatgaatacttgcttgatttcatcaatgtggaggaactggatgagcaggaagaggatttagacgaaaagatagtagaaaagtcgattgttgccaacgtgaagaagtttattatgacttttgggcaggatttcagttttataggcaatcaatatcgtgttgaagtggctggagaggaaatgttcattgatttgttgtttttcaatcgggaacttaattctttagtggcggttgaattgaagtccgggaaattccgcagttcgtatttaggacaactgaatacttatctttccgctttggattcatatgtgagaaaaccgcacgagaatccctctatcggaataatactttgcagagaaatgaatcaaacttttgtagaatttgcagttcgtgattataacaagccgatgggagtcgctacttaccgtacatccaaagatatgccggaacgacttcgtaacgccttgcctgacattgaggaactgagaaagttattgtagagcgaaagcctatctcttttttggcaggtaatttccttttgttgcctttgtacacgaagcccaccactaagcgattttcttcgtttttttgttacctgctattagtaataggtggatttatttgctgataatcagatttgtatggtgatgtgttaatatgtggcaaaatattattaatagctggcaattgtggaagaagagaaaaacaagagactgaagctaccttactgctgatagtttgtagtgtactgaataagttgacacttcaaaaatcgaaaataaagatgaaatattcgaaaaagaagtacaactattacagtgatgatgaacgaatgtcttatattcgtgagtatttatcaagtcc

SEQ ID NO: 223 - DNA, 10335 bp, Bacteroides thetaiotaomicron
cagttaaatatatattattatattctcaaagtattctcacgcctttgagaaaaaattctcaccgcaatgagaaaaaatactcatacctatgagaaaaatttctcattgcagtgagaaattattctcattgtggtgagaataaaaaggtctttgtacttcactgataataattcggtatttcttgttttatagatgctttaattcattacggaataaaggaatggatatttttatgatgcggtagctttgatatttcaaataagttcttatggaacttaatcgtattagaaggaggaaagctaaatggtagttaatgagtatcttgtaaataggaatgacttttattctattttgagtactaatatagagactcaaattgtcgtattttgatgaggaattgttaattcaaaaacacacatatcgttttatgttaacaagaataaaaacgtcacaaaatgatttgggaaactctaacaaatcgttttgccgtttataaatcagcaacttaacatcaaaatcgttactattttatttcgctcaattttcagtaacgatttagtaacactactttgtccaaacggggcatttttgtcctttgcttgcctgcggacaaaataaaaaagtcccataaaaccttgattttacgggacttgtcttagattttccaccatttgtctttagtgttcagcggagagacaggttctatcacctatcatttcaaacaatatcacaaactcgtaatatcttgttaattaccaagttattacaaagtaaacagaaaataaaatatctcttaatatctttgcatatctcactttttgggtgtatttttgggtgtcaattttcaaacacacccaattatgaatatcaaaagaaacatcattttcgcactggaaagccggaagaaaaacggtgtgccaatcacagagaatgtgcctatccgtatgcgtgtgatattcgcaagccagcgtatagagtttacaacgggctaccgcatcgacgctaccaaatgggatacggacaaacaaagggtaaagaacggatgcacaaacaaactgaagctaagcgcatccgaaatcaatgcagacctgctaagacagtatacggagatacagaacatcttcaaagagtttgaagtacagaacgtactacccacacccgcacagataaaggacagcttcaatgcaaggatgaaggatgcaccagtcacagagcaggaaacagccgaaggacctaaaatcagcttttgggaggcgttcgaggagtttgtaagggaatgcgggaaacagaacgactggacagacgcaacctacgaaaaattcgctgcggtaaagaaccacctgaaagagttcagggatgaactttcctttgatacgttcaccgagaacggactgaatgactatgtggacttcctgcgtaacaagaaagatatgcgtaacagcaccataggcaagcagatagccttcctgaaatggttcctgcggtggagtttcaagaaagggtacaatcagaacatggcttatgacagcttcaagcccaagctgaaaaacacacccaaaaaagtgatattcctcacatgggaggaactgaacagactgaaagactacaagataccccaaaccaagcagtatctcgaacgggtaagggacgtttttctgttctgctgtttcagcgggctgcgctattcggacgtgtacaacctcaaacggagcgacatcaagcccgaccatatagaagtgaccaccgtaaagacagcggacagccttatcatagagttgaacaaccacagcaaggcgatactggaaaaatacaaaagcgtacactttgaagatcacaaggcacttccggtcatcagcaaccaaaagatgaacgattatttgaaagaactgggggaacttgcggaaatcaacgacccggtaagggaaacttactacaagggaaatgaacgtatagacaccgtcacacccaaatacgccctgctgggaacccatgccggaagacggacattcatctgcaacgctttggcattgggtattcccgcacaagtggtgatgaagtggacgggacacagcgactacaaggcgatgaaaccatacatagacgttgccgatgacatcaaggccaatgcgatgaacaaattcaaccaactgtaaacacaacaatagcatggaagaaagaataacctcaatgataccccgctacgggaaactcaacaagacatatacggaaataacatccggtgacggcctctcttttgagaagcagaagttcattcatgacttttacaaagagtatgaagacacacagacctttgaaaaggcacttatcagcctcatgcttgaaacggagggtacgcacttttccatattgctgaacagcctgaaacgggagattgaaaacaatatctcaatgtataatacctgcaaggagtttttcgaccgtctcgatattgaacatatctgccggcagcatgaaagatgtcatgaccgggacatcgaaagacaaatgcaaatcacaaacgaatattaccgggaacttatggaagctaacggatctttggaggcagtcggtttcagggaacatgatcgtcaggaagaggaaaggttggaaaaaagatacgggcagtgcaaacgggaatacgacagggagaaagccaagctggatgaactatatgcacagaaggaacaggcaaggcgggaagccctacaatacctgaaaaaccgctgcggagacatatacaggctggacggatcgctgctggcaatcctcgaaaaatacatgaccggccaaaagaaaaaggaaggggaagaaaaagaggccgccacaccgacaccctcacccacctattttcccatgaaactcttgtcagccgtttacgaaaaatgtaacggtgaacagttcgaagccatttccgaactggacttttacgccagcatgaacctgcaaccgtgcgaaggcaaactgataataagaccgagggaaaaggctcgtgtatgttatcttattttccttatgggtgaaacactgcacaaaccagacagagaaaaatggagaaaggacatcatgaacctgctgggaatagacgacacatactataaatcaaaatacaaagaacccgtttccgattttcccagtgacagcaatcagatatttgcgaaggaaatgcagtcaatattccgatagttagcgatacgccacgacattccacgaaacaaccacttttaccacccgaaatatttttcaccactctttattatcttctgatatttagtgagatagcgtgataccccattcacgctatccacatccttaccacccgtatccgggattaactttgcactgttcgaacgaaacaaaaaagcccgtgcgcagggcttacagtacaaacgttaaattcattccaacatggaaatcagagaacttttatcaaagcccgtatggcagatgacgggagaggaattcatattactgaaccgacacgccctgcaggaaagggaagcgagagcagcacagcccgcagccgatacggaaaagaaatacgtgtacgggataggcggcatagcacgcctgttcgggtgcagtatgcccacagcaaaccgcatcaagaaaagcgggaagatagacagagccattacgcagataggacgcaaaatcatcgtagatgcggacatggcactcgaactggcaggacacaaaagcgggggacgcagataaggaggtacggacatggagtacagagaaagaaaagaagtcacgcccgaagcggcggtgatactgtggcaagcctcacggctcgacctttcggaagactacgagagggcacccgaaatactgaaagtacacggttccgtcataggcacgctggggaacttcagcgcatcaatcggaaaagcaaagagcaagaaaacgttcaatgtttccgcaatcgtggcggctgcactgaaaaacgggacagtgctaagctacacggcggaactgcccgaaaacaggaggaaaatactctatgtggataccgaacaaagttcctaccactgtgcgaaagtggcaaaaagaatattacgcatggcgggactgccgacaggcaggaaccataaagaccttgaattccttgtcctaaggaagtacacgcccgaggaacgaatagcaatcgtgagggaggccatttaccgcaccgaaaatgtagggctggtagtcattgacggaatacgggatatggtgtacgacatcaacagccccagcgagtccacgaaggtaatctccctgctgatgacatggacgggggaaagacacatacacatacacaccatactgcatcagaacaagggggacgagaacgcaaggggacacatcggaacggagcttagcaacaaggccgaaacagtgctgcaagtggagaaggacgagaaggaccccgacatcagtacggtcaaggcagcacatatcagggcgatgaacttcgaaccgttcgcattccgcatcaacggggaggcattgcccgaactgctggacgaatacctgttcaaacacaaggatccgggaaaagggaaaaaggagaagttcgacccctacaaggacatcacagagaagcagcaccgcatcgcactggaagcggcattcacactcaaagatgaatacggctacaaggagcttgcggaagaattgaggaaaacctacgcctctgtcggtgtcatgcttgggggaaacaggctgacagacctcattacagtactgaaaaacaaacggatgatagtacaggagaacggcaggaaatacaccttcaaacccgattttcactattagcggtattgtatgggaaccactttactttagtcccgtaccatatatatacggaagtaaagtaaagtggatatagcccgtaatatacaaaaagatacgggcgaaaagaaaaaataatattcacacctgacaagaacaacggtatgacagtacggaaaagggtatggtctcataccaggcctccaccatgacggcacagaccggaaaccgctttactttagtctgggggcatatatatagcaaaataaagtaaagcggatgcagcccgtaacacatgaaagggtacgggcccccccaaaaaaacaatatctacttaaaacagaaatatgatgaatatgaatgaagcgaagcagatacgcatagaggaatatctgcacagtcttggatacagtccggtaaggcaacagggtggtagtctatggtacaactcaccgttcagggacgaacaggaaccctccttcaaggtgaacaccgaacgcaacctatggtatgattttggcgcaggcaaaggtggtaatatcatcgcactggcacaggagctatacgcatccgacagtctgccctacctcttggaaaggataaaggagcaggcacaaaacgtgcgcccggtctctttctcttttggcaagcaacccttatcaaagccgagtttccggcagttggaggtagtaccgctctcctctcccgccctgtatacctacctgcggcaaaggggaataaatacggaactggcaaaaagagaatgcagggaggtccgctatctgaccggggaaaccccatactatgctataggcttccccaaccgttcgggaggatacgagatacgcaacaagcatttcaagggatgcatagcaccgaaggacatcacccatatacgacaatcggagtcgaaggaggcatgctacatcttcgagggattcatggactacctctctttcctcaccctgcggctggaaaggtgtcccgaccgtcccgaacttgacgggcaggactacatcgtactgaactcgacttccgacctttccaaagcaatccgaccgttgggcggttatgaaagcatccattgtttccttgacaacgacaaggcgggaatggaggccgttcaggagttgcaaaaagagtacggactgcgcatacgggacgcatcgcacatatacgaagggtacaacgatctgaacgacttcctgcgggataaaaggtcaggacaggcgcaacggcagcaagagaaaccggaagcggaaaaaaggcaaagccagacagagcagccgaagaagaaaggcaaagggatcaggatgtagccgcacagccaccggaaggctttgaaaaaagccatagctcattagggctttttcttaacgcaatgcacacattgctaaaaaagccccaacgagccataggggcgccgcccctttggaaaccccgtctgccatgcggcataaaggcaaggcaggggaagtattaacctgaaattattgacagttatggggtatgcagttttgcatctggaaaaggcaaaagggacggacagcaggatgtccgcacacatagagcgcaccgttcacccgaagaatgcggacagaacacgcacgcacctgaaccgggagctcgtacagtttcccgaaggggtgagaaaccgcacgcaggcgatagcacaccgggtggaaacggcaggtatcagacgcaaggtaggtaccaaccaagtaagggctatccgggtactgctcaccggaagcaacagggacatgaaacaaatagaggcggacggacgacttgacgattggtgcaacgacagcctgcaatggctccgggaaacatacggggaacagaacctcgtatcggcagtcctgcatatggacgagaagacaccgcacatacacgccacagtcataccgatagtgaccggagagcgaaggaaagccggacaggaagaacagaacgggaagaaaaagtacagaaagaagaacccgcaggacgtgagactctgcgcagatgatgtaatggcgaggcacaggctaaaacactatcaggacacttatgcccaagccatgaacaagtacggcttgcagagaggcgtggacggctcattggcaaggcatatttccaccatgcaatactacaagcagctggtggagcagcaggacagcctgcaagagaacatagaaaacctgctggggctggaagaggaagcaatgaaaaagctgaagcaggtaaagggggaaatcaacgtgcagaaaatgaagggagcggcggtgaacgccaccacagccatagcggacggggtgagctcacttttcggcggcagcaaagttaagaagctggaagcagagaatgaaaatttgaaacggaacattgtgaatctgcaaaagcaggtgcaagccgaacagagggagcagacaaaaatggaaaaccgtcacagcagcgagataaacagagttgaccggagctaccggcagaaaatcgcagaatacgacaatcggctggaactgatagacacctactttcctattgtaaaggaactgatacccatagcagaacaatgccgggaagtgggcttcaccgaagaactgacaagacgaattgtcagcctgcaacccgtggagttcaagggaaggctctattcaaaggagtacaaggagaagttcaggacggagcactcaacggcaacagtggagagggacccgcaggagaaaggaaaattcaggctgtgcattgacggagtacccatactcgattggttcaggaagaaatttcaggaaattaaagaaaagttagggctaaacacacctgttgaaaacaagcagcgaaaaggattgaaaatataattacttaatagcagagaaggggtattaattattagttctctaaaaaactaacgggaagaataaaaaacatattcttcccgtcaagtaatatcataactatattttccaacagaccatattaatattcagcatattataagtgaatcaacaaatcttttataaacatatctctgttctcacagcttaagaggtaattctttttttctgttaatataaaaatttgttgattgggattctttacataggaataatatttcccataatgggtactccccattacacctatataccccaaaaagccattacttccaaaataacggacatcattttgaacaccgtcataaacaaaagcgttcttaatacaagaatacggaatacatttcttaccaaacactctttttataacgagttgatccttttccaaacaaataaatgaaggaatcactatcagcatgtatatgtatatagatacaagaatgatacccaataacaggcttgcgatttgatcctgcaaagattgtagcataaaagttcttaatagaaacataagtccagtagttaataagacaatctttaacaccagagaccagcgctccattatcggctgaaactttgatttatatacgctcattatattgctatctttactgttgactatattacacgtatgttatgaaatgattggtttccttttgcatctccccttgaagatttaaagttttccacaactgcatcaaagacatttccaactcgttctatgggtagatttaaaatcgaaacttcttttccataaggacaaaagactgtattcttataattaaactttgagcttttcattgttaacatagccgaataaccggccttaacactctttttccaaaaaagttgtttctttttagttttaaattccacagcaaaagaattaccattaacgatacgcccaatagtcattgtgcttttatattttccattcttgattgttaatgaagcatctttaaatcccttaaaacctggctcaatcggagttggctctgctgcccgtgtagctgaaacaacttcatccaaatcataagtaggataatcatatttaggccctcttagactattaccgattacaacgtaaccttttatattaccgagtaaggacaaatcattatcagtgaatgtaaaataaggggtaacgtcgaataagtcaactgtattaaaagaaaaaatatctgaatatttatccttgtacgtatttatcatctcttgtattaagtgagaatcatcactttccatatcaaatattttatcgagctccctatctgcctgctcccataaaatatacgccccttcaaagcccaactgctgaaaataagtaaatctttcattttctgtcatgtttttaagctgccggagcgtctcgctatacacctgttcatctttaaaatgaagaactggcatattcaagtactcactaacacttctcgtttcttttacccacatatccattgtcgaaacctcaacatccggtatggtttcttgtgcagaaccgataaattcattttcgctattgcaagataacaagcttacaatcatgcatgcactcaaaatacaaccaaaaatcttttcaattttcatagtgtatgattttgtattaaacaattattttatttaaaaggctttaccttaacagtaaccttttccgttttattagcatggttataaaacacattactacaactttgaaagatgatcaaacatccgaacaatacaaatactattttcttcataaatgatattttttatttaaacaatccatatattatttcttgtaacaatccaccaaaatccatttccactttatgctttttaaatttatagtaaggcattaagataggagtaactcccccacgttcaaaaggatattcacgatacccccttatacctaattccgttccaaaagaatccgttatatcgaaagcaacactgcctccgtagtcattacggctgaatgaagtaacaggagtaaataaaaaaccgccaaatacatgcaaactcattcgggaattaaaggaataagaaagtttacccgatataccaaatgtttcatccacatggcgaggagtactcaacttcattgcatgcaatgcaacatcagcaaataaattatctgacaatgatttgttatatccaatagcagcatagttaaaaacaccaataccaattaaattcatttggcgtcccatgccgtaaacgtgaccattccacaatggggctattacccccgacacattatattcccctttatgtaaaggactttggtctgtgtaaaaaaacggcccacccttcttgaattgaagagtaacaccagaatttgcaaaaataacagaattttgatattcccaaataggatatttaaccgaatcaactgcaaaatctttgtgaaaacgcaaataccgttttctcacaggattcatatcaacccacttcgattcttgaccatacatcccaagaggacacatgatgatccaaaacaaaataaatgctgcaaaactaattaatgtagtcacctttctatacatattgattttcatcattatgcccaaagcatgaaaataaaagcatcatacacaagggctgtaaataaatccactgtcaatttacatttctgcgatatttatttaaatgaacaatcaggatttttgcacgattttttacataatcctttaac

SEQ ID NO: 224 - DNA, 10330 bp, Bacteroides thetaiotaomicron
ataataaaccatgaagaaactagtttatttaattatcttctttttgtattcgactgtgatgaatgctcagctaaaagatctggtacagtatgtgaatacgctacaaggtaccgattctaattttggtttgagctacggtaatacttatcctactacaggtatgccttatggtatgcatatgtggtctgcgcaaacaggtaaaaatggggatggatttaagtatatgtatgctgttgataagattcgtgcttttagccaatcacatcaatgtagtccttgggtgagtgattatgctgtatattctttcatgccgatggtaggggagctggttgtaaatcaagatgctcgtgctaccaagtttagtcacgataatgagatagctaaacctcattattataaagtaacattcgataatggcattactactgaaatggctccgactacccgtggtgtacatttacgtttttcctatcctactacgggagatgcttatttggtacttgacggatatacggatatgagtgaaatcaaaattgatccggctaagagacaaatctccggttgggtaaataatcaacgttttgtgaacgattcaaaatcattccgtaattattttgttgttcaatttgataaacctttcgaagattacggcgtatgggaaaaccaaaaggatgaagtgtttccacagaaattagatggagcaggtaaaggatatggtgcatttattaaatttaaaaaaggctcgaaggttcaggctaaagcagcttcctcatacataagtgcagagcaggctctgataactttaaataaagaactcggtaaagataagaatctggaagtaacgaaagcacgcggtcagaagacttggaatgaagtattgaatagaattgtagttgaaggatgtacggacgaacagatgaagactttctactcttgtcttttccgtgctaatttattctctcgcaaattttatgaacgcaaagaaaatggtgaaccatattattatagcccatataatggtaaaatttatgatggttacatgtatactgataatggattttgggatacattccgttctcaattccctttgacaaatattttgcatccaacaatgcagggacgttatatgaatgctcttttggcagcccaggaacaatgcggctggttgccttcatggtcttccccgggtgaaacaggaggaatgttaggaaatcattctatttcattgctggcagatgcatgggcaaaaggaattcgtgattttgatcctgaaaaagcactgaaggcttatgcgcatgaagcaatgaataaaggtccttggggtggtgctaacggacgtggattctggaaagaatatttccagttaggatatgttccttatcctgaatcaatgggttctagtgcacaaactatggaatatgcatatgatgatttctgcggatatcaacttgctaaaatggttggaaataaacattaccaagaagtatttgcccgtcagatgtacaactataaaaatgtctttgataagtctatcggatttatgcgtggaaagggtgttgatggtaaatggcaggaaccattcgatccactggaatggggggggcctttctgtgaaggaaatgcatggcattatacatggtcagtgttccatgatgtacaaggcttgattgacttgtttggaagtgatgaaaagtttactactaaaatagattctgtatttactattcctaacataattaaaccgggcacttatggtggagttattcatgaaatgaaagaaatggagttggctaatatgggacaatatgcacacggaaatcaaccgattcaacacatgccttatttgtattgctatgcaggtcagccgtggaaaactcaatattgggtacgtcagattgttgagagattatataattcaacagaaaaaggttatccgggtgatgaagaccaaggcggtatgtcttcatggtatattctgagctcattgggtatatatgctgtttgcccgggtacagatgaatatgtgattggcagcccattatttaagaaggctaccataactatggaaaatggcaataagtttgtgattgaagcaccagaaaacagtaaagaaaatttatatatacaatcagctactttgaatggcagacttttagataaaaactatatccattatgatgatatagcagaaggaggagtcttgaaatttgaaatgggaagccagcctaataaagaaagatgtacttcgaagtatgctgcgcctttctctttgtctaaagaataaagaatcaaagaataaagttcaataatacgatcgattttatccgaatagcgaaacagggtactattagtggtattcctgtttcttattcgaaatagactctactaaaagaacatccggaatgaaacataaattcttatttattttattattctctcttgttttagaaggaatggttacaacacaagctgtggctggtgactatgtccatcaagtcaatacgttgattggaacaaaaggtaccggactgacttccggatatctttatccgggagcaacttatccttatgggatggtacaatttactccatcttatttttccaaaaggtcgggattcgttatcaatcagttgagtggtggtggttgtgaacatatgggaaattttcccactttccctgtgaagggaaaactgaaaatgtcacctgataacatcctcaactatcgtataaatgtatctgaagaaaaaggacatgccggttattatgaggctatggtgcaagaggatatcaaggcaaaactgacagtgaccgagcgaacggggatggctagttatgaatatccggcagatcaacagtatggtacaataatcattggtggaggtatttctgcaactcctattgaacaagcagcaattgttattactgccccgaataagtgtgaaggttatgcagaaggaggaaatttctgtgggctccgtactccgtataaagtctattttgtagcagagtttgatactgatgcttttgaaaccggtacatggaagagagaagaattgatgccaaatacaacttttgcagaaggtgagtattctggtgtatactttacttttgatgtaaacaaaaagaagaatattcaatataagattggagtttcttatgtttcagtagaaaatgcacgtgaaaatttgaaagccgaaaatgcagaatgggatttccaaaagatacagaatcaggcggaggcaaaatggaatcattatttgggtatgattgaagtggagggcaccaatcccgatcgtacgacccaattctatacacatttatatcgttctttcattcacccgaatgtttgcagcgatgtgaatggggaatatatgggagcggatttcagagtgcataagtcacgttctaaacactatacttcttttagtaattgggatacgtatcgtacacaaattcaattattatccatgcttgatccggaggtagcttccgatattgttatttcccatcaattgtttgcagaacagtccggtggctcttttcctcgttgggtgatggctaatattgaaacaggggtaatgcagggagatccgactcctattctgattgctaatgcctatgctttcggagctcgtaattatgatccgaaacctatctttaagattatgagaaaaggagcggaggaaccgggttctaagtcgcaagatgtggagactcgcccgggattgaagcaatatttggataagggttattataatgcatctattcaattggagtatacctcagcagattttgctatcggacagtttgcattgcatgcagtgggagatgaatttgccagttggcgttattttcattttgcccgttcatggaagaatttgtataattcggacacaggttggctacaatcacgtaatccggatggatcgtggaaatctcttggtgaagactttcgtgaatctacttataagaattatttttggatggtgccttatgatattgccggtctggtagaaataataggtggtaaggaaaaagccgagaaacggttggatgaattctttacacgcctggatgccggatataacgatgcatggtttgcttccggtaatgagccgagtttccatataccttggatatataattggattggtcgtccatacaaaacacaggaaatcattaatcgtgtgttgaatgagcaatattcaagtaagatagatggtctcccgggaaatgacgatttgggcacaatgggtgcttggtatgtgtttgcctgtatcgggctttatccggaaatcccgggtgtggggggatttacggtaaatactccaatcttttcatctgtcaaggtacatttgaaaaaaggtgatattgtgataaagggaggttcagaaaaggacatctatatcaaatccatgaaactaaacggaaaatcatatgaaagtacatggatagactgggaccagctcaacagcggagctactatcgaataccgtacttcgggtaaaccggacatgaagtggggagcaaaggtcgttccaccatcttttccttaattaatgaattattataaagaacaatcatgaaaagaaaatttcaacatatagcttatttactgatggttgcagcagtgataacttcctgtggagagaagaagcaaacatccgaattccccgattgggcatgggcggattttcaacgtccggaaggtattaacccaattgtctctcctgataccactactgttttttattgcccaatgaggcaggattcggtagcatgggaatctagtgatacttttaatccggctgctacaatttatgatggtaaagtggttgtgctttaccgggcagaagataattcggcggtaggaattggttcacgcacttctcgcttaggctatgcttattctgatgatggtttgcattttaaccggatgactgttcctgtattttatccggcagatgataaccagaaagaattggaatggccaggggggtgtgaagatccgcgagttgctgtgacagaggatggcctttatgtaatgctttatacacaatggaatcgtaagcaggcccgtcttgccgtagctacttctcgtgatcttcagatatgggaaaaatatggtccggcttttgcaaaagcatatggcggacgtttttttgatgaattttccaaatctgcttctattgtcacaaaattggtagatggcaaacaagtgattgctaaaattgatggaaaatattggatgtattggggagaaaagtttgtgaacgtagctacttccacggatttgattaattgggaaccgatgcttgatgaaaaaggagactttctaaaagtaattactcctcgtgaaggtaaatttgatagtgacctgaccgagtgtggtccacctgcaattatgactgataaaggtattttattactttataatggtaagaataagtcaggtgcagagggtgatacattgtatactgctaattcttattgtgccgggcaagcattattcgatgctaaagatccgactaaattgattgaccgattggataaaccattctatattccggaatcagattttgagaagagcggacaatatcccgcgggaacagtatttatagaaggtttagtattccataatcagaaatggtacttatattatggttgtgcagattcacgtgtagcagttgctgtgtatgatccttttaagaaataaaatgcaatgaaaaagataggactctttttgtttgatatttgttttgcattgcaaatggtggcacaagaacaaaactacttcacaaatcctgttattcggggagatgtacccgatccttctgtcattcggattgaagatacatattatgctacgggtacctcttcggaatgggcgcctttttatccaatgtttacctcgaaggatctggtaaactggaaacaggtagggcatgtttttaccaagcaaccgtcctggacttctaattcattttgggcaccagaattgttttatcataataataaagtttactgttattatactgcccgccaaaaaagtaccgggatatcatatatcggagtagctacgtctgattctcctttacatgaatttaccgatcatggtccgattgtagagtatgggaaggaagctatcgatgcatttatttatgatgataacgggcagttgtatatcagttggaaagcttatggtttggatacgcgtccgatagaattgttaggatgtaaactgtccgctgatggtttgcatttggatggtgaaccttttactcttttagtagatgaaaagggaattggtatggaaggacagtaccattttaaagaaggcgactactattatatagtatacgctgcccatggatgttgtggtccttctagtgactatgatgtgtatgtagcacgtgcaaggaattatggtggaccttatgaaaaatattctggaaaccccattcttcatggcggagaaggagattataaatcatgtggtcatggtactgtggtgagaacatctgatggtcgtatgttttatatgtgtcacgcttatttgaagggagatggtttctttatcgggcgtcaaccgattttgcaagaaatggaaatgacggatgatcattgggtgcgtttcaagactgggaatttggctatagctgaacagcctataccttttgtcggtacaaagcaagagcctctttcggattttgaagataattttaaggggaatcaattgaaagttgattggacgtggaattatccttattcagatatacacgctgtgctaaagaaaggaaagttatttttatccggtactccaaagaataacaataaatatggtacagcattatgtttacgtcctcaatctccacagtatagctgtgagacgaaagtaataaacacaggcaaaggactgaaaggattgaccttgtatggcgatgataaaaacctgattgcttggggaattgaaggagataaacttattttgaaagtggtgaaagacgatattgagtcagtactttatgattcagcttttgcaagtaaagagatatatttgaaattggaagttgaacaggggtgtatattccacttttataaaagtctggatggaaaaacatggcaatctgtgcagaatacccctttcaagggtaaatccttgattcgttgggatagagtgcagcgtccgggattactacattatggagataaggatgtaccggcagagttttcttattttaaaatgaagaatttaaaataaaaagaaagtagatggtgataaaatttttagtttatactattaaattatccctcatagtagattaacagtatttgtaaaatatagattgataacatgaaaaagtttttagtattagttgcagcagtttgcatggcatatactactgcgtttgctcagaccgtgaaaccttttaaggaaggtgatagagctgtgtttttaggaaatagtattacggatggtggtcgttaccattcatttatctggttgtattacatgacccgcttcccgaatatgcctattcgtgtattcaatggaggtattggtggtgatacagcgtatgatatgaataaacgtttggatggtgacatttttagcaaaaatcctactgtattgatggtgactttcggtatgaatgattccggttattatgaatataatggtgataatgcgaaagaatttggtgaacagaagtatcaggaaagcatcaagaacttccagcagatggaaaaacgtttcaaggaattgccacatactcgtatcgtaatgacgggaacctctccttatgatgaaactgcgcaaataaaggataatacggtctttaagaaaaaaaatgagactattaagagaattatagaatatcaaagagaatctgctgcaagaaatggttgggaatttacagattggaatgcgcctatggtagctataaatcaggaacttcaacaaaaagatcctagttttactctttgtggtaacgatcgtatccatccggacaatgacggtcatatggtgatggcttatcttttcttgaaagcacaaggttttgctggtaaagatgtggccaacatggaaatcaatgcaaataagaagcaagcagtgaaggcagaaggttgtaccatctcaaatattaagaaaataggtaaagatattagttttgattatctggcagaggcgttaccatatcctttggatactattgcacgaggctggggttctaagaagagtcaggcagaagttataaaagaagttccttttatggaagagatgaatactgaattgctgaaagttaccggtttgaaggggcaatataaactgttgattgacgatcaggaaataggaacctgggatgctgctgatttggcaaagggtataaatttagctgcagaatctaaaactccacaataccagcaggcattaactatcatgcacctcaatgagtatcgttgggaacttgaaagaacatttagagaatatgcgtggtgccagtttggtttctttcaacaaaaaggcttattgtttgctaatgacagaaaggctattgaagtgatggatgaaaatgtagagaagaacatgtggttgaaaggacgtcgggatctttattcaaagatgatgtttaaagaaattcgcgacgcacgtgaacaagagatggatgttctgatttccaagatctacgaaatcaacaagccagtagtaagaaagattgttctgagaaaaatataatatttctttagataagaaaggtttgaattggtgtatggtggtgccggctaatagtcggcaccttttttatgtatgatatttgatttaatttcttttccagaaatcggaactgaacagcagcaataccgtaaacaactccagacgtccgagaagcatcaaaaaggagagcaaccatttggctgcatcaggcaattcactccacgagaaggcagggccacacgtgccgagtcccggtcccatgtttcctatacttgatatgaccgttccgatagattcgagaaatcccactccgaagcccatcatgacaagaatgctgataatggcgatgattgcatacaaaaatgtaaatgccagtacggtagactggatagagggggagatcacctgtttattcacccgtacgggcaatactgcattgggatgcagaatatgtttaaattcatttttggcaactttgaagaggataaccatgcggatacatttgataccacctgtcgtactgcctgcgcaagcacccattatcattacgataagaagacagccccagagaatggagggccagagcatatagtcggcagtggcaaaaccggttgaagtctgtagggagattacttggaacagagatttccggaatgcttcttctgctcccatcgaactggtctgataaagccagactgctatgaaaaccgtgaaaaaggcaacagacataaaataaaacttcagctcggcatcatggataaacttctttattttcccattgaacatcagcaataatagcgtgaagttgactcccgagaggaacatgaaaacagatattacatagtctatgtaaggcgagtggtaatattcgatacttgtctgcttggtggagaacccacctgtactggtcgtggtgaaagcgtggcagatactgtcgaaaagtcccatgcccccgaataccagtaatataatcaatgtccccgtcataccggcatagatgccccagatccatttggcggtaacaccaatacggggatgtactttgtcatgagtcggcccactggcttcggcggcaaatacctgaatacctcccataccgaaaatcggaagaacggcaatcgtaaagaatacaattcccagaccgccgatccactgagtcattgcccgccagaaaaggattccgtgaggcatcgattctatattattcatgatggtggcaccggtactgctgaagccggacattgtctcgaagaaggcatcggtgacacttggaatatacccgcctatataatagggcaacattccaaaaaaggagaaagcaatccaggctacactgacaatcacatatccatcgcggcggttgagtgacttttcggcccctcttccaatagcaagcataatcacacctacaaaggccgtgatagctgatgaaagcagaaaactgtttaaatcatcttccttgtaaaatagtgaaacaccaccgcaacacattaacatagccgtttctatcagtaacagaaaccccatgatgcgatatatcatcctcgaattaatcattttttaagtaataggtattaagtaataggtattaagtaataagtaataggtattaag

SEQ ID NO: 225 - DNA, 10314 bp, Bacteroides thetaiotaomicron
catacatataaatttacagatgtaaaaacgaaaaataaaactaaataattttatactattcaatcaatttatttttcataactttgcggaaaataaaccacaaacagtggcttataaaaactaaatacaagaatatgataaaagttgaaaaagaagtatccaatgattacatcattaagggatttaaacattttacccaattagctacggaatacttccaaggacatccggactgcaatgcagcccgaaaaagaatgcgcgacacaatagatgccaacttgcagctcaaagcagagctcaccgcagcaagttacaccgaacacacgactttgctaagtccgaagatgcagcaaatcatctgggcgcactggggaccacccatcatttcactgtcggaaaaccacgcaaacgaatcggacaacaaacgagtttgaacgcccaaaaagcgaaaatcgaactatatatttttaaatatataatttattagttatcccttattatggttccgccctgcgtttcaaaagatttttctcaacagacataattcactagatgtcagaagattacctcactctccagagtgttccgctgtgcgttccacaaaaatgccctttttccaccctcaaacagaggctccaaaatgaccgaacagaggcttcgtttactataaacagaggctctgttcgcatcaaacgaagcctctgtttcacaatcttcccccaacgtgtagcgcacaaaaaacaacacatgccaaaagcagctatttacgtccccgcaaggaatattacatcccaacacgtccaaacacgcacatccgtttaggattccggcaacgatcaacctacttttggacaaaatttaaaaaacagaatatcatatgcaaaaaatggattgtcaagccatcggatatggctacatcattatccccaaagctctgctgaaagagcaacttatagactgcagcccacatgaaggagaaatagaggctttcctgaaacttcttgtaaaagtcaactactcggaaacaaagctcaccgaccaccaaagacgcaccatcgtgtgcaaaagaggtgaaagcctgcacagctaccgcagctggagcgccattttccactggccaacgagcagaacctaccgcttcatacaacaactgaaaacaaacgggatcatcgaaatcatccctcacaacgacaccaccgccctgcatatccgagtggtcaactacgaaaactggacaaacatctcggcactcctcaacgagaaaaaagaaaacacacaaaaagccagcaacgaaaagttccgcctcttctgggacgactaccacaacatcctgcagctccccaaagagaacatcgccaaggcgcagcgtatctggaaaaagctgagcgaaaaagaacagcagctcgccatcgaccatatcgaagaatattattatcatcagacaaacatgaaattcacgttacatgcctgcagttatttatccaataaagcctttctgaatgaatatgaatactgacaacagagtttctccgcaggctccggagatagaagaagccatactgggcgcctgcctgatagaacaggaagccatgccgctcgtagccgacacgctgcgtccggaaatgttctacagcatgcgtcaccaagtgatctacgccgccctgctggccatgtaccaggcaggaatgaagatcgacatcctcaccgtaaaagaagagcttgcccaccggggcaagctcgaagaagccggcggagcattcggtatcacgcgactgagcagcatagtagccacctcggcacacatcgaatatcacatgcagatcgtacacgagaaatacctgcggcgggaaatgatactaggactcaacaaactcctcgcctgctccctggacgaaacaatggacatagccgatacgctgatagatgcgcacaacctgctcgaccgcctggaaggtgaattcggccacaacgaccacatgcgcgacatggacgcactgatgaccgacacaatggaagaagccgaacagcgtatcgccaaaagcgtaaacggaattaccggcatccccaccggcctgacggacctgaaccgcatgacgtccggactgcaaaacggagaactcattgccatcgccgcacgcccctcggtcggaaagaccgccttcgccctccatctggcgcggcaggctgccatgcagaaacatgccgtcgccgtctacagccttgagatgcaaggagaacgacttgccgaccgctggctgttgtccgccagcgacatcaacccttaccgctggcgcacaggcatccctaacccgcacgaagtagcggaagcgcacaccaccgccgcagaactggcacggctaccgatacacgtagacgacagcacatcgatcagtatggaccatgtacgttccagcgcacggctccttaaaagcaagagtgcatgcgatctgatcatcatcgactacctgcaactttgcgacatgaacaccggacagaagaaccgcaaccgtgaacaggaagtggcacaagccacccgcaaggctaaattgctcgccaaggaactgaacgttcccgtcgtattgctttgccagctaaaccgcgaatcggaaggccgtcccggtggtcggccggaactgttccatctacgcgaaagcggcgccattgagcaagacgcggatgtagtaatgctgctctaccgccctgcactggcacggctcactaccgaccgggaaagcggttatccgaccgaaggactgggggtagtcatcgtagccaaacaacgcaatggagagacagggaacgcatacttcagccacaatccttctctaacgaaaattacggactatacaccaccattggaagtattactgaaacaagcaaaataaaaacagaatcaaaacaatattatattacataatattatttctaatattttccgattttatttcatatttacaatgaaataaatggcataatgcttgacttcgcctcttatatttcgtatatttgtaatgtcatagagaaacaaaataattattacttaaaccttaactttttaaatttatgaatgtttcagtagaacgctatcagcgaagaaagtacgtaagtcaggagaattccccgatgctgtattacgtacgtcagaaatcgggtacagtaagagtgatggacgtcgaaaaactggcagatgccatcgaagccaactcttcactcacagcaggagatgtaaaacatgccatcgaagcttttgtagagcaactccgcctgtcactcacccaaggtgacaaagtgaagatcgacggtctgggtacgtttcacatcacactgtgcagcgaggggacagagaaggaaaaagattgcacggtccgaagcatccgcaaggtgaatgtccggtttgtagcggataaagcactgcatctggtgaacgcaagtcacaccagcacacgaagcgaaaacaacgtggaattcgtactagcaagcaaaggtgacacggaaggcggaaatgccggcggaggaaacaccggaggcggaggaaatagcggaggcggaggaaacagcggaggcgatgaagaagctccggacccgacagtttaacaggacttttttgggaaagagcagtacaaaacactggagcagccctcccaattgaaactgactaagaagtcaatagtatctcaattcccctccctttgggaaggaggggtggctgaaagccggggtggtaggtaaaacaaggtttattcctattctattgtaaataacagagttatgcattcacctaccacctccccctacggggactcctccttcccgaaggaggagaagtaagatactaccgacttttagtcagtctcaggttcgtcgcttcgctcagaatgagagatactatatcgaactaaccttaatgtacaactccccccattatcaattatcaattatccattaaaaaaaatgctagataaaattatcgagattattatgactatcctccctttcctgggtaatcgtaaaaagcgtaaagcgatggcgcaagacgtcaaagaattcagcgaactggtgaaagaccagtataccttcctgatggaacagctggaaaaggtactgaaagattatttcgacctgagcgcgagagtgaaagaaatgcacaccgaaatcttttcgttgagagaacaactggcacaagctgccacattacagtgcgtaaacaaagagtgcctacagcgtacacaaagcgaggcatccatctctgaagcttaatgccggacagattatgagaacgatcaacttaatcgtaattcactgctccgccacacgcgaagacaaggatttcacggaatatgacctggacgtctgccatcgccgacgcggattcaacggagcgggttatcatttttatatccgcaaaaacggggatataaagtctacccgaccgatagaaaaggtcggtgcccacgccaaaggtttcaacagagaaagtatcggtatctgctatgaaggcgggctcgacagcaaaggtcgccccaaagatacccggaccgaatggcagaaacattcactgcgggtactggttcttactttactgaaagattatccggaatgccgcgtatgcggtcaccgtgaccttagtcccgaccggaatgagaacggagagatagaaccggaagaatgggtgaaagcgtgcccttgcttcgatgcggaaaataactggaaagcatgaggcagaaatcaagaaaagttttaattgaatagcctataaacaagaaaactccaattgcccgaccaaactaagtcgaagcagttggagtttctacctttataaaatagatcatcaggatatctcctctgaaggaaatcaatcaacaagcctattataatgcaataaaccgaagtactgatgctgtaaatagtggtatcttcattgacttcatgctacaagaaatatacgaaacactaaagaaacggcaaggcgatcctatagtaacaatgaaagcgacaaaggatgtcggtataaatgtcggtataaacgaacaaaaagttctggaacttttgagaaaaaacaatcaaattaccgccaaagaaatcgccggacttctaggtatcagcctaaggcatagcgaacgtctgatcacatcattaaagcaaaaaggtatgattcagcgagttggatcaaataaaaacggatactgggaaattatagtaaaataaggctactttttatttccaaccttcatcaaagcaagccctatcacaatccagaccatctcacgcacgcgagtgatcaatgccgcatagactccataagctccggaaagggaaagcccgcctaccgcaagggcaaatcctccctcacggccacccaactgcataggcaagaagaacaaaagattggctagtaaagaagagaaggcagcaatcaggcagcaatctgcaaaactgacactccttgtcagcacattgaggatcagccagatttccagacaactgaccacacgtgccgtatattccaagaataaagccgcataaaaagctcccttcttctgttgatgaagcaaggctatctgtttatctatgttctccaactgttcccgatgggagtcggcaaaacggattactttctttttcagaaaaggaagatgactgcccagacgaacgaaagcaactgccatcccatgctgatagccttttacaaacaacatagctaccagcaggcagaagacggtgatcgtacccaaaatggttcccatcacccaccctaccggataaaggcaaaggtatagcaagacagaactcagccaaaagcagaaatgagaaaagatgtgcatcatcacgtagagaatcaccgaagaagtggctctctccactcctatatacggtttcagttccatgatgcgatacggctcaccgcccatcagtccgacgggagttacgtaattcagggcaaaacccgtaacggtaaacttataaagccgggcaaatgaaaaccccggcttccctccgctacgtataatgatgtaccacgatgtagtattaatcagataaacgaacagccacagcaataataccaaaggcaaatatactcctgcccttttcaaatttgcccaaagttcctgataatccatatcgaaagtgaatatcatgatcaggacggcgacaatgccaaaagccaggaatatattgcggtatttgttcttcactatttaatatactgataatatcggtcaaagaagtttctgaatccgcgaatcttcatcagtccgtactcaaagaacagccagccgagcagtgcacaggagattccaaggagtacatctataatatagtgatgacaagagtagatcgctgttccccagatgcctgccatgataacagagaaaagggcaatcacataccatctgcatttgccgataatggcatacaccaatgccacaaccatatatgccgcatgaagggaaggaacggcagcaaagacatttgcgtttcttccataaatggagtcgaagatagtcacgccaaaaatctcgtcgaagcgaccgagacccgccacgttacccggagtattcagtatcggttcgaaaccgtagttgatagcataccaggggggagcagccggatggatataatagccggcaaagccgattaagttgacaaacaaaaagactaatgcaaagcgaagataagtttttctctctttcttaaagtacagacagagtccgaacaggataggcacagggacccagcaaagatagaagatgccggcgaagacatctgccaccgcccaatgatgcacggcaaagtactcacaaggagtaaccagcacaccattatccatcactccgaacaacgacttttcgagattataaagtccggccacatcaatcggatttacttcgtaattggggcagatacgcatccagtcatacgagatcccgaaaatggcgaaaggcagtaaggccactgccagcttccgggtaggtagtccggcaaaaaataaaaccagatagagtgccgccatcagcagatgttcggaacggagtccgatacaagcagctgtcagcagaagaaaaagagccatgatgacaataacggtcagggtttctttcttcgacggcatttgaattgtttttatcattaaggatgttattttaattagtcattcttcttttcgttcgctgtcatcaccttatagcaatgtctcacgcgtgcgaaagctgtgatattggcgaacacagcgacgattgtcaaaggcaccatcaatatcagcatcggatcaaaagcggtaatatccttgaatacaccgcagaacaaggctccgagacttgtcagaaccacacgctccgggcgttgcataaatccaaccttgcactcaatgcccagaccttcggcgcgggcacgcacatagctcaccatcagcgaaccgatcagggcaacaaacgcaatgatagcgtaaatgaaatagtctttgactgacaaatagtaacagataccgaagaaagtcatcaactcactgtaacgatcaagcacagaatcgtagagggcaccgaatttggaactcatgtttcccagacgtgccacacgcccgtccatcatatcgaacaatccggcaaaaaggatcacacctcctgcccatccaagaatggacaaatcattctgtccgccacagataccggcatagacaaacatacctgccgctaccacattcagaataaatccggtagtagtgataaaattaggggtgatgcctattttaatcattccatgtatcaaaggattgataatcttataaatcagttgctgtaagtaatctctgtaattcatatacctaaatctgtttttatctaaatcttctgttttctttcaatttcttttaaacaagcttcttatatctatattccggtaaacaaagaaacgctgcatattataattccagaacaacgctacaatgactgccaccaccactttagggatgatgaagaagtcaccgaaatattggctgagtgtatcacgtacccacggaattttcgctaacgattccgtcagagtgtacgtcccccacgtattcagccaaatactgcaaacccacactattatgaattttacagcaacatgcgtttttttccctttcgatttaaaagtccatttataattgataatgcaattgataattcctccatagatagcgcccgccaaggtagcatatacatagtagacatcaaatagccttaccagaaggatagtcaccagaaagtctgcaatagtcgccatttgagccgaaagctgcgcccttaaaaacataaagactccacccttctgcgagatcatccgtgcaactcttttcagccaatcacccatcgtgccaccgctatcaagataaaactatatacacccgccagtacatcatccatcattacccctactccacctttaaagttctccatcttgcgtactcccaatggctttacgatatcaaaaatacggaacagagcaaaagccgctatcacgtaccaataccaccggtcattatcgggaactgccagtaacggaatccacacacctaccatttcatcgaccaccacacgtgacgggtcttcaccccaacaagactccaacttattggcagcccaaatacctgcaaaggtaaaaagaaccaccaaagcagcagtcgtccataataaagcagtgaaaggaagcaggaagtaaagtgcaatccagatgatagaagccagcaatgccccggccgtaccgggagcaaaaggagaaaaaccagagccaaagcccgtgcctattaaaacaggtagaaaggaaggtctcttcattaatagttgagagttgagagttgaaaattgagagtggaggatgattggatgtgctccaaaaataaaagttgaaagttaaaagttgtctaatgctgcaattacattgcaacaactttcaactctcaactttcaactctccacttatttaattaagctaaataatcaggttctttttcaccaatcatgttacgcaatgtctgttttaccattctccattgtgtgaacaggtcgtgttccggctgatgttcgaaatcgtgcatcgggctcttgcagaagaatgacaaccaagtctggatgccacacatacctgcacgcatagccaagtcactgaacaataccaggtcaagtgcaataggagcagccaggatagagtcacggcaaaggaagtttaccttgatttccatcggatagcccatccatccgaagatgtcgatgttatcccatgcttctttgttgtccttacggggaggatagtagttgatgcgtactttgtggtaaacgtctccatagagatccggatatttttccggttcgaagatggtgtcgattacagacagcttactaacttcttttgtcttaaagttgtccggatcatccagcacttcaccgtcacggttaccgaggatgttggtagagaaccaaccgttcacacccagcatacgagtcttgaacatcggagccaatacggttttcatcagtgtctgaccgctcttgaagtctttaccggagataggaacattcttctgtttagagaattcccacatggccggagtatctacacacaagttaggagcacccatcacaaacggagcatcttctgcgatagcagcgtatgcataacacatactcggagagataacttctgtgttgttatctttcattgctttctccaaagcagcgagtgacatgtgttcgtctgataacggaatgtagatttcggtacttgcagcccacagtacaacaacgcgttcgcagttattggcagccttaaagtcgcggatgtcctgacggagttgttctaccatttcccaacgggtagcagccttcttgatatgtgtaccattcagacgttttgcccagttgtgatcgaaagctgcaggcatcggcttgatagcttccagttcatctttcacaccgttcaggtctttttctttcaaaacctcggcatacatagcagcttcatatgcgttgtccgggaagatatcccatccaccgaaaacaatgtcgttcaaatcagtcaagggcacaacgtccttgatgagtttttcttcgttgttttccatgcgcattgtggctaactgtgtaatagatcctatcggttttgccagtcccttgcgagaggctagtgtacctacaatcattgtggtggcaaccgcaccacctactccaactaccaacacgccaagacgtccagtagcgggtttaatttcttgtttcatttctattctattaaaattaaactaaaattgatgcaaaaataagattaattaattactaaagc

SEQ ID NO: 226 - DNA, 10080 bp, Bacteroides thetaiotaomicron
ctcttatgtccttctttctgcccaatcaaagatttcttattatttatatttaaataaagaggacatgaatattttgtttagaatggaaaaaggaatcgctgtgtgccttttttcttctttttttgtattagcatgtgtaaatcatattccgggagagaaggctgcagtcagcaatggagatattccattgaaatttactgctgatattcatgaagtgacatatacacgtgttgctggcaatggctttgaagagaatgatgaagtgggagtatttgcccttgtagggtcctccaccatgaaggaagaacgttatgcggataatttgcgtttctttcgtacttccgaaaaagtttttgagtccagtgagccgatttattatcctgatgatgaggtaacattacgtttgatcagttattatccttatcaggaagagggagtgaatatgggagaaagtacgatgtcggtggcggtagaaacagatcaaaatctttctgccggctatttctgctctgattttctggttgcttctcaaaatctgcaatcagctcctaaaggagccatcgccctgcactatgatcacaaatttttcaaattaaaaatcgctttggtaggaaaggaaggtgaagaattgcagggtatactggatgctgacccaaaactttctgtttgtggtttttatactaaggcgatttatgatttccaaaaagaaacttattccgctttttctaatgagaaaagcattactcctgccggaaaatgggagatacagggagatcggttgagcggaaaagaagtgatccttattccgcaagaaaccactttgggctatcaatatatcgtattggatgttggaggtaagatatataccagcccattgccctcttcattgcagttgcagagtggtaagcagagtgagctggcgatttccttcatcccgaccgaagatgttttgataagtaaagtcgaaggagaaatcaatagttgggaagatggaaatacagggcagtccgggtccgaagttttccacaattatgtggatgtgtcaaaattggtatttgacgattcgaaggtgtataaagtgttgagtgctgggcagcaggtagcagaaatatgtaaagaatatctagtgacgcctgatttttcttcacaggcaattgtcgtttatccgatgaaagataaccatgcggttgacttatccaagggaacggtagtacaattggtcggacatgcagataaagtgcacggcggaactgtagcgtgggatttgaaagaacattcattgaaatatactcctggaaatcaggctgcccgaagtaaggtgtatattttgcctgacggacaaatagcattgtctatgcctgaagaaatgttgcccgtattggccatgaaagatataatgcgtgatgtgcgtgggagtagtattcacaattacccgatagtgaaaattggtacgcagtattggatgggaagtaatctgaaaacatcattatatatagatggagaagaaattccgaaactggagattatgaatgccggagcgacaggttatctattgtctcaaacagataagagttattatttttatagttttggaacaattgtcagtaataagctgcttcctgtggggtggaatatgcctgattggaatgattggaatatgctgaaaacttatttgagtaatgatgcctctttgttgaaaaccgggacatggaaagcaataagtaccggtgccggtgcaatagtaggaactgctaccaatctcacgggttttgatggatatccggtaggaatgtatgccggtaagtttcagtctgcctatgaaggaaaatatctttcttattggactttgaatgaagcagggacagatgcggatgagaaaatattcttgttgagaagtgataaaaacgaaatagcagagggaaacaccgggttagacaaagcttacgccattcgttgcatccgaaagtaaatcgtggaaaattgttcttcttttttatattttgcttatatttgggaagtgaaacttaaatagaagtcatagattatgaagaaaataataaatccctggaaaggtctggaagggtacaattgctttggttgcgcccctaataatgaagccggaataaagatggagttttatgaagatggcgacgaagtggtaagtatctggaaaccccgtcctgaatatcagggatggatcaataccttgcacggtggtattcaggctgttctcatggatgaaatttgcgcttgggtgatacttcgtaaattacagacaacgggagtaacttcaaaaatggagactcgttaccgcaagccggtcagtactactgattcccatattgtgttgcgtgcttctattaaggaagtcaagcgaaatattgtaattattgaagctaagttatataataaggatggcgaagtatgtaccgaagcggtttgtacgtactttacgttctcgcacgaaaagtcgaaagatgaaatgcactttgataagtgtgatgtagagccagaagagatattgcctttaatttgaaataaaaactgaactttttgtgataaatgtttggaagtatcaaacaaatgctttacttttgtcgcattaaataaaagaaatatgaaatatacagttgcacatcatcatcatcattttcctaacgaataactcggtgggcgtgattgatagtgtgtataactctataaagataacgaaggcttaccgaatacggtaagcctttttttatttctgaattgttcgaattgtaaatcataaaataataaataaaatcatgttaagaatcgcagtacaagccaaaggacgtctcttcgaagagacaatggcacttttaggagagtcggatattaaaatcagtacaacgaagcgtactttgttggtgcagtcttccaattttcctatcgaagttttatttcttcgtgacgatgatatcccgcaaacagtagctaccggtgtagctgatttgggaattgtcggtgagaatgaatttatggaaaaagaggaagatgctgaaatcatcaaacgattgggattcagcaaatgtcgtttgtctttggcaatgccgaaagacattgaatatccgggattgtcatggttcaatgggaagaaaatagctacttcttatccggtcattttgagaaacttcctgaagaagaacggagtaaatgcagagatacatgtcattaccggttcggtagaagtatctccgggcattggactggcagatgctatctttgatatcgtaagttcaggatctactttggtaagcaaccgcttgaaggaagtggaggtagtgatgaaatccgaagcgctgttgattggcaacaaaaacatgagcgatgagaagaaagaagtactggaagaacttttgttccgaatgaatgcagtaaagactgccgaagacaagaaatacgtgctgatgaatgctccgaaggataaactggaagaaataattgccgtgttacctggtatgaagagccctactattatgccattggcacaagaaggctggtgctctgttcatactgtactagatgaaaagcgtttttgggaaatcattggcaaattgaagggactgggtgctgaaggtattttggtgttgccgattgaaaaaatgatagtctaataagtttgaatgatgaaactaatcaaatatccctccaaagaacaatgggcagaacttctgaagcgtccggctttgaatacggagagcttgttcgatacagttcgtactattataaataaggtaagagcggaaggtgataaagctgttttggaatatgaggcggcttttgataaggtgactttgtctgctctcactgtgacttccgaagaaatacagaaagccgaaggactgatcagcgacgagttgaaatctgccattacgctggctaaacggaatattgaaactttccactcttcccaacgcttcgttggcaaaaaggtagaaacaatggaaggagtaacttgctggcaaaaggcggtaggtatcgaaaaggtggggctttatattcccggtggaacggctccgcttttctctacggtattgatgttggctgttcccgcaaaaattgcgggatgcagggaaattgtgctttgtacccctcccgataaaaacggaaatattcatccggctattctctttgccgctcaactggcaggtgtcagtaagatattcaaagcgggaggagtgcaagctatcgctgctatggcatatggaaccgagagtgttcctaaagtctacaaaatctttggccctggaaatcaatatgtgacggctgccaagcagttggtaagtcttcgggatgtagccatcgacatgccggcaggtccttccgaagtggaagtgctggctgatgcatctgctaatccggtgtttgttgcggcagatttactgtcgcaggcagaacacggagtggacagtcaggcgatgttgataacaacctctgaaaagcttcaggcagaagtaatggaagaagtaaaccgccaactggcaaagcttcctcgacgggaaattgctgcgaaatctctggaaaacagtaaactgattttggtgaaggacatggatgaagcgttagagttgacgaatgcatacgcacccgaacatctgattgtagagactgaaaattatctggaagttgctgaacgtgtaataaatgccggttccgtcttccttggctcattgacgccggaaagtgcaggggattatgcttccggaaccaaccatacgctgccgactaatggttatgcgaaagcatacagcggcgtgagcctggacagctttatccggaaaatcacgtttcaggaaattcttcctcaaggcatgaaagttatcgggccggctattgaagaaatggcagccaacgaacttctggatgctcataagaatgcagttacagtacgattaaatacattgaaatgaaaacattacaagaacttacccggccgaatatatggaaactaaagccttattcttcggctcgtgatgaatataaaggcgctgtggcttccgtttttctggatgcgaatgagaatccttataacctgcctcacaaccgctatccggaccccatgcagtgggaactgaaaacactgttgtctaaaattaaaaaggtttctccccagcatatctttttaggaaacggcagtgatgaggcgattgatctggtgtttcgtgcattctgcgaaccgaaaaaagataacgtagttgctatcgatccgacttacggtatgtatcaggtctgtgccgatgtgaataatgtggagtaccggaaagttttgttggacgaaaacttccagttctcagcagaaaagcttcttgcagctacagatgagcgtacgaaactcattttcctgtgttcacctaataacccgacgggaaacgacctgctacgttctgaaatagaaaaaatactccgcgaatttgaaggattggtcatattggatgaagcgtataatgatttctccgaagcaccttctttcctcgaagagctggataaatatccgaatctggttgtttttcagactttctccaaagcttggggatgtgctgctatccgtttgggtatggcttttgcatccgaagcaattatcggaatcctgagtaaaatcaagtatccttataatgtgaatcagctgacacagcagcaggctattgctatgctgcataaatattatgaaatagaacgctggataaaaacattgaaggaagaacgcgactatctggaagaagaatttgcgaaattatcttgtacagtccgaatgtacccgtccgattccaacttcttcttggcgaaagtaacggatgcggtgaagatttacaattatttggtaggtgaagggatcatagtgcgcaaccgtcattccatttcgctttgttgcaactgtctgcgtgtgacggtgggtaccagagtggagaataatacgttacttgctgccctcaaaaaatatcaaggatagtatatgaagaagaaaatattgtttatagatagggacgggacattggtcattgaacctcccattgattatcagcttgattcactggaaaagctggaattttatccgagagtcttccgtaatttgggctttatccgtagcaagcttgattttgaatttgtgatggttaccaatcaggacgggctgggtacatcttcgtttccggaagacactttctggcctgctcacaacttgatgctgaaaacattggccggagaaggcattacctttgatgatattctgatcgaccgtagttttccggaagataatgcgccgactcgcaaaccgcgtacaggaatgttgacgaagtatattgataatccggaatatgatcttgcggaaagctttgtaatcggtgatcgtcctactgatgtggagctggcaaagaatcttggttgccgtgctatttatctgcaagaagcaacagatgatttgaaagagaaaggtctggaagaagtttgtgcacttgcaacaacagactgggatcaggtggcagagtttctttttgccggtgagcggaaagcagaagttcgccgtacaacgaaggagactgatatttatgtgtctctcaatcttgatggaaatggaggctgtgatatttctaccggtcttggcttcttcgatcatatgcttgaacaaataggcaagcattccggaatggatctgaccattcgggtaaaaggcgacctggaagtggatgaacatcacaccattgaggatactgccatcgctttgggagaatgtatttatcaggctttgggcagtaagcgcggaatcgaacgttatggttatgctttgcctatggatgattgcctttgtcaggtttgccttgatttcggaggtcgtccttggttagtatgggatgcagagttcaatcgtgaaaaaataggggagatgccgacggagatgttcctgcatttctttaaatcattgagtgatgctgcaaaaatgaatctgaacatcaaggctgaaggacagaatgagcatcacaagatagaaggtatctttaaagcgcttgcacgtgccctgaaaatggcattgaaaagagatatctatcattttgagcttccttcgagcaaaggagtactataatttacctcatcatattatataatctcataggattgctatatgataatcaataacaaacgaatttggcttggtttatttatcgggatagtgatgtctttttcggtttatggtcaaaacataaacgctgaaaagataactgttcccgatagtaaactgactaatttgtatcagatagactcaggtgtatatcgttcggagcaaccatcggatgctgactttaaggctttggagaaatacggtattcgtgaagtgctgaatcttcgcaacaggcatagtgacgatgatgaggcggcaggaacaaagattaagctttatcggctaaaaatgaaagcgcattcagtcagtgaagatcaattgatcaatgcattgcgcattatcaagaaccgcaaagggccaatcgtctttcattgtcatcacggttctgataggacaggcgcagtatgtgctatgtatcgtattgtatttcaaggagtgtcaaagcaaaaagctattcaggaaatgaccgaaggaggtttcggttttcatcgtatttataaaaatatcattcgcactattgagaaggctgatatagaacgtattaaaagagaagtattacaatagtgcaattgaccgtatgttctgtatgattgatacacagttatgtgacatttctgttttaccccgtataatacttaagataaatacaaaaatgtcacagaagaaagatcaaagagattataaatcttctatttctttaagccagatagttgaacttgcatcacttggcattcgccagtcacctctgggactgatggaaatactacctaccttcggaccatcgggcagacaggagcgcttgaactgctgattaaagaaacgtcggaagaaagtagatagccatttctttattgtttctttgtcatatacatccttgaaagctatattagccagatagtaaatcttggaaggacggaaaccaaaacgcaggaagtaatagaggaaaaagtcatgcagttcataaggccctaccaagtcttcggtcttctgtttgatttccccgttttcgtcagctggaattaattcgggactgataggagtatctacaatatccagtaaagtcgctttagcgtcctcatccatatcattttccgctacccattgcactagatacttcacaagtgttttgggaatacttccattgacaccgtacatagacatgtgatctccattgtacgtagcccatccgagtgcaagttctgacaagtcacccgtacccactaccattccccaagtttggttagcgatatccattaatatctgtgtgcgttcgcgtgcctgagagttctcataggtgacatcatgtacattgatatcatgatcgatatctttgaaatgctggatacaggcatcttgaatactgatttcccggatagaaatgcccaatgatttcattaaatcaatggcattgttataagtacggtcagtcgttccaaagcctggcattgtaactcccagaatatctttgcggggtaaaccgagtttgtcgaaggtcttcacgcagactaataatgccagtgttgaatccaatccgccggaaataccgactacagctgttttagctttggtatgaaccagtcgttgtgccaagccggctatttggatagagaatacttcttcacaatgctcatccagttctgctccttgggggacaaaaggatgtgaattgaagtctcgggtcaaagtaagctctttgctattaacaaactccgttgcgacggagattgcttttttatctcctggatttccctggctggcagcaaaagtggtgttaattctacgttctgcccgtatgcgttccacgtcgatttcgctaatgatcagttgctcctccatgcagaaacgtttgctacgtgccagtaatgagccgttttcgtaaatcaatccgtttcccgcaaagactacatccgtagtagactccccgaaaccacaggaagaaaatacgtatcctgcaatgcaacgtgctgattgttgactgataagagaacagagataatgatgctttccgattccttcattatcggcagacatattgaaaataatttctgctccttgtaaagccaatgaggaactgggaggtatggtagcccaaaggtcttcgcaaatttcgatcccaaaagtcgtatcggaagtttcaaacagcaggttggcacctatgggaacgatttgtccgcataggcgtacggtatcttctgtcagttgaagggcagaagtaaaccagcgctgttcgtagaactccttataattggggaggtaagttttggcagcaacacctagtacttttcctttttgaatcactacggcggcattgatcacggttgaattgactactaccggcatgccgacaatagagatgatgtccagttggcgggtattattgagtatctgcattagccccatctctgcttcttccagcaaaatctgctgtccgaataagtcaccgcaagtatatccggtaatactcatttccgggaatactatgatttgcacacccttaccttcagctattgcgatttggctttctattctctctacattgaatttacagtcggccactttaacgtgtggcacggctgcagctacttttacgaatccgtagttcatcttgtacctttttatatatagtgggtacaaaaataggaaatagttttggatttttgcccttttgactctgaatcctcaaaatgaggtgtcttatgtcgttttaatgactattgcataagcaactaataagaatgtcaaatggaaagtaatatggtcttatttttgacggtttatatgggatatatctatttgtttattaatattttgttaattatgcaataaaaagacatttgaggaaatttggtataaaaaatgagactttttgttttttctatttaactattataattatatttgtagccaaattaaagaattttataggcaatttacacctaaac

SEQ ID NO: 227 - DNA, 10063 bp, Bacteroides thetaiotaomicron
atattattcttcattattggaaaagatagataagaaactgacaggtagaacaaaattagtgtgcgagtggttttctgtagtatcctctaataattaatccatatatattttaattcattgtttcattccttctgtttccacacataaaagacagttcgtcctgctcccctcttgcgaagagttccctccttgatgaaagtattcaaatcatcaattgctttcaatcgggggagtccggtcagtctgctatattctatacgcgtgattcctccgtttttcttcagaaattcctgcaacatttggagacggtcttcaatggatattttagcattgtgagttttttcattggagttctcaactcgttcaagttctatctcccgctttattttctttttaaattctttggaagtacgtaaatgaacattgtcaaaacggatagactcggcgcgaatttctttcttagtcatcactttatgggtacacttcaacgaaatgctgaaatgtccaagttcgcccaattccacgatgtatccatccgccaaggcttcggccagttcatcaactacagcgccaagtactccttcaattatattgtgcggaaaaggttggtgacgggatacgcgttctataaaatcttttttcgaataagttccactcggaacaatgcgggcatgaaggggttgtttctcccctgtatcattagggtccggagtctcatacaaatcataaaatgcactcattagtatattttttattagttgtttatgtgtctatcagtttattcgctaacatttcagtcctcttatactaaaccttaactttagtttagcataaaaataatcgtctgacaactgtttctttttcgtctgacagttgttagacgaaaagataacagttgtcagacgaaagttcaacagctgtcagacgaatagctcatcgcatacaaaggtacagttttatgtaatgcgaactgtaattcttagcaagaaaaaaattattcaatagcaaaacgcgccgtcatctcataccgcaatgtaataacgcgatattgctcagtggcagctgtccccatactgacattactctgtgcctgataaagagaataaggacttacatagctcgaagccggttcgacaatacgaatgacctcacccagtttttgtcccatagcttccacaagataagatgccttttcacgtgctgctttcaatgcttctatcttaccttgtttacgatagttcggcaaatccttgtgcttcagctccccgatacgcatggactcgatgcctttcgtatcaatcttcttaataacggcatttatcttttcgaagtcagtaaaccggatgtccagttgcttacctatcagaaattcttttcctttctgacgccaatagtctccgatttcctgcacacgaatagcctcatccgaaattcccgctctacttagtacccgacgcaaatctttttcaatccattccaacggaactttcgttttataatcttccggcttggacttcggcacaaattcctctttccaatattcctttatctgaatcaaaagatgaatctcatccggcacaacttctatttcagaagaaccggttacctcaatatatcttctctcactctcctgagcatcggcaacaacactccatacacataaaacaatagctaataaaaacaactttctcatatctctgaatttataatagtacttagtttctgaattccctgtcccatatcagacaaatgtagtaataaaaaatcaatcaatgcctgtttttaccataaagctatccacaaagtccatcataacaagcaaatgttctttatccatcaacaggatatctccgtcctttactttatatttctgcggctctttaccggaaagaagcgaaatcactccctgttcaaacagacgccttagctgagtgctggaaagaagaaaattcctttttaataaagacgacaatttcagattaaattcaaactcatatttgatttgaatctttatggttgcatcgggcacacggattatatcttctttcgagaagttatccgtaacctcatattctacactatcataatccgttttcaaatgattcctgccggcaagttcggcagaaaaaacatatttccaggctgctttccgatcgttcatggaaaagctatgaaacaggactttatctatcaaatccggtttggtacgtgacagcaaagtaatgttgcatgtattatcgcatttcacacaccgatatatcagccagacatcgatgttctttttctgcgcattcattctaaacttatcactacagtaaaaccggtcactatcgcaatgactgcatttcttaattaataaaggagaattctttgcctttatctcccatgtaaatgttgtatccataaagcaaagttggatataatccatttataaaattcacaagatgtcacaagatggcgtgaaatttatctgtcgagctcctccatcatcttctgtattttatccttcaacttatcaagaaattgtgtcctgctcttcttccgattcctaatttccaagaagatacgataaaagtccccaatctcgatattgaaaagtatctcgcaacaaaaagcgatgtctttcagactggtatttccattattaaagcatttgcccgcatagatcgcatagatgaattcaaccaaggcgactttactatccgtccattgcagcaacttactgtctactatggaggtgaatttaagatgcagtttgtctgacagcgaatcgatctcgtctgacacatattctatcaaatgactattcgccagaatcattgcaacgcttgaatcgtgtaaggtggtaaaagaagaatccctgtccagcaaatgacaatgaacatcggaaagaatatcataattctcacggataaaatattggttatcaagttcggtctgaccggcacgataataatcatagaagctattattcaaaaatgacttctgtatattttccagctccatctttaaatatttgcattgagccgacagggatttgccgacacggttcttttcaatctgatataaacggatataaaacatcagcaagccggaaatctgcggtttccagactttaaagaactgaatttcttcttcaggattctgaaattgatattcggcaactgcccttttcagcaaagtaagtgatgtctgtatgacatctattatctgctttatccgctcgagaagggcaatcggctgttgctcaatccttttaatttctttttctatgttcagcttactatttcttacgaaattttccattcattctcaatgtacccacagctttcgaaccgtcaaaaggagtctgactaaaagcctgaataccaaattgcactcgtcttaaaaaaacgatgctgtgaataataaaattgataaaatgaaaaaccggttcaagtagaaatactcaaacgaaagaaattagcctgtggtttatgaggctaatattaagctataacaaatttaagaatggtgctcaaaatagttgcttttagaattcagatgcaaatataaccgattttttatgattatgtgaagtttatatgaaaatttgaaaacagcctgcgggaagctacagaaaaatactatctttgccttcggttcttcacaaacacagtgatgaaaccattctttttaatcacataaataataaaagaactatgatcagattaaatgtttttgttcgtgtaaacgaaacaaaccgcgaaaaagcgattgaggcagcaaaagaactgactgcctgctctttgaaagaagaaggatgcattgcttacgatacttttgaaagcagtacccgccgtgatgttttcatgatttgcgaaacatggcagaatgctgaagtattggcagcacacgaaaaaaccgctcattttgcacaatacgtaggtatcattcaggaattagctgaaatgaaactggaaaagtttgaattctaaatgaatgccagatagacgaaaaacacgtcttccagcctaaacataaaagagaaaaacagtccttactttgggaatgtctttctcttttttcgtacacaaatgtaccgttacctgtcaattttataatcgctccagatcaagattagtcaagctttttatgaataaaggtaccttcaatccagtaggttgcgtgattggcggtgaactttagcaatacatagcccggatctgtaggaccaccgggaaagtgttcgataaaccagtcctgccaaagttcctgcttcagtttctcgtctgtcacgacttccacttctcccatcaatgccacactgtcccccttctcctgaaaacataatcctgctttcggattcgataaaaaatcaatagtctttaatgaatccgctccggtggacatccagatagtggaaattccttctgctgcaattttactcattggcacaggacggggatagccttccttgttcacagaagcaagggtgacaacttcgcatttctgcaataactccaccgctttctctttcatagtttttgttgacataatcttattgtatttattttatttcgccacaaagataacggcacagatgtccgttctattgtaaaaaatcgacttttactaatccggtgctaaggttcgatataagtcagcgttatatcctccggaactgtaagcgaaaggaatgatgaaggtgtattgcccgacaatgttttgatttcttttgagaaatgtgccaggtcataatatcctgcgtcgatggcggtagtcagcaggttgacagaagtcgtgtttctcagtaattctactgcattcttgaatttaacaatgcggctatattctttaggagtgaatccggtgttatgtttaaacttccgttcaaaatgacgctggcacaggcatacctcatccatcagactacgaacagaacgcttccctgcggactgattgattatattcaccgctgcggcaacttgggtatcaacaggctgatagttatgtgcaagatacgccaggagatattcttcaacgacctgaatccgtccccggacatcattctgctcacataacctctcgataaaggtactgtcaaaaaccgcctgcatttcattcgtactgattctgtaattcgcaaactcatgcaaaggcagctttgtaaatccggataacccacaaggcagaaaacggacgccaaactgatgaacgaattcggcataagtgacaagctccgaatatttcgtcatcggacccacaaagtaagaacgataaggctgcatgaccagcgtttcttcttttaccttactcactgcttctcccaacgtaaaaatgaaatcggtacaaccatccggcaaaatatggatacgcataccatattccggagttcccttaaattcccaataattatcaatatagggagcgagtagacgagagggctgatattctgtgtacatcggtctattttatacgcaaatataaagagaataaatgccaattcatgtattttgcaaaaaatatcatgtacatttgtgtttcaaaaaacagcaaaacgcatgaaggactttgcagctatcgactttgaaacagccaacggaaagcgcaccagcgtatgcagcgtaggggttgtcatcgtgaggaacggaaaaatcgttaagaaaatctatcgtctgatccgtccttgtcccaactattatacgcaatggacaacagctgttcacggactgacttacgcggatacggaagaagcggaagattttcctgatgtatgggcagaaataaaaccgcttatagacggtcttccgcttgttgctcacaacagtccttttgatgagggctgtctgaaagctgttcacgagctatacgaaatgacttatcccaattataagttttattgtacttgccgcacttcacggaaagtgtttggaaaagagttgcccaatcatcagctacatacggtggcagcccgatgcggatatgatttaaccaatcatcaccatgctctcgccgatgctgaggcttgtgcacaaatagccttgctcatcatccccgagcctaaaaagccaaaagttgatttgcacaccggaagcttattttaatacgaaagctccgtaaatgagcaatataaaagacactaccactattattactgtcaataatagccgtagtgtctttaaaatagattgctaattatgaattctgcttatagaatagactttgcaatacccatttccaaaccgcgaagttctgccaatccacgcaggcggcctaagcaggaatatcccggatttgtcttcttcttcagatcatcaatcatctgatgaccgtggtccggacgcatagcgatagaacatttacgacgttgttgcagaagaatcaggctcttcattacgttgtacatatctacatttccttccaggtggttagcttcatagaagtttccttcttcgtcacgctgcgtactacgcaagtgtacaaagttgacacgatcgccaaaacgctccatcatacctgcaaggtcattgtcagcacgtacaccgaaagaacctgtacacaagcaaagaccgttagattcgttaggaacggcttcaatcagttttttaaagtcctcttccgtacttagaatacgcggtaaacctaaaattgtataaggaggatcgtccggatggatcaccagcttcactcctacctcatcagccacaggtgcaatttctttcaggaagaagatcaagttagaacgaagtttctcagcatcgatatcattataacgatccaatgcttcctggaactgttctacagtgaaactttcttccgatcccggaagtccagcaatcatattacgaaccaacaatttcttatcgtcttcactcatttgttcgaaacgggcttttgctttggctatttcttccggagtatagtctttctccgcattcggacgtttcagaataaagaggtcgaaagcaaggaaagccgctttctcaaagcgaagagctttagaaccgtcaggcattgtataggcaaggtccgtacgtgtccagtctaatacaggcatgaagttataagtaactaccattacaccacatttagccagattacggatgctttccttatagttttcaatatatttcagatattcaccggtctgcgttttgatatgttcgtgcacaggtacactttctacaacggaccaggtcagacccacttcttcaatcatttgcttacgcttcatgatttcttctactgtccacacttcaccattcggaatgtgatgaagtgcgtttactataccggtagcgcctgcctgtttgatatcccacaagcttactgggtcattcggaccataccagcgccaagtttgttcacatagatacataattatgataagtattaagtaataagtaataggtaataagtaataggtattaaatggagaatgcgtcgaaacctccgtcgataacagctactgtacctgttacgaagttagaagcatcactgatcagataatgaatagttccgtaaagatcttccggttcaccgaaacgattgaacggagtatgagcaagaattgtcttggaacggtcagtcagagaaccatcaggatttgtcaacagcgcacggttctggtcagtcaggaagaatcccggggcgatagcatttacacgaagaccgttaccgaatttcaaagccagttcgccagccatatatttagtgaagttagcaatagcagcttttgcagctccgtaaccaaccacacgtgtcaacggacgaagagctgattcggaacagaagtttacgatagaacctttcttctgttctaccatgatttcagcaaataccattgtaggcaataccgtaccaaacagattcagatccaccactttcttaaaggcatcaatctgcaagtcaaagaaagttttgtccggagcaattgttgcgcctgccatattacctccggcagcgttcagcaatacgtcaatacgtccataggctttcatgatctccactttgttaccttccagcacttctttgtccattacgtccgtatacaggaacatagcttcatttccttcagctttgatactttctaccaatgccttacctgcttcttcgcttctatcgagtacaacaactttagctccttctttagctaagtatgcagcgatacccttacctaagattccggctccaccggtgataacaacaactttgtcctttacgttaaataattcgttcatggttcttttatttatatggtttataacttattgttcagataatatttcagattttcttttagaagaatatcaatcggcatcaggttcaccttttcggggttctgcttgaacagcaaatgattgcacaatgacttaatgccatcgtacccctgtcgttcggggcgctgtgcaactaatgcagtgataacaccatcggagagcagttgagtattcctttcaataagatcgtagccaaccaattttactttttgcattcctcttgctttcaggtagtttcctaagatatagcaagttgaattaaagatgattcctccttctatagttgcattcgcttcaaagatttcatccagtttgataaaattgtaaaccgaatcattgattttcaattctacttcatgcaaatttccggtaaatcctgtttctttcagataatgacaaaagccttctctccggttttttccttgatttgagtcgttttttccactatgaataattcgtgccatcagaatatccgaagtcgaagaaatcttgtctgtcaataatcgcgcagcaatcactccggcatcataagactccgttccgaaatatgccaactgatgttgcccttcaatattggagtcaacataaacatagggaatttcattcctgtcaagctcttgcgaaagccgtataacagagtcggtaaacagtgttgcaatcaataccccatctactttttcatccaacaggttgcggacaatatcatcaaatgtcttgttattgtattgatcgaaaaagagtttagtgatcgttatattataagattccatctctgaagccgccttatcgataccatcggaaatagcttcccaatattctccgtgcgtaaaagaaggagtaattgccacaaaatgatattgttttttagatgccaacgaacgcgccatcagattcggctgataatgaaccatttccagaatagtctgaactttcttcctgttctcttcagatacccgtccacgattgtgaatcacccggtctaccgtaccgacagagactcccgccatcttggcgatgtctacaatacgaatatttgagaattctttgtccatttactgataagtatcttgtttttcgacgacaaatgtaaaatgaattattgaattaagcaaaagtgtgtgcgcacacacgttctactataaaaatgctataaatatgatattcagatatttaataaaggaaggcaagtaatacgtatgttgttaaacataagaaaaataatggaaaaagccatcaaatatatgtttgggaggtaataaacaccatgacagaaaagctttttatctgtgaaaagaaacaaaaagagggatataaaaggtaaaatgtgtacgggcacacactgatttgtttatgcataaacagatatgagggatagtgacagtatttggttaaggtaaattttcaagaagaaagctattagtataaaagaaaagtgataaccggttattttaaacctgattaccactttcaaggatgattatttctcccatttttcttttgcttttccaactgctttatcagcctcttcagctactttatctgcgactttagctcctgtttcaacagcttttaagccaagattcatcgcttttctttcagcttcggctgctgctatttcagcatcacgaccgatacggtgaatagcgttataaatatcactttccaactgtctggcttttgctgtacgtgaaagacgataagctactgcaccaaggattgaaccaattccaagtccaatccagaaattcccatgtctacattccataattaagttctgtttttagattaaaaataaattatat

SEQ ID NO: 228 - DNA, 10038 bp, Bacteroides thetaiotaomicron
ccataaaagaggatacgtaaaaggctccagatgatatatagcgctacagaaaatatgagcacataaaaaaatgaagttatcatctccgtcaaaggagtattatacgtaaatatagagtataaattgaccaaattggcaataataaaacacaggaacagtgtaatcaactctgttttctttcgtcgagcggtcaggattgtatctttcatactgcttcggatgtttttgattgatgattcagataattaattttgtattcatcagggaaatatagtgttttttcttcctgtaacgcttggtgacccaataggcagagcatactcgcataatatccttcttccgcgattcttgcgggttgtttgcgagtaataacagcttctacaaaagcttccaataacaaagaagtgccatcgctcttaggacgttctccgaggattaattctcctttgttttcgttagccgtttccggagcccaactggtacctgcgaaaggcagagtgtcaaataatttattttcccaatcgtttatcatttgcagaaaaccgggtgccggcgggatactttcaaagtaatatttacctttttctggttcaacagttccgagatttcccatgatttgctcttccaaaccataaaattgattggaaataacagaatcgaatgtcatttttacgccatcatcgaatacatataggcaacttacattgtcgtatacttcccgaccgtctttccagtatgtaatagctccatgtcccatcactttctctgggagtttattcaatgcccaacttcctatttgtaattgatggcaggccagttccgtcattagtccttttgaatactctttatagagtcgccagttaatttgtcgttctaaattagcagaaggaactgggcgtctccagtctccatttctgtaccagaatgtgcggatcgcatttatttctccaaatgtgccggcatgaatcatttccatagctttgatataacgaggatcgaacagacgctgttgacctgtgaagaatatttttcccgtactacgatgtttattgtacatacggaaacattcttccattgtaaaaccaattgttttttcacagaatacatgtttaccggcatcaaaagcatccattacaattttacagtgcgaactgagaggagtcgctacaagtatagcatctatgttgttgttttccaatagctcacgatagtcaccatatacttttgctttgggagcaagcttcaatgcttcatctatcgaaggctggtaaatatcgcaaagtgctacgatatcaactttaggattttggactaaaaagctcataaggaagcgacctcgtgagcctggtccaataacccccaaacgacatttttcattggaggtgttcacggcttctgaaaaggcagaaagccagggacttgctgcaagaagaactccagctccggtcattccgatattcttcagaaactctcttctgctaatttgcgtatgtttcattttgaagttatttgattctcagtattttattctgtatgcaaatatagaaagaagagtaaactttctataaaattcactcttctttttattaaaattggcatttaccattcaattgcctgatcttcgtctggtatttgagtatttattttacgttccatcgttagagatccctttacaacatattcaagcggataacccggaactgaagtataatctgtaaactcatattccagattgttgattgttacgtaaatatgttttaggtaaggtcgtgtagcatccatctcttcttcaaccgtataggaaggttgccctttcactaccagatttatgtcctcattatcagaagaaatcttcagcttacgtgtttgaagatctattttctcttctgtaaattcaaatttaattttgtaatatttccgatccaagcggtcaatgtctataaggcccgcatagaaaaatatagttttgtcatctattacataagaagtatggtattccggaactatagcctctttttcgtttcctttaaaatatactttatacgcagtagcactatattgcccggaataatcattgaatggggaaatacgtaacatcgccctcctataaaatttgcggggattggcctggtagttgtgtgatggatcgttgctctgaatagctaacggcaatacccatttgtctacctgatctaaatctttcagggcaaaatcgataggcagtaagcttgtacattcgcctgccggtatctgtactgtttccgggaactcgtaatacttgttttccaacggtttaaagaaaagttctttacggctgccgaaatgttcaacattcaacacatccaatgtgtcaagatccaatcctacatgcacattcaagtctttggaattcatggttgacccgctgactatcaatgggagttggtatgttactttcccttccggcttgtaacgtatgtaaataggagttactccttgtgcgttgactggtgccttgaaagataccatttgcacatattgttcagattcccattcattattgcatgacgcacatactatcagtacagtcatggctaagagtaaataatatatctttttcatttttttcaagtttataagattattccggataagtccagcctggattttgagttaaacgtttgttgcgctttaattcagtatgattgattggccaaaaccacattttgcgtgagaaggttgttggtaatgaaggtactgctaccggtgtatggaatacatctgccatttctttagttgctaaagtgttacacccataaattggagttgattcttctaccggagcatctagccaacgacgtaaatcaaaatagcgatgtccttctcccatcaattcaatctgacgttcacgttttaactttttgcggaattcgatagggtcatcatattcttcttgggtataatcaggaactcctgcacgaatacgtataggacgaattccttttttcatttcattgatatcgcgtttgattatatgagtcttattaccatcccaagaaggtatgtcgtattgcccgtttaattcgttcaatgcttcggcataaatcaacagaacttctgcataacggatagccggttctactttctttttaataagttcttcattgttgtctcctttacccatatcatccgggtgtacaaattttttaactccaatgccggtgcgtaaccaaaacatcgagtttgtatacccattaccgtctccacggtaatagaagacttgtatgttttgaggttctcctgcatttttattgctgttcaacaaattccaaacatcaccattgtaggctactgaagcatagaaacggggctcacgattagcatactgtaaagagacgccttctgacaaaggtttgtaacgacctgcttctacgtcttctttcgtcacatagccggacatgcgttccgaaccgtcaccgcggttgatttctttatctttaccgggacaatcagttccatcattcatataatatgcgtcacattgtttctgtgtaagtccgtgtgtattccatcctttagcaacacgtggtagctgatgtattaccatgttattaatgctttggtcaccagtattctgcccacgggtaaaaattaattctttattctcaaaagcactgactgttccgttgaatatagcacgataagattcgaacggatcgatgtctttccacccattcggccaagcttgttctgagaattcagggtggtatggaggagcaatcgttgcaggaaatgcaatatcccctttgtctgtagcataagaaacaaacagcgtgtaacggttcaattctatcacatccttggcagcggcagcagctttcgcccacttagattcatcgtaagcttctggtaacagtcgattaccttgatcatctaccagttctgaagcaatatcagcaggcgtttgtccattcattaatgggctggcagcatatagcagaactttggcacgaagagctaatgccgcaccacgggtggggcgagctatttcttgtattgcacggtctaaagggagagcttgcgcagccagaactaattcatttgtgatataggtcacacattcgtcatacgtattacgcggttgtgctactgcatcataatcttccatgtagtcaatgccttgatccggcacaataggaacaggaccgaacaagcgcaacataatccagtagaaataggctttcaaaaagtgcgcttgtgctttgttgtcagcaatttcttccgctgtatattccgtattcatgtctatattgttcaaatatatagaggcttggcgaatgcctttataacatttgttccagatttctgcactttctcctgctaaacctccttcgttatattcaccgtttttccatgctttatatcggtcatctcgatcaccgaaatacatgtcatcagcaaaacagaaaggaacatatcctttactggctacatcgagaagatggttatctcccaaaaagaagtatgcgcgtgccagccatttgtcagaataagctctgcttgtaaaaacatcttctattgacatacgctcatcaaatagataatcagagtccaagtaatcggaacatgaactgagggtaaatcctatccctattataaatgataaaataatgtatattttcttcataatgtcattgcgtgtattataaattaacggatattcctaaagataaatttttgctgagcggatatctctttccatccgtacttcccatttccgggtcccataatttgaatgcagaccatgtgagtaaattggtgccaacaaagaagatacggacagtgttaaaatgtaccttatttaccagctgggttggtagcgtataccctacttctacagtctttaaacgtagataagacccgttgcgtaaccaataagtagattgctgatagttattagaattaggtccgtaggatagtcggggatattcagcattcggattctctgtagctggatcaccagatatatctgctgaaatccaacgattggaattagccatctctgacaggacatttccccagccatctcccaacttgaacatatggactgttgagccatcgataaaataagttgattttccggctccctgaaagtgcagattcacatctagacctttccagtttgcagctattccgaatccataaataagattaggtttggtcgttgcaccgattgcgacttggtcattaccgtcaattttaccatcaccattcacgtctttatatttaatatcaccaggcattactttataaccatcgaaatcttgtaccggactattacggatatcatcatagtctttaaacaaccctaaagatatcaatcctcttgcttgatttacacgatgtcctttttgcattttataccagtagtagttgttttcttcatctctatctactatttcatttttgctataagtgatattactacgtattgttaagccaacagctcccagtttctggcggaaagtgaaatgtccgtcaaaaccttcagaagtcacttttccaacattggcactaggattactttctaaaccgactatccccggcaaatattcgcgtaacatatagattccttcgcgtttctcattaaaatagtcaacagaaccggataatttgtcattgaaaaaagagaagtcaataccgaggtcatgctttgttgcaatttcccatgtaacgttaggcgaagataaagaagaatagcgcataccaccataatatctgtcaaacgtgtaatctccaaagttgtatccaccagtgtctacagttttgtcaccatcttttttagtcattgtttcaatatcataaaggtaggggaaacgagtatttcccaaattgtcgttacctactttaccgtatgaatatcgaattttgaacatgttcatccatttaagatgtttttttatcaaagactcctcagctatgttccaagctcctgagatggcagggaagaaaccaaaccgatgtcctgctgcgaaattctccgaaccggtatatccgaaattgaaatcaatgaaataacgataattccagttataggtaaatcgtcctgccaatccttgattacgtctggcaataccttgtttaagatcatctccaaggcctaccgtttttatttttgaagactggttatattttaatgttcctcctagatgatgatgtttgaatcctcggctataatgtaactctgcttcaaagaattcatttctaaggccatcggaaccgctctcttgaaacatctttctttcttcagctacacggtcataatcgagggttccgtctgttgcgcggaaacgttttgccttccactgttccggccattttctgcggttaatccagttgttattttctgtgtcatatccgaagcgtcccacgaatctaagtcctttggtgatgaaatcaagtttctgctctaaggttacattagtctggatattattcttccagttttcccgataaccagtcattgtagcttgaacccatggattaaagcgatctccattgtcatttccataggctggtacgtatccattagaatataatttaggaaccataatggcattatatcccataagagctgtccaaatagcatcactgccaactcctgaatcattggccttttgtaatgaacctgaaacaccgacttttaatagagttgatttagtgatgtctatatctacattcatgcggtaattccaacgacggaaatttgcatttgtattgtaatctttcaaagctttatctactttgtacataccttgttggtcaagatagcttcctgatacatagtatcgtgctgtattaccaccaccgttcatgcttagtgtggcacgagtgctccatgaaccttttcgtagtaattcatctatccaattaacattgggatataaatcaggatctagtcctaaacggaatatttccaattcgtccgctttatatagcggctcaagattacgtgtgattttagcttcatttgccatggaagcatatgtgtatccatctacaaagtcaggaacttgggtgagcatattgtagaacgtttccgcttttgcactgatattaattttcccggctttaccgtgtttggttgtgattaatactactccatttgcacctttggaaccgtaaatagcagtagctgatgcatcttttaatacggaaaaagattcgacatcttctacatttatttcatccagactacgttcgaatccgtcaacgagaactaatgcggaattactggctccgaaagttgaaataccacggatccagaattcagaaacactacccggctttccggaagtttgcatcgctaagatgcccggtacattacctgccagggcattagccatagaacctgagggatttgcttttaagacatctacatccacattagtaatagcacctgttacagtcaacttcttttgggcaccggtacccgtgattaccacctcgtcaatctctctagcacttgcttctttcattgtgacattgacagttcgttgctctttgactaatacttctactttttcaaagcctatataagtaaataccaatttgtggtagggtggcattttaatactgtattttccattcaaatcagtaatggcacctaagccgggtatattacttattgatacattaaccccaatcatgggctctttatttgtatcagttacgacacctgttactacaatgctttcttgtgccaaagcactggtagaaagtccaagcaacaacatgcatataaataaaaagtttttcatcatataaatgtatgtgttaatcatgtattattcttcgtagccaattttgcgaatacggcggttttcacggtcacctataaagaaacattctctttcttcatcgtatacgattccttcaggatgattgaagcgtgcttcttggcgtaaatcaccatcattatatccggaagttccattactgcctctaccagcaaatgtcgttactcgaccttgtggtgttaagatacggatacagtggttttctctatcacagaaataaaagtcatattcatcgctgctccctttgtatgctggattctttacgaatgtaccttgtcggggagcatgcatgcgggcttttttaccaactccatctacccaatctttggcaccctgctgaccacaaacaatatatggggtggtaaggcgctttgtcttccagtcataatcagaacgtaagatgtaatgttgattaactactacaatgtatgcatagtttccgctagggtggaattggatatgaaactcccatccactatcttgtatcgtaaacaaaggggtagtttcctgagttgtaaaatcatatcgaaacacttgaccagcattccatgaattgaaatataattctccatttataggatgagtttctgcaccattacagttttgaccttttgtcaattctgttataactttgaatcctgattcacgtgtaagaatataattgttcggtctatcattattattttggtcattggtaataatcatgctgtcagcttcatgtgtccagcagatggtacgtactttgcttaatccactatatacggtacttacatattctttttcaaagtcaatcaaacgggtagggtgctgttcacccactagatataaatgattgtgatttttgggatcaaaggacaaccaaacagcacctccaaagccaccacaatcatcaaaaggtccatcttttaaatcatatttggtgtttccatcatacattgttcctagaaatgttgtaacaagcatcttcttttgatatacaaacttctcattggcttctgtatttgcaatttcttcaccttcatcgttgagaatacttaatttaatatctccatcataagctttagctggcacaacacagtagaggctttttccttttgctcctacaactttggagtcttgtccaccgatagttacctttattttagaaatatcacttccgaagttttctccatacaagagcattcgggttccaagtcctccttcttttggactgaattcagaaatgacaacaggcttattcggatcaaaatctcctgttgcgtcatcattatctttgcaacttgcaaagataagtgtaagtaaagccagtactacccattgagtgtactgacagcaacttttggtcttacttttcattttcataatacattggattttattggtaaaaatatttgtatgcatttttacagattatttgaattcttattcactagtactttcatccaatatcctccgattacagaacgagccttaaaaccagtcattttgcctgttttcgtatcatgccaatcactgataggtactcgtgaagtcgtttcattgatatatttatagagaggatttataaacttttcaaaagtagcctgatccggagacatagttgcagtccacataatccagtcagactttgtatactctttgcgggagtccaatggcaatccgtaaggattctgttttgtcaaatagtaacttacttccttgtcgattacattattggggaacaaattcagattccacatcttgtcccaaatcatattatacttttggctccaggtattctcacggtcgaaagcaaggcggtaatgatcaccttcatttgccatttcttcccatttcaccgccattttcttggctatacctgcatatttctctgcaacatcatataaaccaagtatatgcgccatttcgctatatccggctacacccatgatcgcttttactgaaagattggcattatgagcccaatgaccggcgaagtcatccgtgcataattggttctccgggtcctgtccaaaccgtatagcaaggttgtaaacggcatattatcaacggtttaattcggtaacgtattgtatttgtgttgttctaactcaatctttatgctatttatcaatagtactatgtcaacaaatttgcattatctcctctaatccgattcatatacccccatgttataaaaatgtttggacatatagaaaga

SEQ ID NO: 229 - DNA, 9856 bp, Bacteroides thetaiotaomicron
gtataagctgtacctttgcactgtctttttaaaaacatatattgttatggaacaacatccaattaaaattaataaagtacagatacgtaatcttcaaattgaagactatgcacagttatcccaatcgtttacccgtgtttactctgacggtagcgatgtattttggactcatgcccagataaagaaattaataagtatttttccggaaggacagattgtgacagtcgtcgatgataaaatcgtaggttgtgctctttccatcatccttgattacgataaggtaaagaacgaccatacgtatgcacaagttaccggtaaggaaacattcaatactcataatccggaaggaaacatcctgtatggtattgaggtgtttattcatccgggataccgtggtttgcgtctggctcgtcgtatgtatgaatatcgcaaggaactttgcgaaacattgaatttgaaagctatcatgttcggtggccgtattccgaattatcataaatatgccgataagatgcgcccgaaagaatatatcgcacgggtacggcagcgtgaaatttatgatccggttcttaccttccaattatcgaatgatttccatgttcgcaaagtaatgaccaattatttgccgaatgatgaggaatccaagcattatgcctgtttgttgcagtgggataatatttattatcagccgcctacgcaggaatatatcaacccaaagacgactgtccgtgtgggactggtacagtggcagatgcgtagttacaagacattggacgacctcttcgaacaagtggagttctttgtagatgccgtatcagattataaaagtgattttgttctttttccggaatatttcaacgctcctttgatgtcgaagtttaatgataaaggagaatcgcaggctattcgtggattggcaaagtataccgatgagatcagagaccgttttataaacctggctatcagttacaatatcaatattatcacaggaagtatgccgtatgtaaaggaggatggtctgttatataatgtaggcttcctttgcaggcgtgacggaacttatgagatgtatgaaaaaatgcacgttactccggatgaaatcaagagttggggattgagcggtggtaaactgctgcaaactttcgatacagattgtgcgaaggtcggagtcctgatctgttatgatgtggaatttccggaactttcccgtttgatggcggatcagggaatgcaaatcttatttgtacctttcctgactgatacacagaatgcttactcccgtgttcgtgtctgtgctcaggcgcgtgcgattgaaaatgaatgctttgtagtcatagcaggttgtgtaggaaatcttccccgcgttcataatatggatattcaatatgcacagtcgggagtgttcactccatgtgattttgcttttccgactgatggaaaacgggcggaagccactccgaatacagaaatgattctggtttcggatgtcgatctggatttattgaatgcactccatacttacggtagtgtgcgcaatctgaaggatcgtagaaatgatgtttacgaagtcagattcaagaaataagagtaaaagcgcctattgattgtaaaaagtatttaggcacggattatacggattaacacggttctaaagacattcatttatagcaaaaactgtgaaatccgtgtaatctgtgcctaaaagagagtaaacatatacctttgagacatgacttttctattatttagaagatgtgccgctttccaatatgctgacgatagaaaacagcgtgaagcaaatagctcccagtcctactaaaactcgtgccggaataaaataatcagcgtttacggtagcaagctcgaatacaaaggcagccagaaacaggcatgctaatgctgtcagtaccggaatcatagggattcggttagccagtttgaactcccgcctccatatcttggcgagtagaatcactttgctggaaatactgtaacataccaggccaagaccaagcatgatgtatccggtagtaccgtttgcacttcctgaatcggcaaggatgacgaatatgccccatacaaaagagatcgatcccattaataaaaccagtttcggccatttgttacgttctctttccgaatagtcgttccggacctgacgggctatggttgctaccaatgcaatcagactggtacaaatacatgcgagccctaccatcacatgacctgctacaaaataagcaggatgagagtgactgttgcttaacaggatgaacgcccatatccatgcgatacaggaaatgacgattgcgagaatgatcattgcccgtctctggccaatagaaaacgctccctccggcacttcatttccggtagctttggcattggccggaatcaaagaaaatcgggtggaagaggtagcggcggtagctacacaagctgtgataaatcctacaccggttatgacatgccctgcgacgaaggctgaagtagtggtagcggcattgaaaatgcagatacctccgacaatcgttatgatagctgccagatagcccacaacaggtaaaacgtattttgtagcttcattataggtatgtatgatttgccggattatagtggctgccgtacagaacagcgcaatgcatatcatacctagtgaaaatacaacaggacctgccaccagacggtttcccgcgtcaccataaccgtaaatgaatgctccgtatccgaagcaaaagaccgccatcgtcaaagggattgctctgaataaaatactaataccgtaattcataacttaagtgctttttattttcccactaaaacaaggagatatccgttttgtttaacgcaacatccatttataaacgataacttcacatgattccaattaaaagtccttgctttttgctcaactaaacaaatgtttttgtaaatttgcacccttaaaaatggggatacccctcaaattgtaaattgtaaatagtaaaatcgtagatatagctatgggtaagagatttactgaatattcgcagtttgacctttcacaggtgaacaaagacgtgttgaagaagtgggacgaaaaccaggttttcgccaagagtatgacagaacgtgatggctgcccttcgtttgtgtttttcgaaggacctccctcggctaatggtatgccgggcattcaccatgtaatggctcgtaccattaaggacattttctgtcgttacaaaacaatgaaaggttaccaggtaaagcgtaaagccggatgggatacgcacggactgcctgtggaactaagtgtagaaaaagcattaggtatcacaaaagaggatattggtaaaaaaatctctgtagcagattataacgctgcttgccgtaaggacgtgatgaagtataccaaggaatgggaagacctgactcatcagatgggatattgggtggatatgaagcacccttatatcacgtatgacaatcgttatatcgaaacattgtggtggctgctgaagcaactgcataagaaaggcttgctgtataaaggatacacaatccagccgtattctccggctgccggaacaggattgagttcgcatgagctgaaccaaccgggttgctatcgtgacgtaaaggatacgacagctgttgcccagtttaagatgaagaacccgaaaccggaaatggcagagtgggggactccttacttccttgcctggacaacaactccctggacattgccttcaaatacagcgctttgtgtaggaccaaaaatcgattatgttgcagtacagacatataatgcttatacaggagaacctatcacggttgttctggcgaaagctttattaaatactcatttcaattcaaaagctgctgatctgaaactggaagattacaaggcaggagataagcttgtaccgttcaaggtagttgccgaatacaaaggtgctgaccttattggtatggaatacgagcaactgatcccttgggtgaaaccggttgaagtatctgaagacggaacatggaaagttagcggtaaaggcttccgtgtaatccctggtgattatgtaacgacggaagacggtacgggtatcgtgcacatcgcaccgacgtttggtgcggatgatgcgaacgtggctcgtgcagcaggtataccgtcgctcttcatgattaacaagaagggtgaaacccgtccgatggtagaccttaccggtaagttctatatgctggacgaactggatgaaaacttcgtgaaagaatgtgtggatgtagacaaatacaaagaatatcagggtgcatgggtaaagaatgcctataatcccgtatttatggtagacggcaagtatgacgagaaagcagctcaggctgccgaatctctggatgtcgctctctgtatgatgatgaaagcaaacaatcaggctttcaaaatcgaaaaacatatacacaactatcctcattgctggcgtacagacaaaccggtgctttattatccgttggatagctggtttatccgttctacagcctgcaaggagcgtatgatggagctgaacaagacgatcaactggaaaccggaatctaccggaacaggacgtttcggcaaatggctggaaaatctgaatgactggaacttaagccgttcccgttattggggtactccactgcctatctggcgtacggaagatggaacgagcgaaatatgtatcgaatctgtagaagaactatataatgaaatcgagaaatcggtagctgccggatttatgaaatccaatccgtacaaggataaaggttttgtaccgggcgaatacaccgaaggaaattatgataagatagaccttcatcgtccgtatgtagacgatatcattctggtatcggaagacggtcagccgatgaagcgtgaatcagacctgattgacgtttggtttgattccggtgctatgccttatgcacagattcattatccgttcgagaacaaaaacattctggataaccgtgaagtatatccggcagactttatcgcggaaggtgtagaccagacacgtggatggttctttacactgcatgctatcgctactatggtatttgatagtgtgtcgtacaaagccgtgatctctaatggactggtgctcgacaagaacggtaataagatgtccaagcgtcttaacaatgctgtcgatccgtttactacgattgagaagtatggttctgacccgttgcgttggtacatgatcactaactcatctccatgggacaacctgaaatttgacattgacggaatcgaagaagttcgccgtaagttcttcggtactttatataatacatattcgttctttgcgctgtatgccaatgtagacggattcgaatataaggaagcagatgttccgatggcagaacgtccggaaatcgaccgctggattttgtcagtattgaatactttaatcaaggaagtagatacttgctataatgaatatgaacctactaaggcaggacgtttgatctccgactttgtcaatgacaatctgtccaactggtatgttcgtctgaaccgtaaacgtttctggggtggtgaatttactcaggataaactgtctgcttatcagacattgtatacctgccttgagacagtcgcgaaactgatggcgcctatttctccgttctatgcggatcgtctgtacacagatttgactactgctacaggacgtgataatgtggtttctatccatttggctgaattcccgaagtatcaggaagaaatgatagacaaggaactggaagctcgtatgcaaatggcacaggacgtaacttctatggtattggcattgcgtcgtaaagtgaacatcaaagttcgccagccgctgcagtgtatcatgattccggtggcggatgaagagcagaaagcccacatcgaagctgtgaaagcattgatcatgaacgaggtgaatgtaaaagatatcaagtttgtggatggtgctgccggcgtattggtgaagaaggtgaaatgtgactttaagaagttaggcccgaaattcggcaaacagatgaaggctgtggctgctgctgtagcggaaatgtctcaggaagcgatagccgaactcgaaaagaacggaaagtatgcgttgaatctggatggagcggaagctgtgatcgaagctgcggatgtcgaaatcttcagcgaagacattccgggatggctggttgccaatgaaggtaaactgactgttgctcttgaagttactgttaccgaagaactgcgtcgtgagggtatagcccgcgaattggtgaatcgtattcaaaatatacgtaagtccagcggtttcgagattacggacaaaataaagatcacaatctccaaaaatacgcaaacagatgatgcggtgaacgaatataatacttatatttgtaaccaagttttaggaacatctcttgatttggcagatgaagtgaaagacggcacagaacttaattttgacgatttctcattgtttgtcaatgtgataaaagactaatactaatattgattaaccttttaaactagtaaagttatggcagaaaagactagatattcggatgcggaacttgaagaattccgtgccattattatggagaagttggagttggctcaacgtgattacgatcagttgaagatgagcttgatgggattggacggtaatgatactgacgatacatctcctacttataaagtgttggaagaaggagctaatacgctttcaaaggaagaaacgactcgcctggcacagcgccagctgaagtttatccaaggattgcaggcagctttggtacgtattgagaataaaacgtatggcatttgccgtgagactggaaagttgattccggcagaacgcttgcgtgctgttcctcatgctacactcagcatcgaggctaagaacagtggtaaaaaataatagatagctacaagctacggatgacgagctacaagtagctgcgcaatgtttacgcacggcaacttgtagctcgttatgtttaatttatgatgaacaaatgaagaaactattcacgaagggtagaattgccctgcttgttatcttttccgtactgattattgaccagatcattaaaatctggattaagactcatatgtattggcacgaaagtatacgtgtgacagactggttttatatctatttcaccgaaaacaacggtatggctttcggtatggaaatatttggaaagttgttcctgaccactttccgtattgtagcagtagggctgataggctactatctctataagattataaaaaaaggcttcaaaaccggatacatcgtctgtgtggcccttatcctgaccggagctttgggtaatattatagacagcgtattctatggtgtctttttcaatgaaagtactcattcacagattgccagttttatgcccgaaggcggtggatattctacctggttctatggcaaagtagtggatatgttctatttcccgattattgacacaaactggcccacatggatgcctttcgtaggtggagaacattttatattcttcagcccgatctttaattttgcagatgctgctatcagttgcggtatcattgctttgctacttttctatagcaagtatctgaacgaatcttaccattcactggataaaaataaaaaggaaagcgtagatcatgaagagtaggtttcggtttcatctgtgttgtgtttgtatgttggcgcttgcggtagcaggctgtaaagtcaaaagacctgacgatgtaatctcagaatcgaagatggagaatttgctgtatgattatcatctggcaaagtctatgggagataatctgccttataatgagaattataagaagactctgtatctcgatgccgttttcaaaaaatacggtacaacggaagctgtattcgattcgtctttggtatggtacacacgcaatacggaggtattatcgaaaatttatgagaaggtgagcaaacgcctgaaagcccagcagaatgaaataaatcatctgatagctttgcgtgacaataaaccgaagatgtcggaaccgggtgacagtattgatgtctggccctggaaatgtttcatacgtctgacgggtgagatgatgaatgatcagtatgcctttgtattacctgtcgatactaattataaagatcgtgatacactggtttgggaagtacgttatcgtttcctcgaaccgatgcttgccgattctttgagagctgttacgatggcaatgcaggttatttatgagaaggatacgctgaatcatttggaaacaatcactgatccgggtgttcatcagatacgtttgtatgcagacacattgggtgtgatgaaggaaataaaaggctttatctattacccgggagtacagggagagaaagccggtgcattactggcagaccgctttgctttaacccgttatcattgttcggactcgctttctgtagccgaacgtgattcgattaatcagctggaagctctgaagacagattctttaaagaaagtatctgatcaaaaagatactaagatttcgaaagactctttgcgaaaagtcgatgatctgaaggataatcaacgtatatcaccggaagaaatgaatcgccgtcgtacggtgactcctgaaaagaagccggaacagattgaagtagagcaacatatccagcaggagaagattgagcaaagaagggaacggcaattgaatcagcgtagaaatcagcaaagacgtcagtcaccttcccgttaatattatgaaacgctttgccgctcattatttgcttctgcctgatgttggctttatcagacaacaagtagtagagattactgatgaaggatatgtacgggatgtttttccgttgacggaagaaatagagtctgttgaatggatgcccgggctgatagcattacttcccgagaataaaataaaaaacactgagatgttcagcaaaaacatctcagtgtttcaatttaatcttccaatagtttcgggacaaactttcccatgttttaaagaggctcttacagcgtctgcaaagaggggagaagtactgtttccttatttattttatccttttgattttacttccatgcagcctgtcgccggaactcggcacagattactgcggtagcgatagctacgttgagagattccgaggtttcttttccttgtggataattggggatataaagtttccgattgatgagtgcttccacttcttttcctattccgttaccttcatttcccattacgatcagtccgttggtggataatggttgttcgtacatgttttctccatccaaaaatgttccgaatacaggagcatcaccgagtgaatgaataaattcgggaagagaggtgtaatgaaccttaacacgggcgattcctcccatagtggcttgtatggtcttgggattgtatacgtctaccgtgttctgagagcagataatatgttcgataccaaaccagtccgccagccggataatcgtacccaggttccccgggtcctgaatatcatccagtgccaggcaaagagactggcgtgcgaaatccggacttaacgtatattgcggttgctcgaaaacagcaagtacttgctgtggtgttttcagcaggctggcacgtgatagttcttcttgagagacttctgcaatttcatttgcttgaatgtcgggatgcgcttgtaaccatgaagaagttgcagccagaaaacggcaagggaaatgtcctagtaaatcgcctgttaatttaggaccttcggctaggaatacctgttcctctttacgggttttctttagttccagtgaatggatatactttattttatttttgcttagcattattcttttacttctttatttaccgcaaagc

SEQ ID NO: 230 - DNA, 9826 bp, Bacteroides thetaiotaomicron
tgaaggggatatccataagacgagaaacaaagatgcgcccttgcgaaagtccggatttttgtattattatgtttctaaggacgttcctgttcccacatttcccctttttccccaggaacgtccttttttatctgttttcctttttgttattttccaattacacggatgtgaatacaggtgtaagtgttcagccataaaagaagcctcagaagtaattattgacttctgaggcttttttatataaaggaggaatttcttttatttaattcccaactttttagctatatctttaggaagtgcatctttgtgtaccagaatattcattgttttgtaagcaacgaatgctttggatgcataccagatacctttgtacttaccacttgtaccccaagagttctttaccatgaagtattcttttccgttctggtctttggcgataccgtagattaccattccgtggtcatctgtagtttcccagttgtcgaaagcagtctggcgcatttcctgagtgatttccatttccggaagcggtttggaagtcagttctttgcgtttatcggcagcagtcagacctgtccagcgagccatatccgagccggtaagttctgcacctttagcagcatccggcattacggcaacaccgtcacgggtgaaaccttgttcgctgacgtcactaccccatgcaaatgtatatccttgctttacagcgttgtccattacagccatgaactcgtcaagcggaagattgtaggacagaccattacgccagttgtcctgaatctcgatagcgaattgagaatagaaaggatggtgtgtatatgaagtcagtgatacataatcttcagctttcagtccgagtgattcagcgaaagtcttcggagtatattccttgcctttgtaagtgaagttctccgggcacgctcccaaataagtatcgtagatggcgctaaggcctttcttccataccggagtcagtttagtgagtttacctttggcgatcgcattgatgtatccttctgcaacagcgtccagttcattgtgtaccggcagtgtatcaccatacatgatacccggcattgcttcttgcggaaccagtccataattcttcatacaatagatgatgtcatagaaacttccgccgggagagaaagaactgtcgccatgatagcgtacatagtttgttccgcggtcttccattgttttgtgtacaacgaacatttccgaaaggtcgtattcgcctttacccaaacgtagtagttctgattccaggaatcccaaagcggagaaactccagcaagtgctcgaacgattctggttcttgatagaagtaatcggattttctttcactgttgtgaaaacgaagccctcttcgggttttgcgtcttgtgccattgcgctcaggctgaacaagcctaaggcagcgataaggatactctttttcattctgatgaaattaatattaaattgttttggttacaaagatatggattccttggaggaattccatattcttgcatagattttgcataaaaaaagagtagaaaatgctgtatcccaccttctttactatacaaaaagaggaaaaggcaatcgtatgtgatcaccttttcctctttctacatttattttattttgatcccgagactttctaaatcatctagagtaacagtataattctctccgcttttcatccgtttcattactaactgtccgacttgttcggcatcccttttctccatgaaaggttttttaccggaaatactgggtatgaaaggctgaaaaatcgttatatgattattgtgagatatttgatagccgtatcctccgtttacctcaatcacttccattgaaaaagaagaggcagaagaatctgttttagaaaaagatgttttggaaaaagacagacaagcgattactatcaatattcctgcaacagagcatccgagtatctttctcttagtcattctcttcccattcatatggatgtaactcccatgtatcgtcataataatagctgctgctgcctccggtagtgataatacctcgtctgccggtagcgaaacaaaccgctttgatgcgtgaacttccttcgaaaggagtgtagtcaaaatcatcttccgtttcactgctgcgccataagtctttagcaggatcgtatatccagtaattacttcggaaactaccggaggctgtttgccctaaagtgatgtatgcctgatcgtctatgacaaaagcacagccgtaggtacgggtgattgatttgtaatcgtcatcgtaatcgtcactgctctggtctgtaatgtcccggagacgtacccatttgttctcttcacttttgctgggatcgaacttccagaagtcatcgacatccttaccattatttgttcctccgacaatgtaggcgacattatcgataataaaggagagtccgccggttcttttctgaccgccgaatccgttgacgatagtccattggttgccggaagcggctgtcggatcaaagcggtaaaagtccttggtctgtttatcatctttagactgaccggtgcctacataaccgtaattaccgatagcgaaggctatggcgttgatccgggcatctccggggtagtcatccatctgtttccaggtgtccgttgccggttcatattcccacgtatcttttaaatatgcatatcctccggtatgtaatggatcgtcgtctctgtatacggtatatcccgtagtcacatatcctttggagttgatcgcaaatccgacagccccgttccgggccgccgcctcttcgggaaggtcggcacattgcgtccaccagtcgttatcaatattatattcccaacagtctctttcccgttggtcttttccccgatatccaccgcacaaatatccccggttatctatcacaaatccggctgcgtcctctcttgcccttccatcgaaatcagaacggcgataccacacacctaatgtgtcgtcatcatcatctgaacatgagaacatggatagcatagctattgacactaataacagttgtagttttttcattatttccattcgttttattacgttttaaacttggggcaaatgtagttatcaatgcggttgaagaaaaaagatatcgacaaatagccctattttctctatcgaacaaaaccgagtctataaatagcgggaaatagtcgattaattttggggatgctttcctaaaggggttcctttgcaactcaaaaataatattcattatgagactattcattacacttttttattcattactcttattttgtacaatattctcctgtagggatgaatcttcttccattggaagtaaatgggtagagagttcttttataaatgtagtgacagatacatgtatggtgactctgagcacattattagccgattctctggcaacttcgggagatacgatctgtcagatcgggcgatttaaggatgatctttacggagaaataaaaacttcgttttatgcagaatatcaagtaccttctcattcacttaatgagactactgactatcagtttgactctatcacgttcaaatggtatacttccggggattatctgggggatacactggtctatcatcgtattgacttatatagtttatcgcaaggactctctctggaagataacggttacctgtttaataagaccaacgttagctataatcagaataatcatcttggttctgtttctatacgtcctacacccggctatcggaacgagttacatgaaacgcgcctgcctgacgaatggggaaagaagtggtttaatttaatgctggaagatgatgaatgtatggagtctcaggatcgtttccgggctttcttcaaaggaatagcttttattcccgatgaaaacgggacgtgcattaacggctttcaggtgaacgattcgagtttttgtattaccctttattatcatgaactgaaagagaagcctacggaacagaccttagtgttcaatgccagcacttcactgaactacaccaaggtggaacatgaccgtactaatactcctttggagaatctcaaggcaggaacagattatgaactgccttcttccgagagcgaacatcaggtgtatctgcaagggctgaccggtatgtatatcaatgtcgaatttccctatctgaataatctgaatcagaccggaaggcttgtttccattgaaagtgcagtactcaagctatatcctatcaaaggtacgtataacggaaagtatccattaccgaaatcgttgtctctttatacggcagaccagaataacgccactcagagtgtcattactgacatctcgggaaataccgtacaaacgggaagcctggtggaagataatgtctattatgaagatactcactattcgtttgatatcacctcgtttattcagaataatctggggacagcgggggagagccgtgagaaactgcaaatattcctctctgacaatgctttttataataccgttcagggagtggtgctgggagatagcaaacaccctgtgaatgaccatgataataatgtatcactcactatttattataagacatatacgaaatgaaaagaagagttttatctatccttatactaggtgcgaacttattgaatgtagctgcccaaaatatgacgagttctccggtttccatgttcggactcggtgaattgtccaccggagaaggcggaatttattccggtttgggtggagtcggcattgcattgcgtggagaaaatgtgattaatagtgccaatccggcttctttaacgggattattgccgcagtatttctttttcgatttgggtgtcagcgggtcttatctgaaatattcacagtcaggagcgagcaatcattctctgaatggtaatcttaataatttggctgttggattccgtatagccccccgttggtatggagctatttttatggctcctgtcagtagtgtagggtatgccatctcgctcgatcaggatgtggcgggtacggacggaagtacggtgacttcacttttccaaggtgagggagggttatccaaaatgggtatcagcgttgcgcacgaactgtggaaagggctttcactgggtgcaaacttttcttatgtgggaggaagtatttcacaaacagaaactcaagggagtgcaacagaaagtaatagttcgcataaacatacgatttatgccgatttcggattacagtatacctataagttggatcattaccgttcggcggtagcaggagtcgtatatggatattctcaagacttgatgcaggataatgatcatgtggtgagcagtagcagttccagcggaagcattgaagaaaaaggaaaaaagtatcgtacttgtttgccgcagtttatcggattcggagcgtcttatactacgttgcgctggatggcttccatcgactataaatttgttgactggagccggctggagtcttcgcattccagtataagttttcgtaatcaacatcgtttgatgttgggaggcagctatacattggggaacccttatagtaaaccggtacgcttattgcttggagcaggtatgggcaactcatatatttcagtgcatgataagacgacaacgaattattatctgagtaccggacttaattttgagtttcgtagccgcagtacgctttctttaggagtgaaatatacagatcaactgaaggtgaattcggggagatttaaagagcagaaactttctttttttctgaatctgactttctcggaaaagacttataaggcaaaattgaagtaactggcggggtgttttctttatctggcggatagggagagcatttataatatagaaaagggtaccctcagcggtacccttttctattatttattgcctttcggtgtcactacatagtcttcttttataaactcatcataaacccgtttaggatgatcgaatgctgcggttccattcctctgttcgttgaagttttcccggcggaattgtttcagcttcaggttgtcttcggcatattctcttaacttcttatgttcacgtccataaagtgaactttcagtaacatcagaatcaagcaggctttctttaggagtgatggtgggcaggagcacttgttccaatagtccacgataggcaccgttatattcacaccagacaagatcgttggcaacgaatatacgatagaagtactttgaccatgcggttttgatttcgatggattgagcgtaaatctcaatcgttgcttctgaaccatacgcttggtcacggatcacgacggtcgtccgaccgctgatttcttccttcacggaagtttgccatttgtcagaatgcaggatttcctcaatgagttccggcaacttttctttaatttcaaactgtattctcatggtgcttgcctgcgggcaggactttttttgaatttcctacttaaaacaattaagctagcctaaagttacatagattgaagcaaaaaaacaagattttgtttgaatatttactatttttgccaaactatctgcctttttcgtttgtttttattataattatgcaacaaatagcaaaaaaacaagtttatgcagaataaagcccggaagaattatattatttatgtacttatgctccttctgtttggagggttgatttatgttgctattgaagagggcgacaggttttcacatcatgctgcgaacacgttaaacacggtacaagacgggccttttgccatgtttctacaatttatgcaagataatctgcatcatccgctgacgacgttacttattcagattattgccgtgttgttgatggtgcgtcttttcggttatttgtttagtcttatcgggcagccgggggtgattggagaaatcgtagccggtattgtcttggggccttctgttttggggctttttttcccggaagcttttcatttcctgttccctgtccattcactgaccaatcttgaattgctgagtcaggtcggactgatccttttcatgtttgttatcggtatggaactggacttcagtgtgctgaaaaataagataaatgaaacgctggtgatcagtcatgccggtattttagtacctttctttctgggtatcctgtcttcttactggatttacgaaacgtatgccgccgatcatactccctttctgccttttgccttgtttataggcatctccatgagtattaccgctttccccgtgctggcgcgtatcattcaggaacgaaatatgaccaaaactcctttggggactcttgcgattgcttctgctgccaatgatgatgtgactgcctggtgtttgctggctgttgttattgctatttcaaaggcaggtagctttgccagtgctctctattctgtgggattggctgtagcgtatattgcagtcatgtttttggttgtgcgtccgtttctgaaaaaggtgggagaggtgtatgccaataaggaggcgatcaataaaacgtttgtggcatttatcctgttgattctgatcatttcttcctgtctgacagagattatcggtattcatgctttgttcggagcgtttatggcaggagtggtgatgccgtcgaatctgggtttccgaaaggtgatgatggaaaaggtagaagacatttctttggttttcttcctaccgttattctttgctttcacaggtttgcgtacggagataggtctgatcaatagtccggagttgtggatggtgtgtttgctgctggtgacagtggccatagtcggtaagctcggtggctgtgccatagctgcccgtctggtgggtgagtcatggaaggatagtctgacagtgggtaccttaatgaatacgcgcggattgatggagttggtggcattgaatattggttacgaaatgggagttcttcccccgtctattttcgtaattttggtcattatggcgctagttacaacctttatgaccactccgctgctacatttagtcgaacgtttctttgtacatcgggaagaaaagttatctttgaagcgcaaacttatattttgttttggtcgcccggagtccgggcgcagtctgctttccatttatgatttgttattcgggaagcagttgaagaaagaacatgtgattgcagcgcattatacagtgggtacggatttgaatccgttggatgcccagcattatgaaagcgaaagctttgctttactcaaccaaagagctgtcgaactgaatattcaggtggacaatcactatcgggtgacggataagctggtacaggagatgattcattttattcgcaaagagcatcctgatatgttgcttttaggagccggtagccattaccgtcccgaaatgccgggaactccgggagctattttatggctgacgctcttccgtgataagattgatgacataatggaacaggtgaaatgtcctgttgccgtatttgtgaatcgtaattatcgggaaggagcactggttagctttgttctgggaggaatgattgatgtattcctactttcgtatctgaatataatgttgcaaaacggtcattcggtgcgccttttcctttttgaaacggacgatgaagagtttcatcagtgcatagatgacttgttggctcattatgctgatcagatagtagtggtatggtttgcaggagtagaagaattagtaaccaaagagagagatggattgctggtaatgagccatctttcctatacaaaattatccgaggatgagcttgtgatgcgggaattgtcatcattgctggttattcgtcggaataagaataagggagaaaaaaatgaaagacttgaaattggatgaacatacggggttagtacttgaaggaggcggaatgcggggagtattcacttgtggggtacttgactatttaatggatcatgatattcgttttccttatgcgatcggggtatcggcaggagcctgtaacggcttgtcgtatgcatcccgtcagcgtggtcgtgccaagttcagtaatattgacctgctggagaaatacaattatatcggcctgaaacatctgctcaggaagcgtaacattctcgactttgatttacttttcaacgaatttcccgaacatattcttccttatgattatgatacatactttgcttctcccgaacgtttcgtgatggtaaccacgaattgtatgacaggagaagccaactattttgaagagaaacgggataaaagccgtgtgattgatattgtccgggcatccagtagcctgccttttgtttgtcctgtcacttatgtggatggtgttccgatgcttgatgggggcattgtagactctattcccttgcagagagctattgcggacggttacacccgtaatgtggttatacttacccgtaatcgtggttaccggaaagacacgaaagatatccgtattccatcgtttgtgtaccggaaatatccgaagttgcgtgaagcattgagtcgtcggtgtgcagtttacaatgaacagctggaaatggtggaacagatggaagatgaaggaaagatcatcgttatccgtccgcagaaaccggtgatggtggaccggattgaacgggatgtacagaaactgacggaattttatgaggaaggatacgactgcgcaagaaatctgtttgaattttaagtaaataatgtgaatcagcagttgaaccaaaaccgtacgatttgtaatcagatgtatgaaagaagcatggaggacttgacaaaccgctttttatgttgtatatttgtaaatagaaaccggaagaaaattcaataacattgataatatagacgaaaaatgagcgataataagtattatataataacagattgcaggcattcccac

SEQ ID NO: 231 - DNA, 9680 bp, Bacteroides thetaiotaomicron
ggtttaatagattctaattgatttcaatttgacttaagggcttttggctttttctctcatgtgattaattgttttaaatattatagattcaaaggtgtaaatggctatatataattgtgaagcacactttccgttcggttttcaggatacaaacttagggtatttcaaggaatcaggagcatatgcttttattcatccatgtatatcttttcattcaaaattgctttttttatcatttgcttcgcctttctgttataatattgattatttttgtgacacttaaactaatatgaatatataatgaagcgaaccgttcgatataccgttcttgttttgattgctattataaattctttagttattactacttctctctatgctgttctgccttataatgaactacatcagttgaatatgagtaatggcttggtagataacatcattacttgtatctatcaggatcaagatcgttttatgtggtttggatccactaatgggctgagtcgatatgacgggaagcagattcgcaattttagtgtagacaatgcgaggatgtatgtttccgatataaaagagacttctgatgataaattgtgggtaataactaatgagtatttatattgttttgatcgacggaaagagaaatttgttcttccgtcttttcaggatgggaaaaaggccatttctgtaagtgctatggaaataacaggggattcacttttttggatagtgcaaggcggacaattgcaatgcttgaaacgacattataaattagtgaaaggtgacttacaaatagagatgactgtcgaagcaggctatccgttttttttagatgagggggaatctttttcgaatttatgtgcttcacaagacgggcatttcttgtatttggttaccgataagggaaatttgttgttctttgataagattgcaggtaaagtggtccggaagttcaaatactctattaatcctagcgctaatgctactactatcatgagtgaaggggaatatatttggatttcttctatagtgggtggagtaactcgtctgcatattcccacgggaaaatctgattattatcagtataatgaggatgccaggttgtcttctttatcacattcagatgcgtatggggtggttgcgttggataatgattcttacattgcagtaacctggaatggatatactctgttagctcctgaagaaaatgatccttctaagttgtcggcaacgccttatacgaatacctcatttttgcagtaccggaatgtagagacaagaatgatttctgtttattatgataaagagggaatactatggatcggaactagaggaggagggattgtctattttgattttagacagcattcttatatgcaatatcacagcaaaaaacataatgaaatctctgctcaggtggctgacaaagatggtcgaatttggttgggcacttaccatgaaggaattatgcgtagtgaccagccttatgctaaatcgcgaccgctgaacttttctcctgtgggcaatcaaaaagaagtcccggtgttttgtgcaaccaaagattcatgttctaatttatggtttggaaatgcttccggaaatttgatttgttatgactggagttccgattctttccatatatatccgctcaattatttaggaaaaaaggtaaattcctatatagtggccttaatgattgacacccgttatcggttttgggtatgcacttctgccggattgtacttatttgatcggcagacaggtcattttgaattattctcattgcgtgaagccttgaaagaagatgcagagccatgggtcactgctatttgtgaagataaacagcggaatatctggatagggacagcaaaaggtattgtacgattatcacaggtaaatgttcgtccattaaagatggttcatggatatgaagaaaaagaaaatataggagctcgtgtagttagtgctttactgactggtactgacggaactgtatatgtgggttataaaaatggatttggaatcattcctgtgggcgaagataggatagcgtctttttatacagtaaaagatggactttgtaatgattgtatagattgtatagtggaagatgagaagaagcgtatttggttggggagtatatccggtatctcaagatatagccgacagcaacatgttttctacaactattatatttctagtagcaataaatctgtgatgttgtttaagaatactttattttggggaaacaataagagcttaacttattttgaaccggaaatactgacatctgccaccattgccagcaaaactcttttaaccggattagaagtcgataataagccaattaatataggtgagaagataaaagggcaagttgttttggactcaaacattgcatcaattgaccatttggaactggtcaatgcaaaccgtgatttctctctccttttcaataatctggctttttcgaaggatctgcaaaaatatagctatcggttatatccatatcaaaaagattggattgtttctgaagcgggtaaggtctcgtttaccaacttgtctgccggttattatatttttgaagtcaaaacattgttccctaataatacggaaggagacgttactgcattgccgataacaatccttccacattggagccagaccgtttggtttcgtttgcttttgattttctcggttttatttttggttggttatattttctatagtttgttgcggcggcagcgtcgtttcaaaaaaatgattcaattgaaacatgaactgacgattgcaaatttggagagaaacgcagaacggcatatacgggaagaacgtgagaatttttttatgaatgctgctcatgagttaagaactcctcttactttgatactcgctcctatacatgatataatgaagtccattaccccatcggataattggtttgattcatttagcagattgcacaagaattgtctttctctacagacactggttgatcgtctgctatatgtacagaagatagagggcggtatgataaaacttcatctgtctgaatcggatataaaggagattgttagccgggtggctaatccttttctgcaaatggctatggtcaagaagcgggaatttttggtccaggtggatacagtgcctttgtatttatgggtggatgtggcgaaaatagaatcagctgttcaaaatttgctatcgaatgcctttaaatatacttctcagaatggacgtattgaactggctgtgtcagaggcggaaattgacggaaggccttattgccttgttacagtgtctgataatggggttgggatacctgatgatttgcaacagcacgtgtttgattcgtttgtaacaggaaaacgtatcccgcaatattccacatcaattggtcttggattacatattgtaaagcatacgatggggttgcatcatggatttgttacgttgaccagtcgtgttggagaaggcagccgatttgttctgcacattccggtgggactttctcattttgcgcagggggaatatgaaatggtacctgatccgatgaagggggatttgttagaagagtgtccggcagaagaacgtccgatggaagaagtagtagaggaaaagaatgagactatggaagaggccgttaacagagtgaaaaataataaggaatatttgttgatcatagaggatcacgatgagatgagagaatatttatgcagtctatttaaagaagattataatgttattgaggctgaaaatggagaagaaggggtggctatggctgataaatatatacctaaattaatcatatctgatataatgatgcctgttaaggatgggtttgaatgtagtcgggagattcgtgaaaataagcggacttttcatataccgattatctttttaacagctaaagcagaggatgctgaccggttgaaaagtttacaaataggggtagatgactatataatgaaaccttttaatccggagttattgaaagagaaggtgaaagcgttgatagagcaacgtgatctgctaagaaaactttatgcgaaaactcttatgttggatgaagaggtactggaatcttcagaagatgttcaggatgtttttatgcctaaaatgcttcagattatagaagaaaatttatcaaaccggaattttacaataaaagtgctgacggacaaattgaatatgagccagccgaccctttatcgcaaggttaagcagaaaacaggtttgtcgattatagaggtgattcatggagtacggatgagtaaagctgcctctattatcatgagcgggcgatatagcagtctgacagaagtggcggaaatggtagggtatgattcgatgatttccttccgtaagcagttcgttgcacagtttggggtgcttccttccaaatatatggaagagaaaatgaggaaataagaagccgcgttccatgttggcggcttctgtcttatctgtttgaatggttattgttaaaagcggaaagagacatggcccataacgtttgtacccgcttgcgcagcgtatccggcagaatttattctgtgattcacatccttgtcgtaagaactggatgcccaaccgttgttctcgtattcttcgttgaagaggttgtagacggtcacacccaaagttacttctttcaccacctttcggggtttgaatgtataggccagattcaggttgctcacaaagtatttatccagagtcaatgcttccacttccgcatttgtcatatattgcttgccgacaaactgggattgaagagctgcttcgaatccttgataggtaaaagcaaaacggttgttcagcaggaaatccggtgaaaaagcgatgcgggtgctcttatgagaaacgcttacgatgtccagtaggttccagccatcgtaaatgggaatgttttctacgaaattcttgatacggtttttgctccatgtcgcattgatatcccattggaaccatttacagggcttgatacctagcatcagttcgattcccatccggtaactgttcggaacgttttctgtcagggcttcaccgatatcgttcaaagctccggtgaggacaagctggtcggtataatccatgtagtagaaattggcgcctgccgtcagccaatgattggcgaatgtgtatccggcttcatagtcgagcagcttttctgctttcggataactgtcgggattgccatccgtataattatttcttgtcggctctttttgagctacggagaaagaagcgtagacacggtgattggagttgatattccagttcagtccgactttcggattgaaaaaatcgaatttcttgtctacggccagcggacgcaacgcatttttattccagtcgtatttgtcatttgctccgtcgatggtgtagtcgatgtgccggtattgcaggtcggcataggcacttagtcctccggtgaggtcgtagcttgctttcagatagatgttaccgtcggttttcttcgattggttgcggtagtattcatggtcgggagatagtgcgccgatgtagttctttacccaggtcactttcccgaagttattaccccggtattggttgatgcctccgcccaaagatgccgttagtcggtggttggtataattgagggagaaaacacccccgccaaacttattatccattttcttctgacggaccagatcgctttccgaaatttcttttccgtctgttgtaaaaggtttcagaccgtattctaggaaagatctgtcttctttatattcctcatagtagccgtcacctttggtgtagtgcagggctacgttcagattccacgcagtggagaaagtatggttgaaaaggagttgataattcttttgcagatagttatccgtctggtcggcataataatgtttttcattatcgtctccggtatattcgccgcaagggttataccgtcttccgtgttcttccatttctgctttagtagcatatccccaggcatgatacgtcttttcttttcctgcgaatgcgatcagtttgacagacgtattttcggcgaaatatcctccttgcagatagtaagagttgagattgacggaggcgcggtcgatgtatccgtccgtaccgatgttggaaagtcgggcatcgaatgtccagtgattgttcagcagtccggttcccacttttacagtttccttgtgggtgttgaaagaaccataggaaccgttgaactcggcatacggtttcatggacgcgccttcggtctgcatattgacactggctccgaaggcaccggcgccgttggtcgatgttcctgcgccacgttgcacttgcatatcctttacggaagaagagaagtcgggcatatttacccagaacagattgtggctttcggcatcgttcatcgggatgccgtttacagtgatattgatacgcgtgccgtcagtgcctcgtacacgaagagtcgtatagccgatgcccgatcccgcatccgatgtggtcagcgtggaaggagtcatgctcagcaggtagggaatatcctgcccgaagttcacttttttaagttcggctttgcctatattggtaaatgctacgggagtttttgctgtagcacgtgtggatactacctgcacttcttgcaggttgattactttcagactatcctttgcactcgtttgtgcatggacagggaagcctgcgcccaataaggcgacggccatcatcatcatttttttcatcttgcttattaattagttctctacgccggcattacccggttcagattctatgggtatgttctcagcccgtcatgttaaggcacccctacttagtgaatcgttggcaaaattactgcttttgcgggaggaaagcaaaaaaaacttttagatttgctaaaaacaatataactttgtagtttgttgaaatatgacaagtcagctatttattcattttaatataattatcaaattatgctactattatttcaagcgacagcaacacagcttgcggattctacacaaatcgtcgcagataaattaatggaagaagcgatagccaatgcggacggattggataagctttctctgatcacccagcaattggtagatttcggtatccgtgccggagaacgcatcctgattgcaacccttgtcttcattgtcggacgcttcctcatctcgatgctcaaccgatttgtcggacgtctgatggacaggagaaaggtggatataagcatcaagacttttgtgaagagtctggtaaatattctgctgaccattctgttgattatctccgtagtcggtgctctgggagtcgaaacaacttcttttgcagccctgttggcttctgccggtgtggctgtcggtatggcgttgtccggtaacttgcagaactttgccggcggactgatcgtattgcttttcaagccttataaggtaggagattggattgaaagtcagggagtttccggaacggtcaaggaaatacagatatttcacaccattctgactaccggagataataaagtgatttatataccgaacggtgcaatgagcagcggagtggtgacaaactataatacacagacaacgcgccgtgtagaatggattgttggcgtggattatggagaagattataataaggtacagcagattgtccgtgatatactgacggccgacaatcgtattctgactgatcccgccccgtttattgcccttcatgcgctggatgccagcagtgtgaatgtggtagcccgtgtgtgggtgaatacggcagattactggggagtttattttgatataaacaagactatttatgaaacctttaatgaaaaaggcatcaacttcccgttcccgcaacttaccgtgcatcagggaaactgatcactataagatatatactaaaacgagagagtttcacttcggtgagactctctcgttttatatgaacaaattgtctggtgtgattggaaaatttcttttttatttgatgccgaagtcttctgcaaactcatatcggtcttctttgatccccagtacatggttgattttccttcttttttcaaggtccttaaagtagctttctactacctgatagagatcaaaattactggttgatcctgcggcaagatcgagtgactccaccattttctctactgcctggtggattttccctgcgtctatcagatgcagttcgttgctgtgtattaaatatttctccataactgcaatgttttaatgttatattgttataacgtatcatagtgatggaaagttcaatccccgaatcttcattgcgtcttgttgtcaatcacattttaacagacaaataggttagaatctaatgtcagattttggcgagtgcctgttccagatcggctatcaggtcattgatatgttccgttccgatggatagacgtacagtgcccggataaatctcctgttctgcaagttcctgcgcattaagttgcgagtgtgtggtacttgccggatggatgactagtgatttcacgtcagctacattggccagcaacgagaaaatctccagactgtcgatgaagcggtgtgcttcttcctgtcctccttttacttcaaacgtaaagatggagcctgcaccattcgggaaatagcgttgatagagtgcatgatccggatgatcggagagtgacggatgattgactttcttcaccttcggatgattattcaggaagttcaccacttttagcgcgttttctacatgacgttctacacgcaaagaaagtgtttccagcccttgcagcaggatgaaggcattgaacggactgatcgttgctcccgtatcccgtagcaaagtggcacgaatgcgggtgacgtaagcagccggaccggcagcgtctacaaagcgtactccgtggtaactcggatcgggctctgtcaactgcgggaatttacccgaagctacccagtcgaatttaccggagtcaacgattactcctcccaaggaactgccatgaccgccaatgaatttggtggcggagtgtaccacaatgtctgctccgtgttcgatggggcggattaagtagggagtgccgaacgtattgtctataatcaaaggtattttgtgacggtgagcaatttcggataccgcttctatgtctataatattggaattcgggtttccgagtgtttcgataaatacggctttggtgttctcctgaatcgctttctcaaagttggaaaggtcgctcggatcaacgaaagtggtggtaacgccataattgggcaaagtatgtgccagtaagttatagcttcctccgtaaattgttttggcagctacgatgtggtcgcctgcacgagtaatgttttcgaaagcataagtaatagcggcggcaccggaggcaactgccagacctgctacgcctccttcgaggacggctacacgttcttcaaaaactccttgggtggagttggtcaggcggccgtagatattgcccggatcttgcaaaccgaaacgtgcggctgcatgagcggaattgtggaatacataagaagtggtctgataaataggtactgcgcgtgcgtctgttgccggatctgcttgttcctgtcctacatgaacctgtaatgtctcaaagtgtaaattctttctttccataatcgtatgctttttaagtttgatattctctctttattttcttgcaaagttatgggatgtagatatat

SEQ ID NO: 232 - DNA, 9652 bp, Bacteroides thetaiotaomicron
ctttaaatccttacaaattggaatatttaaaggtgttattaggaaaaaaaagattaaataatgactatgcttaccatgaatagccttaattaatttaactctttatatgcctatttcttaaaaaaaatagatgtgtataaagggtagcttcgggaaggaggagtggtcgcagaccgaggtggtaggagaaataatgtttatacctatttctttgtaaatgacaggattatgtattcacctaccacctccccctacgggtactcctccttcccgaaggaggagaatggaagatagaaccgactatcatttagctcataacatacataaaaaggaataaattgctttgagccgctctactagagaattaaaatatccaaaattgctgtcatctgtcaccaaatgatagataacgcactgattataaactaataaagaggtgacagcacagcgtgacggcattgtgatagcaaaatatgctatcacaatgccgtcacgctgtgttattatatcctgctacaataatatactgacctcttggaatgataagtcaggaataccttagcttagttagtttccatgcaatgaaactatagttccaaagccttgaaaccaatagtttcaagctgaagaaactttagttccaaactgcagaaactaaagtttcaagcgctggaaactctagttccaaggccgtgaaactaaagtttcattaggcaaaaaaataatagttccacagtaggaaactatcagtagtaaggcagatgaaagaatatttttccggaacagggatttaataagcaaggaatactaaatattctcctgtacaatgaatggtaaactcatctgctattgcttcattaagcgttccctgccaccagttggtgaagtcgcttagcggataaaacaatccctctgcttttaatcctttagctccaaagttgatgatagagacctgctgaccgggatatgaggcaaaactttgcgtatcactcactggaataaacgtcccgtaatcagtgactgtccgtacttccataccacttctcatatactccacgagcaggctgatgtttcctaatgtatgatcttcccgtttgccggtagcacctacgatggcgattttccgtatccctttactttgcagataatggacagctttggtctgatcattcgtctcctgatccgaaatttgaaggataatagaggaaaaacgctttttatattccggcaggagcgagtctccatcgcctataatcacgtcgggagtatgtccgcgggaaatatattcattggcggccccgtcgcaacaaacgacgaattgggcttctgccaaaagacgcaggggaagttcgtgcgcaggatattcaccgttggcaagtatgacggcttggggtatatagtgttcgtttatcattgcatgttcattatttttttccatttgaagtagccaaagatagctataatggagtaaagtccgtacaatgcggaggtgaaatagagatctttatagatataaagtccgcaacagacgatgtcgacaagaatccaggcaaaccattgctcgatgtatttgcgtgccagcatccacattccgacaatgctcaacgccgttgtgaaactgtccagccacggaacgttactgtctgtgtattcgataagtatccgggcgatgccgacgaaagacacgataaacacaaggaatagtggcagatagcatttccacggggtatgtataatggggagacttttcttttccccgtgtccccacatccagaagaaccatccgtagatggcagctatcagatagtagatgttgatgccgaagtcggcatacaaccccgcgtcgtaataaacaaagatataaatggccggcatgatgatgcccgccagccacagatagatactggcgcgatactccagccacaggtagataataccgataaacgtaccgaatatctccagataattcatttccatatttgcttatttattcgttctctacgccggcattacccggatcagattctatgggtatgttctcagcctgtcatgttagggcacccctattgcgtgaatcggcggtaaaattacgaatttagcagaaggaaaacaaggaatcatgtaaaaacaagtcctccgttgaaaaaacgaagaggagatttcagcggcatttttgcaatgccgtgaaatctcctcttctcctcatttgtcgtgtattataaaacttctttttctttggtcagttgctcttcatatagcgtgttaccgatcgtatatttgaggctgaactttttggcggttgtgttgtaggtactttctcctgagtcgataattaccggtccgttttcagcatcccatgctttgatcaaaactttctttacatcattagtgccttccactatctgatccgtgatggtcagttctattgtacccgtttggatatcagctttctcgtcgctctcgttgttcatggcatagaatagtctgacagtgttgactccggtaggcttaatcgttttaggcttctgaatcgtcttcggagtttctccttctaaggtggtatgcccactcatctggtaactgcccgaatagtcattctttaattttaatagaatcaacattttatatccggattcacttatcggatatcctgttgtactttctatttcgacggggatgacgtatgactggtcaatcttcagacttgctgtctttatcaacacaggaacttcggcggaaataccttcagcgtgcttgattaccgtattctccaaagaaggaatggaatataaatcagtatccagtgatttataatatttgtcctcattcagaacggtccagtattttttattgtaaatatctaccaactcttcgttgatcttcatttttacgttcacatctcggtctaatgctaatgtaccggaactgctgaccgtgaaataagttttcacttcttcgttactgtagcttacttctgtggtccatactcggttgtaagcaccgatcaggtagatttctttctgatattgttctttttcaagcaggtctttttcacaagaagtgatggagagcgttaacaaagaacagaccactattttgtatattgatctcattatatgttcaattttatatgattaataatcagttatatgatagaaaggggaaagttaccaatctccgaatccgtcccatcctggattttgtttcagtttggcatttttatccaatacggctctcggaataggatagaagtacatcttcctgtcaaagctgcgtaatgcatacttatgaactacattgacaacagtatagaattggtctctttcggttgtcttcttggtaacgtccataccttgtaccggtttgttttcttctgtttctgctagtccccaacgacgcaggtcatgatatcttcttccttcgcacgcaaattcgatcatgcgttcgcggatgattaactgacgcatcttcacttgatcgctggcatcggcaagggtgatgcccggcaatccggcacggtaacgaatcatgttgaagtagtacatgatttcctccggattatacaaaacatgataagtggtgttatctgccgcttccgtatattccggttctcctttcagttcattcaatgcttctacatagttcaacagtatttccgcatatctgaatacagggaatgttttcggttttattttagcacctgtatgactggtacagttatcctccggatggatatatttctttagagtatatcccgttaagttatagtcttctggattggcagcctgttttgcacagttgccattcacgtaatatcctgctgtaaagttagtcacgttgggagcttcggttcctgttaccgaagttgcgggccagaaacattcacagaatccgatagatgcgtagaaacgcggttcgcggtccagatacattttggcaacggttggtctcagctcatatcctgtggcgatggtaggtacagtacccgcttcttcataataatcaggttgttgcacataatcttctccatctttcatgtagtaggcatctatgagtttctgagtgattcctaagccgttccatcctcctagtttcaacgggaaggcgattgaaatgatgttgttgttcaagggagtagcataaataagttcagggtttttcacagccagtgcttctccattgaacatgtctatatacgaatggtaaggatcgattcctcctactcctaacggaaattccgcttgtgacgcctgagaggatgcatacgtgttttcatcgctgggtacagtgtataatgagtaaataccgctatcgataattctcttggaggcagcagctgatttcgcccatttcaccgggtcatattgctgggctatcatgtttcgtccgtcggaagtggtccagtcggcataatattgattgccgttgtaccacttggaagcttggtaaagccggacacgtgacatgagggcggctgccgcatatttggtaggacgttcgaactgagtgctcgggcgcgtcgggtccagtagactgtaagcttcttcgaggtctttgcagatatattccacacattcatcgtacgtgttacgttcgaatgacaagttttcaatgttttcatctaccgacagcggttcttcgggaaggatgactgccggtccgtaaagttccaacagatagaaatagaaggaagctctcatgaaatgagtcaaacccataatttcacgtctgtccaatcctttcaggtctttgcattcatcgatgcgggtgaagatagtgttacacttacggatacctttgtagtattgtccccacatgttgtagtaagaatcgttttgcgtaattttgtctgcgtacaagtaggtaccggcgtactcagctttctgccatgacagaagaacttcatctaccgcagtctcgtaaggaccgtaggaaccggaaaacaagttgccttgagcgggcattaatgccgcagttccccacacataacgctccagataatcttgtctggcaaagatggagtcgagtggagtcaggtcgttaaagtattcatcaactgccagatagttgcatgaagtcagcatgaacgggatgatccccagtgtcgtgcatagaatatgaaggcttttctttaatatctttttcataatagttttcaattagaacgtagctgttaactgtaaagagaaagtacgctgtagcggatatacggcgccgtttttagatgcctgtcccggatcccatagtttcactgaatcccatactgccagattctgtccgacaaattgcagattcatatcactgatgcccactgtccttagtactttattcgttccgatacgataggaaatatccaatgatttccaacgcaggtaagaaccatctgccagccagaaagtagaagcacggttattgttcttattctctccgtaagtcaggcgcgggaaacgtgcattcgggttttctgtagaaggatcccctgaataccatgccggtgtccaacgattcttcgggtcgtttacgatggatagaatgttgccgacttctccgcctgagaagggatagaatccggaaccgccgtataagaagttaactttggctgctccagtgaataaagcactgatagtccatcttttatatctgtactccagtgcaaaaccgtattgaatttgcggtacattggagtgtgcaataggaacaatatcgtcatcgtcaatttttccgtcagcgttcacgtctttatagcggatatctccggggcgtacttcgccgtatgtctgtttcgggcttcggttgatttcatcctgattttgaaataagcctaatgcaaccaaaccgcgcataacaccataatttacatcgctatacgattggtaagggtagcgcaccgcatcttggtcccaatgtacaactttgctgacagcatatgtcatgttggcacgcaccgtgaaagagttgtcttcgtttattttctggttcaggtaaatgttaccatctataccgctactgcgcatacgtcctacgttggtatatgggttggtcacgacgcctacttccgaaggcatcatttttctttcctggaagatattatcacgagtgtctctgaagatatctaccgttccacctattttatcattgagaaattggaagtcgatacccaggttatatttcttggctacctcccaatgtaagttattggctccgatttgtttttctgtcaatccattggaaccccaacgactaccacctccaaagttaatcaacgtcagatatgggaaccgacgtccaccaccgatctgatcgttaccaacttcaccataagaagctctgatcttcaaaaagttgagccatcctgcatgattctgcataaattcgtattgggtcgggatccatcctaaggctattgcagggaacaaaccgaattgtttgcccggttcaaagttttcggaaccggtgtatcctacgtttccttctatcagataagcatctttataagagtaagtggctctggcagacaacgcttgataacgtttgggaatagatgaaatttcatcatttgcttcggtggtttcggtgctttgcatatagtaatgtatcaaaccggttacacgatgttcctgattgaaaagtctttcataggcaagttgcgattcgaagtaatatctccggtcactggcagcactcttggcgaattgaatgttgctggctgataccgtacgttgtgtcattaatgaaccgtcattgtaacggccaaaggccttgtataggtccggcattttggagcggactacgttgtgtatattgttattgttatacgagaacattcctctggcagtcaaacccttgatccatttcccgaagtcttgacgtaaggtgaaattgatgttcatagtggtccggtttccctttttaaatccggtatggttcaacaagatatatggtgagatttgttctccgtttttcccataagcaggaagcattccattggaataacgtaaaggcaccgtcaggggagtcagataggcttgtgcggcccagagtgcgtcattgttagttccgaatcccggtgctctgtcttctacaatagctccgtccatagccaatcccatgatcgtcgatgaagttaggttcatgtctacctttgcgcggaaattatatttagcccatttgacattcgtgttgtatttgttaactttgtcttgcttgaagatagcatctttgaatgtacctcctacactgacaaaatatctggcaacttttccaccaccggatacatttaaatagtgctgatgattgatagttacatctttcagtatctctttttgccagttaacgtttggatataagtcattatccagtcctgctttaataatctccagttctgtcgggctataaagagggtccatattgcttaccactcgggcttcgtttgccaagctggcataatcgtatgcttccagatattcgggcatacggggggaataagagagagtcatactgcttttccaggttaccttggttcgaccttcctgaccggaacgggtcgttaccaaaacaacgccatttgcaccacgtacaccataaacggctgttgccgaagcatctttcaagatagagaagctctcaatatccgacgggtcgaggtcgttgaggtttccttcaataccgtcaatcaaaaccagcgcagactggttggcaccaaatgtgctgataccgcgaatccagaactcagaaacatcctgccccggttcgccgcttcggtcaacggctataataccgggaaccacacctcccagcatattggctacggaagttgacggagcactgatggcagccggattgacactggtgacagcacctaccacgctgactttacgttgtgttcccatacctacaacaactacttcgtccaatgattctgagtcgggctccagagatatacgcatcttcttatcggtttgagcaaccactatttctttgctcttatatcccataaatgaaacaatcagcgttgtttttggagctaatgatttcatactgaagttaccatccatatctgttatagttccggttttttctttccctttaacagatatgtttgcacccgggagcggatcaccatgttcatctaacacgattccggcaatttgaattggttcttgttgggcccatatcccttgtgttgcatttcctgccaatagcagaaagaaacacagggctaatttaaaatatagtgttttcatttctattccttattaattattcaatagcaagttttctgatgcagtggttgttttgatctgcaatgtaaagaaattcatttttgtccaaatagacaccccagggctgattgaattgggcttccaaagggtctccatctttgtatcctgcagctccgctacctgctatcgtggttacgacgttcaatttggtgtcaactttgcgtattcggttattaccaacatcggctatgtataagttcccttctttatcaatagcaattccacgtggttctttaaactgtgcttcttgcacatctccgtcccggaagcctgcgcctgcaccggggatatattcatcgatgtccccatctagggctggccaaccgtccgcatcgcgtgtgagcttaaagcgataaactgcacttttactatgcaacacacagtaaacatacttatcaaccggattgtaagcacataatccattggaacctgtattatagagtgtaccgattcgttttgctttgttgggatttaatgttcttctatttttatcgaaaggttgtgtccacaattgccctgtattttggcggtatatcacaaaagtagaatctacggggtcgagaacaacactatgcatccatcctccgttggctaaaagctgtcccattttatcagccacccagctcacattagcatcgaataagaaacaaccgaagttggcattatcgcatggaccaaatagttgtttcttttctttatcaataaataaaggttggtcgattaccatgccatctagtaaagtgatcgttttattttgttcgatggatgataaacgcgttcttccatcagagtcgaatatgaatacattgtcatcattatctacagctacataccttggagtattgaatgtggtctcgccgagagttccgtctttattgccaccttctttggcttttcctactactgtagatacggaagaagttacaatatatttgaaggttttttcagcattgctgagttcagcttcttttccggcaatctccacccgtacatggctttcccctccggcttgcttgggcacttgggcataaataacatcaggcttgacacctaaaaccaatgcctcccgctcattacctacttcatccttgaagtaaactttcacttggcttttgtcttctccgaaattggagcctttaacaatgaatttggttcgtatgccaccggaatcgggcataaactctgtaaacttgactggttgattaggatcgaaagctgtgcttttcttgtcttcattacaacctactattagtagcaggaagccgaaaaccatccagattagattaaatgatttacgcatgtttttctataagattttattagtttgaaaaaaggtcttttaggctttctatttaaataaggtttaatag

SEQ ID NO: 233 - DNA, 9549 bp, Bacteroides thetaiotaomicron
ctcatagataataaatctaaaaaagaatcgtatttttgccaattaataatatgtaaaacgaaattgccaacggattactattagcatacaggcaaagttaatttataaacgatctataatgaataaacgaattttatcagtttttgtttgctgtgccctttactattctgcacaggcacaggacgcgaaaggcggcatcagcactgacatgatgcagcaaatcaaacagagttatcagggcacttctaccgacaaggctatccggaacgccatcagcaacaacgacatccgtaagcttgccctgaaccaggacaacatgaaggggatggatacacatttttctgtcaaagtgaactccaaggggatcaccgaccagaaatcgtccggacgctgctggctcttcaccggcctgaacgtaatgcgtgccaaagccatcgataaataccatctgggttctttcgaattctcgcaaacctatcctttctttttcgaccaactggaaaaggccaaccttttccttcaaggcgtcatcgacaccagcgacaagcctatgaacgataaaatggtggaatggctgttccgcaatccgttgagcgacggcggtacattcaccggagtagcggacatcgtaagcaaatacggcctcgtccccaaagacgtgatgcccgaaacgaacagcagcgaaaacaccgcccgcatggcgaatctgatcgctctgaaacttcgcgaacaggggttacaactccgtgacatggcttcgaaaaaagctaaacctgccgctatagagaacgctaaagtggaaatgttgagcaccatttaccgtatgcttgtcctgaacttgggcgtacctcctacagaatttacctggacgcaatataatgtcaaaggcgagcctgtagaaaccgccacctacaccccgctttcttttctgaagaaatacggtgacgaaaagctgattgacaactacgtcatgctcatgaacgaccccagtcgcgaatactacaaatgttatgaaatagactacgaccgccaccgctacgacggcaagaactggacatacgtcaacctcccgatcgaggacatcaaggagatggccatcgcctctctgaaagacagcaccatgatgtattactcctgcgacgtcggcaagttcctgaactctgaccgtggtctgctcgacgtcaaaaactatgattacgactcattgatgggcaccaccttcagcatggacaagaagcagcgtatccaaagctttgccagcagctccagtcacgccatgaccctcatggcagtcgatctggacaaaaacggaaaaccgaccaaatggatggttgaaaatagttggggtgccggagccggttatcaaggtcacctcatcatgacagatgaatggttcaacgaatataccttccgtctcgttgtggaaacgaaatacgtgaccccgaaagcactcgaagtcttgaaacaaaaaccgatccgcctgccggcatgggatccaatgtttgccggcgaagaataaccaaccgacaaacacgctgcatagacttgtacgctgcaaggtcttccggcctactttattaaagaacgtgtgcgaacacaaaaggaattacggatatttttccgtaattcctttcttttttcctcccgaatcacattattatttattacttttgcggcaaattttatgaaaccattattttatatagcatggcaaatgtaataaagttacgtaaaggccttgacataaacctgaaaggtaaagctgctgagacgtacacaacagtgaaagagccgggattttacgcactcgtacccgatgattttcctggagtgacaccgaaagtggttgtgaaagagcaggaatatgtgatggccggtggacccttgtttatcgacaagtatcatcctgaagtgaaatttgtttcgcccgtgagtggcgtagtgacgagcgttgaacgtggtgctcgccgtaaggtattgaacatcgtagtggaagctgccgcagagcaggactacgaagaatttggtaagaagaacgtatcctcgatggatgcagatgctgtgaagtccgcgcttcttgaagcaggtctgtttgcgtttatcaagcaacgtccgtatgacatcattgcagacccgacggtaacaccgaagggcatcttcgtttccgcattcgataccaatccgctggctcccgacttcgaatttgctctgaaaggcgaagaagcaaacttccagactggtcttgatgccctcgccaaaatggcaaaaacttacctgagcatcagcgtgaaacagaaagccgctgcactgacacaggctaagaacgttacaatcaccgctttcgacggaccgaaccctgccggtaacgtaggtgttcagatcaaccacctcgaccccgtttcaaagggcgaaactgtgtggacaattgatccgcaagccgttatcttcatcggtcgtctcttcaatacaggccgtgtgaatttcacccgcacagtagccgtgacaggttccgaagtgttgaaacctgcttactgcaaacttcaggtaggtgcattgctgactaacgtatttgccggaaacgtaacaactgacaaagatttgcgctacatcagtggtaacgtgctgagtggcaaacaagtttctcctaacggattcctgggtgctttccacagccaactgactgtaatccccgaaggtgatgacgttcacgaaatgttcggatggatcatgccgcgcttcaaccagttcagtgccaaccactcatatttcagctggttgatgggcaaaaaggaatatacgctggatgcacgtatcaaaggcggcgaacgccacatgatcatgtccggcgaatatgataaggtattccccatggatatcatgcccgaatatctgattaaagcgatcatcgccggtgatatcgaccgcatggaagcgctgggtatctacgaagtggctcccgaagacttcgcactctgcgaattcgtctgctcttcgaagatggaactccaacgcatcgtccgtgtcggactcgacatgctccgtgctgaaatggcataatccgcatggcaaattgtaaattgtaaatcgtaaaatagtaatatattaatgaaagcgttaagaaattatctcgataagataaagccgaactttgaagagggcggtaaattccacgcattccagtcggtgttcgacggcttcgaaacattcctgttcgtgcccagcaagactgcgaaaacgggaacgcacatacacgacgcgatcgacagcaagcgtattatgtcgattgtggttatttcgttagtaccggcgctgctgttcggtatgtacaacgtaggttaccagcatttcacccacacaggtgctactggcagcttcatcgaaatgtttatctacggattcctggctgtattgcctaaaattatcgtatcatacgttgtcggtctgggtattgagttcgtcgtagctcaatggaagaaggaggaaattcaggaaggattccttgtttccggtattctgatcccgatgatcgttccggtagactgtccgctttggattcttgccgtagcaactgcattctctgttatctttgcaaaagaagtattcggtggtacgggtatgaatgtgttcaacgtagcgttgatcacccgtgcattcctgttcttcgcttatccgaccaagatgtccggtgacgccgtttgggtatccggcgataccatttttggtatgggacaggctgtagacggtctgactgtggctaccccgctgggacaagctgctacatcgggcacggttcctgcattcaacatggatatgataacaggtcttattcccggttctatcggtgaaacaagtgtgatcgccattctgatcggtgccgttatcctgctgtggacaggcgttgcaagctggaagacgatgctttccgtattcgttggtggtgcattcatggcctgggtattcaatgctatcggcatggaaaacaacacaatggctcagatgccttggtacgaacaccttgtattgggtggtttctgcttcggtgccgtattcatggctaccgaccctgtgacatccgcacgtacggaaagaggtaaatacatcttcggattcctgatcggtgtgatggctatcgttatccgcgtactgaatccgggttatcccgaaggtatgatgctcgccatcctgctgatgaacatcttcgctccgctgatcgactactgtgtagtacagagtaatatcagccgtcgcgagaaacgcgctgttaagtctaaccaataataccgaatgaaaatgaatacaaatagtaatagttatactatcatttatgcttcggtaatggttgttatcgttgcattcctgctggcattcgttagttcttcactgaaagctacacaagacaagaatgtgcagttggacactaaaaagcagattcttgctgcattgaacattaaaaatgtagaagatgctgatgccgaatatcagaaatatgtaaaaggtgatatgctgatgaacgtagacggcacgctgactgaaaacacaggtgagtttgccactaactacgagaaagaagtgaaagaacaccaacgtctgcacgtatttgtatgtgatgtagatggtcagactaaatatgtggttcctgtatacggtgccggtctttggggcggtatctggggatacgttgctctgaacgaggacaaagacacagtttacggtgtatacttctcacacgcaagtgaaactccgggtctgggtgctgaaatcgctactgactggttccaacacgaattcgcaggcaagaagacactggaaaacggtgccgttgctctgggtgttgttaagaatggcaaggtagaaaaagctgattaccaagtggacggtatctctggtggtacgatcacttcggtaggtgtggatgctatgctgaaggcttgtctgaataattacataagttttttaactaaataataaggaggaggataaagaatatgggacaactgttttcaaagaagaataaagaagtattctctgctccgttgggaatcgataatccggtaaccgtacaggtgcttggtatctgttctgcacttgctgttactgccaagctggaacccgccattgtgatgggactttcagttactgtgattacagcgtttgccaatgtcgttatttcactgttgcgtaagacgattccaaatcgtatccgtatcatcgttcagttggtagtggttgctgctttggttaccatcgttagtgaaattctgaaagcgtttgcatacgatgtaagtgtacagctctctgtttatgtaggtttgatcattaccaactgtatcctgatgggacgtctggaagcatttgccatgcagaacggtccttgggaatcattccttgacggagttggtaacggtttgggttatgccaagattctggtaatcgtagctttcttccgcgaactgctcggttcgggaactttgcttggtttcaatatcctgaattatgagcctatccagaatatcggttatgtaaacaacggtctgatgttgatgccgccgatggcattgattatcgtagcttgcatcatctggtatcagcgtgcacgtcacaaagaactgcaagaagaaagtaattaatataaatgaagggtgaagaaggatgaatgaaggtaacactcataaactcgaaattcttcattcttaatttttaattaaaatatatggaacatttattaagtttattcgtccgctccatctttgtggacaacatgatattcgcgttcttcttgggtatgtgctcatatctggctgtatcgaagaatgtgaagactgccgtaggactgggtatagccgtaacattcgtgttgctggttacgcttccggtgaactatttattgcaaaccaaggtgctggctgccaacgctatcattgaaggtgttgacctcagcttcctgagttttattcttttcattgccgttattgccggtatcgtgcaattggtggagatggtggtagaacgtttcagcccgtcgctgtatgcttcactgggtatctttctgccgttgatcgccgttaactgtgctatcatgggtgcttctttgtttatgcaacaacgcatcaatctgggtgcaagcgatccgaaatacatcggtgatgtatgggatgcgctgtcttacgcactcggttcgggtatcggctggctgctggctatcgtcggtctggctgctatccgtgagaaaatggcttactctgatgtacctgctccgctaaaaggtctgggtatcacatttatcactgtaggtctgatggcaatcgcatttatgtgtttctctggtttgaacatctaaaaagaaaggaataagacaatggatatgaatttaatattatcaagcattggggtattccttgtggttattctgttgcttgttgttatcttgctggttgccaagaaatttctggtaccgtcaggtaacgtgaaactaacgatcaatggcgaaacaggactggaagtagagtccggttccacattgcttaatacgctggccgtaaacggtgtattcctgtcatccgcttgtggtggcaagggttcttgcggacagtgcaaatgtcaggtactcgaaggtggtggcgaaatcctgccttctgaagttcctcacttcagccgtaaacagcaacaagaccactggcgtctgggctgtcaggtgaaagtgaagagtgacatggctatcaagattgacgagtctgtactcggcgtgaaagagtgggagtgcgaagtgatctccaacaagaatgtggctacatttatcaaagagtttatcgtggcattgcctaaaggcgaacacatggactttatcccgggttcttacgcacagatcaagatacctaaattctcaatggattatgataaggacattgataagagcctgatcggtgaagaatatctgcctgcatgggagaaattcggtttgctgggcttgaaatgtaagaatgaagaggaaacaatccgtgcttactctatggccaactatcctgcagaaggtgaccgtatcatgctgactgtacgtatcgctacccctccgttcaagccgaaagaacaaggtcccggatttatggatgtaatgccgggtatcgcttcttcttatatctttacgctgaaaccgggtgacaaggtaataatgagtgggccttatggagacttccatccgattttcgactctaacaaggaaatgatgtggatcggtggtggtgccggtatggctccgttgcgtgcacagatcatgcacttgacgaaaacattgcatacgaccgaccgcaagatgtcatacttctatggtgcccgtgcgctgaacgaagtattctatctggaagacttcctgcaaattgaaaaggatttcccgaacttcacattccatctggcactcgaccgtccggatcctgctgctgatgctgccggtgtgaaatatactccgggcttcgtacacaacgtaatttatgaaacttacttgaagaaccacgaagctcctgaagatattgaatactatatgtgtggtcctggtccgatgtcgaaagctgtagagaagatgctcgacgatctgggcgttccggctcagaacctgatgttcgataactttggaggataatcttcggaagttgatttccggtcggagaggaccggaagagtaacataaagaaactggcgggaaatctgtaaaagacaatggtgcttttcagatttcccgctttctttatgcactatcttaccgaatcttttcgtcctttttgtatctttgtccccatgttagagaaaaatgaaataatacagtccgctcttcagaatttgaagattgaatctttgaacccgatgcaggaagctgcgctcgaacagggcacgggcaggaaagatgttatcctgttgtcaccgacaggatcgggcaagacattggcttatcttttgcctctgttgcttaccctaaaaccgaatgatgacagcgtgcaggtgctgattctggtgccttcccgtgagttggctttacagatagataccgtgttccggagcatgggaacttcctggaaaacgtgttgctgctacggtgggcatcccattgccgaagaaaagaaaagcattgcaggaaatcatcctgccattatccttggtactccgggacgtatcaccgaccatctgtccaaaggaaactttgatcccgaaacaatcgagactttgattatcgatgagtttgataagtcgctggagttcggctttcatgatgagatggcagagatcatcacccagcttccgggattaaagaaacgtatgctgctgtcggctactgatgccgaagaaattcctcagtttacgggactgaaccggacagtcaaactggattttcttccggaggcaaccgaagaacaggaaaaccggttgaagctgatgaaggtgctttctccttccaaagataagattgatacgctttacaacttgctttgttcattgggaagcagctccagcattgtcttctgtaatcatcgggatgcggtagatcgtgtgcacaagctactcgaagataagaaactattagccgaacgttttcatggcggtatggaacagccggatcgggaacgggcattgtataagttccgtaacggaagctgtcatgtactgatctctaccgacctcgctgcccgtggacttgatattccagagatagagcatatcattcactatcatctgcctgtaaacgaagaagcgtttacacatcgtaacggacgtacggcacgttgggatgcaacaggtacttcttatctgattcttcacgcagaagaaaaactaccggaatatattcccgaagatatagaaacgatggaactgctggaaaatccttcacgtcctcccaaatctgtctggactactatatatataggtaaaggaaagaaggagaaactgagccggatggacattgccggattcctttataaaaaaggtaatctgacccgtgaagatgtaggtgcgattgatgtgaaagaacattatgcttttgttgccgttcgtcgggcaaaagtgaagcaactcctgaatcttattcaaggggaaaaaatcaaaggaatgaagactatcattgaggaagccaaataaagggagccgaaaaacaacaggtgttctcaaagctgaaaggtgaatttcaagaaccaaataggtgattgggatgctgacaatgacgagatgatcggctttgtcattacaaataatatcattcttttgaagtgagagacgtctctcatggatgacagactaaaatgatagtaaaaaaacaattctgtgacagtctccatttattttcttttaggaagatattggagactcctttctttctgactaatttttataattgtagtctcgttgcttgttagggtgagaaacccttgtttttctctgtctttcttaataaatattcattttgtaaccgttttcctttcactctgtaaccgattattttccacaggttatattttcgccttttatcccttgcttgatatgtatagataacaatatggtgtatatatc

SEQ ID NO: 234 - DNA, 9479 bp, Bacteroides thetaiotaomicron
ggatatatatgcgctgcaaacgacataattacgataagaaaataaataataatactataatcaataatgtgtatgaagtttataaagaaaaaaggtaaatcgctgggtatcggacttgcaatggttggttcattgttggtatcttctttacaagcaggccccgtttatctgcatagtggtgaatcgattgtttcctggaagttaaagccggaggcggaagtcggaacaaatgttccggctctgctgaacgcaggttatgacacatcatcatgggtggacgctgttgtaccgggcactgcttttacttcttacgtaacggcaggactggaaaaggaccctaactttggggataacattcacaacgtagaccgtgcaaagtatgatcgcagtttctggtatcgtacagagtttaaagtgcctgccgactttgataaagcgttgacatggctcaactttaacggagtgaaccgtaaagcggaaatctacctgaacggacacttgctggggatactcgatggatttatgcacagaggacggttcaatatcacggaaatagtgaagaaagatcagccgaacgtactggcagtattggttcacatgccgcaaaccccgttggcaaactacggcagtcctacttacttgtcgagtggtggctgggactggatgccttatgtgccgggactgaatatgggtatcacggataaggtttatctcagcaacaccggtacggcaacgatcatcgatccttggattcgtacagacttaccgttacccagccgcacacgcgccgatctgtcggtggcactggaagtgaaaaacagttctgacaaaccatctaaagtcgtggtgaacggtacgatcacccccggtgatgtgaagttcaccaaagaagtagatattaatccgggggcgacttcggaagtgaagttcgacaaacggtattatccgcaactggtgatcaactcgccgaaactgtggtggcccaacggatatggtgagcccaacctgtatacctgtaaactggaagtatccgtagacgggaaagtctccgaaactaaagacgtaaccttcggtatcaaagagtatagctatgacacaaacaacaacaccctgcatctgcacatcaacggtgtacctgtatttgtgaaaggagctaactggggaatgtcggaatatatgctgagatgccgtggtgaagagtatgacaccaagctacgtttccatcacgaaatgaatttcaatatgattcgtaattggcttggctctactaccgatgacgagttttacgaaatgtgtgataaatatggtctgatggtatgggatgacttctggattaactctaatcccaatcttccttacgacttgaatgcgttcaataacaatatgatagagaaaatcaagcgtgtccgtaaccatccctctctggctgtatggtgtggtgataatgagtcgaacccgcagcccccgctggaaggctggatggctgagaatatcaaaacctttgatggtggcgaccgttattttcaaccgaactcacatgccggcaacctgacaggtagtggtccttggggagcattcgaccctcgattctatttcactgaatatcctgacggactggaaggtgatccggaacgtggctggggattccgtacggaaataggtacggctgtagttcctactttcgaaagtttcaagaagtttatgccggagaaggattggtggccccgcaataagatgtgggatttgcactacttcggtcagtctgcttttaatgctgcaccggacagatatgacgcttctcttgccaaaggttttggcgccccctctggaatcgaggactattgccgtaaagcgcagcttatcaatatcgaatcgaacaaagctatgtatgaaggctggctggaccgtatgtgggacgacgcttccggtatcatgacctggatgggacaatcggcttacccctctatggtatggcagacttatgactactattatgatcttacaggcgcttactggggaacgaagtccgcgtgcgaaccgttgcatatcctctggaatccggtgacggacgcagtgaaggtggccaatactaccgcagaaaactatcaggatttgaaagcggaagtgacagtctacaatatggacggaaaagcggttccggcttatagcaaatcctctgtcgttcattcagcatccaatagcacgctggagtgttttaccatcgactttaataaggaaagaccgaacctgggattgaatcagaaagtagttgtttcttctacttccgaaggcgatccgtcaatggctgtggatggaaagaaagacacccgctggtcaagcgcctaccgtgataacgagtggatatatgttgatttgggcaaggtacaacccgttggcggtgtccgtctcgactgggaagcatcttatgggaaggaatacaagattcaggtatcgaatgacgcccagcagtgggaagaggcttacagcacgaaaaatggaatcggtggtgtggagctgatcactttccccgaaaaggatgcacgttatgtacgtatgttcgggttcaagagaggctggtggtacggatattctctgtggagcttcgatgtgctgggaggaaccggtaagagcgaaggtttgagcgatgtacatttcatccgtctgaaactgacggataagaacggtaagctgatatcggaaaataactactggagaggaaatgaccgcagagacttcactgctctgaaccaacttccgaaggccgaactgaaagtttcttccaaaatggaacagaagggagagaaggcggaaatccgtgcaacaatcggactgcctaagtctgccaagagtgtagcttttgccgtacatgtacaggctgtacgcacagttgacggtgaacgtattcttccggctatcatgaatgataattattttacgctgatgccgggtgaaaataaagagattactattaactttgacaagtctttgttgaaaggcggttcttacaaattactggttacaccttataataactaacttgctatgacactgagaaatataacttgtgctgtaactttatgcctgcttaccctttcgggacaggctgtcggaaagacggaggtaccaccttataagaataaatcactttccatcgagaagcgtgtagacgacctgatgggacggatgacactgcgtgaaaaggttctgcaattgcagaaccggggcgcaggccgtctggacgagatagaccgtatattcaacggtgagagttatggctgtacccacgaaatgggtacgactgccgccgaatgtgctgcgatgtacaaggaactgcaacaatacatgctgacaaaaacaaggctcggaatccccattattacttctgccgaaggcattcagggaatcctgcaaaataattgtacgctgtttccgcacgctttggcgcaggggagtaccttcaatcctgctctgatccagcgcatgaccgaagctgcgggagaggaagccaaagtaattggtatccatcagattctctcgcccgtactggacattgcccgtgaacttcgctggggacgtgtagaagagacctttggtgaagacccttaccttatttccgaaatgggtatcgcctttatcaatggatatcagaaaaaccgcatcacctgtatgccgaagcattttgttgcacacggcactccctccggcggattgaactgtgcgcaggtcagcggtggtgaacgggaactgagaagtttgtatctctatccgttccgtcgtgtcatcaaggaaacgaatccgttggcattgatgacttgttatagtgcttatgatggagtagccatcacagggtctccttattacatgacagatattcttcgtggtgaactcggtttcaaagggtatgtttattctgactggggatcggtggaccgccttaaaacctttcatgctatcacgcccgaaaccgatgaggccggacgcctggcattggaagccggggtagacttgaacatcgactctgcttatgataacttcgaacggatggtacaggacggtcgtctggatataaaatacattgaccttgccgttcgccgtatcctgacggttaagtttcagttagggctgtttgatgcgccttatggcgatccaaaagcagtgagtaaagttgttcgcagtgcggagaaagtagctttggctaaggaaatagctgacgagagcgctattctgcttgagaataagaatcagattcttcctttggatttggctaagtataagtcaatagccgtagtaggtccgaacagcaatcagacgatatacggagattatgcctggactaccagagataccaaagaaggtgtcactttgcttcagggattaaaggaggtattaggaaataaagtaacggttcgccatgccgaaggatgtgactggtggagtagtaaaaaggataagatagcggaagcggtggaagccgttcgcggcagtgatctggcaatcgttgccgtcggaacacgcagtacctatctgggcagaagtccgaaatattccactaccggagaaggattcgacctctcttcgctggaacttcccggagtacaggaagaactgttgcaggaaatcaagaaaaccggaaaaccgatggttgtcgtattgatagccggcaaaccattggctatgccttgggtaaaagagaatgccgacgcactgttggtacaatggtatggcggcgaacagcagggacgttcgttggcggatatcctcgtagggaaggtcaatccgtcgggacgactgaatgtatctttcccgcgtagcacaggcaatactccttgcttctacaatcattttatcacagaccgtaatgaaccgttcgaccagccgggcagtcccgaagaaccgaaaggacattatatctttgacgcccccgacccgttatggagctttggcagcggacagagttacactacttttgaatatgtggattgtgcgttgagtgattctgtattgaccgacaaggatcaactgacggtaacggtaaaagtgaagaacaccggcaagatggatggcaaagaggtagtgcaactgtatgtacgcgaccgcttcagttccgtggctactcctatccgccagctgaaagcattcaggaaagacctgattaaagccggtgcaacaaacactttcacactaaagcttcccatctcggagctggcactttggaatgcccgtatgcaggaagtggtggaaccgggagagtttgagattcagataggaagtaccgctgacaatatccacttcacgaaggtgataactgtgaagggaaaatgacaccgaacgacaaaaaacgaagaggtctgtttctgacgatagggttgtttatactgccgattcagctggtcattaatcatttctatggcggtattacggtgaaatctttcatcgtgatactggttggctggctgatcagtataggcatgttgtttctggtctttcgttcggcatgtagaagatgaagcttgagtatatacttaaaacaatgattatgaatacaaaaatcctttgcgtatggatagcgcttctgacttgtcagatagcgggtgcacaaacaaagaatgtgacatggggagatcagggaaacggcacgtatatcaatccgatattgaatgcggactattccgatccggatgtcatcagggtaggcgataagtattatatggtaaactcggactttcattatatgggcatgccggtgctggaatccgatgatatgattaactggaagattatcagtcaggtgtaccgacgcctggactttccggactgggatacgaacggaaattatggaggaggctcatgggccccctctatccgtcatcatgacgggaagttctggatttacttctgtactccccgtgaagggctgatgatgagtacggctaccgatcctcacggcccttggtcacctttgcattgtgtgaaacggattggcggatgggaagacccttgcccgatatgggatgacaatggtcaggcttatctgggacggagccagttgggagccggacctatcatcttgcataagatgagcgccgacgggaggaccttggaagatgacggacacgtgatctataccggtccggtggcagaaggtaccaagtttcacaagcgggacggatattactatatcagtattcccgaaggcggagtaggtgagggatggcagacaattctgcgttcgaaaaacatctacggtccttacgagaagaaagtggtactggaaaaaggttctaccaatgtcaacggacctcatcaaggtgcactggtagatactcccgaaggtgagtggtggttctatcacttccagttgacggaaccgctgggaagagtcgtgcatctgcaacctgcacattggaaagacggatggcccgtgattggggtggacatcgatatgaacggcataggcgaaccggtaaaagtctggacaaaaccgaataccggaaagaaagtgcctgtaagcttcccgcagggaggcgattcctttgattcgcccgagctgaacttgcagtggcagttcaatcataatccttctgacgccgactggaatctgacggaacgaaaaggatggttactgttgaaagctctgaaagcggatcatcttcgggcatcacgcaatatgctgacacagaagtgtatcggatacgaggggacggttacgacagaaatggatatgagttcttggaccgagggacaacgtgccggactattctgtataggcaatttgttcaatggcattggaatactcaaagagaatggcaagaactatctgtatctggagaataatggtagtgtggagaaagtaaagccggtaagcggtaagaagatttatttcagagcaacgatgaatgcacgtaccaaccagcatcagttgtactatagcacggacaataagaactttactccttgtggagaagcttattcgctgagattcggtgactggaaaggtgcccgtgtcggtctgtactcatacaacacgcttcgtgacggaggaaatgctttcttcaactggttcacttacgactttaactgatttagttcgttcacaactttaattgattcagccatccacaattttaacgacttgatttataaaccttattaaatgtatatcatgaaagtgagaatcctttttttaatctgtttccttagtatcacctgtcttctgaacgcggcggacaagcctgtcattcagattcatacggataacagtagtctgatcttccgcgtagccgacaacgggcggttataccaaagctatctgggcaaaaagctgaaccatgaggccgatatttctcatcttccgcaagggacggaagcctatatcacccacggtatggaggattactttgaacctgccattcatatccttcacaatgacggtaatccgtcacttctgttgaagtatgtctctcatgagacgaaagcggtgtcgcaaggagttaacgaaaccattatcaccctgggagatgataaatatccggttacggtaaagctgcattacgtcacttatcctgccgaggatatcattaaaacctatacggaaatcagccataaagagaagaagcccgtagtgcttcaccaatatgcctctagtatgcttcatctgaaccgtgcgaagtattatctgactgaattttcgggcgactgggctcacgaagctaatatctccgaccagccgttggagtttggtaaaaaagtgctcgataccaaactgggcgcccgtgccaacatgtttacccctccgttcttccagctttctttggaccagctggctacggagaattgtggtgaagtgctggtaggtacattgggatggaccggcaatttccgctttactttcgaagtggacaacaagaatgaattgcgtatcatttcgggtatcaacccttatgcctctgaatattatcttccggcaggtgtcgtgttccgtacccccgatttctattttacctatagtgcaaatggtaagggcaaagccagccgtaatttccacgattgggcacgccgttatcagttgaaggacggagatgaaacccgtatgaccctgttaaataactgggaagcgacttatttcgattttaatgaggagaaactgataggactgattggcgatgccgcagggctcggagtggatatgttcttgctggacgacggctggtttgccaataaatatccgcgcagcagcgatcatcaaggcttgggagactgggatgaaacggcagataaactgcccaacggtatcgggcgtctggtcgaagaagctacaaagaagggtatcaagttcggtctgtggatagaaccggaaatggtgaatccgaagagtgagctttatgagaaacataaagactgggtcatccatcttcccaatcgggatgaatattacttccgtaatcagttggtacttgacctgagcaatccgaaagtgcaggacttcgtatttggagtagtagatgatttgatgactaaatatcccggtattgctttcttcaaatgggattgcaatagcccgatcactaatatctactcttcttatctgaaggagaagcagtcgcacttgtacatcgactatgttcgcggtctgtataatgtactggaacgtattaaaacgaagtaccctgatctgccgatgatgctttgttcgggcggtagcgggcgtatcgactatgaaacgctcagatacttcactgagttctggccgagtgataacacggaccctatcgaacgtctgtttatccaatggggatactctcagcttttcccggcaaaaactctttgtgcacatgtcactacatggaatcatgatgcaagtatcaaattccgtacagacgtagcaatgatgggcaaacttggttttgatatcaaattgtcggacctcaatgataatgagaagaagttctgccgtgatgcggtcaccaactacaatcatcttaaaccggtagtgctcgaaggagacatgtatcggctggtatctccttatagcggaaatcatacttccacacaatatgtggggaaagataagaagggagctgttgtctttgcattcgatatttattcccgttatggcgagaaactgttgcctgtccgtctgcaaggactggacgccggtcggcagtaccgggtgaaggaaatcaatctgatgccgggtactaactcttctctgcaaggaaacggtgagttattctctggtgaatatctgatgacggtaggactgaatatatttacaggtcagcgtctgaacagcagagttatagaagtagttgctgaatgacaggaccgatggaaatccgttaatcacttgacaaacgccttttattgttgtatatttgtagttccaaacctgaactgaataatataagaacgataaataaaatgagaaaattagtgtggaatcatcggctgcggtggtataatatagtaacaaatagtac

SEQ ID NO: 235 - DNA, 9313 bp, Bacteroides thetaiotaomicron
aactagtgatgtaaataatgaataaaaatggatttagtcgatgtgccgatatctatatcggccgtttgcgagaggagggccgctattctacagcgcacgtctatcagaacgcccttctttcttttagcaagttttgtggtgtccatagtgtgtctttccgtcaagtcacccgtgatcgtcttcgccgttacgaacagcacctttatgaatgtggtctgaagcccaatacgatttccacgtatatgcgtatgcttcggagtatctataatcggggtgtggaggcgggtagtgctccttatgtccaccgcctgttccatgaggtctatacgggggtggacgtgcgtcagaaaagggcgcttcctgtcgtcgctcttcgcaggcttctttatgaagatccccagtctgaccgtctccgccgtacccaggctattgccgctctgatgttccagttctgcgggatgtctttcgccgatctgacgcatctggagaaatccgctcttgacagcaatgtgctgcgctacaatcgtgtcaagacgaagactcccatgagcgttgaggttctggacagcgcaaaggagatgctcgaccagctccggaaccgacagtctccccgtcccggttgtcccgactaccttttcagcattcttcaaggtgataagaaaaggaaggatgagagagcctaccgtgaataccagtccgctctccgaagattcaactactgcctgaagtctctggcaaagcggctgcgtctcaacttccccgtcacttcctacacgcttcgtcattcatgggctactactgccaagtaccgtggtgtccctattgagatgatcagcgagtcgcttggtcataagtccatcaagactacgcagatttatctgaaaggctttgaactgaaagagcgtacggaggtaaaccggatgaatttgtcttacgtaaagcggtgcggagtaggtcagtgcatctgatttagaagcttgatatacagtgtttatcggtgtgcgttacttcttaggtaacggaatgattcatggcgcaaagatggacatatttatgaaaatacgcaaacaaaaatgaaattattttcggaaaatgaatcaaatgcaggcatagctgatgaatattgcaatattcgtgttatgtcttttttttattctaatttttgaaaaacaccttcacatctgctctatttccaagtttatagtcatcttttcatcgtttcgttgaaaaaagttccctgtttagctttccctatgtttgttcgttacctaagaagtaacggataaacatggggtaaaaaaatatgattttaagaaaaaagaaatcactaaatgctgggcctattaatgggacaggggaaggcgtagcacactcaaaacgctggtatgttgctttggttcggatgcaccatgaaaagaaggtttccgagcatttggacaagatgggaatcgagaatttcgttcccgttcaacaggaacttcaccaatggagcgatcgtcgtaagctggtcacctccgtcttgcttcctatgatggtgtttgtacacgccgatcctaaggaacgcatggaagtcctgagtttttctactgtcagccgttacatggtgatgcgcggtgagagtagtcctgctgtaattcctgacgagcagatggctcgtttccgtttcatgcttgattattcggaagaatcgataagcatgaacagttctcctttggcccgtggcgaaaaggttcgcgtgattaaaggtccgttgacgggtcttgttggcgaactggttaatgtggatggcagaagtaagattgctgttcgcttgaatatgctgggatgcgcctgtgttgatatgcctgtcggttatgtagagccgattatggcggctgtttaggccaagggatatggatgctattattttacaagaaaacatagagggtttattaagtttggtacgtatgctgcttcctgatggggggagtgcaggctgcgtgtatttggatgatctttcagcattacaacgatccatccacgaaaagataaacgatttatattctcaacggggggagacaccggaacaggatgctaccctgtgtttggccatccttcagggatataatgtgtcgatgtacgccaatccggaagacgaagaaagaaaacaggctgttttgacccgttctctgtctcttctcgatgttcttcccccttctcttcttaagcaacagttatctgccgtctgttacgggatgcaggaactgtgtgaaatcaactgaaacttttttatttgtcaatgaaaatacaaagactttttagcattctactcttctgtttgatgctgggaagtggctcgcttatggctcagtccatgagtgattcacaagtactggaatatgtaaaggacggtatccgccaaggcaaggaacagaagcagcttgcttccgaactagcccgtaagggggtaaccaaagaacaggcaatgcgtgtgaagcagctatacgagcagcagaacaatgtaaacacctcgaaatcaacgggcacggacatcaacgaatcccgccttcgtgaagagactaaggagaatacttctgatatgctggaggatcatccgactactcaggaccttgcccgtggcgatcaggtcttcgggcgcaacatcttcaatacccgtaacctgacatttgaacccagtgttaatctggccactcctaccaattaccgtcttggtcccggtgatgaagtcatcattgatatctggggtgcgagccagaacacgatccgccagcaaatctctcctgaaggtactatcaacattcagaagatcggccctgtcaaccttagcggtatgacagtctctgccgccaatgactatctgaagaacgccctgaataaaatatataacggtctgaacaacacgaccgatccaacttccgacatccgtctgactttaggtaatatccgtactatccagatcaatgtgatgggagaagtcgtgcagccgggtacctacgccctttcttccttctctaccgtcttccatgcgctttaccgtgcaggcggtgtgagtgatatcggcagcctccgaaacgttcaattagtacgcaacggaaagaatatcgccaccatcgacgtctacgaatttatcatgaaaggcaacacacaggatgacatccgccttcaggaaggtgacgtcgtgattgttcccgcttatgatgtattggtaaagatcagcggcaaggtaaaacgtcctatgcgttttgaaatgaagaaagaagagaaccttgccactttaatcaaatatgccggcggctttgaagccgatgcctacacccgttcattacgtgtcgtccgtcagaatggtgaggaatacgaagtcaacacagtcaaagatatagattacagcatttataaaatgcgtaacggcgatgttgtaacagccgaagccatccttaaccgcttcacaaacaaactggaaatccgtggtgcagtttaccgccccggcatctaccagctcagcggtaaattgaatacgatccgcgaactggtcaatgaagctcaggggctgaccggtgacgcttttctgaatcgtgctgtcctctatcgccagcgtgaggacctgaccagtgaagttgttcaaatagacatcaggtctatcatggacggcacttcgccgaaccttgccctaatgaagaatgacatcctctacatcccaagtatccacgacctggaagatcgtggcaatgtcacagttcacggtgaggttgcccaaccggattcctatccttatgctgataacatgacacttgaggatctgatcatccaggccggtggcttgaaagaagccgcctctactgttcgcattgatgtatcaagacgaatcaagaatcctcgtagtactgcggataatgatacgatcggtcagatgtataccttctctttaaaggatggttttgtcattgacggtcagcccggttttatccttcagccttatgatgaagtttatgtccgtcgtagtcctggctatcaggcacaacagaatgtagccattgaaggtgaaatccttttcggaggaaattacgccatgaccagccgtgaggaacgtctttccgatttggtgaataaagccggtggtccgaccaattatgcctatctgcgtggtgcaaaactgacccgtgtggctaacgctagtgagaagaaacgtatgggtgatgtaattcgccttatgagcaggcaattgggcgaggccatgattgactctttgggtattcgtgtcgaagatacctttacggttggaattgatttggaaaaagccttgagcaatcctaaaagtaatgccgatcttgtcttacgtgaaggagatgtgatctccatacctaataataataataccgtaactatcaatggtgctgtcatggttccgaatacggtttcttatatgcagggcaaggatgtagactactatttgaatcaagccggtggttattctgataatgcgaagaagagtaagaagttcatagtatatatgaatggtcaggtaacgaaggttaagggtagcggcaagaaacagattgaaccgggctgtgagattattgtgcctagtaaagctaagaagaaggctaatattggtaatattttgggttatgctactacgtttagtacattgggaatgatggttgcttctattgccaatttgataaaaaaataagatttatgtcagaacaatcagtagaaaggaaactggaagatatggagattgatttattggatatatttcgtaaaattgtagcaattcgtaagaaaatttataaagcagctaccattggtttgttaattggtattattgtaggggtgagtatccctaaaagatatacggtcactgtaactctttctccggaaatggggaatgataaaggaaacagtgggttgactggcttagctgcctcttttttaggtgggagtgctagtatgggagggggtgttgatgcattaaatgcttccctgtcatcagatattgtatcttctactccttttttgttggagttattgaatatgcaggttatggtagataaaggagaaacaaaaacactatctggttatttaatgacagaatcttccccttggtggagttatatcataggtttacccagtatgtttattagtggagtgaaatctttatttactgatgaagaagaactatttggtgaaagacaacagggtggggtggttatcttaactgagaaagagaaagatcagattgatgcgctaaaaaagaatataacggctattattgataagaaaacggctatcaccaatgttagcgttactttgcagaatcctaaaatagctgcggttatagcagactctgtcgttcatcgtttacaagaacatatcataggctatcgtacttcaaaagcaaaagaagattgtgtttatctggagaagttgtttgaagagaggaagcaggaatattatgctactcaaaaagattatgccgaatatgtggatacacatgataatttaattcttcagagtgtacgtgctgagcaggaacgtttgcagaatgacatgagtttggcatatcaagtatatagtcaggtagccaatcagctgcaggttgccagggctaaagtacaagaggaaaaacctgtgtttgcagtggtggaaccggctgttgttccattgaaagcttcaggattaggtttgaaagtttatgttttactatttgtatttttatttgtttttggtactataagctggatattgatggggaggaatatatttaactgtttgaggaaaaataaaatttgagttttctcatgaagttattttaatatacaatagaataaaaatgtcgtcttctcttataaataaagccacaaagggcgttttttggagtgcaattgaacgtttctcagttcaaggtattcagtttgtactaagtattattattgctcgcttgctattaccatcagattacggactcatagctatgttgagtatatttcttgctgtagcgcagagttttattgatagtggtttttcaaatgcgttgatacagaagcagaaccgtacagagattgattattctactgtattctattttaatataggcatcggtcttttcttctaccttgtattttacatttcttctccttatattgctcttttttattcagagcctcagttatgtttgattacaaaaatagtagggttgaatgtagtgataaattcttttggggtagtgcaaagggcaaagttctcaatcgccttaaattttaggttgcaagctgttgcttcattaacggcagtaattttaagtggagtcttaggggtcagtttagcatattatgggtatggcgcttggtccttggtgatgcaaagtttgttgaataatttttttaatgtattgttgctttggttattatctaaatggtatcctctatggtgtttctcatggaatagtttcaaatctcttttttcatttggaagtaagttattagtgtcgggtcttctacatactttgtatacgaatctttattctttggcaattgggaagaaaatgacttctggggatcttggtttgtataatagggcatctactttggcggcttttccggcaggaaatattacagatgtgatgtataaagctatgttccctgttctttgcactatacaagatagtgatgaagagttggaggtctattttctgaggtatattcgttcagcatgttatgtcgttttccctttgatgattggtttggctgtgttagctgatccttttgttaaagttgttttgacagacagatggtcagggatagttccaatactacaaattttgtcttttgcatatatgtgggatcctgtaatgcgcattaataatcactttttatatgctaaaggtagaacggactatacgctgaaggcagaagtctttaaaaagataattgctttttcgattcttctgttgactattccttttgggctgtatgttatagcttggggagtcgttatttattcatttatagatatatttgtaattacaagatatacttgtataatttctaatgtaacattgaccagtgagataaagaaattatttccagtattattgttagctttaagtatgggagcgtgtgtatggttatcaacctatttcgttatttcttctgtgttaaaacttctctcaggcgttcttattggtgtggtctattatttggtagtttccaagatattcaagtttgaggagatgtgttttttgcaaaatatgattgtgagattgaaaaataagtaatattttataatgagaaatatagcagtaattctagccggtggttccggacaacgattgggtgagaatatacctaaacagtttttaaaaatagcaggtaaaaaagtcattgaacatactattactgtttttcaaaatcattctttgatagatgaaattgtagttgtagtccatccagactatataagggatgtagaagatatttcgttgaggaattctttcaataaactaaaaaaaatattattagggggaaaggaaagataccactctagtttggcagctatcaatgcttatgatgaagaagtgaacttattatttcacgattcagttcgtcctcttgtcaatgagcggattataaacgattgcatccgtgcattgttgacttacaatgccgttgatgtagcaattcctacaacggatactattattcaagtagatgataataatgagattgtcaaaataccctcacgcatattattgcgtaatggacaaacacctcaggcatttaaacgttctgttataaaagccgcttatgaaaaagctttgcttgatcccttgtttaaaacaactgatgactgtggtgtagttttaaaatatttgcctgatgaatctatttatgtagtcaatggagagcaatttaatatgaagttgacatataaagaagatatttttcttttagataaactttttcaattgcgtagcattaggaaccagcccactttattggaaaaatcggaaatggaggaactacaaggaaaggtagttgtagtttttgggggtacgtatggtatcggacaagatatttgtgaaatttgtcgggaatataaaacgtcgttgtatgtatacagtcgttctacaggagtggatgtgtcgaatagtcaaagtgtaaggagagttttatctgaaatatttgataaggaaggacggattgactggatcgttaataccgctggtatattggacaaacagcctttggcgaatatgagttatgaagcggtacatcaaagcattgatgtaaattatttaggtaatattattgttgcaaaagaatcttttttttatttgaaagaaagtaaaggatcgttgttgttttttacttctagctcttatacacgcggaagggcgttgtatagtttatattcatcgtctaaagctgctattgtaaactttgtacaagctttgagtgaagagtggtttgaatatggtattcgtgtgaattgcatcaacccagaacgtactaagacccctatgcgtattcagaattttggaaatgaaccggaagatactttattagaaccgaaagtggtagcaatcgtatcagtaaatactttgctatcggaaatgacaggtgaggttgttgatgtaaaaagataaaattgtatgatgttggttatcaaacacttattaggatactttattttacttgtatcttatgtttttccccgtatttcaaccatttgggtctttggaggagagaataatgcaaaatatttatattataagctaaatgaaaaggcggcagatattaattgtatttggatttcaaagtctaaagaagaggttgcacaagtgtgttctttaaaatataaggctttttatctttggagtttgaaggggctgttttattcattaatagctggacgttatatttatacgttttctgtttcagatataaatccttggactattggttggacaaaaagagtaaacttatggcatggcgtgggtattaagaatgttgaatttaaatgtaagcttggtccattggcaaaaaagtataatccgaatagtcttaaatctcgcttcctttacccatatttatttttcagacctcatttgtttttatcaacctctcctttaatgactaaacattttacagagtgtttcagaatttcggaagatagatgtatagaggctatgtatccaagaaatgaaattttattatgggcacatgatcagatagaagaatttcttaaacgatataataaagagcaggaactggatgtaatagaggattgtgcaagttattcttatgtatat

SEQ ID NO: 236 - DNA, 9305 bp, Bacteroides thetaiotaomicron
attttattgttatttatctaatgacgatttaaaaatgatataccactaaaacaattacatgttttttattaataaatttacttgtatgcaggaaagctcagaacatattaaaaaagaaagtcatttctcccttttatgaagaaatgactttctaaatcaatttaccaagatgaatccgtcagtagctatcaatcatcttcatcatatatgctttcccaattgaaaatacgataaaaataaggacgacaaaagtcagcactacccggaaaatcaaaattatctccagcagtatcagcatcagtattagtagaaaatactaattcaccttctcgtgcaagttctagatgcaaatttactctaagcaaatttttataatactgattacctatcttatccacagaataagggacattaaacaaaattttttgatctgtaaaaggtccataaggcgtctcaccacgatatagataaacagaatgaccataagatacagcttgtcctatcatatagtagtaatctccttttttaaagatctgtggcatactacatacataattattttccattatagtagagcgagttctctcctctttcgtcggatacatcttttgccacataaagttaccacttaaatcacgtatgtaatactcccactcagaagttaaatcatgagtagtggtgcgagcaactaatggtctgttattctctgttacataaagataaatatgtccatcttcatctttccatatagtagaaccatagccaacatcatctgtattgaattcttcgtttttactaattcttttaagataagtactattacccggctgtccttccaaactgtaaacagctagacaggtaccagttcgagtcattttaccttcatgattatctatttccccccacaacatttgaagttctttaactccattattatcaaatatcgtagcaccacctatctgatagaaatgctcttcatctgtttcttccataatagtctcatctggagctatgtgtgtatacgcctgataataaccttctccatcaggatcattagtttgtatataatcaactaaccatcttaaatcatcatccgtttctccaagactaccaccaacagtcgtttggatcataatactattatgtgggaaattacaattacctcttgctcttgtttcagcatctacaactccaaaatagctatcattaaaagcccatagaacatttccatcagacaatgatgtagattgcacaccaattccaccattccatcctaatgtgcgagtaaatagcttatcatactttttgtctttataaacaaaaacctcaccactatgctgacctacattaggaattagctgtaattcccatgccgaatctatatttggaggagtagtcgttacatcactatccactatttcttcatatgcagtttgcgctgcgtcataatcgttgcatgcaactaacgccactgcaacgaaagttacatatagaagactatatatatttcttgttttcataagatttatcatttattatcagccactcaattattttcgttagcaatagccactggagacatcacctctttcatttcataccaatcattcgagttataattataacgataattcaacgtaaactctttcttctctggattataatatgatggggtatcctcaatatttaacactgtaattccactatttacattataccatttatctaatgtcactttttgacattggatatattctccagttggcaatccattactcccgataacaggaacatcaatcatctcctcaggatggaccgtaacaacaatcccttgtttacggagttcttttctatccgatgtaagtgtagatcccgttaaaatacgaataccatattccgtaactggagcaactaacttagtggcatttattggtttataatctggagcattattctttttgtccaaaggttcccaagtatctttagctactctcaatcttgttccattcatagtataatagcttttctccttagtcgttgcataatcatttttcataagtatctgcatcaatacattcctccttgcagaagaaatcatatagtcagaaacagaagctattcttaaaggaagaaagtaattatcttcaggttccagcccatcaatatttactttaattggaaataaagaataagatgaatttgcatttggatataaatttatactccaatcatctactttataatgagtatctggtaactccaggacatagtttttgtaattatccccatatctcttttgattatagtccgataatacagtttcattcctttccagttctaccatcacttctttttcaattggagttgtaccacttgcataaacagaaaggtatcctatttcctccccgccgaaagcaaattctcgttggaaaatattatcttctccactaacaatataaatttccttacgatactgttcatcctgataaaactcttgctcgcaggatgtgagaacagcagtagctgtcacacctaccataagcatcaatttatttgtaaaatttctatatttcatagtttatacatttaaaattttatttatcccaaccaggattctgatcaagaacagaaacctttctaatctcatccaaatgtaaaggtaaccataccatcttaggtttgaaatcacgttcaattattgatttatactgaatgacagtgggctgatagaatccttcccattcagcctgttctacatttaaccccattaaaggttccctttctaaatcttcaacaattccccagcgtctaatatcataataacgttgtccttcccaaaataactcaatcaaacgttcacgttgaacaactttattaaaagcttccactgtaatcaaatcatccgctgttaatcccggaataccagcacgataacgtatctgattaaaataatatttgatagcttctgtatcacgagtataagtctgaccatcaatttcatatgcttgagttaaattattcaaggcttctgcataagcaagcaatatttctgcatatcgaataatcggaaatgacttatctttttgacgcgccccactaccactcatagcatcttgtggattgatatattttcgagaagtatatccagttatattataaacattattattagaatgatttttaccagaattagctccattccaataatcaatattaacatttttcttagcactttcagtagtagatcccatcgcccaccaagcatgtgagtaaccaatattcacatagaaacgtggttcacgattagtatatgccaaatatgttccttggctgattttataaccttcagataaaactttgccttctgtcgtcacacaagtcttatcataaggacgggatatatacggatatgcactactagaatttttaatatcacgcccatctgccatataaaattggtctactatatgctgaggtacacataaacaagaagatcctccaaaattcaatgggaatacgtaacccatatggctaccaacctgcgctgtagaactacaccatatgaactccggattttgattaatagcaagctctccattaaacatttcggcataagagcgatacggatctacgacttttttatctcccatccctacaccatttggaaattctgcagtaggaacctcttgcggtagagtgactacatatgtaccataattccctgattcaggatgttcagcatcagtagaagcagcaacagtatataattgatatcgtcctaaatcaataaccttcttcgcagccgcagcagcaagtgcccacttacgttcatcatatgattgagaaacataatgatctccatctgtacaacgggtaaaatcaccaaaaaatctacgggctgcctctccaccgttatataatgggctagcagcttgtaatctcacacgagcagctaaagctaaggcagctccttctgtaggaatatattgatccatcgaagtggtagcatcaggtaagtttttagcagcttcatcaaattctgaacaaatataatccacacattcgtcatacgtattacgcgttcttgcataatactccgcttcctcattattactaacaatttcatcacctaacaaaatcattggaccattctgttgcaaaattaaataatatgcataagctcttaagaaacggcattttgcacgaaattccattctttcaaaactattcatatcacgaacaccatcaatatgtggcaatatagtattcaccttacgaatcaccttataacatttaggccaaatattgaaatcccatgtccaaccgcccattgaactagaagtaatctcattattcattaacttcgttccagagaattgtataacaaccataccattccaatcaccacagctcacagcctcgtctgaacctgtaactccaggagtgttcccatattcccaaattttatcgacaacaggaagcagagcggcagccccattaaaataacgttcaatattacgcttatttgcataaatagaatcttcttgaaaggtatcctcaaaataatcatctatattcaaataattacaagaagcaaaaaagccggataccaataacagaaccgataatataaaatattttttcatgaactaatttctattaagtttatacatcgtattagaaattcaaatatagctgcaatgaataacgtgcaggtaaaggataagcctgtccacaagatgtcgcttgttctggatcgaatatatttacagaatcccatactgccaaattttcacacatcaactgaatattcatggaattaatgcccaaaatacgttgtaatgcaggaacttttagattatatgccaagctcaattcctgtaaacgcaagtaacgggcatcacccatccaaaatgtagaaggtttcgtattattctcattttttccataatacaaacgtggaaaacgagcatttggattctctgtagcctgatttcctgaatattcagcagaaatccaacgattctccggattataagcaattgtcattatatttcctttatccttctgattaaatggcatgtatccatcgaagtttctaccatccgaaccgccatataagaacttattacgtcctgtccctttgaacaagacatttagtgtccaacttttataacgaaactcagcaccaataccatacatcaactgtggtacccctgaataagcaaataaaggaactttatcatcatcagtaattttaccatcaccatttatatctcgatatttaatatcaccaggacgtaccgtaccaaattgtgtaggactcatttctacatcttgttgatctttaaacaatcccatagcaacaaatccacgttgtacattattggcataaccattattttccaaatatgtataaggcttctttgtatcttcccaatttaatatcttattcttactcaaagtaaaattactacgtaatatcacatgtgcatcctttcctatctgttgatagaattccatatttccatcagcaccccagcttttcatacgacctatattaccataaggcatttgaatcaaacctacataatcaggaatttgtttacgttcctgaaaaataccatctcgtgtatccttaaaataatctaaagtcaaagtaaatttatctttaaacaaatgcagatccataccaacatcaaatttctttgctttttcccacatcaaattattggcaccaacttgttcttctgttaagctaccagtccctccccaaggatttgaagcattttcttcttttattagggtcagataaggaaaacgtctagaactgatgcggtcattaccaacaacaccataagaaacgcgaagcttgagaaaattcaaccaacttacattttcacgtataaattcatatgaagatggtacccatgcgaaagctcctgccggaaagaatccatattgtttacctggttcaaagttttcagatccattcaaaccaaagttcaaatcccaaaaatatgtatctttaaaaccatatgtaaaacggcccgaaagactttgataacgctttggtatagcattcatacttttatctgcaccagtttcagatgtatcttctatataataaaacagtaaaccacctaaacgatgatcgccaaaggtacggtcataattaacatttgcctctaaatatagcttcctccaaacccaagcagcactgctatatgtaacggttttctcatcagctattttctcaaaactcaaggttccattagggttacgctccttcaaagcttcatttagttctggcattttatagcgtgcttctccaaataaactttgtgtatcccatgatccctgtactttagctgatagccctttagtaatcatcgacaaatcctgtgtaatacctaaagtaactaaattcctggtattctgttctctagcattacctgtataattcaatagaacatacggagatatttcatccttagttcctgcagcaggataatatccgtttgaatagcgtaatggatagcttattggagtagtctttgcctgtgaactccatagccaatctgtcaaactgactcctctagaatattcccccatgctcgggcgagtattcaccgacatatagccagttgttccaatatagactttagttgttttagtcaaatctatatccaaattcaaacgataattataagtatcatagcctacacctttattgtatttactatctttggatggattataagccgcagattctttcgacattcctaaacttgcaaaataacgggcaacactgctaccaccttgagcacttacataataagtttgctggaaagaattgggatttaaaataacatcttgccagtcaatgtttgggtacagatccggatctaagccatattttataatatccatttctgtcttgttataaataggagataatccggttgcaacagaagcttcatttgccatttcagcatattgagtggcattaacatattcaggtaaacgttttaaatgtgagattgtcatattagcacgaccactgatcttcaatttggactccaaaccacgcttcgtcgttaccaatactacaccatttgcacctcgactaccatacaccgctgtagccgcagcatctttcaaaacagaaaaactttcaacatcggcagcatctatctgactcaaactaccttccaaaccatcaatcaacactaatgcaccactattagcaccaaacgtaccaattccgcgcacccaaaactcggaaatatttttgcccggttcaccactagattgaactccaatcacacctgcaacacgacctgctagtgtattaactatatttgtagcaggaacctctagttgcgctggatccatcgttgtaattgcaccagcaacactgacctttcgctgcgtacccatacctactacaactacttcatcaatattctccgtagccggttttaaggtaactttaacattgtcaattttattcgtcaaacgttgctcatagttttcatatcccaaaaaagacacaaccactatatcatatatatttacctttaaccgaaatttaccatcaatattagttgttattcccacacctggtttatctttaacatatacatttgctcccggaactggttcattaaattcatcgaagactgtaccagtcaacataaagctttgctctttctgtgcatgtacttgtgctacaaacgcaagaagcaaagcaaaaattacaaatattcgattcatattatattaaatataaagtttcactaattatttattcgacagctaatcgacgaatagcacgattctctgagtcgccgatatacattacatcgtcgttatcaatacaaattcccaatggctttttgaattgagcatcttctgcactaccatttacataacctgaattttggggttttcctgctaatgtagatacataacctgtactcattgttatcttacgaatacagtgattttcggtatcagtcaaaattatattaccttctgaatcgacacacatctgtccaggtttattaaacatagcttgtcctattggtccatccaaatatccacttttaccttcttgaccagcccaacatgcacattctttagtacgtaaatcatatttataaatacaatgcttatcattatttgagaaataaaaaacattctcatcttgaggatcgaaaacaagtccataagcactaccatccttggttccaaccaaatccccattcgttagattctctcctctagcattctctacatcaatccgtaccagatttccacctaacattcttgaatacatttttccatctggtcccattgtaaaattacacttggctgcccatactccaaatccttcaatatttggaaaatttggatcatcccatgaaatagaacttatagctgtagttggtgcataatccgtcttagggtcaaaataataaacttcatgactatctctattagcccagaattgatagacaatatcatccttactgttataccccaaaacaggagagttaaacaacgcattaatatctgactttagagatattaatttatcagcctcctcatttaacataaatgcagcaaactttccatcattatctactaaaaagaaaacatttttatcctgatctacacaaatacacctatcaatatttgctctaaattgtgcttcagatagtggtatagttcctgttggattcacctgtgccgatgtacttcctcccactaacgtagtcacagtagtctggatataataatcaaatgtctgcttgtactcctctatttgttcatgtacttgtactttaaccacacattctgggtcctctattgtagatgcacgtttaggagccaataccaacattctatcatccttcacagaaatgacagaagcctctttatcattgaaaaagaccttcacattttccttactatccccaaaattcgatccattaagaataacttgagttgcaagttttccttcgggcggataaaaatcagtcaacacaatcggcttattcggatcatagcccgaagttgactcttcatcatctttacaagacgaaaagcagcagcctacagccaagcagacaagccactgccatttaaaacatttttgtaataagtttctcatagaaaataccgtttttaagaatttatataataataatgatcataagtttactttcgttattttatgtttctttctcatactttttgctactattaatagtaagacgactagactaatactaacc

SEQ ID NO: 237 - DNA, 9254 bp, Bacteroides thetaiotaomicron
aatattaataaggaaggaaaatagttatgcctgaatatgaattgataaaagtaataggtcaaggaggcatgggcagcgtctatgaagggagaagtggcgatgggaaacgtgtagcaataaagatgatgaatagtaaagctactatgaacccggagtttaaagaacttttctatattgaagctgctgcattgaaaaagatgcggcatccttcagtggtaggcattgttgacaatcctttttcggatgagcatggaaatatgtacttgcctatggaatatgtagacggagagaccatcgaacaccatgtggaaatggcaggaccttatacggaatttactgcaaaggacttgatggggaaaattctggatgcaatggcttatatacataggatgggatgcattcatcgtgatattaagccttctaatataatggtacgtcccgatggtagtatctgcattatagatttcgggattgctaaagatatgaaaaccagcacaggcaaaacaatcggacgtattatcgggaccgacggatatatgagtccggaacaggctaaaggagatagcatagattatcgcacagacatttattccttaggttgtttgttacattatatgctcactggttctcatgccatcaaaaagcggtcaaatgattatgatactatttgctctattttgaatgatgaatttccacgtgcaaagacttttaatccgcatttatctgatcaaactcaagaagcgatattgaaggctgtagataaaaatatgcttcgtcgttttcaaacggtgatggaatttaaatcaggactatttagagaaacggtggtagacccgaatagagtaaaagtttctgttgggcggagagagtgtgacataaccattcctagtgattatatcagcggtcaccatctggaaatagaatatagggaggaaagatgtacaggttcgatacatcgctatctcctatttacagatagtagtacaaatggcaccagtgtagatggcaaatacttacgtcatgggagcattaaaataccattttcttttgagaatccgtccccattgccgaatgtctggctggcagggagaagcgaatatcttttagattgggacgaagtcatacagaaacttcgggataaaggaggaagaactgtcataatggaagaagtggtaggagatatcctgcctcctactcctccaactccatctgtcaaggaagataaacttgggataggatatggaattttgtctgtggtatgtccaattgtaggatgggtactttgggcacagtggaagaaagagacgcctcgacgagcaagagcggctgctatatgtggttggatagggtttgtagtcggatttataattaatatcttaagtagtatatgaaaacaataacaataggaagaagtagtcactgtgatattgtaattgcagatgagagagtgagccgcgtccatgctgaaattactttggttgataataagtatgtatataaagatgtcagtaaaaacgggagtaatattggtgggcgtattattcttaatgaaaaagtcgtgattgctcctggtgctactgtgttactgtccaaccatatacctctgccatgggcgcaaatttatgccttgttacctattagaggcgctcatccttatgaacaagaaactaaagtcggctcaaataccttaatagtcgaacatattcctgtatcttcttcacaggaatatagatcgtataaaaaagatgaattggaaattggctggggaatattagctttttttattccgttagcaggctggattatgtatttctgttggaaaggggaaactcctcaccgagcatctcaagctgcgacttgggcttgggtaggttttggattgggagtttttattaacattctttcgttaacttaaaaaaagaataaaatgattggtaaggaggttcttaattataccattgtctctttgataggaaaaggagggatgggtagtgtgtatttagcagaacacaaatacattaaacaacaaaaggtagccatcaaggtgatcaatagtgacatggttaatgattttacccgtcaacgtctgaaagaagaagcggaacatttggcaagtcttaatcatcagaacattgttcgtttccatgattaccatattgacgaattgggtagtatctacctgattatggaatatgctgatggcattagtctggacaaatatatacagaccgtttctggtttgatcgtggaagataagatttgtccgttattcgagcctatattagatgcagtggaatatgctcatgaacataatattatccatcgggatataaagcctgcgaatattattataaccaaagaaggcattcccaaaattttggattttggtattgctactattatcaatcgggaatctgtggagaaggatgatatggtgatgggaacaccttcctatatgagtccggagcaggtgagaggtgatcatttagattctagatcggatatatattcgcttggcgtaatgttgcatcaaatgctgacggggaatgctccttatgataccaccacacttactgaatatgatattaataagaaagtagttgaagagccattaccacggatgcggacctattataaatatgtatcggataaagtacagaagattgtagataaagctactgctaaggaaccgggagaacgctatcagacatgtgacgattttaaaaaggcattgcatcgggtcatttatcctcctaagattcccaaatgggtatggacgagtgtggctgctattgtcttgctgatgataggaggtggagtttatttttgggattataatcgtacgaaagtgtattattataaagattatgtcgaacaatggggagttcctcagggaatcggagaattgagtagcagggagatgagtcatgtgaacaggctgtatcgttttgaatataaaaaacataaactacagcgtatgtctcatgtgaacagcaaggagaatattatcgaggatggtgaatcggagcgtaatgaaagaccgcttgatatgttattgtattatacggataaggggaatataagccgtgcgaaagtgttggatagaagtgggaaagtattgtatgtgaagtcatataatgataaattgaatactgtaatatttcaatatgatgatgaatatggaacggaaaagactttgggagctcaaactataggatatgtgcgtgcattggaggataatggagttgaaaaaggaaaaatatccagatggttgcttgagtatgatgaaaatggatatgtgtcaacaattcgctatgcaggtttccaaaatgtattagttggtgatgcgcataatatttatgggcgtaaatatgtgcgtgatgagaaaggtcgtgttttgagcgaacactatttgtcatttgatggtactccgaaagctacaaaatggggattagggatgaagaaattttattatgatgagaacgataattgggtaaaagcagagtatttgactgtagatggtaaacctgcttatgatgacgctgatggtattggtgtgtatgtgatggagtatgataaatacggaaatgtggtatatgcccttcatcaagatgctgacgggaaattgatgttgcctaaaaagaatggagttgctgggattaaatatatatacgatcagcatggattccctatcgaagcttcttatctggatatagatagaaaggcatgttttatacctaatgacggattttcaaaggtcgttcgtaaatttgatgataatggctatattataaatcaaactttttatgatgttgatggaaatcaatgtttgtctaatgacggaaactcatctgctaaatatatcaatgataatagaggaaatgttcaggaaatgtggttttatggacttgatggaaaactaaatgaaataaacgaaggttatgccggagtaaagctcaactatgattcaattggtaatataatagagtatgtcacatatggtatagaccaaaagccttgtttgaaatcggatggaacggctgggtataaggctgagtataatgacatgaatctgatcactaagttagtaaacataggagttgatttatcgccatgtaaagataataatggaattgttattgcagcaagagattatgataaaagaggaaatcaaatcaaagtttctttttatgatgctggaggaaagactttagttttgagtaatgaaaatattgcagggtggaattctgtatatgatgataatgggaatgaaacagaacgtagtttctttgatgataaaaacaatcttaccgtatgtgctggaagttgtgcaaaatggatatcaaagtttgacgaacaaggtaatgagaccaacttgcgttattataatttaagtggaaagttgatgatggtaaatggttctgctggagctaattataaacgagataaacgaggtaatatactggagaaaatagaaattggtactgatgaacagttggcttcgggaaaactaatagcaagatataaatatgataaatttgataatcaaatagagttctccgtttatgacagaaacaataaaccagcgttaaattctttagattatcataaatatgtctgtatctataatagtagaaatcagcggattgaaattgagtactatggaaaagatggggagctgacttcctataataatgataaatatgcgatccaaaaggatgaatatgatgaacgaggttatattgttcgtacttcttattatggaaaagataaacaattagtggtttcaaacgaaggctgggcaagttctactcgtgagtatgatgttttaggtaatgtcttaaagcagtctttcttcggtatagatgggaagcctactgatccgaaagtgatggtaccagaaggtctgtgtagatatgacagatggggaaataggatatatttggccgctggagatgggaagggacatttaattattaatccgaaaacaggttggagtatccagaaaagcgaatataattctcgtggaaaattattatcggaagcttattttgatgagaatgagaagcctttgataagccgtatggatggataccacaaagctgttatcagttatacttcttcaggtaatgagaaggaaaaatgttattatgatataatgaataaacctatgctttgtcctgatggttacttcaaagaagtgtatgagtataatgataatcaacaggctattagcctatcctatttgggagtaaatggcaagtctattgattgtaaggatggctatagcaaaatcgaattgacttataataaagatggtgagatggaatctcggaaatacacgaatgcatctggacggattctgctgacacaaaaatggaacggaaaagagtgggtaaattcatcacccgaaccaatttcccgaaattggcagcaagatgtacgtaaatttaatgcagaacttcctattgattttggagagaatactaaacatttagttgcatcgtcatttttagttactggtagcaattcgtgcgagctcagttttaaaactccgaaatcaaaatatgaaatgacggaagcggaagtaaatgagtattttgctagtataaaattggtcgttactaagataaaatcagaaagtttgccctctagtgtggtcataacgggaatactgtttgatagtaagggaaggcaattgcgttctataaggaagtaatttgtttttataataacttgtgtaatttttaatatgtatgaaaaagataatattgttgctcgttgctttattaagcttaagcatggattctttagcacaggagtttactgaaattcaaaagaagttgcgctcagacattatgctatttttgaaggaagaagggtatatgccggaattgaatactaacggtaatattcaattcaaaaaagaaggtgacaagtatttcatatcgattgataaaagggatacttctcccatgtatttaactgtggggttatcttatatttataatgacacatattctgtcgataaagtgtccaaagcattgaaagaactaaatgcatataaagctgtaaaggtggtttgttttgaagatagctatgcctaccatgctgaaatgtatttggttaatgcagaacatttcaaatacactttttataaattaatggatcagctcagtacgcttaaaaaggaattggcggattattgttcttcttcatcaggagtagtgcgaagttcgtccggcacgtcggaatcgcttttacctatatatgggattgattttaatacaactgaatcggctgtgaaagcaatgaattatacagaaaagaaaaaagaggacgatggcagttgtcggtatgtaattaattcatgttgggtatatactaaagatgggaaggttcgaaaaataataataggtagctatcatcaactgccacctaattttcagcagttaggatttgatagaagtagatcatacaatcagtgggttgaatttcttaaaagtataggatttcaaattgtgcaacaatacgatgctcctacaatagaaaagggaaaaggaacctataagaattattttaaagcggattttcgagcaaagaatccggatagtgattatactgtttattttaattttagcggatttgatgttcctaatgcggacacaccaatgactaggccttttatgtcaattgaaccgatatgataataactttgatgatcatgattgtctttttatgttagttagtgctggtaagtagtttgcttgtttataaaatgtagagaaataattttataaaattttggtgtgtttgaaatgaaataattatgaaaataggaaatatcgcagcccgtcgaacagtaataattataatctttttattatgttcggttgatctgactttaggaggagaattgactcctaaacagaatgtttttcagaatgaattgattaatttcttgaaagaagaaggattcttttccaatcaaaaggatggatcaaatgtcatttattttaaaaaagaaggagtgctgcactggattactatttcagatgaggaaccgttttttataacatttagtcgacgtggattttctttagtgggaccagatgcttataaaaaggaattaatgttggaaatttgtaatgaaattaatgcaactcataaatgtgtaaaaatgtattgtgaagaaaatactgctgttcttcaaatagaacaatatgtgtctagcatgaaggaatatatgcaagtattttattcaaatctaaaagctttagaatcagccaatgatgtttttgagaagctttatgatgataaaaagcctgtggtcatgtcagtatctcagccggttgtaagtacgatacgaaagaattttgatagtgtgttttttcccgttttgggtgtgtatttgggaaaaacaacgacgattgagttgcggaattaaggacaaaatccaatagatgaacaagggattacatataatattgaaggagtaatctttaaggatactgatggagatgctattattgattatatgtatattacgaggtctactattatgccacaacaatggataaaagcttttaaatttgaatgggagttaccttataattcgtggttattgcgattaaaaagagctgatttaaagccaaatgttttagaaaaacctaaaattatagggtttgaaggacgtaaagtgctgaaagcaaagataaaggcaatttctaataacaatcttttggagtttacatttgattttgataaggggaatccgaagggaaataaatcggtttcaatttttagagataattctttatatagtatttctgtaaagaccaaatagttaagactgaaaatgtcttattttattgagaaactttatattataatttggaagtaaaatatgtatatgaaaatgaaacttgaattcatgctattggcgggggtattatttttaatctcatgccaaaacttgcataattatgaatgtgattattttagtattagaattcctgattcttggaaatttgagatagaacaacttccagtcagttcctcaaggacagcttatatcattatcacattccaatagggaggacataatagatgtgatggcaatggttatgtgcatgaatcaacaaataaatcctactttactattggatcaacaagttattaaagcaaaaattcccctttttaataaagctttgttcaaaaatggaattgaagaatcttcttttataggcagagaagtcatgaaggtctcattcgaaaacgatctatatggcagatgttacgagggtaatgcgtatgctttttgtgaaaataatgttacgtttttatttattgaactatggttaaaaggaaatagttctgagtttctttcaatgtggaatacattagaaataaaaacatgtgaccatatagaaaaagaatatacaaacattagagaagaggctagtcaataccttagttcgattaaggatcttgtcaaaggtgataaagttgatgataacctctatgcgcaagacattattttagctgataatgagaatcgtctgatttactcttataagatttcgaatgtgagaagaagtgattttaaagaagaagaacttagcaaaatgcgagaagtaggaaagaatccactattgaaaacataaaagcatataggaataatgtagaattcataactaagtgtatggatcctaattttagcttccaatatatttattatgatattgatggacaatttctctatgattttgtattattacctaaggattatgattaatacttttttatggaaacatttagccccaaagacaaagtagttgatattattaaagaatatcctacaacaagaattttatttgatgaggtaagtcattttgatgacacagcttcagtagaagatttttgctttaaaaactctattgatattttttccttttggaataaattgtcaaaagaaatgaggatacaaacggaagataaactacggcttgattctattgctgagcaacaaatgagagaggagaaaatattggctgatagagatctggaaagatataagcggacacataggaatcttttctgtgaagaaacaaaatatatgcctaaagagggcgtaatctgaactctgtccccaaacaattatctttgtattatggatagaaacagtgaagagtatcagcagatgcgtgacaaagcgttatctcaactgcgtagtggcgaatcgctcacgggca

SEQ ID NO: 238 - DNA, 9212 bp, Bacteroides thetaiotaomicron
gtattagatattaatcgataaatagtatatagtatgacacctttatttttgcaatatccggcgtgcagtacatgccagaaagctaagaaatggctaatcgaaaataacattgagtacactaaccggctcattgtggaagataaccctacggtggaagagttgaaagcatggattccacgaagtggattgccaataaagaaattcttcaacacaagtggtttggtatataaagagctgaaactgagcgaaaagctgccttccatgactgaggaagaacaaatcgcattgctggcaacaaacggtaagctggtgaaacgcccgttagtagtgacagacagtttcgttctggtaggttttaagcccgatgaatgggaaaaattaaaataattggaaatttatttaccctaatatttgctggttcggaagtttatactacctttgcagccgcaaacacgggagtagctcagttggtagagcaccggtctccaaaaccgggtgtcgggagttcgagcctctcctcccgtgcaaggtcaaatagctgtaagtataatgcttacagctatttttatatataaaaagcggcttccaatttaatatggaagccgctttcattcgaaagttgtgtttttaaaggcgatgtttcctcaagaggaaagcacttttctttattcgttcactcaaatcgagtaaactatctgataataaatcaatttcatcgtcagtaaaggtagcaaccttgttattaacatgataaccattcatacgctgactgaaccaagaacgcgacttattaaaatattcttcagcaatataagaccaagtaatagccggaacaatatctttcaatgcttgcttgaaatcatattcatcaatcaacgcttgtgactggtctattgtttgctgagctttattggaaagaatctcagcaaattcacgtttttcctcttccgttttccctgataaggtatgagctattttaccctggaactgtctccgttgttcatctgtctccagctggagaaattcattcaacaaattatttatctctctatctgttcccataacaaacatttttatatgattgagtttttaaagcagcccctcaatacatgaggaggttaatgttagtctttcagttgtttgaggagttcgatcagcttatccagttgaatatcgatcaacctctctaactctctttgtgggtatccttgcttcaacaattcctccacactttgagcatagaactgcaagcatcgcttaacatgctctatgtgagcctttagctcttcctgattgtcaaacatcgctttaaaaacacagtacaaacataataaacatttgtttattagcaaaactattgcagataaatccgccctttaaattgattctttaacacttagataccttcctatagcatctatacactctttcctaattgtaaccgttaatcacttatggttttctcctgcttcatccctttggcagtttctaccaaacggataaattctcttctgtatcctttttcatcattatccagtccctgcttggcaagaccgatcactttatcatagcttgcctctcctttgaagtcagagtcccgaagcagctgaccgaacatagccacagcagaagcgaaacggaaatcggaagaaacattatttcctttattatccacaaagggaacttccatctttttgctgacatccttatccggagctttatagcgcagtttcacggtcagcaattcattagaaccggtcggctgcaccgtctctttttgtttcttctgatatttcagatcatctatctttcctacgtagtcattctttacgcctacgggaatcacttcatagaaagctgtcaccgtatgtccggctcccaattctccggcatctttggcgtcattattaaagtcttcgtctttcagcaaacggctctcataaccaaccagacgatatgcctgcacctgagccggattaaattccacttgcagtttcacgtcctttgccaccgtatgaagcgtagcgccaaactcacccaccaggacacgattggcttcctgcaaattatcgatataagcatgatttccattccctttttctgctaaagcctgacctttattgtctttatagttacccattccataacctagcacactcaggaatactccgctcttacgttccttttctatcaactgttccaaaccttccacagaagaaacacctacattgaaatctccatcggaacaaagaatgatccgattgtttcctttaggaaggaagttctgtttagccactttataagccagttggatacctgctccgccggccgtagagccaccggatgtcagttcatctatcgcatcacgtattttctgtttgtcactgcccggagtagattccagttttacgctggcgttgcctgcatacacaacgatggcaactttatctttttcacgcaggttattaactaatagcttcagagatgacttcaccaaatccagacgggtaggtccccacatagaaccggatacatcaatcaagaataccagattagattccggaagtttgtcagtcggaatttcccttgctttcagtccgatacgtaccagacgatgatcagcattccaggggcaaacacctgcttccattgttatcttcaccggatcgcttccggtcggcttcgcataatcgtaggagaaataattcactaactcttctgtacggatagcatcaggcaccggcaaggtaccactgttgatcatacgacgcatattactgtaagaagcggcatccacatcaatagagaaagtagaaagcggagattctcctacctgcttaaaaccattttcactgatcgatttatattcttccgtatttactgcatccatacgtacggacgggtgtctgagacttgccagattgacggttgatatggcaccggtaacagctacctttcgctggctgccgtatccgacgacaacacattcttccaatacatcagaactggccttaagacttacgtccatctttgcagagaatacgactttttccactttatcaaaaccaatatagctgaagataagagtttcccctttgtttgcttcaatcctgtactgcccttgtaggttcgtaacagctccacgggatgttcccttgaccgtcaccgcacatcctaccaacggcgaaccgtctgatccgtccgtcaccgttccctttacgatcaaaggctgtgcccataccgtaccacccaatgtagtaatcactaacatcaccgtgagcatcattgctctgagttgatttgtcttcataactttatctttttaaaatgttacaattaatccgcttttactatagagatgcagattccacacggattccataaaccaactgaagtttttttattttcattgaaaatagcacgcttttcaaaataatccttcattcttttgctgcttctaagatgatgtgtatatttgcgaacaataaacattcataaaaatgaaacatgaagtcgacggaaggcgggaaatagcctcacgaaacaccgcttgggctaacattatcgcccgtaaactaaccggttggggcatcactcccaaccagatttcaatgatgagtgtattcttcgctttggctggttgccttctgctgacgggcactgttatctatcccgatttcaataaatacgtcgcttatattctgttcatcgtctgtatgcagtcgcggttactatgtaatctgtttgacggaatggtggctatagaaggaggaaagaaaagtgccaacggagatttatacaatgatatgcccgaccgattcgccgatgccttgtttatcattcctgtaggctatgtagccggaggattcgggatagaactgggatggcttgccgccctgcttgccgtaatgaccgcttatttccgctggataggagcttacaagacacaacagcatttctttaacggcccgatggcgaagcaacatcgcatggctttactgacactgtgctttgtgattgccacctgcaccattcactggggatatgaacagatcgtgtgcctcattactcttatactaatgaatatcggtctgatcgccactcttatacaccgtttatatcttatgtctcacacaaacaacgaagcgaaatgaaacaactattggacaaattattccctacgctaagcgatgagttaattattgtaatcacccttattatctgtttgctggtgacggcaagcatcgccctctttctggtaaaaaagctgtcgccgaaaaccaatatcagcgaactggttgcccgtacccgctcatggtggattatggcagcaatgtttatcggtgccgttttcatcagctacgacatttcttatttttttcttgcatttctctcttttatagcattcagagaactttattcggtattaggattcagagaggcagaccgccgtgcactgttctggggcatattggctattcctatccaatactatcttgcttatatcgcgtggtatggggcatacatcatattcatccccgtagttatgttcctgttattgccattacgactggtattgaaaggcgatacacacggaatcactaaatccatcgctttgctgcaatggattctgatgctttctgtatttggtatcagccacctcgcttatcttctctcgttacccgaattgccgggcttcaatgcgggaggacgcggactgctgatgttcctcgtgttccttacagaaatcaacgatatcatgcagttcgtctggggaaaactcttcggacgtcacaaaattctgcccaaagtgagtcccaacaaaacatgggaaggctttttgggaggtgtcgtcagcactacggttataggatactttctgggattcctcactccgctctccacgcccaacgtaattctggtcagcgccctcattgccattgccggatttgcgggagatgtagtcatctcggccatcaaacgtgataaaggcatcaaagacatgggagatagcatccccggtcatggtggagtattcgaccgcatagactctctgtcctatacagctccggtgttcttccacctcgtttattatatagcttattagccggcatactatgaaaaaaagattcatgcagtctgccatgatgcagatactatataaaggtatattccggtggtttctgaaactgatcgtgggagtccagttccccgatacccgattcctcagaaaagaaggacaattcatcatccttgccaatcacaacagccatctggatacactcagcctgctttcttccctacccggcaaccttttgtggaaaataaaacccgtagccgcggaagattacttcggaagaacccggtttcaggccgctttcagcaattacttcatcaacacccttctcatcagaagaaaaggagaaaaggactcggagcacgacccactccggaaaatgctcgatgccatcgatgaaggatactcgctgattctttttcccgaaggtacaagagggaagcccgaacaaatgggaaaaataaagtccggcatagcccgtatcttgtctctgcgaccggaactgaaatatataccggttttcatgaccggcatgggacgttcactccccaagggagaattaatcttattgccttacaaggcatccatcttttacggaacgcctgccgtagccggaagcacagacgttcatgagattctaaaacagataacggatgattttgagatgatgaaagataaatatcaggtagtaacagaagacgacgaatagagaaagtgctgttcaatgtacgaaacatatcgaagctatcggacgaggaactactgacccattatataaagtccggggatacggaatatttcggtgaactatacaaccgttatatcccgctgacgtacggactttgcctgaaatatctgcaagatgaagaccaagcgcaggaagcggtgatgcagatgtttgaagacctgttacctaaaatcatcaattatgagataaaagcattcaagccgtggctctatcgggtggcgaagaaccattgcctgcaactgttacgaaaggaaaacaaagaaattccgctggattataccattaatattatggaatccgacgaatttctgcatctattaagtgaagaggaaagttcggaagagcagctgaaagcattgcaccactgtctggaaaagctgcccgaagaacaaaggaccagcattacacgtttcttcctggaagaaatgtcgtatgcggatattgtcgaacaaaccggatttactctgaataacgtgaaaagctatatccagaacggaaagcgaaacttgaaaatttgtattaagaaacaagccctatgaaactattggactacatacgaggactccgcaaaggaaaagaggcgcatcgactggaaaaagagtcgatgaaagacccttttctggctgacgcgatggatgggtaccaccaagtagaaggggaccacgaagaacagattaataaattgcggatgaaggtaaacgcccattcggcaaagaaaagaaatacgtatgccgtcacctggagcattgccgcctgcctgattataggaatcggaatcagcagttacttcctgtttctgaaacagaatgttggagaggatgtgttcatagctaaagagcagcccgccgccactgcaactgttcctgctcacaaagaagacacttccctatccgctccaaagatggaaccggattccggtcgtccttctgccacaaaggaaacggtcggaaaagatataatcgccaagacaaggcaggattctccatcccaaagtacaccttcgggggctccttccgcaacggttcctaaagcagtggcttctaaagcagcgactccccaagcaacgcctgccggaactccgataatggaagaaatggttgctccggcagaagagctggaagaagcggctatcacaacggttacagatacttctttcctagatgccaacaggaaaaagatgaaagcagctcaattgaccacccaaatgaacaacatgatcaaagggaaagtgacggacgacagaggagaaccactcgtcggagctaacgtcacttacaaaggagcaacgtatggagcgataacggatatcaacggagaattctccttgcccaaaaaggaaggtaatgaaatattaactgcacattatattggctataatccggttagtataccggcagacaccagtaagaatatgcttatagccatgagtgaaaataaaacaacactggatgaagtcgtagtaacaggatatggcgcacagaaaaaggtagctgtgacaggagccatttctgccgtatccatcaaagatttgaaaaaagcttcgggtgcattgcagaaatcagatacattaaaagacgctgttatctcccaaaaggccgatagtttacagggtcctgtcgttccggaacccgtaacaggcatgaagcaatataaaaagtatctgaaaaagaatctggcataccctgcggacgatgcttgcgcagaagtcaaaggcaaagttaccttgactttctttgttaacaaagaagggcgtcccttcgacattaaagtcaaggaaagtctttgcaagtctctggataaggaggccatacgcctgattcaagaaggtccggactggacttacggaaaccaatcggcagaaatcacagtgaaattccacaagtaatatagccggcagagttcttatgagagctgactttttatgaattagctttcttatgaatgatgaatacaacaagaattatactcactttaataagaaaaagttctcaagcccatgagaaaagattctcataggcttgagaattatttctcatcgcaatgagtattttttctcatagccttgagaattttttctcattgcgatgagaatggtttgagaataataagcgcccgtcagtcgttataagattctaaatccaagttcctttacgccacaggaattccaacggtccttgtttatgacgggcaagccaccagcggctgaatatcaactgaatagtgaagataagcaatgcaatcagcaggcttcccgttgctcctgcatacttgtacattgacagtccgaatccgtaatagatggttactcccatgattgactgggagatataatttgtcagactcatgcgaccgtaaggaatcagcagactttgccagctatatcctgtatccttcttaaaccaaagcaaggtaaagacagaaacaagaatgaccataaaagcaaagttggcataagacggaacagcaatcttatacggaaccattatagacgggtttgtaatcaaagcgggtataaaagttttcaggcaatagagagggataaatgcaaggatggcacctgtcagcatcttcttccagaaacgcaaggactcttcgcttttcataaaatacttccggcgtcctaaaagcattccgaacatgaataaagctgccgtctggaacaggcgaccgttttctacttgccaaatattgctatacatctgcccgtcagtgatattggaacggagtacttcaaagaaactgccattggatgtcacttcctgagcaagtttataataaggaataaaatgccctgttgacggtacatactccaaattgatcattgcatagatggcacgcccccattcataaggttgcaaaagtaagatggcagcaatccaaaagactgtcttatctttgagcttgcaaacaggaatcaaggcaaagccgactactgcataaagcaaaagaatatccccgttgtagaacaaggcatgtaactgtgcaaacaggaaaagcaggcacatccgccacgcaaatcgtccacggaaatctgttccgcgcttttccgcattatgaaactggatatagaaactaaatccgaacaacaaagagaacgtagcgtatgctttccctgcaaacaggaagaacatggtatcccacgcatacttatctatggtctgcaaccatgccggcaacgtataatccagcggtaaaaacagattatagtgttcaaggttgtgcaacaatacaatagccagcagggcaaatccgcgcagagcatctactactccaagccgttcagtcgttttaagtgtttgagtcatcagatatgtttattcatgattactaattaggcagtaaaaatagtagaaatatctgaagtacaaaagtttataaatattaatt

SEQ ID NO: 239 - DNA, 9057 bp, Bacteroides thetaiotaomicron
atataatatgtacgtaccttcgttccagtaaatcaatagacatataaaaatatgataaatgtaagaagattgacagtgatagcatttcttggagcgggtctgctgcccggtatatccgcccaggaatcttctgtgcagacagccgcccagagcgagatgaatctccccgcccaatgggatttacagtcgtgcatcgactatgcgttgcaacagaacattacgattcgcaaaaaccgggtgaatgcggaaagtacacagatcgatgtgaagacagccaaagctgccctgttccccagtctgtcgttctcaacgagccagaacatggtgaaccgtccgtatcaggaatcaagcagaacgatcagcggaagcgaggtgatcgagacaaccagcaagaccagttacaatggcaattatggtctgaatgcttcgtggaccatttataatggtagcaagcgactgaacaccatcaaacaggagaagctgaacaatcaggcagccaatctggatgtagaaacgtccgagaatagtattcaggaatctattgctcagatttacattcagattctctatgcagcggagtccgtcaaggttaatgaaaacacgctgcaagtttccattgcgcaacgcgaccgcggacaggaacttctgaatgccggaagcattgccaaaagtgatctggcacaactggaagctcaagtcagcaccgaccgttatcaattagtaacagcgcaagccactctgcaggactacaaattacaactgaaacaactgctcgaattggatggggagaatgaaatgaatgtctatctccccgccctgtccgacgaaaacgtactgttgccattgcccaccaagaaagatgtgtatatgagcgcgctcaccctccgtccggaaatcgaggcgagcaaactgagcgtagaggcttcggaactgggtatcgatatcgccaaagcgggatatctccccaccatcagtctgagtgcaggtatcggaacgaaccacaccagcggcagtgacttcaccttcggagaacaggtaaagaacggatggaacaactccatcggagtttctgtcagcgttcctatcttcaataaccgtcagaccaagagtgccgtgcagaaagcgaagttacagcgcgaaacaagtctgctgtcgctgctcgacgaacagaaaacactgtataagaccatcgaaggactttggctggatgcaaacagtgcgcagcaacgttatgcggcagcgaacgaaaagctgagaagtacacagatcagctacgacctgatcagcgaacagttcaatctgggcatgaagaatacagtagagttgctgacggaaaagaacaacttgctacaagcacagcaggagcagcttcaagccaaatacatggcgatactgaacactcagttgctgaagttctaccaaggagacaaactggcattataagccttcttccttactaaaagcggaatataaataagtaaaacagaatatagaatgaaaacgaaaaagattatcctgatcgctgtggcagttgccgtagtagtgggcggaggaatctggttctttacaggttctccggcaaagcacaaggtgatgtatgccagtgcgactgtcagtaaaggcgatatctccaattcggtgactgccaccggaacaatcgaaccggtgatagaagtagaagtcggtacgcaggtatccggtatcatcgacaaaatttatgtagattacaactcggtagtaaccaaaggacagctgattgccgagatggaccgtgtcactttacagagtgaactggcatcccagcaggcaacttacgatggtgccaaagccgaatttgaatatcagaagaagaactacgaacgtagcaagggattgcacgataagtcattgatcagcgataccgactacgagcaggctctctataattatcagaaggccaagagcgctttcgacagcagcaaggcatctctggcaaaagcagaacgtaacctgtcatatgctacgattacttctccgatagacggagttgtcatcagccgcgatgtagaagccggacagaccgtagcttccggattcgaaactcctaccctcttcaccattgcggccgacctgacacagatgcaggtagtagcagacgtggatgaagcagatataggcggtattgaagaaggacagcgcgccagctttactgtcgatgcttatccgaatgatgtgtttgacggagtcgtgacacagattcgtctgggagatgcaagcagtagcagcagcgccagttcaagtaccagcacggtagtcacttatgaagtagtgatctctgctccgaatccggacttgaagctgaaaccgcgtctgacagccaatgtgactatctttatccttgataagaaagatgtattgtctgtccccaacagagctttgcgtttcacccccgaagcaccgttgatcggtaagaatgatatcgtgaaagattgcgaaggcgaacataaggtatggacgcgcgaaggaaccacctttacggctcatccggtagaaatcggaatcagtaacggtatttccacagagatcatcagtggtgttgccgaaggaaccaaggtcatcacggaagccactatcggtgctatgccgggcgagagtatggatggagaaccgggtcagggaaacggagaaagaagcccgttcatgccaggacctccgggaaacaacaaaaagaaaagcaacaagtagccaagtatgaaaaaagtaattgaacttcaaaatatcaaacgagactttcaggtgggagaagaaaccgtccatgcgttacggggcgtttcgttcaccatcaacgaaggtgagtttgtgaccattatgggtacttccggttcgggaaagtccacactgctcaacacgttgggctgtctggacactcctaccagcggggagtatctgctcgatgacatctccgtgcgtaccatgagcaagcctcagcgtgccgtactgagaaaccggaaaatcggcttcgtcttccaaagctacaacttgctgcccaagacgacggctgtggaaaacgtagagttaccgctgatgtacaattcgtcagtgagtgcttctgaacgtcgccggcgtgccatcgaagcgttgcaggcagtaggcctgggcgaccggttggagcataagtccaaccagatgtccggaggacagatgcagcgcgtagccatcgcccgtgcactggtaaacaaccctgcggtcatccttgccgacgaagcaaccggaaatctcgacacacgtacgtcttttgatatacttgtcctgttccaaaagcttcatgcggaaggacgtaccattatattcgtaacgcacaatcccgaaatcgcgcaatacagcagccggaatatccgcctgcgcgacggtcatgtcattgaagatacagtcaacacgcatgtcctgtccgccgccgaagcactagccgcattgcccaaaagcgatgaggattgaagataagtaataggtaataagtattaggtatcaggtattaagtattaggtatcaaatattaagtattaagtaataagtaatagtagtttatgaatggaactaacttatttaaaatagctctccgggcattggcgaacaacaagctgcgtgctttcctcaccatgcttggtatcatcatcggtgtcgcttccgtcatcacgatgctcgctatcggtcagggatcgaagcgaagcatccagcaacagatatcggagatgggatcgaacatgatcatgatccatccgggagccgacagacgggggggggtccggcaagacccatcggctatgcagacgttgaagctgaccgactatgaggccttgcgcgatgagaccaatttcctgtccgccatcagtcctaatgtgtcttcgtcgggacagcttatcgcgggtaacaacaactacccgtcatccgtcagcggtgttgggctggagtatctcgacatccgtcagctgagtgtagaaagtggagatatgtttacggaagccgacatacaaagttcggctaaggtctgcgtgatcggtaaaacgattgtagacaacctctttccggacggaagcgatccgatagggaaaatcatccgcttcaacaagataccgttccgggtggtcggtgtgctcaaagccaaagggtacaactctatgggacaggatcaggacaatatcgtactggctccttacaccaccgtcatgaaacgattgcttgccgtcacctatcttcagggtgtctttgcttctgccctatcggaagacatgaccgagtatgctaccgatgaaatcacggaaatcctgcggcgcaaccataagttgaaagcttcggacgaagacgatttcaccatccgtacccaacaggagttgagtacgatgctaaactctaccaccgatctgatgaccaccctgctcgcctgtattgccggaatatctctggtagtgggcggtatcggtatcatgaatattatgtacgtatccgtcaccgaacgtacccgtgaaatcggtctgcgtatgtccgtcggcgcacgtggcgttgatattctgagccagttcctcatcgaggctatcatgatcagtattacgggaggtcttatcggagtcatcataggctgcggagccagctggatcgtgaagagcgtggcacactggcctatcttcatccaaccttggagtgtcttcctttctttcgcagtctgcaccgtcaccggagtcttcttcggatggtatcctgcaaagaaagcagcagatttagacccgatagaggcaatcagatacgaataaaaaactatctttgtctttatgaaacaaagcctaacatccgcacgtcgtcccctggaagcactgatacacattatcggctgggggattatgttcggttttccgttcttctttgtagagcgcgaaaacggaaacatcaactggatggcatacttacgccattctgccgtaccgttgtctttcatgatcgcgttctacgtcaactacttcctgctggttccccgatatctttttcagagccagaccaagagatatattacttacaatattctcctgttgtgtgtcatcggtctgatgctgcacctttggcggagtctgacattcgatccttcctttgttcccaagcctcaccggtcgggtggtcctccgggatggctgttctttgtcagagatatgctgagtctcgtcttcaccattggactgagtgccgccatacgtatgagtgcccgatggacacaagcggaagctgcccgtaaggaagcggaacggaaccgttcggaagcggaactgaagaatctgcgcaatcaactgaacccacattttctgctcaatacgctgaacaatatctatgccttaattgcttttgatacagacaaggcgcaacaagctgtgcaggaactaagcaagctcctacgctatgtgttgtatgataatcagcagacctacgtcccgctaggcaaagagactgactttatccgcaactatatcgaactgatgcgcatccgcctgtcctccaatgtacagatgactacgcagattgatatactgccggacagtcggactcttatcgcaccgcttatctttatctcgctaattgagaatgccttcaagcacggtatatcgcctacggaacggagttttatccatatccatcttgcggaaaatgagacggaagtgatctgcgagataagcaacagcaaccacccgaagaacataatggacaagagtggttcggggataggactggaacaggtgaaccgacgactggagattctttatccaggccagtatacctggcagaaaggtatttcagaagacggcaaggagtatagatcaaggctgagcatccgtgtgagggagagtattaataagtaataagtattaagtaataggtaataattgagagtatattcggtttaggtaattaaataaaatatagagaattatgatattacgttgtgccattgtagatgatgagccattggctctgggcctactggaaagttatgtgaataagactccgtttctgcaacttacaggaaaatattccagtgcagttcaggcaatgaaggagttgccgggcgaagaagtcgatcttcttttccttgacattcagatgccggaacttaacggactggagttctcacaaatggtagattcccgtacgcgtatcgtttttaccaccgcattcggtcaatacgctatcgacggttatcgtgtcaatgcactcgattatctgctgaaaccgatctcgtatgtcgatttcctgcaagcagccaataaagccctgcaatggttcgagctggtgcagaagccggaagagatagacagcatctttgtaaaaagcgactataagctggtacaggtagaactgaaaaagatcatgtacatcgaaggactgaaagattacatcaaaatatatacggaagatgatgccaaacccatcttgtcactcatgagcatgaaagccatggaagagcttttgccttccagccggttcatacgtgtacaccgttcattcatcgtccaaaaggacaaaatacgggtgatcgaccgtggacgtatcgtctttgacaaaacgtatatccccattagtgatagttacaagcaggtttttcaggcatttttggatgaaagaagctgatgattgtctaatttatcggcaaaaaagtgaattttgtcgattatagtttgtcagaaatcggttttatatgtaactttgcaacgaacagaaagggattgtgaaattccaagaatagaatagtttagttaagtctagtttagtttttgtgttgagtgcttcctcgtcggcggacgatctaggaagcactttttatttatctatttatagaacaagctggacgatagcactaaatcaaagaaaaataacataaagtttgattatacctaaagctcttttatattctattaaatcttaatacatttctttttgcgagcaaagacttgactccgtttgtttataggggggatgctcaaacaagaacagctctccggacgttatactactgatatcaaccaaattataaacattaattgcagataatatgtgtttccacaactccatgtcagccaaagccatcaaagttgccgcccgttacggacgccaatcggatgtagtcgagatttaccaaagcattcttgacgaacagtatcatgtgaatgcgttcactttccccagatatcctatcattacttcttcggacgaagtacaggttttcaactggggactcatccctttctgggtaagaagcgaagaggatgcgacagaaataagaaagatgacactcaatgcccgtgcggataccattttcgagaaaccgtctttccgcgaaccgatcatgaagaaacggtgcatagtgcccagtaccggctattttgaatggaggcatgaaggagcaaacaaaataccttattatatatatgtgaaagatgaacctatcttctcgatggccggcatctacgaccgttggctggacaaggatacgggagaggaacacgaaactttctccatcatcaccactgacaccaattcgctgaccgattacatcgataacaccaagcaccggatgcccgccatactcacccaagaggaggaagagaaatggctcaatccctcattgagcaaggccgaaatagcttctttactgaaacccttcgatacagagaagatggatgcatacgttatcagaaacgatttcttaaagaaatctcccaatgatccgacaatagtacaaagggcataggaaaaagaagtttatcctaaaaaagtgagaggtgtgagggaggaattgcaacttttatatttttatttcactgtttctactctctaattttcaactaaaaaaaatacgaatgttagaaatcctctctcactcctctcactttttcccctttatttcatgaaattcggaagaaagtacaaaaagaaacagagttcaaagagtaaaacgtggtgggaaatccggaaaacataaccatcttttccgaacttcccaccacgttttatctagttcgcaccgtccggtgatttactcacccaactcgcccagcaaatcatacgacggcacaaagaaaagcgtccccgttattgccgtactgaaatcgagcaagcggtcggtattgcccgccggactgccgataaacatattctccaacatccggcgagtcgtgctgaatgtactagcatacccaataaaatacgtaccatactcccccttcgaagtattggcaaacggcatattggcacgtacaatcttcagatcatcaccgatattggtcacagcattatgcgcattccccggcttctcttcgtccgacagctccacatcattgaacttatgacgtccgatcaccttttcctgttgttccaccggaagcgcattccacgcaaccatatcatgaatgtatttctgcacaaacacataactgcctcctgcaaaatccgcatcctcctcgcctatcaccgcaaaatgatagggattctcatcgacagcaggattctccgtaccgtccacaaagccgataatcgccttaccatccatatagcgaaatccatgcgtctcatcaacagacaccacagcccctttaagcttctcatcaaggatagaagcaaactcgaaacacagccccatctgcttcgcccgaatatggaacaacaaatcaccgggagtagaaacagctgtatacttctccccttttatctcggagaaagtactcagctctttcggtttacccttatcggggaaaagccgcgtccacgcatcagccccgaatcccatcgtgcaactgaattgcatatcaggaaaacgattgcgcatactacggatcattgccgagaaattggcacatacatcctttactttatcaaccgtatcgggggaatctgtcaggttatagactataaatattacattctctccctgttttccggccacatcctgtgggatatgaccgccgaacgaattttgaaatggattcatattcttttaattttagttttttagtttcgcccataagatatatccggtgataaaac

SEQ ID NO: 240 - DNA, 8952 bp, Bacteroides thetaiotaomicron
atataattatgatgaataaaatcattcgtaccacactaatcgccctgttacttacattcgccgcccatgcggccgcccaacagggactacagattgctaccgtctttcagaagtacggaaagcaaaaaggggtaactatggtagagctatccaatgaaatgctggaaacttaccagatgactctctataaaagtcttgtgttcaaggatgccagcgatgcactacctacgattctccgttgcctggaagccgacaagaagaaagcaaagaaggtgaaagaagtggtttccaacgggcaaatcaagtccggctattaccagcttccccagctcaaggaggatgtgaaccgctttatcctcttcaaaaccggaaagaaagattcggctacccttatctatatcgaaggagaactggatgccgacgacctgatcaccatgttattcatgaagaaagaataaaaaacagataaagaaatacgaatatgaaaaaactattattactatggctcatgatagctccaatgagcggaatggcacaaaatgaaagtacaccgcaggatacaacactttacgtcaacggacggaagatcgtgatcaaggaacaaggcgacaagattaaagtgaaactctacgaaagcgcatccggcggagatacgataacaaacgcgcaaatcttcgaaggagtctacctgaacgggcagagtacggaaagccgtaccgtgctgagcgctctccccttctcgaagaaaaacaacaagagaaacaggttcgagccacatgccggcggattctacatcggctacacccgactgtccaatgacttcctctcattcaatccgtcgaacggtgccgacctcaacaccagtcattcatgggagataggcggcaatctgtttaccggttcgcacgcttttgcacctacctataactgggggatcaccatcggactaggatggggataccgcagtatgcgcctggacggcaatgatgcttttcgtgaaatagacggagtgaccgaaatttattccggcatggaggcggaagagcctatagagtacagcaaaagccgtctgcgctatttctacttccgcattccgctctccatcgaatggcaaacacggctcaacggcaaaggtcctttgttctttgctgtaggtcccgaagccgaaatacgtcacggattcagttccaaagccaaagtcaacggatcgaagaagacgattgacaagggactgaacggacgcccgctaggtatcaacttactagcacaagccggttatgcggacttaggcgtgtatatgcgttactctacctacggactctttgagaagaacaaaggtcccgaactttatccgttctctttcggcgtatgctggtactggtaaagtaaaaactcagacccttgcctatttctgacagttaacaatcaataaagttgttcttaataaaaaatagctttatctttgggagttgttaaaacaagcacaataggtatattatgagtgaaaagatgattaaatggggcttcatcggctgcggagaagtaaccaaaaccaaaagtggccccgcctttcaaaaggtagaacattctgaagtagtagctgtaatgagccgtgatggcgccaaagcaaaggcttatgcgaaagaaagaggaatcagaaaatggtatgatgacgctcaggaactgatagacgatccggaagtaaatgccatttatatcgccactcctccttcttcacacgctacatacgccattatggctatgaaagcaggcaagcctgcctatattgaaaaaccaatggctgtcacttatgaggagtgtacacgcatcaaccgtatttctaaggaaacgggtgttccctgtttcgtcgcatattaccgccgctatctcccctactttcagaaagtgaaagaaatggtagagaacggttctatcggtaatgtcataaacgtacaagtccgctttgcacagccgccacgtgatttggattacaaccgtgaaaatcttccttggcgtgtacaggctgatattgccggtggcggttacttctatgacctcgccccgcatcagatcgacttgctgcaagatatgttcggctgcatcctcgaagccagcggatataagagcaatcgtggagggctttatcctgccgaagatacgctgagcgcctgcttccagttcgacaacggattggtcggcagtggttcatggtgctttgttgcccatgattccgcccgcgaagaccgcatcgaaattatcggagataaaggtatgatctgcttctctgtctttacgtacgagccgattggtctgcacaccgaacgcggccgggaggaaatctgtatcggtaatcctgagcatgttcaacaacctcttattcaggcagtagtagatcatctgctcggtaagtcagtctgctcatgcgacggagaaagtgctaccttgactaactgggtaatggacaaaatattagggaagctctaagataatgctccctcgtttgtttcttaaaataatttaatcactttattctatcgttagttttctttatatttgcgaaaggtagcaataaaagcaaaactaacgatatttattttttataactatgaccaaagaagaactaatgaggaaagcaatagagctttcgaaggaaaatgttgctaatggtggaggcccgttcggagctgtcattgcaacaaaagaaggagaaattatagctacaggagtcaacagagtaacctcttcatgtgatcccactgctcatgccgaagttagtgccatacgtgccgcagccgcgaaactgggaacattcaacctcagcggatacgaaatctatacttcatgcgaaccttgcccgatgtgtctgggtgccatctattgggcacgactggacaaaatgtattatgggaacaacaagacagatgccaaaaacatcggttttgacgattcctttatttatgatgagctggctctaaaacctgccgacagaaaacttccctcggaagtattattgcacaacgaagccattacagcctttgaagcctggatgtccaaagaagacaaagtagaatattagcatctaatctcacttaaactcactaatacttagtaaaatgaaaagaaaaaactttttgattcttctagccgcaggatgtttgttcagttgtcagcaacaggatgaactgcaagaaacaagtaaagaagcaaccaacttctctatctctatcgacgacgctctctctgacccgctcacccgtaccagcaatgatctgttccctgccagaaatagcatcactacaggagaagttatctccatggctgcctccggtcaggactatactccgtttattgttggcaaagacagccgcgcatggaacgaaataggaactgccacaggcacagtaaccttctacgcccactatccggcattgacagacgaagccgctaccagatcaggcggtaacaaacgctatttaaaaggaggtcaggagcacttgttcggaacagcggaagcagctccgggcagccagaatgtatcgctgaaattcaaacgaatgaccgtgccggttattatacttgatgagaacgatcgtccgtatgaaggcgaagctaaagttgagctcagcctgaaaaacgaaggtacgcaggatttattgaacggtaccatagaaatcaacgaaaatgcgctgtcagagaatatcgaagtaaagaaagtatccgaaggcgttactaccaatgttctcccgcaaaagatcaatgctggagaggaaataggaacaatcactgtcggaggagtcactcagaagatcagtgcagtggaagatcttgatttaaaagccggaagcacactttctgtcagattatcaaaaaaattcggaggcggtattattgatggcaatgttccattgtacagataagaagattgcacttaaagacaatcttgcagattatataaatataaagaacgggattcgtatgaatcccgttcttttatttagacctaaaaactatataataagccggtcagtccccaagagccgaccgacttatttataacactttattacttatcccaccatacgcgtgatgtcatcttatcgcctccgctaagtctcttaacggcatcattgtaattaacaggattagctgttatttcacttgtcggataaatgaaacgacgaggaatctctccatttgtcacattgttaggatagctggctgcatttcgagccggggttaatttgggatatccagtacgacgccaatttgcaaaagcttcatactcattacagaacgtatggatataatattccgtattaatctgttccagcgctttttccgtatcagcatccaatggattagcattcagataggcagttatcgcatcatctgtaatcgtagctgaggctttttcataataggagaattgtttcatggcagcagttactccatctctataaaatttttctgcatctcctgtatagagtccacgtttcactgcatcagccaataataacaagttaccggcatgagtgacaagcatagagggtgaatccgggcgtgcataaactgtacggttaggaacagaatatgcttttctccaatcaacctgatagcttggagctttactcaaatcccagtctcctcctgacacatcataaccaaccggcatacctttctgcttagcagccgtgttgtcacctaaatcaaaatcagcatctccccatcccggtttaggatctctggtacaaactgtagcaatcagaggaagacgaggatcgtcctgaaggatgtttataaatgtttcgctgatatagaacgcctgagtatccagactggaaaatacttttccgtaaggttcggcagagtcatcgcttggtgaaccattggtatgtctgacgatcgcattatcatcgttgcttacgaacaagccattcgaaaccgctttagctacccatgttttcgctttatcaggagctactttggtcaggcgcatggctacccggagcatcagtgagtttgcaaatttcttccatttcgcagcatcaccgttatagataacgtcggcagcccctatcgtattaccggcagaagtgcttaatgcagcttgtgcttcatcgagttctttcagcagatcattatagattgcttcttgtgtatcatatttaggatacggaatcggattggtagaatacccctgccctgcttcagaataaggaacgtctccataaaggtcagtcatattctggaacatatatgctttcagaatgcggcacatctgatattcattcgcataagcgggatttccttcccaattattcatcacatctataatattacgaatagctgcacgcccaccagaatagaatcctccccaataagcaccactatactgatcgttccatgtatagaaaactccatacgcccaatctacactagccgtatgctgtatcatgttggctgtgtagatacagccattacgccacacgtcccagtcggagccacatatctgtgcttcaacctgagtaaattccattttataatccaccactccgggattcaggttcatagggtcgttattcacatccccaaagtcattacagctcgtcgctaatcccatcagaccaaaagccgtcaatatatataaagtaaactttttcattgttacagtatttaagatgttagaacttaacatttacattgaatcccacatttctcgtggcaggatatccgttcaattccagaccttgagcattaccgttattataagcagattccggatcaatattatccgtatgcttcaatatagtccaaaggttacgaccgactaaagaaagggttaccccctttataagtgtctgcttattcaaccatgcctgcggcaaagtatatccgactgacagttcgcgcagttttataaaactcgcattataaacaaactcttcagcaatattctgactggtaatagcctgccagtagtcttgtgcagaaacggctacggtattcttcacatagccccccttaccatcagacattacaccattgcccaccattgttcctttaccgtcagcaccacgtccctgcaaagtattcttgtgcagaccgttgctgtaaagagacagattggttccggagaacatcttagctcctgccttgaagtcaatcaggaaagaaagagttatgtttttgtaagtaaactcattgcgccatccaccggttaccttataaacgccgtttcctaatacctgtacctcgtctgagtgtacaggaagaccgttttcaaaaataacttgtccatccgaagtacgtttgtattcataacctactaattcaccataaggatgccccaagatattctgaacagaaacactacctacacgtgaattggctccgtcaagagtaagtctctttatcttttctcccgttccgtctattcccaggtatttcacatcactgctgttataagcgatattgaatgtagaattccagttaaagtcctttgtatgaacaggaacggcattcaccattacttccacaccattatttctgatttctccgacattctggatagctgattcaaaaccggacgcaccactggtggttacctgcacgatatcatctttggttgtttttacataatatgcagcatccaatgacaggcgattatccaagaaagagagattcaaaccaatttcccattcggaaatctgaaccggtttcagtcctttgttaggtacggtcgagttattgatcgttactacaggctgtccgttcgattggtaattatctactttataggtaagaagattctgatatgctttggttccgttggatgcagctgcataagatgcacgcacctttccgaaagtaaaccagtcaggagtcttgaatgtatcactaaatacccatgacataccgatagaaggatagaaataatgattattatccgggtccagtgtagagaaccagtcattacgtccggttaaatttaagaatacctgattcttataaccaaggtctgcagtaccatagattgaatttacccgatattctgtatattctttcttatacacatgcttcgcagtgttgctacttgaataaaaatcgggcacaaagaatgaagaggccttatcatccagaccgtatttctttgtaatatttctctgacggtttccaccgaaagtagcaccgacactccagtctccgaatgtcttattgaatccgatcaaatagttcaggttcatttcagagaagttctgagtgtattcctttatataaccgcgtggatcttccggagaagcggaaccgattggcttcacttcggaatattccagattataaccgtcacgtgtcacagcaccctgaatgtataaccagtcaaagatatcatacttcaaagtcataccaccagtcagacgattacggttggtttcattagtaaccctgtactgcaaccaatacggattattgaaataaccgttcgtaccgcctaacaactctttgccgtcagcaccggtaccccagtcacaatccggattttcacgttccatccaacggatatcaaatgaattggcatgataaagaagtgcggcattcgtgttactgttaccatcggacaagttagaacgacctttattcttgtcgaatacgtagttggcattcaccattaaatgaacttttgaagaaatgtcataagtcgtattcatattgataccttgctgactgatgctggaattgggaagtatcccctttaccgccatattggaaacaccaaaacgataggatatcttatcggaagcaccacttactgccaaagttgttgtattgttaatcccagtacgatagaagttcttccagttatctacaggagaataggcatattcgttccccaagaagtttactgctttttttccatccattacttcaccccagctggatgtttccgttgcttttgccacatctgcagaaagcggacggttaccctgagttccttgcccgtagacattctggaaatcgcggtaatcataaatcacatcaaaagccaagttattgttaaattcaacggagaccggttttcctttctgaccggatttagtagtaatcaagatagcaccgttaccaccacgatatccataaagagcagatgcagcagcacctttcaacacttgaatatctgcaatatcatccggattgatacttgacaaaccatcgcccatatctttacctccccattgacctgcactaccaatattagtattatcaaacggaacaccgtcgataacataaagcggctggttgtttcccgtcaaagaagcattaccacgaattacgacacggctactaccacccggacctgttgcatttccggaaacggaaacaccggcaatcttaccggaaagtgcgttaccaatgttcgttgtacgagcttccgtgaaatcttttcctcctactgtcgttgtagaatagccgagggaccttttctgacgcttaatccccaaagctgtcactacaacttcatcgagtgtctgcgtatcttcctgtaaggtaatgtctaaaggtttacccgtgaacttcacttcctgtggggtataacctacataagagatttgaatcgttgctccatcaggaacattggaaagaacaaaattaccgtccaagtcggtaattacaccatttgtagtacccttgactacaactgaagctccaataaccgcttcacctgccttgtcttttactacacctttacacgtaccgttttgctgtgtgacactcacacttgttgctccattctcagaggctgcataggaaattgctgccggcatggcaaacaagagcaacagcacacttactgatttgagtggtttaaacataatactgctcttttaaggttaataaaaattgtctgtgtgtagagaggacgtcaatatttcatagtttggttctgactacgat

SEQ ID NO: 241 - DNA, 8846 bp, Bacteroides thetaiotaomicron
atataacattcatgctttatagaaatagatttttccacattaagagaaaatctatttctataaagttaaagagatattcctgaaaataccaaccaagattattctaacctagctatcccctccattagcgaagccccgcttacttgtgctcccattgaagctggttcactggatttccacatttcaccccaccaataattgcaatacatcgctgggtaagccgcatgattcaaattcatgcgcaaagtttcagcattatttttcagaaaggttatcaaatgtttgcctatagaactagatgcctcgtctaatgcaaggttcactgcatatggaatataaacagacttaaaaatactttggtccatactgctgccttcgtcacgtaaaataccatttcgtaagcaacgatcgcttgtagcggcatagttgatcacttgttttgctttgtccatgtatttactttcttgtgtgatatggtatagttggcgacaggcttctccaaatgttccctgtgtataagtcagaggtggttcctccactcgtccatcggcattatacgaattattgaccacatactcgtacaacttctttgcatcagataaataatttccatcttcatatcgttgatagagtttagcagctaccagacaacccggagaattagtgcaagcattacggtcgttttgggtggtattccatggaagtcccgtacctttatcatctgtccatgctcgagtaataatgtatttgtcgtatacaattttagcggtttgcgcaaatttttcgtcacctgttgcttcggagagatgtatcagagtaaggcaaatccagcacatgtcatcagtaaagtcatttaggaagccggtttcatctgatggattacggtggtaattgttagcgtggttggcataccagcgttcaaaataagtgcggtaagtagcagccaattgcttatttgtgtctttaatacgtttataagagtaaatcactacatccatagcatgcgcttgttgccagtagatataagtcgattcgtccgacatatctttgggtgtactccaaaatgtacctttacttttattcatgaattgctctattaagacatatgtacaactgtcggcaagagttgcccaagaaaaagggacagtggtttcagcaggtgtagcaattactgttactgctgacgaacgatgaccatagttatctattgctatggcagaaatctcatatgttccgtactgtggcaattgtaatgtatagtttccagttttcccagctgctccttgaataatttgtttcccgttatgtgtaccgccattcttttgcaaataagaaagttctacaccgagtaaattaggagtattcggattttgccatgtgatcagtagttgattagcaatctgtgtagattttgcctccaagttagttattggagaaactgttatttcaggttccttgttcctttcatcatttgtctccgagtaattatcgtttcctccttctccgcaggagatagacaggcaaattaagcaaattatgaattgaagtaaataataggtctgtgcgaattgtttcataatataaagctttagaagttgttgaaaattgtttccaaatatttcagtcttgcaatataccaagactttatgtattctgcttcctcttcgggattagcatatccatacatagaatatcctgtccaccgttggcgatctcgttccaatgcgcctgattccacaatctgtcttttatagtaatctactttagaagccaggtttgccgggctgagaacattatctttaaccgccatcaagcgttcgtatatccggcgtttgatattgttcgggttctcgttcataattctctcaaaggggcggaagtatttggaaccggcatcattacggagtattagcccgttgtcaaaaccaagacctttttcgggatcaagcttaatggcatcccaagtgcgtcccagtgtaccatccaagtcccagggctgaataatgaacttgggtaataaagtgagatttacattgtatataccccaaaaaacatttcgtcctgtgttatcataagctgacagcagattaataaagataaaataatcaatcagagaggaaacatccagtcgctcttcatattgggcggcaaattcttcttttgatgctgcagcgaagaactggataagatcggaaagatatttaaattcgatttcacccacctcgtccggataatcggactcaaatccctgccatgcctgtttggagttactatatggagtattgattccttgtaatttacattcatccgtccattctttacccttatagagataaccacctttctttttcattttcaactgcttacgatcgatacgatcgcttaaaatatacaaaccatggtaagctccgtccaagatcatttctacaggatagccatgtgtagcattcacagcctcgggttctgtattactataatataaagtgttgaaatcgttccaaagatcaaaacaaacacgattgcgcattttgctacaatccagccacatagcatccagtatccatgattgatcttctcgcagacctaatagctttgcgtcttgattttcattcgtttgacggtttttcaatttaaaactgaaagacttcttggcataacgtaaagctcctgctccacgaaactcgataccggcatagctctcaaatcgtaagacagagttgttggtgcgccgtttaggatcagtcagcactatgtcacacgggcgtttattctcatcctcaataccttcaggagcagagatctcaatcacgggaacaccagttacaatcaatcgacaagacctaattttatcaatagtattgttacctgcttccatttctatattttgtccgggattcaggctcagtgctatattctcgcccgacttaattttcttatctccgatcttgataaagtcgactccaatgccgccaaactcaactttgacctttgcaggttgtacggcatccatatctataggtagataatacgaattgttcacataatccacagctgtagttactccgtcgatagtcagattcaacaaacgaagataatcttcttctccttctatagacgattgcataacggtaattcctttttcttcttttcccgagatgattgcaatccgtccatttcttggtaaaccggaagtgttttttttgactttgattcgaaccttagtgatacctatccctccggaagaaggtgagagcgtcatccaatcgcaatgtatacttgattgccatgcgccgcctgaagatacgttgacttcttgttcaccgccttctatcgtcattgctacttgataaatggatagagaaaatggtaaagtagtgtacacatcgttttccttatccgaagaacaggctgcaagcagacttaaaatcaataaagccggtagtattttataaagattcataatacagatctaaaatttaaatgtatatcctgcgccaatcacatgtccatttgcttcatcctcatctgcatgattctgatacaaatagtaaaaatcaagtccgtggtgtttgctcaacttccattctacacctaaggtccagcgtgttttgtcaatcgcccctttatcgttaagcaaatgagtcaattcgcacgaagcgtaaggagtgagactgcatttaggtatattgtatgttgcttgcagacgagaacgaagcacgttctttcctttacctttcacgtattcatcgtctttaggactaccatcgtcaccatcaaactttgatacagactgactgggtcgataggtatattgccaacgctcccgaagtgaaaatgtgaatctatttaaactcacttttcccgttagttggaaatagaaacggtgtttgggttgccaatattcagggataacattccctttgtttgtaatttcagaagggtgattataatagatgtaagtgtatgctgttgcggctttcagccagtttgttattttatatgctacacctgccgatcccgaccaacgtcccacttcgcttaacttgtcgcgtgaacggaactctccttccagcgaaatatcaaagtcccggaataatcttttttccatccccacactggtccatagacccaaatcgtctttttgtgcttgtaaagcaaaagatacaagacaaaacaaacctgccaaaaaaagtttcttattcatttccacgtggtattttggttaatgtatcaatcgtatttatctcatttgtcatcggttcataatagattttaagcatggcggcatcgcgaagaaagtcaatgtacccaacttccacccgaataattttcagtccggtacgcgctttaatatctgcaatcaattcttgttcacacgaggatttgataagttcgattcgatcatagagtatcagtttacatgaaacatgctttagccaccgattactctcacacaaccagatacataatacaaacaataaattagctcctattagtccgccatagtttacttccacgcccaacgcgtttattactgatatggcgataatagcaaacagataagtcatctctcgtacaggcatggactcagtccgataacggatgataccgaaaatagcaaataagccgagagcaaatccgacctttaactttacactacccagcagaaatatcatcaagaaaatgctgatacttattaatgtgaaggtgaagtgataatctctccgcttgctctttggataatagaaaaggtggataataatgcctgttaccaaaaagttgaagccaaagcgcagcaataactgcaaaaagtcaccaccgtctatgagtggagtttctattatatcaagaaaatctaattcatccatatataagtatgtttttatattgatcattaatatactcccattttattcagcattcgtaactttggtttcagccgattgcattttaaatgtgacactgtaagtgctgaccctatacaatatttggaaaatccggaagattgtatatgtagtttacgtagtatctctttaataggtgaagaattgtgtccatctcgtttcagctcaatgataacaatgttatccaaacttgatatttttccactttgtaagcaacaaaatgttactcctgtatcaattgtaaggcgctcggttttatgtttattgacaagtgtaatacggcgaaatgagttttcaagcaaaggcagaagttgtgattgctcataccaggcatgttgacgtaaaaatgcttcaccaccgtcttctttgatcgtgtcaatactcccgatgcggattctcttcttgtctgttcttcccttattatttttatttttcacttccaaaaatgtgagatctgaatctacgtatgtgcgtatacggattttctcccgtacgacccgtccattctgatgagttagatacatgtcacgatctgctgtatctaagtaaattgtatgataagcaatattgtattcaccgttcacttcttgaacgcggtagtcatgtccggcagcaagaagtatctcttttaatatttggtaagaggtgacatatttggtatcagtacggttcatcagctttatgccactcatttcctccaaagatataggaatatattccttgagtgtctgcagaatctcggtcatgttaaagatagtattagaataaaaagggaaggtaacttcaaggttaaagtttccttcccttctttttttaaattagcatcgtattagtcccattcaatagcctgatctttatcaggtatctgagtattaatgttgcgctgcatggagatagtaccttcaaaccgaaactttattctggctcccggcgctaaagtataatcttcaaattcatagtcaacatcacgaatcataacggtacgtctcaataaataagggcggacagcatccatctcttcttcgatataactactagctcgggtatttattttaaaaccattgttttcggagttatcacttgtcaactccacaatgttagtattcggaacaaaatgggctatgattttgtagtttctacggtcctgtcggctttcgtcaattgtacctgcatagaagaatatagtttcatcatcaatagcataagttactatttcacttttcaccaatggctcattttctcctgcacctgcatctaccaacttgccttgtaagttagtaccaccgtatgtacccgaataatcattaaaaggcatgacgcggagtaatgctttacgataatgcttacgataattcggtttgtattcaccatttggggcgtcttcaatagtcagcggtaatacccacttatcaactaaatccagtccagtcagatcaaactctatatcaagatagcctacattttctccagctttaatctgcacggtttcagggaaagagtaatgtttagagggcatttccctataccaaaggtcttcgcgactggaaaagcgagctatgtttagtgttcgcaaggtatccgcgtcaatcccaatttttacggttatatcgcgatcgtttttagtcgatccgctgacaaggataggcaatctataggttgtttttcccgtttcgctataagacaggttaattctagttaccccattgctgttaatcggtgctttgaatgaaatatagtgctcaaactgctcctctttccattcgtcattacaggcactgaacatcactaatacaattagtgaaaatagtaaagtatatattcctttcatatttattaccatgtttaagattaatcattgtacgtccagcctggattctgagtcaggcgcttattacgtttcaattcgccatgtgaaatcggccaaaaccacattttatcagagaacgtagcagacaaattccaaacagcaatcggtgtatggaacatttcgcgatccgattctgtcataagtgtattgcaaccgtaaacgggcattgcctcttctacccgtgcatctttccaacggcggatatcatagtaacgctttccttcccccatcaactctatttgtcgttcgcgtttcagataaatacgaaaaacatccttgtctgcatatatattgttatcgaaatcgggtacaccagcacgcatacgtacaggcttaattccttttctcatttcggcaactgaacgatgaatggaatgagtcttagttccatcccaagatggaatatcatatgtaccttcactcacttcattgatagcttcagcatacatcaacaaaatgtccgcatagcgaattgccggctccggcttatatcgaaggttgtcgatactgttattttgataggtgtcatcgggatgcacatacttcatcactcctatacccgtgcgcaaccaaaacatacctgcattatatccatccctttttccgcgataatagaatatttgtttatttctatctgcaatttctttttcattacctaaataccaataagctccgttatatgcaactgaagcatagaagcgtggttctcggtcggcatattgcaaggaaactccggcagcaagtggtttatgttcttctgcagtagtcgtgaaacctgtagcacgcggacgagtgtctaaacgatgattgttattatattctggtacattcgcatattcagagttcatacccggacaattgcttccgtcgttcatatagtaagcatccacaatcttttgagtcagcccacttgtattccatccggtagcggtaagtggtaactggtgaaccaccatatccctgatactttgccctccaatatttctaccccggctaaaaattaattcaggattacttaatatatctatttgaccattgaatacagaacggtaagattcgaacgggtcaatgtctttccaaccttctggataattggcattgctatatacttcatgatatgggggattgattgttgccggttccgctggcgaatctgttgtacgtctatcagccgtatataactcatatacccctaaatccatgacatctttagcggcagcagcagcttttgcccatttttcttcgctatattcaggagaaagcaagcgattgcctttgtcatctaccaatagttgggcgaattcatcattgttaccattagctagtgggctggcagcataaatcaacgctagtgcacgagcagataaagctgctccacgagttgggcgggcagcagaattctgacctcttgttagagccagatccttagctgccaaagccatttcctgactgatataatcagcaatctcctcataaggtgcacgtggagtagccagttcatcgtaggatgcgtcataatcaagtccgttatctggcaataaaggtaccggaccatatctacgaagcaataaccaatagtagtaagctctgacaaagcgggcttgtgctttatagtcaagccgttcggcttcactttcaaatttatcgttcatgtcgacatactgaataaaaatagtagcttgtcggattccctgataacatctttcccacataccttgtttagtattctcatcatacaatccttctttaaattcattatatgacaattcaccctctttggattcttgtatggaaccgtcatcatcaccgtaatacatatcatccgcaaaacaatgtggagtgactcttttgttacaaacatcagcacaagcatcgcttagataactgaacgcatttgctaaccaggcttctgttttatctctgtccgtaaaaactttttcgatggtttcccgatctctaaaaatatagtcagagtctaaatagtcagaacaggattgtatgcttaaccctaaaactgatatcaatagaatatatagttttttcttcatgttgtttattattttataaattaacac

SEQ ID NO: 242 - DNA, 8806 bp, Bacteroides thetaiotaomicron
agaatgttaagtttaaaccaattacatattgacggctctttggatatgctgaataatcaacacctggggtcaatgcgcttttagtacgtgtagatacttcaggatcgaaaccgctgtagttggtaatgcagaataagttatagccggttgcataaaaacggagattctgtattccaacttttctggtcagagtttgtggcagtgtgtagccaatggaaagagtagctaggcgaaggaatgatccatcttctacagcccagtctgtcaacacatatttctgtgtccatggagaccacattgaggtatttgcattcattgccgccaattgtgtaggatcattacagatagttccgtcggcatttaggttagtccaacgtttctcttctgccatgacatcaatcatgttacggtatttatatttgcttgaagatgtatattcaattttgtttgcattatagatatcattaccaatactataggtaaagtttgcagtcagatcgaatccgtaaacacgggcattaacagagaacccaccactacagaatggattagtatcaccaattactttttggtcgtctttagtcactttattatcttcacttccatctacgttttttagtttcatagcacctggacggagatatttctcaccgatgatgtcagaagcatctgctacgccagctttcaatacccatttaccatcaatgaaaccttcgaagtcactgacttcataacgtccgtcacttacaaaaccgtaaatttctccgacagaatgtcctggttgtactttgaagtctgattgaatatctgttgatgcccaacctgaatcagcagaatagtccattaagctacctaaggatttaactttattcttattgaatcctacgtttgcattaaaactcaaagcataattctttttattgatggcattccaatttaaggttacttcccaacctttgttttctgtttcacctaaatttctgtattggaagctatatccaacaccggaaacggggaagttgattagcaaatcttttgtagtattccaataatattcaactgtaccacttaactttccgtttaaaagagtaaaatctaaaccggcattgcgagtatgggttgtttcccatttcaaatcaggattggccatttgtgcaccagtagtccaataacttgacatattattcatccagcctattgaagcaccggaaccagcagaccaaatagtacttgtttggtcacttggaatgttgttattaccagctgtaccataactaatacgaagttttaaatcatctaaccatgatttagtactttccatgaagttttcagatgacatacgccatgcaagagctgcggaagggaagaatccccaacggttgtcttttgaaaatttagaagagccatcggcacggaatgttgcactcgcaagatatttaccttggaaatcatagtttgcacgtgcaaaataggatagcaggatatcgtcagcattatagaatttgtcagttgagaaagctgtgccttgacttgataagttgaaagcttggtctgccgtaaatagttttggataaaaacgaacttcatctgtatccgtattacttttcaccttaatcaattcctgaccaaccaaaagacttaaactatgatctttgttctttagtatcttcttgaaatcgtaatttaaagtattagtattacggaaggtttttctttctttggaagtgaatacggcaataggctgattgtttccattgatgcgggagttgtaagttgtaactccataaaaacgtttgtctttattatagtaatgatctaaaccaaattcagtcttgaattttaagttgtcaataaactcccaagtaaaactaccgttataattaaaggtttgacgtgactgctgacgtgcattgtctgcaacggaaactaatggatttgttaattggagatcaggatcatacccatcgctcaaatctttgaaattgaacggggtataaatcataacgtctttcatacgagagtctgcactggaaacttcgcttttggactcgttagcacctgcaccattgattgttgtattggagtaacgtacagagaagtctaaagcaacacgtttattgggcttgtgatttacttttaaacttaagttatcacgcttaaaatcagaatcttgcatgattgctttatcatccatatgcgcatagctgaaagcgaactttgttttgtcacttcctccattgatgcttaaattgtgattgaaagtatgtccggtacgcccaaatacctgatcttgccaattgttaccttcaatattttcataaagatctatatcctgatagttaccaaaaactttggtataatcatctggattgatcgtatcatgtttaccactattcaacatagccaattcatattgccattttgcatagtctccggatgaaagcgtgtttaactgtttggccatctttttccaagagtagtaagcgttataattcacagaaatcttaccttccttaccacttttggttgtaacaaggatgactccattagcaccacgagaaccatagatagcagtagaagatgcatctttcagaactgtcatatcttcaatatctgaagcgggaatatcagaaatagattctacggggaagccgtctacaataaataaaggagtgttatctcccgtaatagaaccgccaccgcgtacacgaatcttcatttctgcatcaggcgaaccttctgttgtggtaatttgtacacctgccatcttacctgttagtgcttccgttgcggatgcaacaggtactactgtcaatgcttcagcattaactgtggctactgatcctgtaatgtctttacgcttggcagtaccataaccgataactacaacttcatccaacgcttttgcatcatctgatagtgtaacatcaatcttgctttttcctttgattgcgatttcctgcgttttcataccaatatatgaaataactacagtggcgttggcaggaacttttagagagaaatttccatccaggtcagtgattgtaccattggtagtattccctttttctacaatggaagcaccgataatcggttctccggttgtgtctttcacattaccatttaaggtaatagtctgcgctgatacgctgagcgataatgctgcgaaaatcattagcagcaaagtgcgcatgtttttcattcctttaggcatcttttgttcttttatattagattattaatattcgagtgtgtccactcttagagttctcactggtgcaaaattatgtttttggggcttgtgggatgtgtaatatttgtttttacgatagtattttttgtttttccggcataaaatgaataaagacgaggatttatggggaaatgtactctcgtcttaatcttttataactgtttattcgggcttttagttttattttttagaatccgcaggatacagatgattcactagctcattcagatatacctccagattggtgtattctttactcaaactatattgtgcgccgtcgcttggatcattcggattcagattgtgctttttctcccattcgtccggtatgccatctccgtcggagtcggttggggtcggttcggatttatattcgggccagcctcctacatctatcggttggtcaaccattccgttggtgcttccatgagacccttcataagtgtaattccctttgcgggtttcttctacgattcgttggtctacggcatcgcggcggtgagaagctccggcaaattgcagtacatctttataggctttctttgccggttgcaatgaagtatgctctgctatatcaaatgcttttttggataataaattcttttccggtgcgaagtcgttcttgacgatcagaccaaatgtattatccatattgactttataaagagcttctttctgcttgtcagtcaggctgggacaggtggcgtccataaagtttcctttgaagtggaagattccatgtacccctgcctcattttgatttttgccgtcgtctgcataagcggtgaacaggcgtcggtatgaacctttggtagcactatagggccccggcttatagtaattattgagaaagttgtacgaaccgccttcaccggcataagccccgtcactaccataattgtagattacattattgaataattccaccttttcttcttccggtttgccggtataacggctgccgcagagtcgtggagtacgattggtgtgatgtgccagcagattatgatggaaggatgctttttgtccaccccagatgccaccatagccatgtgctcctttctcatgaatagagttggcgaggctttcgctgatgatacaccattgaagggtgaattgactgttatcatagaaagtggcacattcatccgtacaccagctcagagagcaatggtctatgattatgttactgtttcctttggtaccgttcattgcatcgtcacctttttgcttgatgtccgctcccatacgtgaacggataaagcggacaatcacattgtctgcttgaatggaaaaggtgtagttcttcagacagatgccatctccgggagctgtttgacctgcgattgtcacatctccattgctgagttttaaaggtttctgcaattcaatgatgccgctgactgcgaaaacgatcgtgcgggggccctttttgttgatagcccaacggaaagttccttccgagccgtcatctgccagtgaagttacagtgtatactgttccaccggcacctcctgttgtatatttccctgcaccgtcggcgcctgggaaagccggaacttttgaacggtcgggagtagcattctctttgtacgaattgtcagtatttgtattcccttggatagaagggagcataaataaggcacatagccctaccaggatttttttgttcatagctacttagttattggttgggtataaggaatttaccaaactattcagatagacttcgaggttggtatattccttgcttaagttatatttgtttccgtcactgccgtcgttgggattcagcccgttggctgtttcccattcgtccggtatcccgtctttgtcactatcctgctgtgtagtggtagtggatgcgtattcactccatccttccacatcagcttgtgtatcgatcagtccgttcgttcctccgtttgagcctgtgtatgtgaaagtgccttcctgggtttcttttacaatacgtttatcaatcttgtcacgcagattggaagcaccagcgtatagtaatacagactgataggcatcttgtgcagactgaacgaacgaataatcatctaagataggaaaacgcaaagatacaagcaaatcttttgttgaaacttcgttgttttttacgcaaaaagcggttgaggaggtattatctgcatttgcattggccaattctgtcttttgtgaattagataacttctcatgtgtttcgaaataattcccgtttacatagaattttccatatatcccttgtgcctgttggtttttaccatcatctacgtaggcggtgaaaatacggcaatgtacttttgccgaagcattaacaggtcccggcttatagtagttattcatgatattataagaacctccctctcccgcataggctccttcaccagtccaattatagattacattattgcataaatcggctttttccatatcttctctgttagaataacggcttccacagaggcgaggggtgcggttgctatggtgggccagcagattatggtggaaggttgcagggcttcctccccatattccgccatatccatgtcctcctttgttgtgaagagaatttgtcagactctcgctgatgatacaccattgcatggtaaagtcggtatttccatagaaggaagcacattcgtctgtactccagctcatggagcaatggtcgataataatattccttttgccgggataagaatcttgatacccattcatcgaatcatcttccgtcttgcattcatcccccatacgtgaacggataaatcggataatgacattgtttgcgttgacacgtaaagtgtaatttttcaagcaaataccggggtggggagcagtttgacctgcaatggttatatcgtcattctttatttgcaactgtttggttaaagggatgactccaccaacagcgaacacaatcgtccttttgcccgacttctctatcgcccaacggagagtaccttctgaaccgtcatctttgagagaagttactgtatatactgttcctccggctccaccggtagttagttttccggctccttcggcaccgggaaaagctgcgactgtcgaacggtcgggagtcggatactccggcagctgatcctctcccgaatcatccggatcagtagaatctcccggctgttctattggaggatttgtgtcctgttcgagattttcttccgaacaggctgtgaatgatatgaagacagatgcaagaaaagctcctaaaaaagttttattcatggcattagttctttaaaatatgggttgtactcacgtattgtgttaattatatggttgcaaatgtatagggaagaaaagacgtcggtgtgcaatatttgtttttcacattgtattttttgttattagattcaattagagcatggtttaatgtactttactctgtcccattcaccgatttttatccggcattcatcggttttctgaccggaaatcatctgaaaagcctgtaagagcacaaagaaatgatgtatctttgaaccatcaatcattaatcatagaaacgatggaacagaaatctaaattctcatctgctacagttttctcaggaaaacttctgatagcttcattatttatcctttcaggaattttgttattcgcccgtaacatgggttggattactgctgaattgttcaatataatagtatcatggcattctctccttattatattgggaatttattcgatgatacgccgccattttgttggtggaattatccttgtattggtaggtgtttattttctgttaggaggtctttcgtggttgcctgaaaattctcaggcaatggtctggccgctggctttgatcatagccggagttttattcctcttcaaatcccgccacagaggaccgtgggatgacaaacagcgtatgtttcgtgaccatagagaatggatgaagcatgggcaccatggtcatgcgggcatgaactttacagacaatcagcagcaatgtgaatcggaagatggctttctgcgttctgataatacttttggggctgcacgtcatgtagtactcgatgaactttttaaaggagcagtcgtccgtacctcttgtggaggaacaacgattgacctgcgccatactcatatcgcaccgggagaaacatatatcgatatcgattgtagctggggaggagtcgaaatatatgttccttccgactggaaagtagtatttaagtgtaatactttctttggcggctgtgatgacaaacgctggcaaaacgggaatattaataaggaaagtgtattagtcattcggggaaggctttctttcgggggactggaagttaaagactaacgtatgaaagcacatccgattatagattatccttatcgctgggtgccgatgctggtggtagcgctggtattggttgtagctcaggtaatgataatgagtgtatacacaggtgcggactatgtgcctgctgtcatagacggaatagcgacaatcggttggttgatggcattaggttatttggcctggtttgttgtcggagtagtctctatctttcagacggaagtcattactctggtggcaggaatactgatctggatagccggcagctttatgttttacgatattgtaacaaggatagccggtatgccctatatcacttttgcatctaccatcccttttcgtctgttgtttggcattccgacctgggtcgccattcttctttggtatcgcttgattgtcgctaaagaagatgcactgaatcaggaactggagaaagaattgataatgcatcaaccggttagcctgccggaagaaccgcagatagagcagattgaccgtatcacagtgaaagacggttcgaaaattcatttgattaaaacggatgaattaatctacatacaagcatgcggagactacgttatgctgattactccttcgggggaatatctgaaggaacagacgatgaagtattttgagactcatttgccttccgatacttttgttcgtgttcatcgctcaacgattgtcaatgtcactcaaatctcccgtgtagaactgtttgggaaggaaacgtaccagctattattgaaaaacggggttaaacttcgggtaagcctttcgggttacaggttattaaaagaacgtttaggactataagaaatagctatttgatcaacggatgattcattttcgttcgttatcagctaaaatttgagtgtccatcaggcggctagcatttagagtaatgaatgctagccgcctgatggacacttttattctaatccaagcaaatactgaaaatgactagtagaaattactatgtaaagtaaaatatggaatttttggtattttaatcccaaaatctcgtatctgatattttagtgataaaatagtgcacctaaacgctcaaaaagtcccctctctttatgttttatataacttcttttgcacatatgaaacaaaaaataagaactataaatcaggaatattaatgaataaacatgagatgattcctgtttcaattttccccatgttttcaacgattgatttgcatgtaacataag

SEQ ID NO: 243 - DNA, 8788 bp, Bacteroides thetaiotaomicron
attataatgtgatagaaattgtaatgttaatcagagttttacgaataaaaactttcaaagttcaattttcaacaacatcacatccaagagcggaatgtagcgcagttggtagcgcactacgttcgggacgtaggggtcgggcgttcgagtcgcctcattccgacaaaagcgacaaatgattttatcatttgtcgctttttgttttaattcactttggtaacgtactgataatccatcagataattcaataatcaaattctttttcgttcgattcctctctattttcagtttaatttatttgcacgccaatagattcatttatatctttgttaccaatattttatttaatcccattaattcatcaacctgttacatcatgaaaaacagattccaccttttagccacagcggtagtttccttgttatgtgttagttgtacagaaactcaggtttctcaatccggaagtgaaaaagcagtcaatccccctattatgggttggagttcatggaatgccttccgagtagatatcagtgaagatattattaaaaatcaggccgacctgatggttaaaaaaggtctgaaagacgcaggatatcattatattaatattgatgatggtttcttcggcgaacgagatggcaatggaaaaatgcagaccaacaaaaaccgtttcccgaatggaatgaaaccggttgccgaccatatacatagtcttggaatgaaagccggtatttatacagatgcgggcaacaacacttgcggttctatctgggacaacgatcatgcaggagtaggtgccggtatttacggacatgagcaacaagacgcccaactctatttcagcgattggggattcgactttatcaagatagactattgcggcggagatgtactgggcctgaatgaacaggaacgctatacttccatccggaacagcatcgacaaagtaaacaaggacgtctctgtcaacatctgccgttgggcttttcccggcacatgggcaaaggatgtagctacttcatggcgtatcagtggtgacatcaatgcgcattggggttcattgaaatatgtggtcggcaaaaacctatacttgtctgcctacgccaaagacggacattacaatgacatggatatgatggtcatcggtttccgcgacaacagcaaagtaggaggaaaaggacttaccccgacagaagaagaagctcacttcggcttatggtgtatcatgagctcacccctgctgatcggatgtaatctggaaagtctgccggaatcttctcttgaactgctgacaaacaaagaattaatcgctctgaaccaagacccgctaggcttgcaggcatacgtagcacaacatgaaaacgaaggctatgtactggtaaaagacatcgaacaaaaacgtggaaatgtacgtgccgttgctctttacaatccatcggacaccgtttgtagcttctccgtacctttctcggcactggaatttggcgggaacgtaaaagtacgtgacttggcaaaacgcagtgatttgggaaatttctctgatgtctttgagcaaacgcttcctgcacacagcgctatgttcctccgcatggaaggagaaacacgtctggaaccgacattgtatgaagcagaatgggcatacctgccaatgttcaatgatctcggcaaaaatccgaaaggcatcatatatgctgccgatcaggaagcttccggaaaaatgaaagtaggtttcttgggcggacaaccggagaattacgcagaatggccggaagtatacagcgcagacggcggacgttaccaaatgacggttcattattcattcggcaaaggaagacaactggaggtagatgtcaacggcatcgtaaccaaaatcgattcactgggagaggatgacaagcacaatcaagtaacaatccccgttgatctgaaagccggttacaatcatatccgtatgggtaacagctacaactgggcaccggacatcgactgctttacgcttaccaaaggaatgtaacagactgaaaaacagctaaacgtgacaataaaaaaaaggaggagctaagatcactctccactcctcctgtcacgacaaacaactaaaattattcactatttgatgccatccaatgcccttttagcagtagcattagtggagtctatagccagaattttgctccaatactccttagatttttctttattcgccattgcttccgctttcagtgccggattttcaatagccaataagtagtaatatccaagataactgtagcactcaatcaaagctgaattgtaatgaggatcattcttgctttccagcagggtggctacctcctcatagaaaggcttcgccagtccaagagtcgtttcggggtccagtgcggaattggcacgtgccctccaaaaattacccaggtagctgtccggtgctgcttctgcgatggaatggaaaacagaatcagcggccatcaaagcctgcttgcgctcttcagcattgattgtcagcgaatcagtctgcgtacctgcaccataataaagtctgccaaactggaattgtaaatccggagtctgatgttctttatcaagggatgtataatatttctggtaagcactaattgcttttttataatcattcttctgttcataggcagaagagatatttttgtataagtccgtctttgtcggatctaattgtatggctttctcatattgtcctacagcttcatcatatttcttcagagcttcgagcaaatgcccgtaatacatatagtcaagatatgaataatcagccttgtccgattcggtaaaaaaagcatccgccgcttttattgcttcatcaaagcgcttcaggtctgtataattatacattgccaggcgattgaacgccgcgtgacgcgcattctttttcaatcccatattcgccacttcaagtgacttctcgaagtcatggttcaggaagagggcaaatgcatatttcactaaatcctcttctgtcgctgtcggtcccatcgcaaaacgcgaataagcttcggcagctttactaaaatcattcttcaaataatagatttcggcaagtttcttatctacggctgtgttggacggttcctgggctttcagctgttccagtttttcaatggccagagcagcattggctgatttataaatatccgcatatctcagatatgcttctgtgcaactcggatcgaaatagatagcttcttcatatttctgagatgccagaccggcgtttttctgctcaaaggcgatgtctccctccagtacggaggcaagagccgatttgccattcacctttttggcaagagcagcatactcctgtgcttccggaagttttccggctttcagatatacctcgccgatagccaccagaagttccacattctttttattctttccttttatcaactgttcagcttcctcattggcctgagccggattcgtctgaatggtttctttcaattttgcaactcctgcctgccattcggcatcagatgattgcgcatagagcgacccaactgctataaacgctccagctaaaaacatttgtactcttttcatgatagtctctaattttagttattattcgtctttcacatggacaatacgcactggctgagtagccggaacaagtccagattttaatataatccgctgccctttgtcggatgtcataaaagaagcaaatccccaaggcagcgcactgcgaggatcattcagtaatgcgtaaatgggtcgtgccaatggatagttaccgtaatacaagtaagcctgataaggcttataactgttagcaggagtagctacatcctccgcactcactgccattactctgatttcctcggtgaaagaaaggttggtggtgtcgctgcggttgcccagccagttcacaccaatgactcccattgctccgggattctctgctacatactttatcacctgctgattggtcttcaaggcactgacattgtcagtagccagtggttttccaccacagatagaatccattgtatagcgtacggtgctggagtttttattatcgaacaccacctgaatactcttcaggcgggagttcggatttatatccttccagtctttcgcctcaccagtgaggatgcggctgaaatcccgtacggtcaacaaagaatccggattgtcccggttgacgattaatgccagaccatctgtagcaagcttaatctcgcggggaaagaacttgcggctgtgaaaggaattcatttcttcctcagtcaatgtccgggttgcaatagccaaccggacactgtctttcagaagtaaattaatagcctcgacttccgtcgtgtagcgagggacaattccggccaaaggatacagactttcaaacacatctatctcttcctgtataataggctcaaaactttcatccgccgcaatagatatcaccccagacgaatacgtatccgtcggtccatccgatttggaacggcaagcactcaacaccgccaacaaaacgattcctaccagccaaaattgtctcttcatcatcttactgtaatctaaacattaccggaacggtgaatttcacacgtaccgctttaccattttgtttaccaggaatccatttcggcatactttgtaccacacgcacggcttctttatctaagtatgggtctacaccacgagctacgtgcacatcggtgatagtaccgtcacgctctaccacaaactggataataacgcgaccttgtgttccattctcctgtgcaattgtcggatacttgatatttttcccaaggtatgacatcagttcctgctgtccaccggggaaggtcggcatctgctctaccatatcaaatactttttccggttccgcagcctgtgtcaccacttgcttcaggtcagcaatatcggctccgttggcttcgtcattaccttttacgtcggcaatggagattgccactttggtagaagtcaattcttcctgactcttgatctcatcgtcttcgtgcacctcttcatctttcttgatgacaggggcagtaaacttaatagaactcttcagtgcaggagggggaggtgcaaccggttctacccgtttcatctcttcctgtttgatttccggttctgccaatttcgacaaagttgtaacctctgtcattacttccttttgctccggggtcgccaacttaagcagcgtagggatagtaaatccaacgattgctatcgccaccacaatcagcattgcaatagtatgccgtctgggtgaattggcacgcattctatatgcgccgtacgcttgattcttgccttcaaaaatcagctgacaccattccgaagaagctaaatctaattttgccattttactttctttttttaggtgttacatcatttatcggccaagttctgtgacagttctcccttagcatcataattcttaatcaggaactcatcagcttcggcaatatccgttatcacatatttacctatattacatatctgcatctcgtccaatgcatcaatcagattcatataagaagcatcatccgtcgccttgataatgacggtcggcgtattttttccgctttttatttcggaaaccttctttttgtattcgtcatctgttatcttcagatcgagcttctgttgtttcaaagctcttacctgattgacagctgcagcatttttctgaagaagtacggcacgtaacccgcttgccccgtaactagtctctttcaatgaggtgtaatccttgtagttaggctctccctcatagtaatagagcttgttatcggctcccagcaataatgtaattgcctgagaggctttcaccatactcttttgttgttcagttatatccttgtcattgctcggcatgcttatttccatcgtctgaggcttgctcagcgtggtacaaagcataaagaaagtaatcagcaacatgttcatatccaccatcggggtaaagtctacccggacagtcattttcttctgcttgccttttcctctttttccgctgctctcttgtacttcagcactcattgtctttcctcccttttaattttcagattctgctttgagagaagtaatcagattataccgattttcccgcaaatcctgaagtgagttcattacgttctttatcactgagtatggagttgaagcgtccgctttaatagcaattcgcagatcagcattggcggcacgtgcattacgcacccacgacttgaactgattatcggtactatcacaaggaattccttcattcttcagaattttgtcccgttgatcttccgggaggtcaaggaatttctgcatacttctgataggcactccaaacgtagaagccactgtgaacctctttgcctgttccggagtgaacttgatgccatactcttcacccatactctccaagacagcctgcatatcctgctgcttgtcgagactcataaatatttttccttcctggtcaaccagaatctggagtacatctgtctccggaatcttgatttccgatacggaggctggagtggtaacctgcaccggctccttcttcacaaatgttgatgtcaacataaagaaagtcagaagcaatacagttacgtcactcatagcggtcatatctatgaacgtatctttctttttaattttcgctctacccatgattaatagattttaaagggttcgccaaattaatgagtagctgcaaaagtctgcacgatagagaatccgacttcgtcgagtccgtaagtcaatttgtcaattttgttagtgaagtagttgtaagaaataacagccagcgcacctgtcaagataccgaaagccgtattgatcaaggcttcagagataccttgtgacaaagccatagagtcggcaccaccaccggcggacaatgcggcaaatgaacggatcataccgattacagtaccgagcaatcccatcaatgtacctaaagtagtaattgtagcgataatcggaagattctgctgcatcataggcatttccagagcagttgcttcttccagttctttctggatagccagcagcttttgttctttaggcaaagcagtgttcttttccatttcttcatacttgcgcaaagtagcagtaactacattggcaacagaaccgcgttgtttgtcacaaatctcttgtgctttcttaaggtcaccggcagccagagcttctttgatgttagctacaaatttagccaacgagcctttaccgaaagcagaacgaagagcaaaaaagcgttcaatactcaaagcgagtacagttaacaacagtgtctgaataacaggcacaatcacaccacctttgtaaatggtacccaacatgttcaatggatggttgttagggtcattgttcataaagttagacggatttcccaacaggaactgaaaaatacacactgctacaatgaaacagcagatgattacgataccggcattctttatacctacaatctgagactttttagtagtttccataataagtttttttgttaagatattaattttagttatttagaaaattttcaaatgattagatacactgcgctatagaccctgtgacttttcaagaatgaaagtcacacagcttcatacagggtacgaaaaagtaaataagatgggataagtaattaaataaggatacgtcttagagcgaacacgtagtagtcgctacagataatggagtaatgtggatccttatccgaataataggatttactttgatctaatacaagtgagttttctcttaacaagaagaacttatacataacgtctttaaagaaatcattggattcaatgattctacgcagacgataattattagaagatgtttctgttactgatttaaagcctaattctacgtcagaaatagacaaagactgggatgatctgtcataccccagcgaacgagtcttaaatgaagaattagaattcgtatcggaagttgattcagacaactgacaagagcattcgctctgagaaatacatgaagtgatattcatagcatttccacctatgctatatgatagcatcagcagaacaatcgctaatatgaatctcacagaacctttcatgatatttattttagttgtttatatcgaattctcgtatttcggtgacaaatgtagcaattaaatatatccgtttgtcgttattcacatcatttaagcataaaagtttaactctattattgaaacaacgtacaaagtgttttgttctcgcagtttgtgattttatgtgttaaaagtagttaggcgtacatacgttttaaagaagtccgccaagtttaataattgagagaaatatgtataatcaataaatcctctccagtcttaaatccgaaagtatccaaaacaataaagcccttctggtatttctaccggaagggcttctctaaaaatggcggctacctactctcccactgttacgcagtaccatcggcgtgacgaggcttaacttctctgttcggaatgggaagaggtggaaccctcgtgctataaccacctgaatttcttcaattgacaatggacaattgacaaatgacaattatcgcagctgtcatgataagttatgacatgataaaaagtaaaattcaagtatctgttaatctaattgtcaattgtcaattgtcatttgtcaattgtcaattaaaaaagctaaacgtatatatcgcgatccgcaccgtccgaaagaaagtgaacgggcaattagtaatgctcggctttgatgttaccacctttacacctgcatcctatcaacgtcatcgtctttaacgaccctaa

SEQ ID NO: 244 - DNA, 8574 bp, Bacteroides thetaiotaomicron
actatcgcccatcagcaaaaggattgcatctaattgataccttttctgcctgcactggagaaaagccggaaaggaatttgataccgtacttttcccggttctcccggacatggacgaaaaaagaacattattatgataccaaaaaataatcttatagtattcttttcccttttgtttggtagggtgtttaggaatttatatatttgcgtttgtagaaattaatagcaagatgtgtttttgtgtccacaaaaaccaaatcttgcctgataaatcaggagtttagccccctcgcaacttgggggcatatattatttagtatcatagtatgaaagcaaataaaagagatagaatagtgaaagttcgcttaacgaatttagaatatgaagaactaactaaagcttctaaatctagcaaatgtatgtcagattattttagacagagagtctttaggaaaggagttggtcttattgaccctaaagaatttattcgttcgatggatgaaatttgtttggaaatgaaacgtataggaaataatataaatcagttggctaggtatgtaaatattcataaggaagaagttaatcaagaggttcttaatgaggtagaaaagaaaatggcagactatgtaattatgcaagataaattgaatgttacttggcgtaagttgatgtcaatcaaataatatatgtatatataatattgatatatataattttagtgataaagacagcgttactatttctttcccctaaagttctttgtgtcgtttctctctatacctgaatacaggaaaacggctgcatcataaaagaaacgataccgacaccattcaggaactatcgcccatcagcaaaaggattgcatttaattgataccttttctgcctgcactggagaaaagccggaaaggaatttgataccgtacttttcccggttctcccggacatggacgaaaaaagaacactgttatgataccaatactttagggaaaaatattatatatataaataatatatgaatatataatatttgtatatttattatatgaataaattatattgaaatattcttttattgaatatttgtttgtatatttgcggtgtgaagttataaatatggtagtagtagttttaaaagcggcaacttctttcgctggtattgattataatgagcgaaagaatgaggaaggcaagagtgaacttcttgttgcagaaaattttgctatgaatccagataatttgaagaagtcggattatatagcttatatggaatctgtctgtaggactaatccagcggtcaaggcaaaacaatttcatgcagtgatttcatgtaaggggcgtgaatattcggcagatgatttgaaaaatgtagctttgcaatatataaataaaatgggttatggaaataatccttatatgatatattttcattctgatacagaaaataatcatgtacatattgtttctacacgagtacagaagaacggacagaaggtaaaagataatatggaagctgtgcgctcacagaaagtcataaatcaaataatgaatgttgatttagctttgaaggctaaagatgatatttcaaaatacatggagttttctttttctacagtgcagcaatataagttgttacttgaacaatcaggatggaaattaagagaaaaggatggattattaattttgtataagggtggtgaaaagcacgcttcaattcaattagagcagataaaagataaagctaaacaatatacacctgatgaagaaagaagaaaacagataacagctcttttatttaaatataagcaaggactttcctatacagaacttcaaactttgatgaaagataagtttggtataaatttagtctttcatacaggaaaaggacatactaaaccttatggatatacattaattgattatagaaataagagagttttgaaaggtggggaagttatggatttgaaggaacttttagtagagcctaataaacaagcaaaagtagaacattgtaatagtataattaatcttcttttgaaagatggaacaaaatatacaatggatagtttcaagaaatcaatgttagattacgattataggttttcaatgaatggcacaatatttataaatggtgatgataaggctttattggttcttgataaaaaactgctgaaagaatttagatataatagcagagtgtatgaagcaaataaatttaatgttgctacagttaaagaagccgagttgttaagtagaatttatcatgtgaaaaaagatgatattttgattcaagagcatatggataaaaaaaatactgtctattctgatatgataaatagttatttggctcatagttcagatttacattctacattaagagaaaaaggaattctttttgttgaagatgataatttagtttatctaatagataaaaagaataaagtaatcataagtactgatgatttaggaatcaatattataaaagatggctatagtaaagataggattactctagttactcttgataagatggaaagaataaatgttgaacaagattcagaactggcaaggggatttaatctgattgatgctatttgtgatattcttagccagcatataaatgtacagcaagataaatctcctaacaggaaaaagaaaagaggacagcaacaaaattaattaataaatagaataagatatgataatattatttggaaatcagaaaggcggttgtggtaaaacgactaattgcatacaatttgccaactatctagtagaaaaaggaaaagaagttctagtattggatttagattttcagcgttcattatcggatagaagaaaagaagatattgcgacctatgataatgaacctaaatatgaggttatacaaaccgatatatctaatgttgctaaaattattagtgattttactaaggttgagcaaggaaatctattaatagatttgcccggtaagattgatgatgatgctttgggaactattcttaaagctgcggatataataatatgcccatttaaatacgataaatttacaatggatagtacaggcttttttatccaagtgttacagtatttaaatgtaaaagctaaaatattctttttgcctaacaatatgagaactgcggtaagatatgagacgaaagaacaggtagttgatattcttaagcaagttggttttgttacagatgaaataccagcttctgttgcgatggaacgtataaatacattagcaattagtaatgagtgtattgataaggtgaagaatgcttatgattatatcattcaagaaggagcaataaaataaaatattcattttatagatatttgttataaaattattcatttattgtatatatttgcgcatggctgataaattaaggaaaaagcaaaatgaaggcatttctagtgttctggaaatagctaaaatgataagaggtgaagaatcgcatgggagtagtataaatgaaactcctattcaagaagctaaatgtgaagttgaagaggagaaagaaccacctcatgtagaaatggaaacaacttcttcggaagtttttaattttaatggctctagtgatatggatttgacggacttattagagtacattaaaggaaaaaattataattgcaaggaagttctatatgttgatacagatgtaaaagaggtgtttggcttgctcaaagctaaagccaaaatacctatttcatctttagtttcgtttattttggaagattggttaactaaacaccgtaatgacataagttctttgattaagcaaaaaaagaaccgttttctttagtacagaaaaagggtcgttttgtgaaacaaaagattttaggttaggctagacccgtccaatgggcttttcctcattggacggatattttagatagaaacaataatttctttagggattcctgtataatatgctattttttctacaggaatattatcttctctcatttttattataatatcaatattttctttagtaatagaagaaggtataaacgtaaataaaatgtctgacaatttgcttatagccttaataactttttgtttgtcagattctttttttaagtctattccactgaaagttgaaagtttatcatgcaaaataagataatatattccccctattattagtgcagatatagtcacaatatcaatatctgtattggagaatatgtttgagaatttttggcatagaggtaacgtatgcaattcccgtagttgagcggtacgttgactagtttcattgttattagctagttcccattttagaagttcttgcatgattttattctctgataaagattgaaataagcctacaagaatgttcatatatagtgctttatcgttactatattgtttttgtgattttacaatatcgctaaaccaatagtcgtatttttttacatactcgtcaatgaacttattcaaatcatcatatctgttatagaattgtacaggctcaatttcagcttgtcgcataatacttgtaactgttagattagaaaatccttcagtttcaataaaacgggttgccgcattaataatgctttcctctatgtctttggtacttcttctctttctcctttctttcattattattttatttttatgttcttatttatatcattaagagtattgactaaagattctaattgttcacgtttatgcgtggcaagaacgctgacccttaatcttgcttctttggttcttacagctggatatacaattccaattgtaaagatacctttttcttgcaacattttagcaatttcgtaaacctttttattatctcttatcataataggaaaaataggggaaacagattttcctatgtcgaagccttcttctttcaaccgttttctaagataatttgtattttcccaaagtttggttcttatttgtggctctttttttataatctctaaagcttttaatatggatgctgtgacttgtggggtaggggctgctgaaaacacattactgtccgcataaaatttcaagtattgtattatcttctttgaagctgctgcaaatccccctacgcaaccaaatgacttgctgaatgtgccagtaataatatcaatttgacctaaacagttataatgttcagctgttcctctgccattggctcccattactcctattccatgtgcatcatctaacatcagcatggcttcataagtcttgcaaagagtaataatttccgggagtaaagacaaatccccatcttgggaatatacaccatctattattacaagtttagtttgatattgccctttgacttcttttagtaccttctccaaatattctaggtcgttatgcccaattcgttttatatttgttccttttagtccagccattgcgcttgtgtggatataagggtctatcaatgcaatatcattttgacccaataaggctcttagtattccggcatttgctccaaatccggaagaaaataaaatagcttcttcttgtcctacaaaagaagctatttctttctctagctgttggtgtatgtcgagataaccacctattacttgtgcagcgcaagcacctgttccatatttttttatagcatctatacctgcttgtttagtttcttctctttgtgacatacctaaataatcattagaaataaatgcaataacaggttcgttgaagccttcaattgccattgttgaaccgatacctgtatgtgaagttatccaatagcttttacatccgaaatcatttagttgctcaatgtactgctggaaatcatttgctctctcaatagcatttttcccataggatagttcaaagtcttttaatgaatgataagttttttccatattagtataatttagattgtatattgcaaaaatagcaaatatatcatgtttttaagcattaacagtgaaaaaaacagtataattcttatattatatacaattcatattgtatatttgcgatatgcaaatgcatttgctgaataattactaacttaaaaatttcgctttatgagaaaacaaattttaattttattaggtttctcttttagtcttattgcttgtcagcaaaacgaagagattggttctgtggaggataatgccaatccaaacgaacttactactagagctgcttctatgagaagggttcctacacaagcggaaaaggataatcttaaaaaggatttcccaaatttagatgtaaataatatttctgtaacaggagaagcaacaggtacatataattgtattgcttattctatggggataactaacaaatggattgacccagaatctttttacaatgattttatagaacagtataaaaatgctaaaactttatatggttcgtcttgtaattatgaacagactagtacagaaggtagcaatgctactgttgatggttggggaacaagtagtatagatatgactcatggaagtgttgtatatagtagcggtacttgggagtcaaaacttgggcgttatttgcgtattacccataaaaggagtgagctatctggcactttgtatggtagaattttggtatcttttatcgagagtagaacaaagactgatatgtcggagataaaggaacttgcaaaacagatagcacaagaagatattgaactttctgatgcagaaaaacaagctgtcattgataaagctgcaaatattaattgtgaggtaaagactaagtttaacgatttgtttaattcatggaacgaagaaatttcaataaatccacaaactaaatatagttcaagtactctcgcttatacaacattaccacagtttaaagaaatgcaagcgatgggtaaaaatattattccgttaataatggaaaaacttttagatgaagataatttctttttgcttcctctatatgatgctatacagactgattctcaattaaaaataagctataagaaaggtgatgcaaagattctagaaggagaacagaataaggctaaaagaacagttcgtctttggctaagtctttcgggaaattaagtaaaatataactgactttttgggataaatagctcttaacgtaatatgctgtaagagctatttatatatttacctaaaagtttttggcatcatggatttgttttctcttcgtccttttgtatatgtggcgtattcgcgtgcgtcagaaagtaaatctacgtgaactctattgcgtatttgtttctaaggacataattttaaaactatatttatgaaaaaaaaattctattctttttggggcgtaagtcaattattggtaggagcaatgactattggtcttgtctcttgtgaaaaaagttctgaacttttatatgatttttcggaaacatcagaaagttcaatccagtcaagagctatctctgttgctgactctgtgagtctgttttctaatatagatgagtttaaaaaaaagccagaaacgaaatcttattcttattatcctgagacagatgaattttattcatcaaatatgtatgctgttagagagcttccttttgcgttgaaagtcagaggaggtggagtggttggacagccttatctttctactcaaggaatgagaaaagaattgatactttcagcttatagttcttcaaaattctatttaaagattttgccacctagtagtggaataccatatttgatttattcaaagtcttataataagccattggtttgtggtcaatataacaatgacccaaacaataaacttgtttttgtttgggactcggaagatataagttctggaagttgggaccttataccatcaacatataaaggatattttaatattgaaaatcagacatatttaggaacggcagaccccaataatccttggagtgtgtttaattattctatagaagtaaagagtaatgggcaggtagggtatgcaaaatataataagcaaccacagcaagagtttctattagagtttcaggataaatttaaagtaaaagaaatagcatttgaacctaaagctgtagtgacggaattagaccctgttgttgtgtattcaaatggtcagacaggagcagttgctggaccatcaaatattacaatttatgcaaaaaaagatgtaaaagacacttcttgttatacagaaaaaggagctttgaaaattccaatggcaaatgaagaacaaatgtttttacgtcctgcaataatagctgggcaatttattgcccctggcaattttagtagtggggaaatgcctgattcaacaatatttttgcctagagctccttatacttccacaacgtatgagatacctaaaacattatcggtgactattccggtagaagttgatgagccatctttaattaaagtaacgacttatttaaagaaatatagtgtaaaggctgactatactattactatgacttatcgtaatggaaatgaggctaatgatagagaagttaaatttaaaggttcttggtatggaataataaatactacatcaaaggcaaaaccagacgaaatagtaacaattcctttagaagaatatatgaaaagtttatctaataataatctgcaataagaaaagattatga

SEQ ID NO: 245 - DNA, 8541 bp, Bacteroides thetaiotaomicron
ttataatataggtagtatatttatggtttgcattattcaccaaagtctcaaacaccttccgattatagttatgaaaataaagatcaacagtagctgaattgcctactgtctccataaaagaattataaatatcttctttaaattcattgaactcattgaaaagcagaaatatattgtgtttgaacggaacacgcgtacttacgatataatacccgactccaggattcgatttaatgatacctctcgatttcaattctcgtattccggaaaaaacagtatcacgagacaagccgtacatttctctaaattcattaagagaaggtatccaggcacctttctttaatcgtccttcattaatcccgtcgatcacataatcaactaccaacttatattttgatttattgcttttcatcgttcgttatttttgcgcaaagatacaaatatcacagccatactggtacggagtggtatgtgttttacaacatacagaccagttcgtactagtcaaaaagaatattctatctttgcggcagattcatcttcatataaattagaaagttaaacataaagttagaaacatgaaaagtacaaatctacttaaatccttggcagttatagcaacactatccggaactccacatagcgcggtacaaggacagactgggaaagtacaatttgcgaacattgaaaacgtaaaagtgaacgacgcattctggagccccaaatttaaaacatggaatgaagtaaccatcaatgatgtactaaacaaattcgagggtaaacacaccaacgccccggaacagcacaatgctttctgtaattttgataaagtggccaaaggtgaacgtggcacacagggacacttcggagagccgtggttcgacggacttatctatgaatcgattcggggtattgcagattatctggtcatgtatccggataaagaactggaaacacgtattgacagatatatcgaccgtatcgaagcagcacaaatgacagaaccaaccggatacttagagacttatacacttctgaaagaaccggaacaccgttggggagacaatggtggtttcctccggtggcaacacgatgtgtataatgccggcatgatgattgaagccgctgtgcattactacaaagcaaccggaaaaaccaaactgttggaagtcgccacccgctatacaaattacatggcagactatatgggaccagcacccaagaaaaatattgttccctctcactccggcccggaagaagccattatcaaactatactggctattcaaagaacaaccggaacttaaaaaacaattatcagtgtccgtaaatgaagacgcttactggaagctagctactttctggattgaaaacagagggcatcattgtggctatcctttatggttgacttggggcaatggcaaatccgaaaaatggatcagagatgcccaatataatgctcctgagcatggcgagcatagtcgtccgacatggggagattatgctcaagactcaattccggtatttgagcaacaaaccattgaaggacatgccgtacgcgccacactattagcaactggtatcactactgccgctttggaaaatcattcacctaaatatatagaaacagccaagcgcctttgggacaatatgaccggtagacgtatgttcatcacaggaggagtcggcgctatccacgaagacgaaaaattcggtccagactttttccttcctccgggtgcctatctggaaacttgtgctgccattggcgccggattctttagccaaagaatgaacgagctaaccggtaaaggaatgtatatggacgaactggaacgcgttctatacaacagtttgcttaccgcagtttcactcaaaggagacaattatacctatcagaatcccttaaacgcagagaaacataatcgttgggaatggcatggttgcccttgctgtcctccaatgttcttgaaaatcacatctgctcttccgggattcatctatgcatcagacaaaaaaggagtttatattaacctgttcataggcagtgaaacagaaatcaagctttcttccaaaaacagcgtacaattaaaacaagaaacatcctacccttggaaaggcaaagtcaatatttccgtaaatccacagaaaacagacaaatttccgattaaagtacgtatcccgggatgggcacaaggcattgagaatccatacgagctttatcaatcaaacttaaaaggagcgccccaactgttcgtcaatgggaaatctgttccaattaaaatcgttgacggttatgccgaaatcaatagaaagtggcagaaaggagacctaatcgagcttgaactacctatacaaccccgcatcatcaccgcacatactaacacaaaagatttgagcaacacagtttgtatagcttccggtcctatcatctactgttttgaagacgtagataatccggatttcaaagatttccgattagacacaaatgctccattggaaatcatttatcaaaaggacttactgaatggagtgaatataatcaaaagtaacggaaaaacgactgctattgctattccttactactcgataactaatcgtaaaagagatagcagtcataaagtatgggtacctaaactctaaattaagttgtgaagttgtaaagcaaacaataccggcacagccaacgtgaacgccgtagtattcgtcaaataactttccgcatcaatactgaaaagttagattcaatacattcacctcccagcgaaactttctcgtaagggaggtgaattttcttcttttttactacttttgtcctcagataaaaacatccgtatgaaatttaaatccattatttcaactatcacgctattatgcctcctttctttggcaagctgcgtatacaataaaaaaacttctttggaagcattcaagcaagacgtatacatgcccgaatatgctaccggattcaagatactgggcgcaaagaatgcccaaagcaccttgatacaagtatccaacccgtggcagggagccaaagatgtaacaatgtcctacttcatctcccgcaatggtgagctcccccccgcaggattcaccggaccgaccatccctgccggagcccaacgcatcgtatgtatgtcttcttcctacatcgccatgctcgacgcactgggacagatgaaccgcatcgtcgccgtatccggcatcaattacatagccaatccctacatcctcgctcacaaagattctatcaaggacatgggtcctgaaataaactacgagctgttactgggattaaagccggacgtcgtactgctatatggcatcggtgatgcccagacagccgtgacagacaagctgaaagaactcgctatcccttatatgtatgtaggagaatatctggaagagtcaccgcttggcaaagccgaatggctggttgccctctccgaactgacagacagccgtgacaaaggcatcgaagtattcagtgaaatccccaaacgctatcaggcactgaaagaccttaccgcatccgtagagcatcaccctaccgtgatgttcaacaccccgtggaacgacagctgggtgatgccttccacccagagctatatggcacaactggtcactgacgcaggagccgactatatatataaggagaacacctccaacagctccgcccccatcggcctggaaactgcctacggactgatacaaaaagcagactattggatcaatgtaggcacggcatccacactggacgaactgaaaaacatgaatcccaagtttgccgatgccaaatctgtccgtgataaaacagtttataacaacaacctgcggataaccgccacaggaggcaatgactactgggaatcggcagtcgtacgtccggacgtcgtattgcgtgatctgattcatatctttcatcccgaacttgtatccgactcaacctactattacagacatctagaatgaagcaacctcgtagacacaccactcttttattcatcactttgggaataatcgccgtagtcttattattaatagatatggcgacaggggacacttatatccccatccccaaagtatgggccgtactgacgggaggcgaatgcgacgagatgacacgcaacatccttctctccatccgctttatccgggtagtagtagcagggttgataggtatcgccttgtcggtcagcggcctgcaaatgcagaccgttttccagaacccgctggcagacccttatctgctgggagtcagttccggtgcgggactcggagtggcgttgtttatattaggtgccccgttgctaggctgggcagatttcccacttttgcaatccgccggcatcgtaggttcgggctggatagggaccgccgtcatcttgctgggcgtagccatcatcagccggaaagtaaagaatatactgggcgtactgatcatgggagtcatgataggctacgtagcgggagccatcatccagatattgcagtatctaagttcggcggaacaactgaaaatgttcaccctgtggtcaatgggatcgctcagccacatcacagccggacagctgtctatcatgataccggttgtgtgcataggtctgctgctctccgtagcctgcatcaagtcactgaacctgctcttgcttggcgaaaactacgcacgcacgatgggcatgagcatcaaacgctcgcggacgcttgtcttcatctctacagcactgctgacaggaacagtcaccgccttttgcggccccgtaggattcatcggactggcagtgccgcacatcacccggctgctgtttgataacgccgaccaccggatactgatgccgggcaccatgctgacaggacttatcgccatgctgatatgcgacatcatcgccaagaaattcctgctgccggtgaattgtatcaccgcactgctgggagttccggttattttatgggtaataggtaaaaacttgcgtatattcaaatgattcaactcaaagacctgacactgggatacgaacagcgtacgctgctggaaaaagtctccgcccacatcacgggaggacaactcgtcgcactgctcggcagaaacggcacaggaaaaagtacactgctgcgtgccgtcatgggactggaaaagccccaaaacggagagattatcctgcacgggaataacatcgcttcactgaaaccggaagaactggcacggaacatcagcttcgtcaccaccgacaaagtgcgcattgccaacctgcgatgcagagacgtcgtcgcactgggacgtgctccctataccaactggctcggtcagctgcaaggagaagacaaggagaaggtggacaacgccatgcacctggtaggcatggacagttatgcggaaaagacgatggacaaaatgtccgacggagaatgccaacgcatcatgatagcccgtgcccttgcacaggacactcctgtcatcctgctcgacgaacctaccgccttccttgacttgcccaaccgctacgaactctgtctgcttctccggaagctgacgcaaaaggaaggaaagtgtatcctgttttccacacacgacctggacatcgctctctcactttgcgacacaatcatgctgattgataatcctcaactctacagcctgcctaccaatgagatgataacgagcggacatatagaaagactgttccataacgagtcaatcacatttgacgcacaagccatgaaaataagaatcagataaatatcccatatcctgatttaacaaaaacaagcatgacaggcggaaattatcaaatgataattttaatctccttacatccatctacctttgcagatgttttcaacaaactaaaaataagaagttatgaaagatagtattgatttcggtagtatggacatctccacattgtttcgtaagttattagttcctacggtactgggaatggtattctcagctatattcgttattacagacggcatattcgtaggtaagggaataggcagtgacgccctagctgccgtcaatataacagctccactttttatgatcgcaacaggcatcggactaatgttcggagtcggaggctcagtagtcgcttccatctatctgtctcaaggtaaacgcaaggcagcaaatatcaacattactcaggctcttgtattctctacgttcatcgtattagtgatgtctgctttatgtttttgcttcgtagggccattgggatgcttactcggaagttcagacagattattgcctcttgtcatagaatatatgatctggtatctacccttcctcgtattctatgagttattgagcacaggcatgtttttcatccggctggacggatctcccaattatgccatgatgtgcaatgccatcgcagctatattcaatattatattcgactatattttcatctttgaatttggctggggaatgatgggtgctgcctttgccaccagcctgggaacagtagtaggtggattgatgactgtaatctatcttacgcggttctcccgcaacattcatttgcatcgcatcaagctaagtttgaaaagcctgatgctaacgctccgtaacggtggctatatgataaaactgggaacttccgctttcatcagtgaggcttccatcgcctgtatgatgtttttagggaattatgtctttatccatcatctcggagaagacggagtagctgcgttcagcattgcctgctacttcttccccatcatctttatggtatacaatgccatcgcacaatccgcacagccgattatcagctataatttcggtgccgggcaaccggatcgggttcgaaaagccctacatcttgccatccgtacagctttaatttgcggaatcagctttttcatcatcacgtttctatgccgtcagaatattgtttcgttgttcattgaccgaagctgtccggcctttgatattgcggtcaatggcattccttattttggggttggattcatattttttgccgccaatatgataggcatcggctattaccagagcatcagacgaggtcaacgagccaccatcatcactcttctgcggggagtggtattcatgctgatcggattctttgtacttccacttgttttaggagtaccgggaatatggctggcggtttcgttggcagaattgttaacgactctctatattatcggaatttatttcaaagatcgcttcatggtccaccgactatgagtatatttgcaacatggatgcattcattaaaaaactctgcgacaaatataaagtattggaaagtgacgtacagaccttactaggctgtatggaggaagtacatttcaaaaagagagacctcattgtacgtgaagggacaaagaacagcaacctttattttataaaaacgggaatatggcgggcatattaccacaaagacggagcagatgccaccatctggttcgcttcagacggagaagcagctttctccgtctggggatatgcagacaatgcttattcactgattaatattgaagcaatgtgcgacagtgtagcctacagtatatcccgcgcaaccttgaatcaattatatcattcttccatcggactagccaatctgggactgcggctgatggatcaccagcttcttctgcaagaaaactggctcatcaactccggcagtccacgagcgaaggaacgttacctgactcttatcaaggagactccggaactgttgcaatatgtgcctttaaagtacattgcatcttatctgtggataacaccgcagtcgctgagcaggattcgggcatccttataatcttcactttttttatgagtataagatcaaatatttctctcaaactcaagtgaataaataaaactgtccgcacgataatatcctatattccattccaacggacacccttcgggatcataaacaaaccttttacgcaccaaaattggatctccgacctttatctcaagcttaccagcaatgtacttgtcagccagcctggcactaatatcttctttagaaacttttgcaatagcatgataatctctttccaatatctcataaagaggtctggagaaatcctcacttcctgttaaacctattttaggattaaaataggatataaagtacacgaaagggtattcttgatttccacgtaaacgctctaacttcagtattctttttacatcaggagcattaaaaaaaagggctatatcatctgtaggctttgtccagctaacatgaagttcataattcattggtacaattcccaaagttttcatttcctgtgtgaaactcatccaattctgagctttggaacatacagctgaatttacaacaactgtacctactccctttttcctcatcagcaatccttcgttcacaaggttattaatcgcctgtctcaaggtattacgagatatgcccaattgtttagacaaatcaatttcatttggaagcattttaccttgtttatattcctcccctttgataatagtcctcaactgttcttctatctgaagataaagggggattgcgctgttatggtt

SEQ ID NO: 246 - DNA, 8485 bp, Bacteroides thetaiotaomicron
gctttatgctatgtaattccatgccgcgaagttaaaacatagagtttttcaaaaataggaaaaatcggacattttattcagcagcgatctttaagggcgttttaccgtaaaataatttaaactcttttatgaaatgagtttggtcatagtaaccaaaatcataatatgatttttcggattttattaatttaactgaagggtcaatctttaaaagattttgaaaacgaacaattcggcaaaaagacttggctgtatctcctatgtaaaaattaaaaagtcgttgtaaatgacgactacttattccatcattcaaatctttctcaataataatcgatcctttgctttttaaaatagtttctaatgcacagaaaaatctattatcaaaaggtttatctattttatttatgtgcttaataaaatagatattgagttcatcgcacaaatcctgaaggcataagcatctatctttcgattgttgaattacattgtatatacaaggttgcacggtatttaaacgttcgtaatggttgcttaattctgacgcatctatattaaatagtgacggaaatatacccggaagaaaccgtattccgaaataattgaattctttatcaatgccaatcttcacaaaagaattgcagtaccccattatatatgtttcatcataatttgtacaattaaaaacgatatcaatacacccatcagcaactacacgataattgtatatatcatctagtggcttaatagtctttagattccaataacaataaataaagtcttgtagttgtgcgtcaggtggcaactcaatatatgagacctcgccattagttcctattactgctggctgtactggagtgtacaggcttcttatgttgtattccaatttcaaattacgagtgctaacttagattattactttatcaactttatatatcggctatctctcactataaatcaaaagctgacatagctttaaaatattcggtgtagaaatctatgcattcctttactttatttgtatggatcgtaattgaaaggtctttgaacttcatgctgactacatttataaattgttgcaatatagtaaaatttggagtgtgctcatgatatttatcatgaagatttaagtgttattggggaaactatcacccaaacaaatcatgtcttatgaaaagaactaatgaagattatccatccttcaatctgttttccattgtcggcacatgggaaagcgttaatctgaatcctacggttatcatctaccggaacggtaaagaatatctcctttctattgtatatgtatcggaaaccaccaagcaggcttcacccgctacttatgagatacagcaagatggtagccagtattttattgccactgcatccaaacggctctctgtagattatgacccggcaaaagatgtacttagcatctcatcattgggggactatctgcgcaactagcctgctatctagagatcttgaaatcaatatttcaataaaacaatctttcagtcatggaactaataaataaagataccctacaaatcaaagaatttatttcttcgctcgattcgatgctggacggcattgaatctattgtaaagcactacaagccacacttgaacggggaacgttttctttctaataatgaggtttccaagaaactgaatgtcagtctacgaaccttgcaggaatggcgagatacggggctaatcccctttatccagataaaaggtaaaatcatctatcgtcaaagtgatattgataagttgctccaaaagcattactttgaaggttggaaagaataacctgctagccctgagaacattttttttcagaatttaatttgaatcattgactttgccagtgaagtatttagtctgtgcaagtttttagatgaaaatacgctcgaatgaaatgagaggaagatttttatccaaagttctcctttattgtcttttagcaagtgttcaggtgataagtctttcacatcgctgaacgccaaaccggtataactgcaaaaaatgaaaacgtctcgtacctgttctactcgtttaattgtgaactctttagcgagaatgattttaatctcgtccattgtcagaaattcaggatatgtttctttcagtttgaaacgatagtaagcgaatggatctttctttatccagtcattttccaaggcaatgcggataatcttctttaagttctttaatcgggtgatagcggagttctgcgcacaacctttttcaatcttcaagaaagcatcgaacttagaaatgaagttggcttccaagttgttcagggcaatatccgataactgatattctttcttaatgaattcctccaaatatcgggtagtggtttcataccgttgaacggttttactaataaagtctttaccgattagcttgcggctttgttcgttatgctccctgaatacctgtaatagcgttttgttatcttcgtccacatcataatacggttttctaacaagatcaacagtgataaccttgccggaagtttccagttctctataaatttgatgtacgtgggaacgtgtgatttctaagtagtggttcggttccaccgacatacggtctttgccttttgaattctctttagcctgattccataggtctacaggacagcttcttttgatagaaatgtctactatacagccatttacggtgattctcatgcatacgagtgcttcaccgttctttaattattctcttccaaagtacgaccatgcaaaaagctatgaatcagcgagaaagatgcaaattcgtgggacttttttcgattaaattttagtcccacgatttatccaccgataatatgcttgaaacggctattttctgctacctgccaaaaaaaagaaatccccgataatacttgattatcagggatttgcttgatttttcttttgttttcagtgatccagctggggctttcaccgtagcggtctatatctttgatttataagctcttgtaaaccttgaaaaattgtaccgtaacgaattagtaacgatttataggaacgcttgttgtcagtgagaggcattcgtttgtcagccgttctctgatgccgcaaagatagaagattactttttattttccaaacatttgattattaaatctttaaaaaagatccccagtgcaaggggcgaacctatatatatggataggtttgccccttgcaccgggcggatgttgcatcagtcctacagccttgccgtccgcctcaataccgccgtttatgtgaagcggttcccctcctttttcgctgaaccgaaaaaatcatggtgtagtacacgtatagtatcccatgcgctgccttttattgttattcttttgcagcaaacattgaaaattaagtttgttatggaagttattacatttgaaagtgaagcgtataaagcgcttgtagggaagattgaaaaaatcgcagagtatgtagccgcagcgcagttgccttcggaagaaaaaaaggaggcttggctggacagcaaccaactggcggaagcgttggggatcagtacacgtacattgcaacgcctgagggatgaaaacctgatcagctactccatgctgcgtggacggtgtatgtacaagctgtcggaagtcgaacgctgtctggaagagcgtaccattcggtgcaaacctcaaacattggaggattttcgcaagaactacctaacgagaaccggcaatgataagaaaggatgatatactgaaaatgacggaaaagggtatttccgtattccgctattacctgtcggtggacttcaaggtgggaaagaacttcctgaaccctttttataaggatacggaggcttcttgcaatatttattacgaacgtaaggccggagtgtttaaaatgcaagatttcgggaatgaggattattcgggggactgctttgaactggtgggcaggctgaacggccttaactgcaaggagcctaaagagtttgtcgagatcatggaaataataaaccgtgacctgcatttggggctgtccgcacatgaggaatatcatgtgagccatagcaaagtaccacaaaagagtgaagtggtatcggaagagccgaaagcgaaaagtgtccggccttatactgtcgtgcaaaagccctttacggctgcggaacttgctttctggggtaaatcgggtatcggggagaatattctgaaagcgtaccggacggtatcgctaaagaagttcagcagtgagaaccaggaaaagaagcctttttcctgcatgacaagcgtcgatgaaccgatgttcggatatatggggaaacagcatatcaaggtttaccgtccgtgttcacaaatgcggttcctgtatgccggtgattttggcgacaactactgtttcgggctggaacaactgccggcaaagggtgatctgctctttatcacaggcggggaaaaggacgtgatgagtctggcggcacacggcttccatgcgatctgtttcaattcggaaacggcttttatccctgcggctgtcatacaccggctttcgttccggttcaaacatatcatcctcctctatgatgtggacagtaccgggctgaaaagctcggcgaagcgtgaagaggaactgaaagaatacggggttaaacggttgttgctcccgcttgccggtacaaagacggagaaggatgtctcggactactttatgctgggaaacagccgtgaggatttgataaaactttttctggactatctggaaaccttatacagcgaaaccatgtcggcattgaaatcctgcgaggtggatttcaacaacccgcctcccattgcacagatgatcgtatcggtaaatgacgtgcctctcggaactcaaggcaacctgctttgtatcaccggcggagaaggcacgggaaaaagtaactatgtggcggcgctgattgccggtgctatccgtcccaccggaacggatgtggatgcgctgggcgttacgcttcacgaaaatagcaagaacaaggcggtcctgttctatgacacggagcagagtgaagtacagctgtataagaatatcagcaacctactgcggcgatgcggacgtgaggcgatgccggaatggttcaaggcgtattgccttacgggaatgagccggaaagaacgcctgctttccataatccagagcttggacaaataccattatcaatatgggggtgttcatctggtggtgatagacgggattgcggatttgataaaatgcgccaacgatgaagcggagagcatagccgtcgtggaagaactgtaccggctggccggtatctacaagacgtgtatcgttgcagtactgcattttatccccaacgggctgaagctgaggggacacttgggaagcgagttgcagcggaaggctgcggcgatcctttccatagagaaggacagcgatccggccgtatcggtggtgaaggctctgaaagtaagggatggaagtccgctggacgtgcctatcatgcagttttcgtgggataaggaaaaggccatgcacgtctatctgggcgaaaagccgaaagaggaaaaggacaagcgcaaagaggacgagcttgtagcggtggccaaagaggtattcagccggaagcggttcgttacttacgtggagcttgcggaagaaatccagtcgatactggaggtgaaggagcgcacggcgaaaagctacatcaagttcatgcgtgagaaagaaatcattctgaaatcatccgataaccagagctattatgttatcgggaacttttaaggagggaagcgtatgttagtagataaaacggaatttgaagcatggatggaacgtatcatgggtgagctgtaccgcatctcccggaaactggacaaggcggaaacgagggaaaagcacctgaactacctgaacggagagcgtctgtacgacaatcaggaagtatgcctgttgctgcgcatcagcaaacgcacactgcaacgataccggaataacggggtgttgaagttctattcgatatatcacaagacgtattacaaggagtcggacttgcacgagttcatccgcaacaacttcgacgagaacgaaataaaacggcaggcacgtgaggacaagctgtccgagagctatccgctgccgaaagaataagtccatgtttttgctttataccggtgaaactactgccgtgaggcaagaaatcccaaactgcatattggtgtttgtcatagcaatggcttcatacagttgtgaaacaggatgaagtttcttttcttgttcgaatggtgatactccaaaggacagcggttcggaggagtatcattttttatgtgtgcacctaaaaatattccagttttgtggcgtaaaaactgggcgtttttttatctttgcaaaaactatcatttatgaaattaggaatattacactttacagattctcacataaagagtgccactgattggattttgagtgagttttcatcccttgttgcttccgtcaaaacgatatatgaagaatgtgatcgcatatatatagtgtttacaggtgatgttgtttactctggtagtgaagaagaatatattttggcttcaaagtttttgaattcaataagaagtttacttaaaacattgtataaagataaggtctatgaacaaataatttttactcccggaaatcatgattgtaatttcaatatggataggcaggcaaggaaaaatgctataaaaaatatgaattatgattatatcggtgatgataatagtgttatagaacaatgtcttatcgtgcaagaacctttttggaattttgaaaattcgattaatgggaaagaaaccaaaccatgtatctacaaggaatatatagatgatatacaaaaagaggttgttatttttcattcttttaatacagcttggatgtcttctattaatgaaaatgttggtagtcttttctatcctataaaaaatatagaagaaactattaatacaaaagcaacaataaatatatcagtttttcatcatcattcatcttggttaaatcctaatacagaagaaaataataagcatgaattttccgaactgatcaatagcttttctgatgtagttatttatggacatgaacatgaaaggcaaggaatgattcatacggacttaaacacacataaggagtgctatatttttgcaggagaggcattacaaatgaatcaagcaaaaaaagttcattcaggttttcaagtgttcatcataaacacagaaaataggattggatttaattatccatttcattggaatggaactatctactcacaacagaaagaacaagagttttcactaaaagaaataggacataacaatcttgattttcattcaaatcagaccttcttgtcttctttgaatgatatgaaactgcctttatttttcaatgatgataaaaaaatcaaattgaaagatatatttatataccctgacattgagaaaaccaatgatttaaagaaagaattatatgagaattatgttgatagttctatttttatagagagttcaaattacaaagtagtattgcttgaaggagaaaatcaatctggtaaatccagcttgattaatatgatgtatcttgactctattttacatcaaaaatttccattgttgattaatgggaaatgctttaagaagatggaaatagataaacctttagaaaaagcctttatagaacaatatgaaaataaatcatttgaagaatataatcaatattctaacgaatgtaagatattgtttatagataatcttaattcggcagagttgaataataaatcaatcttagaattattaaaaaagctcgagaatcgtttttcgagaattatcattacaacttcttctatatataatattatttctgttttagaatctacaactaaagatgttttttgtggtaagatactacctcttggtcacaagaaaagaaataaattaatagaaaattaccatcgtttaaatgaggaaaatccatatagtattacagaacagatttttttagaaaaaacaaaagattcatatgaacaagttcaaacttttttgggagataaattaataccttcctatcctatatttgtattatccattcttcaatcaatgaatttagtaaaacctaacaattatgaacaaacttcatatggatattgctatcagtctttgatacatttcgctttagcggcaaaggctaaaatcaaaaatgaagatattgatacttatataaattatttgtcagaattagcattttctttgtttgataaaaagaaaaaatcgttgtctgatattgaatttcaagagtttcataaaaattattcagctaattatatagcaccttcttttattgaagtgagggataaactattaggatccggtcttcttgtctatgatgaagatgaatggtttcattttggctataattatattttctattttcttattgcccaaaagattgcaacaatattaacagaagaaaaatgaaggcaaataa

SEQ ID NO: 247 - DNA, 8428 bp, Bacteroides thetaiotaomicron
atacagaatattggatatgaaaaaattggtcgtattaggaatgggagtatgcatggtgcttgcgtttgcatcttgtaaatccagtgaaagcgcctataaaaaagcttacgaaaaagcaaaacagcaagaattggcagaaccgcaggtggaagctccggtagaagtgactccggtagttgcagctcctgtgacaacacctaaggctacagatacaaccggcgttcgtcaggaaaaggtgacagtcgtttccggtaccgacggattgaaggattacagcgtagtagtaggcagcttcggtgtgaaagcgaatgctgaaggcttgaaagactggttggacggacaaggttacaacgcaacaattgcattcaatgcggaaaaagcaatgtaccgtgtgattgtaagctcattcgctgacaaagcggctgctgtcgatgcacgtgacgcattcaaggctaaatacccgagtcgtacagacttccagggagcttggttgctgtatcgtatttattgatttctttttggtaatatatatcgggatggataacctgttttcccgaaataagaaggcggtaactgggaagttactgcttttttgttacacattgtaaattcgttttttagaaatttttatcattctactaaaagaagttataaatagcaggtgggaaacttttttcgtaaataaagtttttacttttgtcattatgaaacagaaatatgtaatggctgctatcgatgcagcgttgaaagcgggtgaaaaaatcctttctatctatgaagatccgaagtcggattttgaaatagagaggaaggcggataactctcccttaacgatagcagacaggaaagcccacgaggcgattgtggccattttgaatgaaactccttttccggttcttagtgaagaaggaaagcatatggactatgcagtgcggcgaggctgggatactttatggattgtagacccgctggacggaacgaaggagttcatcaagcgtaacggagaatttacggtaaatatagctttggtgcagaacgctgtacctgtaatgggtgttatttacgtgcctgtaaaaaaagaactttattttgcagtggaggggacaggtgcctataagtgttccggcattgtcggtctggaagacgagggagtgaccttacagcagatgattgagaaatcgaaacggatgccattggcggatgcgcgcgaccattttattgctgtcgcttcccgttcacacctgacgcctgaaactgaaacatatattgcagacttaaaaaagaaacacggcaatgtggaactgatatcaagcggaagttctattaaaatctgtctggttgccgaaggaaaggcggatgtctatccgcgttttgctccgacgatggaatgggatacggctgccggacatgcgatagcccgtgccgcagggatggaagtatatcaggcagggaaggaggaacctttgcgatataacaaagaggatctgctgaatccgtggtttatcgttgaagcaaaaagagaacgctaattaatgtttatatgacatttgaaattgtatttgtactattatccttattaggaatgatggctgccctgatcgcggataagatgcggccgggcatggtgctcttttcggtagtggttttatttctgtgcgtcggcattctgactccgaaggaaatgctcgaaggtttcagtaataaaggaatgattaccgtcgccttgttattcctggttagtgaaggtatccgtcagtcgggtacattagggcaagtgatcaagaaactgcttccgcaggggaagacgacggtgtttaaagcgcagctgcgtatcctgccgtctgttgcattcatttctgcctttctgaataatactccggtggtagtcatctttgccccgatcatcaagcattgggcgaaatcggtaaaacttccggccaccaagttcctgattcccctttcttatgtgactatccttggcggtatctgtacgctgatcggcacttctaccaatctggtagtgcatggtatgattctggaagccggctatgaaggcttcaccatgttcgaactgggaaaggtcggcatctttattgccattgccggtatcatatatcttttcattttctccaaacggctcttgcccgatgcacgtccggatacggctgtacccgatgaagaagtggaggaaggagagaagctgcatcgtgtagaagctgtattgggggcccgtttccccggtatcaacaagaaactgagtgatttcaatttccagcgtcactatggtgcggaagtgaaagagatcaaaacacgtaacggtcagcgctatgtcgatcatctggaggatgtagtgctccgtgagggggatacgcttgtggtgatggcggatgatacgtttatcccgacttggggagaatcttcggtattcgtgctgcttactaacggcaatgatccggatacttcgggaaagaagaagcgctggctggcgttgatcttgctggtactgatgattgtcggtgctacggtgggcgaactgccggcaaccaaagagatgtttcccgatatcaagctggatatgtttttctttgtctgcattactactattatcatggcgtggaccaatattttccccgcccgtaagtataccaaatatatttcgtgggatattctgattacgattgcctgcgcgtttgccatcagcaaggctatggtgaactccggtgtggccgattgtgtggcaggatttatcatcggtttgagtgacgattacggaccgcatgtattacttgctatattgtttgtcatcacgaatttgtttacggaactgatcacgaacaatgcggctgcggctctggcattcccgttggcactgtccatctcggcgcagttgggcgtaagtccgacacctttctttgtcgtgatctgtatggctgcgtctgccagcttttccacaccgatcggttatcagactaatttgattgtgcaaggtatcggcaactataagtttacggattttgtccgtatcggtctgccgctcaatatcatcactttcttaatctctgtgatcctgatcccgttgatctggaacttttaataaacatattctataaatggaagaaaaaaatcatatatatccgatttttgaccgcatgatgacgcgggaggacaaagaagaacttctgggacagcatagcgtgatgatctggtttacaggtctgagcggatcaggtaaaagtacgattgcgattgcattggaacgtgaactccataagcgcggactgctttgccgtattctggatggagacaatatccgcagcggtatcaacaataatctgggcttctccgaaactgaccgtgtagagaatatccgtcgtatcgccgaagtatccaagttgtttctggacagcggcatcattacgattgcggcatttatcagtcccaataatgatatccgtgaaatggcagcgaatattatcggaaaagatgatttcctggaagttttcgtaagcaccccgctggaagagtgtgaaaagcgggatgtgaaaggactgtacgccaaagcgcgcaagggagaaattcagaatttcaccggaatttccgcaccgtttgaggtgcccgaacatccggctctggcattggatacttcgaagctgagtctggaagaatcggtcaaccgcctgctggagatggtgttgccgaaaatagaaaagaaataaatgaagaaatttcaaaaaagatggaagaatataaactgagccatttgaaagaactcgaagccgagtcaattcatatcatccgcgaggtggcggcggaatttgagaatccggtgatgctgtacagcatcggaaaagattcttcggtgatggtgcgcttggctgaaaaagcgttttatccgggaaaagttcccttcccgttgatgcatatcgattcgaagtggaagtttaaggaaatgatccagttccgcgacgaatatgccaagaaacatggctggaacctgattgtggaaagtaatatggaagcgtttcatgcaggggtaggacctttcacgcatggaagcaaggtacatacggacctgatgaagactcaggcattgctgcatgcgctggataaatataaatttgacgctgcattcggcggcgcgcgccgggatgaagaaaagtcacgtgccaaggagcgtatcttctctttccgtgataaattccaccagtgggatccgaagaaccagcgtcctgaattgtgggatatctacaacgcccgtgtacacaaaggtgagagtatccgtgtgttcccgatcagcaactggacggagctggatatctggcagtatatccgtctggagaatattccgatcgttccgctgtattatgccaaggaacgtcctgtgatcaatctggatggtaatatcatcatggcggatgacgaccgtctgccggaaaaatatcgtgatcagatcgaaatgaagatggtgcgtttccgtactctgggctgctggccgttgacgggcgcagtagagagcggtgcggctaccatcgaagagatcgtggaagagatgatgacgactaccaagagcgaacgtactacccgtgtgatcgactttgaccaggaaggcagcatggagcagaagaaacgtgaagggtatttttaagcaattaaaaatgaatgattaaaaaaactaaaagttggaaatggataataagctggatataaaggcctttctggataaagacgaacagaaagacttgctgagactgttgactgccggttcggtggatgacggaaaatcgactttgatcggacgtctgttgtttgacagtaagaaactgtacgaagatcagctggatgcattggaacgtgacagtaagcgtgtaggtaatgcaggcgaacatatagactatgctttgttgctcgatggattgaaagcggagcgtgagcaggggattacgattgatgtggcttaccgctacttctctaccaatggccgtaagtttatcattgcggatactccgggacacgaacagtatacacgtaatatgattaccggtggctctacggccaatctggcaattatcttggtagacgcccgtacgggtgtgattacccagacccgtcgtcatactttcctggtatctctgctgggcatcaagcacgtggtgctggcggtcaataagatggacctggtggacttctccgaggaacggttcaacgagattgtatcggaatacaagaaattcgtagaaccgctgggaattccggatgtgaactgtattcctctttctgccttggacggtgacaacgttgtggataagtccgaacgcacaccatggtataaaggaatctctttgctagacttcctcgaaacggttcatatcgataatgatcataacttcacggatttccgtttccctgtgcagtatgtgttgcgcccgaaccttgacttccgtggtttctgcggtaaagtggcatcgggtattgtccgcaagggagatacagtgatggcattgccttccggaaagacttccaaggtgaagagtattgtgacatacgacggcgaactggattacgctttcccgccgcagtcggttacactgacactggaagacgaaatcgacgtatcccgtggtgaaatgctggtgcatccggacaacttgccgatcgttgaccgcaacttcgaagcgatgatggtatggatggatgaagaaccgatggacatcaataaatcgttctttatcaagcagactaccaatttgagccgtacccgcatcgacgcgatcaaatataaagtggatgtcaacacgatggagcatctttccattgacaatggacaactgacaaaggacaatttgccattgcagctcaatcagatcgcccgcgttgtcctgactactgccaaggagcttttcttcgatccttataaaaagaataaatcttgcggttcttttatcctgatcgatccgattacgaataatacctctgccgtaggtatgattatcgaccgggtggaaatgaaagatatggctgccacggatgacatccccgtactggatttgtcgaaactggacatcgccccggaacatcacgccgccatagaaaaagccgtgaaggaactggaacgccaaggactctccataaaagtgattaaataaaatgtagaacgatgggattacttgaatttaataaacttccgattaatacgttggtaggtgccgactggaaaacgtttaaggcaatcactgccggccgtgatattgatgctgcttataaaggcaagtaccggttgacgaaagcggtgtgccgcctgctttctccgttggctgcattgcaggataaacgctacgaaaagttgttggccaatcagccgctggaacatgatccggtattcattctgggacactggcggagtggaactacttttgtacataacgtgttctcctgcgacaagcattttgggtataacacaacttatcagaccgtattcccgcatctgatgatgtggggacagcctttcttcaagaagaatatgagctggctgatgccggacaagcgtccgacggataatatggagctggcagtggatcttccgcaggaggaagagtttgcattgtcgaacatgatgccgtatacctattataatttctggttcctgccgaaatatcaacaggaatatgcggacaagtatctgctgtttgatgatatcacggacaaagaactgaaagtgtttgaagaggtattcacaaaattgatcaagatttctttgtggaataccaagggtacgcaattcctcagcaagaaccctcctcatacgggcagggtgaaagaattggtgaaaatgttcccgaacgccaagtttatctacctgatgcgtaatccgtatacggtatttgaatctacacgcagtttctttacaaatacaatccagcctctgaaactggaggatgtcagcaatgaacaattggaggagaatatcctttctatttatgcaaagctgtatcataagtatgaatcggataagaaattcattccggaaggcaatctgatcgaagtgaagtttgaagactttgaagcggatgcgatgggaatgacggagaatatttataagtcactttctatccccggcttcgccgaagcacaaggagatatcgaaaaatatgttggcggcaagaagggatataagaagaataagtataaatatgacgaccggacgattcgattggtagaggaaaactgggattttgctttgaaacaatggaactataatttataaaagaaaggataagtattgatgattaagaaaatggttcatcgcctgtttctgacaggcttcgttgcatttttttcttccttgtctttgatggcgcagcataaagtggagatggtccccttcggggatatggaccaatgggtggaccgccagataaaagagtcggggattatcggagggaatacgaagaatgtgtatgagattggtccgacgactgtgattaagggagatcaggtgtataagaatatgggtggctcaccgtgggcgacttcgaatgtgatggcgaaagtggcaggtattaccaagacaaatacgtcggtttttccggagaaacggggagacggttactgtgcacgcctggatacgcgtatggaaagtgtgaaggtactggggcttgtcaatataaccgtattggctgccggctctatctttacgggatctgtgcacgaaccgatcaagggtaccaaaaacccgcagaagatgcttcagacggggattccgtttaccaagaagccggttgcccttcagtttgactataaagtgaagatgtccgacagggaaaaacgtatacgtgctaccggtttcagtaaaattacagatgtagcaggcaaggattatccggctgctattttatttttgcagaaacgctgggaggatgccaacggaaatgtttatgccaagcgtatcggaacgttggtgacttattactatcactctaccgactggaagaataatgccacgtatgaaattatgtatggagacattaccagccgtcccgaatataaacctcacatgatgcgtctgcaggtgactgagaactatacagtcaacagcaaaggtgaaagcgtgcctatccacgaagtggcatggggggatgaaaatgatgagccgactcatctgtatctccagttcacatccagtcatggcggagcttacgtcggttcacccggaaattcattgtggattgataatgtaaaactggtatattaattaaggtagcggaaaaaataagggataaccaatgatatagattatcattggttatttttttgcttttatttttctttcaaaaatgttggctataccctttgtaggctatccaacacttttatcatcccatataaatatcacgaagaaatgtttttttacgagtttttttgtgtgtattac

SEQ ID NO: 248 - DNA, 8280 bp, Bacteroides thetaiotaomicron
gtagaaagtagacaatcaattcattaataattaaatgtaagagatatgaaacgaatattattattaaccgttgtatttattatgatgcttggaaccagtttttctttcgcacaggctgatgcggataacttttataaaagtgattgggtaaaggtagaaaaggtttctttttctaaccagtataaaatgaaagtagccggcaacctgtttttgccgaagaccatgaaagagggagagaaatatcctgccatcattgtcggacacccgatgggagcggtcaaggaacagagtgcgaatctgtatgctactaaaatggcggaacgtggtttcgttacgctgtccattgatttatccttctggggtggaagtgaaggtgagccgcgcaatgctgttttgccggaggtatatgcggaggatttcagtgccgcagtagattttttgggtacacgtccgttcatcgaccgaaataatataggtgtaatcggaatttgtggcagcggaagtttcgctatcagtgcggccaagatagaccctcgtctgaaagcgattgcaaccatcagcatgtacaacatgggtacagccagccgcaacggactgaaacatgcgctgactctggaacaacggaaacaaatcatggctgaggcagcagaacagcgctatgcggaatttctgggcggagaaactaaatatactggcggcactgtacatgaaataacagaaaactctggtccgatagaacgcgaattttatgagttctaccgcactcagaggggagagtttactcccgaaggagcaaccctgacaactaccacacaccctacactttcaagcaacgtgaaattcatgaatttctatcctttcgaagatattgagactatttcgccccgtcctatgctttttataaccggagaaaatgcccactcacgcgaatttagtgaagatgcctaccgactggctgccgaccccaaagaactgtacattgtacccggtgcaggtcatgtagacctttacgaccgtgtggggcttataccatttgataaattggaatccttttttaaggaatatctgaagaaataagtatgaacaggaaaaacagataactatttaaataaaagacaatcgaatcatgaaacaaattaaaaatacacattacgaaggcgaacgtcctttgttcgcatcccacgggctttatttggaagaagtaaccattcatgccggtgaatcggcactgaaagagtgcagtgatatagaagcggtaaactgtcgtttcgagggaaaatatccgttttggcataatgacggttttgtagttaaaaattgcctttttaccgaaggagcacgtgccgcactctggtattccagaaatctgaagatgaaggatacattagtggaagcaccgaagatgtttcgcgaaatggacggagtcgaactcgaaaatgtacagttgcccaatgctttggaaacactctggtattgccggaatgtagaactgaacaatgtgaagatagataaaggagactatctctttatacatggggaagacatccgcatcaagaattttgtattgaatggcaattactccttccaatattgcaagaacgtagaaatccgccatgctgaaatccattcgaaggatgcattttggaatacggagaatgtgactgtatatgattctgtattggacggtgaatatttgggctggcattctaaaaacttacgtttagtgaattgtaagatctcgggcacgcagccactttgttatgcacacgacctgataatggaaaactgcacaatggcggatgatgccgatcttgctttcgaacacagtagtgtgaaggcaacgattaaaggcccggttcacagcgtgaagaatccccgtacgggaaacattgttgccgaaagtttcgggacaatcatcctggacgagaacctcaaagctccgggaaactgcgaattgaaactttgggacggactgacttgttttgattgaaatatatgaagtacaacttcgatgaaattgttccacgcagaggtacaaattcctataaatgggattctgccggagatgcggatgtattaccaatgtgggtagctgatatggatttccgtacagctccctctgtggtggaagcactgaaaaggcgggtggaacatggtatcttcggatatgtgcgtgtgcccgatgcttactatgaggcgataacaagatggtttgccggacgtcatggctggcagattgaaaaagaatggattatttatacgaccggagtagtaccggccctgtcagctgtcatcaaggcgctgacaactcccggtgataaagtaatcgtgcagacacctgtctataactgctttttctcctccatccgcaataacggatgcgaggttgttgcaaatccattgatttacatgaacggaacgtatcagatagactttatcgatttggaacggaaggcggctgacccgagtgtaaaagtcctgctattatgcaatccgcacaatcctgccggaagagtctggacaaagcaggaactgactcgcttgggagaaatctgtcttcggaataatatatgggtagtagcggacgagattcattgcgaacttgtctttccgggacacacctatatcccttttgcatctgtctcagaagagtttttgatgcattccgttacttgcacctcgcctagtaaagcctttaatttggcggggcttcagattgccaatattgtttctgctgatacggatatacgaatgcaaatagacaaggcaatcaatatcaatgaagtctgtgatgtaaatccgtttggcgttgaagccttgatagctgcttacaatgacggggaagaatggctggaagaacttaaccaatacctgtttgccaactaccattatttaagggcttactttgatgaatatcttcccgaatttccggtgctgccattggaaggtacctacttagtatgggtagattgctcggctttgaaacaatcgtcggaggatatagtgaaaactctgttggagaaggaaaagctttgggtaaacgaaggcaatctgtatggagaggctggcgaaaggtttatccgtattaacatcgcgtgtccgcgacagcggttgatagaaggattaaacagattgaggcgggcattgaaataataaaataattgtcagtttattaataggttccccttctcactccccgtaaatacaaataaaaagaagtgatatgaaaagtcagaatccctcaaagaggaatttgccgggtgttatcatcgcttatttcctcatttatgtagtctggggctccacctatttttttataggggtggctttgaaagatttttcaccttttctgctcggagcactgcggtttacgactgcagggctgatacttcttggaatctgttatttacggggagaacaaatctttaagaaaagcctggtaaagcgttctgccgttagcggtattgttctgttgtttgtagatatggctgtcgttatgctggcacagcgctatctgacaagtagcctcgttgctattatagcttcttctacggcactttggattttacttttggatgtccccatgtggcgtactaatttccgcaatccccttacgatagcaggcggagggattggcttcggcggagtagtaatgctttatgcggagcagctcaatgcagaatggttgcatccgcaaagtgagcgtggtatcttgctccttgttttcggatgtatatcctgggctttgggaacactgtatgccaagtaccgttcttcccgtgaggaagaagtgaatgcttttgcaggttctgcgtggcaaatgctttttgccagtgtgatgttctggatttgtgctgttgtgaacggagatgttcgggaagccgatttgagtacagtttcggtcacaagctggttctccttgctttatttgatttcttttggttctttactggcatattcggcgtatgtctggctcttgaaagtacgcccggcggcagaagtgggtacacatgcttatgtcaatccttttatagcagtccttttaggagtatcttttggaaatgagcaagttaccttcgttcagctttccggtttgctggtgattctgctgggggtgatgttgattagccggaaacgtaacaaaatgaaatcaacggcaatatcccgttaagcggaattgattcggcgtcatccccacaatccgtttgaacatccggctaaggtgctgcggatactggaatccgatttcgtaagcaatttggctcatagtcttgttcgaagacatgagttgttcttttgccagttcaatcattttatcctggatatattcggagacggttttaccggtttgtttgcgcaccatatcgccaaaatagttagcggaaaggaatactttatcagcgaagtacttgaccgatggcaacccttggttttgcggggcatctccttcgaaatattcgttgagcagatgttcgaagcggacaatgatgtctttgtttactccgtttcgtgtgtcgaactggcgttcgtaaaagcgcatacagtagtcgagcagcaatcctatgttggcgcagattagtcggcggctgtgtttgtcgatggaatgttccagttcgatggtgattttttgcaggcagtccatcactgtttgccgctcttcttcggaaatgtggagtgcttcgttggtttcgtaggagaagaaggagtatttctttatttcttgtccgagcgcagtgccacgtataaggtcgggatgaaaaagaataccatgcgcgttgggttgaatatttggcagcatttccaggtcggtgatttgtccgggagcgaaacagacaatggttccgtcttgatagtcgtaatattggcgcccatatttaatatcaccacattttacatttttcaagtatagtgcatatacttcgtaacgaaaccacgcacgtgtgggccacgtagtggatttggccagatcgatgatgctgactaacggatgtctggtttcaagcccgaagatttcgttgtaacggtcaacgctgtctattacaatcatttctttagtattctcttccatatcacaatctgtttttttaatgcgttacaaatataattcttttctctttaaaatttttactctcccatcaaaatccatgattggggtataaatatccgtaaatcgtctacatccgggctggaccattccccgtaactttgtaaccggtaatttaacattgaaaagagatagtaatatgaaaaagattctattaattccattgatgatgctgacgatgatgccgatggcggcttgcgacggctcaaacgctgatccgattcttccggaacagccgggacaaccgggaaattccgacggtggagacgaggacgattctacaaacccgacaaaccccattccgggcggtaacgggcgatatctggtactttactgttcgcgcaccggcagcacggagcgtatggcgcaacagattcagcaaacactcgattgcgatatcctggaagtggaaccgcaaacaccttatgaaagcgattataatgggatgctcaaccgtgcacaggaagaactggctgctatccgtcaggggaattatccggcgattaaaacttcggttgaagatttcggcaactatgatatcgtgtttgtcggctatccgatttggtacggtagcatggccacaccgatgcagacattcctgcataatcatgcttcgaaacttgcaggtaagcgtatcgctctttttgccagcagtggcagcagcggcatctctgcatcagttgacgaggcgcggacactttgctccggtgccactttcaccgaaacattgcttctgacttcttcgacactttcgcagatgggaaaccggatacggacatggctcgaaacactcggtgcgagtcgggaaaacaattatccgtctacttctacgaatgtgaagattacagtcggtaaccgtaccattactgctacgatggaagacaatgccgcggcgcaggactttctttcacgtctgccgcttgaagtgacgctgaatgattataataatatcacagagaaaattttctatccgtcgcctgcactgactacggcaggagtgccccgtggctgtgcacctgtgcccggtgatattacaatctatgtgccgtggaataatgtggcgatcttctgtaaaagcgggtcgcaaagcaatgacttgataaagattgggcgcattgacggtaacggaatagatgcattgaacgttccgggcaatgtggcagtgaaattcgaacgacaataaattagcaaaatgaagaagttactgattatttttctattgtttgcagcaaccgcttcggcaaacgtaatcagaccggtcgaaccatccgccgccgagaacaatatggtgcggttgtcacgcatcataatcgatccggaacggctggaagagtacaatgcttatctgaaagaggagatcgaagtctcgatgcggttggaaccgggcgtattggtactgtatgccgtagcggagaaagaacgccccaaccacgtgactattcttgaaatctatgccgatgaagcggcctataagagtcatattgccacacctcattttaagaagtacaaagaaggtacacttgatatggtgcagatgctcgaactgattgatgctacgccactcattcccggactgaagatgaagtaaatgataggcagtactataaatctgtaattttggtttttatatccgtaatttgtattataaagagttggatcagaacagctaactttgcattatcagagagttcttaaataataaaccatggacgtcacagtatgagaaaattattttttatttttgtaacagtcatcggatttctgcaaattccgatgcaatctataaatgcacagagtatgaagaaagaagaagtacctcagaacatcagcgcatttccgttgggaaaggaaaatacgggattcaagcaatattttacaggagaatcctggctggcaccgctgaccggtaataaagacttgaatgtacccatgtccaacgttacttttgaacccggctgccgaaataactggcacagccatacgggcggacaaatcctcattgctgtcgggggtgtggggtattatcaggaacgtggcaaagcggcacgccgcctgctccccggtgatgtggttgaaatagcaccggacatagaacattggcacggtgccgcccccgatagttggttttcgcatctggctatcggctgcaatccgcagaccaacaagaatatttggctggaacaggtagacgaccagcagtatgccgaagctacgaaagataacggaggaaccggattaagcgccaccgaccccgaactggatgcaatattcggcaatttcacaaaggaggtgcagcaatacggcaacctggatactaaaacccggctcatggtaacattggcatccaatattgcctcacaggcacagaccgaataccggatgatgcttgaaagcgctctcaatgcaggtattactccgatagaaataaaggaaatcctttaccaggcagtagcctatgcaggcatggctaaagtgatggactttgtcggcatcactaatgaggcgctgcttgcccacggtgtacgtcttcctttagagggacaagcggtcgtttctgccgaaacccgtttcgacaaaggactggcgttgcagaaatccattttcggcgaacggatcgaccaaatgcataaaaatgctcccgaaaaccaaaagcatatccagcgttatctctccgccaactgcttcggagactaccagacacgcggtggactggacgtgaagacacgggaactactgacgttctccatccttgtttccttgggaggctgtgaatcacaggtgaaagggcacatacagggaaatgtcaatgtaggtaataataaagatactttgctggctgtcgtgacgcagcttttgccttacatcggctatccacgtactctcaacgctatagcctgcctgaatgaagtgattccggaaaaataacaaagacgttcatattcccggaaagcaggcggttaaaatctgtttgggacttgacaaatgcttttttatgttgtatatttgtagttcgggaaagtatgaaaccaatgaataatgaatgaaaaaatagataaaatatgagtgtaaaacgaatgataaatggtataatattaggactaatataacatatttctttagctcgttctagagatcagaaggataaatatagagcaaaggttgcaaactttatggag

SEQ ID NO: 249 - DNA, 8255 bp, Bacteroides thetaiotaomicron
caattagtttctccacacccggatgaaaccaactgtaatgaattgacgaataagataatggattgtaccgtctaaatgacgatcttccttaaaccatatatataatatgtaataggatcgtaaaagtacttgggaatatggagtgaatgagtctgagacgtgttttgctggcttttgtattcacggaaataagtaatcagcaattgcacgcttttatctgtagggatgtgtgcaacatccgcatgactcatatcacaagactgggtagaatagaaataatgaagacgttcaagagcattatgaacaggatgatcctgagatacgtagcacttctcctggcgatatgtcgggggggatactctgcagttatcttccattgcttcattggaaacaacatggatcagcaaagcaagtaccagaaatagtccgtattttaagctttgtttcatctttctcttttaacggctgcaaatataggattaatattcatgttttttgcaaagtcggggttacaaaaaagtattttttaacttgctttatttcaagtccgtttttatttcagtgctactttggagaatcttcttcttttatggtatatatccgttcttatttggttaaaagatgtaataaaaagaacgatttacgttctttttgacgaattacccaaagaaaattcatttttttgcaaattgtatataacacattgatatgaaacacacactttgctttataacaatcctactgggttctttgttgaatctttatgcaaataacgagaatgattctctattgaaagttttagataaagtgatttctgagcgtcttgtgtatacagaaaagaaggaagctactatcaaagagctgaaagcaaaaaagaaggaacaaaagaccttggacgatatgtatcgtctgaattccgagattctccatcaatacgaaacgtttgtctgcgattctgcggaacagtacattaatgagaatattgagatcgctaagaaactggataataaaacctatttgctggaaggaaggctgcaactggcttttgtttattccttatcggggttgtttattcaagctaatgatattttcaaatcaatcaattgttcggatttacctagtcatttacaggctttgtattgttggaatcgtattcggtattatgaaaatttgattaaatatacagatgatgctcggtttgccagtgaatatttggttgaaaaagaagcgtatcgagatacagttatgagtatcttgtatgatgcatcggaagaatattcgaaagaaagagctataaagcttcaggatcagggaaatacaaaagaagcacttaagatactgactaaaatttatcaaaaggaaaaaacaggaactcatgggtttgcaatgatgtctatggggctatcaagagcatatcggctggtcggagagcatgaattggaagaaaagtatcttatattagctgctatgaccgatataaaactggcagtgaaagaaaatgaggctttgttgactttagccgtgaatttataccataaaggagatatcgatagatcttataattatattaaagtagcactgagtgatgctatcttctataattcccgttttaagaatacggtaatagctcgtattcatcctattatagaaaatacttatttatataggctggaaaagcaaaagcagaatcttcgtttttatattttgctcactagtttgtttgttgtggctcttgctatcactttgtattttacttataaacagactaagattgtttcccgtgcaaagaagaatctcaatgttatgaatgaagagttagttgcattgaacaagaatttggatgaggctaatttaataaaagaaagatatgtaggctatttcatgaaccagtgtgccgtttacattaataaactggatgaatataggaaaaatgtaaatcgaaaaataaaaaccggacaagttgatgatttatacaaatcttcttctcgtcctttcgaaaaagaattggaaggattatataccaattttgataaggcgttcttaaaattgtatcctaattttgtcgaagagtttaattcattgttgaaaccggaagattattataaactggataaagaccagttgaatacagaattgcgtatttttgctttgatgcgaatggggattacagatgtttcgcaaattgctgtttttttgcattactcagtacaaacgatctataattataagagtaaagtgaagagaatgtctttattggatggaaatatcttcgaagaagaggtgaaaaagcttggttctttgtcccaaaaatgattctatttggtttaccaaaaccttaaaatggttgtttgttaatgcgttgaatattaatgtattatctagaagagatgttcaaaaacgtctactttatagcctacttccaataaggagtaggcttttttcatctctatatttgcatcacaagatttttgataactgaatactaatctaaagaaacacagctatggatttttcagaattgtatcttacttattattcaaaactggttcggtttgcaaaagaatttgtaatactggaagaggatgcagaaaacataacacaagatgtgtttaccgacttatgggcgaaacgtgattctatggatcgcattgaaaatatgaacgcgtatcttttcagattaataaagaatagatgcttggatcatttgaaacataaaatgtttgaacagaaatatattgaatcagttcaaacctctttcgaaatagaaatgtccttgaaattacaatctttaaataggtttgatgtgtctgatatctcggaaggaaatgaaacggaaatgctcgttcgtaacgcaatcaatagtctgcctcgaaaatgtcgtgacatatttttattaagtcgtgtcgaagggttaaaatatagagaaatctcagaacgtttgggtatttcagtaaatactgtagaatgtcagatggggatagcactcaaaaagttaagggtaaaactaaatatttgccttgcagcatgagttttaataattttattgatatttttttaggggtatttactgggataatcgttcttttgtaaaaaggaacgaataatgggaactaatttaaataaatattttgcaggtgaattgacttcagaagaaaaggaagtcttccttctgaatgtgaagaataatggggaaatgcgcgaagaatttattgagtatcagagtgttgttgctcttgtggattggtcgttccctaaagatgataaagaacttgctaagcaaaaactatctgaatttatgagtcggatagagaatagcgaaaataaaaaggcttaaaaataccatgaatagacttaataacatcatattactagtcgtctttatatgtacgcatgctcattcgcaacaagcttattttgttgatggatatcatggagggatatacgggcattatccggtgaagtggaaaactcagtttattgtcgaccagttatccaagcatccggattggcgaatttgtctggaaatagagcctgaaacatgggatacggtgcaaatacagactcccggagcctatcgacaattaaaaaacgtagtagtaactaagcaggtagagtttacaaatcctacttatgctcagccttattgttataatatatcgggcgaaagcattatacgtcagtttcaatatggtattgctaagataaataaacattttccgggagtgacttttaccacttattctgtggaagaaccctgtttcacaagttgtttgcctcagatattgaagttatttggttttaagtatgccgtactcaaatgcccgaatacttgttggggaggatacactaacgcttatggcggcgaattggtcaattgggtaggcccggatggaactcccattcttactgttcctcgctatgcttgcgagaaattggaagagaattctacttggcagacaactgcttggtgtaatgaagaatcttatctgaatgcttgtcgtgatgcagggattgaacatcctgtgggaatgtgtttccaagatgccggatggaaaaatggtccatggttaggaagtggaaagaatacaaaaagtaattcagtttatgtgacgtggaaagattattttgaaaatatttccattggtaaaacgaatgatgactggcatttctcgcaggaagatatacgtgtaaacttaatgtggggaagccaagtgttgcagagaattgctcaagaagtacgtacttctgagaataaaataataatagcagagaagatgtctgttattgctcatcttgccaatgggtacacttgtgttcaggaagatttggatgaagcatggcgtactttgatgcttgcgcaacatcatgattcttggatcgtaccttacaatggcctaaataaatttggaacctgggcggatcaaataaagcgatggacagatgagacaaatactgtggctgataaaattacagctgcttctatattcagttttgataacgatactattaatactgaaaaagcccagggatttgtacgtgtttataatacattgggaacaaaaagaaaagaactggtaactgttgaactccctcaggaatatgcagactttgatttggaagtcaatgattatagaaataaaaaagttgattattcaataggaaaagaaggtggaaaaataagattgttgtttgaagcagatgttcctccctttggttactccacatatcgtattaaacaagtaaagacaggtaaaagaacggtttcaggaagcgaaaagattataaatgaaggagaatatgtggttgaaaatgatatgtataaaattgtttttgacttgtcgaagggaggaattattaaaagccttgtagcaaaaaaagaagaaaacaaagaatttgccaaacaatcgggtgaatattctataggtgaattgagaggctatttttatgacgaaggcaagtttcgctcttctacagaagctccggctaagctgacggttttgcgaagtaatatacaagagacaaaggtaaaactggaagggaaaatagcttcacatccttttgtacagattataagcattgctcaaggggagaagcgtatcgattttgaccttactattaattggaagaaaaatgtaggtattggagaatataaagaaaatagttggcgggataatcgcagagcttattgtgatgacagatttaagttaagtgtacttttccctgtaaatcttcattctcctcgtatttataaaaatgcgccgtttgatgtttgtgaaagtaagttagatgatacttttttcaatagttgggatcagattaagcataacattattcttcattgggttgatttggcagaacaggaaggagattatgcattggctttattcgcagaccatactacttcctattcacacggaaaagattatccgttaggactgactgcccaatattctggtaatgggctttggggacctgactataagatcacgggaccgttgaaaatgaaatatgctattgttcctcatcgtggcaaatgggacaaggctgctatagccacgaagagcgattgttggaatgaaccattgttatgttcctatcattcatttgcaaaattggagtcaaggtcactggtagacttaaaaaataccggttatcaggtgagtgcagccaatataaaagatggaaaaataatcttgcgattgtttaatgcggaaggtgacaggaagcagcataatattacttttgatatgccgctgtctagtatagaagaagtagatctgaatggtagagttatagatagaaagacaataaaaacacgtaccggaaaatctgaaattagtatttctatgcctcgtttcggtctaaagacatttgctttgaacttgaattgaacatattctaataatagtaaactgtaatatttttatgtataaagctagcgctaatattttaatagcttgctcttttttgtggctgactgcttgttcttcagcaggagtagtaacagaagatttaattccgactgattatgtaaatccttttataggagctagtaccagtgtaggagctgccggtgtttatcatggattaggtaagacatttcctggcgctactactccttacggtatggtacaagtaagtcccaatactataaccggaggtgataatagttccggttatagtgatgaacacaaaaccattgaaggctttgcctttactcagatgagtggagtgggctggtttggggatttaggaaatttcctggtgatgcctacaacgggcgaactgcaaaaaatagcgggtaaagaagatggtagtataaaagggtatcgttcttcttatgataaagctaccgaaacagctaaagcgggatattattcggtagaactgactgattataagattaaagtagagagcagtgcgacacctcattgtggaatattgcaatttacttttccttcgaatgaacaatctcgtattcagatagacctggcacgtagagtgggagggacttctacttcgcaatatgtgaaagtattggatgattataccattcaaggctggatgaagtgtacacctgatgggggtggatggggaaatggtgagggaaattccgattacacagtttattattatgcacaatttagtaaaccactgagtaattatggcttttggagtgcggatattcctgatgaatgggttcggaagcgtgatgaagtggtaagtattccctatctgacacgtatatcacaagctccggtcattaaagataagaaagaactggaaggaaagcaccttggcttcttcacagagtttcccacaaaagagggagaacaggttgagatgaaagtaggcatttcctttgtcgatatggaaggagcagctaataactttaaacaggagattgcttctaaaaactttgctcaagtaaaacaggaagcgagtgatttgtggaataaagaacttagccgtatacggatatccggtggaactgatgacgaaaaaactgttttttatacatcattatatcatacgatgattgaccctcgaatctatacagatgttgatgggcgatatattggcggagataaaaaggtacatgaacaggacggtacatttaccaagcgtactatatttagtggttgggatgttttccgtagccagttccctttacaggcgatgattaatccgcgtttggtgagtgatgcgttgaattcgctgataacgatggcagatcagagcagacgggaatattatgaacgttgggaacttctgaattcttattctggctgtatgataggtaatcctgcactgtcggtgctggcagatgcttatatgaaaggaattcgcacgtatgatgtagaaaaagcatatcaatatgcagtcaacacgtcagctaagtttgggaatgattcgttgggatatactcctgaaccgttgagtatttcatatactctggaatatgcctatgcagactggtgcgtggctcaattggcaaaggcgttggggaaagaagaagatgcaaagcgcttttatgaaaaagggcaagcctatcgtaacatgttcgatgcggaaaaaggctggttccgtccccggaatgcagatggatcatggaaagcatggccggagaatgcactgaccgaagaatggtatggttgcattgagtcaaatgcttatcagcaaggctggtttgtgccgcacgatgttccgggaatggttgaactgatgggaggcaaggaagaggttatagctaatttgactaatttatttgaccacactccctctgatatgttatggaatgattattataatcatgctaatgaaccggtacattttgttcctttcctttttaatcagttggatgtaccttggtatacgcagaagtggacacgatatatttgtaaaaatgcttatgcgaacaaagtagaagggattgtgggcaatgaagatgtaggacagatgtcggcctggtatatattggctgcttccggcattcatccttcctgtcccggtaacacccgcatggaaataaccagtcctgtttttgacaaggtagaatttaatctggactcaaaatatcatcaagggaaagtatttacaattattgctcacaacaacaacacaaataatctatatatacaaaaagctttgctgaatggcaaggagtacaataaatgttaccttgactttgctgaaatcgcagcaggaggaacattggaattatttatgggcgataagcccaatacagaatgggg

SEQ ID NO: 250 - DNA, 8137 bp, Bacteroides thetaiotaomicron
cttatgtattatttataatattgtaccgttttataagtctcctgtaggtagttggatcaaaatcataaaagagtattggatgatgtctgtttttaataagcgtagagagtttgttcgtttcatattggttggtgttctggcaactgctactcattatggtatttatttctttttatgtgtattgatgttaccagctattgcatatactattggttatgctattagctttattctgaatttttacttgtctaatatattcacctttaatactaagcctactgttaggaaaggaataggatttggtatcagtcattttatcaattatttgttgcatatcgggctgttgtcgctatttatatggatcggagttcccgagagatgggcacctcttcctgtgtttgcattagtagtgccggttaattttcttcttgttcgttttgttctaaaatctaaaaaaatatgagtaaagttagtgttttaatacctgcatacaacgaggaactctctcttccagagctctattcgaagctaaaagaaatgatggattcttatgcagaatatgagtgggagattttgtttgttaatgatggcagccatgataaaacattggaagttattaaatttttgagatcacaagatgagagaattaattttgtcgacctgtcgcgcaattttggaaaagaagtagcaatgttagctggtttcgattatgctacaggcgattgtctggtgattatggatgctgacttgcaacatcctcctcacttaatccctgaaatgttgaaatattgggaagaagggtatgatgatgtatacgcaaagcgaataaccagaggcaaggagagtttgatgcgtaaatatctgtccttgttattctataagttattgcagaaaacgacccgtgtggagattctcccgaatgtcggtgatttcagactgttagatcgttgttgtgtaaacgctttgaaacagatgcgtgagagccaaagatatactaaaggtatgtattgctggattggatttcgtaagaaagagatcaaattcgagcaggaagatcgtgttgccggtacatcttcgtttaactttttcagccttctgagcttggctgtggaaggggtgacttcctttactgtagctcctttacgcatttctacttttgctggaattatagtttccctggttgctttcatatacatgtgctttatcatgtttaaaacattgatatggggcgaagttgtacagggtttccctactctgatggttgtgattctttttctaggtgggatacagttgctgtccttgggagtcataggggagtatataggacgtattttcaatgaaacaaagaatcgtcctacctacattgcaagagaatataatggtgtgaaacaatagctaagattatgagtaaaaaaacggttcggattggtattggcgcatttctgttgataataggaagtttattttacctgatgaatatgtacactccgatatgtggagatgattatctttattcattctatttgactcctgtggcagctaagtctttctttgaaggcacatcgataggatttgagcagaagatatcatcatttaccgatgttattttttcgcaatataatcattatttttatgtgaatggccgtaccattcctcatattctggagcagtcgtttgccggactttggggggagaattgttttaatttaatcaatgtattcgcttttctgttacttaatatgttggttatatggatttccggaaaaagaaatctgacaaaattcggttactgggttgctgcagttttctttatatggttcttattgccttgcccggttgatctctttttactgatgagtggtgctctcaattatacttggagcgccgttctttgtttggcttttctgcttgtttatactaaagtgcggcaaatggaaagggtgaattggggagttgcttttcttctttttttgctgggcgtcatttctggttggacacatgaatctttggttataggcatttccggggctttgtttattatttattgtgtacaatataataagaggaagcctaaatcacctgaaatagctttggttgccggcttttggcttgggaccttgttgttgtgtttatcgcctgctgcccgcgggcgcgcgtcgtttgatcatccttccatctgggaaaccttcttattgataatcggtgagcttcgggcattttatgttcttctgtttttgctggtatatactttttttcgtgaaaagagaaacaacaataatcataccctgagaaagtttttctatgataatcaactttatttttatgtaatcttaattgaacttgtttttagcttggttataggatttcgaaatgtccggcaattgtttggaatagagttgttttctgttgtgattttaatcaagctgatcagtgaacagacttcatttaatgcggtttggtgtagaagtgtatcaattgtggcagcaagtgcgatcgttttgcatatggcatttgtcattccatgcgcaaaacgttctcatgcgcaatttcaggatatagtgaccacttatctccactcagaagacggtgttgtttctttcagatacgaagagtttccctgttgggtcgattcttatgtctggcgattcggagggtatgcggattgggaagctttttgtatttccgtctattatatgggagacaaaaagccgatgaaagctttgctgattgattagtattcatttgtgataatagatgattgtcagttaagatgtttttcggtagtaatattttttgctgtgtataaaaattgtaaaaagaagtaggattttgcatgtgttcatattaatagctctatatttgtataattaaacctaaacccttttacagtttacttatggagctattgaaaagtcatttttttaaaatgagaaaggcttatattgagtcgtttattattcttttgtttctgtcctgttgtcctttcattgtttcttcctgtcacgaggaagagaaagaggagatacctgaatctccttttgacgaagaagatattcaacacgaacaagatctgaatgcttatttgggaaaaagctattcgtgtaaaatttctcaggtctcagtaatggaatcttccgtttgcgttactggtgaatataccggtgaaggcaacttctttttaggtgagattcctccttatttggatatcatagatgtgaagaaggctccttataagttgaagttagaagattcatcttttgaaattaagttagagcgctatgtagaaagggatggagcgttatatgaccgtcttttgtcaaagtgggctatttataaagagggagtagaaagagaccaactggtttctcatgcgcatcaagcggatgaaattcatgcgtttcagaatcttccggctatcaaactgacttcaaagaaagggttgggtggaattattcctaaccaatatatatcggattttacttcgttggggataagcagtgctacgattaatgtttgtatcactcagtttatgcacctgacgccaagagcgggagatattgcgcatacttatgggggaagaacctattatatggatgaaggttacctcaagactgtgcttgacgttcctcttttagaagcagccaaacggaatattgctgttgctcccatcattcttgtcgaaccggcagctaaatgtgtagaccctgacttgggggcattgttgcaacatccggattatgaaagaggggtttatacaatgcctaatatgactactctggaatcggtgaattgttatgcggcggcatttgattttctggcgaaaagatattgtacggcggacaatcgctacgggcgtatagctcattggattatgcataatgaggtagacggctgtatagactggacaaatatgggagtaaaacctcttactgtatttacggacacctatataaaatcaatgcgtatatgttataatatagtacgccaatatgataagcaggcagaggttttgggctcctttacacattcctggacacagatagcgaatgtgggatggtggctctatacaagcaaggaaatcattgatttgttgaatgtttatagtcgggtagaaggggactttcagtggggattagcttatcatagctattctcaggatttgacgaatccatgtgtttggattgatccgaacgcaacgttttccatggatacccaatttattacgtttaagaatctggaagttctgagtaagtgggcgcttaccaaagaaaataaatataaagggactattaagcgctctgtctggctttctgaggctggagtaaattctcctacttattcggatgaagattttcagaagcaagcggctagtttggctttcgcctggaagaaaatcaatgcattggaagggattgatgggctacaatggcataattggtttgatcatccgggagacggagcttgcttcggattgcgtaaatacttggatgaatcttacagaggggaagccaaacctgtgtgggaagtttatcgaaaagcaggcacaaatgaagaagatgaatacttcgaacaattcttacctttaattggaattcctgattggaatattattgagaatttttaatcaacgacattattaactaaaactgaaattatggaaaatttgaaagttttctttacgagaaggcctgaacgcctgctagggcgatgtggcatgttgtttttaatggcattttttgtgatgaacttgtcttcctgtaatgatgactttattgaagatgatgggggagaagttattcctcctgaggatattgttatcccgcctgtttatatgttattggatgggccctataagtcgggagtaacgttaactcagaatgaagacagtagttatacgatagaaactactaatggtgatccttgggcgactgccggtttgtttaaagaagatgttcccgaagaatgtaatgttcttgaatttgaatatcagacggaaatggggatgagtaaccttgaactcttttttgctgatgcaaaaaatgggattgatgctactcatagcatgagtgcgggaaccgttcctgcttctacggaatgggcttcattcagcgttcgtctaaagaaatatagacaggagtttgattggggaaaagtgaaagattttctgcgtctggattttggagaccagcctaataatatcatacaaatgcgtaatatacgcctacgtatgatgaatgatgaggaaaaacaggcggaagaggacgagaataatgaagcacttaataaagagaagtacgaacaaggaattaaagattatctgaataaagaatatgattgccatgtaactgatgtggtggtaggagagagtacgatcagtattcaaggtaactatacgggagaaggtactttcttcttgggagagattccaccatttgtggatatgttcaaagtggaaaaggtggaaaataaaacacctttatcaaacggctcttttaacgttcagttggatagatatgttactataggtgactataagtatgatcgtttattgtctaagtgggctatatacaaagaaggagcttccaaggatgagattgtttctcatgcccgctatgcgaacgtggataaaatacacgtaaaacaaagtgttgaggctattcctttaaaatctaagaaggggttgggaggattgataaaccatggattccttgcatctgatttggatgatttgggtattgccagtgccaccatcaacattcctatttctcatttcatgcatctttctcaacaggaaggagatattccgcatacttacggtggcaggacatattattttaatgagggatatatgaagagttcatttgatgctgtgttggagcaaacgagtaaacgtggaatctctgtagcaggtattttgctggttcctcctaccggagatgccggtactcttttgaaacatccggattttaatggtatagctccttatacaatgcccaatatgaccacaatagagtctacaaattgttacgctgcagcacttgacttcctggcagaaagatatagtgaccctaatatgcgcatagcgcactggattatacataacgaagtggatggaggaagtcattggaccaatatgggtgacaaaccgattgccacgtttatggatacttatctccgttcgatgcgtatgtgctataatattgcgcatcaatatgaccagcactcagaagtctttatctctttctcgcatggatggaatatcgctgccggtggcggttggtataaagtaagagatatgctcgactttatgaatcagttcagtgaaagcgaaggtgatttcttctggtcattggcgtgtcatagttacccggctcagttaggtaacccgtgtacttgggatgatgaacaggcaacttattctatggatacggaatatgtgaccttgaaaaatttggaagtgttggataagtgggtgaaaacatcccgaaatcaatataaaggaactatcagacgttctgtatggctttctgaagcgggcacatgttcgccatcttatgaagatgatgatttgcaggatcaggctgccggatttgcttatggttggaagaagattaacaatttggacggtattaatggcatacaatggcatagttggtttgaccatttgggagatggtgcttgtttgggattgcgtaagtatgccgatgcacctcataatggtgaagccaagcctgtatggacaacctatcaaaaagcggatacagatgaagaagatgattattttgaacagtatttatctcgaatagggattgatagttgggaaggaattattcaagatattccataagcgatattaggtaaaagaggaagctcatttgtgcttcctctttgggtgttgtgattatatctaagtctgctataaaagaatttttttagtctcacggtctcactacttttgcataatcacctaataactaggatattatagaatgagagatactttttacagaggtatctctcattcttttctcactggaattaccctattttaccctatctctcattctattttacaactatttcccataatgtcctggacacggcacataaatcggttgcgtacgaattccgatattctgcaaagaaccttcttctttcaacctgcgaatatggcgcgccgccatactgtgtgtgaattggcaaagtgactgcatatcagagcgggtcaaaaccgtatgcgtagcgaagtacccggttaattttttgtctatttcttcctgggagagggtagccgagtggggtttatactttgagcgttgtgcatgcatacctataagctcaccttttaaatctctgtccgccaagaaactgaccgatttaaacttcactttgtcagcgtgtgcggccatggaatgtatcggctctgttgcttgtaatgtgatctgaaaatagccgaccccgtcaagatgtactctttgcccttcgcgtaagtggttgcccatgcaccgactgagttccattaacattgcttccacttcggccttgccaaaggtagttgccgagtgaatttcgactgccagtctttgggtagtcacgtgttgaaaattcacgactctgggatgataacttgtttccccctcttcttctccctgaacgggattcttataaaattcgaattgtactgccatcttaattgttgtttatctgttgtttatatatggtgttacttatctcttcggcatttaaagcctttatctgcgtgtcatcttactgacatcttcatcgttctacccgggtgaaccgatcattgcaccttcgagaacgtatctgtgtacctgggtgaacaggtcggttcacccgggtagtatgatgaataacgtccttcaaagatacgacaataatagttgtaaaacaagcaattataggattgtttgcatgataatgaatggtaaaatatatgcgccttaaagtacttctaaaaggagaaatgtataggtctgaaattaaataatggaagttggaaagcagaatgagagataaacaaaagaaggtgagagacaggttagaatagagtaatttcagtgagggaatgatgagagatacctctgtaaaaagtatctctcatcctataatatat

SEQ ID NO: 251 - DNA, 8061 bp, Bacteroides thetaiotaomicron
gtattaggtattaagtattaggtattaagccatgcggataagctcataaacagcaacttcggttaatacttaatacctaatacttaatacttattttttcttcattcctttatagaccaggaagcctacgatgaatattccgatggcgatgaagcaatagccgatttcgtggctgtattctgtaactttggcgatcagttgttcttcgctttcgataccgggcactgttgacaggtaataaccgataacagccaggatggtattccataatccggctcctatagtagtgtagagcaggaaggtgtgcattttcatgcgggcaagtcctgccggtatggaaatcagctgacgtactgccggaatcaatcgaccgatgaatgtggagagtgcgccatgcttgtcgaaatacgattcggcatgctgtacttttgcttcgtcaatcagacacatatggccgatacggctgttggcaaacttataaatgatggggcgtcccagccattttgccagataatagttgattaatgctccgatatctgcaccgatggtggcaaacaagactaccagataaatattaagctcgtcattgacagccgccttgtaagcagccggcgggatgatcacttccgacgggaaggggatgaaggagctttctatagtcattaataaagtgattgtccaataattcaggtgttccagacaccactggataaaagctactgattccatgtgtttttgggctaaagtttattaatatgattagttgtttcctttctctttcttcatgcgttcccatacttctctcagcatctgttctccttcttccgtttggttggggcgggataacagctccagaatgatatcttcgctgatgggatgctcactttcattgttgtacttgaagaagtcgtctatttcattatgcatcaggctgaggacactcagtttctctgcgatgtccgcatagttgggatcaatccggtatgcctcctgaaaacagagcttggcctgatataagtactctgcgtccgaataggccgaggctaccatataccacatttccgcacttggttccattgtcagtgctttatcaaaagatttgaccgcttttttcttttgattttcctgtatgtagagtttgccttctgccagatagatggcaggatcatccggttggatggctatggcttttttgcacagctgatgcgcttcctcgtacttgcccagtcgggaggcggctacggctttattggtataagtatctatcaataagggagaattgccgagaccctcttctataaagcggtcgatgacacgttggtagtaatcgtcggcttctttccatgcttctttgttggaatatgtaagccccagaaacatataacccatttcgggaggaagagctttgtactttattgcctttttataatcttcaatggcggcatctgagttgttcaggtagaaatagctatgtccgcgataggcgtaagcttctccacatttgtcgtcggcagccagtgcaaagtcgcaggcttcgattgctttttcacagtcttcggctgcaaagcggcatttggcaagtcctacccagtagctggcgttgtaggggtcgatgtcaatcagttgattgtagaaagttgatgcggcttcgagctggttggtacctgtgaggtagtccgccataaccgccatgaaatcttcttttttgccatgacggggagcacccttgtccagccattctttggcggcttcggggtatcccatatccatataaagatagacgatgttgatgatcgtttccagttcatcagcatcttctatagtatccagtacatttcgggcgttttccagttgcccttcgttcagcataagttccgctttcagcattttcacatctgtgtcatattcgtctgtaatactttccaccactttttttgccagaggaattttgccggtatccagataaagataagcttgttctaccagtagatctgtactgtcgggatgcaggtggaggccgtaagttatgacttcttgcgcttcgttgaatttacgttcggcggcatattggtcagcaatgtcggctaattggtctccgtccaggtagagttgccggttttccgctctggccgtttcatattgagcgattaactcgttcagttctttatttgcggacggtgaattttttctccccattctgatttattttgatttgaataagacagtgctaaaagaggttttaggcacggattacacagatttcacggaactgaaagttgatgtaacttagaaccgtgttaatccgtgtaatccgtgcctgaaaatatcagtaagctatttttcggcttttggcactgtgtctttttgttgttaccaagcctgtgaaggctgaattatttattgattttaccccaggtatcttttaatcctaccgtacggttgaatacaagtttctccggagtcgagtctttgtctatattaaaatagccgatgcgttggaattgcaggtatgagagtacaggcaaggttgccgcaaacttctcgatatagcaattcggaagaactttcagagaatccggattgatgatttccttcattgcttccagagcttcgcatttctttgcttcgcggatagcagccagttcgtcgcgtgggttttctactttccacagacggtcgtagaggcgcacttctgcttgcagacagtggttgcagcttacccagtggagtgtacctttcactttacggttggcatccggcatgccgctgcgggtatttgcatcatattcgcaatatacttctgtgatcacaccgttttcatccttcttgcatccggtacatttcacgatgtaagcgtttttgaggcgtacttcctgtcccggagtcatgcggaaatatttcttgggcgcgtcttccatgaagtcttcgcgttccatccataattcgcggctgaactcaatcatatggcttccggcttccggatcttccggattgttgatggcttccagttgttctacttgtccttccggatagttggtgatgatgagtttcaccgggttgatgacagcggatatacgggtagcacggctgttcagatcgtcgcggacagagctttccagcaatgcgatatcgttcagtgcgtcgtaagtggtgtaaccgatcttatcgataaatttatggatagattccggagagtaaccacgacggcggaaaccgcagatagtcggcatacggggatcgtcccatccgttcaccagtccttcttttaccagtgtcagcaggttacgtttgctcatcagcgtgtagctcaggttcagtttgttgaactcagtctgacggggacggttgtcgttcaggtccttaccttctttcagccagtcgatgaagaggtcgtagagcggacggtgcaccacaaattcaagtgtacacagagagtgagttactccttcgaagaagtcactctgtccgtgggcgaagtcatacatcggataagccttccaggtagtgcctgtacggtggtgcggatgttttacgacacgatagatgatcgggtcgcggaagtgcatgttaggattggacatgtcgattttggcacggagtaccatagcaccttcttctatttcaccgctgttcatcttcttgaaaagttccagactttcttcgatagggcggtcgcggtaagggctgttcacacctgcctgggtgggagtacctttttgttgggcaatctgttcggcagtttgctcgtcaatatatgcttttccttcctcgatgaggcggatggcgaagtcccataattgctggaaatagtcggaagcgtagtattcgtttccccattggtagcccagccattgaatatcttctttgatggcttctacatattccacatcctctttggtcggatttgtgtcgtcgaaacgaaggttacatacgccgccatgcttggcagcgatgccgaagtcaaggcaaatagctttggcatgaccgatgtgaaggtatccgttcggttcgggcgggaagcgggtctgcacttttccaccatttttaccttccttcaaatccttctctactgcctgttcaataaagttcaggcttttcttatcgcctgtgtcttcgtttttaatatctgtcataacgttaaaatgttaactctatttataggctacaaaagtaggacattttttttattttactggaatataaccgctcttttttataatctcctgcccttcgggtgaaagaatgaagtcaatcagaggagctacctgttctttattcttcacattatagtagtaataaagggggcggacgatgggataagttttgttcgttgcgttctccaccgtcggggcggcatagtggcttccgtcatatgatacggaaagcgtcttggtgcgcggagatacgtatgccaggccgacatatccgatagctcctttcgtctggctgacggattggatgatggcacctgtggcgggcatggaaaggctgcctgccatataatttttatttttcagcacgttttccttgaagaactcataagtacccgaagaggtttcgcgggagtagacaactattttgcggtcgtcgccgcctacctgtttccagttggtgatttttccccggaagatgtcttccagttgctggcgggtgagctgtttcaccggattggaaggatgcaccactacggcaagggcatcgtaggctacgatgacttcgtccacctcttgtccggcttccttggttttcatcttttcgctgaatttgattggacgggaagccatggcgatatccgtcgtattgtccatcagtgcagagataccgacaccggttcctccgccggtgactgtgacccgtgcatccggctgcagattcataaatcgctctgctgtttgttgggcaacaggcaatacagtgtcgctgcctttgatgcgctgtgcgttggcgctgagagacagaagggaaagggcgattaataaatttcttctcactttcataattattctttttattgttggtgcaaataaaacaatcacatattacatttttgtttcagataagcgggaaataatgtttgtaacacaaatgtaacatcattgaaatacttccttcaaacgttagtcacacctccttaataaggagtcgctttctttgcatcagaaaaccaataggtatgaagaagatttttgagaagataatagaaggaattttgacttgtagcggtttcgtaacaagtattactatcctgctgatcgtacttttcctgtttacagaggctttcgggctgttcaatagtaaagtgattgaagaagggtatgtgttggctttgaacaaaagtaatcgggtaaatacgctgagtcctgctcagataaaggatgttttcgacgaggagataacaaactggaaagaactcggtggggaggatctccccatccgggtttttcgtttggaagacatcacggagtattatacagaggaagaactcggacccgcttatgagtatgccggtgaaagaatcatgcaactggtggagaagacgcccggcattgtagcttttgtcccgcagaaatttatagtgcagcctgatacggtgcattttatcaaggacaatactatttcggtaaaagatgtctttgcaggtgccgagtggttcccgacagctactcctgctccattattcggatttctgccgttgattgcgggtaccttatgggtaagtctgttcgctatcctctttgcgcttccgttcggactttcggtatctatctatatgtctgaggtcgccaatccgaaggtgcgcaactggctgaaaccgatcattgaactgttgagtggtattccttcggtggtttacggctttttcggtttgattgtcgttgtccccctgattcagaaattctttgatctgccggtaggggagagcggtttggcaggaagtatcattctggctatcatggcgctgcctactattataacagttaccgaagatgctatgcggaactgtccgcgttcgatgcgggaagcgagtctggctttgggagcttcgcagtggcagactatatataaggtagtgattccctattcgatctccggaattacttccggcgtagtgctgggcatcgggcgggctatcggagagacgatggcagtgctgatggtgacgggtaatgccgcagtgataccgacaacgattctcgaaccgctccggaccattccggcaacgattgcagcggaactgggagaagctccggcaggcggaccacattacgaagcgttgttcctgttgggcgtcgtactgttctttattacattaatcatcaactttagcgtggagtatatctcttctaaaggaataaaacgtagcaagtaacatggaaatacgaagtaataataaagcgaaacaccgttcgcagaaactggcattcggaattttccggttgttgagtctctgtattgtgctgattttgtttgcgatcctcggtttcattatatataaaggtgcgggggctgtcagttgggagtttatcacgtccgctcctacggatgggatgaccggcggaggcatctggccggctatcgtcggtaccttttatctgatggcaggcagtgcgcttttcgctttcccggtgggagtgatgagtggcatctacatgaatgagtatgcaccgaaagggaagctggtacgctttatccgggtgatgacgaataacctgagcggaattccttctatcgttttcggtctgttcggtatggctctgtttgtcaattacatgggattcggtgacagtattctggctggttctttgacattaggtttactttgcgtacctttggttatccgtactacggaggaggcgttgaaagcaattcccgacagcatgcgtgaaggaagccgggcattgggagctaccaggttacagacgatctggcatgtgattcttccgatggggatgccgaacatcattacaggattaattctggctttgggacgtgtttcgggtgagacggcaccgattctgtttacttgtgccgcttacttcctgccgcaattacctgcaagcattctggatcagtgtatggcattgccgtatcacctgtatgtgatttctaccagcggaacggatatggaagcacagttaccgttggcttatggtaccgctttggtgctgatagtgattatccttctggttaatctgctggcaaatgcattgagaaaatattttgaaaaaagagtaaaaacgaattgattagtatatggatacagtaaaaatagatacgcgcgatgtaaacttctggtatggtgactttcatgccttgaaggggatcagcatgcagattgaagaaaagtctgtagttgcctttatcggaccgtcgggatgtggtaaatcgactttcctccgtcttttcaaccggatgaacgacttgattcctgctactcgcttggaaggggagatccggattgacggacataatatttatgccaaaggagtggaagtggatgaacttcgaaagaatgtgggaatggtttttcagcgtcctaatcctttcccgaaaagtatattcgagaatgtagcttatgggctccgtgtcaatggggtgaaagataatgctttcattcgtcagcgggtagaggagacactgaaaggggctgcgctttgggatgaggtcaaagataagttgaaggaatctgcttatgctttgtccggtggacagcagcagcgtctttgcattgcccgtgcaatggcggtatctccttcggtattgctgatggacgaaccagcttctgcactcgatcctatttctacggctaaagtagaggaattgattcatgaactgaagaaggattataccattgtaatcgtgacgcataatatgcagcaggccgcccgtgtcagcgacaaaacggctttcttttatctgggagagatggtggaatatgatgatacgaagaagatattcaccaatccggaaaaagaggctactcagaattatataaccggtcgtttcggttaagtattgccggagtgtttgcagaaaacagaatattaatcatttatatat

SEQ ID NO: 252 - DNA, 7970 bp, Bacteroides thetaiotaomicron
gattactatagagatttttttttagggtttggtaatttcccctattaaacaagagttcattttgtatcggatgtctttattagatagtccgtgtcccagcaaaaacatcagtttagttacagcacattcgggagtactgtcatatccactgataacacctgcttcgagtagatgcattccggtctcgtaacgtcccatttctactgctccggaagcacattgtgtgatgttaacaatgataattccacgatcagtagcctcttttaattcccggatgaaccattctttttgcggtgcatttcctgatccgaatgttttcatgacgaccgctttcaatccggggacatggagtagtgaatgaatgatctcctcctggatgccggggaaaagagttaatattaccacattcgtatcaaacagatagtgtggctttagtggtttgtccgggtccggtttgcgaataaggttgggctcgtatttaatatggatgcctacgcgtgccaatggcgggtaattgaaagaccggaaggcattaaagttctcagcattgatttttgtggtacgattaccccgcatcaagtgattttcaaagaaaatacatacttcggggacaatagctgtaccgtccggattcttggcagcagcaatctcgattgcagtgatcagattttcttttccgtccgtacgcagcgttccgattggcaattgagaaccggtcagaataacaggcttactcagattttcgagcataaaacttagggcagaagccgtataggccattgtatccgttccatgcaaaattacaaagccatcgaaatagtcgtaattatagttgatgatctttacaagttttgcccagtaagctggttccatatccgaggagtcgagaggaggatcgaattgataggaggaaatgcgatagttgaatcttttcagctcaggaacgtgcttgagcaaatggtcgaaattaaagttttctaaggcacctgtctccggattttctatcattccgatagttccacccgtgtaaattaacaaaacggaaggggtctctactctcataattgatgaatttctgttaaaacgctgacaaagatatagattaattgcgaattatgaatagtaaatgatgaatttgttcgtagtttgcagtgaaatgttataaatctgaatatttatgcgtaattatacgatggattaaaagaaaaaatcaagtgagttgtaaaaatagtcaagtagctaaaattgtttggaaagaatggttatgcaaagcaaaacgatactgcccggctattttagctaccatttgtctgactatttcttatgtctatttaagcgcatctttcagttttagaatggctttttccggatctttttcttcttcaagcagagtgacaaagcggctaccgatgatagctccggaagcatgttcgcaagctgcttgaaaagtagctttgttggagataccgaaaccaaccattagcgggttgcgcagattcatatcttcgatctttttgaaataggcacgtttctgttcattaaagtcttgttgtgcgcctgtagttgctgcggatgaaaccatatagatgaatccgtctgtatgtgcatcgatctcacgtacccgctcttcgctggtctccggggtgatgagcatgattactttgattccataacgttcggcaatgatacggtagtgatcctgataatctctgaaaggcaagtcggggatgataacgccgtctattccgcattccacgcatttgcggcagaagttttcaaatccgaactgcataatagggtttaagtatcccataaataccaatggaatacttacttcctggcgaatgtttcgtaattgttcgaaaaggattttcaatgacattccgttgcgtaatgcctgagtggcggcattctggataacgatgccgtctgccatagggtcactgaatggaataccgacttcaatcatgctgacgccatgtttttcgagagtacggatgacattgactgttccatcaagggtaggattacctgcacaaaaataaatagaaaggatgtctttcttgttgctattaaagagttgattaattctgttcatgattttgagaatttaattttatgactttagttcatttagaaatatccggattcgttccggatctttttccccgggcttcagttcgaaacgactgttcaggtcgtagcctgccagacggggatggtcgaatgctttcaatgcattggcactgtgtgagttgatgccgccactcaataagaatggaacttgtccgttgtaggtatgcagaatgttccagtcgaattggtttcctgagccaccatactgctcacatttcgtatcaaacaggaaaagattgcaagttttttcatactcgcttacgtgattcaaatctttcggacgagctacagaaaaagctttgatgattttcaggccggaggtgcgcaatgactgacagtattccggtgattctttgccgtggagctggatatattccagtccaaaacggtcggcgtacatcgtgattacatctttgtcttcatttacaaaaactccgacacggcgggcatgaacaggtaggtaagcgggaagttcgtagatataacggggagatttgggatagaagataaatcccatcatatccactctttgtagtgactccacatcccgtatattttgggcttcacgcataccgcatactttgatgatttttccgttgatcatagggctgtccgtttttggaagttcatatatttattggatggctttcagaaagttctgcagagtttctcccggttgcggagttttcataaatgtctctccgatgaggaatccccggaatccggcggtccgaagacgttttaccacttccggatcggaaatgccactctctgatactaataccgcatcttgtggaagttgtcctgccagtcggaaagagttttctacatctgtgaagaaagtacccagattgcgattattaatcccaatcatatcaattttgctattaatataaggtaactcttccgcactatggatttcaagtaatacttccagtcccagttcatgcgcctgctctgccagttcctgacatttttcctgtttcagtgcggcggcgataagaagtacggcatccgcaccgacaatttttgcctgatataactgatactcatcaatgataaagtcttttcttataatgggcacatcgaccaaaggacgtgctgtacgaatatctttcagacttcctccaaaaaacttctcatcagtgagaatagagagggcggaagcacctgccgcaaggtatgacggaacaatttcttcgggacgtgcctcctgtttgatccaccctttggatggcgagcgacgcttaaattcggctataataccggaatcggaagaagccaatgcccgtttcatagaacgggaagccggaacttcattgataccttcctgcaactgttcgatggaaatagcctgcttttgcaaatcgacttcaaaccgtttgttagctataatttcggataatatatctttcattaatcttaaatttagaatcaaggcaaaggatatcgcatattcatcctttaccacttatcatttataacttattacctattacttattattcaattcaatgaatttcttcagtgtagccaatgcccggccactttctagtgattctttagcgagggcgatgcactcttcaatcgttttttccggacgaactacttgaatagcgaaagctgcattgataacaaccacgtttttctgtgcttccgtagctgtattgttcatgatgttatcaaagattttagcagcatcttccggtgtctgtccaccatccagatcagtatcctgataacgtgcaaatccgagaccttccggagtataaatcttctcattgccacaggtagctaccttaaactcgttcgtcagagaaatctcatcatatccgtccaggctatgtacaacggcaaatttagtcttactctcctgataagtataggtataaaggcgcaaaagtggaagattatacacgcctaaaagctgataagtcggcaacaccggattgaccaacggaccgagcatattaaagaatgtacgtaccgccaatcctttacggatcggggcaactgccttcagtgccggattgaacaaaggagcgtgcagataagcaatattacattgttccatgctgcgccgcatctgatcaacatcacttgtgaatttaaccccatgttgctccatcacattgctggcaccgctgactgaagtagctccataattgccatgttttactaccggaatacctgctccggctactgtaaagcaggccgccgtagaaatgttgaacgtattttttccatctcctcccgtaccgacaatatcgatcggagcaaactcgctcaaatcaaccggaacccgcatttccaataatgcatcacggaatccgcataattcttcgacagaaatattacgcatcagaaagacagtaatcagtgatgctacctgtacgtcattatatttcccttgtgcgatgttttgcaggatagtacgtgcttcatcgcgtcccaaatattggtgttcgaaaagtttatatagaatctgtttcataagtttattcgtttaagaagtttttgatgatttcttttccttgcggagtcagtacggattcgggatggaactggatgccatgtacatcataggttttgtgacgtaatgccatgatttgtccttcctgactttcagcagttatctccaggcactcgggaaaaccttcccggctgactacccaggaatgataacgtccgacaggtatctctttgcccagcccttcaaaaagtacgtctttctgcaggatgctgatcggtgtctgtacaccgtgatatacttctttcaggttttccagtcgtgcaccaaaagcctcgccgatggcctgatgtcccagacaaacgcctaaaatactctttgtcggtgcatatcgtttgataatgggcaatagcaagcctgcttcttcgggtattcccggccccggtgaaagtatgatcttatcaaatcgttccacttcatcaaggtttatctggtcgttgcggactacttcgacgtctgtagctcccagttctttcactgcatgcagcaaattgtaggtgaaagaatcatagttatctaaaagtaatattttcattttattgttattgtaaaattgttgttcaaatactgtttctgacttatcaggcagatcgctctgaacagttagttttttaaattaacagctaaatcgatagcctttttaagagctcctaatttattgtttacctcttgcaactcgtattcatcctgactgcgtgcaacgataccgcctccggcctggaaccataactcgttattacggctgacaaaagtacggatggtgattgcctggttcagttctccgttaagtccgataaagccgatacagccgccataagcaccgcggttatgaggttcgatttcactgatcagctgcatggcgcgtactttcggtgctccgctcaacgttcccgcagggaaagtatcgatgaaagttttaatcttatccgccccttcattcagctgaccgctcacgcggctgaccagatgaatcacatgactgtaatactgtggttccttataaaacaatacccgtacatcatggcaattacgtgaaagatcatttcttgccagatcaaccagcatcacatgctccgcgttctctttcggatcggcaagcagtgcttccgccaattcgcggtcttttaccgtatctccggtacggcgggttgttccggcaatcgggtcgatgtaggcacgtccgtcttcaattttacagtgagtctccggagaagaaccgaaaatgcggtatcctccgaaatcgaaatagaaaagataaggagaagggttgatgctgcgaagagcacgatagactttgaaatcatctccggcataaggctggatgaatcttctggaaaggacaatctgaaaaacatcaccacgcatacaatgggcaatacccttgcgaacgttcgctttatgctcctcatcggagatcgggctgctgacaggacctgtcaccgagaaattataagaagcataatttctgttttcgatagcggcctccagttccggcaaaccgctttcttcaccttcgcccagcatttctaccaatgtcaattcattcttgaaatgattgaaaacgatgatatacttatataatatgtatagcaagtccggagcatcattctgctcatcatgactttctttcaccgggatatgttcgaagtatttcactgcgttgaatgtggtgtatccgtaaagtccgcacacattcttgttttctccggtcacttgaaactgactgatgaattgattcatcgctttttctaccgtgaatgattgggtgagcggctcttccttccgacttttgtcaggataactagcagtgactattccgctattgacaccgatacttgccagcggacaaagagcgatgaacgagagggaattttctcctgcatgataatcggaactctccatcaatgcagattgtgggtacatatcacgtactttcagatagatactgacaggagtgtgcatatctccgagtacctgtttgctatgggctgtataactgaatgttttcatttttataatttctaaattcaaactacaaaactagatgttgataatcacttttcattgaaagacaaataagtttcaatgtctttgtcgccacgtcccgatacggtcagtacaaccacatcttccggtttgaacttcaattttttcagcgcacccagtgcgtgggcagattccagtgcgggaatgattccttcaagtttggtcagttcataagcggcttctattgcttcgtcatcattgacagccaatacggtagcccgtctttgagcggcaagattggcgtgtatcggtccgattcccggatagtccagtccggcggagatagagtagggttcttcaatctgtccgtcttcgttctggataacgtaagtacgggctccatggataatgcccattttcccaagctgtatagtggcggcggtcattccggtttctattccttttcctcctgcttctgccagaatgatgcctacccgtccgtcattgatataatgataaatcgttccggcggcattgcttcctccacctacacaggctatcagataatcagggtgatcacgtccttctttctccataagttgttttttgatttcttcgctgattacggattgcaggcgtgccaccatgtcgggataaggatggggacctactgttgagccgatgatataataagtgtcggcaggatgacagcaccagtcgcggattgcttcgttggtcgcatctttcagtgtcatgttaccggaagtgactgggattacggtagctcccagcatcttcattttttcgacattgatgtgctggcgctcaacgtccgttttacccatatagacaatacattccatatccatcaaagcacatacggtagccgttgcaacgccgtgttgtccggctccggtttcagcgataatacgtttctttcccatgcggcgtgccagcaaaatctgtccgatagtattattgattttgtgggcacctgtatggttcaggtcttcccgtttcagatacattttgcaaccatacttttctgaaagtctgcgggcgagatagagtggggaagggcggcctacgtagtcacgcagcaactggtcaaactcctttttgaaatcttcgctttcgagcactccgaggtacgtattcttcagttcctctacacatttgtggagaatttccggaacataagcgccgccgaactctccgtagtaaccatcctgatcaactaaaaaacttttcataatcctatttttatttattattatttattcgattttcaaaaacgggcaaataaaaagagccctgt

SEQ ID NO: 253 - DNA, 7950 bp, Bacteroides thetaiotaomicron
ataaaagaaaatcgggtacagttgcaccacctatttaaataaattctatttcaattttaaaagaaatagataaatatatagtaaaagatttgattatagtaaaccctggaaatttataatacaaacttccagggtttatttttataagaataacatttgatgaatagcttaataaaatggagaactttattcagctacactccacaatcttactgacttaaattctatatttctacagatatctgagaaagatactacccagcctacggtaatagttttttcttctgttagttcaaatataggtaaggcagatgttttattagtatgttctgactcaaatttgaggtaagagaggataatgtctgacttttccaattcttcattgtcgggtagtgattcgccttgagctacagcaaaatggatattggtactgccagaacctatatttgcggcgttttttacttcgatacgcatttcatactttccttctggtaaagtaaatgtttgccagatctttccgttgtcataatatccctgactccattgtgttgtttcgaactgaattgttccatcgttatattctgtgaagccggcacctccattggcatttttagtttccataacttcattccatttccaatcgtaaggttttccccatttattgtttacatcatatcctctaaatggatatccggcattcttaatataaagactggttaggtcttttgtaatgccaatgtaactttgggaaggcaatgtaacttctttatattctgtaacaaattcgtccaaggaagttgttgtcggtttatatatactattgtaccggagtattccattagctttaaaattgtcgagttctgttgtagtctcgtcaactgaaatatatttcgagcctaaagttccgtcctgacgttcatattcaaggttacagcctactaaaccatctcctcttgatatattccaattcagtttggctgcccatattctttctgattgtccactttcatttacaatttctttttgttcaggagagatactatgtaaaatccggttggttaatgcttgttggtatagttcgccatatgcataagcagatacctctgtcgggatagatgtgttgtttttgggatcataggtgactatcgagaagtcatattgtccttctgttaaattctctaacataaattcgaaggtttctcgtggttccgtacgttctattggaaactctttaaacttttcttccaatgtaataggatctttgtaactgataacacattttacctgatttacaccgtacatcatttttccttctattttgattctgttttttccagtaaaagctttgagtgaatcaagttttcctacatagattttttctccctcgtctagataaggctgaatgccatccagcatgccattacatgaatagaaaaagcacaggatactacagagaatcaatatatttatttttttcatacttttgctttgttaaaaggttattgtatcggggttccgtagaaccaaagttgctgcataactaccaatccggcaccgtcatgagtagaaagtattttaaatcgaatgtatcttactggaggaatatctgctagaaattcaaattcttctcctttactagcatatgttatatcttcttctgaatttgaaccggtgggccatccggaaggttttatgctttcacaatctgccagtttggtccatccgtcccaacttccgtccgaagatggtaaatcagaacgtccccatacttcccattctttgatagcacctgcacgatagtaataactacctcccatggagcgttgccatgaggtgaagcggcttaattgagcggtttgacccatatcgaatgtaaaccatacaggaaactcggaaggattaaagtcataaccgtgagcataattccaactgtttaatccatgatctccattgaataaagactccaaagtatgacctgcgttgtccatctttatatcattggctagatagaaagttttgaatttggtcaaatccaatttttcttcatatagtggtgtcaaggttgttaagtattcttctgactggttatcatatagatcgcggacacgaactttaaaatcatgtggttcggcagagaaccctcggagtgtaaagccgatgttttttacagaagtatattctgtatgttctatattccaattaccttttgaatcttttgtagatacatcaaagatgagatagtttctgcctccatttgtagtatgtatataaatacctccgaatgtaggatttacctctatttcttcaatggcagtaaggtatgccggttttccaggtactatttcggtgatgatagcttctccttctttctccattttgttaacggctgagattactagttttttcggattcgtatttccgaaaccttctattgtcgtttcatcagtatagagagaagcacgtgcttccatttcttttccattgtcaagtgtatattttattttgatatacaatagatcttcgtctgttggagcaatgaatttcaatgtcactccaccaggaatttgttcataggaagtcacttgtactgtaccaggagcatgtccactgccatccccataaggtttatgagtttctacatcttcgcaactgtgtagcaatactgccgcacatgctatccatatataatataagattctttttttcattgtttttcgatgtttataattaccatccatacgtttgaattaatttgtcgtctacttgtaagtcttgtttttttataggccacaaatagtctttagttgtaaatgcgcgaggaacaaagagagttgtgactttataaaagtcttcctctatttctccttgtacgttccatcctttaatggatttactcagttcttttgaagcgtctttccatcgtctgagatcattgtattgatgtccttccaacgcaagttcaattttacgttcctgtttgatgatacttctcatcccatctttagttttaggtttggtaggatcattgctgtacttttcccatgctactctgacatctcctatatcttcggtctgtccaagtacaccttttttcaatccagaacgttcgcgtaccttccgtaggtatgtataaacttcttccggtacattattatcaccttctgtagcttcattaagtgattctgcatacattagatacaagtcgcctaatctgataatagggaatgggtattcgtagactacttgtgaagattgagttatagcattttgataatatactacttttttagcgaaataacctgtaatggagtagttaaatccccatttgtttccagagtttcttccatatttaccatctacataattcaagtcattgacatctgtacgtccgttaccataccaagtggaaccatcgaaaccgagagacccgtagaagcggggttctctgttgaagtgaagtacggcagtggtccagcctgttcgcatgttatatttatcagcactagtcacttgtcgggttgtgtaacgattatcatattttccgcttgttaaccattctttgtcttcgtcaatgggcactccatttttactgtaaaattgttctgcagtttccagtgtaggagcatatacacctgctgccctgctttgcaaaatactgcctgttacttgaccgtttccacttccttgttgcaaagaaggaacgatacaagccatcgataggttttgcagttcattggtaccctgtttgcctacgctccatatcaattcggagttaaaacgttctgttactgtttgacggatattcatgctgtaaaatatttcttctggtaggtcctggctataagacatgtccatgctgcagtcataaagttgacatccgttggtttctgcagattctatggcctctttacatgcttcagctgttctcacccatttttcacggctgaattcttggttgatgaatggttttccttcttcatttctgaaatttgcataatctttgtttccattgaagagaggactagctgcccacagcagtattttggctttaagggctaatgctgcaggttgtgtcaaacgtcccatttctgtagcttccatagtgatgactggtggcaagtctttgtacgagtcgtctatgagctttaccatgtaatcaactatttgatctaccggcatgcgagtaacttttactccttctggatcagtcgatacaggaagagctttgtctacaataggaatagggccatagtgttcaaataggaaaaaatggtaataggcttttagtacgtttacttcggcgatccatctttttcgttcagaatctgtcaagtcgttcactttatgctgatctcttacataatcaagaaagatattacactctctaatggcacggaacatgggaagattactgcctccttctccgtcccaataattggcataaggagcatcaatattctgtaatccacgggctatataaaagctgacttcattgtcaaagtgagagtcattagtagtatagaaccaacattcgtgtccggctcccatgccgggaattcgtttgacagatccatggtctggaacaaaatggtagcagttggccaaatagcgttcggctgtatttctgttgttgaatacaatgtccaatgttgtcacattatcgggaactatatccaaataatctgaacaagaacaaagcaacgtcaaaatgatagtcggaatatatttcgtaatttttttcatatcattgctttttagaagttaatgttaatgccgaggttatatactcgctgaataggatatcctaggccattattacccatttctgcatcccatagtttaaatttgctgaaggttagtaggttacttcctgttaagtataggcgcaaagattgtacacctatttttttcagagctttttgcgagaatgtataacctaattctacagttttcagacgaataaatgatccgtcatgcatccaccaggtacttgtttgcatattattttcaacaagtgtaggagataaacgtggccaaaatgcgtatatattacgattgtcttcagaccaatgatctttggctataacatccaaacattgttgaacacccgtctttccacctgcatcgtagtttacaaaaggagatgtgtttctagggtcgatgaaaaaagatactcttgcatttccttgaaaaaacatagagaggtcgaatcctttgtagccggtagagaaaccaaatccgtaagtaatttcaggttgattaggataaccgagaaaaatttggtcttcactagtaatttttccatcattatttaaatctttatatttaatatctcccggcatggctccaccattgaaacttgtttgtgagggagagttggcaacatcattttcatcaataaataggcgttcggcgatatatccgtaattaaagttgattggttgccctattctagaacgatacccttgtccgtaactagcataatctggttcttcatagacttcataccttcctttggcaagcgtgaaattacccattccttttatccagaaatctttattggcaatataagaatagttgactgataaatcaactcctcgggaagatgcttcacctatattagcacttactccggcagaaagtcccattgtagaaggaatgtaggcgcggttttggtaaatttgagtacgacgttcatagaagaagtcagcttgaacttctaatgcactgttgaacatacctaattcaataccaaagttccctttctttgatttctcccatgtaatattagtgttgggataacgagaaatagatacaccattcatttggttgccgtaatttgttccaaaatattggccacgtccaccatcatttggatttacttccgataaataatagaaacgatcatctgaacttccaatggcatcattacctaccagaccataggtcattttgaatttcagtttatccattgtgtttaataatggctcccaaaagctttcgttcgaaatgatataccctaaaccgaaggaagggaagaaaccgtatcgttcgtgagcagcaaaccgttcagaaccgttatatccaaagttgaattctgcaaaatatctggaatcgtaagcataggtaaagcgacctgctagcccttggtttctgcgtggtagtgatttctgtagagtgtcttcacttgatcttttttcttctcggcgagtatatactaacattccgctagtggcatgcacaccgaatgttcggttatagctgatggcagcttctacatagttggtagtgttgatatttctgcttccttgattgtatgacaaatactcttccccttctacaatgttagtcaatgtataactattggtttctttgtcatagtcggcctgataataataaggattgatagctcgagtaaggtcggaataagaagagcgagtggtactaactaagattcgggcatccaatcctttggttacgaagtcgaacttttgttttaattctgcttgtgcagctaccaataaattattggattctttgtatcctctaaccatatctgcatatggattaatgtaggctcctttatcggcattaccaaatagcacatgcgtagcattgacatattcgcctgttgcaggataacttttaggatacataacagggcttgtcttcattaccttcttataaagtccttcaccactgtccaacggaccggtatagtcatcaaaatttccattgacgcgaatagagaattctgtagtcttgctaagatccatattgatattagaccgaacagaataacgttgccagttaatgttactgttgtagttgttgagtttatcatttttgatcactcctccgtctttggtatatgaagctgctacataataacgtactgcactgcctcctccacttagattagtatttactcttgtagaaagagcgtagttattgaatagttcatcataccaatttactgccggataacaatatgggttggtaccagcaattgtattttctattttttcttgactataaactgtgtaattagcgctggcggcaggattgttaggatcacgccgagagtttacagcttcattatttaatcgcataaaggtgataggatctgttaattccaccttctttcgaggagtggatactgattgttctacacggacggatactttcggctttccggcgactccttgtttagtggtcacaaggattactccatttgctccacgcgcgccgtacaaagcagtggctgtagcgtctttcataatagaaaattgagcaatgtcatccacattcaagcgggcaagatcatctgtactcaattcaatgttgtcaatcaaaataagaggatcttttttataaccaaatgttgtggcaccacgcacaaagaactgagcattgtccttaccgggttcacctgttgtttggaaagcaattagtccggacattcttccggcaagagcggttgtcagattgctactcggtactttcagttcctgtggatttactgtagagatggcactaattacgctctctttcttttgcttggcaaaagcaactaccgttacttcgtcaaactcattagcttcaggaaataatttaatagagtaaaagtcgttactatctacttttatttcttgctttttcatgccaagaaacgaaatttctaatatatctccggtttttactcgcatagtgaattttccgtcaatatctgcaattgcaccaccttgactgttttttattttgatggtagctcctgccataggttcattatcgtcacctgtcactatacccttcacttctctattttgcgcatatatacttgtcgcaaagaaaagacagaatatgactggaatcagtcgattcattttaaagaatgaaaaaagtttttctttcatatttttcatggataatttaaaattaatattaggt

SEQ ID NO: 254 - DNA, 7878 bp, Bacteroides thetaiotaomicron
atatagatattagacatgtcggatctaagaggtagaactttatttaaacggattaaaccattaattaaggtattcgttatagtagattcatatcttcctaggaaacttaataattttttatttgtaagtttaagaggtattggaggaaaagttggtattgtgattagatacatattggtgaaaaatctagcaaaaaaatgcggtgataatgttgtaattaaagaaaatgtatatatatctaacatagagaaactagaactgggagataatatcagtattcatccgatgtgttattttgaatgtagcggaggattgatgatcggaaataatgtgtctattgcccattcaagttcaatactaacaagtactcacacttattctgattttaatttacctattaaatataatgaaatcctaaaaaaaacggtagttatccatgatgatgtatggattggttgtggagtgaggattttatgtggagttcacattgatacaagatgtataataggcgcaaatagtttggttaataaaagtgttgactcattctctatttatgggggagttcctgcaaaaaaaataaaatcttttcaatgaaaaaaaagaaattattcaaaataacaaattcagcttattttcaagtccggcaacttcaaggtcaattgaattatttttccgcatatttcgatgtcattgccgttgcccctaaaggagaaggttgggaggaattacagaagcaacaggcacgttgtattccggtaaaaatgtcaagagccataaatccgattttcgatttaataactcttttccaattggtaaaactttttatcaaagagaagccgactattgttcactcgcacacccccaaagctggtcttttgggtatgttagcagcatggatagcacgtgtgccgatccgtatgcacacggtaacaggcttcccattgacgacggctacgggcataaaaaaacaaattcttcgttttacggaacggttaacttacgcttgtgccacaaatgtatatcccaattcacaaaagatgtgtgatattatttgttcaatggggatcggcaatcctaaaaaaatgcttgttatcgataatggtggttcaaatggaattgatacggcattctattcgcgaaatgctacacaagatattaagatttcaactttcgatttcacgtttggttttgtaggtcgtatattttatgagaaaggaatcaatgaattagtagcttcttttattcgattacagaaagattatcctaacataggattacgtttaatcggctttatggaagaaaacctttatccggttgatgattgggtaaaacaagagattagcacaaattctcacattgagtttgtcggctttcaacaagatgttcgtccctatctaatggggtgtgaggcttttgtttttccctcctatcgtgaaggtttccctaatgttgtcatgcaagctggggccttggaattaccacaaatcgttacagatatcaatggttgtaatgaaataattgttcaaaacaaaaatggaataattgttccaccacaagacgaacacgcattgtataaagccatgaaatattttttggataatcctaatgaggtaaaaagaatggcaaagaatgcaagggcaatgattacatcacgttacgaacgcaataaattttggaaattgatgcttgaagaatactatcggcaaattaaaaatcgaattaaataacatctatgcaaatcatactgttatccggcggttctggtaaacgcctatggccgctttccaataatacacggtcaaaacaatttatcaaactgttgactgcgcccgatggctcgaaagagtcgatggtgcagcgggtggtacggcaattacgagaaaccggcatctgtgattcgattactgtggcaacaagccagtcacaacgggatatcatcatcaaccagcttggagaagagattcctgtagttacggaaccggagcgtcgcgatacattcccggctatcgctctcgcaagctcgtatttggcctacaaacgaaaatgttccaccgatgagattataatcgtcatgccttgcgacccttataccgaaacaggttattttgaaacgattcgcaggatagcggatgcagtgaaaaacaatgtagccgaactagtattgatgggaattaaccccacatatccgtcagcaaaatacggatatgtagtgccagtcaatgatgtacagaacaaaggaatatttcaagtatcacgctttacggaaaagccagatatgataactgccgagaaacttatttcagagggtgctttctggaacggaggcgtattcgcttttcggttggggtatatgacagatattgtaacccgacacatcaaaaccgacactttttcagaaattcgttctcgctatggggaatttccgaaaatcagttttgactacgaagtcgctgaaaaagcgcagtcggtagccgtcgtaccttttgccggagagtggaaagaccttggtacatggaatacgttgactgatgaactatcggaacacaccatgggcaatgttgtcatggatgaagaatccgaaaatacccacgtcatcaacgaacttggactgccaatcatgtgcattggcacacggaatctagttatcgcagcatcaaatgatggaatcctaatttcggacaaagataaaagcgagaacatcaaaacttacgctgactgcctacaacatcggccaatgttcgaagaacgtcgctggggtgaatacaaagttgtcgataccgccgagttttccgacggttacaaatcacttaccaagcaactgaaaatcaaatccggtaagagtatcagctatcaggtacaccgccatcgcgatgaagtctggacgtttatcgacggcgagggagaactggtactcgatgatatcaggtcggttatcagcagaggcgatacgattacaatcaagaaaggtgttaaacatgcagtcagggctatctctgaattgacgttcatcgaggtgcagtccggaaatctacttgcagaagaagacattgaacaatttgactataaatggtaaaatccttcgttaaaacctctgacaaaagaatgaagttggtttacaagaaagttatcgaacctcaattaggcaacctgatatccatattgaaaaagaaatgataatctatagcattgattattatcaacaagatcaagattgtactcaatgtggaaaacattcggaatgtatttgccggtaaaatgataaaatatcactatccatatgtaagtaagtatatataccggacacaggatcttgcgaaagtagcttcgttttcagattctaaaccgcagaaacagcattacgcaaaaattaatgggttggaaaaacttattataaatactggtaatgaaccttttcattgatttttctaatgaaaaagaccatccttcaatacatgaccgatatctatcaggaagatattcccaaacatatccttcaagaaaacaagatacgcctgaattcttttttcctggaacaggaatccgtacagaagaaagggactcagtttatattcagatatgcattctactccgttgagaaaccccgaaagatcacgaagcagcatctattgaaagaatatgcaggggtgcctttggaaaaaaggagcgtacaaccggaacaaatacccgatatgaagcaatatagtgatataatactgtatggagatgccagctctcctgaagcacagcaacagctggcggaatacctccaacaacataattcattaaaagtccagttgtctttttttgacaagagaaatgattccactagcaaggatgaacaagccatcgcatatgcggaactacagaaggcgctatttttttgccaaagaaaaaagatacctctcctgttcgtttccttaaaagggatgatagacgacatccgttttctcaatctgctggaggagagccatgtcgatttcagatgtatcgattttccatggttctgcaaggagaatctgcctctgataaaggcagttgtgctatatgaaaagttggaaataagaataaatgtataagatatcaagcttacagattggacttcaatgttgcagcattgaggtttatgagaaacaattctaaatatatttctgtttggcgaaatcttattctaaaaggaactctaaataaaagaatccaccttcagatatctttcttcacttatcctcaaagtatataatccaaacataaatatcagacctattttccctataactgagtaataaaaagattattccccaacaccgtaaacaaagaaataacagaagcactttaaaatggtgtatctaactcacttttttaaggataatatccctgttacagttatctgtagcaggtgatcctttcaaattgggcattagatgcacccttttccttattccaacaaatgcgcctcttgtaacctcaccaattcccaatacatcttcaaaaacatctccagatacaccttcagactcgggaaatagacgaaagacttccagcaaaagaaaggcacatgaatggccgttcattcggaacctccatttctggatagcgtttctttgtccatccaaaataatctctatcgggacagaacaataaacaaaagcataaatatcaggcaaaattgtcccgataaaagaattataacatgactattgaagatgaaatcctccaatacctgcactatcatcctctatcaaacagggttgagataacgcttgggataaccaatcctcccagtggcaggattgtaaaaagactactggccgatgccgtaaccaaaggaatgatagaagtactctaacaatagtagtgccactattttataagcagcactgcaattgttccttaccccagcaaatgcacctcctgtaacctcaccaaccccaaatacatcttcaagaacacctcctgatacaccttcagatccgggaaatagacgaaagacttccgggcaaaagagaggcacgtgaatggccgttcattcggaacctccatttccggatagcgtttcttcgcctggtcaaccgccatcttgttcagtgaagccacgaagttagcctggcgtatcggattccatttcggggtttcaagaatcaccatcccatctttccgctcaggaataaccaaatattcatcctgcacgttacggacgtaatagcacacaaaagacaaggcctcatagacattatcccctacatgaataccgataacccgttcttcaaccggtgtaccggcaaagcattccgcaatctgtttcatggcatacccatgcaacaaggcagcatcagaagccaacagataagccggtgcggtacgctctcctcccttatcgatggcagcaaagacagaaggactccaacagagatggatgagctttcctttttctttctcacgaagggaagcgacacataaacggttatcaaagaccaaacgggcttctttcgtttccggatggaactggaacacgttccgtaccctgtccggcttatggatatccatcatcagatagccctgccaaccggacacgtgctttgtcttcaagacggtttcgctttcctccacatcgaaaagataagacaagagcttttctcgcttacaacatacgaagagagaaagctcgtcctgttctttcatctgctgcatatccaaggaaagaacaaaagccaattgccaaggagtaagctcggaaaagccatgtaattcaatacaagacaacgcatccttctccggtgagtaaacgacatatccccggccacctatctcatatctcaacatgaaatccccctgttcagtgggatgataattctgtaaaacggtctgataattcataaagcaaatatattaagttagtattcatcataatgagaaatcgggaccactcttgcgtttccgtttctttttggacggtatgagatcatcctcttgcgacttcttcccgctgccggtaatgtcaagttccggaatggccataactcccccaccctgcatatagaaagcctcacgatccacccgctcacggaactcccctaccctatcgatatgtggcgagagaccgacagccacaccatcgaaatgcttctggatattctgataagtgagcttacgggaaagatccgcacctttaaagacatgagcattttccacgttttccatataaaaggaaatcccgtatgcgcctttgctgtttacatgttccgtcacacggatcgattcttccgccaaccttttcttaaaatcctcatagcctaaagaagcgttcaatgccttaaacacatggtcatagagataatgcttctgttcatcggcgctcatgccccggccatcaaaacgaatattaccaaaacgatatttctgaggaagtgaaacgtccttcaggtaaaagcctgaatccttgatgccatagacataataggatttgtccttcttggtgaccagacgcatatacaatccttcttgttccaggttccttcggaaatcggatgtactttcggaaaaagagtagatgcggtcaagctgttgtaacagttcatccttgaacaaggggttgaaaaaacctcctttttccagcaatgcgaaaaggttgtcatagctttcatcccccaataggacacgccattcttcattggccaattttatttcttgcaagggtttattcaaagaccggtatgtatcggattgttccaggacagccgataccttatccttgtaattataactacgcatggctttcttcaaggccgcatcgaaataatagttacggtattgcgcctctcccaacgtggttctcttgcctccttccctttccaaaggcaacagaccgtacttctgctccagttcccttgagatcttttcggaacggctgtaattatttccggaaggaatgcttttgccttcttcatcaattgtggtcagcagcacatgcacatggctgtgtgccttgtcggtatttaggacaacggcataacaggactttccgtaccccatcctctcgatatattccccggcaagagaaagccactgttcatcggaaaggctttctcccggatagaggctcagaataaattccgcataaggtagtttcacccggtcattcaactgggagataagtttcatgtaggctggcatggcggccagttcgtcaccagtggaggtgtaaagcacttttccgtttccttccttgaccttggaaagctggtattcaattttccggctcatggacaggtgggatgagaaagaaggttgtatctcggctatcataacaatttccggttaatggtttctacatccgaaaggtattggttaatccgatccaatgaatacaatatattttcatcggacggaagcgtattgatatgtttggcaagctggttgatattggctcctattttacgaagttcatatatcatttgcacatcggttttcgatatgcttctgcctttcaaggcagactctctgataaaggaagaaagggattttccctcttcctttgaacgttgaagaagctgttctttctcggcttccgtcaagcggatctttatacttatatctcgattctctttcatatatacagagtatgtgagtgtaacgaacattggtcggcagctcggctgtcgcaaggttttttgtacccacaaaaacataccttgcattagcaaagatatacaataatactcagctgtgaaacaaaaccagacaaaagtcttgatttcttaatccagattaaccgctcactttgttacaaagtaactacgcacattgtaacaggcgaacggaaagccattagttacaaaatacataattactaattatattattacaaagtatgaacatacatac

SEQ ID NO: 255 - DNA, 7839 bp, Bacteroides thetaiotaomicron
agatatacaagtcagaaaaaaaatatgagcaagcactcacttatctggaagactatactaatatattagattccacggtatatagcaacatccagtctaagatactgaacatagaacataaatataatcacctgaaaatcagcaaagaaatagataatctaaaaatgaagcaacagaactacatcatagtttctgttatctgtattgcagctctgctgttaatagttataggatatttattatacagaaaacaagcaaaagagaaaatcttaaaacagcaaaaagaattagataagatgaagttaaacctatacacactttctcttgagcttgaaaagaaacgaagtttattaaatacattcaaagaaaaagacgaaaattatgatcagctgcaagaagacatcgttcgtttatctgccaattatagaaaactacaaaataaattacttatagattcacctctatacaaagaactaacaaaattggggaatcaaaacataccgggaaataataaatcgctcataacggaaaaacgatggaaagccattacaaatgaaataacaaccatatatcctgaactttataattatatatatagcttaggtccgaacttaccggaagaagattttcaatattgctgtttgtacctttttggattcgataccaatacagaagcaaaactattaaatattgcccccaattccgtaagtaaaaagcgttccagacttaaactgaaactcaatatcacattcccgactaattcttcattatatgaatatttgattaagaatatgcattaatatccatattttatagagatattaccgatgtcatgttcacagtacatatctaaatcgtaagtgactgattatcagccaccgcctgtccatatcaaaactagtagttctcatacttagtccctcatattttaataactttgcagaaaacatttaaagatatgagaaagctaagtattacattattattaattgccctttcattcataacgatggaagccaatattttatcaacacacaaaagcaaaattttagtttttaaaggatggagtgaacgccagaagtcagttgtttttatacccatagaagcagttctcgaaggtcataacatcgaagtgcagttttttgaaaaaccgaacgagccagtcacgtttcaggttaaagacaagaatggaaacattgtgtttcaagatatgacaactcctgataacctggaaatctatcaaatagatgtgagtggcttcaagacggggcaatatgaacttctctatatagaaaaagatgtgactctcattggagagtttgaaatcgagtagacatcaacacatataaagacgattcatttgtcctgtcataacgccaatattaatcctataaaaataatatttatgaaaaacatttctagatttttagtagcattgtgttgcagcgcactatttttattctcatgtgagaatgaaattgaaagtgagattcaatcctcgtcagaagaattagttacatccgcagagacaaaggcactgtcagttgatagtcttgaaccacttaaaatgacagacgagttaaaagcattaaaagaaagaatggatgaactaaagaaaacaaagactagagcggcttccagtaattacggccaatatttttctgagaacatgtgggctattcgggaaatgccttttacattgagagcaacaagcggaggttatcttacagctagtggcagaggagggaaagtagatgtagatggccgtagagcagatatttacaaacaattttatgttacaatccccccgtcaattgtaggagttccctatttaatttattcatgccaatctgaaacacctctggctgtaggtcactatacaagtaatccaaaccagaaagtcgtattagccatgactactaactccccgaatgagttttctgcttcttgggatattatacccgcaagcaataatccgggagggtacgttattcaaagtgaatcgtatatcggacaaggaagtggcggttggtgggatgtttttaactatgtggttgaagtacaaggaagcaatctgggttatagtcaatactcacaaaaggcagaacaagagttcaccatcactcccaatgctccattcactctaaagaaactcgaatttattaatccatattctgctaccgtaattcaaagagaaaatatttctatccaacaagcaaccacaaatgtttcatttcaagaaaagcgggataatctgaagttcattaaagaaatgaaagacaattcttattttgaagaagagaaaggtattgcatttcaagtcccggcatcggacctagaatttgcactccccaccgtaacattaggagaaatagaccttgtacctaataataaagttcccgttgatacgaaatatgagcccggcatccgcagaacagtactgagaacactatataaggaaattcctgtagcagtcaaaccgcgtacaaagctcacactgacatattattttaaagcttatgatgtatcagtagattatgtcgctactatcgaatattttaatgaaaaagataaagagattagagaagctaaactacccggacgttggagcggaagaatatatgttgatgaaatagccgaaccggattatgaagaagtaaacttagatactcaacgaagtgcaaaaggaaaagctaacatcaaaaacgttactcaatcatcaccactcactttttaaattatacgcaaaatgaagaagttatttatatccctatgtataatattgttcacaatatcatgcactaatgaggaggaaactaataattatactccggtagataatcaaagcaattccacatcagaaatcatcttgcaagaacgtaactctagtttacctagagtgtggtcgaaaaaaacagcccaaagagtcacgacaagagcatccttcaccgatgctacagacttccttggatgctcttatgcagtagaaaatggaacttctattatcggtgatttcgctaacgccaaatacccggttgtcaacatgaagaagttactcgaaaggtacccttcatacatcaatcccaaagaactaagaacaacagagacaaaggctttatcttattctgatttcgatcgtttagagaagaataaaactttcactaaaacagtaaagtccggtttttctctaaatcttggaccattcaaatttggaagacaaaaaactatcaaagagacctttgtccataatacagatgatagtgagaaggtagtccatggagaactcagtatagaggtagtcaatggaatgttaaacttgcaaacagcacctagtgcattgagaaaaattgcagctgattatttagatgaattattcgtagatgcattatataattcatctatggtggaattaatgcaaagttatggagaatttgtcctaactggctactatacaggaggacgggcttcagcacttttttacggagttgacacaaatagtatacaattcgacagcaaagagaaagatatggatgtagcgataaatgcatcctatgaatggaaaaataaaaagccaacagctccaagcgacacaattcattctgcttcaggaaacttatccattggaacaaagagagaaaactcagaaacaataaccaacaaattctccgcattatcatattccatcaaaactcttggtggagcgtatggttacagcatttcaactcccccctatgatattacgaactattctattgatttaaccccttggctgcaatcgttaaacgatcccaaaacacatactatgattgatctgcaagatggtggactatatcccatatccgattttattttggaagagaattttaaacaaagatataatgatactcacatggactttcaatatcaagagagtcttgaagaaccatatatagagattataaagatgtatattcgcaaaagcaattcgggagaaaaattatatgatattgttcctgtgctcaatacaagacaaggagataagcttatattctcgaacccagatgctgctagtcaatccgatgaagaattaaaagctaacagcattcccgcaacatttcttaccaaaagtaatgcaataaaagatgagaaaagtaaatactaccaattaaaaattaaagcagatcccaataagactataaatccaattatacagactactctttcattccagataaacaatgtggatgagaaaggtatgtacaagttcaaaaatgccaacactaatatttggtacatatataatccaacatctatgtattgctttgcatactatgatgatgactatattcctgatgcatatggaatattagattgggtaaacggcatccccattaaggcagttactatgacaactctgtatcagagatacaaaatatatggtttgtagtaacaataaacagaattaatgttcctaataaacatagatttattaggaacattaataataaaacattatctttattcagacttaacaaataactattatgaatacaatcaaaacgcttctattattatcatttagcatcctattatttaactgtagtgatgaagaagataagaaaactgaaaaagagtttatctttagcgcaagtgaattaaaacaaactgaatgggaaggagaattcctttacctaacaaatggagaaattgactcaaaaggatcgataaaaatcgttttttatacagaaaaaaaaggtgtttgtgagtataaatttgattatcatattgatcctgagacaataagttttgaatatgaaatcagtgacaaatttatgtacattgatggtcctcttcctattcatggaaattggatacaacaaaaatacaacggaaattctctagaaattgctgatagcaaagcggcttttaccaattctcgcatgataaaattaacgagagtcaactagtaaaacctttttctactaacaattaccattccaaggaaatagcctgaaaataggagtcttacatctgtctaatagcagatgcattattcctttttattactatcaaaatcttcttattaataaaattcaccaaagtatcaaccataagaaacatgaaacaatctaatatctccgcaacaataataatgtcaataatatcatttgcatcctgcacaaatgatattgagaatctcgacattattccgacaaataatggacaaaatacagaaggcaacattatactacaagaaagaaatccaaatcttcccttacccttaataaagaagttcatattaaacaagccacaaaccagaaatagcgtttcaggcgaagacagaaccttccttggatacagttataaaataaaaaatggggattatatacaaggaagcataaatagtttaggctttccaataatagacattgactctataagaaaatatagaccttcttatctacaagagaaacttataactgtaacagagactaatattttcacttataataatctcgacaaatacttgtatgattcaagatttggcaaaaaggtatcatctgagtttactttcaatcctaaagttttcgcaacagaaaaaaaggaagcaatcacaaagttattcggtaatatagaaaaagctacttatggtaaactcgaagtttcttttctaaaagggcaatccacattaaatcatttaccaagttcaagactatggtatataagccaatttcagaatcatattttcacaaatatcctatataatgccccaatggcatccatacttaacgaatttggtgaattcatattaacagattattttacaggaggaaaggtttatgccttattcgcaagcaaagccaaagaagggacaaccgctcaacaaaaagaagatgacatgtatacttctataaacacttcagtaattaacctcaataacgctactagtattaatttaggtttcaacggttccaactttgacgcaacaaaaacctttaaaagtacagatacttatttagatatgaaaacatttggaggggaagtaagtcaaagcgtagcaataaatacaaaagtttctaatatcaatatagacttaacaccgtggagatattctttaaaagacatggctaacaatacaatgatagatatagcagacaatagcctgtatcctctatcagcctttgtactcgagcaaaatttcaaacaacgccttgatgacaccttcaacgagatactacctgcgaacaaagagctagtacctccacgcattgaaatcgtgagagttctcgcccgtacaacaccttccaatgaagctctttatgatgtagcagccgttttagttacaaggcaaacagatagaataatattgagtgacgctatggcgtcatccgctacagatgaagaattaagaaaaaatgagaacaatgaagttttcatgcagaaagtagaaaaaatagcaactgaaaaatctaagttttttagttctgacatagaaatatcatataataaagagactaaactgaatcctactttaaaatcaccattatgcatagaactaacaggatttaatgaaagaaacttttatagattttattatgaaaagactaatattgaatatatttacgatcctgctactcatctttgcttatcatattacataaataaaggggacgatagaatcttagatatctatggcattagaaactggatagaatcactacctgaaaagaaaatatcaataacaacattagcaaattcatataaaatcattggattatagacattgaggataatcgctaaaacacgaaatcaagtagacatcaactcatataaagacaataattcatttgtcctgttagagttgaaaacagatgcttatgtatgtaagaatcatgttaatatataaactatttttgtaaattgaaaacttaattagatatgaaatataatataaaacagtcctctttattgatgctcttcgctttgtttttagtagctttttgctttatagcttgtgatgatcaggacaatgaagagcaggaacaggtggggcaactcactcccgaagctctctatcaaacttcatggcgtggcaccggacattgtgccgcatggagtttgaaagatagaggtatcggtatacaattcgtagatacccaaaaaggaaaagtggtttgggaagattatgatgaatttgatattacctacatgatagaagggagctatattacatttaatgatattgcgtttcaacttgccggggctccttgggtaattaaaagttataccaaaaatcacataactcttatacaaaatgaagctagtcctgataaagataaaatagctacaatagagttggatagggtagactaattctttaaaagatatagtttgaggttataaattcctctttcaagttgtattgataatggaatgcatttaacaattagtaaagtgctatattataactagaagaaagagtgtatcaaaggccagatagaagtatcattctatcattcagagcgtagtgaagaatcttttctttgatataaataaagagtagatccttcggcaagcttaggatgacagagcaaaatgatagcagtcttcaataaattattaagtagagtctgctgaattacaaatacctgctgcttgttaaaatcaaattttagcgagcgcaggtattgaaattcaaagattaattgattagagtctcaatttaacaagaaattgagcatttcaaacaaggtatgcagaagttcttaaggggacctaaaggctaggccatctatttagattaaaaataaacaaggacataaaaagtaaataaatgaaaaatagttatgtctataatat

SEQ ID NO: 256 - DNA, 7836 bp, Bacteroides thetaiotaomicron
atatctctcagcattctagcattatccatatcctcaggtgaagcaaagggattataaggatgagaatggatatctattattggtataaaggtaggaaataaagcctcttgcactttagttaatccatacatacttgaaactctattcctattattatttgtacctaatataaatgttctctttccatccatataacctcccttaagagtccattccacacttgtattatccgcaacaaataaaaaaacattagcagcattatataccgagtttgtcgtagtgtaaagcttacgatcccaatagtctctccccttttcccctttactcgccgttaatccctgcaacatagatttatcaaacacccgaatacttttccaatttggatcaggctgcgtcgctttttgagaggaattaataccacttgcatataaaacatctactatcctatcagtcttacgcatcaagtaaactgctccatttgcatttacaacataatcatcttttccatcagggtcaattcgtattattggactatttttacagtaagcatataaccccaaagcaggatatttttctcctgaaggatctactgcatgccatcttcccaacgaagcatcatacattctcgccccataatcataccaatccaaaccattatctctgttcagttccttgccgttatacttataaggctgaacattattagacaatgatgaagaaagcaaccctccgaatggataataatcattcacttcctccaccacaccattttgagtgacaaccacacgattattaccttgatgatcctgaataaagtaatgaaattgattattcgaaacggtaatgtaaccatcttctgtcaacacctttatcaacacaccattttcatagatcgcattgccacaatagtctgttatgatagtggcatttcctgtcttatacgtagtacggagttttgttccatcagccgcgtagaggtaagaaatactgttaccaccttcaaactgcaccttctccggcaaatttaaacaattgtattgaatgtcagctatctttttattcaaatctttcgtcaaattaccatttgcatcgtattcatattctatctctttacttgcgccatccttgaattccataccgttaccgaatacatggcccgtagcattgtcgttgacagactccaattggttaccgttgtaaaccaagtttaaattatcaatcaagccatagctcattgtattggtttgcccgtaacggagtaaaccgaggatgtttccgttcttgtcatagcccgttacctgttcagtgaagtggttcgtattattgcttaatagttctccttcaccataaacagcatctttcaagcgggaaaagccgtcatatgtaaacttatagccacgtaatccggcctcacttcccgaatgccaggtcatactactgatattgccattataacaggggacacctactccatcaacatagtgtaacgtttgagaaaagtgctgactttcgattccagtcagccagccacggatattataggataaactctcagacaccttatcaccataattcctgccagtcagacgccccaatgcatcgtatacataagtgattttatcggtaaaacgcccgttccaagtattggctttcgttagtaaccgtgcacgatcatcgtacgtataaacggtttcaaggatatccgtaccaatgttatcctgctttctcaagacattacccgtgaaatcataagctgtatgactatatcgcagtcccttttcaggataatgacagagcgtttgaatgacacggctacgatcatcgtagtagattgtctctgtcaaccagtcatctgtgccaagcaaacgtgttttcgtacttgtggtcaaccccgaaggatacagggtatacgacgtatcatagccaacggctgctacaaacggatgggcagtcacattctccgttggtttgtaattgtcatataccgtatattgcaatggagtgcgagttcccgcaggaagataatgctcgctttcccaagcggccaattgcagttcgccacacgtttgctctgccgataaaagcatttcaccgctttctattacacgatcatgagagtcatagagaaaataactccatttttttgcatcagcagtccggagtttgccgtcttggctcaaaaccagacggtcacgacggtcataaaccatataaatgggagcgcaacccgggagacgtttggaaatcatccggttcagtttatcatattcataactgtatgctaagctatgcagcacggagatatccgtcgtgtcggtctccgccagctgatggctggcttctggaggcagtacataacggagacaattgcggtcatcgtacacatagtaggttgccaagctatcttcaccgttgacagatacagtcagaagagtccgttcattagagtcggtataggttttactccgatgcccatcttcgtctgtttcaacaatgacttccagtttccccgctccatagaatcctgaagcgatcaatgagccgctggaagaaactttatagcactttacctcatttgtactgttcattccgtaagtcacacggacactcttatcactggtatgccacgccttgcccggtcccatcttccgggaaacacgcatcagtggactatcctcatattgagtcagattataagcatatgcctgttctcccgtaccgtagacactccaacgctccggggaaaacttatcaaaggcaccgttgttgccggtctttgcatacggaaggtattccttctctacttgacccatcatattgtaggtataagaaagtaccaaatccgcattacctccaggactgccgcctatctgtatttcctgttctttacggccaaaaccgtcggtatagacaatatcattgacaattcgtgcagcaccgctacccgtttggctactcgcatccatataagttcgctctgccgtataattacgtgttttcgtataacctgtcgcttgctgcccgttcatgaaaagggaaaacgacagcagacagagtattgacaaagttcgtttcatctctattgttttcatattctgcatcttgttttattagttattaagcttgttgtactcatacgtttttaaaatattaccatattggtcttccactttgataactcgtccggcagcatcgtaagtgtaatactctacatttccgctctggtcaaatcgggcatacaccgtaccgtcaggattataagaagtggccttaaaatttgctccttcagggaccaatgccatataagaaccttgagtattggcagttacagaagttatgtctgtgtatttacttaggtcaatatcatatattttcaatttagaagaagaaacgctctcaacggtatatggaacctcacttcctgcatgggtgatgcttcctgaagcagttgcatttccgtccaaaatatatagtcgcaagtttttcataccggaagccggagttaatttggggagataagcaaatttgtatttatctacttcaccatacaatccgtacaagtaatcgaataatgatagtccatcaaattgcatcattgcctccattgcacttataaattgtctcaaaatctcaaactttggatagagtcctatcatccgttcatattcttgtttaaacacattaaataaatcataacatacaatatgttcataataatatctcgcctgactcaaatccggcttacttttcactatttcttcagcaaatgaagctataaaggaatggtcttgcgagttcagaaagcgaagaaaatgctgattatccacttcttctttaagtacttctattcctgacgcaaaagtccgttgttgttttctcaaataattgatagcaaatttaagatcagcctcatctatcgcctttcccactcccttatatttatcacttgccgtagttcctattacatcacactccagtaacagtttcccatagctgtcgtaaacacggctcttccgttctgtcctcccgttggtttccacccacatctttgaggcatatcgataagaagcttctgtagtatagttactttccccatgactaaacagtattgtatcaactacgctctgagcataagcttccggcatatcaggaacataagtcaatacctcaactggagctatgaaaccaatttttgattctctgtcaacctgatagcgacacacagtctcatgtactaatttttcatcaacaaggataagtgacttcacaacaggcgaaagaaaattggcttctttcatcataacaaagacagaatctgcagtgtctgccatatccatcgcacgcttcagaacttcagtccgttcaataccatcagagccaatacgaatgacacaggtgggatacatcgacatcggattatcataataatatttcgtccgagaatacggaatattttcgtcacttctgtattctacttcttcttttagagcagttctccagccatattgcagattgtagaacttgtcagtattagtaggagataatcgtggtttgatattatactcataaatctcttttcctgtaagatacgaagttccctgatttctataaaaagattccaaagacttcccatctaaataaaaatcagagggttgcatttgcggaagtttatcttcatagttgacatcagtttcataaatgtattgaattttctttagcatctctccattagtatcatacactgctttctccctcaacaaaccattctcccaatatggataatcagattcgttcactgacgtaggaggagatacttgataactatagacagtagaacccctaccggatatagtctccgtcacacatgaatagtaaagaccgttattacccatatttatcaccggataaccttcctgtatcactctgctatactcaatccagtccgtgcattctggataagagatactgacaacattagataaaggcttatacacactcacgcctactctcggataaccgtaagaaatggtatcactacgtccatttaattcgttactgaataccaatgacttcaaacgaattcctccgactataccctttctcccatagtttctttcatatttgacttcgattttccctccatccgataagactatatttttcagcgagttaagagtagcatatatctcataatctgtacactcttcatcctcatcctccgcataaggatatccccacaaatctactcctgtctccttccaaactggaaaatcagacttttcataataattgaattcaataccggatgttttcttgccgtttttatcacagaaagccaatcctctcgctaatgctcctcccgtggacgaaacagacgaaattagttccatatttcggttgtacaaactgatagcagataagctagaggaagacgaaaaataggcaaattttacaatatattcaggaaatacgattctgttgagcaatggagaatgaactttatagctttttcctccccatatctcttttgttttaacgtatttaacctcagataaacaggcgtatatatagtctgctgcttcctccaaatacgaaccagccatatccgcattaaatccgcctatacgtttacaatatgcagcgaaacctctcagactttctcccaattcttttgatacaccattcattttcgaaatgttggacaatacaccgacaattcgattgttagtttttatatattcactttgtagaggttgaatatttatccggctatatctttcaaaatcttttattttagagtccacatttttaaaatccagcaaaagagaacacatattcaaatagttttgggctacctcaatagcagaataaaaccgagatttatactggtcaaaatcaaacggttgttctttcacagattgaccatagtggtaaatcatcttatatgaatcatagattttcatagtatggatactatctaatgatagatttccaaaatctaaatccattacatcacctttatagcagaaatcaatcggtgctccattgtatggaagaatacgggtaagatgccatgccgaggtataaccggaatctgaaatagcattggaagtggaaacatccacatactcaacatctgcacatatttctctctgccggtagatataacggtcaccattattatctgtaatagtccagcctgttatctctgtggaagtcccttcacactcaatgcgaacatctgtctgtcccaacggcaaagcatatatctgtcttttttcattcatacggatgataaaatccaccttcttcccattgaacacgacagtaaaaatatcgctttccccatcccgtttacgaagccccacagtccttgcatcctgttccaatggagtaacagcattttctgtccacaggtagccgtaacctgatttctcatcggcaaatccaccacgcattgttcgggtaactataccaccaacgttaagtgtccaattttgacctattaaaccttcaggatcactcaccttcactccctttgcaatataatccaatgaaataggtaattcataatcacctgactttaattgatacagaggtacggtgtagtggaacaatcctgttgcatagtccaccgttacgttctttctttcggtcaggttctgggcttccggaccaggattgaaatcctgtgcctttccggatatagtcaccaataaaaaaataataatgtatatagtttttctttcataatcatttgtatttaatatctctagtttagtttttccgtttgccggatcgctaatcgataccggcaaacggatagtagctgccttacaaactcatcgcattagcccccaaaacgcctgctacagccgacgccaccgcgataaccacctttaggatcatatcccatactgatttcttcattgccatcatttacctcctttctcgttctttaaatagtttagtttactctgtgttcctaccgtattttcctccggagaaagcgtacgattcccctgcgtggcggaacaatgcaccacgatcaaattgatagttctcatgttaattgataattctctgtttagttgattgtcttattaaagtcctagtctttaaccaattatcattagttagtcttttgctggttatccttagttagctctagtttgtttcttgtttctttatttttctgttttacagttacagttcagtcgttagtcttatatttcttcccgcgaagcaagaaacaaattatactgtcgggtccggtgcttctccatcatctccgccatcgctgccaccaccaggcttgtcattcggatcatcaaccgatccgccgtcaccaggtgcggagaccagcttgtcatagcgagcacacttggcacccgtcaccatagaacgagtagcggtggtacgatccagattcttcgtcgtggtaggctggaagcggacggtaagcgtagcctgtgcagcactcacctcatcggcggtctcaacaccccggccacgggcactcatcaccatgcggaacgttcccaagccatccacactgacgctttcggacgactgaagatgctgcgccatcaccgtcaccagattgtcaagcgtattttttacatcacccggagaaagggaagaatatgcggcaatctctttggaaagctgtgcggaattgatatttcctgtacgaactacatggggataaaacagtttcttcccacttttcttatcttccagattagactggaaaggtttatataatactggcataattgtaatagtttttagttattaatctttttgttagtttctgtcgttaagcttattgac

SEQ ID NO: 257 - DNA, 7806 bp, Bacteroides thetaiotaomicron
catataagaagaaaaaatgaaaactatttcctgtatttatcaatggtctcttgtatacctacaggaaaaccaaaaaagttagaagaaatcttatacattgaagggcaattatcgttttctagagataagtcgttccattctttccacaaatcatcaaatgcagtaatatatttatccatctctatccggttaaaagacttttttgttgtatctgccacataaccgcatagcataatctgccacgaaacagcaaaaagctcatatttaatgcgtccatacgaacaggaaatacgaataaaatgattcaattcttctgagggaaaatgtagtttttgagatatcagttctatttccttccaaatacgaacagcttcttccttttctttcagataagcatttacttgatttctttcaatcatacgatcaaaataactcttttgatatacatctcccgttatggtgtcatcacgtgtccaattaacataagtatctcccatagtactatattgcccttttatcactccatcttctgataataggcaaagtcgacggaacatctcccattctgactcgggaagcccttttgcttttacaaaatcatatagtatttctttttctgttttcaaaggattactagcccaatgtgagatgacataagcatttaattcgatccaaaactcattcttgatataaggacctccccagccaccgccacgtgaccaagtccaaacacccttaaataagggattatctttcacttggtttaaacaatacggcttctttatattagatttcttaaattcttcaaaaccatcaattactcctttagcgatataattgggatgtgctccctttccttcatactcacgttgacattgcacttcaactacttgttgatgtttaccaatacctatacaaggattaaaaggaacaccatattgtcctgattcttccaaccaatatttatccattgtattataattcatatcaggatcagtaattgctgatctccaaaaatccgtcatggtatgcttgatagagaaataaagatttggatgtggctctatactgtctgtaacggacaaataatatttagggatcgaatgcaattgccccatatcccatgtacgataaaacaacttcttattacgtctttcacaaacctcttcccgtaacaaattaattaacgtaatatgatcatacataccattttgtactggatgattgcctacataataaggagcatcgtgcaggtaagtttctccagtacgaatcactaatccatccaattgtggaaacgtttcaaacatttccttcatcaattcacgaatacaaagctgagtgtaaggtttcgatatatcaagttttccttgttcgttagtaagttctgttctatgtttttctaccagcaaagaaggaagtactaacatatcaagcatacagtatacttgaaggtcttccttttttgctgcatcatattttttatgtattatttctgctttttctgccacccaacgtccggcttcagtcgtatccgggaataaagaaggatcaaaactcttccaatcaattccaaactgtgcagcctcaaacaagaaaaaaacttttgctccatattcatttttcttcaaaaaagaaggatcgagaaacttcgattccgtcatagcctcacccggattatggtgtaccatatccattacaacatatttctgtcgtacacaactagttaacaatagattaacagcacaacataataaaaaaacaaaataaatatatcgcctcatgtgtcgttttatagtatgatttttcttctagttagcaaatgcattttccaatttaggagcttttttacctgtaatagctttatatatatgctccgccaatataagcgaaccgctcttattcaaatgtacattatcccatacatagcaagttgaatcaactttatgttctaatgggctatacagatctaccaatttcagatgaaacttcctagctactttcttttgtatcggataaatttcatcttttattatttcattacgaatcccatataaattattacttgccggaatacaacgacatataataatttttggtttagatccacacttctgaaaagtgctgatcatatactctaaatcagtttcaaattcatccttatatttccagttctccggcttggaatcatttgtaccaagtttaataattacaacgttcggttgaaatttctgtgcattgataaatgcatcggtactcatataaggatgatcaccttttcgcaataaagtatggccccactttccaaaattgccaacttcatattgatttccaagcatacgagccaaaggagtcggataattgtcagccccttcagttatactattgccaatgcatgctattttaattttatcctgcgctacaccacaaacaggtataagcatcagaaatgcgaaaactaatattcgaactattttcgtcatatgattttgtattctagtcattatttttctgtttttaactgaaaacaaaacctttttacctttaaaaaacagtctacctatcttgacctacggtattttacaagctccctccggctgtagtaagagcaatgaggagcaaattttaaccggaggataaacttgaaaaccaatcaaacaccaatcctaaccttttacctaaaataaacccataaaaaacaatgtttatattaagaacgagtaagcaagcaaataccactaaaaagaaataaaaaaatatctataaattttaattcatacgataaaaggacttgatcttcaaagcctattttgttaagaatcactttacttacgctcaatattgagtaaatattctagaaacaaatcgcataacctcaggtaattccatccgccaataagtccacgaatgactgccgtctttcatacgaaattcatgaccaacctgatgctgtaacaacgtgttatgtaaaagacagttcgttaccgataagaaatcatcatcaccacaactgatataccaacgaatccatttgatacggtctagcttttctttcggagatttctccaagatagtttgtatatccatttgcccgagaacttccgcttttttttcttctgacaccttcgataaatctgattgattcttcatctgatcgaatgtccatgcccctccaacagcacttaacggagcaacagcaacaaacatctccggataatgaagggcataaaacaacgctccgccacctcccatagacaaaccggagatagcacgataacgactttcagcacgcactctatacgttttctcgatatgcggaatcaattcttgaaaaaagaagtcctcataattatatgttccatccaacaagttaaaataacctttatgaaccgtgtcagcatctggcataacaataatcatcggagctgatttcccctcagcaatcgctttatctgcaatatactgaacctgcccaaattgcacccatcccgtatgattatctcctaatccatgaagcaaatacaataccggataactaccatctccttcgtcatagcctgctggcaaataaatggaataactacgttccattcccagaatcttactttttacggtacgtgtctcatacactttcccttgctgggcaaaagccgtagtaaccagacacatcgctaaaagcgctgataataaatgttttttcatacgtatctattatttcatgtaaatataatatttaaaattacctgcttttaattgaatcattttcttttctatgcgaatattcttcccatccatcatacaggacaccgcctcatcgggaatacagagtgtagcagtaaccccaactggaatatccacttgaagatccataatattatctgtcaattcccagtcaacagcaatcacaccatatggagtatcttttgccatcttagcccaagtcaaacctttcggtatttgaggatcaataaatacatgttgataacctggtatcgattcatctattctaagtccccctattgcttgataaaaccaggttccgattccattatagcagttatgcaccctactccgttcaccactccaatactcccaagtcgctgtagcaccattatctatcatatacagataacctggataatcacgtttcttcaacatttgatataaaaagtcaacttccctgttacgaatagcccactctgtcaaaattgggacacctaccaaccctacagcaatatgacctttgtgctgcttttcagtatcagtcatcatctttcttttcacatcatcatacaaagaatccggtacagctcctacaagcattggataacacatatccaactgtgaacctgtagaatagatacctttacccggatgataaaacttttgatgaatcaactcatttagattcttcctgcgcatagcaaacttctctgcctcctctttttccccaagcatcagagctattttttccattgtccccaaacattcactgataaaacaattatttaccagatcaacagaagattgtgctcctgcatctactcctatcggtgcaagccagtcaccaagaaaccaatcccgatattgagtatcaggccagcgtttcagcaatccatccaccgtatatttatccacatatgagaaccattctttcattttcggataatagttctttattaatctcggatcattgtaattcacatacgttcgccatggcgcctgtacaataaatccacaccaatacggaccaccgccacctgcaccgggattaggacctacatgggccagacttcccccttcgcgcattgaatctccccatgtttgtatccagtttgtgaaagtcggtgctacgtcatacattgtttgcaaactcattgtagacgaatttccatcgccaccatagcctgcccgctccaaatgcggacagtcgaccatatatccgctaaatgtcagacacctcatagtatattgaatcatattatgaatggcgttcaagtcagcatccgaacattcgaaagtcgcagtctgccgataatcgccataaatctggagagattttatccattcagttttcggtcttgccggaaggttggagatacggacataacgataagcatgatgattgaatttattcctaaaatattctcccctccgtccacctgcaatatagacatcactttcaccttgtttgtcaaattctccttctttagtcaggttatcgctatattccatcgtgacctcatgtcccgcagataacatcggcatcttcatttcaaaccatccggtctgtattcttcccatatctaccaaccaggtatcttcactaagtttcctgatagaaacaggttgcaacgtttgatgtatcttgttagcttcacacatttgaggtgaaacaatgtgtcttggtacatttacttccaccacaggataccatttcattttatctagagaataagttgaaaaatctgtcggcactattctcccatccaccctttcaccaccaaattgtaaagcacaccaattacctgtatccgaatagccactttctcgtcccctccaagaagtgtcagttgcagtcaatacttcccattttccatttctcagcatattcagttccgcttttaccaacggaccgtcataagcagcaccaaaagtagttttcttataccacccttgtccaagccatatcagcaggtcattctctccttctttcaaataagaagatacgtcataagtgaccattaacgaacgtttattcagttgagagactgcaggggtaagaacattctccgtaaccttctttccattgacatatacttcatgatatcccagcgaattcacatacagaaaagtcgttgccagttcacctatttgcacttttttacgaagtaaaggagcacaaaccttacctccttccggtgatgaaccgatatagacaccgtgtatctgttccttattcaaaagaccaacagaaaaacgcgccaccggactccattgggaaacatgccttttccgatcccaggcacgtaccctccagtagcataaagaacgcgaagccaaaggtaagccttgataaggcaccatcacagaaacatcagacttcaacttccccgatttccataagtcagccttccccccaattaatagaagactatctgacgctacctgaatttcgtaaaatgcttgtccatccaccaccccatctcctttcaacttccaactcaaatggggagtaacgttgtcaatccctaaaggatcaaccatattctcacattttaactccactaaagaaaaagagaccttgttttctttcccatgtacaatctttggcaaacaccaaagacaacacattattcctatacctagtaacagttttttattcctcataaataagtttctgcgaatattacagctatggatcatccccccaacactcttacaatggataatgcattactcaacctatctttgtcaacttgactttatgagttgtcggcttattcattttataaattgtatcgacgatgatcttcatatatctactccatacttcgcgtatctcaggatacatcgctttggtataccactcataactcatcctcagaaaaccatctttaggtaaatactccctaagtttatttatagccttctcattatcagcaaacagcagaccttcctttttcaagaacgaatattctgtccacaaatattctctgaaacgtttttctacttcaaaacgttcttcattcagatacatgattttcatggcttgctggtattggggtgtattgggataatcggccaaattgataccatcttccaactgtccagatgaaacattatcgataaacaatccatctattgtcagccgataatgtcctttttctaaattagtcacctgcaaacgttcttgattaaattccttcataaacggtatcaaatccatagcatcacgttgtgaccttttatttccccaaccatgtcttggaatagaatccaaaggataaggaagtgaatttgccaaataatcaaaacttaaaccaccagcttctttctttagtttggagaccttacaattcctatgacttaatagattcttgttatttgcatcaattgaaatatccgaaacttcgactccagccagtccctgcgcctttaaaaataaataagccatcaccatctgtccatcattatcaggatggattctatctactctacaaaaagtgaatgtcgaatctttcttttgctcttccagacttatttgcaccatcggctgattaaaatccacaaatccccatccatttttcttcgccgccttacgctgggcatcaattatctttaaaatagcatcatttttatgaagaaaaagtaaactgttcaatttcgtagtttcatcataaggtgatccacctatcagcactttggtcattttattctctgccagcaagcgcttctctatttcccgaaagctttccaaagatttttcaatccgttgctccgacaactccttagcattctccttccagaaaatatcataccctgtgtcattcataccaaaagtcagagttacataagtcggttttctgtcaaaaacatcgtagtccaaccgatctttaatatcccacgcactctcaccgccaattccggcattcattattgtaatcggtttgtttggaaaacgagtcatataatataaccacacaaatgaatgataatgtccaccatgagttatactatttccaacaaagactacccgttctccttttttaaagggtggaattgattgtgcgtacaggctattag

SEQ ID NO: 258 - DNA, 7638 bp, Bacteroides thetaiotaomicron
attacttattacctattatttattacctattacttcactctaattaccatattagcaacaattgcagttaaacctccggtggtgattcctgaagagaaaatacttcgaattgcctctggagcttgttttaatacgtccggcattagttccacacccaaacctaaagataggctgactgctaagactaaggtttctttgcggcctatttcctgtgaggaaacgatgcggatacctgctgccgctactgtaccgaacattaataaggtggcgcctcccagtaccggatcgggcatcagagagaatatagctcctacaatggggaataatcccagcagaacgagcatagcggcaatataatagcctacatagcggctggcaactcctgttaattggatgataccgttattctgtgcgaagatggagttcgggaaggagttgaatatacctgctaaaagagagttgaagccatctgccatcacaccgccggaaacacgtttcagataagaatcaccttcaatcggaagtccggaaatcatagagttggctgtcacatctcctgtggcttcaatggcggtgatcagatagaccaagccaatggcaataaatgaagagatattaaaatcaataccgtatttgaaaggttgcgggatgttgaaactcatcagcatctcgacatttagtgcgctcatatttacttttcccagggcgaaagccagtccataacccaggcaaagaccgaacacgatggaactcatgcgcaggtatttgtttttgcagcgattgaaaaacaagacgctcaacagtacgagtgccgcaatggacagattttcccacgaaccgaaggagccgtcgtccatcgcactatatccgccgccacaggaaacgataccgactttgatcagactcaatccgatcagtagtacgacaatgccggacactagcggggtgatgatattacgaagatacttgaaggtacggctgacgaccatttcaataggtgcggcagctatacaggagccgaatatcagcggaagtccgcctactaatccggtcgctatgataggaccgataaaggagaagctggtaccttggatgcagagcagcttcgctcctatcggaccgatacgacggcattgtataaacgtagatacccccgaagcaaaaagggacatagataccagaaagcttgttttttcaacatccagcttcagtgcgctcgcaatgataagaggaggtgtaatgatggctacaaagatagccagcagatgttgcaaggcagcaaacagggcatctttaaatggggggcggtcttctacgccatagatcaaatctgttttcattcgatatttttattcaataattgatgtatatccgttggggaattttgtacttcgaagtttagttcagcgtccacttcaaagccagtgtcggaattacatagaagccgtcacgaccaccgaaattattgctcagttccacttcggaaccgacactcaggttaaagtttttattcactcccttgatgcggttcaggtttacccaaaattgcggttcggagaggaagatggtttttccatacttggtttcttcacgccaccagtcggcaaaaccggagaaggtgagcaaatccttgcaaaagttcatgtaccatgttcctgtcaactggaagttattcggggatgggtgcttctgtatatatttgtacatcgctgtcaatgtgaagcctctggagaaagaagcgttattataggtataggtggctcccgccaggtaagcgttgttgtaggagaatcctttcgccagtccgccattgtattcgagatgggcggagaaaggacctttccagaatttcagttcacgggctatctcccagtaagcggaagcgaccccttcggacgtatagtccatatcgataaagaagtaggtacttccccagttgtcgggatggaacttctcgacagtggaggtcaacagcgggcgtcctttcaagtctttatcatacagggaacgtccgaaatcataatgtaactgaatgttttgtgcctgcaattccggtacggcagaaagcagcatacataggaaaagagcagaaatgatctttttcatgacaaatgtgtttaaatgaaggtgcaaaaatagttaaacctatacatatattcacattccgacactaaaattttaatccagactattatttcctgtatcccaccacaatcgggtacctccatgatcgggtccgcccagagcctccacaagagccaggtattgctctctgtcttcggtttgcagcgtgccggggaagttgaggcgacgtaccattgtctccgtgtcgatacatccgttcctgctatggttgaagcgtaccggaaacaggcggggatatcccgtgcgacgctgttccgcccatgcctcgcaaccttccgggaataaggctatccatttctgcgtaatgatcttttccagctttatttccttgtcgtctgcgggattccatttaggagaaaccaggcaacgggcaggaatgttattttcggggtcttgtgtgtcgatgaaatcggcagctgtccgctcactgttcagatagtcgtccatctgataaatgccgcgttgatgaagagacgcctttattccgttttgataacattcttcttcatcctccggtatccatccgcgcaaagcagcttcggcacggagaaaccagatttcagcggaactcatcaatggggcatccgtactctggtcgacggacaatttggataagcctgcataatgattgtgcgcaaagcaggttccctgacggatgccgcggtactctcctgcatacgctttgtcggtacaggtttcaaagtaaactttcagtcggggatcatcgtagcctgtcagaatagattccattgcagcgctcatataagtttcattccatacccggttgagttctcccaacggattcgtgaatccggatttcgtagagaccgctacccgttcatcttccgcttcaaaaacaccaaattcattttccagtcctttcaggaactcggtgcgtgccttatccggatcaaccgcagaaatacgcattgccagacgcatacgcaacgaattggcaaacttgatccaggaggaatattgaccgtccagcaagatatcaaagcgggtgaatccattagattcgggcttcttttctatataatcggcaagagagacaacagccgaatcgagttcattaaagaactcatagtagacttctttctgcgtatcagggcgatattgattctgggcattcgcgaaattcttataaataacagggccgtaataatctgtcacacggtgcatgacttccactttcagcactttggtaatgccgaacaaggcaggttccgtatcacgggtggcattctccgactggtagatttgtggaaagatatacgaatacatatgtgtccacatggcgctgttccagccatcctgcatattataatccgagttatgcgtacctccgttcaagggttttccgtcgtgcatataaccggagaacatatccgcgttcagattctgtatcaactggaaaggccagttcttgcctttaccgaaatcgtagttaaagtagatgccttgctggataatccccagacgaataccgtaaccattgtcgtcaatcagcaaatcatcgtccgtaactcccgactggtcggtattaaattcacggaatttccctgtacagccaacagaaagcagcagcatccccagcaagtatatataaatatgttttttcttcatcgtcttccctcctactcttaaaattcacatgtcaaagtaaagcccagactgcgggtggtaggcataccgaacacttcaattccctgattgtcattgcctgtagaaagtaccagatcgggatcgaaaggcgctttcttgtacagaaaacaaaggttgcgggctacaaaagaaagttgcaggtctttcagacaattcgttttctgtacccattttcgggggaagctataactcagcgatatttcccgcaaccgtaggttggtagcgtcatacatatagtattccgtcactccggcacgtccgcccactacattcttatagaatcctttgacatcgcttatttgctggccttccagcgaaacatatcctttatcacgggcttgtgccgtcgctttcgatactccatagaggtccatctccgcctgggtctgcgaaaggacttcacctccatagcgccagtcaagcaggaagtaaaggctaaaacctttgtaggagaaggaatgattccatcccagcataaaatccggattggcattgcccacctttacggtatttccgtcgccttcgaccaacggaagtcctttatagtctccgtccgttccataaacgatgctgcctgcttcatcacgtataaaggctttaccgtaaatatcgccgatagagccgcctttcaccagtttcatcgcataactggacgagaagctggtaggtccgtaaacaaattctttcagttcttcatgaagttctacaatcttattcttattggcagagaagttgagagaggtcttccacgtgaagtcgggggtcagtaccggagtggcatccagcgttatctcccatccctgattccggatatctccggcgttgacgtatcgataggcatacttatcccccgcaagcgcaggcagtttgaagaactgctcatacgtgtcggtacggtaataggtcagatttaatccgaggcggtgctgcaagaacttccattccatgcccaattcgacggaatgcgtcatttccggtttcatctcggcgaaaggggccgcatcgcttgccagtatctctccaccggcagtcacatacgaaacagggtaagtgataaaaggaggcaccccgttgcctacgatactataagcaccgcgcaacttcgagaacgaaacccattcgggcatctttacccacttatccggaaggaaagagacaccgacggaaggataaaagaatcctttcttctcatatttcgtgtaagccagcgtagacgaccagtcgttacgtgcggtcaggtcaaggaagactccttctttatagccaatctgtgccgtcgcaaagaccgattgcagttggtaatgggcatctattttctgatcgatactggcagaactgctcatcacgatattggcaagattgaacacattggcatatttcaacgaagcattcttcgaatcaatgcgagtggagttagtgattctgtcattgatactgccgccaatggctacgtccaatgtgaagtcattcagttgcttcttgaccatcgccatcacgtctccgtacatctgcgtttcctgataatccatttcaatatagcgcccgttcatcccacagagtgccgtagcggtggaggcataaaatttctgacgcagtttatcggctgagtgatccagattgccacgagcctgaagtgtcagccaatcagtgactttcaaattggcagaaagggaaaggagcaggcggatacgtgcatccttactctgtatgcggttttgtatccaatacggattctgttcaaagtcttcggtaaaagtatgccagttttgtgtattcagctttctgtcctcgtcataacgttcatagttctccttataataagacaagccctcgccacgaggaaaacggtagagccctaccagcggattcatataaaagcctcccgatacgggtttattcttcaccgtctgcttcatgacattcacgttaccgtccagtttcagcctgctgttgaagaggacggcggtctctctcagattgatattgtgtttggagagtttattttcattcagaataccgcgaccggtggtgttggcataggagaaatatgtttgtagcttgtcatttcctgagttgacggatacagaagtgatcgacgtcagtccggtacggaaaaagtcacccaaattatcgtaaaccgtcagattttctttttctccccaactgtctgttacatcacttactccgtagctgttctgcatttcaggcagagaaaaagccttttcaaaagtcagtccggtagagaaatgaatatccctccgtcctacggtatttcctttctttgtagtaataagaatgactccgttggccgcctggctaccatacagggctgcggcaggagctcctttcaggatgctgatactttccacgtcctccggattcagattcgagatgccgtcgcctccgtccctgttgccggcatttgccgtaccgccgatagccgaataagcctgttccgaagtagaatttagcatggggacaccatctatcacatacagaggctgattatcaccggccaccgaccgcaccccacggatactgactttcgccgatccgcccatgccggaagagttcttgctgacctgtacaccggctgcctttcctgccaaagccgtgatcatattcacttctttcacacgattcagttcttctcccctcaccttttgcacggcataagccaaagaggattctttcttttcaagtcccaaagcagttacaatcacgtggtcaagcagcagaatattttctttcagacatacttcaagcattgacctaccctttacactgacttcctgagactcgtaacctacgaaagaaatttgcagaacagcactatccggaacgaataaaaagaaattcccctccacatctgtcactgttccattcgctccgcctttctctctgattgtcgctccgataagtggttcaccataggtatcgatgacccgcccccttaccgtaaaactggcagaggagactttcacacattctttcgaccccggccgtgaagcataacaatcttcttcaaagaaagataacaagcttataaaacagcaacttataattattcttgttttcaacagcatttcaataagttgtttttcaccatctccgtgcaaaaatagccaaatatttttaaatttgtttttttccgcaactattttgaaggaaaagaatagattcgttatttttgtaggaaattacatcaatatggagattgaaatcgaaaaacatcctttaaaaccctttctcccaccaaaagcaaagttgctgatgctgggaagttttccgccacaaagaaaacggtggtcgatggatttttattatccgaacctgaacaatgatatgtggcgcattgtcggactcttgtttttcggagacaaagatcactttctgaacgatacgcggaaagcattctgccgggaacagattattgacttcctgaatgaaaaaggaatcgccctgttcgatacagcctcatctatccggcgtttgcaggataacgcttcggacaaatttctggaagtggtgcaaccgacggacattgctgcattactccgccaactgcccgaatgcagagcgatcgtcaccaccggacagaaggcaacggatacgctccgtgcacaactggaagtggaagaaccgaaagtaggagactatgccgaatttgtgtttgaaggacgggcgatgagactctaccggatgccttcttcctcacgggcgtacccgcttgcattagataaaaaagccgccgcctatcggattatgtatcaggatttgcagatggtaatttaagtaataggtattaagtaataagtattagat

SEQ ID NO: 259 - DNA, 7599 bp, Bacteroides thetaiotaomicron
ctgataaccgaaatcggaatgtttttgcctttggctgcgcttgcccatgaatgacgggcacagtatatgctaagaggaacggatatatcggccagtctggctatttctttaaggtttctgtttattccggacatgacattcctgtaatgcttgtgcgtatccttaaaaggatatttcaataccggcaaaagataaggactgaggctgtcttccgggtatttgccgacaatctcctgcatacatttttcccacctgataaccagccgttgcccggtctttcgtctgcgatacgataagaagccgttctgaagatctttcttttttaggtgagccatatctatgaacgacataccacgggtatagaagctgaacaggaacatgtcccttgcaaattccagattaggctgtaaggacagatccagattcttcattcgtttgatggctgataagggaacggcacgcttgacggtcttgtccactcccgtatagacatgcctgaaaggattgcgctgttccatcagttccttttccaaggcacggttatataccgcccgaaggatacgcatgtagaatgaactggtattccgtacggctcctttcccatgaaggtaggcttcataaagctgcatcaaatccgaatcaatttcggacaacagaacatccctgttccctctgaactgcatgaaacttttcagagtgcaggaataattttcggctgtgcgtatcttacccatctgttttagacgggctatgatgccttgcatgaagttgaaaagcgactgtccctctgtattgctttgaaaagaagtgacaatatcatccgctgtatatccggctttccggttatccagttggcggacaatcatgtccagccgcttcaggtcccactccatgtgttcctgcaaggaaaggagcagattgcttcgttccgaactaccgacaatgatacagcttccagcttcgttccattcatccgtaaatatccggtaatccgtctttaactgacggattacacggttctggataatctgataatagacggtaccttcctttccttctatggtggaaggtctgaattttattttaacactggccatatcaatctgattcagattctacctgtaatttaagtctctcctgcatcaggctgtctgaaacagctttcagctccttctcgtacccgtcagcctgttttctgacccagtcgatggccttctcgtcacgatggatgtcgaaaaccttgttcagccagagaatatcttccggagtacacccgctccaggagcggatggcgcggaacttcagggcgtcgtctgcatattgccggttggactgccaaagtctgatatttccccataaggacaggctgcataccacgcccattccgaccaaaagagaaaatactttgcttgacctgatgtcaaaactatgccggtgaatatgccttacgcatgttgggatcacttcttctgcctgtctgccagttggtgttccggtcttctgttccagcttcccgtttatcatctcaatcttgttcttgatttcttcaaacaaaacatatacattgtctttttccatactttaccatcttattttacgttgttttttctttttcttctttctcaaataattgtccggataaccttctggttgttccgtttgcgggttcggtgtgaacagacctaaagaatcgctgtataattcactgccatgcgattcctgttgataggttggttcactctgaacagctacctttctttgggtttccgaatgtgacggtgtctttaacgcggtatctatcttggaatagctgaactgtctgtcaatcttggaaccgctgaaggaatagccgttcatgatgaacacgataccctgtatttcatcggattttcccttgtatttgaaccgtacatccactcctttttcgtttaatccggcaatcagctccttccagtttccggcttttctgacttccgttttaagcagattgtaaagttcatattttgtcttgtccggttccctcaagcgttcagtcttgacatgatccttacctttggccatgtgaagaccatatttcaaggtcagttccttgcagatgcgtgcactccgtaaccgctcgtttttgtcggatatggtcctgccatcattgtctattcggttgtaggcgatatgtatatgaggatgctccttgtcgaaatgtctggctataaagaactgtgtgttccttatgcccatccgttccatgtattccaaagctatttctgccataatccggctggtcagcctgctttcatcctctttggaaaatcccagtgcaatgtgtccgaccggtctggatactttcggattcattccggcctgtgcttcgaaagcctttgttattgtggtaacatcctcaatgaacaagccggcatgtgcgataatcctggcatcctttttattgtcaatgatatagccggtaacctcacggaatccgctgccttttacaatcttcgcaatcatagcaggatatggttcagaagttcttcgattcttgccacctgtacacggcattccagctttgccgtatcgaaccctccggcatttgccttatgagccagctggttcagattgttcgccataccacatagcctacggatatagtcggaatgttccgctgtaagtctttgccggacatatcccttacggaaacattctctcaggtattcgcttgccgatatgcctgcgcttcttgccctgcttttcagtgtatagtaatccggtgtcgccagtttcacggtaacacggtatttcagtttgtcggtcgtactcttgggaggacggccgcccttgttgtttctttctgtattctgtttcttttccatctgttgactattttataaaatgaatgtactgattagaccagcgggatgaacctctcactgcgtccagtagtgggagcaagcggtttcggtctgcccgaaacacaaacttgctccactaaaaattagagtcccgctattttgagcagctctgaatataccctctataaattcgggagaaataataccgttgtcggtatcattttatggaggggacaggcctgtttttccgtttctgttcatcatttgttttctcattttgtttgccatgttccgatatatctcggaatgaattgtctggcaaaaaaagaatataagtttccaatagtcaaacagttggtcgggatgtggcaacaatgtggcctgttgcagtttgcatgcggggcaatcggtgtggaatgcggtatttttcttgtttgaagaaacaatgaaccggggattcaaacagttactgatttattgacttgaatatttactgacttaatgtcgtattgtcgtactgtagtaaacattcatgtctgtgaatcattgaaggaacaattctttgcttccttatctaatcaatggcttggaaaagtaatgaagtaaggttacagggaaataaaccattccttatccattgctatggacctttattgaatcaggttcatagatcttttattctgcaattcattattggatggagtccctgaatatagggatatttgcagaaaatgatatgaatgtggcctcataactaagataatcagcgccacatgctgccagttaggcggaaaccattgcctttcagaatatatggcttttctttgtcgcaaacaacgaaaaaagaataaacatcaatcaacaaaaaaggaaacgatatggaatttgtaggaatagaaaaacaactgtttgaagaattggtgcgtaagtttgaatactttgagcatcgggtcatggatatttgcaaccgggagaacgacaggacgctgcacaagtggatggacaatcaggacgtatgccagtatctgaacatctcgccccgtaccctgcagacactccgtgataacggtaccctgcctttttctcaaatcaatcacaagatattctataagccggaagatgtgcagggtatcatcaagaaagttgaggacagaagaaaagaggctctttacagaggacgtaacatataacagttaaataataaccactaaatccataataacatgagtgaactgagaacagacagcagagaatgggtacaccgtatcatgggaagtcttgaccgtatgctggtcgggattgagaatctggcggtcggaaaccgtcccgtgctgggcggtgaacgctatctgaccgacaaggaagtgtcggcgcaattgaaactgagcagacgtacgcttcaggattatcgtaatgaagggagaatatcttattaccagttgggaggtaaaatcctttaccgggagagtgacatagagaaaatgcttcaggagaattatcgggaagcctacaaagtaaaccgcatctagtctgcgtgtataacaatagccgacagacaggctggaattatccgcctgctgtcggctattgctttttaagacaagaatctaacatttcagataagaatgatttttgccgataatacataccaaagaacctgtacttccttttatagcttttgttatcagatatttccgcagtcggtctgccggataagtatctaacaggaaggttagcgcaaaaatcatttccacattataaaaaatctcgtaacaaccgtctttctgtttgattcgtttttccactattcccggatttaatatgcctttcttatatatagtccgtactgcagccctgaaagttggtgcaattacgttaaagaaagaaatcagttccggctcgttcatccaaatttcagaaggattgatcgtttgtataataatatttccactttcattgattgttattgcttctcttttcatatactggtctgttttttatcggtttgactgctgctctttcttttctccattagtttgtccatatcttctgagatcttatcatcagtaaccctggcatatacctgagttgtcttgatatttgtatgccccatcattttactgatactttctatcggaacaccggcagaaaggagcaatgttccgaacgtatgtcgtgcctgatgatggctgagtgttcctttgactcctgccagtacccctatctcatttacggcataccagagcatatcccgattaggaagaggaaataccggtttcgtatcatccgtggtattataaagttccaatatctgctcggcaaccggatgaagtggtataaaggattcaactccggtttttttgcggttaatgcggatataacgccttccttcagcagtcttgccgatatgatggggataaagttccttcatatccacgtatgctaatgaagtgaaggcagagaagataaagacacgccgtgtgagttcctgccatttgttgggcataggacgttccataatcagttgcagctggctccggctgatatggtttagcttgggggcttccttcttttcgtaaggaacatcagctatcggattgaagcgtaaaatttcccggtcaacagctatataaatcagcctgttcagccacgtcatacaatgatttatatgagaagccttgcagccttttgacttgacaaactgtttgaaaccataaccgaaatcttccgtaatgtcctcaaatgctatatccgtcatttttagtgtgagcagatattcgcgtaggtaagcctgtgtacttttagactgcctgtaactggaggtagaccggatttcaactgaacggactctgagccgttcacgttcctcttctccggcctgaagaaggtattccggcactgtattggcctgtgtaatctcatttttaagcagttctgcactgacaacaccttttgttttcaagtacttttcataagtctgttccaacttgttgcggagttcaatcaaacggttgttcgctctttgctccctgatttcccccttttcggtattccagtcctcgggacggcaatatatccctgtggaaaatacacagctcttgccgtctatggaaattcggcacatgacggatgtagtaccgtctgcctttactttattgcggtttatgtatggtaatattgaaaatgtgctgcgcataatcgtataatttattttattggtgatactattatcagagtacaagtttcaagtctttggtagcctctatatatttatccatgtcttcaaaaagtttcttcggagtcacccgcgcataaatctgggtagtagaaatgtctgaatgccccagcattctgctgaccgtttctatcggtacaccgttttcgagtgtgatcagagtcgaaaacgagtgccgtcccatatgataggtaagcggaccgtctattccggccataaccttcagactggacaagttccacatcaatgcaccgtgttctatatgtggaaacagtgtctttcgtgatttgctgcggtatttttcgataagctctattgcttctggaagcagtttgacacggcataattttccgttctttcctcgctgatatttcagccataaagctccgctgtcatcctttacaaggtttgtttcggttatggacactacatcaatataagatgttccggtataacaggcgaaaagaaaaaggtctctggtagtaatatgcgaccagcgatgttcctctatttccaaatcacggagtttttcaaaatcctcacggctcaatgctctcggtggcttctccagcttctttggcaaagtgtaatgttcaaaatggtacttgtccgaatgtccttccttaaaggctatacgacagacccgtttaagtaaagccagataatggcgtacggtttcaacacttagtccacactttatgaccacatattcctgaaactcccttatgaactgctcgttcaactgtccgaaagcaagatcggaaaccttataacgactggatatgaattcggcaagtcgttgacgtgtataaatgtaattgggtatcgttcgtaatgaatattccacaccgacaagagatttgacttcttctatgtggcggtcaaaaagtttgagcagagtcatgcggctgtccattccaccttgaaacagattttttactgaaactgcatcaaaatcggttttccgttctgcaaggatatcaaatgctttgtgtatggaaacaagcagcctgtctattttggcattggtttccaccgcttccttacttttaccgttcaaccggctttccctcggattccaaagtttctcactgcaattcagtttacaactgaattgcgctacactacgatttaccgtaattctacccatgatcggagttttaccgttcttgtctgttccgcttcttttaaggtaaagcaacaccttgaatttttcaatcttcatacgcttacattttttgtcgtaaaactacaattcttataagcgttctttgatatgcaaaatattgcaaatcagcgagaaattatccggtatcagattacttgatttgctcaccgttacctatattgttcaggtaactggacagctaacgttttggtaactgaaaccgctcaatattctgcgcttcattgctttttaaactttaagcaaaataatgaatatctgcttatttccaacacgttacgatttatctattcaatcttgttagctcttgctttttactttatactccattgtgc

SEQ ID NO: 260 - DNA, 7595 bp, Bacteroides thetaiotaomicron
agtagctatacacttctgaagagtaggtatgtctatatacaaacttacccaaggatacgttaatgttcgtaaacttgggtaagattttatagatattgtttggagaggacttagaattcacactcttatttatgaatccctacagggtctcaactttgttgcatcagttttctcagcttctctgccacttgtagtaactgccctttatggtctaccatggagatggccggaatagctccgggaggcaagttctttttgatctcctcattcttctttatcaattcttcgcaggctttatcacaccactgagcagctttctcacgcaatgacatatctgcacattccttattgagccagttcacccattgcaataaatgcccttcgtcacccaaaatggtgtgcgaagcaagtatcttatcgccacgtttcacaaatgaatcccattgcttcattataccgtctctgctgaggcgcagactctcgcctatcatgtcagcttccgccacattcatctgtttcatcttcgccacgtaggcatccagtccctgctcatcaaatgtacagtgattggactcgtccactttcaggtaggcatatgaaccggctatccagtcttcgagcagtctgcggtcgagagaagcggcctgacggggaaatttatcagtaatttctttcttatggtttaccgcatactgaaatgcggaagagttgacatcatgcacatagtaatagaataccaagaagtaatcttcatcttccagcattttctgctcacttccctgcaagaaatcagctgccacctttcctgcctcctgttcacggttggcagcagaaagcgcattgatatatccgcagataaaagccaaatcacggtcaccagcttcataacgtttcttaagtcccgaaagtccaccggactctacacccagtttcactttcttcagcaattcaggagcatcctcagcacctaccagtcggtatacgacctcaccgcttgaattaatgaaaagaagggtaggatatgcgtgtaccccatatttctttctgagttccactccttcacctttctccatgtccatcttcagattcacaaaatgacggttaaaataatcggcaaccaaggaatctttaaaaaccactttggataacctcttgcaaggaccgcaccaagtcgtgaagcagtcgacaaaaagaagtttgtcttccacctccgctctttttaaagcctccggaaaagaaagttcacgaaaagcaatcccatcagcttgcgcaagagtcatttgtgcgccggcggcaggtgttgcggagattttctgtgcaggaaccatttgttgtccttgtgtgttctggacggctaacaggcatactattgccatgaatgcccaaaaatgtcgtttcatttcaaattgttttaggttggttattagatttataataattgataaactcctcctgccaatacccgtacggctcccttcatttccagttcaaagagaattgcactcattttatgtacgggaatatctgtctctaccactaaggtattaatctgtaagtttccttgtttttccaacgtatgaactatcttttgctcctcttctgtcagttccagaaacaggctgcgctgtacattctctacctttgccggatgtgaatccaacgtccatcccatcgcctccaccaagtcttcggcagacaacagaagggatgctttactgtcacggatcagttggttacatccttttgaatattcatcggtcacacgaccggggaaggcgaaacagtcgcggtgatagctttccgcaagctcggctgtgatcagagagccgcctttggcagccgattctaccacaatcgtagcatcacacataccggccacaatacggttgcgactgataaaattgtgtttatccggtgttgtaccgacaggaaactctgtcagcaatccgcctttatcaagcatttcaacggctgtcttacgatgaagagaagggtaaatacggtccagtccgtgagctaacacgccgaccgtaggcaagtcattgtccaatgcactccggtgggcattgatatcaatgccgtaagcaaggccgctgacaactaatacgtcaggacacaaagcttttaagtcacggaggaaagtagtacagagttgtgtaccgtaatcagtagcgtggcgggtgcccaccatattaatgatatggagagcgttcaaatcggcatttcccttatagaacagtacaacaggagcgtcttcacactcccgcaagcgggaaggatacgcctcatcatgaaaagtcaggcactggatatgattcttttgcaggaatacaagttcctgttcggcacgggcaataattgacggacagtccagtgcacccgacacccgttcatgtactccggataatcgctgcgccagttctttcctgaagcggaacacatcggtggcactcttcatgccctctaccagacgtttcgctccaatgtgcccgataccgggcaccattgtcagagcgatgctatatatttgttcttgttcgttatcggtcatttcaggtatggagcaaagacattgtcgaacaattcgctgttacttaaacgtccgtttaccacacataccgtctcaacagtggatttcactactactttctgatcgcttttgcggaagatatcctgatagaatacgtatttgatgccttctttcttcatatacagtttggagacaaactcatccccactcttcaacggagtcttgaaagccatattgatacgtgccactaccggatcgactccctgttcatgcaacgccgcaaaactaacacctaccgaggtcagaaactcgtggcgggtatgctccagataatgctgataattggcattgttgacaatcccctgaaggtcacattcgtaatcacgcaccttcatctccaattcgtagatatactggctcatcgtttatcctcttttctgttctacatcaagtcccttgaatttcttcaattcttcggtagataccaatttatataatttgtcgctgggacgtatcttctctgatttcattgagaaacgctgacctttctttaccgtctctaccggcttcagatcgacacgcgcttcgtccagtgtcataaagactgcgccggtggtaggtcccgttatcagcagcttgtcacctacactgacttcggcagcttctaccaagaactcagagacaccgatattggagaagtatttgatacctttgcccacatagattttacgttccgtagcggccgaaccataattccgtgtccattcgcccaagcgttgtcccagatagtagccatcccaaaagccacggttaaagactgccttcagacgttcatcccaagcggcaatcttttcgtctgtaaacgtatcatccagataggcctttatcgcttctttataacattccaccaccgtacgcacatactcaggaccgcgggcacgtccctcaatcttgaatacacgcacacccgcatccatcatcttattcataaaatgaatggtcttcaagtctttcggtgacatgatatattcattgtcgatatccagttccacatccgtctccttatcgcgaaccgtataagaacgacggcatacctgcatacaggcaccccgattggccgagtgattcatttcgtgcagagacaaatagcacttaccggagactgccatgcacaaggcaccgtgacagaacatttcaatacgaatctgctctccgctcggaccgcagatattctcttcccgaatctgacgataaatctcggccacctgttccagattcaactcacgggccagcactacgacatcggcaaactgggcgtagaacttcaaggcttccgcattcgatatattcaattgagtagacaggtgtacttcctgaccgatctgacgggcatagttcattaccgctacatcggcagcgatcaccgctgatattcctgccgctttagccgcgtccacaatggtacgcatcaaaggaatatccttatcatagataatggtattaacggtcagatagcttttcattccatgttcatcacacgtctgagctatctcacgcaagtcatcaacggtaaacgtattggcagaacgggcacgcatgttaaggttttctataccaaaatagatagaatcggctccagcctgaatggctgccgcaagggattcacgcgaaccgacaggcgccattatttcaaaatcttttatattcattttactatctgataatcattaaaatgtgataggagaatgcaaaggtacgaattaatccgtatccgtgaaacttacctcaacaaatagttctttcagtttttatccgtacctttgcaccgcaaaaagaagtatcgattatgaaaataagccatatagacctgggagaacaccctatactactcgccccgatggaggacgtgacagatcctgctttccgcctaatgtgcaaaaagttcggagctgacatggtatatactgaatttgtatcgagcgatgcactgatacgcgctgtcagcaagactgcacagaaactgagtatcagcgatgaagaacgccctgtagccattcagatttatggtaaagatacggaaacgatggtcgaagctgcgaagatcgtagagcaggcgcagcccgatattctcgacataaacttcggctgccccgtgaagagagtagcaggaaaaggagcaggagcaggaatgctgcaaaatattccgaagatgctggaaattacccgtgccgtagtggacgcagtcaaaatacctgtgacagtgaaaacccgtttaggatgggacgccaataataaaatcattgtagatctggcagaacaactacaggattgcggcattgccgcactaaccattcacggtagaacccgtgcgcagatgtacaccggagaagcggactggacactgatcggagaagtgaagaacaatcaaaggatgcacattcctatcattggcaacggagacgtgacaacacctcaacgctgcaaggagtgttttgaccgttacggagtagatgcagtcatgatcggtcgtgccagcttcggacgtccctggatattcaaggaagtaaagcattatctggaaacgggggaggaattgccgccactcagctttgaatggtgtatggaggtacttcgccaggaagtgattgacagtgtgaatctgcttgatgaacgcaggggcatcttgcacgtgcgccgccacttggctgccagtccgttgttcaaagggattcctaattttaaagagactcgtattgccatgttgcgggcagaaacgaaagaagaattgttccggatattcgaaacaattcctgaaaaagtaaattctcttttagattagttttacttaaacatcggctgcgcaaaccacttcttgaacatccacgtcgccacaacatacaacaagaatgcagagaagaaacctacgatcgcatcgataacgtagtgcgcctgaatatatactgtagccccgcaaagcagcatatagaaagggatcagacaggcaaacaacttcttactgccacgccatgccataatcataagaatggtagaaataccgacatgcgaactggggaaagctgccgtaggacgctctcccacttgctgcgaaccttctaccaaactgtaaaagaagccatgttgatagcccggaccgggaagtaactcctgattgttattgaaataatcgccgatggccgggaaaattcctttagatacattatcaaaacctatagctgggaagtagaactgcggccctgctaccggaacaaagatataaatcagataatagataaagaaagaagttaccagtacaaacgacatcttctcaaaccattcaaacttatagataaaataaaacaccgtcacaatgagcatcatcggataataaaagaaatatcccatattgaatgcttcactgaccaaaagatgcgggaatgtatgacagaaccagatagcaggttgcccattgaagataaactgctcggttatagcaaacacatggtcgagattcggaaagaaccggttaaactcaaacgtatccggataccagtaggaaagcaggctcatctgaatagcaacacgtacaaacgccgaaaacttgcaaggagccagccgataaagatacatcagcagaaaagtcattgcagcgatcatcgccctatccagcaacatgtgccatggatgatccattcgctgaaacaggaacagaatcaaaatggaggtcaacagattataaatcaatgttatcttctccacagcaaacaaccccttccgggtttccactcgcttaaataagtctaaagccatccttcgtttttataccagtcaatggtttcacggactcccttctccaagtcatattcgggagcataccctaactcattaatggcaggggttatatcacattgccagttacgttgtttcattattttatatttatcagaattcagcgtactgctcttgccggaacgtgttgcaatgaattcagcgagcaaagatataacttttagcacaattaatggacatttcacatgaataacaaacggattacccagttctttttgtattaagtccgaaaatacacgactattatacaccttcccgtcagtcagaaaataggctcttctagtcacttttttttctattcctaaaaagatggcctgcacaatgtcttttacataaacaaaagtcaggtcctgccgccggaagccgacagagaagtcaacatgctgccggatggacttcgccatcaggaaataatccagttcacgaggaccgtaaactcctgtagggcgataaataacataagggaaaccgggaatactctgaatataaagttcagccttaagcttgctaagaccataagcagtatttggcatcgggacatcaccggcttctatcggcgaataatctttttcgcgtacaggtccgaatacactcagcgtactgatatagatgaattgcttcggaaccatattcaacgctttcagggtatcaataaagtatttggtctggagataattcacataatcaaaagtattcttatccggacatttcgtgactcccgcacaatggatgatatagtcaaacttattataggttcctttatgtccggagagttgggcacgcaattcattgggatgagcaaagtccagttccagaaagtggatcttccggttcttcaagtactttttgctgctggtgggacgaatccccgcccacacaccaaactttcgttttaatgcctcttcgacaataaaacttcctataaatccgcttgctcctgttattaagatgctctccattaattataacctcaatgtataagaaaagaatgatgctacaaagatacaataaatataaaataaaagccattttgcatttctcaattattctctcttataagcattcctcctaaatcaccttagaaggaatactttttattttaataaggacgaaattatcgaagtcagcgaaagttttatccaattcataactatcaaattcaaatatttgtttactttgtactcccatcaaagaattttcaaataaatcaattctatac

SEQ ID NO: 261 - DNA, 7561 bp, Bacteroides thetaiotaomicron
ctataataacagccatagttcgcaaaaggttcacggtattttatttttatttataaatgtactgtatacgttccacttgctgcgggttgtcatagctggtgcggcatatccattgtcccgtattgtcatattcgtaataggagtcaccgtcgatccggtttccgtactcgtcgtacaggcaggtcaggcagccggacgtcttctggctgttgccgaagatacgttggtagacgatgcgggtgaggtatccgtatttatcatattcatacagttctttttgcgagagaatctggttgggcgaattgacaaagagcatattctgatgctgagattcggtcattctgcctttgtcatcatatttgttgactgtatatccctccatttccccgttcttgttgtactctttggtttccgtcagtaatccctgcttgttgtagctgctgacggtatatctgccgtccatgtattttagggaatcgctttcgatgcttccgtcgataccgatgcggcgtgcacggcggtagaagtccgttttggttttcggattagtcttcacttcgaagatgcagtggccttgcgggtcgtacagcctgctggtttgcacctcgttgatgggttgcccgttcttttcagtcacggataatgtggtggtaagctgccccttgtcattgtaggtgtagctggtcgtaatattgccggtgctgtcggtctcgcagcactttatcaatcgtccttgagtgtaatattttacagtagtcggggtggaaacgatggcttgcaggataaatggagcacgcaaattctttgcctggtcacgaaattccttatacttgtgtgttttgaggaattcctgcaataaaccgagcgattcggagttgactattgccggtttcagaagctcgaagtctgccttttcactgagatattcaagatcgttcaggtgagtccgtgcaccggtggacagataaggtgtgttcttataatcatcgataatctgccggatggcggtggcatttccttcttttttcaggctgtcgatacgttggaacaggaaatcatcgtataaggtacggacctcggcaagataggggcgcggacctctgtcttgataatacttctgcatttcggggtcttcaaagaaggctttgaagtttgcaggagtcggggccgtcttcaccagttggtagagccgtacgttttcggaggcgttgacttgtgcgataaatttgccgttgggatactccttgacgtaagtctggtaaatgatgggagtgggggctttgagcattccttccagcagcgccacctcgcggatgttctgcagccgttgcagcatggcggagtcaaccggatattcggtggcgtgaatgctgtccagcagtgcccggctgaaaggaattttatctttcgaggcctccagcaggttgataatggactggtccgccttgtcccgtatctgagaaagcggaatcttttccccttcacagatactggggaagttattttgggcggctttctcgtagcagccgaaatagagggtggctgcctgttcgctctgtccgttccacaggtcgttgaggacgtccatcaatgataaatcttcggcatagtacgcctttgtttcgtcatccagtttttccctgttcttctgccatttgtcggcgtcattgtcgttcagatacctcagcagcttttccatgcggctttgcttttgtgccattgcttgctgtggtatgcaggcgacaaggcacaaacataaaataaatgataaaaatatactctttttcattgctttgagtgattaggttaaatagttagtgatgaaaattcataaaaatatcttcattgtcaaatgaatgttatacttttgtcgtattgaaacaaatttgaacgccaagggtttgttaaaaatcctcattgtttttataatgctgttatgaataccaactatatagaggaattaaatgagagtcagtgtgcagcagtgacttataacgacgggccttcgctggtgatagccggtgcaggttcgggaaagacacgtgtgttgacttataaaattgcctatctgctggaaaacggctatcaaccgtggaacatcctcgcactgacctttaccaataaggcggcgcgtgagatgaaagatcgtatagcccgtcaggtgggcatggagcgggcacgttatttgtggatgggtaccttccattctgtcttttcccgtattctccgtgccgaagcaaagtatatcggattcacttcccaatttactatttatgattcggcggatagtaaaagtctgatccgttccatcatcaaggagatgggactggacgaaaagacatataagccggggatggtgcaggcccgcatttcgagtgccaaaaaccatttggtttctcctacgggatatgccgccaacaaagaagcgtatgaaggagatatggcagccaaagtgcccgctgtccgtgaaatatatacccgttactgggaaagatgccgtcaggcgggagctatggatttcgatgatctgctggtgtatacgtatattctgttccgcgactttccggaagtgctggcccgttatagggagcagttccgttatgtgctggtggacgagtatcaggatacgaattatgcccagcatagcatcgtactccagttgacgaaagaaaatcagcgtgtttgtgtggtaggcgatgatgcgcagagtatttactctttccgtggagcggatattgataatatcctttatttcacgaaggtttatcctaacacgaaagtctttaaactggagcagaattatcgttctacgcaaaccattgtctgtgctgccaacagtctgatcgaaaagaatgaacgtcagattcggaaagaagtattctctgaaaaagaacggggcgaaccgattggcgtgtttcaggcttacagtgatgtggaagaaggggatatcgtagccaataagatagctgaactgcgtcgggaacatagttacggctatgctgattttgccatattataccgtacgaatgcgcagagccgtgttttcgaggaggctcttcggaaacggagtatgccctataaaatctatggcggactttcattctaccagcgtaaggagattaaggacgtcattgcttacttccgcttggtagtgaacccgaatgatgaagaagcattcaagcgaatcattaattatcctgcccgtggcatcggtgatacgacagttggaaaaatcatctccgctgccactgaaaatggtgtcagtctttgggcggcgctttgcgaaccattgagctacgggctgaacattaataaaggtacgcacaccaaactgcaaggtttccgtgaactgatagaaggctttatgaccgatcaggtggacaagagtgcgtatgagataggaacggatattatccgccggtccggcatcatcaatgatgtctgtcaggatacttcgccggagaatctgagtcgtaaggaaaacattgaggaattggtgaatggtatgaatgatttctgcgcgttgcggcaggaagaaggcaacccgaatatttctctgacagatttcctttcggagattgccttgcttactgatcaggactcggacaaagcggatgatggagaaaagataacgttgatgaccgttcattcggccaaggggctggagttcaaaaacgtattcgtagtggggctggaagaaaaccttttccctagtggtatggtgggcgattctccgcgtgctctggaagaggagcgccgtttgttctacgtggccattacccgtgccgaagaacattgttatatttcttttgccaagacccgtttccgttatggaaagatggagtttggaagtcccagccgtttcttgcgcgatatcgatgtgaattatttgcggttgccgcatgaggcgggagtcagccggtcggtagacgaaggtgcggggcgtttccgcagggagatcgaaggtggatttacacgtgcggcatctcctacacgaacgccttatggtactaaattttctgatcgtgaacgtccgaaggctcaggtgattgcgcccactgtgccgaagaatttgaagaaggtcagtgcggtgagtggaagcagtatacggtcggcttcagccggctcggcatctgtaacaggagtacaggcggggcagatgatagaacacgaacgtttcggcttgggcgaagtgatcagggtagaaggaacgggtgataatgcaaaagcaacgattcattttaaaaatgcaggggacaagcaactattgttgcgttttgcacgttttaaagtgatagagtaatcatagtaaaattagagatgatcatgaggaaacaactaactgtaattctgctttctgctctgatattgagcggatgtgcatcgggacgtatgggaaatcccggagcaattgtaggtggtgctgcaattgggggaagtctgggaagttcgataggcggacttatcggagataataatcgtggctggaggggcggatatcgcggctctgccattggaaatattgttggcaccattgccggtgcagcgatagggaatgcgctgactgctccgaaaccggacccgatagaggaatatgcttacgttccggaagtcagacaagggcagtctcactctaagtttaaacctcggacacagactcagcagcaactgactcagttgaaactgcgcaagattcgctttattgacgataaccgtaatcatgcgatagacgggggagaaagcagcaagatcatctttgaaatcatgaatgaaggacggaatccggtttatgacgtggttcctattgtagagacggtcgggaaagtgaaacatatcggcatttctcctactgtaatgatagaagaaattcttccgggtgagggtatccgctatacggctacagtctatgccggaagtaagctgaaagatggtgaagtgactttccgcgtagcggtgtccgatgagaatggggtaatctgtgattctcaggagtttacgctgcctacacagcgggcggactaggacaagaatagctcaaaatattcgatttgttatagtgacagtatgtgctcgggatagtgacactatccttggcacatactgtcactatgttaatgggatggtgacactatcccaatacaatagtccggtgcagtcattacacaataaaatgaagtatcggtttcatctacacagaagcattctatatgagtatctggcaaaattttacgtatcggttttccttcccagtcgaaaacccaaatctcgctgtttagagtttctttttgttcttcgtgcatccgattggtgtttgggttatacagtacataaacatagttattggaaacggcaatgcctcgtgctcccagttcggcatcaggattatcactttccgcatacacaccgtctgggcttgaattgaactgataatgatagggtgctaacaatagtcttttatggagcgttaatgtttccggcttatagtcccatagctcaagtacattattggtagcacatgccagacgtttccggtcggtgttgtaaccgaattgtgattgatgaaacatacctttagccgtattgggtatgttttcttctccactttgatagttcgggaagtcgccgcatttggatataacattgccgtcattatctaaaataaggaatctgcaatcttcaaaaacaccggacgctataaagcgtgattcgcttatcggatagactctgtcaatgctcatgggcaggtgtatcaactctccttgtcgctggatggaaaagtctttcgtgttgaatatatagttttgcgctgtgaagtgccatcgattgtgtatgaaggcagacgaatcagacagaaagaattcgacagggcttaaaaattcatcaggtccttgtccttgtggcagcatttgatttacaaagcgttgttcactaagactatagcagtataaaaggctgtctcctttaaaatcaccggcatataagatatctcctttcttttttatatccattggaatggagataaaggtttccttcaaagcggtagatttagcagttgtgctttcgctaaaggatactcttttttgtgattcactacaactgaacaatggcaatgccaaagtaaacaatagaatgatgtttttagatttcattttgttttgctttattttgtactataactacaaagataacgtatgtgttttgaaaaacaaggatattgaagagaaatagggctaaaatatttatagtgagaacataataatataattggcattcggtaattaccatatattgtgttaactttgtgatttatttgatggtaattgtagttgcgtttttgctaaagggtatatttattgccataaatagtattgatccacataccaaagaacttgtcggtaaccgaatatactttattgatttctgtaataatgtctttttcaagcagttttttagttgcggactgtacagaacttgcggatgtcagactgtatcgtttgataaatttcgctgatgtgacgttttctgcttcacctactttggcaatggcataaagcaattccttctgcttttcgggaatattagataagatttcccgaaagattgtatcattatatgcaataaggttatctatagctgttttgataatttccagtgtacattctttccctttcggtgtatctgcaaaagcttcattgaatgttttttgaatataaaaggtatgtcctttgaatagccgatatactttttctatattttcgatttcaatatgccgttttcttttttggaaatggtctgcgataaatggtatatagatttccggtacaatggctttcagttccaaaatatcggcactgtggtagaatggacgggatgaagatagaaacatttcctgcatcatatgccgttcacttccggcaaagatgaagttactgttttctattgtctgtatgtgtgtgcgtagtaatgcttctatattcttctcgggatatttagcaatttgttgaaactcgtcgatggcaacaatacaaggtttgtctgctgctatcagacattgaaatatttcttccagtgtatattcgggtcgatcaatatctcccagttccagattgaaagtaggtagattggtcagcgggtcaaatccgaatttaccattgattgatttaactgtctggataaacaggcttgccattttcttactgcggggcaatagtgtttcataaatttctttgccaagcagataagtgaattctcttaagcttgatgtatggagtatgtcaatgaagaaagtataatattcttcttttatttcaggtttctcataacagaaacggattagtcccgttttacccattcttctgggtgagataatgacaaggttattgccattggttaatgatttaaccagcctctctgattctttcacgcgatcgcagaagtactcgggttctatttttccagttactataaatgggttaatttctttagtcatacctgtttcaattttccgtaaaggtagttatttgaatagaattatgcaaatcgaataatgttaataaagtac

SEQ ID NO: 262 - DNA, 7471 bp, Bacteroides thetaiotaomicron
attatttatatagtaaataaacatagtttttctctatctttgtgactgctaatatacgcacaaaatatggatgtaataacaaataaagaggtaaacgtttatcttgataatgaaaaaggaacattgtgcttaacaggaatgttggtaggtacaatggtatttttatatgattcgcagggggagctgaaagagaaacatagatttgccttgccttcactcactttggagatatccagaaaaggtacttatgtcttagtcatgagccatcctaattgtcagccggaagtaagaagaattatatattcaggaatataaaaaagccgatatgctcacttgggaacataccggctgtccttataacaactaactataatttagtttctgaatactaatccgtctccgtttgagtcaacaatgattgctttgcttctgtcgacttcctgagacaataactttttcgacagatcgttcagtaaataacgctggatagctctttttaccggacgggctccaaattcaggatcatatcctacctgggataagaaattcaaagcagcatctgtcatttccagttcaactccgttttctgcaagcatcttttgtacacctttgatttgtaagagtacaatttgtctgatttcagtttccgtcagcggcaggaacatgattgtttcatcaatacgattcaggaattccggacgaatgtttttctttagcatattcatcacttccttcttcgtttcttcgataacttcttccttatttgaaccgctcagtttctccatctgactttgtatataagaacttcccatatttgaagtcatgatgatgatggtgtttttgaagttgactactcttcctttgttgtcagtgagtcgtccgtcatccagtacttgcaacaggatattgaaaacatccggatgcgctttttctatttcgtcaaacaaaacaactgagtaaggtttccggcgaatggcttctgtcagctggccgccttcatcgtatccaacgtatcccggaggtgctccgaccaaacgagaaacactatgcttttcttgatactcgctcatatctatacgtgtcatcatcgattcatcgtcaaagaggaattccgccaatgcctttgccagttcagttttaccgacaccggtcgttccaaggaaaataaaagaaccgatcgggcgtttgggatcctgtaatccggcacggctacgacgtacggcatctgcaaccgcttcaattgcttcgtcctgtccaatcactcgttgatggagttcgtcttccaaatgcaataatttatctttctcactttgcatcattttgctgacagggatgcccgtccagcgtgaaacaacgtcagcgatgtcttcagcatccacttcttctttgatcatggctttatcaccttgcataccacgaagtttctcctgcgtatcttctatctctttgtccaaagcctggagctttccgtaacggatttcggcaacttttccatagtctccttcacgttccgctttctctgcctcgaacttcagattctctatttccactttgttttgctggattttatccatcagcgttttttcactttgccatttagctttgaaggacttctcaacttcttttagttcggccagttctttgccgataatttccagtttcggcttatcattttcacgcttaatggcttcacgttcgatttctaactgtttgatcttacgtgagatttcatccaattcttctggaacggaatctacttccatacgtagtttggctgctgcttcatccatcaggtcgattgctttgtccggcaagaaacggtcagtgatgtaacggctgctcagttctacagctgctatgatggcatcgtctttgatacgtacatgatgatggttctcgtagcgttctttcaatccacgaaggatggaaatggtactcagagtatccggttcatctacctgtacaatctggaaacgacgttccaatgctttatctttctcgaaatacttctgatattcgtcgagagtggttgcaccgatcgaacgtagttctccacgtgccaatgccggtttcagaatatttgcagcatccattgctccttcgcctttgccggcgcctaccagtgtatgaatctcatcaataaacaagattatatcaccttctgatttcttaacctcattgactactgattttagtcgctcttcgaattctcctttatattttgctcctgcaaccaatgctcccatatcgagagagtagacctgtttgtttttcaggttttcgggtacgtctccccggaggatacgatgcgccaatccttctacgatagctgtcttacctgtacccggttcaccaatcaagatcggattgttcttggttcggcggcttaatatttgcagtacccgtcggatttcttcgtcacgtccgattacagggtccagtttgccgctgcgggcggcttcgttcagattgatagcgtatttctccaatgactgatagttgtcttcactggattgagaagtaactttttctccttttctgagttcattgatagcgttacgcaattctttttccgtcattccggcatctttcaagatggtggatacggtacttttcacagttagcaaagccagtagaatatgttctaatgaaacaaattcatctcccatttctttagaatactgggttgccttctgcaatacttcattagattctctgcttaggtaaggttctcctccggatactttaggcagagattcgatctgtttgtcaacgactagagctacctgttgcccgttcattcctaatttttgaaagatgaagttagtcacattttcgcctaccttcattactccatgtaggatatgagcaggttcaatcgcctgttgtccccgactttgtacgagatttacggcctcctgtaccgcttcttgagatttgatggtaaaattgttaaagttcatatggttgttctcctttcttttttcatgattttaataacacttgaaggggctcaaaagatttgccaagtagaaaaatatgacaaaataacatgattataaaggagttagaagacaaaatgacctttttcatctgaatgatactgacgaatttgccgcgaaatgaagtgaataaataaaagtattgtagtatctttatccgctgtaatcatattataaataaggtatgaatgataaacctcaaataaaactgtctgaaacagtagtgttgattgatgctgctttcttgaattttgtaattacagatatgaaaggttactttgaagagactttgcgacgttctttacaggatatcgacctttctatgttgaccacttatctgactttggatgccggaatcacggaagggaaaaatgaagtacaatttctttttgtttacgataaggagtccgatcagcttgtacattgccatccttccgatttggtgaaggagttgaatggagtcgcttttcagagtccttatggtgaatattcgtttgcaagtgttccttcggaagggatggtttcacgcgaagatttgtttttggatttattgtctatcgttgctgattcggctgatgtgaaaaggatgattgtcgtttctttcaatgaagaatatggaaagaaagtattcgatgcgttgcatgaagtgaaaggcaaggagattatccagtttcgtatgaatgagcctgaagtgcaggtagaatataagtgggatatgttggcattccctattatgcaagcattaggaatcaaagctgaagaactatagtctttgtgtttaattcctgatctttaattttaatcctcaaataacttaaataaaaaggtgtccgattttcgtttaaaagtatttcagagcgtagcgaagaatctgagtttcacaaaggcttcgcaagaattgtttgtcagccagcctgctatcactaagcatattcaggaattggagacttattatcaggctcgtttgttcgaacgtcaggggagtaaaatctcattgactgttgccggtgaattactactgaagcatagcgaaaagattttagatgattacaagcggcttgaatatgaaatgcatttgttgcataacgagtatattggagagttgaaactgggagctagcacgacgattgctcaatatgttctgccccctttattggctcattttattgcgaagtttccacaagtcaatctttccgtccttaatggaaactctcggggagtggaggtcgctttgcaagaacaccggattgaattgggattggtggaaggtatttttcgtttacctaatctgaaatatactttgtttttgcaagatgaacttgttgcggtagtgcatgtgaacagtaaactaaatattcaggaggagataacacctgcagaattgccgaatatccctttggttttgcgtgaaagaggttcggggacgttggatgtatttgaacgagccctgtcgcaacacaatctgaagctgtcttctttgaatgttctgatgtatcttggtggtacggagagtatcaagctctttttggaacatactgattgtatgggaattgtttctatccggtcggtgcataaagaacttgtggccggcactttacgggtagttgagataaaagggatgccaatgttgcgcgaatttaattttgtgcagctacaagggcaggagggaggattatctcaagtttttatgcgctttgcggggcatcatagcaagaacttgtaggtcagacttcttccatacgaaccatctcccaaccgcagaactgtattacgatgcagtgaagttgcgtgccttggcataatagacggactttcggacttgcggcataaccatgaatttgagccaccgcttcttcccattgttcggcagactgggcatcaaacttttctttaggcagatattttagttctactatatagctgtgtgcaatttctgcatagcgttgcaggtcaggcatgagaaacatgtcgcaaaagccatggttcaactctacctcaggtgtcgtcaagtaatatgcattgacgctaagataggcagtgaagaatccttgaatattgcgttctccttcaatgctgctgcgcacggaagaattctctttataagctttggctataaattccaatgcaggtcgccattcaccgtcaaaagccatgttattgaagagtatctctatatctatcagattgatatagtggtggttttgatattcttccaagatatattcataatattgttttcggacatttgtattagggattcctaagatagtcagatttccacgtgttccgatgatagtcagcatgccatagtaaaaaagcaggctgggaaatatttccggattcgtaatctggtctgcggaaaaagactggaataggttagtgatgatttttccttcttcggcaatgcgtttgataacgcctttgcgattaccgtcaagacgatccagttggatgagttttttcatcttgttataatccgttcgggtattagggtcaatcatctgttcgggagatgctcccaactgaatccgattccgaaggtagtaaagtaccatatcgcagttgaacattttgggatcagaactcaggctttgacgtgcaaaacaataattgtcataccacggcttcatttccagaatcatctcttcaatatctccatgcagttgccctgtttccttgtaatattggaacatagtgcgcacatctttttcagaaaatcccagcatctggttaaataccggactggtactgatgttccaaccgatattataaccgctcgacaagtcgtctagcgttacgggactgacaccgatcataaagatacggtcgaacattcctttatagtttttgaaggcatcacggtagaagccgcttgcgtgggtgatggcacgatatatttcgttgcctttttcgttgaggacgacattggtgaagttatcgtattcatctataataagatataggggataacctaatctcctggcttcgtcatcaaggatgtgaagtttatcaattcctttatccgcagcactgaaacgttctatgaattcatctgtgtaatattcacgatatcggttgagaaaaccgtctagctgcacagcgctgtaagaatcgaatctttgtggcagttcatcaatactgccaccgattttggaaaagtcaagataaagtatttggtatttgccttgaagcggagttgtatgctgaccgatccagagattgccgaatagttgctggaacttatctttttgtgaaaggtcatagtatgaccggagcatactaagcagcagactcttgccgaaacgtcgaggacgaatgaatatcaggtagttggcttgatcttccaataagggaatatacattgttttatccacgtaatagcggttttgcatgattacgtcctcaaagttggacatgccatatggtatttgtttcactgtttccataactataaagtttgcttctttttgtttttcagattctagctcctcaaacaatcaaatatcaaagatagttcttttaagatgattattccatttttgtgcgtttattttccaattcggtcataatcgctgctttttcattcgaatcttaccttctacagaaaaagaaaaaaagattttatctctcattgctctcattgttttttcttaaatatcagataataagattcttatcgaatgagagatacttctgcaagaacctatctctcatcattttatagtgaaaatacgcctaaaaacagttatctctcattcatttttagttatctctcatctattttcagggtatctctcatcatatattattttttattcagtggcaactttcttctttacatagactctgtgcgaacctcttcctgcaatatcaataccggattccggaagatcagcccattgtttcagctctttagtagcagctgtctgaagcagtccggttagtctttggtaattccgtacagtcaggaaagcgtgttcgtcgagaaatttcagggctaatgtcagccgttgctccggtgtgaactttttagaggagcgttgtggtttccatggagctctttccagccggcatctttcattaatgtttctgatcatcgttctgtctgcccgaaaattcactcctcctacacagatgctttgtgcgtttcggtgtttggcgccttcttccgcctcttctcgttctttgtctctgcatagggcgagtgagggggtaaaagtccctattccgtctattttcacagagcgtccttccgccatcagatgcgccatttctatggcggtctggagcaatacgccttctatgtctccggcactgaagccgctgacgtctcctactcgttgcgccagttccttaatgcttgcattgtctatccgtgcaaacttgggataagtaattcttttgcccgttttctgaatgtcgggcatctcttccataatgtatcgtgccatactgtcttggttctaaag

SEQ ID NO: 263 - DNA, 7460 bp, Bacteroides thetaiotaomicron
gtcttagcatagcaacgcttttgtcgcaacatcatcaggtgacggcagtcgatgtgattcctgagaaagtagatatgcttaatcgtaaacaatcgcctattcaggatgagtatatagagaaatatttatccgaaaaggcattgaatctgactgctacgcttgacggcgccaaggcctacagtgatgctgattttgtggttatagcagctcctactaactatgatccggtgaagaactattttgatactcatcatatagaggatgtcatagacctggttttaagtgtcaatcctgatgctgtgatggtaatcaagtctactattcctgtaggatattgtcggggactttatttgaagtatgcccgtaaaggagtcaggaagcttaacttgcttttttctccggagtttcttcgtgagagcatggccctttatgataacctttatccaagtcgtatcattgtcggttatccgaagctgattgatggcgagctgtttgatgaggaaaatgaagcgattaagtctgttgcggatcttcctatccttgaggaagctgcacgtacttttgccgcattgcttcaggaaggtgcaataaaggaagatattcctacactttttatgggtataaaggaggcggaagctgttaaactgtttgctaatacctatcttgcattgcgtgtcagttattttaatgaattggatacttatgcggagatgaaaggtctggattctcagtcaatcatacagggtgttggtcttgatcctcgtattggtacgcactataataatcctagttttggttatggtggttattgtttgccgaaagacaccaagcaacttcttgccaactatcaggatgtacctcaaaatatgatgactgctattgtcgaaagcaaccgtacaagaaaagattttatagctgaccaggtcttgtttaaagccagatattatagttatagcaatcaaaatcactataataaaatacaagagaaagcatgcatcattggagtctatcgcttgacgatgaaatccaattctgataatttccgccaaagtgccattcaaggcatcatgaaacgcatcaaggcgaaaggagcatctattattatttacgaacctgccatgcaagacggtgatactttcttcggcagtcaagtggtgaatgatctggcaaagtttaaagagatgagtcatgctatcatcgccaatcgttatgatagttgcttagacgatgtgatggaaaaagtctacactcgtgatatttttcagagagactaataaacgggtaaaatcaattaaagaaatctaaaatatatagcttctatttgtctcatgcgtgtaaatattggggaataaggagcttttaaataactaacgtattaattggacgcttactttattgcatttatagagattgtcctgtttgataattattgaaacatattgctaagcctatgaaaactataacaaaagatcaaattttcaaactggatcagcgagtaggggaggtatgtaaagccaagtataatgaagtaatggaagaatatcgtaagaatcgttctagaattaagtgtttaaagagtaagaaggatagaaaaatggaaataattaaatgctttaaagcgattacaattgcagcctgtacgacccctgaatcttcaagaattgtttgtgaacaaaatggtcctcctcctaatatatgtatgttcaaacaagagattaagaaaatagagaagatgcgtaaggattgtaaaatgcccaaaccgaagaacaaatttggacgttgtgcagaacaacgaggggctaatactttgatacaatcttttccgtctaaagtttctcttgatgatatattctttagcgtagctcttcgacctagaacttctcaagtagtagagtattgtgagaattgttgttatctgtttaaaacgctacgaacatgaaacttgatactgatattattcgtgatctagatattgattggttaggacgaataggggatattcctatacatgttgcctctggtggcggtggtttacctagagccgtaaataatgatgagtatttgattcagtgcttggagtggctttctgaattagacgatgtggttaatgttagtgaagtatgtgttaacacaaaactgatagaacgaattgttcgggatgatatcagacgcatggtgaagcactatttttttttgtttgccgaggaggacaaaggttatgtcacagagttggtaaatgataatcgagtagaagaaaagatagaactctatcaacagagtttcgtctcgtatgcaaagaaaggtttctttagctttgataaggctaacttgaataataagtccagaaacacgtataatctaattgcttgtccttgcaatttgaaccattgtaaaaacattcaagctccatttcctttgagtgagttttattgtgaacctttcaatatgttgagagattcttttgatactacttcttttgataaattcaataggataaatctcaaggaagttagtaggtaattgaatatgctcagctgaattcttatacggctgagattaacttataatgccttacatgataatgaaaacagtaatgttagttttcggcactcgtccagaggccatcaaaatggctcctcttgtcaaggagtttcaaaaaaatagtgctgacttcagaacgatagtttgtgttacaggtcagcatcgagaaatgcttgatcaagtattgcaaattttcgacattcaccctgattatgatttgaatattatgaagcaggggcaggatttatacgatgtcacagctagagtcttgactggtttacgtgacgtacttgaggaggtacatcctgacgtagtcttggttcatggagatacaacaacttcaacagctacggcattagctgctttctatgcacagataccagtgggccatgtagaagcagggcttcgtactcacaatatctatagtccttggccagaggagatgaatcgacagattacgggtagaattgcaaattatcattttgcaccgacagttctttcacagcaaaatttgttggcagagggtgtaaaagaggagtgcattcatataacaggcaacacggttatcgatgcattgtattgggtggttaatcgaattaaggagaaggtaacgctctcggatgaacttacttcattgctcaaggattctggttatgattctactcgcctggaaaagggtaagaaacttgttcttataacgggacatcgcagagaaaactttggggaaggctttaatcatatgtgtcaagccattaagtttttgacggaaaagtatccggaggtagatttcgtatatcctatgcaccttaatccgaatgtgcgtcgccctatacacgaagtctttggtgaagacttggcttgcttgaagaatatgttcttcatcgaacccttagaatatcttagttttgttaacttaatggaaaaggctcatatagtactgacggatagtggtggcattcaagaagaagcaccaggtttaggcaagcctgtactcgtaatgcgtgatacaacagagcgacctgaagctttgtctgctggtactgtcaaattagtaggtactgattatgataagattgtgaatgaggtgtcagccttgttagacgatgctgtcgcctatgaaaagatgagtcatgcggtaaatccttatggagatggtaaggcttgtggtaggattgtagatgtcttgagataagttgaacaggaataatgtctcttctacaacttgaagaagagaaaaaacgagataaaatcaaatggttggaattgtcacatggcattactatacaaattttggtagtgctttgcaatgctatgcgcttagtaatactatttctaagttaggttatagagtgcaggttattaattatagaaatcctaaatatttacagtcaaatcgttttttagcgtgtttgaagggggtaatagaatcattgcttggattgttcccaccgttaaggtttaggtatgggcagacttttaaacattttttgtctgaagctatttcacagtcacgtttatatacttcatcggatgaaataaagaaggatgcactctcttacagtacaatcgtagcaggtagtgaccaaatttgggcaccgaacgttttcaatcctgtgtacatgattgattttgtcgatggtaaaaaagttaataaagtttcatatgctgctagtatcggtttgaatgaaattcctgagaaatatgtaggccaatattcttccctattaggcgattttacttcgcttgcagttagagaggaagaaggtgcgcgtttgttgaaagatagatgtggtattgtggcaaatattgtgttagacccgactcttcttgtcaatgtagcagagtatcgtgccttacagagcactaaatacctgccttttcttcctagtaaatatattttctgttacttcttaaataaaaaacatacgtataaggctagagtagaagaatatgcaaagaagaatagtttttctgttgtaggatggtctgcaaagccggaagattcgatttggatgactttatttcaaagaataggacctagagaatttttgtatttaatagaccatgcagagtgtataattacggactcgtatcatggtactattttttcaatgctgcatcataagtctttctttacttttcaacgctttgcacaaacagatccgatttgtcagaatagtagaatacgtcagttgaattcatatttccattttgatgaaagaatagtcgtagatcaaaatattccttcggatttgctgaattacgattataactcgtttgaggaaatactttgcaaggagcgcgaaaaatcaatgaactacctaaaacagtcgttaagataatgctttcttttactcaagataaagggcactgtacaggttgtacagcctgtaaggctgcttgtcctaaacaatgtatttcaatggttcaagatgaagaaggttttctttatcctaaagctgatatggagaaatgcattgattgtggcgtttgtgaaaaggtttgtcctattcaaagtcctatcaagcctactgttaaacagactgcttatgcggctgttacgcgggataagaatatttggaaaaggagtgcgtcgggtggagctttttctgaaatatgtatggcttggggtgatgaatcaactatgattgttggtgcagcctgggatggattgaatcttcatcatattagtataataggtacggagaaaattgcacctctatgtaagagcaagtatgtagcaagtagcttggaggatgtgtttattgaaattaagacacatcttaagtcggggaaaaaggctattttttgtggaactccttgtcaagttgctggcttacgttcgtgcttacggaagaattatgaaaaccttcttatcatggatttgatttgtcatggcgttggtagttctgcagtctttaaagcatgtatgaaggcgataggaaagcaattggattctgaagttattagttatgaattcagagcaaaaatgagcgcatttgaagcagattacctctctagtgttacaatatgtagaaatcaaaatagaaagattttcttacgaaaagacccatatatcgagcttttcttgtcgcaaaagattcttcgaccttcttgtggtaagaattgtattttcagagataggcaaagacaaggcgacattacaattgcggacttcaaaggattgaccaaagtgttcccttctttgattgggcaaaagtataattactcgacagttgtaagcaataattcaaagggtgacacaattattgaattacttaagaatagaatggtaatgcttgagtgcattattgaagatattgaaaagttcaaccctttgttctcaaggcatacatggttttcgaatgagcgcgattctttcttccaagaatataatgttaattcagaaaaggcaatattgcatcatactcatcaagccgttatttataagtcgtctttgttgcgtactatatacgatttgttgcctgtaatagtaagaaaacaagtttataagctaagaggaatcaagtagttatggccgcgagtactctaaataatttattttggaagtttgctgagcgtatttctgcacaactaattagtttgatagtatctattgtattagcaagactcttagagccatctcaatttggcttgattgcaatggttcttgtatttatagcgcttgctgatactttagttgttggtagttttagtgatgctttaattcaaaagaaggatgctgatgaattggatttttcctcagttctctgttttaacataggattctctatttgcttatatatcattctatttttctcagctccttttataacgagtttctatggagatcaatattcgttgctcactcctgtgcttcgagtactcgggctgcgtattttgatttccgcaattaatgcggtccaaaatgcttatgtcgcaaggctatttatttttaagaagtattttgtcgcgacaatttcagccactttagtttctgctgttataggtgtagttatggcttatatggaatatggtgtttgggcacttgttgctcagcaactcgtttcttgtgttgtaaatacgtttactctaaatcgagttgtacggtttaatttatctttgaaatgttcttacgatagacttaaggtcttgataccctatggctctaaggtcttagggactagtttgttggtgacggtattcatggaattaagatccttaataattggtaagttatatagtccggctagtcttgcgtattttgatcgtggacgtcaatttccgaacttattagttgctaatataaatacatccatcggtgctgttctctttccaaagatgtcgtctcaacaagatgatattgaattggtcaaacaaacaacacgtaagtcaattcgtctttcttcctatataatgtcgccattgatgttaggccttgcagctgctgcagaaccattcgtaagattgattttaacagaaaaatggattgattgtgtacctttgttgcaaatattttgcatcatatttttgtttcaaccagtacatactgcaaatacccaagctataaaggcgataggtagaagcgatataactttgaaacttgagtttattaagaagtgtattgaaattgttactctattatgtgtgatgtggataagcgtagaggctatagctatcaatatggttgtattgactactttgtttacacttatcaatgcaaggcctaatataaagttgctaggatatagctttaaggaacagatgaaggatattcttccaaatgtggggatggctgtgctaacggcaatagtaatgatttctgttaatataataaatctttctcctgtattgagtataataacacagataattctaggtctttttatttattcattcctctctaatctatttaaggt

SEQ ID NO: 264 - DNA, 7435 bp, Bacteroides thetaiotaomicron
gtagtaggtaataagtcataggtaataagtaataggtaataagtgaacaggctgtttgcttaaatatataattcaaaattttaaaaatcatcatgtttctattaggttatgatataggtagctcgtccgttaaagcgagtctggtcaatgctgaaacaggtaaatgtgtatcgtcagcgtttttcccgaaaacagaagcgaagattatcgcagttaatcccggatgggcagaacaagatcctgagagttggtgggaaaacctgaagttgtccactcaagctattatggcggagtcaggagtgagtgctgctgagattaaagctatcggtatttcctatcaaatgcacggactggtatgtgtagataagaatcagcaagtattgcgtcctgccattatctggtgtgattctcgtgcggtgccttttgggcagcaagcatttgaaacaatcggagaggagagatgcctttctcatttgctgaattcgcccggtaactttacagcgtctaaactggcttggatcaaacaaaatgaaccggctgtctatgagcagatatataagatcatgcttccgggggattatattgccatgaagttaagcggagatatctgcacgactgtttccggtctttcggaaggaatgttctgggacttcaaaaataatcgtgtagccgatttcctgatggattactatggcttcgactcttcacttattgcggatatcaaaccgacttttgcagaacaagggcgtgtgaatgcagttgctgcgaatgaactgggattgaaggaaggaacaccgattacttaccgtgccggtgaccagccgaacaatgcgctttctttgaatgtgttcaatccgggtgaaatcgcttctacggcaggaacatcgggagttgtctatggggtgaatggtgaagtgaattatgaccctcaatcccgtgtcaacacctttgcgcacgtgaatcatacgatggaacagacgcgtctgggagtgttactttgcatcaacggaacagggattctcaattcatgggtaaaaagaaatatagctcccgaaggtatctcgtacaatgaaatgaatgtgttggcttccaaggcgccgatcgggagcgcaggtatcagcatcctgccttttggtaatggtgcggaacgtatgctgaataataaggagataggttgcagcattcggggggtagacttcaatgcacatggcaaacatcatattattcgtgctgcacaggaaggaattgtattttcttttaaatacggtatcgacattatggaacaaatgggaattccggtcaaaaagattcatgccggccatgcaaatatgttccttagctccatcttccgtgatacattggcaggagtgaccggagccactatcgaactttatgatacggacggttctgtaggagcagcgaagggcgcgggtatcggtgcaggcatttataaagataacaatgaggcatttgcaactcttgataaactggatgttatcgaaccgaatatagctaaacgtcaggaatacgccgacgcatacgccagatggaaatataatataaataacgatataataactttttaaataacaagaattatggcaacaaaagaattttttccgggaattgaaaagattaaatttgaaggtaaagatagtaagaacccgatggcattccgttattacgatgcagagaaggtgattaatggtaaaaagatgaaggattggctgagattcgctatggcatggtggcacacattgtgcgctgaaggtggtgatcagttcggtggcggaacaaagcaattcccatggaatggtaatgcagatgctatacaggcagcaaaagataagatggatgcaggatttgaattcatgcagaagatgggtatcgaatactattgcttccatgacgtagacttggtttcggaaggtgccagtgtagaagaatacgaagctaacctgaaagaaatcgtagcttatgcaaaacagaaacaggcagaaaccggtatcaaactactgtggggtactgctaatgtattcggtcacgcccgctatatgaacggtgcagctaccaatcctgacttcgatgtagtagctcgtgctgctgttcagatcaaaaatgcgattgatgcaacgattgaacttggcggagagaattatgtgttttggggtggtcgtgaaggctatatgtctcttctgaacacagatcagaaacgtgaaaaagaacaccttgcacagatgttgacgattgctcgtgactatgcccgtgcccgtggtttcaaaggtactttcctgatcgaaccgaaaccgatggaaccgactaaacatcaatatgacgtagatacggaaactgtaatcggcttcctgaaagctcatggtctggataaggatttcaaagtaaatatcgaggtgaatcacgcaactttggcaggtcacactttcgagcatgaattggctgtagctgtagacaatggtatgttgggctcaattgacgccaatcgtggtgactatcagaatggctgggatacagaccaattcccgatcgacaattatgaactgactcaggctatgatgcagattatccgtaatggtggtctcggtaccggtggtacgaactttgatgctaaaacccgtcgtaattctactgatctggaagatatctttattgctcacatcgcaggtatggacgctatggcccgtgcactcgaaagtgcagcggctctgctcgacgaatctccctataagaagatgctggctgaccgttatgcttcatttgatgggggcaaaggtaaagaatttgaagacggcaagctgactctggaggatgtggttgcttatgcaaaaacaaaaggcgaaccgaaacagactagcggcaagcaagaactttatgaggcaattctgaatatgtattgctaattaatatttaaaacaggcggtaaagcagcggtagggctgctgctttatcgcctgactttttctaatccaactactacactactttatccactttttaaaactatgaataatacaacgaacgaaggaagtaaactctacttgtattcgattacttctgttgctattttgggcggtttgctcttcggttatgatacggcggttatatccggcgcggaaaaagggctcgaagccttcttcctgtccgcttccgattttcagtataataaggtaatgcatggcattacttcttccagcgcattgataggctgcgtgctggggggggctttatccggtgtctttgcttcccgtttgggacgtcgtaactcattgcggcttgctgctgtattatttttcctctcggctcttggctcttattatccggaagttcttttcttcgaatacggaaaaccgaatatggatttgttgatagcattcaatctgtatcgtgttctgggaggtatcggagtaggactggcttcagcggtatgtccgatgtatattgctgaaattgctccttccaatattcgtggaacccttgtttcgtgcaatcagtttgccattatctttggtatgttggttgtgtactttgtgaactatctgattatgggtgaccatcagaatccgattattctgaaagatgctgccggtgtgttgtcagtaagtgctgagtcggatatgtggacagttcaggaaggatggcgttatatgtttggttcggaagccttcccggccgctttcttcggcctgttgctgttctttgttccaaagactccccgttatttggttcttgtacagcaggaagaaaaggcttacactattctggagaaaatcaacggtaagaagaaagctcaggaaattcttaatgatattaaggctactgctcaggaaaaaacagagaaactctttacttatggagtaacagtgattgtgatcggtattctactgtccgtattccagcaggcgatcggtattaatgcagtactttactatgctccgcgtattttcgaaaatgcaggtgccgaaggtggtggtatgatgcagacagtgattatgggtattgtaaacattatctttacgctggttgctatctttacggtagaccgctttggtcgtaaaccattgctgattatcggatctattggtatggctgtaggagcatttgcagtggcaatgtgtgatagtatggcaatcaaaggtgttcttccggtactttctatcatcgtatacgctgctttcttcatgatgtcatggggaccgatttgctgggtattgatttcagaaatcttcccgaatactattcgtggtaaagcagttgctattgcagtggctttccaatggatattcaactacatcgtatcttctactttcccggcattgtatgacttcagtccgatgtttgcatatagcttatacggaatcatctgtgtcgctgccgctatctttgtttggcgttgggtacccgagactaaagggaagacgctggaagatatgagtaagctttggaagaaaaacaaataaattaggttagtgtttttttatcatgtcattgtgacgtgagattattcagattatgacatcatgcaaattgtatggtgtcataatcatatatggatattataatctgtgaatcagtggtttattttgcattatctatttctggatactccgaaccatcccggcacaggaaaataaaaaggagaacggatatagcccggatgagtcagctttccttcatccacccgcttttgtaatctgcggagtgcagtggcttttcgaagtccacataatgaacaaagctgctgtgtggtaatacaagagttatctttgaaaaattcagctaatctcccatctatttctatatcgctcaattcctgtgacctgcgggtctcactgaccttttcaaaagttgtagcctttaattcgcgaagcaaatctttttccggagtaaaaacgattccactgcaatgaatattttcggcacggatttctttgggagaacgtacttcgggtgattccgctttgatacggaatgaaccgactcccggaatgtgaatactattcccgttggataattcttgtttgaaaacattggcaaactctataaaagaccctattacgtcgctttgtcttaaactacttctggactcaatcgtttcggctatatcttccagtgtgatggtgtcccgtacaaccagtcgggcatgatatctcgttttattggaatctttaggttggggagtcaggaagaaatcataaagtgcattcattgctttagttgttttgtgcgtatcaattagcagacttacgcagtcattttatttatttcgtgcctttctattgattggctcacattatgtgcaacagctaactcacatattgtgtaataactgtcgctcattatgtgcgacagctatcgcacgactggtgctacgcctaatatgatgcgtcaaaattactaataattctaatcaaaaacaacacttcaaaggcttatttctgttagatcatttttcaaaaaagaatgagtcagcttatttgcaaatccggtattcggtagtctatttttgtgtctcaaacctcacaataattttaaaaaacagcaagtatgaaaacaataattagagaaatggtagagacaataaaacaattgtttgcgcagaaacagcaaatgcaggagccggtagttgccaattacgaggtatccgaaatcgtggaacaaaagacactgaagaagaaggaagagtctgagaagacaggtgaaaaaacgggtaaatctaataaatggagtcaatcgttgactttgcaattaaaagagtatttgaatgacaattttgatttccgttataacaatttgacaggagctacggaatatagggagaagagtggaaagaactgtttccgacctattgatgaacgcgaaatgaatggaatgattgtggatgcccgcctggaaggaataccttgctggagaggggatgtacccaccatggttctttcaaacaaagtggagtcttataatcctttccatctttatgtaaaggaattgccgggttgggatggagtagatcgtgtgacccctttattgctacgtgtttcagataatgagatatggctaagaggaggacgttgctggttacgggctatgctttcacagtggagtggggaagaacgtctgcacgccaatgtacttactcctgtattgataagcgggaagcagggattgagtaaaagtactttttgccgattgctgatgcccgactcattacggcattattttattgataatctgaatctggcagcaggcagttcgccggagaagaagctcgtgaaaaacggattgattaatttagacgaatttgataagattaaagagagtcaacaggctacattaaagaatcttcttcaaatggtgaatgttcccgtttttcgtggcaagcgactgggatgggtgaatgagtcccgtcttgcttcttttatagccacaacaaatgtctatcaggtattgattgactccacaggaagtcgtcgttttctgtgtgtggaggtgttaaaacctatttcggaagaacctttggagcataagcaaatatatgcgcagctgaaagaagagctgaaatccggcgcaccggattatttaaacaaagaagaagaaaaggctttgcagaaacataacaaggcatattatcgccaatccttactagaagatgtgtttcattgttgtttccgtcatcctttggaaacggaaaaaggtatctggctgacaacagctgaaatatttcaagtgatgcgtaaattcaactctgcagctttgaaagaagtctctgcacgtcaattgggtctgaaactttcagccatgggatatatggcaaagcatacgtctttcggaaatcggtattatgtgtttaatctttcggctgagaaaaaagatgcgtcattataatacgttattatacaggtggttattgtaaaaagtgatttgctgatatatacattttatgcttactccttgaaaaaatacctaattaattttgcggattaaaatattgttcgtagttttgcgaacaataaataaggaggagatattgaagtgaaagaaaagcagtatacagtagagcaggagcagatagctcgttttgctaaagctatgggacacccggcacgaatggctattcttagtttcttggctaaacaggaaagttgtttcttcggagatattcacgaagaattgcctattgccaaagcaaccgtttcacagcacttgaaagagctgaaagatgcaggattaattcagggagaaatagaaacgcccaaggtgcgatattgtattaataaggaaaattgggaacttgcccgcaaattatttgctgcatttttgggagattgtaaatgtacaggaacatcgtgctgtggataacagcacttttttttaagaatattgttcgtagttctacgaattacgattaagagataaactttaatat

SEQ ID NO: 265 - DNA, 7354 bp, Bacteroides thetaiotaomicron
atactatattgatcaaacacatgcattttcatttcttcatcgccaaaatctgtatttaatagacttttatctatttcgtatctgaattcaaatcacaaaatacaaaattaagtgattatatataaatgataaatatattcttagataaatattcatcattcataaacttaagttcatcaacacctctatatttgcattttttattactaatacatattaaacgcatagcattttccattacatttataacaaaaagcctaccataactcataataaaacgaataatatgcatagtaaaaatgatttcaacattgaaaattacataaaagctctatccacatacataccagcgtcctccatggtcaaactaaaaaaagcatataaagccttcacttttacaaaacaccctaaatcaactattcttgaaaacagacaactgaatgattcattttgcatccttatatgtgggaccataagacattacacaatagatagtaacacagcagaagaacaaacattacgattcaccctctcaggcaatttactgtgtcaatatggaaccgctacagaagcaacagaatatttaagctgcctatctgaatgtaccattttatctgtctcaaatacaattttagcagagataggagaagaaacaaatttgagaatatactgtcaaaatattataaaagaaaacttagagttagaagtggctctattaagaatgccaccagaaaagcgatatataaaactatgcaaacaatatcaaaacatatttctgacggtcccattaaaatacattgcgtcatttttaggaatcactccccaagctttatgcagaattagaaagcgtttactaataacaccctaataccactgaatattactttgcgtctgacttctctgctcatatttcaagtcttgaagaatacttgcattagcacgaatcgtaacattatagtatttccaacgtccaaatggtgaaagactggcagacaagttaaagcagtgcaaatcacgagaaatcgtacaggaagtctgcgttatttccttcgcttggaaatcgtaacccgaattgaacgaaagcgaccagttattggaaatcttcacattaccattcatattgatattgtgagtataagtaaacggatatctcatcgaatagcgattaataggcttagtcctatcttcacgaatattaaatgaataactgaaacttaaagaccaaggcatcttgaatacttgataaccatccgggtcggcttgcgccttctctactttcttggtcgtagttccatcttccgtaccttcagaatcttctccgtctccatcttctgactccttcttgtctttatccttctcgtcttccttcggaccgaaccactttttccaggtatcgttattaaaggtatagttaaaagaagaaccatacccctgaaaacgtccgaaacgtccatacgaccattcagttcgattaccttcgaccacattaccacttttatcaaacgtataagcgtaagtagcaaatgatgcattcatattgaaagtataattctttgtcagtttcagtcgaagattcatactcaaggggctccatggcttttcctttgcagccatattatatgacatattcacactcaaatcatcaatcaagctgactttctttaatgtatccttcttagcatcataatatttcatctccagattattagcaatcgagaaactaaccgttcccgaaccctcacgtgaagggactccaaaaggctgtcccgtatagggtgaataatactgagtatttccgttattatccgtatactcttcccagtatttactaaatgcaggagcaccactgataccaacctgcggagtgacaacgtggcgaatctgtatctctttcttcttcatgaaaagaggtttgtacataccatacagtttagtacttaaagacaaactggctgaatagttggaaacacgataaaagccattaatagtatcattcagattctgttccaaacgccctgtttcctcattatacgtctgatttatcttgcgggtgtaccaacgctccgtataattcaccgaaggattgacctgcaaatacttgaacagtgtaaaagtagcactgacaggaatattatggttcatcgcattttcccatccgctgatgccggtcttgaacagacggtcgtctttagtacggatactgttcgtcagacgtcctgtatagctgacagaaatcttctcataccaacgctcggctccggcagccttcttccgcttgaagggaaacagacggctcaatgtaatattaaggtcaggaagcgttactgcaatggatgagtcacgcatggtctgcgcaatattggtcgttccagacaaggtcagaccgatatcggggaaactacgggagtaactgatacttgatgtctttgtattctgagtcaacaactgggagttataaaggttgttgatgttagatcgttcgtaactactggtagagaagttcacactggcggagaaagtactgttcggacttgccttggcatcctgacggtggttccacactaccttgaagtctttggcaaccgtataatccggcattcctttgtctccggtcttggtcacctgataatccgcctgcaatgtaccggagtatttgtacctcttattataattggtcaatccggaaagccgccatgaacctttcgtgaatatatctcctgtcagcttcaagtccatgatgtcactcatagcaaagtaatatccgccttccgccagaccgaaaccacggcttgaatcatccatatacgtcggcataatgaaacccgaagaatagctgctggagaaagggaagaagaaaaacggcacagccagcggcaggggaacatcttccaccacaagataggcaggtcctgtcactacattcttcttggggcgcactttggctcttgtcaactgcatatagaagtgaggatggtcatgatgatcacaagtcgtgtagcgaccgtgctccataaagatttcatcatttgctcctttcttggctctgctaccggtcacataaccttcaccctgttgagtgataatatcggtgattcccgcttttttgctcttgaagttatagctgattgtttctgtatcgtatgcagtttcaccttctttaaagacaggtttacctttgatcgttcccgtcgtgtctttaataccataggcgtgtactgtactactgtccagattcatggaaatcacttccgctgccagctcaatgttctgatagttgactttgccgctaccataaagcgtagcggcacctcccaatgtaaaagtggtggagtcgttagattcataaataaccggtgcatcgaacggttgtttctttgtcggtgctacagagtcaacgcgtaccacaactgtatccgcccctaacgaatctttcctgttaagggaatccgtttgtgcagtgttggaggcaatcatccctcttcttcgacgctgagacgtagcctcatcaggaagcatcagcaagacaatcagcaatatgaatgatataattatttttgctctcaatggcgccattaactaatagttttacgcttgaagtggcaaaagtacacaatcttcatcaataatgcgtgagaatctccgttatttaattattttttagtgctataaaaacaaagagcaccacccatcaaagcggtttagaccttcttcaccatattttgcaatgcttttccgggctttttctactgtcttttcttcgtcaagatgagttttagaaaagaatttatcggcaaaacagattatttgctcttccagagtgacgggcaccatctcacgatgaggaacaggaagctggcgttctatgatttcttccagtgtcagtccggctccggtgtgacgttcgcaaaccagtgcatggcgttcaaaaccttcttttcgtaaaaggtctgcacccagatagccgtgcgcgatgtagggatgctctccgaaacattggatggtgggagcatcggtcataaagattcctatatcgtgcagaagcgcggcttctctgacaaagctgcggttgataggtaagttaggatgtgcatctacaatcttcaaagctttttgggctacagaaaggctatgtattagtagaatgtgtcgttgttccgtatcctgcggataaaatttgtcgatgatttctattggattcatactttttcactagttattacttgttcccttactgataaatgatatttttgtgcaatattacaaaaatttactgatatgcaagccagaagttccctcattcttttctctctgttcataatactgtgttctacatacgccagtggaaaagtaattacgggtgccgagcgtatggatcaatacctgccgttaatcaaaggaaagcgggtaggaatggtggtaaaccacacttccatcgtcggcacagagccaattcatctgctggatactttattaaaacaaaaaatcgatatagtgaaagtctttgcaccggaacacggtttccgcggcaacgcggatgccggtgaaacagtaaaagacggaaaagacagccgtacgggagtaaccatcgtctcgctctacggagataataaaaaaccgactgccgcccaactgaaagatatcgatgtaatcttgttcgacatccaggatgtgggcgcacgtttctatacatatatcagtacgatgtattatgtaatggaagcttgtgcggaaaacaaaaaagagatgattatactggaccgccccaatccatgcgattacgtagagggacctgtattaaaagccggatataaaagttttgtcggaatgctgcctttgccggttcttcacggttgtactatcggagagctggcgcagatgatcaatggagaaggatggatgactacccaggcaaagacttgtccgctgactgtgattcccgtaaaagggtggaaacacggacagccctatgcacttcccgtgaaaccgtctcccaacttgcccaatgcacaatccatccgcctttatgcctcactttgcccttttgaagcaacacgtgtcagtgtgggacgcggaacgacctttccttttcaggtgttaggcacacctaacaaaaagtatggcgattttgccttcactccgcgctccctgccgggattcgacaaaaatccgatgcacaaaggagtcacttgttatggcgaagatttacggaacgtaacagacgtaaacggtttcacgctccgttactttctgcgtttctaccgtttatccggcgaaggcgcagcattcttctcccgtccccgatggtttgacttactgatgggaacggattcggtacgcaaagcgatccttaaaggagaatcggaagaggaaatccgtgacagctggcaaaaggagttgcagacctaccgtgatatgagacagaagtatttactttactaaggaacggttcctccacttctcagcattccgttcgaactcttcggctttctttccactcaaccttgcaggcatttcaagtatctccggaatgtcttttgcattgtcaatgatttgagtgccggaagcgttcttcacaatacggacatcatcgtacagtgagtcattctccagataagcttgcatccggagcgtgtctcccgtcacgtcgatatgctggtagaaacggcggtccgtcccgaaacgatcatacttatcattgaaagatagacggtaactcttcggggaagcgtggcttaccagatacaacggggtggtcatttcgccctcatcgttcttattagtcatacgggcatagttatgctcatgtccctgaagcaccaagtctactccatattcacggaacagtccgtcgaacatccagcgtacggcaaggttgttcgttttaccttttatagaatatacaggatgatggagcatgacgatcttccatttctttttcgaagccttcagcgttttctccagccattcccgttgagagaagaggaaccaaggatcacggttactatccagcgtgatgatagtggcatcgttgtaatcaatagaatatacattattattcttatacctcgattcgagcagataagaaaagacataagcaaatcgtttctccaaaacacgtaccagtccttttacatattcatgatttcccggagaaaccaatatcggtttggtgggagctatggaatccacgctctgataggcttcatcccagtaacagttcatcggacgctctgcaaagtcaccggcaaacatatagaagtccgcctgcggatagcgatggcgcacattttccataaagccacgtgtctttccacgcaaagtatcctgcacgtcacctataaatacaaaggagaaatgatcagtcgaatcgggttgcatcgtgaacgaataccaatcggatgagcgatcgtcattccatacccgataagagtaggaatcgccataagagagttctttaaattttgcccagttggcataaccgaacccgcccagtgtacggagaaatttggaagagccgtcaacgagaagagtatctccggaaccgatctttgtatattccagctttgcctgcttggaaacgcctccgcacacccagctcacattacgggacagttcgccgtcatttccgaatgtcagaaatacccgttgcgggtcttccgtcagcacatagcgtatttcagggatattgtggaaccagactttccagcgtatcttacaaatgacaccaccggcaatcaatatcaggagaacgatgccccaagctattttcttcttcgtaatcttcatttttccgattttaaaaactggtagcaaagataaatatagtgtcccataaatcggaaattatgtccttttttaacctttaacaaattcacctctacatgagaatttaaatatctaaaattgctgtcatctgtcaccaaaagctaaataacacactgattataagctaataaagaggtgacagcagggcgtgacagcattgtgacagcacattttgttgtcacaatgccgtcacgctttgctgtcatatcctgctactatcatatattgctccttggaatgataaatcaaagaatagcttagtctagttggtttccatgcgatgaaactatagttccaaagcattgaaaccaatagtttcaagccgcagaaactttagttccaagctgaagaaaccaaagtttcaagcagaggaaactccagtttcaagacgatgaaactaaagtttcatcaagcaaaaaacaatttctacaataggaaactgatgtgtactggttttagttgacaacttcgtttgttataactgaattagtttactcaatatactttaatatctaaataggtttacttt

SEQ ID NO: 266 - DNA, 7327 bp, Bacteroides thetaiotaomicron
attcagcctatagtcatttaagactagtgtcaaagttagttcactgcaactctacttttcaaatatacacttatattttgttgtgatatttaatactgcaaatgtaaatgtgtcaaaagtcaatagtcaccccattttagttactattggcttgacacacactcttttagtttgtattggatattataaatggatgaaaccagctaatatcccggattctgttccagttttgtattcattacccgtatcttttccggaatcgggaatacggtggtatatccattattctcagcaggaagttgcggacgactgctgtatgctctcgtgaacgctccgaagcgaatcagatcctgccgtcgccaaccttcccaagccagttcgagctgtcgttcggcaaggatattttctaatgtagccgttcgggaggaagcgttgacacgcccgcgtacttcgttcagttcggcatctccgtcttccccattacgaacctttgcttcgctcttcatcaacaggacatctgcataacggaacagtacaatgtcgttctccatcagtttaccgtccttggtagccgtttcgtctacttcgtactttttcatgcgtgctcctgccgtctgctcatagggagtattcgagatatccagttcgactttccacggcaaatattcgagaacggttccatcgtccagacggactatatttccttttaaatcatatacgactccggcaaaatagcagatatcgaaacgcgggtcctgttgcgctgtttcatagccgaaggtttccagaacttcgatagtagcgctcggtccgttttcaccgctcagtccgtaggctttggcgtgattgtaatggcgggaacggaaaaggtattgcatctggttggtgtacaaggtcttgttcatcgggatggtgaagatattctcaacagacggttcgttgaatacggcaaagttgtttttgtaatccggttccagacgatagcccatttcttgcagttggtcacagtaagcgataaccgtctgccaggcattgaggcggttgccgtctacttcgaaaaagagattctttccgtcgggacgctggccgtccgtccagtcgttgtcggcatagacttcggcattcaaggcaagctttgccaagaggaaaacaactacgggacgggtgattcgtccgtaatacggaccggactggttgctgtggacttcggtcagcaaaggggcggattcttgcagttctttgaatacaaagtcgaatatcgttttccgttcgctctgcactacgtctttcatcgatggggatgaggtaagtataagcgggacacgtccgaacagatccatcagataatagtaatacatcgcccgcatggcgcgtacttcggcacgataggcgggaagttcggcgtctgcgtgggtagcactgaatttgtctattcgttcgagggatttgttggacagcatcaccactttataaagatattcccaagtggcttggatggcatcgttttctattccccattggtgcaggaacagaccttgccaaaagccgccgtcgtaccaatcaccgccacgggtggggataatggcttcgtcggtggtgaaggtgttcaggtcatagactcccctacccgtcccctgcaatccctgactgtcgctataaccgccgatgtaggtgtaaagtgaggctacggcattcagatatacatccgagatattgttgtagacttcatcttccggcagtttgtctttgggactctcttccagaaacttgtcgcacgagaagaaggtaatgcacacaataagaaagacaactgtttttttcaggttcatcttcccctcaagcagattccccccaagcagagttgcttttccatcatatagagatttactctctaaataccatccttgctgctgcaaatatcgctttatctttttcattattgttttcctcctccgttaaaagttaatactcaatcccaacgtgtaagtccgcgctaacggatatccgcgtttatcgtccagccccaaagtggagttgaccgtcgaactgttgatcatgggcgaaagacctgaatagccggaaatcgtcgcaaggttgttgactgtaaatgccagtcgcagggagcgaacatatttctttagtttctgcaccttttctatcggtacgttccagccgagtgtcacgtagtcgaaattgacatacgctccgttttccagccagtagtcggtggcggtctggtctttgatattgcgtgcgggagcttcctgcatcacattgtagtcggggaatatattcatgttcatataggtcagggaggttccgttgtatattttgtgtccgaaggcgccgttgatctgtactgaaatatcgaaacgcttgtagcggaaactgaggttcgatccgagaatcgtttttggtacggcttgcccggctacatagcggtcttcgccatcttcgaggctgacgccgccgccattgaggtcggctatgtcataggtgtagccgccgtttccgtcggaaacgagtccgttggcacgtggcaggtagaagacacccagcggctggcctactacttgataaacgatgtggttataacctccgtgaaagccggctccgtcgaggctggcgagactcttgtattcgggggcggaaatcagttcgccattgtacataccgctcagagaaagcaacttgttctgctggaaggtgatgttggcgttgatgttcagttccatgtcctgagtcttcaacggggtgatgccgatggctatctccagaccgctgttgcgcatggagccgatattcgccaacagggtgttgtaggtaaagggcggtacgcttacgttgtagaggtagagcatatccgtcgttttggagttgtaataattggcggagagcagcaggcggttgccgaacatggcaaggtcaatacctgtattgaaggtatgtttcacttcccatttcaagtcgggattcgtgtttcgcaagtctcccaatgacacggctgccgagtttcctacgggaatcactccgttcggtttgacaaggctcagcgtggtgtaggagtcgataccgctctgattgccagccaaaccgtaacctatacggaacttcagattatcaatcacggggaggcgtttcatgaacttttcctcactgatcacccatgcagcggagacggagggaaagaatccccatttgtgattggctccgaatttggaggaggcatcggtacgggcggtcattgtcagactgtagcggtcggcataggtgtagttgaagcgtcccatgaaggaggccagatgcggttgctcgtagtacgagttggttccctcccacggacggagagcgccggcttgcagattgtggtagccgaatttatctgtattgaagttggtgactgtggtatagaatccggtgtatgtctccttctggagttccgccagtgccagcgcgtcgaagtaatgcttcttccagcctttcttgtaggtcagcatcatgttacccaggagggattccatctttttcgtgcctttgtatgcctgtccgtgcgcccagacggaggtgggcaggtattgggaattttcgattatgttataggtataagcaccgaagagaaccagtttcagttcgtccatcagattgaaagtcagacgagcgtgagtactgatatgcgaggtggcgtcatgatcctgtacttccatccatgccaacggattcgtgatctgactggcggtagtgattccgtcccatgaaccggaatcggggtctttgtgattggggtatgtgggattgaaagtggcggcagaatagaaggttttctgaaggtctaccagattgtgattcttctggatagaaccgaacatgcccagttcgcagttcagaaaaccgtcgaacatcctttgggtcatgttcatattagaggtgaagttcttcatgtcctcgttcagtatgactccctgacggtccatgaaaccgagagatacacggtagctggattcattcgagcctccataaaaggcgatgtggtggttctgttgcaatcctgtctgttctatttctttctggaagtcggtgttgtttcctttgtccagtatggagatgccacgttcagatgcgacccggcggaagtcatctgctgacagcattttcagattcttatagacggtggatataccgaaaataccgttataactcacttgcgttttaccgctcatccccttcttggtggtgatttcgatgacaccggaggcgcctcgtgatccgtactgtgccgtttcggaagcgtctttcaggatggtgaagctctctatgtctgtaggataaatggaggtaagcatactcaaatcgccgaagactccatcgacgataatcagcgggtcgtttccgctggtcaatgaggtggttcctcgcaggcggactgcatctaaggcggcgggaccgtttgtcccacgctggatggtcagacccggtactcgtccgcgtatggcttccagcggattcgtgatctggtctttattcatctgtgtctccgtgattttctccactgatccggatatggtttttaaacttccggtggcgtatcctaccgttatcagagagtctatcggagtgatcgtttttctctgggcaaaggcacttccactggaagtgatcagaaagaaaaggctccaaatagtaagtctgtagtgttgtttcataattatcattttttaagggataatacaaatataacaaaaaaaacgggcatctggttgtccggatacccgcttttctttgatatgggatataaaaattatattgtcaacgtagatgaatacaacaaaccgcttgattggggaaaatcaagcggtcggctatatctgactgactatatcttgggggatatactgtggtcaatcagattgaaacgggctatcgtttattctcaggtttattcttagaaccggattacgatttagcacctttttcctgtccgtaaccgtatccgtagccatagcgtttgccatatccatagtacttgccatacttaccgtagccgtagtagtagccatacttcctgcgtttcaggtctacgccattgattacagtacaaaggttaggcagtttcttttcttcggcaagttcgttgatcagtgtgtactctactttatgggtatagtcggcacggcatacgtagacggacaagtccgctacacgaccgatcaataaggtatcggtaaccatacctaccggtgcggtatccagaatcacatagtcaaagttcttcttcaatatctctattgccttgtccagaccatcacgcgctaacagctcggtcggattaggaggaaccgttccaccgggaaggatatacagattctgattaatatccgaaggttgtaccagactcatcaaatctgtttccgggtttgcaaggtataaggtaatccccttctctttcgtcgaaagacggaagactttattcaatcccggtttgcggatatcaagccctacgattactactttctttcctaataaagagagactgatggctaaattggcggagataaatgattttccttctccactgacggtagaagtcacaagaatcactttcttgtcattctgaagcatgaactgaaggttggtacggatgtttcggaaggtctcgctcatcaggttgttctgattctcaaagacggcaatagaaccgtctttttcgttcttctcgtcggttaatgggatatcaccgacgataggaatagttgtcagtttctcgacatctgcacgaccttcgagtttaaacttggtcaggccgatcaggtagatgatgcctacggggatgccaatgcctaatactaaagcgatcagataaatcattctacgcttaggagaaacagggatatcatcagcgatagcttcatcaatgatctttgcattgtttgcagtagctgccaatgctatggcgttctcctcacgcttttgtaaaagcatcaaatacagtccggctttgatttcctgttgacgggcaatacttacaaactgacgttcttgtccgggagcatcactaatacgacgagaaaaacggcttgcttcacgttcaagatcagcttttgtaattaataaacctttcaatgatccgtcaagggtcgcctgcacattcgacttcatggcacggatgcttgtatccagattgataatcgtaggattattttctgtagaagtacgtaataagcgcttccgttcaactaacatttcattatatcgttcaatcgttgcaaccaatcctggatcttgcaagcctatattacccggaagaacttcgtattcatttcctcttatatatttccgcaaatcttcaataaggctgatttgtgtccggttctctactctcttcttttcatattcggcgttaccggtcaaggcaatttgcgcttcactagtcaagtcggtaataccggcattacgtttaaaattctcaagatttgcctctgtactcccaagctccttggaaataatattgatacgttcatctataaattcagcagtcttttgagcaatctcatttttatcattattcgtattacggttatacatttctaataattgattgataaaatcttgcccacgttgcaaactagagttcttcaatgaaatcacagctaccgaagtcgttttagaagtaggctcaatttttaaattttcacaatacgcccgtgctactttcataggtgatttaatcttagccgtaatatgccgtatatttgaagacgcttccattgtatctttcttcaatgataaggaatctggcgattgaaaaaaagctaaagttccctcatccatcgggaatacagctggcaatttctcaaaatgcttttggtattctttatcaccaactgtaacatttacctccaaaccaccttctccatacaatgccatctcaacaaccataggatcagttagtttctcagcttcttgcggagtcaaactaactaaaacaggagaagttttatacatattctttgaaggaaatccatcttcatctgtatatgatacatataagtttaacagattgattacttctttcactaaagtctttgaacgtaaaacttcaagttcattatctatattctgagaagaactaatcaagccacttaaccctaattcttccagtcctaccatacttcctgtattgccaccttttttgtcatcctttatcaaaactgttgccgatatattataaacaggagtggccatacgcaaatatatccaagctccaataagacaaactaaaacggcaccgacaaaccacggccaatgaataatatatttaaaaagtaattgt

SEQ ID NO: 267 - DNA, 7204 bp, Bacteroides thetaiotaomicron
agtatatattacaccgatcaataaacctattcatcgtatttcttgggatacttacgaccggaggattcacctcatgcaattttttaagagtcgacgactattttgacgatacaatgaagtttgacagtatctttactaaatacgagtatctggtacaatatatgtggggaacatcagatcagttccccgacgagagccgcatccttaccgatccggtcactcccggtccgatggctacggatgaagctttctcaagtcagaatccggagcatggccttcgcggactctcctacattctgggaactattaatgccgataacatcggtaactatagcatgaatatatggtcgtccatgtataaagtgatccgtaaatgtaactacatactggcacgcaaaggagaggctcacatgaatacaatacaagatgaggaaatcactggctacacccacatgatgcgtggttatgcttattacaatctgatccagtcttatggtccgtgcattatactcggtgatgatatcttacccaataatgaattacctgaaacttacaattattcccgttcgacttatgacgaatgtgtggattactgttgtaatgaactggaacttgctgccaaatatatgcctatagacttaaatccgactttttttggacgtccttcacgtggtgctgcttttgcgttgatagctcgtctgcggttgcaacaagcaagtccgttatataatggcggacaggccgcacgcacagctttcggcaactggaagcggacagtggacggagccaactatgtgaatcagaactacgatgaaacacgctgggcagtagcagctgcagcatgtaaacgtgtcattgagatgaacaaatacaaattgcatacttctcccatcgatcccagcatgcctccccgagtattgccggcttccgtgacaatcactgaccccgattttcagaatatcgactattatcgttcctattcagaaatgttcaccggagaaacgataggcagtaaaaatccagaatttatctggggtagacagtcggatgctatggcaaacatgacacaatgcagtttcccgacggaaaaagcaatggggggatggaacaacctctgcgttactcaaaaactggtagacgcttattatatggtggatggacgagataaaaatgatgcaagtaaagaatatccatatcatgtagcaaacggtatagtgaccgatgattacttttccaccagtgcagaggagttctccggctacactattccgatgggagtatacggtatgtatctgaaccgagagaatcgtttttatgctacaataggttactccggacgttactgggcagcacgttccaatacccaagaacaatatggcccttatagggcgtggtatcatcaaatggtaacttcaggacgcgatctgttttccgggaaaaattccgccataaccaatcctctggattatccggcaacaggatatgtgctgactaaatggatccatgcggacgacgcatggataggaaccggaagtatgcgaactaccaaatattttcctatcatccgatatgcggaaattttattaggatatgtagaagcaataaatcacctgagtaaaagctataccgtcgaattacccgcaatcaatggtggaaataatgctccgcaaagctatacagtcgaacgtattccaactgaaatacaaaaatacttcaacccgatacgaaatcgcgtcggtctgcctggattatctgacacagaagccgcatcagatgaaacaactttggacaacatcatcaagagagaatatatgatcgaattcgcttgcgaaaaccgcagatactttgatgtacgtcggtggggcatatatgaagagactgaaaaaactggtgtttatggaatgcgtttgggaggagataaatatacttattatcagaatccgattcctgtgaatcaggttaacaaccgaaatcgcgtgatagataaaagactgattctattacccttgcccaaagctgaagtacgtcgtgtagaaaatctcgaccaaaacccgggctgggagaattaataatttacttcgtattaaaacataaataaccatgaaaacaaaatatatttatatagcttttttaacaatcttatgtgggggaagcttggtggcatgctccaatggcgacgagttcttcaaggatgaacgctacaagaagatgatctatgcaatcagcgacaatgagcaaatatttcacgctgaatttgaactgaataatgaagaagatatcataggcgtgcagcctttcgcagtaagcggcactaatcctatagatcaggatgtgcatctgaccatagaaaaagatccggagctgttgacggaatataactataatacctacatggatgaaacagataaatatgcccgtgagctgaaggacggggattattcacttttatcttctatcgttgaaataaaagcaggagtgaaccccagctatgaagtgggaaaattacaagtgaaaataaagacatcgatcattgaaaaactatccgttgactctgcttactttctttcgttccgcattaaagaggcaacaccttacgaaatcaatgaagaaaaaaggaatgtattattccgaatttataaaaagaatcagtatgcatcccaaaagacacccacttactatgcctcttccggctttatggatgatgtcgtaatgccgttcgactctaaaattatcatgccattggcatataataagatacgcacttacattgccggacaaatttacgatgcgaatgataccaaagaaacaatcaacaaaaattcgatggtaatcactgtagatgccgataaccaagtactgatatctgctttcgattctgagaatggattaaaagttgaaatgttatctccaagttctgatcccaatgatggctcatatggatatcggaactattataatccagaagaaaagcaattctacttatattatcgttttgataatggtgaaggctggaaggttgtgcgtgaaactttaagagccgaatctatcataagtaaatagtgattggcgactatagatattttttcattatgcgaaaagaaacagacgaatattgctgtgttttaataaaaatacactatattgcggtattgtttaaccttaaaatatgatagccatgaacacaaaattattcggtttgtttattgcattgttggtatgcctgccttcgcttgcccaacaaaagcctgtggagaaggtagatagtgatggagtttatctgatgcccgatcaaatgccggagtttccgggcgggatgcaggcgatgatgaagtttttgactacaaatatcaagtatcctgtagaagcacagaagaaaggcgtttctggtcgtgtgatcgtacagttcgtcattatggaagacggaacattggatcaggctaaagttgtaagaggagtcgatcccttgctggacgaagaagccttgcgtgtagtgaagttaatgcctaaatggaaaccgggaatggatagaggcgaggcagtgaaagtacgttttactgctccgataatgtttaatctgtccagatcggaggcacagagacctacttttcccgaacttgtagtacctatcggacaagaagtggaaaacaggtctttgcaaggagtatggcagagttgcgttgtgcaaccgggcgaacatggatataaaattctgttattgcctgttttaaagatcgtatcgcctgatcagacattcatgaatataatgacagccggtatgaacggcaggtcaaatgccatcatctattgtcagggagagtacagtttgccgtcggatggcacttacgtggagatggtggaaaaatcggttgatccggttttcatacaaggagtaaagaatgaaatcagtgtggaacgattgcatgataatctgattaaattgtcttttacggttccgggacagggaagaaaagtgacggaatattggttccgggccccttcgccggatgtgaagataatggctgattgatataataatattattttaggcacggatttcacagattacacggtcttaatgaataaaagccgtgttcatctgtgaaatccgtgcctaaaaagttctctgtactttcttatcttcgactcagcttattattaattcttaaagaatccgttatcttcccattttcccgcttcctgtggctgtgctgatgtggcgcttacatcgataggcagccatacttccatgtcaccctcgccccgatgtgcccaggcataatagggtatcagtgtgagttctacgtctttagttaccagttttccagctttgtcataacttaatgcctgcgcatcggtcgttatctgacggatgccgtaaagtaactccggtttgtctgttaccttgaattgcggatgctggttgagaagtatgctgtggacgttgaatctgttgtccggccattctgcgcaataaacgatggggccgcgttcaacggcaacacgtccgtgatcggcttctacttttggatttgcctttactattcgggggatcatgtcgaaatgtacctctaccacatctccctttttccatttgcgggcaatgctgagatagccatcattgacatcgctttctactgtctgtccgtttacggatacttggtaggcaggtttctgattgtcggcgtaagaatacagatcaccgggaagtacattgccgcgtacccagccggggatacggagtttcatggtgaagtcctgattgccctgcgttattttcaggcggatgtcgccattccagggatagccggtttcttgttccagcagaatctttttcttgtctacctttagctcggctttgttggaaagataaaggttcacgtatacctgatcgttcttcacggcatacacatatcccggtaatgacggaatgaaacggctgacgtttgaagggcagcaggcgcagccgaaccaaggtttgcggctgtattttccgttagaagacagcgggttggggtagaagaaagaacctccgtccagtgatacacccgatatcagaccgttgtatagtgtgcgttccaggacatcgaaatatttggcgtctccgtgcagcaggaaaagacggtagttcatgtatacattgccgatagcggcgcaggtttcacaataagcggacaggttaggcagctcgtagttgttgccgaatgcttcgcctgcatggtgtgcaccgatgcctccggttatataaatctttttagaaacgatgttgtcccaaatcttgtctatcgctttgatgtagctgctgtctccggtgatggctgccacatctgccatgccggaatacatatatacggcacgtacggcatgtcctacggcttcatcctgttctaccacaggtttgtgtgcctgactataggtgtctttccggctggtatatccacgggtatccaggaagaattttgcctgatcaagatactttttgtctcccgtcgccatgtatagtttgactaaagccatttcggctatctgatgccccggtacgtatttcttctgttgagggccgttgccgatttcgcggcagacacagtcggcatatttaatggcgatatcgaggaagtttcgttttccggtagcctgataatgcgctacggctccttctatcatgtggcccagattgtagaactcatgactcaggttctctaccgctacccaacgctcttttcctgcccagttgtgcgggtgcttcgggttcatggtgcgggctgtataaaggtaaccgtccggttcctgtgctccggcaacaatgacgagtacgctgtcaatgtacttttgcagtttcttgtccggataggtttgcagagagtaactggctccttctattgttttgtatacatcggtatcgtcgaaagagaagccctctactttgtaggtatcgctgggatgtgctgcctttacaaagttttcgtaacgtcccgtctcttcacatttgctgaatgccagagggatggttacttcacggcttgcttgaaggcgctgtccccaaaagttgtccgtcactttaacggaagtaaaggggacagggtctataggatatccatgatttatttgcgcgctgcctgttatgcagatgcaggtcaggaatgtcgcagtcagaatgtttttcatcttagtatttattttagtatgaatctctgttgcggtgttatggtgtagggattacctgtttgattgttccgtccggattgaattccatccggtcaatacatacttcgcggtgccagcccggtccgtcattcagatggttcttgttgatacggtggtatacgatataccatttgtcttttcccggtacttgcaggatagagttgtgggcaggtccgtagatctcttcttttggattttggatgagtactattggttctttggctacttcgatcggacctagcggtgattgggcggtaccataaactacgtggtagttgggtgagccggtgtcgtctacagaccagaagaagtagtaaattccttttctataaataacgtaaggagcttcacggtatgcgtaagtctgcaaagtccctcctttgggagttaatactaccgttgtctcttctttgatggacagcatgtcgtcgttgagctcggctcctgccatgtagccgttaccccaatagaggtagcttttgccggatacggggtcggtgaatacatccacatcaatctgctgtccccgtcctgtgggagaagaggtgatgataggtttgcccagatctgtgaaaggtccggtgggggagtcggctacggcaactcctatttgcttgcctttgttggtcgttgggttggcactataataaaagaagtatttatacttcccgtctatcttcttttcttcgatgcagggagcccatgcgtttccgtttgcccaagacacatttttgcccatctccagaatcacagtctcttctttccatgtttttaaattcttcgatgaaaagaccttaaaataacttccgccccatcccggaaatccgtcactggtggggtaaatataatagcgttttgtctgatgagaatacagtacttccgggtcggcatggaaccccggtagaataggattgccggatttcttattctgtgccgttacttgtactgttccgatgagtaataagtggaatagaaagattctggtaaataaatgcttcatgat

SEQ ID NO: 268 - DNA, 7158 bp, Bacteroides thetaiotaomicron
aattaatattgtctttatttttatttgtctctttctaaatgtcagtcgttcgacttgcaaatataattaataagttcgaacgattcctctttttagaaaaaattcgcactacaggttacagagagaaaatgaagaatgataaactatagaatgaagaatctccatgcaacttaaagctaaacgaagcaaattcctcattcttcatttttagttctccttttatttgattagctccgatgtaatgagtaattttgcacccgtttttaaaagaacattataaaaactactaatatttatggattggttacaaagtttattgtgggaccctagctccgtagcgcacattgtattcctctacgcttttgtagtggcagccggtgtgtatctcggtaaaataaagatattcggagtatctttgggagtcacttttgttttgtttgccggcatcctaatgggacatttcggcttcacagccgatacacacatcctacatttcatccgagaattcggattgatcttgttcgtattctgtatcggtcttcaggtggggccatcattcttctcttctttcaaaaaggggggaatgacattgaacctgttggctgtaggcatcgtagtgttaaatattgctgttgcattggggctttattacctctggaacggtcgtgtggaactgccgatgatggtaggtatcctctacggagctgtgacgaacactccgggacttggtgccgccaatgaggccctgaaccagttgagctacaacggaccgcagattgcactgggttatgcctgtgcgtatccgctgggtgtggtaggtatcatcggttctatcatagctatccgttacatcttccgcgtcaatatgaccaaagaggaagagagcctgaaaactcagagcggagacgcgcaccacaagccgcacatgatgagccttgaggtacgcaatgagtctatcagcggaaaaacactgattgaaatcaaagaatttctgggacgcaactttgtttgctcccgtatccgtcacgaaggacacgtaagtattccgaaccacgaaacgatattcaatatgggcgaccagttgtttattgtctgttcggaagaagatgctcccgccatcaccgtatttatcggaaaagaagtcgaactggactgggagaagcaggatcttccgatggtttcccgccgtattctggttactaaaccggaaattaacggaaaaacgctcggttccatgcacttccgtagtatgtatggtgtcaacgtgacccgtgtcaaccgttccggtatggacctgttcgctgatccgaacctgatattgcaggtaggtgaccgcgtaatggtagtaggtcagcaagatgcggtagagcgtgtagctggtgttttgggtaaccaactgaaacgtctggacacaccgaatatcgttactatcttcgtaggtatcttcttaggtattcttttaggaagtcttccgattgcattccccggtatgccgactcctttgaaattaggtttggccggtggtccgttggtggtagctatcctgatcggacgtttcggacacaaacttcatttggtgacttacaccacaatgagtgccaacctgatgctgcgcgaaatcggtattgtgctattccttgccagtgtaggtatagatgcgggtgccaactttgtgcaaacagttgtagaaggcgacggcttactgtatgtaggctgtggtttcctgatcactgtcatcccgttgcttatcatcggtgcaattgcaagactatattataaggtaaactacttcactctgatgggattgatagccggtagtaatacggaccctcccgcattggcttatgccaatcaggtgacatccagtgatgcaccggcagtaggatattctactgtttatccattatctatgttccttcgtatcctgacgggacagatgatattactggcgatgatgtaaagcgaactaatttaattaataaataaagccgaccaaattcagaaagaatttagccggctttattattatcgggattttgttttctttttcaattacattccaatctgtagttttttagccacaaactcttccacaaaccgcaccgtctcctcaatccccaaagaagaggaatcaacacacaaatgataagtagccgctgctccccatgttttataactgtagtaattataatactccgaacgtctcttatccgctttttctatcatctcttccgccgcctcctcatcaatacgatgcatctgacacaaccgtgcgatacgatcttctttagtagccgagataaagacatttgcacaacggggatgttcccgtaaaatatagtcggcacaacgtccgacgaacacacaggatttctctgccgccagacgacggataacatcactctgcaccttaaataaagcatcattgctcagacagttggtacatggcattgccccttcactgatgaaaggaaaacgcataccgaacagtccgccgataatgccttgcgaggctttttcatcagctttttcgaagaactccttacataagccgctctcttcggaagccagattgatcagttccttatcataaaagtcgattcccaaacgggcagccaacttctctcctatttcttttccgccgctacctaactggcgaccgatattgataacataattaccgctcatagtacattttgttttatggtttgatagcaaacatacgacttttttctaaaagatgcaccattatacaaaagttatatttaaaagaaacaatcggaaagcatccttttttcatatatactctgccaataatacatctacatggcacaggagtccggctatcacccacctattttttcttcttgccccacttgggagttataccgataaagaactcgaagttaattcccggcatcggacgggataataccgaaagatactcttcgtcaaagagattattgactgtcccttttaaggataaatctgcccaacggagtgagaatcctttttcaagggtcacgttgctcatgagatagggtggaagatgtcccgtataggatacagcattactcgtcattgtataacgttcgctatagtaacaccatttataaagaagcccccaactgcgatatgtcagcctgcctgataacgtagctgaatattcgggtatgtatggtaactgcttccctactgactggtcagccttgctcgtaggttcaccttcattaatagaaggagtccacgcaaatgttccatttaatccaagcttccatgctttatcaattgcaactgcataatcagcctgtacttccacgccataggcgtgtacttttttaagattaacgggggaataaaatcccttcgacgtaggtagccaaataatccagtcgtttatatgttgatcgaaccaggaagccgaaccggataatgtataaacattatccttatccacagaaaaggacagccccgtttcgtaagtaaatccactttcattattcaatgccggattgccacccggcaaaaaataaaggtcattcaatgtcggaaaacgataattacgggtaatagaagcctttgccattatattgcctcttttagaaagaacataatctacaaaaaaggcaggaataaccggtgcccatttagtcccgaacatctctccccgcaggaccaatgacatacccaaccgattgaccggctgccatttcaatgagacattacccgacaactcaatacgtcctttatcaaaataaacaatagaatcattcttccttccctgaccatacttatcgttcttattatcatctttattcagatctttatccaaactattcaccaaatgctgatgagccgacacacccgccgtcaaaaggagtttatctgagaaaaaatactctccatccaactgcccgtagaaagtattgactttactacgtgaacgggtcattgtagccattataccatttcccaaatcccgcttatagtcgtacgccaaccatgtatgcacataacctccccttgccgatactttccagttttcacgcgtatgatcccatgataaaacacttcgcagtgtatgttcccgttgtcggttctcgaaatccataagatcaccctgatcggtcgtcagtaatgccagttcacggttagaatcagtataccacgcattcagtccgaagcgatcacctttacccgtattgtaatatacctcctgtaaaatgtgcagatctttgtatgcaccactacgattacgttctatgggataatactgttcgattatattatatttatcatcataaatattctctttcttatcatgattacgatatttataatcattgggcgacgactgatagaccgcccgcgtcgagatctgccaatgtttatctccatacttcaattgcagaaactcatcgaaggtactaaatgaaccgataccttgaacatattgcattccgaagccttcttgatgagcaggcactgtagataatttcaccaatcctcccaaaccaccaccagccatattcaccgatgaagtgccatgcagcaaagaagcgtcatctataaaataagatggaatcatcgaaaagtcagtcatccccaacattggattgttgatacgcataccgttccatgttacctgtgtatgcgaagcagacgttccccgaaatgatacagtagaaagcgtggcacgtccgtagctttttacaaaaatagaagaattgaaagtgagtatatccgccattgacaaggctatattctccttaagcacaagtgaatcaaatctggtctgctgtacgcctatatctttcatcgggcgctttcctaaaatttccacttcacgaatgacaattcccttttccgcccaattcttattgtcgctgctgtgttgttgtccactcattatagatggaagtaataaaagaactcctacaaactgcactaataatatatttctcctcatattcttctctaccgattacttccaacaaaatgctccgggaataattccaacataaaactcatccacaagttccccatcctccgtatagcgataaatcatcccctgttgctgatagtcaatggcgtcagccacatagacatctccgtttttcggactaactgtcaacccataatacttcgtatcacgatacttgaggaaaggacgtacgggaacacgttcttcatcgacagacatacgccagatatctttgttaatccagtaaagctcatcacccgcaccattaagctgtacttccgaaggagcatctcccaactgaaacttaaattgtttctctattttaaatgtctcggcatcaatgcgataaagcgacggctcctcatatccgtatggacttcctttataccctccatcagtaatcgtccacatcttgaagttcttatccatcactagagaagtaggttgtatacctacagtaagctgatctaccaccttgtccgttgtagtatctatctttaatatacgattctgataagaccagcaattcacatacacatacttgccatactgcaccatttgctctgtcgagcctgtttccatcgtcatatccggacattcgatatatccggttatctgataagttttgggattgacaataaaaatacgataatcccatatttgtgtaatataagctttctcatccgaaataaaatgaatatagcgtggagaagtaagtcccgtaatgcgtcccacctctttgaatgtattggtgctaatagcgaagattacatgagaattattcactaccacccatccaatagtatcccggacaatcattgattgcgctacatcacccaacttcatcgcattagcccggtaaaagatctcattctccacctttttcgtttccggatcataataagataaggtagcattaccgtattgaaaattcccctcattcataatgaaaagtccatctcctgtagccctgaaaggctccatcttgccataatcccatttcatacaaccgacaaaagccgtcagacagaagacaataaataaaacagaaagtaaaattcgtttcataattaaaagcgagaaaaggttattaactaacttgtcgcatcactcttcagacatctgccggcaaatcaggatttgcgacaaatatcaaacatagcatttgtaccgaccggttgaatgaggaatcaattgaatataggaatgaactataccagttgatttctacccgaaaacccgcgggtataaatctgcagcgtcaaggcaggtcttctgactcgtccccatttatcacgccttcccagtgatgtcaccagtggcaaagaatgtgataaactcatctcccgaaagagaggacttacagcagcaggtactgtcccggatttacaccggattcccttttcatcgttttggaaggttagacaactccaaatacgaaccttgcaggtgcaaagatactataattatacttcacgcctcacttctcccctgtcttttttttaacaggaacaaatctgatgaacagaatcttttaaaatgacgtcactatgaacatgtatatatgataaatataggatagatagtctttatagtgaattacgaatatttaaattccaaggattctcaattgtctcaatcgtttttttattaataagagaagccatcgtgcgtcccatcaatttgaaatcagtagaaagagtagtaatccctcctgccagcacttctttcaaaggggtatcattataagatataataccgaaatcttttcccggaactaactgctgacggtcagcctgcttcaacaaattgaccaagtctctatcattaacaaccataaacacctcctgctttacaatctcccttccctgaatttcgccaatgcactcatgcgtaaagccatgctctttacaaaaagcccgtaatccgtcataacgttcaaaaggttctttcgaatctttctgaaccattacaatatgcttgtactttcgcaagttggacagaccatacactaatgcttcataagtatctttttcaaagttctggaatacagacgaatatttccctttcaattccgagtgataatgatcgagtagaaatacgtttccggataaactctccagtaaaggaccaatatcggcaaatttgccggacattataatataggtagtata

SEQ ID NO: 269 - DNA, 7083 bp, Bacteroides thetaiotaomicron
aaatgttagtttataaaattaggttagttatttttttatcttttatttttccacaccgaatttgtagatagtcacctgctggtattcatcgcccggcaataaagtagccgaggggaaatgaggtttgttcggagtgtcggggaaacattgtgcctcgaagcagatagcgcttcttgcagggaatgtagcaccgtgagcaccttcgaaaccattcagccagttaccggtgtaaagttgtacacctgcttcagtagtgtatacttccatggtacgaccgctattcggttcgaaacaagtggcagccaaatccagtgaacctgtttcaatcttgttcagtacgtagcagtggtcgtatccggcaccgttaatcagttgttggaatttatcgttgatacgttcgcctacggtatgcggagtggtgaagtccattggagtaccttctactttggcaacttctccggttgggatagaaacttcatcgataggcgtgtagaaattagcgttgatagtaacaatattgttttcgatagtaggagtaggattgctgataccagccagattgaagaaaccgtgattggtcaggttgactacagtagctttgtcagttgtggcacgatattcgattaccagtgcattttcttcttcttccaggcgataaaccatttcaacctccagattgccggggaaaccttcttcgccgtcggctgaaacataattgaactggattatattttcagccagttggtcggcatcccaaacgcgggcgtgaaaaccggtaggtcctccgtgcagggagttgggtccgttgttgatggtgagctcgtgctcttctccgtacaatgtgaattttcctttggcgatgcggttgccatagcgtccgatagtagtgctgaggaagggttccgggctgttgacaacgtggtctatgctgtcgtgtccgaggacaacgtttgcatattttccatctttatccggtaccatgatagcgagaatggcgcatccgtaattagttacggcgacttccattccctttttatttttgaggataaataaatcagtttctttattatttatctccttttggaaatctttccggctgagccctgatagattcctttccgttgggaatgtgttattcatgtctggtattcttaaaattttcttgcaaataaaggtaaattctttgttactcacaaattattccggctaaatatggtgggtagtttaggaaagtttagcgttctcacttaggtttctgtatttttcatccttcttttcttttaaagtgaacattttttcgtatgtttgttcccggattattataatccgggagaatttaatctaagtttattaacaagaaaaacaaaaatgtatccattaaaattcgaacctattctgaagcagacgctttgggggggcgacaaaattattccgttcaagcatttgaactcagacttgaaaggagtaggagaaagctgggagatttccggcgtagaggacaatgaatctgttgtggctaatggcccggacaaaggtttaactctggctgatatggtgagaaagtatcgcgaggaactggttggcgaagcgaattatgctcgttttggcaataaattcccactgcttatcaaattcatcgatgcaaagcaggatttatccattcaggtgcatccggcagatgatttggcaaagaaaaggcacaactcaatgggtaaaaccgaaatgtggtatgtagtggatgctgataaaggagcgaaactgcgttctggattttccgagcaaatcaccccgaaagaatataaagagcgtgtgctgaacaatacgatcactgacgtattgcaggagtatgagatcaagccgggagatgtattcttccttcctgccggacgtgtgcacagtattggcgccggtgcgtttattgccgaaatccagcagacttcggatattacttatcgtatctatgacttcaaccgtaaggatgcaaacggaaagactcgtgaattgcatactgacctggcgcgtgaagccatcaattacgaagtgttggatgattatcgtaccaaatacgaagcggtgaaagatgagccggtagaacttgtagcttgtccgtacttcactacttccgtgtatgatatgaccgaagaaatcagctgtgattattcagaactcgattcattcgtaatcttcatttgtatggaaggtgcatgcaagataaaagacaatgaaggtaatgaactgaaagtaggtgccggagaatctattctgcttcctgctacaacacaggatgtaacaattactccggaagctggaaacgtaaaattgctggaaacatacgtgtaaataatagacaatattattgataaaagtatagaccgggcaggcgagaaaaactttctcgcctgctttgcgttgtagaaagaaaggcgtatcgattttgtcttacagactgacaaattcataatatgtgatggaatttaagttggatggtactgctgaagaagctatcaaacagattaatgaaaagcattatgcacttccttttgaggcagacggacgccgacttttcaagataggtgtcaattttagctcagaaacacgcaatattgagaagtggatagtggagtagcatcaattctatccccattcagttttatataatttttttggaaaggttttaaacttctgttgctaaatcatttttttcgtcttatcattgtataaatttactagtgatatatatgaataaaaatggatttagccgttgtgcggagtcgtacatcggtcgtttacgaaaagaagggcgtcattctacggcccatgtttatacgaatgctcttttttcttttaccaagttttgtggcactacccatgttgctttccggcaagtcacccgtgaacgcttgcgctgttacgggcagtatctttatagttccggtctgaagccgaatacggtatcaacgtatatgcgtatgcttcgtagcatctataatagaggagtggagtcgggcagagctccgtatgtgcatcgtctgtttcatgatgtttatacgggagtggatatttgccagaagaaagcgttgcctgtcggagaacttaatcgcctcctctatgaagatcccaaatcggaacgtttgcgtcgtacgcaggctatcgctgccttgatgtttcaattctgcggaatgtctttcgctgaccttgctcatttggagaaatcttcgctggaacggaatatcatccggtataatcgtatcaagacgaaaactccgatgagtgtggaagtactggatactgcacaggatataatcagccggcttcgcaactgtcagccttctcatccggattgtcccgactatctgttcagtatccttcttggcgacaagaagagagaagatgaaagtgcataccgggaatatcagtccgctctccgcaggttcaataatcgtctgaagagacttgcaaaggctcttcggctgacttctcctgtcacttcctatactatccgtcattcctgggctactaccgctaagtatcgtggtgttcctattgagatgatcagtgagtcgctggggcataagtctattaagactactcagatttatctgaaaggttttggtctgcaggaacgtacagaagtgaatcgaatgaatttatcttacgtgaagaactgtcggataggacgggtgtaaaatatttaataagttgatagtcagtatggatctgtttctgttacttcttaggtaacggaagtaaatttgatgcaaagatagacaaaaacacaaataagaaacaaattaaagcccactttttttagttttatctaaaatatagggtaaaaacatctttagacatgaaaaatacttattttcatgccccactccttatatacctaatttccattggtatatacccttctacttagggtgtaactctcttgacaacatatttgctgctgcttttcaaccttttttcattgttcgtttatgctgtatacacttccgttacctaagaagtaacggaaacatatggggtagaaaaacatgattctaacaaaagagaaatcagccatcctcgggaccaaaaatgggacaggggagggcgtagcgtgcttaaaacgctggtatgtggcacatgttcgcatacatcacgaaaaaaaagtagccgaatatttggggaaaatgggaattgagacttttgttcctgtccagcaagaaatccatcaatggagtgatcgccgtaaattagttgaaacagttcttcttccgatgatggtgtttgttcatgccgatccgaaggaacggatggctgctttaactcttgccacggtaagccgttacatggtgttgcgtggtgagggaaagcctgctgtgattcctgatgatcagatggcgcgtttccgttttatgcttgattattcggaggaggcaatctgtatgaattattctccattagctcgtggaaagaaagttcgtgttatcaaaggtcctttgacgggactggttggagaactagttgcgttagatggcaaaagtaagattgctgtccggctggatatgttgggctgcgcttgtgtcgatatgcctattggatatgtagagcaaattggcgaaagaaactaagaggtgatggggaccttcaataatagcatacaggagaaaatagaaaaactacaaaaaacagttgatacattgcttcatatgggtgagaatatggactgtatatgtgtcgacgatctttcactacttaataaagagatccatgaacagatcaatgatctgtatccttatcacggtaagactgctgagcaggaagctgctttgtgtctgtctcttctgatgggatatagtgtgtctatgtatgccaattcggaggatgaggcaaagaaagaaactgttctgaggcgttcgcaaatgattctgaaaaaccaattgccttcaccattgaaaattcagttacacacaatctacgataaactattgtcatagtaaatctactttttttgaaaaagactttataatttattggggtatttaaattatgaaacacgcatttgaccgttttgttcaatatttgcagaaaaattattttagttattggattgtattaggaattgatacattcatagctttgatttgtacctgggtgtcatttatcggcattcattatataacggagacttctaaagaaatcacttctctcttccatattttggcgatttctgtgatctccagtgtcttaggttcctttttattccatacctaccgtaatacgatccgtttttcccagttgaaggaattatggagaattgccggaagtgcactgataaaagctgtctgtattgcaatggctatctggcttttcctgcctcagacgggactgcataatagtcagaaaatagtctttgtactgtttgatggaatgctgacttttattgccatggtaggctttcgcattcagttgattctggtgtatgaactcctgttgaatatgctgaataagaagaatatgcatattctgatctatggcattgatgataagagtgtggcattgaaagtccggttaatgaacagctctcactataaggtagtaggcttctgtatctacggaacaggcgactccatccgacgtgtggctgatcttcccgtttattcatttaaagatgaagaatgctttaataaacttattcataagaagtgtatcggcggcatcctgtttgcccgttacgagaatacccgtgaagaggaagaccgcctgcttcagtattgtaaaaggagtggattgaaaacgttgattgctccgagtatcagtgaggctgacgaaaacggaagtttccaccaatgggtacgccctatcaagattgaagacttgctgggtcgttcagaaattcatatcaatatggaggaggtgatgactgagttttgtggcaaggttgtgttggtgaccggagctgccggtagtattggtagcgaactttgccggcaactggctcagatgagcatcaagaagctgatcatgtttgattccgctgagtcacctttgcataatgtccgtctggaatttgagaagaattatcccggtcttgattttgttcctgtcattggagatgtccgcgtgaaagaacgtcttcgtatggtgttcgaaacttatcagcctcagatcatctttcatgccgctgcctataaacatgttccgttaatggaagagaatccctgtgaagctgtgctggtcaacgttgtcggctctcgccaggttgccgatatggcagttgaatacggagctgagaagatgatcatggtttctaccgataaggcggtgaatcctaccaatgtaatgggatgctcgaaacgcttggcggagatctatgtacagagtctgggctgtgccattcgtgagggaaaagtgaaaggtcataccaaatttatcactacccgctttggtaacgtcttgggtagtaatggttctgtaattccccgttttaaggaacagattgagaatggtggtcctgtcacagtgactcaccctgatatcattcgtttctttatgactatccccgaagcttgtcgtctggtaatggaggctgccactatgggtgaaggcaatgagatttttgtctttgagatggggaaggccgtgaagattgttgacctggctacccgtatgatcgaactggccggttatcgtccgggtgaagatattgagatagagtttacgggattgcgtccgggtgagaagctttatgaagaagtcttgagtgataaggagaatacaatccctacagaaaataagaagataatgatagcaaaggtacgtcattatgaatatactgatatccttgaaacttatggagagtttgagaagttatcccgtacggtaaagatcatggatacagtgaagctgatgaagagagtggtacctgaatttaaatccaagaactcaccgagatttgaggtcttggataaataactagaataattctgaacactaacataaatcaacaatggatacaaaagaattgaagattgctgttgcaggtaccggctatgttggtcttagcatagcaacgcttttgtcgcaacatcatcaggt

SEQ ID NO: 270 - DNA, 7045 bp, Bacteroides thetaiotaomicron
gattaaaatactatttttgtagtcaacaaataactatcagaatgaagaagattaagatcggcctgctgccacgcatcattattgctatcatcttaggtattgccattggcactatttttccggctccgctggtgcgaatattcgttacgttcaacggaattttcagtgaatttcttaacttctccatcccgctcattatcgtcggactggtcaccgtagccattgccgacatcggcaaaggtgcaggaaagatgctgcttgtcaccgccctcatcgcttacggtgcgacgctcttctccggcttcctgtcctacttcaccggtgtcaccgtgttcccctcgctcatcgaagtgggcgtaccgctcgaagaagtcagcgaagcgcacggcattctcccctacttctccgtatccatccctccgctgatgaatgtcatgacggcattgatccttgccttcacactgggattgggactggcggcactgcacagcgatgctctgaagagtgtagcacgggattttcagaaaatcgtcgtacgcatgatcagtgcggtcatcctgcctttgctgccgctttacatcttcggcattttcctgaatatgactcattccggacaagtatatgccattctgatggtctttatcaaaatcatcggagttatctttctgttgcatatcttcctgctcgtctttcagtattccattgcggcactctttgtccgtaagaatccgttccggttgctgggcaggatgatgccggcctatttcaccgcattgggcacgcaatcgtccgcagccaccattccggtgacgctggagcagacgaagaagaacggagtatccgccgacattgcaggattcgtgattccgctctgcgccaccattcacctgtccggcagcacgctgaaaatcgtggcctgcgcactggcactgatgatgatgcagggaatgccgttcgacttcccgctgtttgccggattcatctttatgctgggcatcacgatggtagccgcaccgggcgttccgggaggagccatcatggcggcactcggtatcctgcaatcgatgctcggcttcgacgagtcggcacaggcactgatgatcgcgctctacatcgccatggacagtttcggtactgcctgcaacgtgacgggcgacggagccatcgcgttgatcatagacaaagtgatgggaaaaggaacgggaaaataaaactgacttggtttgcatatacagcataaaataacgaaatttgtcccccgtattttcaaataaaaaataaaggaatatgaaaacagcccttatatcaggcatcaccggacaggatggttcttatcttgccgaatttctcttgcaaaaaggttacgaagtacacggtatcctccgtcgttcttcctcattcaataccggacgtatcgagcatttgtactttgacgaatgggtacgcgacatgaaacagaaacgtaccatcaacctgcactacggcgatatgacggactccagctcactgatccgcatcatacagcaggtgcaaccggatgaaatctacaatctggcagcgcagagtcatgtgaaggtatcattcgacgtgcccgaatatactgccgaagcagacgctatcggcacactgcgtatgctcgaagccgtacgcatcctgggactggaaacgaaaacaaggatatatcaggcttccacctccgagcttttcggcaaggtgcaggaagttccgcagaaggagacgactccgttctatccccgctctccctacggagtggcaaagcagtacggcttctggatcaccaagaactaccgtgaaagctatggcatgtttgccgttaacggcatcttgttcaatcacgaaagcgaacgtcgtggcgaaacattcgttacccgcaagatttctctcgctgccgcacgtatcgcgcaaggcgagcaggacaagctgtatttaggtaatctggatgcccgccgtgactgggggtatgcgaaagattacgtggaatgtatgtggctgattcttcagcatgacgttccggaagatttcgtaatcgccaccggagagatgcacaccgtacgcgaatttgccacactggcattcaaggaggcaggcatcgaacttcgttgggaaggcgaaggcgtggacgaaaagggtatcgacgtggctaccggaaaagtattggtagaggttgatcccaaatatttccgtccggcagaagtggaacaactgttaggagatcctaccaaagcccggacattgctgggatggaacccaaggaagacatcgttcggagaactggtaagcatcatggtgcgccatgacatggaaaaagtaagaagaatgatcgctaccaagcactaacagacctcaaaccgaacacggattacgccgattcaacgatcttcattttttacatgagatgcgcataaccggagtaatccgtgttcatatatgatacttaatcatggaaaagaatgcaaaaatctatgtagcagggcatcacggtttggtgggttctgctatctggaagaatttacaggataagggatataccaatctgatcgggcgtacgcatcaagaactggatttgctcgacggtgtagctgtccgccgttttttcgacgaagagcaaccggagtatgtgtttctggctgctgcattcgtaggcggcatcatggcaaacagtatttatcgtgccgacttcatttataagaacctgcaaatacagcagaacgtcatcggtgaaagtttccgtcataacgtccggaaactgctgtttctgggcagcacctgcatctatccgcgtgacgccgaacagccgatgaaagaagaagtcctgctgacttcaccactggaatacacaaatgagccatacgccatcgccaagatcgccggactgaaaatgtgcgagagcttcaacctgcaatacggcacgaattacatcgccgtgatgccgaccaacttatacggtccgaatgataattttgacttggaacgcagccatgtcctgcctgccatgatccgtaagattcatcttgcgcactgtctgaaggaaggagactgggaagctgtccgcaaggatatgaaccaacgtcctgtagaaggcgtcaatggcgacagccccaaggcggacattctgaatatcctccgcaaatacggtatcagcgaaacggaagtgactctgtggggcacgggaactcccctgcgcgagtttctctggagcgaagaaatggccgacgccagtgtattcgtaatggaacacgtggacttcaaagatacctacaaagaaggtgacaaggatatccgcaactgccatatcaacatcggaacgggaaaggaaatcaccatccgccaactcgccgaacgaattgtagaaacggtaggctatcaaggcaaactaaccttcgacagcagcaaaccggacggcactatgcgcaaactgaccgatccgtccaaactacactctttgggatggcatcacaaaatagaaatagaggaaggagtacggagaatgtacgaatggtacttgaaataaattcaaaaagaactatccgcattggggctgactaaaaagtcggtagtatctacattctcctccttcgggaaggaggagtggtcgaagaccgaggtggtaggtgaacacataaactaataataataaattaagttatatgcttacctaccacctccccctacgggtactcctccttcccgaaggaggagaagtaagacactaccgacttctaattcagctcattaggaacagactgaaaacaaccggtttttcggattaatccatgttaatgactgcgacatgcattgtggactgtcttaacaagcattgttaatgacattaccatgcattcttatcgaccctaacaagcattgataacttccttttcttatagagagaacagtaatgtcatctgtaaggaacaatcgtgccacaggccggaaacacttgtgccaaaggcgtggcacaactccttcccctatacttcccaacacttttcccatacttccacatcttagtcccttattaccccaagactccccatttccaaaaattcttcattcttaattcttcattcttaatttaattactatatttgcacaatttaataccaaatgtgcaaaaacaatggaaaagagttttatagcttacattgaaaatagtatcaagaacaattgggacttagacgccctgacagattataagggagccacccttcagtataaagacgttgctcgaaaaatcgaaaaactccatatcatctttgaagaaagcggaatccgcaagggagacaaaatcgccgtttgcggccgaaacagttcccattggggagtcactttcctcgccacactgacgtatggagcagtcatcgtccccatccttcacgagttcaaggcggacaatgtgcacaacatcgtcaaccactccgaagccaaattactatttgtaggagacatggtgtgggaaaacctcaacgaatcggcaatgcccctgctggaaggtattctgatgatgaacgacttcaccttactggtatcacgcagcgaacgcttgacgcacgcacgtgaacatctgaacgaaatgttcggcaagaaatatccgaagaacttccgcaaagaacacatcgaataccataaggatgaacccgaagaactggcagtaatcaactacacgtccggcacaacgagctactcaaaaggagtcatgctcccctaccgcagcctctggtcgaacaccaagttcgcgtatgaagtgctcgaactgaaagccggagacaagatcgtctccatgcttcctatggcacatatgtacggactggccttcgagttcctctatgagttctccgtcggctgccatatctacttcctcacccgtatgccgagtccgaagattatcttccaggcattcgaagaagtaaaaccgaatctcatcgtcgccgttccactcatcatcgaaaagattatcaagaagagcgtactcccgaaactggaaacgccgaccatgaaaatcttactcaaagtacccatcatcaacgacaagataaaagcaaccatacgcgaagaaatgatcaaagcgttcggtggaaacttcagagaaatcatcgtaggtggagcagctttcaaccaggaggtggaacaattccttaaaatgatagacttcccttatacagtaggctacggcatgacagaatgcggtccgatcatctgctacgaagactggacaagattcaagccgggttcgtgcggaaaagccgcgccgcgtatggacgtacgggtgctgtcttccgatccggaaaatatcgttggcgaaatcgtctgcaaagggcctaacgtaatgctgggatattacaagaacagcgaagcgacagaagcagtgatcgacaaagacggctggctgcacacaggcgacctcgccttgatggacgccgaaggcaatatcaccatcaagggacgcagcaagaacctgttgctcagcgccagcggacagaacatctaccccgaagaaatcgaagataaactgaacaatctgccatacgtatcggaaagcatcatcgtacagcagaacgagaaactcgtcggactggtttatccggactttgacgaagcattcgcccatggtctgaagaatgaggacatcgaacgggtaatggaagaaaaccgcgtagcactgaacgccatgttaccggcatacagccaaatactaaaaatgaagatatatcccgaagaatttgaaaagaccccgaagaagagcatcaaacgctatctgtatcaggaagcgaaaggataaaggaagtgaaggattaagggaatactctgtgaacctaaactgaaaaaaagagttataataaagatgaagataataaagacaatattcacggcagctgttctgatggctgccgtttgtttgccggcacagaacaagagtgcgggcatcaacctttccttatggaaagacatctgcacacagccgtatgacagcactcagacgacttatgtaaacctcggtctgctgtctacgctgaaccgtctcaacggcgttggcatcaacgcgctgggaagcgtcattcatggagatatgaacggagtacagatcacaggattagccaatcttgccggtggtacgatgcggggtgttcagatagcgggtgtcagcaatatcagcggaaacaacaccgtagggctttccgccgccggactagtgaatatcacaggcgacggctcaaagggggtcattatttcgggacttaccggcatcggtggagacaacaactcgggagtaatgataagcggtctgatgaatgtgacgggaaacatggcttcgggatttcagttttccggcgtgtcaaatatcacgggacagagtttcaacggtatgatgacttccggactcttgaatgtggtaggcgaaaacatgaacggtctgcagattgccggtatcgccaatatcaccgcaaaagacctgaatggcgcacagatcgggttatgcaactatgcgacgaaggctcatggctttcagatcggtctggtcaattactacagggaagatatgaaaggattacaactcggcctcgtgaacgcgaatcccgatacaagaatacaaatgatggtatatggcggtaacgtcacgcccgccaacataggagtgcgtttcaagaaccaactgttttatacgatcttgggagtgggtgcattcgatcagaatctgaacgataaattttctatcagcacgtcttaccgtgccggattggcggtacctgtttacaaaggtttgtccattagcggtgacctcggattccagcatatagaaacgtgctccaacaagggtgaagtgattccccgacgcctttatggattgcaggcacgagcgaatctggaatatcagatcagcaagaaattcggcatctttgccaccggtggttacggactgacacggtattacaacaaatccggtaatttcgataaaggagcgatcatagaagcaggtattgtcctcttctaaggctgattaataagtaataggtaataagtattaagt

SEQ ID NO: 271 - DNA, 6981 bp, Bacteroides thetaiotaomicron
caaaagagtagtattagtttataaaattaaggtattagattttaagattagtttttaggaaaaagattgttttgattaggtattaggaaaaaagtagttttcaggtaacaggtaaattgagatgcagaaaaaagaatcccatttatgggggattctttaggtggggcggagttattcgctctttttttattttatgcccctttattctatttttttatatgaggggtgaacttacatactgaaaaaacagatatatttgtaagtcatatctattataaccagtttttgcagtaatttgaagagagtcttttattgtttgattaatcttgttgccgtatgagcgataaagatgatttgatagtagcaggtgtcaaccagaaagataagggaatctggagggacttttatgatcgctattatgcggccttgtgctcatatgtcgagaaactcctgttcctcaccgatgccgtagaagatctggttcaggaggtgtttatatccgtgtgggaaggtaaacgtactttttccgactcccgtgagctgactaattatctttatcgtgcctgctataataatgcactgttgtatatccgcaaccatcagattcatgattctatattgaatggcttgcctcaggaagaagattttgaagacgaggaaatgttgtatgctttgactgtgaaagaagaagctatccgacaactttatttctatatcgaggagcttcccgccgaacaacgccgtatcatcctgctaagaatagagggacattcgtgggatgaaatcgcatcccggctgggagtcagcatcaatacggttaaaactcagaaaagccgtagctataaattcttacgcgagaagctggcaaattccagttattctgtacttcttgctcttatattttattagaaaccgggctatgcatccttgcttttgtgggggtgaagtgactgtgatgtggcttatttaagtggatgagccgttatgtttaacaggtaaacaaagcttggttagcatttttagtaagctatatgtgttcgttccatgtctgtgtcttattgcattgtatatcaattagctaagtccgaaagtgacggatgatgataaaatatgagtttcaaactccttagtaaaagctaaaaaatacatcattttaatagcggcaacgaaaaaaaacaaatattttttaagatgcctaattgtcatttattgatggctgaattttgattctgaaaagggaatgatttgttaaatatgtcatttttgttgctgaataatgtcataatgatagtttttcattcttttccgttttcgtacggagagtatctcataaaaaataatcatctttttgtcacccatttatggacgttatgtataattatagtaaagcaaagataaaatcctcattagaaatagataaaattatgaaaaagttagaaaacacatatcaagatgcctctttgataaaaaaggctcttttgggagatgcaagcgacaaagagcagcaggtgttggaacaacgtttatctatgcatccggaactgaaagccgtgtatgagaaattgcaggatagtgaggaattgaaagatgcttttaataagtataaaaaatattcatcggaaaaggcttacgagcatttccttcaacaaattcaacaaaaagagaattcgtccgctggaaagatccaccgtatccggtcatggtggtatgctgccgcagcggtggtagtactggcagtaggaatttctttttatgccataaatcattatcaggcagtggaggagtcccagacacgtatcgcgcaaatcaagccgggtagcaaacaggcagtgttgactttgcccgatggaagcactattgatgtacaaaagaaagatataaatgtaatagtagacggcgtccaggtgaaatacaataaaggggtgctgtcatatcgaccgaccgtcacaacacaacaacacgaagaagaaaatgtcgatgaaagtccggtgaagtcaaatgaactggttataccacggggaggagagaatactgtccttcttgctgatggaaccactgttcatttgaatgccggttctaaattgctttatccggtccgttttgtcggaaagcgccgaattgtgacactggaaggtgaagcctattttgatgtgagaaaggatgaggaacatccgtttgtggtccggactcgtttcggagaagtaacagtacttggtacggcatttaatatcaatgcttataatgatgcggatgcgtgctataccacccttgtatatgggaaagtaaatttctcgacacccgatcagaatacaattacgctggcgccgggtgaacaggcagtcgcctcttcccgtggcattgaaaagcgggtggtggatgtcaatgaatatatcggctgggcacaaggtgtatatgttttcaataacaaacggctgggcgatatcatgaaaaccttcgagcgctggtatgatgttcatgtctattatgagaaggagtctctgcgcgacctgacttatagtggtgacttgcagcgatatggcacgatcaatactttcctgaatgcattagaactaaccggcgatatctactatagaataaacggaagaaatatattgatatatgagaatgagtaatattgagttttgatttaaaaattatgaaaaaaagaagagtctttatgctatgtctttttgcattgagtatggtactcagtgcatgggcacttccacctgatgagaagaaagtgacgcttgatttgaaggatgtgccgatggaaacatttttaaacacggtaaaacagaaagctggaatcaacatgctttataactctcagatgtttaaaggagttgaaccggtgactgtaaaagctaccaacgagccttggaaggaattgctggaccgcgttctttcacctaaaggtttcacttatgctaccaaagatggtattgtggtcatcaagaagaaagatcagaagacacgtacgttggaaggtaaagtggtggatgaacagggtggcgaactaccgggagttacggttttgatactgggaaaagaaagaaatatcggaacaatgactgatgcagacggtgctttttctttaggacttcctgaaggagatgtaacaattcgtctttcctttgtaggcatgcaaactttggaaatacatactggcaagctcaatcttgataaagtgcatacctttaagttgaaacccgattcaaagcaattggaagaggtggtggtaaccggttatgcaaagatcagtaaaaatagctttacgggtacttctgtgacggttacggcagatcagttgatgtcggtttccaaaacaaatgtattaggggccttgcaaacgttcgatccctcttttcgtattgctgaaaataatttagcaggttcgaacccgaataatgttccggaattgtatattcgtggacgttcgggtattggaacaacacaattggatgcgcaaagcctttctaaaacatcattgaagaacaatcctaaccttccgacttttatcatggatggctttgaaatcagcgtgcagaaattgtatgatatggaccctagccgtattgcaagcattacgatcttgaaagatgctgccgctacggctatgtacggttcgcgtgcagcgaatggtgtggttattattacaacagtaacaccgaaagctggtaaagtcaatatcgattataactttaccggaacattggaatatcctgacctaactgattataatatgatgaatgcacgagagaaacttgaaacagaggttgctgcaggtttatttaaggcaaatccagaacaaggttttagtgaacaaagtcggttagatgcactttacaaccaaaaactgaacaatgtagttcgtggagttgatacttattggttatctaaaccccttcgtactgtattcaatcacaaacatagtttgtatttggatggtggtacggaggatttgcgttggggagctgacttttcttataatagtggagaaggcgttatgaaaggttcttatcgcgaccgtatggctggtgggttgtctttatcttatcgacttggagcttttcaggtaagaaactatttttcatatacttatactaaatctcaggagtctccttatggaagcttctccgactatacttcaaaattgccatatgatgaatatattgatgagaatggaagatatttggagacaacttatccttggaccggaggatcaggagaagtaaaccctttgtatgaagctacattgaagaattatgatcgaagtaagtcttgggaattgattaataatacagaattgttgtggaatatcgacagttactggttgttaaaaggacaatttagtgttacgaagtcaaattcggatgcacgtacctttcttgatccgcgttcaaagaagaatgatgatttgttaggcttaaataatgtggtttcaggacagttggatatcgctacttccaatagtttaagttgggatgctactgctactttatcttataacagaaatataaagaagcacaatctgaattttttggtaggtattaatgctacttcaagtactggtgatagttttggtattacttacaaaggatttccgtctggcgaattgtcttctccaggctatggtaataaagtctctggattaccttctaactcggatagtaaaagccgtcttttcggtgcattagggacattcaactattcatttgataatatttatttggcggacgtttctgtacgcttcgatggaaactcagagtttggtgctgatcaacgttttgcacctttcttttccggtggtcttggtttgaacttgcataattataagttcatgaaacagtttgaatggatggaccgtctaaagattcgtggaacttatggtattactggtaaagttgacttctctccctatgaagcgcagactatttataaagtagttacagacaactggtttaaaacaggtctaggagcatcattgatggcattgggaaataatggattgggttgggaaaagactcataacatggatttaggtctagatgttgatatgtttaagggattactccagatgaacttttcatattatcgtaagaaaacggtggacttggttaatagtgttacattacctagttctacaggttttacttcttacaaagataatattggtgaggtgatgaataagggtgttgaaatccagttgagaagtaatattttgaatgcaaaggattggtttgttgcagtttttgcaaatatggctcataatgaaaataaaataactaaaatctcagatagtctgaaagagtacaataagcgcgtacaagaaaaatatgcgaaatatgattctggaaaaggagattcaaaatatagtgagacttacttgcagtatgtagaaggtggttctctgacatctatttttggtgtgagatcattaggtatcaatccagcagatggtaaggaaatttatcttcgtcctgacggtacaataacatatgactggaatgcggctgaccaagttgtgattggaaacgaagagccaaaactccagggtacttttggatttaaccttcgttggaagcaattttctctctattctacctttatgtatgaatttggtggacagcgttataattctacattggtaagtaaggttgagaatgcacatattcaaagtagtaatgtagaccgtcgtgtattgacaggacgttggcaaaagcctggagattgtactccttatggacgtttacagactgatggtgtagttgcagtgactcgtcctactagccgtttcatccaagattataatgtgctgacatttaactctcttactttaggatatgattttaatgctgaatggttgaagaaagcgcgtatcggtctgttacgtgtagaactttcaggaaatgatttattccgtgttgctactgtacgtgctgaacgtggtttggattatccatattcacggtcttttgcagcttcggtgaagatgagtttttaatagtttaaagtagatgaataatatgaagaaattatatacaatattactgttggctacaagtctgtttactacaagttgtagtgattggctggatgtagcaccgagtaatcaggtgaatggggataagctttttgaggtaggagatggatatcgaaatgctttgaatggaatatatttgaatttgggcacttcttctatgtatggacgaacaatgtcatggggatttatggatgctattgctcaatattatcaaacagataataattttatacctaaaaattcagcttattataaatcggctaagttccaatttgatgattcggatgtgaaaactttcatttccaatatatggtctattggttataataatatagctaattgtaataatttgattctcaatgttagcgaagctagttcttctattttcaaagagggagaatttgagaaaaatatgatttggggagaagcattggcactacgagcttttatacactttgatttacttcgtttatttgctcctgccatatcgaaagatgatggaaagtcttatattccctatgtagaggtatatcctaccattgttcctccatatgaaagtagtaaagagattctttctaagataattagagatttaaaagctgcaaaagagatgttagctaagtgtgatataactgatgaacataaaatttggatgagtacaggttatcgtatgttggcatcaagcatactttctagcgatattgcttctagtgatgtattcttcgcttatagaggatatcgtatgaattattatgctatagtagcggcattggcacgtgtatattattgggaaggagaatatgaactggcttataaagaagcaaaagaggtcgtagaagcgacttatccatatggaagcaagcctgaatcctgttttaattttgtggaatactcaagcttaggtacgaatcttaaagactataatagtattatta

SEQ ID NO: 272 - DNA, 6939 bp, Bacteroides thetaiotaomicron
atttagttatgactaaacagaagaaattcatcacatgtgatggtaaccaagctgcagcacatatctcgtatatgttctctgaagtagcagctatctaccccatcactccttcttcgactatggctgagtacgtagacgaatgggctgccgcaggacgtaagaacatcttcggcgaaacagtattggtacaggaaatgcaatctgaaggtggtgctgccggtgcagttcacggttctcttcaggctggtgcattgactactacttacactgcttctcagggtcttcttttgatgatccctaacatgtacaagattgccggtgaattcttgccttgtgtattccacgtttctgctcgtacactggcttctcacgcattgtgtatcttcggtgaccatcaggacgtaatgtcagctcgtcaaaccggcttcgctatgttggcagaaggttctgtacaggaagttatggatttggcaggtgttgctcatctggctactatcaaatcacgcgttccgttcatgaacttcttcgatggtttccgtacttctcacgaaatccagaagatcgaaatgttggaaaacgacgacctcgctccgctgatcgaccaggaagctttggctgaattccgtgcccgtgcactgaatccgatgaagccggttgcccgtggtatggctgaaaaccccgaccacttcttccaacatcgtgaatcatgcaataactactatgaagcagttcctgctatcgtagaagaatacatgaacgaaatttccaagatcacaggccgcaaatacggtttgttcgattactacggtgcagaagatgcagaacgcgtaattatcgcaatgggttctgtaactgaagctgcccgcgaagctatcgaccacttggtagcaaacggcgaaaaagtaggtatggttgccgtacacttgtatcgtccgttctctgctaaacacttcctggctgctgtacccaagactgcaaagagcatcgcagtgcttgaccgtacaaaagaaccgggtgctaacggcgaacctctttaccttgacgttaaagactgcttctatggcgcagaaaatgctcctgttatcgttggcggtcgctacggtctgggttcaaaagatacaactccggcacagatcatctctgtattcgaaaacttggctatgccaatgccgaagaaccacttcactatcggtatcgtagacgacgttacgttcacttctcttcctcagaaagaagaaatcgctctgggcggtgaaggtatgttcgaagctaaattctacggtctgggtgctgacggtactgtaggtgccaacaagaactctgttaagattatcggtgacaacaccgacaaacactgtcaggcttacttctcttacgactccaagaagtcgggtggtttcacttgttctcacttgcgtttcggtgatactccgatccgttctacttacttggtaaatactccgaacttcgttgcttgtcacgttcaggcttacctgcacatgtacgacgtaacacgtggtttgcgtaagaacggttctttcttgctgaataccatctgggaaggcgaagaactggctaagaacctgcctaacaaggtgaagaaatactttgcacagaacaacatctctgtatactatatcaacgcaactcagattgcaatggaaattggtttgggcaaccgtaccaatacaatccttcagtctgcattcttccgtatcacaggcgtaatccctgtagatcaagctgttgaacagatgaagaaattcatcgttaagtcttacggcaagaagggtgaagacgttgttaacaagaactacgctgctgtagaccgcggtggtgaatacaagactctgactgtcgatcctgcttgggctaacctgccggatgatgcaaaagcagaaaacaatgatcctgctttcatcaacgaagtagttcgtccgatcaatgcacaggacggtgacttgctgccggtatctgcattcaagggtatcgaagacggtacttggtatcaaggtacttccaaatacgaaaaacgtggtgtagctgcattcgttcccgaatggaatgctgaaaactgtattcagtgtaacaagtgtgcttacgtttgtcctcacgcttctatccgtccgttcgtactcgatgctgaagagcagaagggtgctaagttcgagcaactgaaagctgtaggtaaagcattcgatggtatgacattccgtattcaggtagacgttctcgattgtctgggttgcggtaactgtgccgacatctgtccgggtaatccgaagaagggtggcaaggcattgaccatgaaacaccttgaaagccagttggccgaagctgataactggacttactgcgctgaaaacgtgaagagcaaacaacacctggtagacatcaaggctaacgtgaagaactctcagttcgcaactccgttgtttgagttctcaggcgcttgctccggttgtggtgaaactccgtacgtgaaactgatttctcagttgttcggtgaccgtgaaatggttgctaacgctacaggatgttcttctatctactccggttcagttccttctactccgtacactatgaacgaaaagggtcacggtcctgcatgggctaactccttgttcgaagacttctgtgaatttggtctgggtatggaactggctaacgaaaagatgcgtgcccgtctggtgaaagtaatgaacgaagctatcgcttctgattgctgcccggctgaatacaaagaagtatttgctgaatggatcaacaatatgctggatgcagaaaagactaaggaactggccgaaaagatcattccgatggtagaagctgctaaagataaatgcaaccactgcaagcaaatcgctgatctgcaacaatatcttgttaaacgcagccaatggatcatcggtggtgacggtgcttcttatgatatcggttacggtggtcttgaccatgtaatcgcttccggtaaggacgttaacatccttgtattggatactgaggtttactctaacacaggtggtcagtcttctaaagctactccggtaggcgctatcgctaagtttgctgctgcaggtaagcgtgtacgtaagaaagacctcggtctgatggctactacttacggttatgtatatgttgctcagattgctatgggtgctgaccaggctcagactctgaaagctatccgtgaagctgaagcatatccgggaccatcactgatcatcgcttacgctccatgtatcaaccacggtctgaaagccggtatgggtaagagccaggaagaagaagaaaaggctgttaagtgcggttactggcacttgtggcgttacaaccctgctttggaagaagaaggcaagaatccgttccaactggatagcaaagaacctaactgggaagacttccaaggtttcttgaagggtgaagttcgttacgcttctgtaatgaaacaatatcctgctgaagctgaagaactgtttaaagctgctgaagaaaacgctaaatggcgttacaacagctacaaacgtcttgccagagaaaactggggagctgatacagctgaataataagtagaaatactttgtacataataaaaggcaggaatcctggaaacagattcctgccttttttgtttatatcttagaagtaacgattacttctcacgaagatattcattaaaactctaaagatatgatcggatttgttatttggattatcggtttgatactgactttcagagctgccatagagatttggaatgtaaatgcggctgtagagaaaagacttatagcgattgtattaatcgttcttaccagctggctgggactacttttctactacttctatggtaaagaaagaatggcgggatggttgaagtagtgtttgcatatcaatctttctcaggaatccaactgttcaccagttcctgatgttcttccatccattgacgggcagcctgtctttccgttgtctgcgcctcttccagagcagtcattaaggagctgatttccgcatctgtcagacgaatgttgcccaaaagttcggcagcaaaagggtctttctcgctaaaacctttccatgctatggtatgaatggattccgtatttccatatatcagcttcgggtcctgaagaactttcagcttgaaacggtcgaacatccagtgaggcgtccatcccgtcacgacaatccagtctttcttatcaatcgctttctttagggaagcagtcatggcaggtccgctcgaagtcatcagtttataatccaatccatagtctttgatggcctgatcggtagctttcataataccggctccggcatcaataccgacaatctgaccggagaaacgttccttttccgcgttcagttcttcgattgagttgatcgtaacgtaatccggaaccaccagcccgatacgggcaccatcataaatatccccgataacttcgagtttatccccgtattgtttcatataatcttccatagtgacaggcatccagacatccataaatacgtctgctttcttacgggagatagaggtaaatataggtgcaaggtcggcattcagcaactttacatcgtacccctgatcttcaaaaatcgctttggcaaggtttgtcattgcaataccttccgaccagttggcataagcgatacttatcttcttactctttccgttgtctccgcaggaaacgaaggttaagagtatgccggcaataaacattgccgcaatcatttttatcttattcattgattattcctttctttggtgtgattcttatttctttttactttttctgttatctgccataccctgagtgatgcggtccagcacgatcgccaatatcacgactgcgataccgccttcaaatccgagtccgattttcatttgggtgatacctttcagcacgatttctcccaatcctccggcagaaatcatggcagcaatcactaccatcgaaagtgacatcatgatcgtctggttgattcccgtcagaatagtaggcaacgccaaaggcaattgcaccttataaagaagctgccagggagtagctccaaaagagcgggaggcttctactacgtttttaggaacctgacgaatgcccagaccggtcagacgaaccacaggaggcattgcaaagatgatggtggcaaaagctcccggcacagttcccaatccgaagaatagaacggcaggaatcagatagacaaaggcaggcattgtctgcataaagtcgaggacagggcgcattatcttgttacaacgatcactgttggcagtccagattcccaacggaacgcctaaaagcaatgccagacaagtggaagaaagtaccaatgccaatgtctgcatcgtttcttcccaaaagcccatgccgtaaataagcaataaacccaagagggtaaatacggctgtccccttacccgacttaaaccaggcgagcgcagccagcactgcaattgtgatataaaaaggtattccaaacagtacgtgctgaaaaccgtctatgaatcctccgatccccatgctgagagcatcaaaaaaggaagcaaaatgttctgtgagccaattaatggcagtctctatatattgtccgatatttatcataattctattgcgttttgaatgatttcattaatttcttctttatcttttcccgttacttcgatgatcaatgaggaaagtggcactacgccttcaaactcccgattctcatttacgacccagattggcgagttcgtttttgtcatcaacggaagaatatcttccagcaccgtatcacccagcactgaatgaacttcatgccttactacggactcgatggagcggatttgctcttttcgtagtttcagcaagtcattcaaccgcacctctcctactaacagattattggaatcgactaccggaagaacggtcagattccgttcgcgcatcttacggatcagcacctccgggccttctttcttcaaacgtgccactatgggtttatctaccataacagaggaagctgttataatcttgcttcgatctacattctccacaaatcgttctacataagcgttggcaggttcggtcaggatttcttccgatgtaccgatttgtacaatttctccatccttcatgatagcaatccggtcacccaatttaatcgcttcactcaggtcgtgagtaataaagacaatcgtttttttcatcttcgactgcaaagtcagcagttcatcctgcatctgcacacggatcaaaggatcgagtgccgagaaggcctcatccatcaacaggacttcgggattattggccaaagcccgcgccagcccgacacgctgctgcatcccacccgacagttcacttaccatctgattctcgtagcctttcagccccaccagttgcatactttccatcgctttctgctcccgttctcccttttttactccctgtagttcgagcccgaaagctatattatgcaagacagaacggtgaggaagcagaccgaagttctgaaagaccatagccagttctttccggcgaatctgcaacagttccttatccgacactttggctatgtctgttccattgataatcacttctccggaagtagggcgtatcaaacggttgatgcagcggagtaaagtggactttccactaccggacagccccataatgacgaatatttcgccttcattaatggaaagattcgcatctttcaccgcaactgtacatccggtcgctttcaatatttcactttttgttttaccttctttcaacatcttcaaagccttctgcttctcattgccaaaaaccagatagagatctttaatttctattttactcatacaataaaatggtttaggttattaaaataatatacacagcaagacaagaacaaacgataacaggaatctttctttatatcgtataaagttctgatttaaataagggac

SEQ ID NO: 273 - DNA, 6792 bp, Bacteroides thetaiotaomicron
ggacaaagctattaatacaatgaacatattgatccgataataataaatttcggaaaactttgctaatagaattacaccacataaggtccccaaagtgcgagcggcaaaataccagcttgtaccataacttgcgatttctttagtcaactctgcattttcaattaaaagttttggggtaaatacattcattcctacatctaagccaacaatacaaatgatgcctccgaataaaaggcagatggttttatttttcaggagagaaataacttgatagaaactggatgttaatcttttgtcgtctttctcatttattggagtgaaaaataaccagattccggaaattagagtaatggcggcgaatatgggaaacattaatatccagttgttgaaataaacagagcagaatccggccactataggtcctacaaaagaagatagtgctttgatgaattgtccggctgtcataatgcttgataattttccttcagcgataacattggttaataaaggattaagtgacacttgaaggatggtatttcctatgcctaaaagtgcaaaggcgatataacaggctgtctgtgtgaatgtaagtaatggaagtaacattccaataaaagtagataaaagtcctatcagtgatattgtttttctacctttcttgtccatccagatagaaatcggaatagagatgagtaaaaaccatataaataccattgatggcaggaaaccggcttgggtttcgctccaactgaaataatctttcgcataggtgactgatactcctactaagtcacagaaccccataataaagaaaccaaaaagaactggtagtatcttacttttatttttcatatgtgtttatttatttaaatgcatttggatttggtcggtcacccataatgaaatgaagtgttcctccttttttgagtttactccattctatatagttattactaaggcgcttgttattgaatcttacatattgaatgtaacaattgtctttggatacattttctgcttttatgataagtttttttccagagtaataggtgttgtctaacagaatttctacccggtcaaatcgcggactccccagtaaccatacaggatctttgctgcaaccgccatccatttggaaaagtcctatgctgcttaagatgtaccaagaactcatttggccttgatcttcgtctcccggataggcgtctcggggacccattccataatatttttcttgtatagcacgtgcccatttctgggtgtgccacggctcactggtataagagaagaggtaagctgcctgcatatttgtttcattcccatgattaataggataagctcccatattatctcctaaagcattgaagcttactttttcggatgttgcaaatccggcattcagccggtcgatgaattgacgctctcctattaaattgatgaggctttttacatcatgaggaacgtaccaggtgaattgccaagcgctgccttcgcaaaatccgggagcatgatatgggttggtgttttcgatccactctccgttgggacgtcgggggcgtacatatccggttgatgggtcgaatatgtttttccagttatcagaacgtttcataaatgtattgaagtcatcttttttattaagagcgtcaaaatattgagcagcgcaatagtcttgatatgagtattccattgtattggaaacgtatgattgataatgcggagaattccaatcccatgcgtcatcgtatagaggtacataacctttggttatataatcgggataactttcgttaccgacttgtcctcctccgggatagtttatcatagtggctgtttgttggtgaattaatgcccgatacatgagttgactgtcgaagtcacgaattccatgttgatagccggagactatcaatggcaaagcaggattgcctatcatgactctgaaatatttcataccgggattaccattgggaagccagccgccacgacgatagaactgctcgtaagtgtaaatccaattggacatgtactccggatagagaagattataaaatggacctaatgtccaatgcattccccaagcagaatcacctccatatacgcttttacctggcttgtctataagagctttgttaccgttcatatctatccattccccatttacatcattccagatggtccgtggactgatagaacggtaaagattggtgtagaatttttgctttaagaggtaattgtctgttgtgatactgactctttggaaaagtgtttcccaggtatcttgttgattggtgacaactttatcaaaattccatccgaatggtctcgctatttcttcttccagatttagccgtgcgttatcaatgcttactaatgaaatacctgtccttaccataacatcatcaccagtgttaaggttaaagtcgaggaagattcctgcgtccagtttgtcttgactgttattttcgactgtaaatacctgtcgggacttcatgtttgatttatgtagctgttcaatttggctatatactttgtttcgtatccagccattcattgttttgaatggcttatcaaactgcatgacaaaatgtaatttatatctttgtactccatggtatcctgttgaccggcaatcgttcaaggtccatccctctatttctgtgtcagatactttttttacgtatacatcatctaaattccagtcgtattctgctggaaagaaaaagtcaactagtattcgtggctgctctgctttgttgaatgtgtatcgctgaagggaactgcgggtagttgctgttaattctgcttggatattataatctgtaagattaacagaataataaccgattcgggctgtttcggttttcttattaattcgggagcgatacccatagtccggctgtttttctgttccgggttgtatttttaaatctcccgtagttggcatcattaagagtcctgtcattgtccattcgtgaatgtggctgaatcccattatgttttcaacgttatattcatatcctgctttccaatgggcatcttcgttatcgggcataagttttaccattccaaatggcatccatggtccggggcctatcatccatcgtgaaccactggaaccagcaaactgatcaacataatcaattgatctgcgtagttgctggttactacggataaattcttgagttgctactgtttgtccttctgttgatattttaactttgattttagactggtctttaagttttccggttggaatttcgtagatattctctccttcttctacttgtttgaatatcttcttttggttgatttgtattttaagtgttccggattttttagttatagttttcagtagaagaggctgtgttcttgttttcccttgttctaattcataatcagccattttcattgaaataataggagtatcacctatcttattgatttgtgtctcttgaggtccgtttaggcaaatggcgtcaaaagttagggatttaccgttgaataactgcattacaatcttgttgtacccttcctttagaattccgggctgtattgaatatgttagctgtttggtgccaggctttataggagaatcgtaattctttccgttgacttccagtcttaagaacatacagtcttcgtattctacattctctataaaaatattccattgatatttctttagcggattgacatcggatagttttattaaaataggaagttgtatcctgcattgtcctgcccagtaagatgagccagcccattcagcagtaggccccggtataatgtatggaaaatcggccggtgtgtgttcgcctgcataaaaatattttttattatccccaaatccggagataataaatcgatcttttccatccggtgctaaggcaaactccttggatgaattatctgttttgccaagttgccagattgtgctgtattgtggatatacattcgcaatacaatatatgaaaaagataatttgtacaatagttcgtttcatagtagttggataagatgtttttattaagacattatttcaaagtaacttctttttttacaaaggcttttaccaacattattcttttgtcgggattttcatttatgattgtatatgatcgggcagcagcagggatgacaaaagtctctgcataattaaagcgttgtttcatgccgtcctctgtttcaatgcaaacggagtctccttctactatcatacatacatggcatgtattttctgtattcatttgaatacggtctttgaaggtgtaacgatatacatcataaaaatgctctttatgagtaggtagatgctctatagtacactcctgattttctttcatgatatatggatggcatatcaattcctggattactttttccccttttctttcaaaatatagattattcattccgtgttgaatgtttagaggtcgtggtttcccgtctaatcccatgcgtatccagtcgtacattttaaatgtgaaaatatagggtgcgctacttatttccaataccacgcaatcttttcctgaagcatgtatggtgccattgggaataagaaagaaatcgtgctttttagcttggtgtttttgaacaaacctttctatctctaccttcgttgctttttgttgacttcgttccaaggtatattggaattcctcagggacgatgttgtcttgaaagcctaaatatacacatggcgagtttttacaatccaatatgtaatatgtctcatcttgggtgaatggcatgttaaaatgctcttgtatatatcgggggcgtggatggcattggatagaaagattatctccgtcaaaggtgtctagaaagtcgaaacgtatcgggaaatcgtacttaaatgtttccgaacattctcctaatatattctgataatcactatacataagaaaatcgaaagatacttcaagccgatatccgtcactctccagcattagtccgttttcaagtaccatcagttcaaaagaccatgccagattatttacttctttatttaatccttgaatatgatttttcatccattgtcctccccaggcgccaggctcgaaccatggacgaactctgaagaaattgcggctcattttgtgcaatccttctcgtaggtcatttcctgaaatcattaatagttcatcccattctctttgtccgtcaataagtaggtcaatcagaggcaggcattgctttttgtgcttattaagaacaatccagtctacaaaatatagttgtttgtaagcctgttgattgtcttttcgataatctaatcctaaattattgatggctccggcgcgcattctaaactgaatctcatttttaggaatatcaatataaatcaggggagctttccattgagatagggctgctcctgtacctataaatatatttaaatctgcttccgggtcaggttgtatggaattaagcttattttcatcaaaccaattaaccaaatgcttatcagtaatggtgccgaataacggattatctcctccaagataaggagcaatcattttttcaatagtctgtggatctttcattgctacactggaatgaaagaatcgcacattctttcctctttttctgagttcttctcctaacttaatgattaattcatcccaaaagactccaatataaccatctatttttatttgggaatgcttttctatccagtcagctagttggtttatacctttcccaattttgccttttcccaatggaaatgccgggtatatatcatattctcctgatggggtggcagtagagttagtaggtgcaataaattgctgtgtgtgtcttttctcttttgtattttccatattttcaagtatgttgcttgtgtaaatagcagatccgattaatggcgacatatcccataatttacagatatctattttagtgattaaattgagtttctttaattgaaactgaatattatctaaaaagaagtcagaagctttcgctatatttcctcctataataagtttctccggtttaaaatttagcaggaatggggttatgaattctacgaaatttgaagcgaagttttcaaataatgactgtgcattattgtctccgttcgaagcgcgtagtgcgatttcttttacgccagttacctttttatctggaaatagcatattccatgtatttacaaaccatcttgtcgaaaaaaagtcatctgccattccgtctcggtaaggtatgttgtagagatatccatgttcaggtattccttctgtcagttcgttcaaaacagtatcattttcaagaaatgtacttccaagtccggtgccgattgtgactataatgcttctacttgtgtcttttgctgctcctgcataatactctccaagggcataagcggatgcgtcatttatgaaaacagtattcaggtcagatacttttttaatttcttctttaaggttaagaccgaaaagtgactgaaactttggcacaccataaatggcaactatacctttggcatagtcgcaaggaccgggcatggctataccgattccgcctaatttagataggggcatacaggcttgaatgtcagtaataacttttctgactttcgtaatgatgcttgatgttgaatctgtggcattcagttcttcgtgagatagtatgttttgatgaatgtcattcgttagaaggttgacgattccaccttttatatgtgtaccacctatgtctattcccaaataatacttcatagttattatgatttaattaattagtatgtctgaacatataaacatttgcaaatgtattctt

SEQ ID NO: 274 - DNA, 6710 bp, Bacteroides thetaiotaomicron
gaatagacatgaattgcacaaagatgaaaaaactttttagaaaaggtacgttgagtatacttcttttaggagtaataacgtttttcacttatccgctctcagcccaaacaaatagtagatccggtaaaggattatatgaaatctttagtactaaaataccggacggggcgcagtggaaagctcaggataataaatttgtccgtgatgggggatactctaaaaaatcagaaaattatatatatgtaggagcctctaaaagtccggcagagttgaccgggctatccattcctattcgcgagaatccgggaccgggtgagtttcgctatatcacttttgcctgggtaaaatggggaggtgatcaaattggaatgaaatttcatgtttccgaaaagtctgcaaatcaaaaaggcaagaaatatgattttacttatatagccggtaagtccaaggatttgataaatccgatggaaggtcttaatctcggtgaactaccgggacactggatggtgatgaccagggacttatggaaagattttggtaatattacgttgactggtatttcttttatctgcccggagagacgtgatgcgggatttgatgaaatctttctcgctaagacacaggatgatataaagaatgctccgaaagtacttccgagcgaaattgcaactccggtacccgttgatggagaagaggaagggctggtatatgaagagggaacaactaatgaggatgaacaaccgcaaggggtacagattgactgggctgcacagattaaagcgggaggattcatgatgtatccgttgtatttgcttggattgcttgccttagtaatagctttgcaacgcttgctaacttcaagagaaggaagactggcaccaaaaggactgcgtaaaacagtcagcgaatgccttgcacaaggagatttgaaaggtgcgattgcagcctgtgataaatacccttccacattaggaaattcgctgcgttttattttcgagcatgtgaaagccggaagagaagctgtcagtcagacagctggtgatatggccgcacgtgatatccgtacacatttgtcacgcatatatcctttgtcagtcatagcttccctgtcgccccttatcggtttgctgggaacagttgtcggtatgatcgaagcgtttggtctggtagcattgtatggtgacgaaggcggtgcttctatattgtccgattctatttcaaaagctttgattacgactgctgccggtttgatcatcgcagctcctgccattgctttgtatttcattattaaaaatcgtattatgaaattggcttctttggtggaagtagaagttgaaaatgtaattactacgctctatctggaaggagattcgacggatatgaacacaccggggagtaaggaggagaagcatgagactaaactatgatgaagaagacaaagtagaggtgcagatgtcgcccttgatagactgcgtctttctgctactgatcttcttccttgtgactactatgatgaagaagtgggaaatgcaaatacctttatcacttccttcaatgacttccagcttgtctaccacccgcgccggagaggaagctgttatcatagcagtggatgaggagaaaaatgtgtatcaggtagtaggacatgatgcgtacactggtgagaaccactatgtaccgatttctgatctgaatactttccttacagaactccgcaacagtgaaggtacggaaattgctattgatgtggcggcttaccggactgtacccgtaaatacggtaatagagatattcgatcaatgtcaaatacaaggattcacgcgtacgcgtgtccgtttgggtagtaaaccttattaagcttatgagactatcactatttaataacgaagatgaaccggaagtgtctatgtcgcccttgatcgactgtgtgtttctgctattgatcttctttcttgtctctacaatgacgaaggtgaaaaacagggatatttcagtggatctgccgacttcggaatcagctataaaactgaaaccggatgataaacaggctattgtaggactggatgctgaaggtaacttctattgggacggacaaccttgttcgactaattttatgatggaacaattgcgggagacctgtatctctgatccgggtcggcgtatccgcattgatatggataaaaacactccattcggacgttttgtggaagtaatggatgcttgtcagttttataatttaacgaatataggaatacgaacatatgacgaaaactacaacagggagtagccgtctgacggttatcctatcatgggttattgcgctggtctgcctggtaggaggagcgttgtttatctggctgatgccatcaccaggacagggagctattgacttgcaagcgaaaaaacagaaatctccgaaaagtatcagtgataaaataaagcaggagcaggctcagcgggagcttcccgctaattattctgagcaattagtgaagcagtcggaagtattggtcaagaaaaatttggaagatcagcttcgtaaatttcaggaaatggctaagaagatgaggcagcggaaaaatgaattgttgactaaagtagagcaaagaaagttaccacgtacggcaccggatgatgctaatgatacttcgaaagcaaggaatattccgcaggcgggcaagttatctgcgaatccgtcggtagatgatatgtatgctcttttaagagaatatgaggctgaaatacagcagaaccatttggctgccaatgcagctaaacaggcgctttccaagggactttcgtttcccgaggtttatagttctctgaagacaggttcttcccgtatgccaagttttgatgaactgattcgaatgcagactaaagggggggaatgggctacttcagcgggaagtaatgccagcgcaggtctggaaataaaaagtacggcagacttgaacaattaccgtggtctgttgggacaagcgacccgacaagccggacttgctcaatctcggttggaaaatctctttggagtagtgaagcaggtcggaaagcccggtggcggctttggaattggcaatggtcagccgggcggaggtgaaggcagtggcaatgggaacggtttcggtggcatgggggaggcagctcagggcagtggaaacagacgtccgatgaatgcttatgcaggtccccggcttaatcaggaaatggtaaaagctcaggcattgcccggacggcgtttctcaaaaagcgcggatcgtaaagggtggttatatattaacacatggtatatgataggaccgtgggaaagttttgggcgagaggacttttcgattgtccatccgcctgagatatctgtggactttgatgcggtatatactgacggacaagtaggtacaggggtgatggaaacggattctcatccgataaaggtcataggggaagaagtgtatttggatggtacgctgcgatggaagtttatgcaaagtgaatcaatgcataatacggttcctgtcactaccggacattctacttattatgcttatacggaactttattttgatgaggctactaccatgctggttgccatcggtacggatgatagtggccgggtatggataaatggtaaggatgtatggcgcgattatggtaccagttggtataatattgacgaacatattactcctttccagttccgtcaagggtggaaccgtattcttgtgcgattggaaaatggcggaggaggagcgtgtggtttcagtttcttaattattccacaagagtaagatgacacacgttggccggcttatagaagatgaactacatcgacaaggattgtctgtcacttggtttgcagaacagctttgttgcgcgcggaccaatgtgtataaaattttcaggaaatcaagtattgataccgaactccttttgcgaatttctgatatcttgcaatatgacttttttcaatgttactcagcgtgtttaaagaacaaaaaggaaatgatgtagttgtggatacatcatttccttctcttttataattttagttttgtaccgattgtcgttttcttttttgtccgaaggtattgaaccgatacgcaatatatgccataaaatatacgttagaagtactggattctctgtcggtgatagaattctcggaaatggaacgttccgaactttcattctcacgaagtatatcatataggtgaaatcggacggttgcctttttcttcttgaggaagcttttcgatatttgtgcgttccatagggtgcggttagtatcatttttaccgccatatcctctttttaatctacaattgatattggatgagatttttatatcccaaggtaagtttaagtttgcttcagttccgaatgtataatcaaatgtttcccgtcggttctcttttttgatagaatgttctgattttcgatatctgacttctgcagataactcaaagtcaatcagatcgctacggtagctcccttttaagcgttctgataaaaagaggttagtcgtattacttttaactgcatctgactctttgttgagcacagtgaaaccgacagagttgccgtaatttgtattggtgtgtgtatttactgtgaattttttgttggataatggagtactgaaggtaagcgaaccgtttattcgccagttcccgttcacattagtcggttgggtagtctgtcctccggtattttcgtcatatgtgacaatacgtgttgtactattcattgtattattataggagaggttagcattcaaactacgggatgtttcagtaaagtaagtattaaatgtagctgatatgttgttattgaatgatggtttaagttcggggttagctagccgtatgtttaaaggatcagaaatatctttttttctatataagtcggtcataccgggttgtgccgttctcccacgatagtttatttttaaggttgtttgtttagagaaggtatacttaaagtttatggtgggggagtagtttattgcatttctggataaatactcaaaggtcgtgtcccgcatatagcttttatttgtcgttttttgtgcctcaacttctatacctatattataaaaatagttggtgcggatagtacggaaaaatatgccggtttggtgggtggaatatttatttttgtagcaatcactgtgcgctgtgtcaggatattgactgtatgtatcttcttgtttatcccagtcataggcatatttttcagagagtgaggaacggtgttgatagctataattaatttcgataaaccgattggtaaatacaggttccatatatgttatctgaacttgatatttattgtttttgtcaagtttttcaatccattggttcaaagtttttatactatcaccatacttcaagtaataagtattcgaaagactataccgatcggaattgccgtcatccagatcgtaataaagacgtaaggcgatgtttcttcctttgctgtttaatttgcggttcaactgcaaagagccattggtggagaatctgtcattcgtttggtggtttgtggcttctttccggttgataggagttgactcgttgttgagcgtttctgagaagttgcctgaattggagtttcctttggaaaaattaaatgtcggtcgatacataatagtggtgaggctgtctaatttccattcgaaacgaaaattagcggaaatagcacttgtctttccatcggattggttgttctgcagggaaaactgagaagtgttgtctgacaaaaaagattctgtatgacgcttgctccatgaatcgcgtttattttcccggacttcaatactacctccatatttgagtttctgagtattctgagaatagttggcacctattctttgattggaattaattccattgtcgttggcggtaccattgattgataagttcattttgtttttgaaacgattggccattccttttgccctataatggtcgtcatttccatatcctgcttcaaagttaccattccatccttttctcatacttggttttacgcgtaagtcgagtaccatttcttctttaccgtcatctactccggtaatacgtgccatgtctgatttcttttggtaagtttttagttgatctatcatatcggctggcagttcttttaaaaccgtattggggtcgttaaggaagaattcttctccgttcatcatgatttttttgacttcctgaccattaatgattaatttcccttcttcgtttatttcggctccgggtagctttttgactagttcttccaatgcagcaccttcactgacgcggtaagcggaagtattatatgcggttgtatcacctgtgacgacaacaggcggggcttgggctacaatgacggtttcgttaagaagtacagcatcaggtttcaactctattttgcctagttgaacaatagtctgggttgtgtttatttgcaggggcttatattcggtagcgaggcctatgaaagaaatttttagcaaaaaacgtcccgggagagttgtgagtgaaaattttccctgttccaagctggaaatgccttttacataattactgtcgggcaaggataacagttgtatggtagcttgctcaacagggaactgtgtgtctttttccagaatactcccctgtactgtgacacgttgagtctgtgcttgaatataagcagtatttatgtatgatataattaatgttattagt

SEQ ID NO: 275 - DNA, 6641 bp, Bacteroides thetaiotaomicron
tatatagactgattttattataaagtctgattgttttgtttatagagaacaaaatatgagtgatttggttcgttatcaaccggcattccgattaaaatcgtatatttgcgtctgtaatcagattgggtccatgaacgaaaatgtccttactaaactaaagatacttgcagaatcggccaagtacgatgtatcctgtgcatccagcggtacagtgcgctccaataaaccgggcatgctgggcaataccgtaggtggatggggaatctgccacagctttgccgaagacggacggtgcatctccttgctcaaagtcatgctgaccaattattgcatttacgactgtgcctactgtatcaaccggcgcagtaatgatctgcctcgcgccacgttgtctgtctccgaactagtggaactgacgattgaattctaccggcgcaattatatcgaaggtttgtttcttagttccggtgtggtccgtagtccggattatacgatggaacggcttgtgcgtgtggcgaaagatttgcgtcaggtgcatcgctttaacggatatattcatctgaaaagcattcccggagcaagccgggaactggtgaatgaagccgggctgtatgccgaccgccttagtgtcaacgtagaaatcccgaaagaagagaacctcaaactgctggctcccgaaaaggatcataagagtgttttcgctccgatgaagtatatccagcaaggcgtgctggaaagcaaggaagaacgacagaagttccgtcatgctccccgttttgcgcctgcgggacagagcacgcagatgattgtaggggctacctccgagtcggataaagatatcctttacctttcgtcggcactctatggacggccgacgatgaagcgtgtttattactccggatacgtctccgtgaatacgtacgatacacgcctgcctgcactgaaacaaccgcctctggtacgtgagaaccgtctttatcaggcggactggttgctccgtttctatcagtttaaagtggatgaaatcgtagatgacgcatatcctgatctagatctggagatagacccgaagctctcgtgggctttgcgtcatccggaacagtttcctgtcgatatcaataaggcggattatgaaatgttgctccgtgtgccgggcatcggggtgaagtctgctaagttgattgtggcatcccgtcgtttttcccgtctgggcttttatgagttgaaaaagataggcgtagtgatgaaaaaagcgcagtacttcattacgtgcagggaactgcctttgcagatgcagacggtgaatgagctttctccgcagcgggtacgcagtctgctgcttccgaagcctaagaagaaggtggacgaccgccagttgatactggattttggggaataaatggagtttcagatgttgtaaaccgcaagataatgaacgtctatatctacgataaaacttttgatggtctgctgactgctgtcttcgacgcttattttcgtaagacctttcccgatttcctgttgtcggaaggggatgctttacctttgttttatgatgaattgcatacggtggtcaccgatgaagagaaagccgcccgcgtgtggcgtggcttgcagaagaaagtttcttcttccgcgcttggctgcctcacccagtgttggttgtcggaattgccggatatagggatggttatctttcgttatattcgtaaggcgatcgacgctccccgttctatcgagactaacttcggcgatccggatgtgcttctgcttgcccagatatggaagaaggtggatggcgaacggatgcatctgatgcagttcgtgcgttttcagaaagcggcggacggtacgttctttgctgccttcgaaccgcagtataatgccttaccgctaaccgttcagcatttcaaagatcgttttgccgatcagaagtggattatctatgatatgaagcggcgttatggcttttactatgatttgcaggaagtgactacgatttcttttgatgacgacagccgggaagctcatctgattacggggatgctggacgagagcttgatggatgaaaatgagaagatctttcagaagctctggaaaacgtatttcaaggctatctgcattaaagaacgcatgaatccgaggaagcacaaaaaggatatgcctgtccgctactggaagtatctgacggagaagcagaagtaggcttattctatccgctgcaccgtcacatccggaaatttctgcatcaacgaaagtaaatgtccttcatcattgttccgttttgatttgatgaccattgtgtgacttgataggattccatttcacccgaatgctgtgtttccatttcgtaagagacaatcatataatcttttgaattaaatctgtccgctatctgtttcaaggtgtctttgttgttagtagagaaggagatcatcgaacttttcatgcctacactcttgaagatgtaactgagtagttccaggccgatcagagtcagtacggtagtggctatgccgatggtgtacattcccgcgccgactgccagaccgatgccggctgtagcccatatgccggcggctgtggtcagtccacggacgatttgtttctgtaggataatggttcctgcaccgatgaatccgatgccgctgactacttgtgccgctacacggctggggtcgagcgtcacactgttttctttgatgatctcttgaaatccgtattgcgaaacgatcatgatcagggcactacccaatgatacgaggaagtgagtgcggtatccggcttctttggcacgatattcacggtccagtccgatgatggctcccagtattcctgccaccagtaatcttaacataaaatcaacgttcaacatcataggttcggtctcctttcttttctttgtttgtttcttctgtttttttctttaaaaacggttagtcctataaatatacaattcttttctctttttgtgctattaatttagtaatatttgaacgtagcatatgcattttatcgtatattcgcagacaaaaccgtgcattacgccaaagattgaataagaaatgaagaaaaggatattttacatcattagttttctggtgatattttgtatagaggtgttcatagccttgtatgtacgtgatagtttcatacgtccttatatgggagatgctttggtcgtggtgctggtatatagtttcgtacgtatatttatcccgacaggggtaccccgtctgccgttttacgttttcctgttcgcttgttttgtcgaagtgctgcaatattttcagttggtggaaactttgggaatcaccaaccgtgcattaagaatcattttgggctccacgttcgattggaaagatattgtctgctatggagcaggatgtatctttatctttctgtttgagcaaatattcagacgacgttaattggaataacagactttcttgtttggcgattgcttattgtacgttctctttatcttcgttttctgaagtcggattcagatcgtgtccgcaatacttgcagaactgcgcattgtcttcatgccctgaccgatggcagttcggacattctttgtctcttctccgtttgtagtccttcatcatggaggcggacacaatgccggtaggtaccgcaatgatggtataaccgatcagcatgacgcaagccgaaagaaactttcccagtccggtgacgggagttatatctccgtatcctacggtggtcatcgtgacaatagcccagtagatactgttcggaatgttattgaattgagaattgggcaaagttccttcgatcatgtacattaacgttccaatggaagtaaccaaaatcacaacaaacagaaagaagaccgcaatctttttactactttcccgaagtgcggtgagcagtcgttcgccttcattcaagaaattgaatagcttaaagacacggaatacccgtatcaatcgaaatgcacggatgataagcagatagcgtgctcccggaaagatcaaaccgatgtaaagcggcaaggtagccaacaggtcaacaatgccgaagaaactgaatatgtatttcttcgggcggggagagcaatatattcgtgtcagatactcaaaagtaaagaaagcagtgaaaaggtactccattacgacaaatggggtagtcagataggaggggagccctttcaggctttctataatgactaataatacactggcaaggatacagccgataagaaccacatcaaacagttttcccgaaggagtgtctgactcgaagatgatgatgtacagcttatgtttcagcttttggtcattcataaaataatggattctttcttttagtttcatgagaataatcagttgacaggccaatatcccaataacctgtattttacctattacttattacctgctacttattacctattacattaatctattacccagtgcttgttatatgcaaccgtcttctttggatcatagtacattccctcttgtgtaggtatctggagaacgtatgtttttccggtcctgttctttagggtttgttcgcgtagccaagggttcgcatctcgaagttgggcgtatgtgattccctgctgtttggcaaaatcgcttaagttggcaatgggggtggtgaccgttatctctttgtaggggataggcgggtacaggtgttcctttttcagcaggaatccatatcgttgaggattcttgaatatttctttgactgccagcaggcggaacatatagcgggaagtctcttctaccagccataagtccattgcgtggctggcaagttgctggtccagttgagaggaaattcgtccttgtccggcattataggcggcagatacagccatccagtctccgtatttggcataagcctgtttgaaatatttgcaggcggctaccgttgctttttcgatgtgataacgttcgtctacgttctcatttacttcgagtccgaattcccgtccggtagcaggcatgaattgccataatccggctgcaccggccggagagcgggctatgttgttgaggttactttcgatgaccatcagatatttgaaatcgtcggggataccgttcgctttcagaatcggttctataattgggaagtaacggttcgcacgcttaattagcagcatggtggtggagtgcatataggtgaacgccatcatctcccggtccatccgctcgcggcggtcgtaacggcggaggtcgatcgtctctccgtcaaaagtcacctgctcgggaacggtaggtgaggtgacgcaataaggtacttccgatttggcggaatgctgttcgtctacatgactgctaccgatcagaataggcagggtagctccgatgcagaacactaatataaaggttagaatgtagttgatcttggtaaatttcttcattttctgttttcttttagtcatttgattggttcttattccaatatctggcaaccacggcagtaatagatgctaccgccaagataattctccttgacaatggtttctccgcaacggggacaggctttgcctgccgtgtctttagagaggcaagctgtgtacttgccgttttctccgaacaggtccgattccgtgtttcgtccaccctgtcggtagatatcgttcatggtttcctttacttgatagaacaaattttctttctctttgtctgttaatgctgctatttttttctttggatggatgtgggcatgatacagaatgtcctgtaatacaccgtttcccagtcccggaacagtctgttcggtagccaggaaagctttggcggatttcttctgcgcactttcatcattaatcagtccgaggaaatattctttgctgaaagcgtccgacatgacctgcggcttgcttttcgctgtccggtaatattcggaaagcatgcccgtagcagcattcttgtcatagcacatgagtccgccatacattctcacggacgctataaggcagctttcatcttcgaatgcaataagtaactgatgtttggccggcagcttggtccctggagtcagatagcgcagatttactccgtccgtgagtacgagcactttatcttctattgtaatctctaccatacctccctgagactgcgcactgtttatcctcttatcgactagccattcggcaaactcatcggaattgccgttaaaccaagcgaatttgtgagggctgaattgaataaatacatctgatattctttttcctacaactgtctcagtgagttgttcgcagagataacgggcttcgggtgcttctatcatatagtctctatttctgattttataaatgttctcatgcaaatataatatttattagtcagaactaaacaaatccggtggaacaaaatcaggttgctgcaatatctggcctttattatcactgttaagaaatgaaatctcgatttcttgtgtaggataatgactatatgtggttggaggaaaagtatatgagttttgcaaagcgtatatataaatattcaaaacaaagtgaaggattcaaacttgttctaaagtttaatttcctccacgatgttctgaatatcaagttaaagtctagttattttatttgatatagatggcttatagatagtcagtaagtatcttatcagcgtaattttataaac

SEQ ID NO: 276 - DNA, 6575 bp, Bacteroides thetaiotaomicron
gcagtctgattcagcctatagtcatttaagactagtgtcaaagttagttcactgcaactctacttttcaaatatacacttatattttgttgtgatatttaatactgcaaatgtaaatgtgtcaaaagcaactaaactctcctccttcctgaaggaggggaatttagttgcttttgacacatcttcttttctgtttcttatttcagtaaatgtcccccttccctgtgttttgatttactacttaatctgttaattattagaatgataataacagatgttcttttttctaattgtccccctctttcttgccttgttttataagccgattgcctatctttgcggcaggtttttaaataataaatcaaaaagagaaaactactttatgaaacacatttcgaacttcctcagatcaaaaagctggaacgtatttttgtttttatatcttgctcttcctttgtttgcgcaaaaggaatataagatcgatcaggtatctgttgttaatgtaggcgatggcagactgttgtttcaggaactgaaaacggaaaaagcattgaatggcgaacatcgcatcatagatggttatcattccgcctatgtgctggcatcttttaaagatggtttttatgatggcggatacaaagaatatgtggacaatatattaataacggaaggaagttataaagaagggcggaaggatggcctcttcaagattaactccaagtttgacggtaagctgaaagaagaaaagtcctataaggaaggtaagctggacggtacgagcaaaagttactttactaccggaaaagtggaaagtgaaagaaacttccggatggggaaagagcacgggaagcaactgtcgtacgaatctgacggtactttgcggaaagagcataattacaaggacgggaagcaggtaggcaaacagtatacttttctgaaaggtacatatgatttgtatgagaccgtttatttcaatgaagaaggtttgcaggacggtgaatattcgtccgtgtttacgtttggctcgccacgtatactgggtagttataagaatggaaagaagaatggtcggtggactacttttgctgaaagcggagatacgctgatgattgaaacctatctggatggaaaagaagatggactccatgtctcatttgccaacggaagtggggtaaggcagaaagaatattatatgaagaacgatcgtaaagacggtttataccgtgaatataatctggaaaatggtgaattgagatatgaagctacctatcaggccggcagattgcatggcaaggaacgacggctgatagtgagcaaccgctttgattattgggaaacttctacctatgtgaacggaaggcagaacggaccgttcgaagctcgttatgtaaagaatgaccagcttcgtgaatgtggggaatataagaatggtcgccgtgtaggacgatggaaacgctacactattgatggtaaactggaaaaggaatgggatgaaaactaaccggtagatgaaaggtcagggcataaaaaaaggagcaacgccttgctccaacctttgttaaccttaaatctaatactatgaaaaacacagtgcaaagatacggacttctgtgaaatctgcaaattatccaagtaaaacgctatgttttataacattgattaagtgtttgttttacgctttatacttttgttaatactttccgatggtctgaaagaggactgctttccttctttttagaataataaatagctgaagttagagaactttacagtattatttcttatttttgttcttaattggattacagaaagaactatgaaatgatgagatggatgaagacgatgagatatctgaagtggatgctggtgctgtttggtttaatcgggatgacggcttgccggcaggatacaccccattttcgtattggggtggctcaatgcagcgatgattcatggcgacataagatgaatgatgagattcttcgggaagcaatgttttataatggcgtttcggtggaaatccgttcggcaggagatgataacagtaagcaggcggaagatgtccattattttatggacgaaggagtcgatctgctgattatttccgctaacgaagctgctcctatgactccgattgtagaagaagcttatcagaaaggcatccccgttattcttgtagaccggaagattctttcggataaatatactgcctatatcggagccgataattatgaaatcggtcgttcggtaggaaactatattgcctccagtctgaaagggaagggaaatatagtagaactgacaggattgagcggttcgactcctgcaatggaacggcatcagggatttatggctgccatcagtaaattcccggatataaagctgattgataaagcggatgctgcgtgggaacgtggtccggcagagatagaaatggatagtatgcttcggaggcatcctaagattgatgctgtgtatgcccataatgaccgtatcgctccgggtgcctatcaggcagcaaagatggcagggcgggagaaggaaatgatttttgtcggcatagatgccttgccgggtaagggaaacggactggaactggttttggacagtgtgctggatgccacctttatctatccgaccaatggcgataaggtactgcaactggctatggacattctggagaagaaaccctatcccaaagaaacggtgatgaataccgctgttgtggaccgtaccaacgcacacgtcatgcagttgcagactacacacatctccgaactcgataaaaagattgaaacgctcaacggacgtatcggtggatacctctctcaggtagctacacaacaggtcgttttatacggcagtctgattatccttttattggtagccggcttattattggtcgtttataaatcactccgctctaagaatcgcttgaataaagagctttttaagcagaagcagcaattggaagagcagcgtgacaaactggaagaacagcgtgaccaattgatacagctctctcatcaactggaagaagctacccatgccaagctggtctttttcaccaatatttctcacgacttccgtactccgttgacattggttgccgacccggtagaacatttattggcggacaagacattgagtggagatcagcaccggatgctcatgctgattcagcgaaatgtgaatatccttttgcgcctggtcaatcagattttggatttccgtaaatatgaaaacggcaagatggaatatactccggttacggtggatgtcctttcttctttcgaaggatggaatgagtcttttcaggcggcagcccgtaagaagcatatccatttttcttttgatagtatgccggatacggattatcatacactggcagacatggagaagctggaacgtatttatttcaatctcctgtccaatgcctttaagtttacaccggaaaacgggaaaatagccatccgtctgtcttcccttagtaaagaggacaagcgatggatacgtttcacggtggcaaataccggttccatgatttctgccgaacatatccgcaatgtattcgaccgtttctataagattgatatgcaccataccggttcgggaatcggactggcattggtaaaagccttcgtagaaatgcacggtggtatgatctccgtagagagcgatgagaaacagggcacggtctttaccgttgaactgcctgtacagtcttgtgaggctgttgctgccgaaccggataccacccttgtttctgcggattcccgtacaacagatgttctattggcagaagaggaagaactggaaaaaggatatgactcttccaaaccgtccgtactgattattgatgataatgaggatatccgttcgtatgtccatacgctgttgcatacagactatacggtgattgaagcggcagacggctccgaaggaatccgtaaggctatgaagtatgttccggacctgatcatttctgatgtgatgatgccgggcattgatggcattgaatgttgccgccggctgaaaagtgagttacagacctgtcatattccggttattctgctgacagcgtgttcactggacgaacagcgtattcagggatatgacggtggtgcggattcttatatttcaaagccgttcagttcacagctgttgctggcacgtgtccgcaatctgatcgattctcaccgtcgtctgaaacagttctttggtgacgggcagacattggcaaaagaagatgtctgcgatatggacaaggattttgtagaaagattcaagtcattgattgaagagaaaatgggagactccggtttgaatgtggaggacttgggcaaagacatgggactaagccgtgtgcagctttatcgcaagattaaatcattgactaactactctccgaatgaattgctccgtatcgcccgtttgaagaaggcagcttctttgcttgcttcttcggacatgaccgtagcggagattggttatgaagtcggtttcagttcaccttcttatttcgccaagtgctataaagagcagtttggagagagcccgacagatttcctgaaaaggaaaggatgatttcattgatatcgtaaagagggatatatgaaagattataaagtagataaagagagcttttccgaatcctttcggaaggaagtgtacgaagtcgtatcccagatacctgtgggaaaagtatctacttatggaggtattgctttgctgttgggggcaccccaatgctcgcggatggtgggacgtgcattgaaagaagtgccggatgaattatccattccctgccatagagttgtaaattccaccggaaggctggtgcccggttgggtggaacaaaaacaactcttgctggcagaagaagtttctttcaaagctaacggatgcgttaatctgaaagaacatttgtggcacgtggatgaatgaaggatgcaaggaaggtaagccatatcatccgtatccatacaataaagaaaacccatacatgaagccataaggtcctggtaatgaaatctctgatgggtacagggacgaatatgtcgataggaacgatacataacagcacaaaacagcaccaaaatagaatcttgtctgttgcggtacgtgttggtctgctccaataccagagcatgaaacctgccaatgcgataatataggtatgcttctcggcggagtcactcagtaatactacccagcccatgagaatgcccaaagcctgggcacggaaggcaaaagacgaccatttgcggaaattccccaaaaagagcagagtcagcaagccgagcattcctatctgaagtgcacggaagtgtggcaatgtccatgctgcaatggggcgggcatagaaaaatgaatcataagctccggcggactgatgaacagcaagactatggcaccattcttcataataggggagcaaatctgcaggagctatttttattaacggtaatgcaagcaatacaatgcccattgtaacggcatagccaaagttacgccatacgtgaggatagcacagcaacaatgccagttcgaaaattccatatactttggtacatcccgaaatcatgattaacagaacagccagaaatccacggtctttttccaataacgtataggcgaataagaataaataggctaccgttatgttatactgaaatgaaagtaaactttgtcctaaaatcagtaacagaaaaaggaacatacggcatttctgctgctgggtgaattgttggggcagcgtgaagatcgccataaagaacagcgaataattgaatagattccacgcgaaaggtcccagccatgcaggcagatacgcaaacggagcgaacaataccgtgaaaactggagaataaaggaagtagcgtccgtgagcttctacaaattcagttgtgtatgggctgatgccttgccagaagaattgagtagcgtccgagaagaccataaagttttgatgccgtcctcgtataaattcgagcagagtcactataaaagcgagcaggaaacctatcatgtagagattccgccggctatagaaaaacggcattttggggttctttttactaaggaactgtacttggcttttgtcgtctagtgtggcagtacctgtttgtttttcttttgttgtgtaatgacaattatccttccccaggaaaattgtaatagccctgttgaacatataaatctagtttagttattgacgccaaatatacggtgtttaagtgaaatattcaaacttattttatatttatctgccggtttgttctattttgctgagtgataggggaatattacccggaaactttccatatcattacaaataaagccctctgtatgccccggattttgaatataatttgtatgtttaatccgttttttgtatctttgtgccagcaagatactggaacaggctgtttttatacataaaaatgctattttttgctattcgttgaaaggattatcttatcaaattctattccttttttaattactcagtctgtcaataatcattttattaattatttcgggattcattgttatttgtcccttatttaaatc

SEQ ID NO: 277 - DNA, 6316 bp, Bacteroides thetaiotaomicron
gttttatattatgtaaatgaataattttaaaatgtataacctaacttaatcgtctcattccaacggctcgaacctgctatatattcaaggttgaaaccgtgcgtatatccgccctgaatttcggcataaatcccccgatgaaagtgatagcgtaatccgacgttcactgtcgcccgtggggcagttgcatactcattctgcagatggtaataatctgtcaggcggtatggaggatcgcccggttcggctgtcgtttcagtagtcctgctcttctccgtgaagtctcctatggataaacttgcggcagctttcacatcgaatcttccggcatgaagtacgccggatgcgtaaacccgtccacaagtcattgtctgtgacgcgacataagggtacatttgggtagtcatgcttttaaaagacgaaatctcggctccgacacgcaattctcctttaggagcgatcaactcatattcgggctgaacggataaagcctttctttcgaaaatccggttggaaccgtaaacatgggtagtcgtgattccgttggatatctcctgtcccaatacattctcgtcatttgtctggcgtgaccatgagaggttgatccgcaggaaatgttcggtactgcctttggcgaaacggtatctcagatgcgatgtaatccggtgtgccggaaacttaaaccagataacctctttctctccggcggaaccggaagaatgcagatactccacatctccgtaaagcgatccccattggacctgaactgctgctccgtgagacagttccttgatggggaatccgttgatacccgattcgctcagatggactccgcttcccgaccatgcttcgtaggcaccgtacatcagtcctttatcaaggaatgcgtaataaggtgtagcggctgttccgatctcttctgctgaaacggattcgctgtttttgctgaaaatataagagaatccgatcgcataatggtccgaatgatacatgatgccgggagctacttttaagtccagtctgtagttggtatgtcgcaagtccttgcgtttggagtaattggcagaggtgaaatcgatctttccgccgatgcgccagttggtgccggcatctgctgctatacctcccatgaacgcataagtttgtaaatcctttcggccgggggtaaactccagtaggtctaccggataaaatccgggatggatgaacatggagccgctcatatccttgccggaagtgtggtcgaatgagaacgagccgatcagagaatacttctttaagtgtgtgatggacttggctactgcaccggcactccataatttgccggcttcgtagtagttgcggaagtcaccgtgattgttcttgccgtacagttcggcgtaggagacggtgacgctgtccatcatgattcccgttacgtttgttccggcattccatgaatttcgtcgttcgataacatcgtaagtctgtgccgagcttacggctgctatacacaacagcatacatcctatatatattcctttcatattactcatgcagggattgttgttctctttcataaaaatcggcggaagagttgttcgtatcttccagtatttcataaccggcctccttcgatgcttcctcgtctacccgacggtgcaggctgcgtccgtcatacagtgcactttgactgacatatccggcatcgatggaaggcgaaatgcgttttttgttgctcgacgaaccgccatagtacacctctaccccgtcaatcacccagtcgagcggaatcttgatgacctgatccaccgtgctgccgggcttttgtatcacactgcccgtttgctgtacatactcctgtatcgtagtgtcctgagccttgaagatgacagtggcgggagaaaatatagagaatgtataggcattcgcctgtcccagtttgatgaccacgtccagataatggtcgcggctgatctggtcgcccggagcaggatgatacatcgtattccagtaataaacattgttgtagcaggcaaaatatcccggtttgttcagattgaccgacagcgggtattgcgcggcatgatcgatggctccgttgacggcgatgaccgcatcggcaccgggtgccagcgggaaggaagtgccgttaccgccgaattgccagatgcactggacgataggagcgaaatcggggaaaatggttgctccggttgcttcgtcctgcgtcacccatacgttggtggactgggagttgtaaggatcgagcgtacctaaacacaaatggtcgagatactgcgtctgggaatcattgttgtgcaggataatgtatttatcagcctgataagtaccttcctgcggcagcttggtacatcctccgcaatagatttccttgataatgatggcaccggctttggagtgtgtaagcggaacgttgagtgtgatatctccgtttacgagttttaccttgtctgccagtccgttaaatatatgctgatcggctttatcgctgatttgtatgcggtatatgccgttggtcagggcgaattgcgctgtaccgttctggtcggttaccgtcttgtaggagttgccgcgggcgatgtcttcgatttggacggtgatgccttcccgaaggtattccgcataatcgtccggatagacggcagtcacctgcaaggtgtgcagctggtcttcgtaaggattgcctttgtcgaggtccgtacatcctccgagtaaggatgtgacgaaaagcagtatgatatagattgactgttgtttcatatttctaaagtttaatgcggcaggttagtccataataaaagttcggggtaaagattgcactggttccggttgcgtatgatttcacatacgcccgtgagttcgtgaaattaatcgcgttgaacgacagcgaaacatgatcgcctatctccttggtaatgctgatattggcagagaaatacggatcatatccgtcggctgcgaaagtataggcattgcccgatttacgtatcagatgcgcgaagtccggattttcggcttcggcggcggtgaacggatgtacctcgttgttcaggtcgaggtaggcaaccggataaatggccgtataagaatttccgtcgtagatgctgcctcctgttttctcgttgctgttctcgctgacgttgaacgcgtaggacgtaccgttatattcggagagattctgcgaccgcttgatgagcgaggcttccagtttgcaggatatgatcagccttgctttcgggatacgggtgatcgctgtgatattggcatccagcgagtgagtgcgcttgccgttggcggtcgtggatgagttgtcgccgttggcatatatacctacatattggtaggaacggttggcgagagtggtgtgcgaccatccgttttggtagtaataagacaaggaattgtctatgtatttgctatatgtataggccgcatccacacggaactgcgtacggagaggagtgatctccggaaaatcgatgatcatttccgctcctctgcgggtgatgtccggtccgttatcgggagaggttgacctgacgaaagtctggtctttcacctttacgtccagcggtgtccagtaactgtcctcatcgtcccgtatatatcccatgcccgtctgattgtctacggtaatctgcggattggcggacagctcgaatccttccggcaactgtagaacattgtatgcgaacggagtataggtacttgtatatttataaggcatcttcgtgcggttaaagtatcctaccagtgaaatacgggtgcgggctacattgatgtcaactcctatttcggcattctgattcttctgccagcggagtttctcgttgtgtaataaagtatatggctgactgtaatagacgtaagccgactcattgttattgtatgagactccgaaagtctgaatatcccgatactcctgtcggggatagagtacatagtacgaaggcagcttctcggtcactccccatccgccccgaatcgctatgttttcgttcagctgccatctggcgttgaaacgtggcgacagtgtgttcagcttgtcgtattgcgttccgctgatgaacagattctcccaacgcaatcccgccatcagcctcagcatggtgctgccgacagctaccgacaggctttcttccgcatacaacgaaacattgtgcatatacggataagccgagtaagaacgggggcgatatccgttgggagccagcgaaggattctgataatactctccgtcgcccacattgcctgttcctttccattgcacgcctgctttcagattgctggtaacgttcttgaaacgacggttccattcgtacttcaacgaagcggcataatccagttctttggaatcgacaatctgatcggcaaagaaatggtaaggcagtttgcctgcaatgaaataaccttcctgttcagcgtggactgccggctgttcggacgcataagaataaggtgtatgtgcatgcgacttgttatcattgtaatacaccgatgcatccagtttgaggttggtaatccatgacttgttgagcagccatgccaatgacgtgtttgcacggaaaacgttgtctctgactttggtatattctcccgtatatgcgtcgggatcatccttcgtattcattcctccgatgttaccggtcagcccgatgtcgaatcggagcactttccggaacgtattgctgtaacctgcggagaatcctctgcgggtataagaagtatagggtgaattaagcttttgagtagccttgatccattcaccgcttatgttgacgattcctttatcgttgccgaggtccagccctttggaaaaggacacctgttctgtgcggggattgatggatagcagtacattccacggagtcttcccttttttcgtatggattttgaccataccgctgttcaagtctccgtactctgccgaaggtactccggtgatgacttctaccgattcgatatcggccacagagatgctgcgggtatctattccggtcatattgccgaaagaagagttgttgccgatgcgtactccgtctacttctatcgccgttccgaaagccgcgttgcctgcggatgaacctccgtcgcgcagagagaaaatattgttgctggtcaagtccggaactttcgtctttcctcccggaagaagggcggaaatatcgcttacattcgatatctgcagatgttccagtgcgttactcccgatgttgagcgtggtgttcagctcactcttcggagcttgtgcggtaacgattacgtcgttcagggcaagtgtattttccttcagttgtatctttaatcctttgatgctgttgttcacattcaccggaaccgttgccggaacataaccgaggaaggaaacttccaattgatacttgccttcctgtattccttgtatcgtaaattcccccttctggtcggatacagcccacaaataggtgcctttgattaaaatggatgcgccgggcaacggcgaacccgtcctttcgtcggatatacgaccggaaatagaataattgttagtattggcttcaattctggaaatgatcaaagaaagaagcaagcagagcattattttaagtgtaagaaacctcatagaacaaattttgtgcaaatttcgttctatatcgttaatactacaatcgcaaataatgactattttgggagtatgcgagtacccataaataggtatttctctccatagtgatttgatagcagttttgctctcatgctctaacaaacggtctgtatccctttattcatcgtggtttccagtgtggtagcaactgtggcggcaggtatgagggcaaacggttgctctcacttgcatcatggacttaatctcgtttgtttagctttatgctttgatttgcaggatgttaatgtctgatgtgtcaactgttaacaattggcatcccagctattaataactgagaaatcagttgttaatagctgacaactccttcattatagactgataaatggtttgaaatggcttgaaaggacaggttaaatgagtcagttgttacggtcaagtcatttcaatcgacagttgtttcagatagtttcaggcgcttgaaacttttagtttcattgcttgaaaccaatggtttcaaaggttgaaactattagttccaaggcatgaaaccttttgtttcaaggcatgaaaccgaatttggaactgtacttccctaataatggttgacttgtttatctctaatagctgctatgtgttgactagaaatattactaaccctggcagctgtttactttattatttattattcctgcctccggtttacttatt

SEQ ID NO: 278 - DNA, 6027 bp, Bacteroides thetaiotaomicron
agtattaggtattaaccgtagctatcatttagaggtatatctatctgtcattcaaagttttcatcactttatcaaagtgaaacaattcgataatgacgagcataagtatctgtcatcctgagcttgtcgaaggatctcctcttttgtagtcacaaagaagagattcttcctccttacagtcgtctgaatgacagacagatgcgtctctaaatggcagctacggttaatacctaatacttaatacttattacctattacttatttatactttctctttaatcaacccgatgcgataagccacaagcaacttcttcaaatcctgaatctgcgtcacaagttccttccctttatcggtgtctttcaccatcatccgttgcgaattgaactccagtacaaagttggttgacttgatatccaacccttcttcaatggctttctgcctggactggaacggctcgtgctgcaccaactgcatcccgtgagaatggtaaacaagcgtatagcccgcaattcccgtctccggctgataggctttggaaaatcctccgtcaataacgaacaatttgccatttgccttcatcggctgttctccttgaatagtctttacaggcacatgaccattgatgatatgagaatgaggtcccaatgccccgaactcatctaatatctgatcgcagatatcttcacgattgcgaagcgtgtagtaatatcccttcttttccttttgtatctccttgtcttccagaaaatagcgttcgaaagtcgccatcttatccttatcaaacagaggagcttccggaccacaccacatataccagatatagtccatcgcaaattctttatcatcctctccttcttcatcaaagtatgcagtacgaatcagctgatcggccttatcgagcaacttgcgtccccaatactccttgccacgtatcttgacatgcttgaaactgccatcctcattcaaaggtaccgaagcatgataaagaagattggaattggaaaccagatacattccgccatacgtaaacaggcaacgcatgtgcttcttcaacttctcgctattcataaacgaatagtgaatcttttccacaagttcccgttcttcgtcggtcagtcgataaggatcggcagggtctacggtcggaaagtttgtgtcacgcagggcatattctttgccttcatacacaaaaactccacgctcaaaatcgatcttctccaacagcttccggttactcatcccgaactccggacgacggtctattatttcagcttccagcttaaactggatgatcgtaatcgccttgtgcatctgggtgatcagacgcaaagtcttctcattgtaattggtgtcggcaaaattcatcttcggcataaagatggtacacggatcatcggcataagtatccatggcaaaagttgccagaggaagcagattgattccataaccgtcttcaagagtacccagattgccgtagcgcatggacatacggatcacgttggctatgcaactgtcattgccggaagcggctcccatccacaggatatcgtggttgccccattgaatgtcgaagttgtggtaattgcacaaagtatccatgatgatgtgcgctccgggaccacggtcgtatatatcacccacaatatgaagagaatcaatagtcagacgctgaatcagattacacatggctataataaagtcatccgcccgcttggtagagattatggtgctgatgatgacattgatatatgcgtgcttattcggctcgacagacgtttcgtgcagtaattcctgaatgatgtaagagaactctgcgggcaaggattttcgaactttggaacgggtatatttggaagatacattctgacaaaccttcaccaactggttcagagtgatcagataccagtcgtccagatccttctcgcgggcttttaccagctgaattttctcttccggataatagatcaacgtgcagagttctttcttctccgcttcgcgcagggtattgccgaaaatctcgttcactttgcgttttaccgcacccgaagcattctttaacacatgttggaaggcttcgtattcaccgtgtatgtctgtcaagaaatgctccgttcctttaggcagattcaggatagcctccagattaataatttccgtacttgcatcggcaatagtaggaaaactccgggaaagcaactgcaagtagcggagatcgccaactatgctttcaggagttatattactttgagcagtcattatatgtactattttactatttacaatatgctatttatcgacttatcgtttatcgctataaatataacgatttatcatctacttattacaaattccagcctttaatgttcatcgtcagcccaataaaaacatcaacagcacctgcgcaatgatcacacgcagaaacatacacaacggatatactgtagcataagcgacggaaggattgtcacccggtatcgtatcgttggcataattcagcgccatcggattcgccatactgccgcacaacataccggatacactgccgaagtctatcttcataatcttgaaagcgacaaagccgaccaggaccgtcgggataattgtcagaccggctcccaaagctatccaaagcaatccttccggacggaagacagtatcgaagaaatgagcaccggcatccagaccaagacaggctagatacatggaaagccccaacgcgcgcagcatcagattggcgctgcgggtagtgtaagtgatcatgtgtatccgtgggccgaaagttcccagcaggatacccacgataatcggtccgcctgccagccccagcttcacgggagtactgattcccggtatggagaacgggatcgctcccaatgccaatcccaatacgatgcctataaatatgacaacaagattaggttctttcagacttttcactgcatttcccaatactttttctacattctgaatggctgctgcttcacctactactgtcaggcggtcgcccagctggagaatcagttccggagtggcaagtagttgcacacccgaacggtacacacggctgatattgattccataatggtttcttagtctcaatgagccaagtttctttccattcagttcggggcgggttacgacgatacgctgcgagatcaattcgctgtcaattgcattccagtctatatcttccttgttccagtccgtattttcttcctgttcaccgaaaagtactgtcagagccaggacattcttttccgctgtgatcaccaacaggcggtcgccttccttcaataccttgtcggaggtaggaatactgacatgaccgtcacgccacaaacgggaaatcacaaatttcggataactcatctgagctatatccttgatacttttattaaaaatagcggggttatgtacttgaaacgctgcgataaaggttttgttggcatcatccttttctttaatctccaagtcttctttatgaaccaagaatttacgaatcagcagtacggcaagaatcacaccgatcactcccatcggataggctaccgcacaccccaaagccggagtactgctctctatgcccatctgtttaagtgtctgctgcgcagctcccaaggcaggagtattagtcgtggctccgcaaaggatacccaccatatcaggaagagacacacctgtcgcataactggcaacaacagtcagcaaagtacccaacagaactacggccaacgccaacatattcagcgtcacccctcctttccggaaagaactgaagaaaccgggccctacctgaagccccagtgaatatacgaaaataaccagtccgaaactttctgcataattcagcatctgtggatcaaccgaaagcccgaagtgtccggcaaggatacctgcaaaaaaaacaaaagtgactcccagagatactccccagaaatgcactcttcccagccccagcccaatcgcagaaatcagtgaaagcaccacaactgcctgtaaggcagaatgttcgagaaacagattatataaccactccatgaattaaacatactaatagggcgcaaagataaaaactatttagtcccattcaaaacttttaagctttcatttcgcgccctatctcttctctaaattcttaatatcctgaaatcttatatgttatcctttaaattatctgtttgttatccgcaatctttttacctgtcacctccacctatcgctttttaccttttcaacctattccatgtggtatctttctacctgtcgttatccgaaatctctctacctgtcatcttttgtgtaatcatcattttcttttcatttgccggcactttccatctgccggctgttatctcacctacctgtatattctacgaaattattccgaccatccagataaccgctcaatcgatttcctccgatgtatacatcatccaggtaagatacatcattgcgaccgtaatccatacgaatggaagtctgtgcataattctcccagttccaacggaaataatattcgaatgtctccacatgtccattaggatattccacccgaataaaatcaacgcctgtccggtccaaataaaagtcgagttcctgacggcaacggttaccgtccacatcccgataaaaactcacccatgtacggctacataaatcagaagaacgattatagtaaccaccaccgatattatcatcatcataaaaactatcgatttctacttcacaagaagtcagactcaacgttaacacagccattaaagccagtcctaagtatctaaatgcgttcgttttcatattcctttatttttaatggttcctttattaatcctatcatttatctttcgatattacaaaagtagggaatgaattctccttatgaaattgaaaattcctacttgtttaggggaattcacctaatggaagaggtaaattcccccaacgtactggataccttacagattcctaaatagctaagaagacacgcttccgccctccaaaaccttaataaacattgaatcaaacattcaattatttaatcaatgttataaatcaagccatttagcccgatttatttgcagatatcacaaaactccgtatatttgcaatgtgtttttcatagtattagatttaaggttaacaaaaagattggctgtctgggatagatagcctttttttatgctctttttttaataaacttctcaagaagccatggagacaaacgtaaaatggcaaatactgatgtaaaaaatctgatgacaccacaggcttctataataattaataaggtaatcgttttctcccatgaatagtgagaaaaaatattctcaaaaaaaataatccgtttaacatttgaaacatagcaagttatctctttcatcaaaaaacaagtaaaaaaaatcttgctaaaagatttgcgtagtccaaaagttccccctatatttgcaccgcatttgagagagaatgcgggttcaaggaagtttgggtgagtggctgaaaccaccagtttgctaaactgacgtacgggtaaccgtaccgggggttcgaatcccccagcttccgcaagattctctagataaaaagagctaagttttatagacttggctctttttaaatctatcaaaagccggtgggttcgtctaacggttaggacacatgcctctcacgcatgtaatacgagttcgattctcgtacccactactcttattttagttagcctcttacattgaagtaagaggctttttttattgggttcatatctcaagaaatggaatataacgtaaaagaattaaaaaaggtattgattgaacaatgcaaagaagaaggtatttattacgcattgatagcaatcaacaaacaaacgaaagagatcgttttgccacaaagccttgataacgctttaaataatccggattactgcgtctttaaatgcaggaaagtgaaggatgaatataaagtagaagaggtaaaataagcataattaaaaaagaaggatatgcttattgatattgtattaagatgttaaa

SEQ ID NO: 279 - DNA, 5936 bp, Bacteroides thetaiotaomicron
atagtatatacttcatttttattaggagcgagtttcgccagtacagaagcacaggtaagtactcctcccaatattgtattgattttatgtgacgacatgggattctccgatctgggttgctacggaagtgaaatccagactcccaacatagaccgtctggcagaaaacggggtacgcttcagcctgttcaaaaatacaggaagaagctgccctagccgtgctgctttgctgacaggacattatcagcacgaagccggcatgggatggatgacggcagtagatgaacaccgccccggatacagaggacaaattacaaaaaacatccccaccattgccgaggtgatgaaagcgaatggctacagcacatatatgagcggtaaatggcacgtcacagtggacggagcttttgatactcccaatggcagctatccggcccaacggggatttgacaaatattacggttgcctgagcggaggaggcagttattataaaccaacaccggtatacagcaatctgacccgaatcaaagaattccccgatgactattactataccactgccatcaccgattccgccgtcagttttgtcaagcaacaccctacagacaaaccgatgtttatgtacgtagctcattatgcccctcacttacccctccaagctcctgccgatcgtgtagagaaatgcagagaccgatataaagtgggatatgacatgttgcgtaaacaacgtttcgacaggttaaaggagctgaagttcatttcggacgaaatggattatcctgtctaccaaaaagaatttgacggaaaacgtccctcttgggaaacactcacaccaaagcaacaggagcaatggattaccgatatggcaacctatgccgccatgatcgaaattgtggatagcggaatcggtgaactggtggaaaccatcaaggagaaagggatgctggacaataccgtatttatcttcttaagcgataacggtgcaaccaaagaaggcggatacctgggccagcttatggctgatttgagcaatactccttatagaagctataagtcacaatgttttcagggaggcacaagtaccccttttatcttatcttatggcgatgccgaaaaaaacaagatgaaaggtcagatttgcaggcaacctgcccacattatagacatactgcctacctgcatggatattgccacagctacttatccgtcagaattcaaagagaatttgcccggcaagagcttactccctccaatccatggaaaaaagataaagcccagagaattatactttgagcatcaaagttcctgcgccattatttccaatcattggaaactggtacgcggcagccggaatgaaccatgggagctaatcgacttatcggcagatccgttcgaaaccaaggatttgtccgcccaatatccgaagctagtgaaaaaactagaggctaaatggaataaatgggcgaaacaatgtaatgtctttccactcgaaaacaaaccttggaccgaaagaattaactactatctgaaacaaaatccggatcaaagcggaatagaataaaatccgggaacaatagtcttcttaatactaggtttagaaaaaagactgttccttttagacgaacagtcttttttctgtttacaagacatattgtttgtatatagctgtttttttattacttttgtgccttcagccccaaagagctgtaacacacttaaattcatgaaatatacttttatctaataataaacacgctacgacaatgagaaagaaacattcgctcctattttgtgccttatttacgatttttacgggacatgcagaagatacggattataccaaaggactttctatctggtttgattctcccaatacattacaaggaaaagaagtctggcatagttccaaacaggatgccagttgggaatcacagtcattgcctataggtaatggaagtatcggtgctaatattttgggttcaatagaggcggaacgcataacttttaatgagaaaacgctttggcgtggcggtcctaatacagccaaaggagcagattactattggaatgtgaacaaacagtccgcgcacatcctggacgaaatacgtaaagcattcgtagaaggagaccagaaaaaagcggaaaaactgacacgcgagaatttcaacagtgaagtcccttatgaattttccagagaaaagcctttccggtttggtaacttcactacaatgggagaattctatgtagaaacaggattaagcacaataggcatgagtgactacaaacgtatcttatcattggattcggcaatggcggtggttcagttcaaaaaagatgacgtagcatatcagcgtaactattttatttcttaccctgccaatgtgatggtgatgcgtttcagtgccgaccaaccgggcaaacagaatctcactttcagatatgcccccaatccggtatctacagggcagttctctgccgacggtaataatggtcttgtttatacggcttctctggataataatggaatgaaatatgcagtccgtattcaggcaacagtaaaaggcggtaccttaaacaacacagatggacggattacagtgaaagaagctgatgaagtcgtattctatgtgactgcagataccgattataaaatgaatttcgcaccggactttaccgatccaaaaacatatgtcggcgttaatccgcttgaaacaacccagcaatggatgaaggatgccgtatccaaaggatattccaacttactggacgaacactacaaagactacgcttctttgttcaaccgagtgaaactggaattgaatcctacagtgaaaacatccaatctgcccactgctcaacgactgaaaaactatcggaacggacaacctgactactacttggaaaagctctattaccagttcggacgctatctgttgatagccagttcccgaccgggtaatatgcctgccaatctgcaaggcatctggcataacaacatagacggcccctggcgtgtggattatcataataacattaatatccaaatgaactactggccggcctgctctacaaacctggatgagtgcatgctcccgctaattgatttcatccgtaccttagtgaaaccgggtgaaaagaccgctcagtcttattttggtgcaagaggatggacagcatctatttccgccaacatctttggctttactaccccattggaaagtcaggacatgtcctggaactttaatccgatggcaggtccctggctggcaactcacgtttgggaatattatgactataccaaggacctgaaattcctgaaagaaacaggatatgaactgattaagagcagcgccaactttactgttgactatctctggcataaaccggacggaacgtatacggctgccccctctacttcaccggaacacggccctatcgatcagggagctacatttgtgcatgcagttgtccgtgaaatcctgctggatgctatccaagcgagcaaagaattgggaatagacaaaaaggaacgtaaacaatgggagcacgtgcttgccaatctcgtcccttataaaataggtcgctatggtcagttactggaatggtcaaccgatatcgacgatccgaaagacgaacatcgccatgtaaatcatctcttcggtctgcatcccggacacactgtttctcctgtcactactcccgaactggcagaagcagccaaagttgtattggtgcatcgtggtgacggagctaccggctggagtatgggatggaagttgaaccagtgggcacgcttacaagatggaaatcacgcttataccctctttggtaatctgctgaaaaacggaacagtagataacctttgggatacacacccacccttccagattgacggaaactttggcggcacagccggtatcacagaaatgctattacagagccacatgggattcatccaattactacctgctttaccggatgcctggaaagacggctctatttatggcatatgcgcaaaaggaaatttcgagatagatattgcatggaaagacggacttctaaaagaagcgactatcctgtccaaagcaggacagaattgtatcgtgaagtacgccggtcaaacaatctcttttaaaacagtgaaagggcgtagctatcagctaaaatacgacaaagagaatggattaataaaaatcaaataataacataacactttaacctatgtcatcttagatgaatacaaaaacatttacccccaaatcgaccatgaaaatttatacttgtctttgcttgcttttcttagccgattatctggttgcccagaataatacttcggcattgttgcctatgcccaatcagataacttcagtaaaagggaaaccctttactgtccgttccggaaaaacggccatttatttgagtcagccggagttgcagttcactgccaatacgctgcaaaatatattatcagacagaatgcaagtggaaattccacttgcttccgaatccgaccgtgctgatatccgcttgttaattgaccctgcaatggaaggaaatgagcactatcgcatcgaaataacttccaaaaggataactatcagcggagctactgtacgagctgtttattatggagttatgactatggaccagcttcttttaggtgatgtatgcgccactacacaaaagaaaatttctcctgtctacgttgatgatgcgccccgattctctcatcgggcattgatgctcgaccccgcccgtcattttcttccggtcaatgatgtgaagttcttcattgaccagatggcacattacaaatacaacatactccaattgcatttgacagatgaccagggatggagagtcgaaataaaaaaacatcctaaactagttggcaaagattattatacccaagagcagcttgccgaaatcattcaatatgctgcccaacggaatatcgaggtcattcccgaactggatatccccggacacaccgtagctatattagcagcttatcccgaattaggatgtactcataccgatacgctgcctaagatagtaggcaaaactacggatttaatgctttgtgcaaataatcagaaagtgtattccgtctatcaggatatcatcaaagaaatatcttctttgtttccatccgattatatacatttaggaggcgacgaagctgttatagaaaagaactggactcaatgtacccgttgccaggccatgatgaaagagttaggctatcagaaagcttcgcaactcatgattccttttttcagccgcatgctttcgtttgttcaggaaaataataagactcctatgctttggtgcgaactggacaatatttatccgcctgccaacgactatctctttccttatcccaagaacgtaactttagtaagctggcgtggaggattgacacctacttgtcttgaacttacccgaaaacatggcaatccgcttatcatggcaccgggtgagtacgcttatctggattatccgcaactgaaaggagatttccccgagtttaacaattggggcatgcccgtcaccactttggagaagtcttatcaattcgacccgggatatggcgtgtccgctgaagatcaagcccatatcataggagttatgggcactttatggggagaagctatacgggatataaaccgggcaacttatatggcatacccgcgcgctttcgcactggcagaagcaggatggacacaaatgaaacatcgcaattgggaatcattcaaacaacgtctttaccccaatctgactaatatgatgaagaaaggggtttcggtacgtgttccttttgagatagttgacaggaagtaaaatctcaattataagccatttaatatgctatttcaactaaacatgagatactagctatttttagggatagaacattgatgaagctattcaaat

SEQ ID NO: 280 - DNA, 5799 bp, Bacteroides thetaiotaomicron
cgggacttgataaatactcacgaatataagacattcgttcatcatcactgtaatagttgtacttctttttcgaatatttcatctttattttcgatttttgaagtgtcaacttattcagtacactacatgctgatatctagccatataaagtactatcggtaatattatagagtttatgttcatgtccaaacagatatgcttcattcttacatcgttagagcatttagacagatgaaaataaagtttttaaataaatctataaggaactgctattctaatatataagacaagtatctcatacttcctataattcttttctttctgtaacttatttattcatgtataatacatagaattacaatacaaacgcaatacaattcaatcataatccattaattaataggatgttaatgtgtttgcgggtcgtttggacaggacccggaaaatcaactttgtacagatgattttgcaggccattgggctcataatgccaatctttcaataaaagcgattatgggtgtagccggatatagtgaaatagcccatatactcggattaaacagtgtagcagaaagatacgctgacatagctaaaaaaatggcgatgaaatgggaagaaatggcaaatgaaggtgaccattatcgcctcgctttcgaccgcaataatacctggagtcaaaagtataatattatctgggataagatgtggaatttgaatatattccctaataatgtaatcagtaaagaaatcaactactatctgacaaagcagaatctatatggattgccattagattcccgcagagattacacaaaatccgactggattatgtggacagcagccatgtctccaaaccgtgaaatttttgagaagtttgtagatcctctttataaatacatcaatgaaactacttcacgtgtgcctatcagtgactggcatgataccaaaactggcagaatgaccggatttaaggcacgttccgtaattggaggatattggatacaagtgttaatggataagatgaatcattaaaaatatggacaataagttgaaagaatactttttcgcatggatgaatcatttcagcataatacaacaagagataagtaatgaaccaacaatataatattttattaatcattaattttttacgtatgaaaaaaaacaaaatcatgaaagactactggcgggtatgctggatggcattactgctagttgctctattcttcggaagttgtagtgatgacaatgacagcaacggagattcagacaatgcagcatttgatccgaatattccggttcaagtaagtggtatcaatccgactacggggggattcgggcagcgattagttatatcaggagaaaattttggtaatgatccgtctattgtgaatgtctttgttggtggaaaaaaagctatcgtaatcaatgtgaaaaatcattctatctactgtttggtaccttcacaggcttattccggagaaatcgaagtacaaatatccaatggcgacaatccggtagtatctactatcgcagaggccaagttcgaatatgtgcgaaaacagttagtgagtacattatgtggttcgcgtagagatgacggcggatacgatacaaaagatggtccatttaatgattgtggtgcatttggttcccccaactggttagaatttgaccctaaatatccccacttagtgtacgttgcagccgatagaggtgcaggtgatgaaaatgaaggaaacggtaatatgcgtattctcgacctcaaaaaccaatatgtaggaacggctcttacagaaggtgacatgggaggtactaaccgcggacgtgcacttgccttttttgatgaaaatcacatggctgtggcagttgaccaaggagacgaattgagagcagctgtatatggttttacacgtaatagagaagcccctgagggcgatgagcgcaattataaaatgtggggaaacagattagcgttggttaatttcaaagcttgtaatacagtaacttttcatccggtagatggtgatatgtactttaatagttgggataaggggcaattcttcaaagtagagaagcaacaaattcaagaaattttcgacggtacacgtacaactcctgctgataaagaagtactttttcaaatggataatggatgggaatataatatccgtatacatccgacagggaattatgcttatattgtgtctattaacaaacactatattcagcgcacaaattatgattgggcaagtaaacgatttgtcactcccttcattgtagcgggaacagcagaaagagctgcttatgtagacggaattggaacaagcgcacgttttaatactccttatcaaggagttttcgtaaagaacccagagtatgcagggcaagaagatgaatacgattttattctttgtgataagatggggcaatgtatccgtaaaattaccccgcaaggaaaggtctcaacatttgccggtcgcggaagcgccagtctgaatggtaacccatggggatatgtagatggagatttacgtcaagaggcccgtttcgaccgtccgaaaggtatagcttacgatgaagcaaccgatacgtattacatcggtgatggttccaatcggcgtatccgtaagattgcttacgaaggagaagaataactaatgattaaaacgcacatgaataatatgaaaaaatatttatcattatgtatcatgctgttgtgcctttgttcaacggttatggcgcagcaagaaaaagttgttgtgaaaggtgttgttacagacgaagccaaagagccgttgatcggtgtgaatgtcaccgtgaaggacatgcccggtttaggttcaatcacagacatgaacggtcattactccataaccatggaaccttaccgccagttagtgttcacttatattggttatgaatcgaaagaagtaatggttaaagaacaacgtacaataaacgttgttatgaaagaaagcgtgacaagagcagtagatgaagtcgttattactggtacgggagttcagagaaaactaacacagacaggtgctattacaacggtagatgttggtgagctgaaacgtaatccatcttccagcattgtcaatgcactggcaggtaatgtaccgggtattatggcgcgtcagacttctggacagccaggtaaaaatatatctgagttctggattcgcggtatatctacgtttggtgccaactcatctgcttatgtattagttgatggtttcgaacgcagtatggatgaaatcaatatcgaagacatcgaaacgtttactgtattaaaagatgcttcggctactgctatttatggttcgaaaggtgctaatggtgtagtattgattactactaaacgcggaaaagccggtaaaatcaaaattgatgctaaagtagaaacaacctataatacgaggactgtaactccaaagttcgaagacggatttacttatgccagcttgatgaacgaatcgcgaattacccgtaacaacgaggctgtatataaaccagaagagttggacatcttacgtttaggcttggatacggatctttatccgaatgtggattggatggacatgttactcaaagacggtgcgtggagtaaccgtattaacttaaatatgagtggaggtggaacaacagcccgttattttgtttctgctagctatgtgaaagaagatggtatgtataatacagatgaatctttgaaagatgattataataccaatgcagcttaccatcgttggaactaccgcttgaataccgatattgacattacaaaaacaaccttattgaaagtcggggtagcaggattcttatccaaacgtaatagtccgggattaggtgatggtgatgtttggggggaacttttcggatataatccaattaagacccctgttatgtattccaacggatatataccagctattggatccggcaataaaacaaacccatgggtagctgcaacccaaactggattcaatgaaaattggacaaataatattgaaacaaatatttctttggaacaaaattttgatttcataactaaaggattaaagttcgttgggcgttttggctatgacagcaacaaccaaaatacgatccgtcgtctgaagtggccagaacaatggttggcagaacgtgccagagatccggaaactggtgaattaagatggaagaagatcagtggttctcagaacatgaaacaggaaagcagttctagcggtaatcgtcgggaattcctagacatgatgctaaactgggatcgttcttttggagctcatcaccctagcgctactataaagtatacacaagactcttacattcagacacagaatttaggagaagatttgaagactggtattaacaaacgtaatcaggatttggccggacgtgtagcttacaattggaattatcgttattttattgattttaattttggctataatggaagtgaaaactttgccaaaggcgaccgttttggttttttccctgctttttctcttgcatggaatattgcggaagaaccgtttatcaaaaaacatttgaaatggatgaatatgtttaaagttcgcttctcttatggtaaagtaggtaatgataatgtcggaacgcgattcccctatctttatactattgcagaccgttataaaaacggggataatgagattatttatggaggatacgattgggcacaatatccttcaagttattcgtttggtggtttaggatttgcagatgtagcctccaatggtatcacttgggaggttgctgaaaagaatgacttaggtatagaccttgcattgtttaatgataaatttactgcaacgatcgactatttcgatgaaaaacgtaccggaatttatatggttcgtaactacttacctcagattgtcggtttgaacgggcataatccggcagcaaatgtaggtgctgtaagttctaaaggtttcgatggacacttctcatacaaacagagaatcaatgacgtgaacttaactgtacgtggcaatatcacttatagtaaaaatgaagtactggaaagagatgaggagaataatgtatatgcctatcagatgcaaagaggctatcgtgtggaccaatgcaagggattaatcgcagaaggattattcaaagattacgatgatatccgcaatagcccgacacaaagttggggaaaggtacaaccgggagatatcaagtatagagatgttaacggtgatggtgtgatcaatgatggagaccaggtagctatcggtgcaactagccgcccaaatctgatttatggtttaggtgcatctgcctcttggaaaggtttagatgtgaatgtccactttcaaggagcaggtaaatcaacatttttcacttatggcaagtgtgtatgggcctttacagaaggcgaatggggaaatatttttaaaggtatgctggacaaccgatgggtagatgctgatacagctgaaacattaggtattcctgccaatgaaaatcctaatgcttcgtatccacgtttgagctaccaaggtgacaatgccagcaataataactaccgaaactctactttctggttgaaaaatggtcgttaccttcgactaaaaacaattgatgttggttatacactccccaaatcaattgttaacaagatgcactttaataatatccgtatttttttggtaggaacaaatctcttgacatggtctagtttcaagacttgggatcctgaaatgggcgatcccagaggtgaatcatatccgttaacaaaatcgataactatgggtataagtg

SEQ ID NO: 281 - DNA, 5762 bp, Bacteroides thetaiotaomicron
ataataaagagtgtttatgaaaagaaaattaatgctgttattggcctgcttgctggcaagcataggtctagtgattgcccaaacacctaaaaaggtgacaggtgtcgtcatttctgaggaagatgatcagcctgttgtgggagcatccgtattagtgaaaggtacaacgatgggaacagtcaccgatatcgatggtaagtttaccataaacgatgtaccaagttctgctagaactttgaagattagctatatcggattgaaaactcaggaggtccccataaaagcaggaacgataagaattctgatgaaaccagatgcagaagttctggaggaagtagtggtaaccggcatgcaaaaaatggacaaacgcctttttactggtgcaactcaacaattaacagctgataatgtaaaattggatggtctccctgatattagccgtggacttgaagggcgtgctgcgggtgtgtcagtccagaacgtatccggtacgtttggtactgctcctaaaattcgtgtacgtggtgctacctccatttatggtagctccaaaccattatgggtggtggatggagttattatggaagatgctattgatgtgggacctgatgatttatcttctggtgatgctgaaactctgattagttcggctattgctggtttaaattccgatgatattgagagctttcagattttgaaagacggttcagcaacctcaatctatggtgcacgtgcaatggcaggtgtaattgttgttactacaaagaaaggtaaagctggagtcagcaaaattaattatacgggtgagtttactacgcgtatggtgccctcatacaaagagttcaatattatgaattctcaggagcaaatgggaatatataaagaattggagcaaaaaggttggttgaatagtgctgatttatttcgtgcaaagaattcaggtgtgtacggacgtatgtataaactgatcgaccagtttaatgaaacgaatggtcaatttgggctgatgaatactttagaagcacgtaatgcttatttgaccgaagccgaaatgcgtaataccgactggtttgatgtattattctcaaataatatttcacagaatcactctgtaagtattacttcaggttctgataaatcatctttttatgcgtcattgagtgccatgcttgatccgggatggtataagcagagtgaagtgaaacgttatacagccaatttgaatacgacttataatatcttaaagaacctaagcataaacttgatatcaagtgcttcttaccgtaaacagaatgcaccaggtaccatgaactcatcattggacgttgcggcaggtcaggttacacgtgattttgatatcaacccctattcatacgcactgaatacttcacgtacattagatcctaatacagattatgtggctaattatgctccatttaatattctccgtgaattggacaataattttattgagttgaatgttgttgatgtaaagttccagggggagttgaaatggaaggtgttgcagggcctagaagtcagtgcgctgggtgctgtgcgttatcaatcatcatcacaagaacataatataatggatgattctaatcaagcaattgcttatcgtacggggttggacgatgctactattcgtgatgaaaacgactggttgtataagaatccagataacccatatgcattacctatttcgattcttcctgaaggaggtatttatcagcgtcaagatcgtaagatgttgggactggatttccgtggtactgtatcatggaatcatctatttgcagaaaagcatataactaatctttttgcaggaatggaagtaaatgatcttcaacgctctaactcttcattccaaggatggggtatgcaatattctatgggtgagattccatcatatgtttatcagtactttaagaaaggtattgagactggagaaaagtattattctatggggcatactagatatcggagtgtagctacatttgcaaatgctacttattcgtatgacggacgttatacgctgaatggtactttccgctatgaaggaactaatagaatggggcgtagccgttctgctcgttggctgccaacgtggaatctttctgcagcgtggaatgttcatgaagagaaattcttccaatcacttcaaccaacgctttcaaatttgacatttaaggcatcttactcattgacagctgatcgtggtccggctgatgtaacaaattcacaagctattattaagagttattcaccttatcgtcctttcactgatattcaagaaacgggtcttcatatagtggatttggaaaatagtgaattaacgtatgaaaagaagcatgaattgaatataggagtggatgtaggttttattaataatcgcattaatctttcagctgactggtacacgcgcaataactatgacctgattgggttgattccaacacaaggagtgggaggtactatttataaatatgccaatgtagctacaatgaagtcacatggtattgaatttaccctttcaaccagcaatattaaaacgaaagacttctcatggaattctgattttattttttctcatgctaagaatgaagttactgatttgcgaggacgtactcgtatgatggaacttgtttcgggaaatggatttgcacgtgaaggatatcctgtgcgcgggcttttctccattccttttgcaggtttggatgaaaaaggtattcctatgttcgatatcaatggaaatataacatcgactgatattaatttccaggaacgtgagaagttagattatttgaaatatgaaggtccgacagatcctacaataactggtagtttcggtaacgtttttgcatataaagggtttaaactcaatgtattcatgacttattcatttggtaatgttgttcgtttgaatccatattttaattataaatattccgatttgagtgctatgcctcgtgaattcaagaatcgttggacgctttctggggatgaggcaaagactaatattcctgcaatcttgagtaatccgcaatatgaagcaaaccgaacattgtataaagcttacaatgcttacaattattctacagagcgaattgcaaaaggtgattttatccgtatgaaagaaatctcactttcttatgagtttcctaagagctggatttctgctgcgaagatttccaatctttctttgaagttacaggcaactaatttattccttatttatgcagataagaaattgaatggtcaagatcctgaattctttaatactggtggtgtagcttcaccggtgccacgtcagtttacattaactctgcgtttaggattgtaagagaatgattttaataataaaaaaaaagattaaagatgagacgaaatcaattatatattccattgttcatcgcaacgcttgctattgtcggtagctcttgtaatgattttcttgacgaattaccagataaccggacggagctgaattctgagcaaaaaatagctaaaatgcttgtttctgcttatccggaaggatctgcgaatgaactgtttgaactttatagtgataataccgacgataacagtgccagatattcttattataagttatctgaggaagagtgctataactggaaagatacccaggaagaatatcaggatacgcctacaaatctttgggaaacccattatatagctattgcttctgctaacatggctttggaagagattgagaaacggggaaatccggaatcgttgatgccgcagcgaggagaggctcttgtttgtcgggcgtacaatcattttgtattagcaaatattttttgtaatgcttataatactcatgcatcacaggaattaggtattccttatatgactaaagttgaaacaactgtgcaaccacaatacgggcggggtactttgcaggagacttatgagaagattgagaaggacttattagatggtatggctcttatttccgatgatagttattctgtgccgaaatatcatttcacaaggaaagctgcatatgcttttgctgcacgtttctatctttattatatgaagcctgacttttctaattgtgatgaggtgataaaatatgcagatcgtgtgttgggaagtgatcctgctgccgaattacgggattgggaagcgttgggaaaactctctgctaatgataatgtacagcccgacgcatatattgcttctacaagtaaggctaacttgttgataggtagtaccgtatctaactggggtattattctgagtaattacatgacaggaaaacgttatctacataataagttaattgcttcttacgaaacatcacgttcttccggattatggggtatccctgaccgcatgtatatgcagccttttacaacatcgggctatgaatgcagtatgttgagaaagggcggttattatgctggtgactacctgtattatatgcctgtgattttctctacagacgagactttgctttgcagggctgaggcttatacgctgaaaaagaactatccaatggctgctgcagatcttactacatgggagaaagcatatacttctaataagcaaactttaactccggggatgataaatgagtattatgataagatggattattacaatccgacacaaaatccgactcccaagaaaaagcttcagcctgattttactattgaatcaggtatacaggagaactttattcactgcattctgcatatgagacgtattgctactttgcacgaaggtctgcgctggccggatattaaacgttatggaattgttatctatcgccgttctattgctaataacaatatagtcgtaacagatgaaatgccggtaaatgacgcaagacgtgctatgcaaattcctaagagtgtagttctggcaggaatgcaacccaatccacgtactgaaaattaaaaggaggaaataatatgaagaaatattatatttatatactaacggctgttttgcccattctttggggagcctgtaataatggcgatgatattgacaccaagcatagtattttttcaacagagccaatggaacataatggttttgatgaatggttgcttgctaattatacatatccgtataacgttgatttcaagtatcgtatgcaagatattgaaagtgatcacaaatataatctggtaccggcggattacgataaatcggttgctttggccaagattatcaagcatgtatggatggaggcatatactgaacttgccggaccggcttttcttcggtcttatgtgccaaaaacttttcacttgataggttctccggcttatgatagcagtggtacgaaggtgttgggtactgccgagggaggaaagaagataacattgtacgaagtgaacagtctggactttgagaatgtcgatatcgaagttttgaatgagtattactttaagacgatgcaccatgaatttgcacatatcctgcatcagaagcgtaattatgacccatcgtttgatcgcattaccgaaggaaaatatgttggttccgactggtatttctatgttgctgaaaatggaaattcatatttgcgagaggatgcggatgcatggccggaaggatttgtgacggcatatgcgatgagtgaggcaagagaagattttgtagagaatatcgccatgtatgttactcacgatcaggcttactgggataatatgctgaaggttgccggaactgccggagcggctattattaatcagaagtttactattgtatacaat

SEQ ID NO: 282 - DNA, 5585 bp, Bacteroides thetaiotaomicron
gaataattgttttatatttgataactactaattacaataataagcgaatagctaagaatacttttcttctctatttccgtatgttatttaccatgatggtatcattgtatactagccgtgtggtactagctacgttgggggttgaagattttggtatttataatgtggtagggggagtagtaactatgtttgctattatatctacctcattgtcttctgccattagtcgctttataactattgagttgggcaaaggtgatctacgaagactgaagacggtattttctacagcagtagttatacagtttttaatggctttagtggtcgttatacttgctgagcttataggagtgtggtttcttaataataaaatgaatatacccgaagttcgtatgaatgcggcaaattgggtgcttcagttctcaatttttacctttggagtcaatttgatttgtattccctttaatgctttaattattgcacacgaacgaatgtctgcatttgcttatgttagtattctggaggtgtcacttaaactcttaattgtttatttattagtattaatgtcagtagataaattgattgtttatggggctttgttgttggtggtagcaattgttataacctttgcttattttatatattgtaggcgacattttaaggaatgtaaatgtttttgtcgaatcgatagattcctattgaaaagaatgttgagcttttcgggttggaattttataggggcatcttcagcaatccttagagatcaaggcgtaaatattgctataaatcttttttgtggtccaactgtcaatgctgcaagagggatggctgtacaggttaatcatgcaattaatagtttcgctcaaaactttatgacagcattaaatccacagataacaaaatcatttgctgtaggtgatagtaaatacatgtttactttgatttttcagggggcaagattatctttttatatgttactatttttgtcattaccagtactcatgagtacagaatatatattatcaatatggttaaaaattgttcctgattatacaatcatatttgtccgtttagtcttgatctttgccatgtgtgaatcaatatcaaatcctttgattactgcgatgctggcaacaggcagtattagaaattaccaaatagttgtaggcggtatgcaaatgatgaattttcctatttcatatatattgttagaacgaggttatgcaccagaaattactctttatgtggctattggtatatcattatgttgtttggcacttcgtttatttatgcttcgtagtatgatacaattgcctgttagaagctatatgaagaatgttttctttaatatatgtgctgtgacgatattttcagttgcaattccctatttaatctcattacgattacaatcatcattttattcgttcttgatcttatctttctcatgtatcatatgctcatttatggctatcttttttgtgggttgcaaagcaagtgaaagagtatttgtcgttgatcaagtgcgtaagcttataaaaaataacttgtaatcatatcaaataagctgttgaggatcatgataaaaataaaaaaatcagaggattgttgtggatgttctgcatgcttgtcaatctgcaatcataatgcgatagtttttaaggaagatgtggaaggttttaaatatcctatgattgaggaaggtaaatgcatcaattgtggactttgtgagatggcttgtcctattctttatagaaaggtgaaggatataaggccaactccaaaagcatattttgcagctcgccataaaaatattgtaacgttacggaacagttctagtggtggtgcttttacagctattgcaggatctgtaatagaattgggaggggttgtttgtggtgtagaatatgataacgatggagtagtgagacatagcttttcggaaacgatggaaggtataaggagttttatggggtcaaaatatgtccagagtgaaattcaaggtgtttacaatcagataaagacttatttaaaaagcgatcgctgggttttgtttacaggttctccttgtcaagtagaagggcttaagctttttttacgtaaaccatatgagaatttactaacggttgatttagtttgccatgctgttcctagtccacttatatataagcaatatataaatatgtgttcgacgaaacttggccaaaaggtcatgtctatcaacatgaggtacaaacaaacttatgggtggagtcatcgcttctcttattgtttttattttgaaaacggccagaaagctgtcgatcctgtttgggtagttaattggggaaaaatatttttttctcaaatgataaatcgtccttcttgtcactcttgtaaatattctaacttggaccgtcctggagattttacaatagctgatttttgggacgacaagaagaatcgcccggatttgtattcatgtgaaggtacttcattattaatggtgaatactaatatggggttagacttgataaacaaactttacgattctattgatttgtggaagataacgaaagatgaagctatgcagccatgcttaattcgccctacatgttctaatcaaagacgacaagagttttgggaattttatcttttaagagggtttgatgctgcatataagaagtattttggtgatagcaaatatgttatcactaaaaaaatagtgaaacaaattattaaaagagtattaagaaaactccaataatagccaagctatttatgggtgaacaaaaaatcaaataaatgtcagaattacaaatattgatatttaacgctgctgtcttttctatattagcagtttaccactattggaaaaataggaagttaaatatcgctttctatatattggcatattattcgatttgtgcatggggagcattactgtatcatgagcacgagttgtttcattatatgcgggggagggagacgtattcaattataccatttttatatcttatacctgttatttttctttttgcatatcctattatcagatatgataatactagaatcactcgaattgaaacgttaaattctaacttcttcataaatttggtttggatacttctttttattcagatagtgttatatattattttatttccttcatttttaaaagcaatactttcttcaaatattggtgattatcgtaatgatacatatgatgaatctgagattgtacaatttccaaattatttttttaacatattatgtcgtctatatatgggcgcacgcaatgttgttattttgattgccgcttacggtttacttgtcataaaaacacatagaaaacttcttaagatatttctcgtcacttctttatgttttcctgtatatatgtttacagcatatgcaagtagagccgtaatgataatgacatttttctttttagtttttatttttgtgtttctatctgtttttatgaatgtaggattgaaaaaaaagattgtatcttatttaatcttaatcttagttcctatttcttcagcctttattcttatatccaactctcgttttggtaatcttgccacttatatgttttatcggtatttaggagagtcttttaataattataatacacattttttctatgagttaaaaggtaatacatggggagaggcatattttgttttttttcgtaagcttatgggaatttcctcaaattttaaaacaacacgtgaaaaatgggagtggcttgataatattacaggtgttgacacccatgtattctatacatttgtaggcggtctgaatattgagtttggttttgttggcactattgttattggtttgcttttatcgttttttatggtaaagaaaatgcgaccttacaatgtactgacactgcctaagttcatagctttgggaatgttagcctacacactgatcaatggtgtttttttctttgttcttcaaggggattgggggaatcttgaaattttgtttactctttttttctgctttttatttagtaagtatcggacaagaaaatatattaataaataatgaagatcggaattctaacatttgctaatgtccctaattttggggctaatttacaagcactatctacgataagctatctacagaatcacggatataatcctattttgattaagtgggagccagaagattttgaagctcgtttcacaagtattaaaactcagaagcaaccacaagagcattttcattttgtagagaaatatcttccgcagaccaaaatatgtcgtaatgatgatgatatttgtcaagtgataaaggatgaaaaaatagaaggtataattattggcagtgatgcagttcttcagtgttcgtctttttggggtagattggattttccaaccaaaacagttgtacgtgttaataaaactacatctgaacgtgagtatcctaatgctttttggggtacattttatgataaacttgggtctaaaattccaatggtgattatgtctgcatcatcacagaatgcgaaatatagattgatagcgcgttcggtaaagcataaaatgagtaataatttgtctcacttcgaatatatttcggttcgagatatatggactcgtgatatgattacttatataacaaaaggggcaataataccaaatataactcccgatccagtatttgcctttaattataattgtgctaaattcattccttcaaaagaagatattcttttaaaatatcatttgcctgaaaattatgttcttgtaagcatgaaatgtagaatgcttgataatatgctatggatggataaattaaaatcagaaatgaaaaagctatatttagaatgtgttgctcttcctatgccgactggtattgagtttaagcataattttgatttttctattactactccgctacctccattagattggtatgccttgataaaatatgctaaaggatatattggggaaaatatgcatcctattgttgtggctctacataatgcagtaccatgtttttgttttgatacctatggtgtacttaaatatgcacgttgtgtatgtgtcgaagaatcgagtaaaatttatgatattatgtcacgtttttctttacttgataatcgtatcaatgcgtattctcgcttttggaaatgtccacctgttgatattgtgattaatcgaatattacattttgatgtaatagcatgtcaaaaaacagctttgaattattataataactatgagcaaatgatgagttctattttggaagtttttaagtctaaataatgttttatgaaatatcttattacattgccatggatgccttatcctgctacagacggaggaaagcaggggtcgtttaatatgttaatggagttgcagaatatgatagatataactttgatctatcctgtattctttaagaaacaaatggcctgtcaatatttgttggaaaaacaattaccaaaggttaaagtttacccttttgaatattataaaaataaagatggcatcaagtcgcaatactcattatttcgtctgcaccgtattataacccggaaatttttgaaacagccatatttggctacacctatatat

SEQ ID NO: 283 - DNA, 5387 bp, Bacteroides thetaiotaomicron
aggtaatataccatgcggagcagcatttcagcagctacgattaatacttaatacctattacttattactttattcttaaagttctccaagtgcaaaattctcaggatgttttcctttgaaatccttgaagtacagtttgatttcccgcatatctttattaagatctcccgtcggcataattgctttagtggacgttatggtctttgtactgtagtcaataccgatcagaacgataggcacttgagccttgagagcgatgtaataaaacccttttttccagttcgggttcgccttgcgggttccttcgggtgtgatagccagatgaaactttttgcattcagcaaaatgatgaaccatctggtcgaccaacgaagttttccgactacggtctacgggaattccgcctacagctttaaaaataattcctaacggaaaaaagaaccagtcttttttcatcatgaaacttgttttacggcctaatgctccataaaacagttttccaataaataaatcaaggttcgttgtgtgtggtgcggcacatatcacgcatttatcataattaggtaccgtaacgtttgtcttccaccctaacaggcggtaatagataaagctataaattgctttcttcattctgatctttaattcaatttcccgatggcctcaataatctcgttaacttttgcattgaaatctactcggaatttcttataaaagcctttcacattgcccggctctgtatggctgatgcggctgacaaattcatcctgcattcttaaaacttcagccatcagttcatcagctttagccttgtcagtaccagggataaacatactattgattaagcactcggtgaataattctcctgcgatatagtttacgttctttttaagttctcttctacttgccataatatttacatttaatggtgaataataaaaattacttggggtaaagatagggactttctttgattctagcgaataaatggattgaattttttctttttactatttgctctctaagtgtatcctgcttggatatacaattgattaatcaaccggattttgaaatattgaattaaaattgaacagatttgaatgaaatttagtcaaacggggaattgcctcgacaaggatgaggtattttatttattactgttcccttttgaatgattatagtactttttcccttttgaaaagaattatctttgaataattacttggaaataagatttttaatagctataattaattaaatgaaaaacaatggatttagatttatctaaaagaagtaagccctgttttaagaaaaataggatgatgtcaatgggaaaagtaaagaatccttttttaaagctttgtggtattgggttgttgacagtaatatgtatttctgttaaagcccaaaaagtaaactttacagtgaattcgaaaactggagccatacaatcaatgaatattgataatgataaacagaatatgaattggctgatagcaacagatggtagccaatatccttggataaaggagaattatggttggggacttggctatttcactgaggtgagaagaaatcagaaaaacaagttgttttggaatcttcctgccagtataaagcaggatgggagagaagttacttatcgagttggagatatatgtatccttgtagaaaggagtatgagaggagaagatttaatagaagagtatactttccaaaatgatggaacagaggaaatacttttatcggatataggcatctatactccattcaatgataactatccaggggcacaaacttgtataaatatgcgggctaatgctcatatatgggagggtgataatgcagcttatgtaaacgcgatacgtatgggggatatgctccacatttgggactggttttgagggaaggcgaaattaaaagttatgaaatatcagagcgtgatagaaataagggtaactctcatacaaggggaattatttctttgaatcttccggatatgaaattgatgccgggtgatgaacaagtattttcgtggtatatcttttcgcataaaggtgaagatgattttcgtcaaaagttattggaaagagagagtgtttgggtatcttgcaacaagtatgtatttgagaaaggagaaactgcccttgtgaaaatatcaggtgggcagatggtaaaaggctgtatgcttaaaaagaatgatgtcactattcctatgaaaaaacaaggaacagcatggtatgctgaagtagtaatggatcagttaggagaagtgcgttttgatatactatatggcacagggaaaaaaactcatgcaaattgtttggtgattagtagtgtggatgatttgattaaaaaacgagtagagtttatagttgcaaatcaacagatgaaaagttcgaatacgcgtagagatgcttatatggtttatgataatgaaaagaatgaaatatatctgaataatacgcataactgtaatccggttgacagggatgaaggtgctgaaagagtcggtatgggggtacttttagcaaagtattatcaattgcatcctgttgctgaagtaaaggcatctttattgcgatatgcaagttttttgcgtaatagattgcaagatgctgactataagactttctcttcagtcgatcagaagggacgtaacagggcgtacaattatgtatgggtagcggatttttatttccagatgtataaaataaccaatgacaaacaatatgctaaacatggttatatgactttgcggtctatgttcaaacagttcggacatggtttttatgccataggtataccggttcgcttaggactgcaaactttaaaaaatgctgatatgcaaagagaatatcaagagttggagaatgattatattgcggttggtgatacttttttgaaaaatggtttgaattatccggctagtgaagtaaactacgaacaagccattgtagctccatcagtcatgttcttgcttcaactttatatggaaaccggaaggcagaaatatttggatggggcaaagattcaaatgcctgtattggaagctttcaatggcaaacaacccagttatcatttgaatgaaatagctgttcgtcattgggatggttattggtttggtaagcgggaaatgtggggagatacttttccacactattggagtacattgtcaggagctgctttttatctttattcgcaatgtacgggagatcattcatataaagagcgtgcagagaatattgtgagaaataatctgtgtttattctttgaagatggaaaagcttcttgcgcctatatttatccaaataaggttaacggagtaaagggcggattctacgatccatatgcaaatgatcaggattgggctttagtttattatttgcttgtacaaaatggtatatattaacgaataatggaatcgttaaatacagaaagcttaatagggtaactttttgtgatcgatgcaaaatgaaaagccagtcaacatttaaatagttaactggctttttctaatacactttgctttcttatttattgtggttttccgtaagcagcaaattcataaatgccatctgcccacattgcagaattgtttttatgtacattgacaacaccgtatacgcggagccgtaaatatctgtagagcgacggatcttcaatattcagaattagaaatcctacctgccagtttaatttgccgtctacgagcattttataactttttccatcccggcttccttcaatggtatatttgtaggcagcctcggaaccgttaaccaatcttgtcgaaagattaatctcagaaatcacggcttctttctgcatatctatggtaaacatataaggagaacctgtagcagcatttgaacttttctggaaataagtagaagattcagtacaagctccatccgtgatacaatcagctttaattcctctcgctcctgggacagcggctgtcaccggtacatttaatgtcaggtttttaccgttctgaacagggataataccatatttgtcactaaattccaggtatctgtaataatccatcgaagcatatcctttgttaaatgcggctattgaaattctcgggaaattgccagccggagttttatattttcgttgcgctccccagtggtaactccatactccgcaggtttttccaactgtactgattctgttaaactgtgcatcaaaagtagaattattgccaatttctctcataggtgtccattcgcctcctaaatcagcggcagatgtatacatggtttgactcggataccatccggaagcctttgaactgaagaaataatattctccgtcttttttgatgattgcaggagtttcccgatgtagtcctttacatattgtattaactaataaaacaggcttagtccatgaagggtctagcttatagatgtttatatctctgttcatatttgtagctgaaaggagataagctgtaccgtcatcatcaatgaaaagagattgatctctagagtcatagcccaatggtcgttccatagtgcctacttcgagctcgcctttgggagttatttgtgccagatagattttagctgcaacatatccactttgatcttcataatgtgctgaaagtactaccttaccggtttttgcgttatatcggaaagcaataccctcaaattttacatttgggtaaaaagccagttcacgggaagtactccaactaccattgagccctgtcggagaaaagctttctgtagctagccatcctttgagtgtttgtccatctacttccttttcaacgttttccattttataagagaaataaagctccccaattttcataccctgaggtttttgggcagattctttggtgatatattttccgtttagattatcataaactttagtttcgccgttaggggtgaaggttgttgcttgttgagaagcggacgtggctattttcttcccctctttaaatgcttctacatggtaggtaaaagttttatctgctttcagattataatcatcgtatgtatttcctttagcttctccaatacaatttccatcccggtagattctataaaggtcagcgtcctctcgttgcatccaattcagttttacattgttgacagctttttcaccgacaagtttgaatacagtggcagtggctgcccagatatctgttgttataacttctttcgattgagttgcgaaagctggttgcaaagacagactacatagatatataaatatgaataaaaaactattttttgcctgttggctttttatgttcataatgtaacaaatttaatttatcagaattacatatgagaaatttattgggctttcatctgttttagattattagccttgtaggcatcagagaatatatctgcttc

SEQ ID NO: 284 - DNA, 5291 bp, Bacteroides thetaiotaomicron
ctctttcgggcacataatcattttcccaatcatatttaaaataaatcaaatcaacatcataacatgaagctaaatcattcagcattatcatagtgtttttttcacctgctgctgccttattgggaacttgactttaatacctgcccctgtaaacaatggggatatcaaagctttactctgagataaaatcttatatggatcatctacaaagccaagaatatctaaattcaaattcggaactatatttttcacatctttattaggaaatccacgtcctatgattttaatatgtactttttttctcaataatggacctacagtattaataaaccacaaagccccttccgcattttctttacgccgccaatcgccaaacattgtgaaataatcctcaactttatcgggacttttattaataatttgttcatcaatatagtctaaacaaagattagtttccttatgataaatctgttttattaggtcacaatctttttgtgaaaaagaaaaaatatgagcattaggcagattcaaggacatccgttccgagaaaatacatatcttctgcattaaatatgaagaagaacgaagcacacgttgtgcaattacatcatggcaaagtaatattttaggaatacgtttatcaatatatcgtccatacaagaacatattactatgattaaaaatcacaactttataatgattcattttaagcaaatccctaactcttcgaagtatcagccaattaaaacgtatagaaaaagtaggatgaacaaaaggaaagttgcaaatattttttaatttagtcattatcgagttacgaattgttagtttcgtatttacatttcctctttcgggcacataatcattttcccaatcatatttaaaataaatcaaatcaacatcataacatgaagctaaatcattcagcattatcatagtgtttttttcacctgctgctgccttattgggaacatatgctgtcaaaaacaaaattttctctttcatataactttaattcctacaataccacaattcttagcaaattttatatcactatcactatcacctatcataaggcacttagctttatcaatatctggataatctctcaatatttgaagaaacatacctattcccggtttacggttaatatcagaatccgtcaaagcggtacaataataaattctatctattctccctccatagttcttaacttcagaaatcattcgctcatgtatatgttttaaatcctcttcactcataatttccttccctactccacgctgattagtcactataaatatatatttaaaatgggtattccaagctttcaaaatttcaagtactccaggaagaaattcaaactcttcccattttttcacatagtcatctggacgaagtctgttaaccactccatcacgatctagcaacaatgtttcaaaaccagttacatcaatatcttgtagtctcattatagaaagaattatttagaaaaggagatctgaaaattccgcattggccttgtcgtaatcttcgggaataccaatatcaataaaatatccattttgcaccacaccataaagttttcctaataaacattggggttgaagaactcctgtctcaaaagaaaatctctgcggtagtctgtcgaatatcggttctaatgtattgataatatatataccaccattaatcaagcctttctcgcaatattttttctcatcaaatctcctaatctgattagtatcttcacatatctgtacatttccgtaacggtcaaagttttccattggctttaatgccagtgtgattgatgaaggatataaacaatgccattcatataattcattcaaatttacatcaaagaatgtatcgccattcaaaacaataatattaggtttactagttctctttaaggctagttttattcctccacctgtccctaatggttcgtcctccacggcatattcgaaagcaaaaggaaactcatctttacactcatcaatccaatcaataataacaccgcgtaaataacccaaagatagaattacttttgatacatcaaattttgtaagatatttcagtaaataccacaaaaaaggtttgtttgctattggcgccatacacttgggtacttcatttactacactacgcaaacgagtcccaaatccaccagctaatatgataacttccataaaattatttattatattcttccccgaaaatattctcttccacaatacagcaaataatatgtcctatcaatgtttgacattcctgtatacgaggggtttcagcactaggaactttaatgacaatatcaaaatcatccattttacaagacttcatacctgtaagagcaatcgtcgtaatccccttttctttacatataggcaaggcatctacaatatttttcgaattacctgaagtagaaataccaataaaaacatctcctgccacaccttgtgcctggagttggcgtgtaaatattttatcatatccataatcattaccaatagctgtaataacactggtatccgtagttaaagctattgaaggaattcccggacgatcaaaataaaacttactcacaaattcgccgactaaatgctgagcatcagctgcactccccccattacccgcaaacatcgttttatttcctcgacgataggcctcagtacatacgtcagccgctttagcaatagccgctatcacttcttcatttttagaaagttccgctttcactcgctcactctccgctacttgttttcttacaatatcaatactttccatacttatgctatatctatttctgaactttatctgttgaataaatcttccatccgtgtgcaccgtcatcaataaactgaaatggcataacaaaaccattcaaattatttaaagcccgtaccacttcttctttacgtgtcggctcaaccacaaacatgataaatcctcccccacctgctccactaaccttaccggccatagcaccggcaccagtggctacatcaaaagcttcttgaatcatcggattagtaatggcgccagccatcttcttcttattttcccatccttcacccaaaatacgagcaaactccccaacatcccccttcaacaaggctaatttagtatcaatagcactctgtttaatcttatgcatcgcctctatagcggtttgattaccttcgctcgtatttttcttctgctcattaataatagcagcagaagaacgagaacgacctgtaaaatatagaaccatacttgactctaattcatccacaatccaacgtttcatttttagcggattaacaatcaccaaatcattttgcaagaattccatataattgaatcccccaaaagctgctgcatattgatcttgcttaccaccactcaatcccaaatccttacgttcaatttcataagctagacgcgacgtctcgtaatctcctaaaggaagtgacaaccactcaataaaagcctttaatatacaaacaaccatagtagaggatgttcctaatcctgatccagcaggcgcatcattataagttgttattttgaatgacttaggctcaagcctataatcacgaataatacggttatacacaccttttatgagacttgcttctccatcaatctctaattgagacatagaaaggtaacttttgcaacattgtgcatcataagcattaatctcaatcctaccgctgttggtctcttcaatagtacaataagcatataaattaattgttgcattgagaatcaaccctccataaatatcactataaggtgatacatcacttccaccaccagccaatcccagacgtaatggcgctttacttcttacaatcattttattgaaatatataaattattcatatagtcaaaaatatagaacatcctttactcttttagctagctgaatgaaacgatatgtccaattaatgataaatgcatcattgaaggaaataatattttttccaaccgccttatctaataagaggcgtatttgagattttgagattgcttgagaataatgtaccactaaacgaaaaaaagcatactttgtaaatcggtagacagatgatttatgaaagaactcatttatccaatgagtaaactcaatatcagcagtaagcttccggagcaccattttattatccatattaggtgttatattttttttgctcttacgccaatatacataatctccagaaatagttttaatacctttatcagctcctattttcacccatgtagctatatcacttccccatgctaaatcaaagtgctgaaaaccacctgtacaattataaatatcccttagaaaaatatactctactacaaaactatctaaccgagccgacgctttccgacgataaaaagtctcactatctatcaccgatggataaacagttggaattctcactatctgattttcgcaatcaacaatctttacatcaaaatgataaatgtcaaaagctccattatctattgctattgtattaaaaaaatattctacacaacgaggccccataatatcatcatcagaaaacagccacagccaaggctcattctgtgtcagttgtatacaacggttccattgtgcaacgagatcatgcccaccaaaattcacttcaaatcttctataaacaatatccaattgcttcgaatattgttctataagactcttaaaatcatctctactacaatcctcaccaatataaacagtgaaatctttacatgtctgttgcgctaaagagaataatacagtctcaaagaagtctaccttataggcaggtattacaattgctaattttttcattaatcaactttatagaaaatgaagatatgtccctcccaaagtataccgcaaatcaatagaacgttgcgccaaaacttttgctggtattcctccacatatagtaaaaggcggaatatccttagtaactacggcaccagctgctatcactgctccctccccaatagtaacactatgcaaaattgttacattagggccaatccatacacggttctttatataaataggaccacgattcgttttcatagatcgaaagtatggatcattataatcatgaccacctgtccaaagagaaacattagaagcaatattaacgttttcaccgatatagattcctccacgcctcgcatccagaatactattatctccaacgacagaaccttttcctatcatcaacatccatggtgcacgaatttcacttccataatataatactgaattcttttccatttttaccaagaaaatatac

SEQ ID NO: 285 - DNA, 5214 bp, Bacteroides thetaiotaomicron
ggtttatatattatatattcatatattatttatatatatagtgttttctctttgtttttttccctatagttttatatcaaaagaccatagggacaaaaacccaactttttaaaatacgctttttttagatagggacaaaaacccaactttcatttgagtagttgtatcatatagagccttttttagttaatatatgttcttttccctaaagtttgtgttaagataataagaaaagttccttttttaggggtttaggtgataagaaaagttccttttttgtgtttggtatgattatcaggttttttttatcagctagtgatggtagtaccctttaaaatgaaaaggtaactgtttaaaaatcaacgattaatcacaaaaagctagggacaaaaacccaacttcttagggacaaaaacccaacttcttagggacaaaaacccaacttcttagggacaaaaacccaacttttacaccatccatagggacaaaaacccaacttttattcatcttctttttcttctccaatcattccggggagtatttctacctcttttaataatacggataaacaatattctgctttatttgaaattttattccagttatctctaacatattcgcctagataaagcatcttagttactactgctttatagttgtttaaggtaatctgtggaataaactgctgcaaatgttcgtccttcattgcaaagtgcaaagaacaaaaattcgttatcatcttcttttgtccttttaatagttcttcttccttctttgataatgcagacttaataactttgaaattaagtttataaggctgtgtatcgcctgaattacgataaacttctgccatttcaaaccagcaatcagcctgttcaaacaaatcttcgtaaacagggcgtattacacgtctatataaatctttaaactcggggtatttatcctctagttttaagaatttccgaaatctatccacataaatagagaaaccacctttttctttccacgaactaatcagcatatacattcttattgtatatctactttgcgctcttaaggctatctcttttatatagcgtgtaaagcctctatcaacattaatgaaaactttagcgacctctctatccatttctaaagaaaaacctcttgaataaggagttttaggtatatttgcctttgtaaataaaccagtaatagaccaactttcctcacctgttatggggtctttgacatcaaactctacaggaatactgattaatttacgaaccatactttttacttccttgtattggtctggactaacgcccaaatcccgatatgcaatatctactcttatacggtctgaatattcttgaaataaggataattgctcgcatggaatagatgtaccatatttatctagatgctgaatacttaattctatgacattctgtaatttctctataacagctattaagattctaatctgtactgtcttaaaatcaccagccattaatgtaaccacattaggttgtttcagccatgtgggattttctgggagttccacaggaagatttgtacgaggatgcccttttctaattctaacaatctcaccgtctatttcttctttttcttctttcaccgcacgttttcgggcttttatttctctatttaccatcgcttattattttgactgattaatacaccaaaaaaaagtagaataaagaacataaacataaacttggctatataaaatagccctatgagaatcattctaaatatagcaatgataacttctaatagatttcttattatgttcctccagttcattttctctgttttataattcctgtcgccaaagctccggctgcactattgtataaccagcactttgcaaatatattcttttaaattcatcaggcaacgctccttcaaggaataactttttatgccttgatgcagttcggcggtcatatggactatttttagaccaacctcttttaaggattagttccttaaagcattcatctaatgtttttgctttatctatcataatcttttcgtaaagaaattatagggtttttcatccctttatacatttcacaaggatttcctaatagttcgcacataacaaaatgtattatcttcccttcatccaatggtggatttgatttatttgctaattctacaactaatgtatattgataactataattctcaataacaatttctttttcattagaaacttcattataaatcttcctgtacttatgccataaagatgtattaaaaagctctacagtaaggtaactgtttacctgctctgttgtatagtcttctggtaaacgttcccctgtaagtctataaatagcctctatttttgcttttttccctacaaacattttctttccaatcatctgacaagaagggagttcatccctagatataaaaggcttcaaatctgacatcttacgatataccttatattcaataaacattctatctatactttgattatatgacatccattccctttaacacaattcgataaaattataatcatttatcccaatcgtaattatcgtaatctatttcttttcccttggcatggcattcagcaacataatcagcccatttcttttgccttgttacgttgaagggcatcgagcggaaatcttccctccatggcaggatgtaggaggcaaagtcgtgcttgttggttatcgcctgtacagcgtctctgattgcgttgtattcacgtccttcttccagcaaaggttcgtcacccagtttggagtatatgtttgccacttcccgaagcatctttccaaattctttgtatgtggcaaaattcttttcttttttatccataatcattcttttttgttttgagtattaatttttttcgatgaaagtattggttgtattcaacaccccggctgaatctcgacttttgccatctcttatgaagattccttcttctttcaaccgttcataatcaaattcattcatcatgataatgacaatattttcatttgtatatagcttacacttcataaattgagtaccttctatttttccaattacgtcaatttgaatttttgttgccatttccattatatttttagtattaaacaaaaaaatcacaatcatagacatcttcaccggatgggaactttactctaacgcagtagtttccacaaacaatgaatctgtcagatataatggttccgacctctcctctgtcacctgatagccgggcttcatcttattaagttccgacttcattttatcagaggtaaaaacagtaacattgcaaccacattgctcataatatatcagtcccatatcaagtgaattggtgaattgcttaaccatttcctttatttcctgtttactcaatacagtatcagtttcaaactgctgcaccttaacatcaggaaacttctttataaaatcttgctttgtcataccattattatatctattataatctaatttctaaaatcacttaaataaatttcaggtagtatttctctataattctctggacttgtaacataatgtattgattctattatattagcctcacaaatgacatcatatacccatgctttaaaatttccttccaaatcactctcattatcattgaatttattaaaatcatttttggcttcatctgttagatattttaatacattatgataggtaaattcttcctgaaacattattacatgaggtgaaatccgctcacctattcttggaagatgcggtaaattccaatttgcttttaccctcattctaaacagaaaagtattaattacaaatattactttcatacaccatttctcattttataatgcttacaaggtttctttctcgctgtgattcgcttttgaagcatacgacagtacatagtgaagttcgtacaaatttcataatgcttgcactggctacagtgcttatcatcaacgacagggaaaacagagttgatgaactccaacatggtttcagattcaaaatctgattccatctgggatttcaggcaatctttctttgtcaagcctgattcttctattacctgtttagccagttcagtttcattgtgtgaacaaacaagaaactgaacggcagaccatattccattattgaattgctttcccatcactattttctcttacttcataatgcttacaaggtttctttctcggtgtgattcgcttccctaaccaatgacattgcatagtacaattatcatgctgaatatagtaatgcttacacttactacagttatctacaccatcttcctcaaaggcataatcaataaaatctaatgttttttgacagactaaaccaaaatctgattccagttccaaacagttacttttagtcaatccggcacaatgaattaatttctttgcatcatgcttattgtcaaattgcagaagtaccctaacagaataccagatacctctgcaaatatcttttctcatttcaaattttctttttttcatatcattatcttaattttactcctttactaagattcctaagttctttctcgctgcttaattataaagtcattaggagttatatatccaacagactccatacggtctattatttcatgcacattcatttctgaaccgttaaattcaagtatacaaaaaatactcttttcctgcttaaaagtacgatttaacacagaactagataatctgaaaattttcttctctactccaatcataaattaatcctttcacatttctaataattgactatcaatctgtagttttcttcaatgcttcaaaagaagacaagtaatcatcaacagctttatttaacgctgcatatttatctttccacgttcttatttgccgttgtgtttcaatatacctatcattcaaagttgcataattctgaatagcaaatctaatagctttagcatctgttttttcaccagataatttttttagattttctaactctgcacaggcagcatcgtctaagcgtaatgtaaactcttttttcataaaaaaatgattaatgaattaatactgaaaaatagtcctaacagttggctacgaaatggatttaagaagcaatgtttcataattttgtttgctgttctttatactggcagccagaccagctttaaaggtttgtttatctctttattttcaatactcaaagatagcaaatttctataaatgtcgcaaataataagacaattat

SEQ ID NO: 286 - DNA, 5159 bp, Bacteroides thetaiotaomicron
gtgctccaaacaataaaaatttctttttcataaaaataaaatttaaaaattaataaatgaatgaactatatactctctcgtctttgcttgaaggacgaagggaaagactacatctctatatctatcggcacggtctgccagtcctcgacctcgggctggaaaccgccgccgttgacgatcggtttgggcaggggaagcccgtccaggacgatatgcacgttgcgcgggtccggagccgagtggatttgatccgtcacgtcataggtgtaataccacttgcttccatcggccagaacggcatagacagtcagcgtatggttgtttcccgccttatggccgaaggtgagcagaccgcccgtgatgacggttttctccccgtccttatccttgccggtaacggcatcgaagggaattgtcacacgctctcccgtaagggcatcggctcccgtaccgggcaacagacctcccgccaggcccgagatcgagctgccaaccccggagacgtatttcaggtttttggcatcgcggatctcgaccgtgtagcggcagactgacacttccgggtaaagcgtgatcgtcggcgcggctgtttcctgattcaatccgataccctccgcatggtcactccacagcatgtcgggaggcagcacgatacgctcatcctccgtacctctggcacggggtacaccggcggaccgcacacccagtgcggaaaggcccgataacagatcggccgtgcgggtggtgacctcgaaagtcgttttcgatccggtattgcgataggtgacgttctccgtgtcgctgttcaggcaaaatgcatcgtaatgcccgacgggaacgcggataataccgccgttacggtctgtgaactcgtaacgcaatgcctccccgccatgggtcgggaacaggtagagcgacatggacgcgggggcggcatccggagccttccgccagtcgaagacaaccttcacgttgaccacatgcaaactgtcatggcacagatccttgtgctcgcaggaggtcaatgacaagaccgccaaaacagcgacggccagcaatacatggttcatacgttccaacatcctgttcattgtccgcctcctttcttgtcattataattgccacgtcccagaagccacacgagcgagacctccgctttcgtcggcccgaaccaatgacgccgcctggtctctctccagacataccggccgccatcgggaacgtatgtatggtattcgccgccccagtagcccgcgccgatgacgaaatccaggttcagccgacgggcgacgggtagcgagtagccgtattccagacccaccgcgtagttcatcttctcccagagcgtgccgcccggcttgccgcccatgtagcccgtacccccgagctcgaagtcgtacgtgaacagctgcccgtaaaagcccagatggtgtcctgtaagcggtttttccgccgcgcggcggccgaagtatttgcgtacgtccagctccccgccgtagaggcgccagtaattatggcgcttattgctgttccaccaggcgtacatccagttgccgccgaccgtccagcccttgcccaggtagagctctacaccgatattcgggacgagaagggcatcgtagagcaggtttgtcttgagtcccatgtagaaagctttgggaacatcggcaacgggaatggctgcctgtaccgtgtcgcggatgacgacggtcctttcaatggtatcacgaacgatgacggtatcccttggttccgcctgtcggggcagaacgacagtgtccccttccatccctttggagaccggttcgaactcgcattcgattacggaacaattacgcagttccggaaagaaatgttctgccatataatgccatacgcggccgccgcgcagattcatcagctgccgcttgcgggaatcgacgacgactccgttacgggtcacccactcgggagtgtcacgaaggatacggagggcctcctcgcggtagggcatgtcggaagccttgacaagtgaggcaagcccctcccagtcattccccgaagaggtgcatgcgaataccgaatcgggaacgggaaggcgttccaggataaggccccgcaaggacgcgagccgttcatcggacaagcgcctgtttgaggcggaattgccctcgggcgacgatcccgagcgcatactgatacggcgcagcacggaatgggtctgccgggaacggatgcccgagagaagcgagtccaggcggacaccgttgtcccggtaggaaagatccggtgtggaactgcccacgggaaagtagagccggcaatgcagggtatcaccaccgcaaaaggccggacagaaaataccgaggaacagggtcaaaacaaaaactctttttaaatccatctgcaaaaaagactaataaattatctacttaaaagccaagcaatagtttccactctccatgacagagagtggaaaaaagaataaaatagcgtaaatagagctcaaaaaggggactttgtatgaaataagatgaaaaaaagattggatatagaacatatataaaagataaatacgcagataagcaataacataaccttatattttttactaaatggcagaaacaatgcgaatattatatttgaaaggggataccccctgttacaattatccaaaatgcatccgggaaggattttcatattacaaattttgtaaaatagaaatggatgaagatcccaatgagactgattgtatttggtttgtaacggaaggagaactggaggtatcctgcaacggagaaaaaacaaagattttggccggtaatatgatttgtttcagcaggggaagcatatgcaggatattctcacggggaaaagcgactgttgtcattgcacaatttgacaacatcgtccaaagttgtgaaaagatattattctcacagcttaacagtctgagtttcccgggtgaaaaagcaatatatccacttgaaattagaaccagattacaaatgtttctcaagcttttaataggctatctgaaggatggagccaattgcgttcattttcatgaaacaaagctgaaagagctgttctggaacatacagttttattatactaaaacggaacaagtttcctttttccgtcctatattggggaatgagcatgaattcaaaaagaaggtgcttgataattacagaaatgccaggacagtaaaggaacttgcccgcctatgcggaagttctctttctacttttaacaggaaatttttaaaagagttcagagagcctgcgagtgagtggttgcagaaacaaataaacactattattaaatataaattagctgatgaggatataccgatagggaatatagctgatgaattacatttttcttcacatgcccaattttgtagatactgtaaaaggaacttcggatatactcccggagaatggagaaaactactgaaaaatagtgataaaactccagagaggctatccggaagaatgtaattgagtgaaaaagataaaaaaaagacttgttatgataattatagttaattgacatctgtctaactttgcgaccgaaatttcaatgttgtcataatattattttttgcaaataaaaacagcctattaataggctttccactctctgtcatggagaatacaagagcatgcttgcaaatatatcatatccccaattaaataggacaccataactataaaattaacatatattatctgctatgtgattattcacttcgtccagtaccgaccggtcaagttccttcagataaattctggtcactttctccgaagaatgccccaaacattcactgatggtatgaagcggggtaccgttttcacgggccattgttgcccagcagtgacgggcagcatgcagacgcaaaggaatatttatatcgattctttgggaaatctttttcagtgcataccttatcttgttataagcttttttataccccgaataaggagtttcagattcatcaaccagagggaaaagatagtcacccgaagtatctccatacctttccagcaaactctgtatctgccggttaatacctatttcaagcaactggccggtcttctgccttctatagcggattaccccgggaaaaatatcgctcttttttagaaaagcaatatctacgaatgacattccgcgagtatagatactgaacataaaaacatctctggccaagcattccggtgttccgactgaaagtgacaggttggcaagagacttcacctgattcataggaagactttgtttgacggtcttttcagaccggattctgatattgcaaaaaggtgaaggaaataccagattcaattcaagacatccacgcctgtataccgctttcatattatgtaaataaaaccctatcgtattcttgcccacaccggcctccaggagagtgtcacgatacttaatgacaaggcgggaagaaagatgtgcaaatggaaaatcagtcttacacaaatgtttttgcatggaatgcagggtcgcctcatacgcttttgccgtcccttcatgcccggtgtcgaaaagcacacggattctctcacggaaatagctgtaaaaacccactttgccagtcagggtttcatagactctggctatatcacatgtcgtatattcattaccctccctttccaatatgcctatggctttatccaagattttacaaattttccggcatgtacggttcatgcgtcggacagtttccatggtatatgcaccattaaagagtactcgtccgctaaaagaatcaaactcacagggggtaatgctgtatcctgtataaaaaactttctttttccgtttatgaaggacctgcacagccaatggataggccccgcgactattacaccgcccctttactaataccgtttttactgttgccataactataaatacattacaaatgattatatgaattaactgtttgcataaaaaaatgcaaaaatcgcatgaaagaagcaaaacagcaaacaaaacaccatatgaatcgaattgggtaagttgatattttatcaacaatgttaactgtattaaaatatgtttccaggtagaattgcaacaatttgaaacaagctattactgttttcgacttaaatttctaaatttgcagtcataaaagatttttggcagaataaaag

SEQ ID NO: 287 - DNA, 5139 bp, Bacteroides thetaiotaomicron
gttatataaatgtgaatcgaaaataataaatggaatatcgattctaatatttatataaaaactaatgtttaatcttaaattcaagtgtatgagaatcaatgactcgtgtagaggctcgaagatttttcgggcattgttgatcttgatgctattcgcccttccggcacaatctgcaatagcacagttaacaattaggatctccaattcttctttaggaactgtgattaagcaaatccagtctcaatccaagtatcaatttttttatgatgacaatttggcttcaatgcgaatagagtcattgaatgttaaagatgtttctttggtagaagtactggataaggctttgaaagggaaaaatgtcgtttataaaattgatgacaatgttgtttatttgtcgaaagcaaatgcatcttcttcgacaaagtcgactcaacaacaacagaaagtaacaggtaaggtggtagatgctaataacgaacctttgattggcgtttctgtattggaaaaaggaacaactaatggtactattactgattttgatggtaattatacattagtcgttacaggttcaaatgcagttttgcaattttcgtatgttggatatcaaactttggagagggctgtagcaggaaagactgctattaatatcactttaaaggaagatgctcaagtcttggatgaagtcgtagttacggcattgggaatcaaacgctcagaaaaagcgctgtcttacaatgtacagcaggtaaatgctgatgcagtgactaccaataaagatcctaactttattaactcattgagtggtaaagtggcaggtgttaatatcaatgcttcttcatccggagtgggcggtgtatctaaagtagtgatgcgtggtacaaaatctatcatgcagtcttccaatgcattgtatgtagtagatggggttccgatgtactccaatgcaaataaagtgaatgggacagagttttcttctaaaggaaatactgagccgattgccgacattaacccggaagatattgaatcaatgtctgtgttgactggtgcggcagcagctgcactttacggttctgatgctgccaatggtgcgattatcattactactaaaaaaggaaaagaaggtcgtgtgaatatcacagtgaatagtaatgttgagtttaatgctcctttggtaatgcctcgtttccagacacgttatggtacaggtattggtggcgtgaaagatgataactccagtcgtagctggggccctaaactgacagaagccagatattttggatataatcctcgtgatgattattttcagactggtgttataggtacagaaagcgtatcattctctaccggttcggaaaagaaccagacttatgcttccgctgcagcggttaattcaaaaggtatcgttcctaacaacaaatatgaccgttataatttcaacgtacgcaatactacttcatttcttgatgataagatgacattggatgtaaatgccagctacattttgcagaaagaccgcaatatggtgaatcagggtacttacaacaatccgttggtaggagcttatctgttccctcgtggtaatgactgggaagatattaaaatgtacgaacgctatgacgttgcacgtaagatctatactcagtactggccgacaggtgatggtaatatgactatgcagaatccttattgggtgaactaccgtaacttgcgtgaaaataagaaagatcgctatatgttaggtgcaagtctgaattatcagattcttgactggttaaatgtttccggacgtgtccgcctggataattctaacaatgattatacggaaaaggcttatgccagtacaaatactcagctgacagagttgtcagatcgtggtctttatggcatttccagaagctacgaaaagcagttgtatgcagacttcctggtaagtgtaaacaaaacattcggtgaaaaatggtctttacaagctaatatgggtggatcgtttactgatatgcgatatgatgaaatggctgtacgcggacctattgctgatgattcaaaaacgtttgctggtgaaaaagccggattgacaaacggtttctatattcaaaatctgagtacgaccaagacaagcaaaatgcagtcaggatggcgtgaacagactcagtctatctatgcatctgccgaagttggctaccaaagtacttattatctgacattgacaggtcgtaatgactggccttcacagttggcaggccgtaactctgtcaataaatcattcttctacccttcggtaggtatgtctgtagtgttatctgaattgatgcctaaattgaataaggactatctgtcttactggaagatacgcggttcttttgcttctgtaggtacagcattcgaaagatatatagctaatcctttgttcgcatggaataccagtatcggtcagtggagtaacctgactgacttcccggtatatgacttgaaaccggaacgtaccaattcttttgaagtaggtatgaatatgcgttttcttaagaacttcgaactggatgtgacttattataacgccaagacaatgaatcagacattcaatcctgagttgccggtaggtgaatatgctcgtatctacattcagacaggtgcagttcgcaatcaaggtcttgagttagcgttgaattacaataatacatggaaagattttacttggaatacaggagttacttattcaatgaacaagaataagattcttaccttagctgataatgccatcaatcctatcactcgcgagaaattctctatttcttctctgaatatgggtggtctgggtagtacccgtttcatcctgaaagaaggtggaagcatgggtgacatttactccttgatggatttgaagagagatgccaatggagctgtttatatcgatgagaacaacagtgttgtaacagagagtctggaagctaataattacatcaaattaggtagtgtattgccgaaaggaaacttggcatggcgtaacaatttcagttggaaaaacattaatgtggcattccttgtatcagctcgtctgggtggagttgtattctcacgtacacaagctgttcttgataacttcggagtttctgaagcatctgctgctgcacgtgacaaaggttatgtatcggtaaatggaaacgaccgtgtaaatccggaaggctggtattcagtagtagctggtggtacggctgttcctcagtattatatttattccgctactaatattcgtttgcaggaagcttctatcggttatactattccgagaaaatggctgggcaatgtgtgtgatatcaaagtttcattgatcggacgtaatctttggatgatctacaacaaggctcctttcgatcctgaaagcgtggcatctactgataacttctatcagggaattgactactttatgatgccttcattgcgtaatattggctttaatctgagctttaaattctaaataaatcaagataggtatgaaaaatataataaataaattagtatttggatctcttaccgttgccttgtcctcgtgtatcggtaactatgagaatatcaattccaacccatatgaagctcctgatttgtcagcggatggatatgctttgggatctgccatgaataacctggccggttgcgtggtatcaccggatgtaaatacagctcagttcacagactgcttgttgggcggacctttaggcggatattttgccgattctaatgccggttttacagaaaccatttcaaacttcaatccgaaagacgactggagccgtgtgtttctgaaaagtgataagattattccgacattatattctaatctgacccaagtgaaacttgtatcacaaaatacgaatgatccggttccttatgccattgcacaagtgataaaggtggcagctatgcatcgtgtaactgatgctttcggtccgataccttattctcagataggtgcgaatggcgaaattgctactccttatgattctcaggaagtgacatataatacattcttcgatgagttgaatgcagctattgccacactcaatgagaattctaacgaacagctcgttcctacagccgactatatatataaaggtgatgtaaagaagtggatcagatttgccaactcactgaagttgcgtcttgctatccgtatagcttatgctaatccggtgaaagctcaacagatggctgaagaagctgtgaatcctgcaaacggaggtgtcatcgaatcgaatgcggacaatgcaacatggaactactttgagacttcacaaaatcctatttatgtagctacccgctacaatcaggtacagacttccgatcatggcggcgtaccctgtttgactggtggtgatacgcatgctgctgccgatatcatctgctatatgaatggttacaaggataacagacgtgaaaagttcttcacaaaatccgaatgggcgggacaggactatgtaggaatgcgtcgtggtattgtcattcccgaactgaagacaaccggacataaatactctggggtgaacattgctcctacatctccgctttattggatgaatgcagccgaagtagctttcttacgtgctgaagggcaagctgtttttaacttcagcatgggtggtacagcagaatcattctataatcaaggtatccgtctgtcatttgagcaatggggtgcagacggtgtggaagactatctgaaagatgatgtaaacaaaccgactgcatatacagacccggcaggtacgaacacttatcagaatgctttgtccaatatcactattaaatggaatgatagtgctgacaaagaagagaagcaagaacgcattatcgtgcagaagtggattgccaactggcaattgggtaatgaagcttgggcagacttccgccgtaccggatatccgaaactgatcccggtgaaagaaaataagagcggtggtgtcgttgattcagagaaaggggcgcgtcgtatgccttatccgttggatgagtttgtcagcaataaagcaaatgtagaatatgcgattgccaactacttgcacggtgcagataacatggctacagatgtatggtgggcttctaaaaaataatattaaacttaaaggaaagtatatatgaaaaataacc

SEQ ID NO: 288 - DNA, 5068 bp, Bacteroides thetaiotaomicron
ttatagaatactgcatcctttctttattttttttctcagaatagttattttttttctttttatggtaaaatcttctgattgaggtggagcttttaattcttttttaagggctgggcaatgaaaatattgaatatttcattgttcgtaaatggtataataaataggtgttgaaaatgaaacaaacagatttttccctctaattatggtcgtttaacgaaaatattattgttttttatttgcgtatattggtaaatatggtcatctttgcaccgttattcgtttctgtttgttaaagaataacgaataagtgtggggtaaatagatgatttttagtaaaaaagacattcaagaagttctgccggcagatgtgactggcaggagcgtagcgcaccctaaacgttggttggtggctttagtacgtatttctcatgagaagaaaacgagtgagcgactatctaaaatgggtattgaaaacttccttcctgttcagcaagaagtgcatcaatggagtgatcgtcgaaaggtagtcgagcgtgttcttcttccgatgatgatatttgtgcatgtcgatatgtatgaacagaaagaagttttgacattgggctctatcagccgatatatggtattgcgtggagaaagtactcctgctgtcattccggatgaacagatgcaccgctttaaatttatgctagactattcggacgaggcgattaatatgagtacgactcccttgtcaccaggaaccaagattaaggttatcaaagggccattatccggacttcagggagaattggttacagtaaatggaaaatcgaaagtagcagtccggctaactatgttgggatgtgcttttgtagatataccagtagggtgtgtagagcctctggagaaataagggtttaaatataagtgaaacaagcattaagtgaataaaaggggtatggtgagttttttactacaagaaaatattgatgaactgcaacatctggcagatcatttacttcacatcggtgataaaaatgggtatgtatacgccgatgacctttctgcattacaacaatcaatccacgaaaagataaacgatttatattcacaacggggggagacaccggagcaggatgctaccctgtgtttggccatccttcagggatataatgtgtcgatgtacgccaatccggaagacgaggatagaaaacggtctgtcttgcagcgttctctgacccttcttgatgttcttcccccttctcttcttaaacaacagttgtctgcggtctgtcatggtatgcaggaactgtgtgaaaccaactaacttttttatttgtcaatgaaaatacaacgactttttagcattctacttttttgttctatgctgggaagtggctcgcttatggcccagtccatgagtgactcacaggtactggaatatgtaaaggacggcatccggcaaggcaaggaacagaagcagcttgcttccgagcttgcgcgtaaaggtgtgaccaaggaacaggctatgcgtgtgaagcagctctatgagcagcagaacaatgtaaacacttcccaatccacgggtacggatatcaacgagtcccgccttcgtgaagagactaaggaaaatacttccgacatgctggaagatcatccgactacggaagatttggcccgtgaggaccaggttttcgggcgcaacatcttcaatacccgcaacctgacgttcgagcctagtgtcaaccttgccactcctgccaattaccgtctgggccccggtgatgaagtcatcatcgatatctggggtgccagccagaacacgatccgccagcagatctctcctgaaggcaccatcaatattcagaagatcggtcctgtcaaccttagcggtatgacagtctccgccgccaacgactatctgaagaatgccctgaataagatctataacggtctgaacaatactaccgaccctacttccgacatccgtctgactttgggtaatatccgtactatccagatcaatgtgatgggagaggtcgtacagccgggtacctacgccctttcttccttctctaccgtcttccatgcgctttaccgtgcaggcggtgtgagtgatatcggcagcctccgaaacgttcagttggtacgcaacggaaagaatatcgccaccatcgacgtttatgaatttatcatgaaaggcaacacacaggatgacatccgccttcaggaaggtgacgtggttatcgtccccgcctacgatgtcttggtaaagatcagcggcaaggtaaaacgccctatgcgtttcgaaatgaagaaagacgagaaccttgccactttaatcaaatatgccggcggctttgaagccgatgcctacacccgttcattgcgtgttgtccgtcagaatggtgaggaatatgaggtcaacacggtcaaggatatggactacagcatctacacaatgcgtaacggtgacgttgtaacagccgaagccatccttaaccgcttcacaaacaaactggaaatccgtggcgctgtctatcgtcccggtatctaccagctcagcggtaaactgaatacgatccgcgaacttgtccatgaagcccagggcctgaccggtgacgcttttctgaatcgtgccgtcctttatcgccagcgtgaggatttgaccagtgaagttgttcagatagacatcaagtctatcatgaacggtacttccccgaacctcgccctgatgaagaatgacatcctttacattccgagcattcacgatctggaagatcgtggcaatgtcacagttcacggtgaagtcgcgcatcccgattcctatccctatgctgataacatgacacttgaggatctgatcatccaggccggtggcttgaaagaagccgcctccactgtccgcattgatgtgtcgagacgaatcaagaatccccgtagtaccgcggataatgatacgatcggtcagatgtataccttctctttaaaggatggttttgtcatcgacggtcagcccggttttatccttcagccttatgacgaagtttatgttcgtcgcagtccgggttatcaggcgcaacagaatgtagtcattgatggtgaaatccttttcggaggaaattatgccatgaccaaccgtgaggaacgtctttccgatctggtgaataaagcgggtggtcctacgagtcttgcctatcttcgtggtgcgaaattgacccgtgtggcaagtgcgggtgagaagaaacgtatgggtgatgtgattcgcctgatgagcaggcaattgggtgaagccatgattgactctttgggtattggtgttgaggatacctttacggtaggcattgatctggagaaggctttgactaatcctaagggtagtgccgaccttgtcctacgtgaaggtgatgtggtctttatacctaagaatactaatactgtaactatcaatggtgctgtcatggttccgaatacggtttcttatatgaagggaaagaatgtggattattacctgaatcaggccggtggttattctgataatgcaaggaagagtaagaagttcattgtttacatgaatggtcaggtgacgaaggttaagggaagtggtaagaaacagattgagccggggtgtgagattattgtgcctagtaaggctaagaagaaagggaacatagctaatattttaggttatgctacttccttcagttctttgggaatgatgattgcttctattgctaatcttataaagaaataatagaatttacttttatgtcagaacaacgacaggataaaaacttgctctctgaaccacacaagacagaaagtgatgagatagaaattgatttggttgatatctttcgcaagattattgctattcgtagaaaattatacaaagccattggagttggttttattattggaatgattgtagcagtaagtattcctaaacagtatacagtaaaggttaccctttctccagaaatggggagttccaagggtggtaatggtttagcgggacttgcagcatcttttttgggaagttcagctactacgggtgaggtctctgatgctttgaatgcttccctttcctctgacattgtttcgtccactccttttcttttggaattattagatatgaaagttgctttatcggatgaaagaacagatataactttaatggattatttggataggcaatcttctccttggtggaattatgttataggtttgcctggaatggtaattggtggtgtgaagtctttgttcaatagtgatgataatgataattcacttaataaagtgaaatcgggtactattgaactaacaaaagaagaaggtataaaagtcaatgttttgaaaaagaatatatctgcttctgttgataaaaaaacggctataacaagtgtctctgttactttgcaagatcctaaagtaactgcggttgttgcagattctgtagttcataaattgcaagaatgtatcgttggttatcgcatttctaaagcggaagaagattgtatttatttggaaaaactatataaagagcgccaacaagagtattatgttgctcaaaagaaatatgcagattatgtggatacacatgacaacctcatacttcaaagcgttcgtgcggaacaggagcgattgcaaaatgacatgaatttagcttatcaggtttatagtcaggttgccaatcagttacaagtagccagagcaaaagttcaggaggagaagcctgtttttgcagtgatagaacctgcggttgtacctcaacatgcttctagtatcggattaagaatttatgttttgttatttatatttttgtctgtatgttatactattagctggaatttattaggcaaaaaaattaggtatattttgaagggtagtaaggagaatcaacaataatcttttgatattgatgaacggaaatactcgaacgaagagaagtttaaaaaatatgcaaacagcattgctgttttatattattaatttagtattagctttcatttctagaaaagtttttatcgaccatttaggtattgaggtattaggacttaatacaacacctgtatcaatattatac

SEQ ID NO: 289 - DNA, 5027 bp, Bacteroides thetaiotaomicron
gagagttgcagtctgattcagcctatagtcatttaagactagtgtcaaagttagttcactgcaactctacttttcaaatatacacttatattttgttgtgatatttaatactgcaaatgtaaatgtgtcaaaagtcaatagtaacgaaactggggctgacaaaaaagtcggcagtatcttaaatctcctccttcgggaaggaggagtacccgcagggggaggtggtaggtgaatacacaagctattgctactgacttttgacacccccattaatgagtaatattattaccgaagtgttacactcaatttattccccgaaggtatatccgaactattgccatacatgatttcatattttccgggcataatacgcatagtatttgtagtcggatcaaagaactcaaatgtagttggcaaaagatcaatagatacaacacaagtctctcccgccttcagcggtacccgacggaaagcgcgcaaactctttatcggcccttccgcatcatctactttgcggacatacacctgaataacttcagctccatcatacttccctgtattcttcacattgactttaaaattcaaatcctgtccggcagatataattttcttattcaaacgtcctttagaaatatcgaaagtagtataactcaatccgtatccaaaaggaaacaaaggaacttccgtcatatatctataggtacgattcttcatactgtaatcttcaaaatccggcaactggtccgtactcctataaaaagtaacgggcagctttccactcggattaaaatctccgaacagaacgtccgccacagccaatccgccagactgcccgggataccatgcctgcaagatagcatcacaagactccatctcaggaaccaatgcgaccgccgatccggaacagttgacaaacaccaccttcttccccgctttcttcaatgctttcaggatatcacgctgcacttgcggtagttcaattgaagtacggtcgccgccagcaaatccgggactgttaacggaatacatctcttcgccttccaaactcggcgaaatgccacctgcgaaaataacaatatccgcttctttgactctatcgacaaccatctcaggtgaaatatgacgataaatacccaaatcaaatctaagcaatgcctccgcacctgcctgcatatattctattctgatcttataatctgtccccgcaattgctttcaacgtatattcccttttagcactggcatgttctccccaataatcaatcaccttttccccgttcacatatacccgatagccatcatctccttcaatcagcaactcataagctccactctctttcggacgaaaagttccttcataaacagcagtaaaattatataagcccacacctgtggcaaagactgtattcccaccattactcagattaatcggagaagtaatctgacttgtagccgcgacatcaccactcaaattcatattattccagtaggtagccgtcagaccgggacgcccattgttggagatctcattaaaataagattcaaaaatccgattatccagtaactcacatcctttctcaaaaggtacatcgcctatcttgcagcgaatcccttccaaaatagtatatgtatgtgagggtacaccttcatagtttccccattgcatcaccgaatcaaccgcattcggtcccatcactgcgatacgtgcccctgtttttgccaacggaagcacgccattattgcaaagcaataccatagatttacgtgccagatccaacgccatctgtttgtgcaaatcacaatccacagtatctatactaattctgctccagggaacgatagaatccggatccatctcgcccaaagcaaaacgggctttcaacaaacgacgcaaacttgtgtctatacgttcttctgtgattaatccctgctttactgcttcctccaaatgcgaatatatcgaaccacattcaagatcagttccattgatcacagcagaagcactggcatcggcagcatctttatgtgtctcatggcggcctttcacaaaaaaatcatcaatagcaccgcaatcacttacaaccaaatgtttatagccccattcatccctcaatatttgcgttaacaaccggttgctatcacaacagggctctccttccaggcgttgataagcgcacatcacttccttcacgtctgcctcttgcaccaaagccttgaaagccggaaggtaagtctcccatagatcacggggagagaggtcttctacatcaaaagagtgacgtttcgcctcaggaccactatgcactgcataatgcttgacacacgcatgagccttgtcatattcggcatctgccggcccctgcattccctttactacagctactcccatacgggtagtcagataagggtcttcgccgaaagtctcctgtcccctcccccaacgcggatcacggaaaatattcacattcggattccaaaaagtaagcccttcgtttccatatccatagcgattactgcgatgggcatcgtggaatttagcacgtccttcatcactaacggcaacatacactctttcaattgcttcatcatcaaaggtagatgccatacccatagttatcggaaacactgtagccagtccattacgggcaacaccatgcaaagcctcactccaccaattatagggagctactcctaaccgttctaccgcaaaagaagaatttttcattaatcctattttctctttcaaagttaatctccctaataagtcttccgcacgctcttcgggagtaagtttcggattcttataaggttcattctgcgcgaagctgcccatcgacgcaacgatactcaaacttaaagttaacagtacttttttcattttgtccaaattaattaaagctttatttattatgttaccttgcaatttcacatcggaaaactacattctaatcattgttttcaaatacaataactatgatcggggaatgctgtctgatttatctgttcaaatggaaacgcctaacttgaaacagcgatgaatgataaatgtagtgcaaaaaaagctgccataccaaacttttttccaactatttttattactaaataatttttgcgaatcaaagcttattactatcagcctccaaacctgattatagccaaaagtacatgagtttctattacatcattaataatctgactacttcagaaagtctatctgaaaagaaaagaggctattgaaaatacagataaagtaacagcctgctaaaaacagcaagaaagaagataagtatattccgacactatataaataatgagaaagaaggaatgtcttatttttataactaaaatgaaagaagcgacaatagaatctcccagcctcgcttcaccttatctttcaagaatttcaaggccttacccatatgtatttctacagtcttctgactaataccaagcctctcggctatctccttgtaactcaggctttcttcacggctcaacaagaaacactttctttgttgttcaggaagtgaattgattaaccgatcaatgaatatttttagttgagaagcgcaataatcttcctccacagtagtggagttataataaccttcgtttccataggctaccaaaacagaggttttgaaaagattctcatttactctcttcttatttttattaaatacgatgtttcgggtaacaataaagagaaaacctttgatattttcatcttccttcagtaaatgccttgattcccacaacttcacaaacacatcctgaacaatttcctctgcatcagcaattgtagcgatgtacaatcggctaaagtcataaacctgactccaatactcgttatacaaatctataaacgcttgatgatcaccgcccttaatagccaatactctttctctttcgttcatatttgtgcaaatattagtgacaacaaagctatacattatttaaaagatacaaaaataaaacacattttttttatatccgataggggtaaatgtaatatggggagtatttagtatgtaaccgaagtcaataacgatcattatcactaatatacaaagacgtgaattcaatagaactcattaatattataaaaaagatgttagccgacagactgacaacttccgaaagggaacagcttctcaatgagaagcctatggttaactttcagtctcaacaatgggataaagctcctaaagctcatatacaagatcatgttcccccgcacaccatactcaataagattatggtcagatgccggaacgaaaaacagcctttagagagaaacaagaaatactatcgtatcggatattccatcgctgccactgttgccatcttcattatcggcttttggattgccaacaatatttcatcatccgacattaatatcagtgctccaatgaatgataagctggcagtcatgctgccggacagttcggaagtatggctcaacgcagcttctcaaattcgctatcacaagtcatttctgaacaacagagaaatcttcttggaaaaaggagaagctttctttaaagtgaaaaaagctcagggagcacccttcagggtttatttccgggaatcgcgtattgaagtgaccggaacggaattcaacatcaaagccgggcacatggaatcggaaattaccttattcaccggctccatcaaattccaggcagaggaaggacagcgagaactgccgatgcaaccgaacgaacgaatcgtatacaatacccaggccaaatcagttgtacgcacgaatatagatatcaacgagtatgactggcgctcaagtaaatatcgctttaccaacaagccattacaggaattcatcgattttatcaaccgttcataccatgtaaacatcataattaaagaagaaaagctcaaagagctgaagtttaacggaactatacgtaaagacgagccgcttaccaatatcatcgaaaagatatgtatcagcctcgatttaaaagaaaaacaagaaaataacaacatcatattatattaatacataag

SEQ ID NO: 290 - DNA, 4953 bp, Bacteroides thetaiotaomicron
cgccatacccctgccttatccatgataaacgatatgttcttattatgatcatcggatatacctgcgacataattaaataccattctgataaatatctgatctttgtcttcctggggaagtttcagagtctctgctatccaacacagcttcatataatcatctgcacccggcataatggccgcaagggtctgactaaagagcttttctccattcttacgatcaaatctttccgttacgaaatgatttcttccatcaatttctttcaggaagcatggcatcatgttgattcccgccgcctttgccatttcgctatataccatttctatctctgtggtaggagagtcatctgcttctttaaatttgatgatatactgcttaaaattttcaggcaaatccacctggccggaacgaaactcttccgtttcgagattataggcaatcactgccttcgggcgcatgccaccggcagaagttccaagatatatcaactttttcatcgtgaggctatcctccggtgatatgacagcagcatctcgatcattatatattttagaagccaaagttgccaatgatgacatatttactgactcatggatggcatcatcattaaattccggttcaaattccaatgctcccatagccctcttgccaatataagagagcttcaatagaggcaatgattccgtaacctttatattattatccgtgagccattggtcaaatagggaagccccccatttgtcaggaagcgcatctgcaagaaattccggaagcccttgatataatttatctttattcccatagaaagacgcaaacaaaggggttctcttagggtgtgtggaagggcatatatcataatcttgtttcctatattcatccgtaaattggaatacagaacaatgcttttcaaagtcccaattcaatttgccaatgcaagtcccccacagatatacattcactataatcggctctttcttcataccatcttacgtttaccgttaattctttgtattcttttacctgttttttcattgattaggaaaggggagtctggaagttccggaaccaaaccgacaacgccttcaagagttccacttatacgcaaaatcttaagcaatgtacttagggcaatatcacttactttacaagattctattctcttaatagtaacgatagatactcctgccttatccgcaaattcttgctgggaaaaacagcagctaagtcttatagacttaactctcttgcagatttcctttacaatacattcatctgaaaattcgtatattgtatatgtatcatataatcttttcatagaaaaacatatttaggtatcatttttgatacaaaaataccgataaatctgaaaatcaccaaattaagaaacactttttttataatcttctgccgcattagcaaacgattgaagcgaccttgtgccgcttcaatcgtttgattgctttttctttttagtccgggggttcttatttttccggagtcgggtagaacttagtagctaccatcacaatgcggttacgtttctccccacttttagaatccgtccattcttccggcttaaagtagccttcaacggtaatcagtacatctttttgcagtatccaaaaagcatagcggtcttccatcttactccaggcttcaactttcataacagaggaaacaaatgttttttcttcatttatcttgcctatgcgactgaccacaatagagaagtgtgcaacctttactatttcgaataaatggatttctgcatccctacaaatcctgcctgttactgcgaatgaattttcaatctttttcatatctctgattttttagaagttaattaatcaattttacagtgcaataactgattgttggctttgggggacaccatgaaaaaagatataaatactctttttatgctggccggaaaaaggaagatttgtaacttttttattggtgaagatggcaacgaataattcgggttaaatacgctttttgtgcaaggcaaaaaaggaagatttcagacgaataacaacgtggtgtttgtgaatcgtccccttatccccgtaaaaggggttagcaacaatctatatttgcaacggaaaatgatttgacttccctaaaaaatgatatgaaaaagacaaaacttgaaaatcagtaacaggtttggaaaggatgcaaaaaacaaccggttagacagcaagcatggcacatcccgaaaagatggtcagccgcctatcgacacaccggaagaaacatctgcaattccttttaaaaaaatgaagccgaagaatgaagcatatcatattccacgtatcgaaaaaagtgactgcacgataaaatgaaaagctgcaacggaagaactgacttgcggattctgcgggagaacataaccacacaggcatacagccactacacctgtttccaataaaagaagattacaccaccggaaaagcagaaaggctccactcggagaaaagcaagcaaacgattgaagcggactgccgatttggcagcgaaatatccaactacctatctacagccctaaaaggctaggacatatgggtaagcaacagactgccgggcagtcactccgctgaaagggtgggtgggaaaaaactaagtggacgcaaaaaacaaccttaccattgggggataaacttccccctattttcacttcacatattctttaccccacttcaattgattcaacaaacttcaacaacaaagcgactgttaccgtatgaaatgaaagctgattgaacaacttatgcgctttcagcatctcaatagcggcttcagccgtaacaactctctgttcataaagccgaattgtcgcatataactggtcatttgcgacaggccccattattaggtcatagtcaccgttttctcttcctctgcggttgttgacaacaaactccagccattcttttgtcgcacccataaaccgaagaaccggatattccctatcaagaatatcatcgggaacttcataaacagagacgattgctttttcgctctgttccctgttcttcttcaacaaagcccatttttttgcttgttcaaagttggttgtcgtataaaatcccttcccaaagtccgtagccttccgtcctttctgtatattagggcgtttcacggtaactgtagatccatgaaatagtctcattttcttttattgatataagtcgttatagtatctaatatatattcggggtcttgggtatgaagcatttcaaaagtctcatccaaaaaatcaaaaaccccatagtccgaaaacaacaacaaggtttcttccgcactttgtttcttttcctccctataattctcaatgcagaacatcttgaaaagcaggatcttcgtgtcaccgttataccgtcgtttttcttctgttttttccttctccaatgtttcataaagcgacaatgtacttgaataccataacttggtactcttatccagcaaagatttatacaacttggaagaatatatataatacagtgcatcgcctaaaggcaatgcctttttcttcatgaccagttctaccagctctctcatcacgaatgggagcatggttgagtcaagttctccttgatttttatgagtaatttccatattcttgttgttattactttagcatattttcgaaaacaccttcttcacagttctttatacacacctgacactcggccaccacttctcttaatattcgggcacattcttcattcgaatgcccttgcagtaattcataggcatatcgcatcagttcattagcttccattgtttccatccttatcaataatattcaagttcatcattattttctgcaacgactccatatttggagttcctaaccaacacacacctatgcaaaaggtcatattgttctctgtatctgaaaaacgcatattgttttaccttttacaaacattgttgtcccattaaaatctaaaagagttctttgaaatatttgaaatttagttagttacagcgattttccgagcgaacggacttgaatttgtagctttgcatcagattaatccgatggcatatgttccaagacaaatacgttttcgctcaattggcttcatttctgaatcgaagtaagtttaaccgcatagtcaccaagtatgatggtgataaatatgtgaagcacttcacctgctggaatcaactacttgctttgatgtttggtcaactttctaatcgtgaaagtctgcgagatttgatagttgctcttgaagctcatcattccaaatgttatcatttaggaatgggtaaaaatgtatcaaagtcatcgctggcaagagcaaatcaagatagagactatcacatctttgaagaatatgcttactacctggttagcgaagcacgacaaaagtgtgctaatcatattttcaaacttggcggtaacgtttatgctttcgattcgactactattgacctgtgcctttcagtcttttggtgggcaaaattccgcaaaaagaaaggtggtatcaaagtgcatacattatatgatgtggaaacacagattcctgcattctttcatatcacggaagcatccgtacacgattctaaagttatgattgaaattccttatgaaccaagctcttattacatctttgaccgcggttataacaacttcaaaatactgtataaaattcatcaaattgaagcctactttgttgtcagagcaaaaaagaatctcgggtacaaatccatccaatggaaacgtaggctgcctaagaatgtgctttcagacgcaagtgtatttctgacaggattctatcctaaacaatattatccagagccacttagattggttaaatattgggatgaagaacaagaacgagaatttacattcataaccaatgcgatgcatatatctgcgcttcaagttgctgaactttataaaaatcgctggcaggtagagctgtttttcaaatg

SEQ ID NO: 291 - DNA, 4860 bp, Bacteroides thetaiotaomicron
gctttttattaattgtagtattaattatagtaactgtaatcactgttagcagtaccattgtagtcactaatattttcataattataattcccgtaataactattaccatagccataactatcttcgtaattaccataaccaaaataaccataggcatagccgtagctttcctcatgagcaccaatggtagtatcaatgtcggctttttttattcgatatattgtggatatatccgaaatgtctacttttcttacctttttcccatcttccccctctagggttgggtcaaaataagagatttttccgttttcatctggtactgcaaagactataatagtatgtcctgtgccatcaggatttaccatagttgcaacttgataatagtctctgttagaagtcattgaacctggaactgtattaccaaatcccataacgctaaggacatttccaattaattcattgggaactcctcccattgctgtaggatcaagaccataaatatctttataatcattagcataatcttgcgcagatcgggagggatccatatggtgcatgcaattgaataaacaatcccaacttgtagttccaccatctccaccgttgcaacatctcatttccatttctgtcagtactggcatctctttccgaatctcatcaatgagtgctcttgttaatttttgcttcataagtattaaattttatttgtgtgattctgcaaatatagaaataaatttcgcatctttgcaagaaatataaatctttttttatgcaaacaagacaattcccctgggagtaccaaatggatgcaaaagactgtggcccagcatgtatcaaaatgatagcaaaatactacggcaaatactattcgttgcaatatttgagggatttatgtgggataaccagagaaggagtttcctttttggatattagctatgctgccgaaaaaatagggctaagaactgtagcggttaaggcgactatggagaatctgaccaacaggattccactgccatgtatcatacactgggaccagcaccacttcatagttgtgtataaaacaaaaaaagggaagatatatgtgtccgatcctgccaaaggcttgctttcctatccggaagaggatttcaaagacagatggtataaggaaggggaagaattcgggatgctgatggtactggagcctatggcaaacttcaagcaaatagaagctcatgaacggatcgaaagattcaaaagtttcgaaaaccttctcaactattttacgccatataaaaaagcattcggcatattgttcgctatcatgttgatagccaccggactgcaagcagtacttccgtttatctcaaaatctgtaatagatataggtatatatactcaggatatatctttcatctacatgatgctaatcggcaatattgttcttttacttagtataacgctgtcaaatgtattaagagactgggtcttgctgcacgtttctacccgtgtcaatatctccctcatatcggactatctgatcaaattaatgaaattaccggtgactttcttcgaaaacaaactggtcggtgatatccttcaacgggcgggcgatcatgaaagaatacgcagctttgtgatgaacaactccttggggatgttcttctctatcattacattcgttgtattcagcattatactgttgatttataatcctatgatcttttttatttttatagcgggcagtgggatttatgtagcatggattttcacctttttgagcatacgtaaaaagctcgactgggagtatttcgaactgaatgccaagaaccaaagttactgggtggaaaccatcgaaaatgttcaggagattaaaataaacaattacgaagaccttaaacgctggaaatgggaagctatacaggcaaggatataccggttgaatctgaaagtgctgaaaatcaataatgcacagtcgcttggggcgcaatttatcaatagtatgatgaatattgccgtcacgttctactgtgccatcgccgttatcaatggagatatcactttcggagtcatgatctcaacgcaatttattatagggatgctgaacggacctgtggcacagttagtcagttttatacaatctgcccagtatgctaaaatcagctttatgcgtatcaatgaaattcatcagctgaaagatgaagacgattcttcgcctgtgataagcaacagtctgagtttgcctgtagacaaaagtttatatctgaagaacgtatcatttcagtattcgagaaatgctccgctggttttgaaaaacatcaccttgcagattcctaaaggaaaagtgaccgctattgtcggagacagcggatgcggcaaatctactttacttaaactgttgttgcgtctatacatgccttcttacggagaaatctgtatgggagatatgaacgtgaataatatcagtcttcgcaattggcgtgctaaatgcggctgcgtgatgcaggacgggaaattgtttaatgacaccatacagaacaatattgtactggatgatgccaatattgattatgaggcattgcagaaggctgttgaagtagccaatatcagccacgagatagaagctatgccgcagggataccagacaatgatcggagaaatgggcagaggtttgagtggagggcaacggcagcgtgtactgatagcaagagcgctctacaaggatccggactatctgtttctggacgaagctaccaatgcacttgatacgattaatgagcaaaagatagtaagggcattaaataacgttttcaaaaacaggacagtcattgtggtagctcatcggctaagtacgattcgcagggcagaccaaatcatcgtattaaaagcgggaatgatcatagagacaggcaatcatcaaagcctgatgacaaacaaacagtattattacaacttaattcaaagccaatatgaaccggaaacaaacaccttctccacagaagaaagcgcagactaaatcatccggaagaagcgaagaactggatgagattattgaccggatgcccatggctttcggaaaatgggtggcactggcggtcattgtatttgcagcattatttctattgttcggatggattatcaaatacccggatatggtgaccgggcaaattaaaattaatgcgcagaacccgaccgtaaggcttgttgccaacagtacggggaatttgctgcttctttcgcacaaagcacaggaggaggtgaagaagggggaatatatagcggtcgtgcaaaatcctgcttctacagaggatgtgcggaagattgcggatttaataaatcgaatagatttcgatggcacccatttgcttgctcttaaagatacatttcccgacaaggtatatttaggagaaatcaaccctcaatactatgcctttcttgcagctctgaaagctcaatgtgactatctgcagcagaatgtctacgaaaagcaaagagagaatatcacgacgagcattgaatggaaaaagaagattgtccgagaagcggaggactcgcagaaagctgcaaaagatagaatggatgttgcccggaaatggcttaaacgttatgtctctcttgatcagcaggaaatagcgacttatgaatatgagaccgatcagattaaaaataattacctgacaacagtacaggaggtacaaaacataaatagggagattgcctcgacccgcatgcaaatcacagaagcataccatcggctggagcaactggaagtggaacaactggagaaagaacgggaactgaaagtggaacttttgtccactcatcagaacttgatagcaaatatggccgcatgggaacagaaatatgttttcaaagctccttttgatggaaaagtagagttcctgaaatttatttcagatggtcaatttgtgcaggcaggagaagcggtatttggagtgatacccaaggaaaaccatatatatggtcaggtgctgcttccggccaatggagccggaaaggtaaaagaaaacagtaaagtcgttattaagttagagaactatccctacatggagtatggatatatagagggatatgtatcttctatttctttggtcacccaaacgcagaaaacaggagaaaagaccattgaaacatatttgattaacgttgaattgcccaacggattaacaactaattatgaagagactctcgactttaaatatgagttgggaggaactgccgatattattgtaaaagacagacgattgatagaacgcctgtttgataatttaaggtatcggactaaataaagctcatactcaaatttacgctccataggaattcaacacgacttttgccctcatgctctaacagtccgtctgtatccctttattcatcgtggtttcgggcgtggtagcaagtgtggtggcaagtatgagagcaaacggttgctctcactcagtttcgtcgcattatatgttgttttttgctgctattatttgatttacagagtattaatgtctgaagtgtcaactattaacgattggcatttcagccattaataactgagaaatcaggtgttaatagctgataactcacgcattattgaccgatatatgattgaatgcttcctgaaagatcaggttgattgaaacatttcatgcggtcaaatcaatccaatcatataagtcaagcgccagtttcctgcttgggaaactggcgttcccttataagggaacgccagttccaaggcaggaaacgagcgtttccgatatagggaacgctcgtttccaaaataagactgatgtgtactggttttagttgacaacttcgtttgttataactgaattagtttactcaatatactttaatatctaaata

SEQ ID NO: 292 - DNA, 4830 bp, Bacteroides thetaiotaomicron
atatttaatactataagtataagtaggatcatcttgtggaatcttttgcaggagttcttttgcttgatttaaagagtcagatgctatgtataagctaattaatgccatgtaattaggcattttttctcttccttccaacgctttgtagaagaactttttagctttatcgtatttgttatgcattacatatatgttgcccagagtgttttcgattgaagcttttacatctttatcctctgaagtttcggttatagaatctgccataagcagaatttcaagggcacgggatattgaatcagtgcatgcgtattcacgccccatatctcttagagcacaagcgtagctatcagtgttattttcttttttgaaattgtcggcagccatttcgtattttttgatagcttctgttcgcatggctttctctctatataagtcgcctatatagctatatgtatacccaactaaattatagagtttattcttttcgccaatctctaacgcattagtatatatagacattgctttgtcataatccccgtcatttgcataggaacgtcctaaataaattaagatttgtacttgttcattgggtttaccgtaggatgaataccaagcgttagctcgctcgaattgataagatggcaataggatattaaagatttcgtcagtgactttgcccgataacatacaccaacgtgcaaaggttttatcatccagctgctccggagatgctatgttttccagtatgcttgatgcgctatcaggatttacttctatgattttttcaacctcatccagttgtttgtccaaagtggattgttgtttgctgcaccctactaataagaatgtagctagaatagttatcaatgtactgcttttcatctgtttgtcgtaatttagttcgttgtagaaactatccaaaaagaatgttttgcttgtcgtcaaagcaggaatgttatcttcctattgttacaaaagtaagaatttaatttatataatgccatttattatgtttttattcttgtaacttgatgtcaaataggtaatttcataaatcaagaagttattgtttaccgctcttttagatgcaaatgatcctatattctccagtctttcaattggtattatcatattatctcaccgatatcttcatcgttctacccgggtgatatgattatcgcacttaggtgaactgatcgtgtcacagtagtagacagttcgtcctacccgggtggaacgatgaagatatcggtaagaaaacatgcagatgtaggtatcaaaagagaaggatataggtagcagcataacatatgaagccttaaaaacaatgagagatacccttgaagtggatgagagatacgtgaaaaatagctgtttgaatgaagaaaagagtgagagacacctgtttgaaaaggatctctcactctttatattgctgattatctacggcttatcttaatggaatgagaccgtgagaccaaaaagttttttttatttctggggaggaggtgtgggggcttatcccaacaactcttttacttttgcagaaatagcacggccttctgccagtcctgccaacttcttggaggcaactcccatcaccttacccatatcttttccgctggtagcacctgtttcggcaatgatttccttcaatgcagcttccagttcttcagcagtcatttgtttgggcaaataagcttccattacggcaacctgtgccagttctccgtcagccagatcctggcgtccctgtccgatatagatttcggcagagtccttaccttgtttcaccagtttctgaatgattttcaaggcagcttcgtctgtcagtgtatcgttggctcccggagctgttttagcttcgatgaagaatttctttatgtttcttaaagtctccaaggcaactttatcttttgccttcattgcgtttttaatgtcttcgctgactttgtcaaataaatccatgatgatatttatattttaattatttacaatttgtaatagcaaggggaagaaccatctagaaagtgattactccgtcattgtccgtagcctcttccatggcaacttcctcttcaagagccgctttcgtcttgatcttcaacagcttcgttttatcgcgcgtgtaagtaggagattcctctatcatggcgatgatgtcgtcgttgtccaaatcttcggtattgaagatatagatatggcgacggctgcgcaggcttttctttccgatgccggcactttcaccgtatgccttgcggatacgctctttattcttctccttctcttcttcaagctgcaactggcgttcttcttcctcctggctgcgggcttcgtgcagtgtgtccataccgggcacgtcttctacaccaaatccggtggcgagtacggtgatctttactttggtgtccagagagttgtctacggcgacaccccagattacttccacaccttcgcggaacttgctcatgaactcgtgtatctcgttcatttcttccatcatcagttcggacgtgggacagaaggatacgttcaacatcacctttttagcgttgaagatgtcgttgttgttcagcaacggagagtggagggcatcatcgatagctttggtgacacggttctcgccttctccgaatccggtactcatgatggctacaccaccgtctttcaggatggtcttcacatcggcaaagtccagattcaccgtaccacgcatggtgataatctcggcgatactctttgcagcgatggaaagcgtatcatcggccttgccgaaagcattcatgaaggtaaggtcggcatatatttcgcgcaggcgctcgttgttgatgaccagcagggcatctacgtgctgggcgatacgttcgacgccgtccagtgcctgaatgattttcttttctccttcgaaaataaatggaatggtgacaatacctactgtcagaatatccatctccttcgcaatgcgggcgatgacaggggcggctccggttccggttcctcctcccattccggcagtgatgaataccatcttggtgccgtcgttcagctgttctttgatatcgtcaatactttcttcggcggcgtcgcgtgcccgttcgggacggttgccggctccaagtccttgtgtgatgctacggcccagttgcagtttcaccggaacgggtgactcggccaatgcctggttgtccgtgttgcagagaacgaacgttacgtcatgtatgccttcccggtacatgtggttcacagcgttaccgccaccgccacctacaccaatcactttgatgattttcggtgagtcggtcgggaaatcgaattgtactatctcgtccatattattgaattttgaatttatttcatatcgtcgtcagagaagatttccttggtcagggagtcgatcttgcgttgaatccaactgggaccggcttctctcttgcgtctttctttctcttctttctccttctgcttgcggagtctttcagcttccttggcggctgcccgtgcttctttctcttcctcttctttcttgaggcgtgccagtcgggcttgctctttcagttcctgatcgtcctcaaacatatctacggtcttgtgaatttctggctccggtcggggagtggcgggagtgaccggtatctggggagcggtttctatcaggcagcagttctggttgccttcgaacagaagtccgaacagggtgttctgcgaaccgtccttcttcagtatattgctgggagcgtgaacggtgttgcgaggcagtttcgccattcttatcttttctatcttcgagcgtctgcgaagcatttcttccagattctttaggttggcggctccacctgtgaggatgatgccggccagcagtttgtcttcgtagccggagatttgaatctggttccatacgttggcgatgatttcctcggcacgtgcctcgatgatgttgttgagcttgcccagttcgactgtgcggctttcatcttcgagcttgcaggtggcgggctcttcgctttcgtcttcttcgtatagggcgtctccgtaagttttcttcagacgttccgcttcttcttcctccatttgcagggtggtgatgtcgcgggtgatgctgtttcctcccagcggcagcactgtcaggaagcggagaatgttgtttttataaaccgaaatagtggtggtatcagctccgaagtcgatgagtgcgcagcccgaacggcgttcgctctcggtcagcacggcattggctgttaccagtggtgcgatcagttggtcggcaatatcgatctttgcctgctggaagcagtgttccagattcttccgtacggaagagcgggcgacgatattgaggaaacgtccttcgatgtggcttcctaccagtcccaccgggttggcttgcagattattgccgactttgtattcttgcggcgctacgtccagtatatccatatcgactaccggaatcgctacgttctcatcgccgatagcgtttaccagctcttccgagataatcgcttcttcttcgaggtcgcgacttactacgttgcggactgtgcggagggattgtccgccaatgcctacgtataccttggcgattgagtttttcaactcaccttccagtctgttgatgatagaagtcaggctttgtgctgtcttgtccagattgaagatcactcctttgcggataaacgttgaagagtcttcctgggcgtatgccagtatctgcatgcttccgtcactgttctttcttccggccacaccggttatcttcgatgaaccaagttcaatagcggcgataaattctgttgttgccatctctttatttacaatttaattattttcaac

SEQ ID NO: 293 - DNA, 4596 bp, Bacteroides thetaiotaomicron
atgttatattttcataatgagaacgcaaaagtaacgaaatcttttgagttttctattttttatcaaaaaaatgttattctgtctgatccgtgaaacgcttgatcacgttgtaagcagaaacaactcctagttcaccggccttgctcaaatctgagattcccgccttattattacccaggaaaatatgcgtaagtccccggttgaaataagcgtcagcaaagtccggagacagctgaatcgccttatcgtaatcgacaatcgcagccctgtaatctttcagcatagccgccacattggcacggttataataagcgtaaacgaagtccggagccagagttatcaccttatccaggtcctttctgacaacttcataatccaccgcactcacttccttgacagcagcgccactcggcatatccgcttcggcagcctgttcagccttctgatattccagttgtttgcaacgaatcagtgcacgcatgaaataggccgggaagaaatctccgtccagcaatatcgcctgagtcaggtcggcaaccgcactggagaaatcctgtaccagataaaagtcaatggcacgggcaaaacgcttcggagcactcttgtcatcgtccacaatagccgatgtatgcgcatcaatcagggcaaaatggaatttcacctgttcttccgtcagcggggcctccatatttgtaatacggatacgcttcggaagtacattcgacagattcaggtcttcaataaacttatggaaattcaccgaacgcttcacttcgctcgacttttcataataagtcaaggcaaacatcggttccagttttatgttcacattcttatcctgtacgcgtccgcgataatcacttgtatagcgttgatccgcttcagaatcatcggcaatcacaatcttgcgatagttgttcatgttcttgtcagacttcttacgagtttttccttcctcgctttcgtcaccgttctcgccgctctggttttctttatctttattctgattctgggcaacgtctttgttcgtccctccattctgcttgtcaagctgagccttcaacagtttgaagtcatcctgttcggcccccttcttgtcgccgatcttcttgcgggcttccgcacgatgataatatcctgcgaggaagttcggatactggttgataactgtcgtatagtctttgatagcgccccggtaatctcccgtctgagcacgaagcaacgcacggttaaagatagccatcatattatcaggttccatctgaatcacaaaatcgaagtcctcgatagcacggttgtcatccccgacacgggcacgaagcaaaccacggttataatgcccgataaagttattgggatcaatatccaaagccaggtcataatcgctcatagcacccctcagattattctgatggaatctggccaaagcacggtttatataattacccgcgttcttcgcgctcagatgaatcgcacggtccagatccgattccgcttctgcatagttggactgctgcaagcggacaatagcccttgccgaccatgcgtccggatcatacttatccagttcgagagccgtattaaagtccttcagtgccgcaaccgtatccttctgctgcaaagaaacctctcccctcatcagataagcacgtgtatagcgcggagaaactttcagcaagctctccaaatcctccttggctgcgtcataatcctttttctgaatatgagacaaggtcagattgtgccacaaggtgatgttttccggatcataatgcaatgctttctgataatcctcaatcgccccgtcgaatttactctgacgaatccgtgccagtccacgaacctgatatgcacctactacaaacggattccgtttgatagcctcgtcacaatccgcttccgctccttgataatcctccagattcacctttgccagcgccctgaaaaaataaggctcatacaaatatggcttcgcattaattacctggttgaaatactgaatagaaagcacgtagtcctcaaaatacagcgcattgcgggcaatagtcatcacccgctccgtattaatctgagcacaaaccagtgtggggaacagcaataaaactgttagtattcttttaatcattgatattttatgcttgtaaacgaaacaaaaataatgcttttcgcttacttaacagggatataaacgttttttatctttatttcacctgtttcatcttatatgaactacgcgcttttcctttcagcatcgtatttaattttcctcttatcatttgtttgcgtaatggcgaaaggtggtcgataaacatctttccgtccagatggtcgaactcatgctgcatcacccttgccagatagccttccaccacttcatcatgctctacaaagttctcgtccatgtatttcacacggatcttatttcctcttttcacagactcatgaatgccgggcagactcagacagccttcttccatactgacttcctccccacccacttcgatgatatgaggattgatataagctttattaaaatccttaaattccggatagtcttccgaaagcgggtctaatgtaatcgtaacgacacggataggcaagccgatctgtggagcagccagtcccacgccatcggcgtgcaccattgtttcaaacatattcgcgatcagctctttcaggttcggatactccggggttatgtcctctgccacctttctcaaaacaggctggccatatacataaattggtaaaatcatactttatactctactaaaaaattaaattattctctgtcttattattaaaaacgtttactctccaaatatgtttgcagaataatagtggcacttatctcatccaccaatgctttgttttgccggtctttctttttcagtccggcttccagcatcgtacggtgtgcgagaacagatgtgaaacgttcgtccacatattctacaggaagttccgggaaacgtttctttaatgaacgaacaaagggttcgatgttcttcatattttccgaagcttcattattcatctgcttgggcaatcctataataatccgctctaccggttcttttgccacatacccaccgataaagttcagaagttcatgcgtgggtacagttgtcaacccgtttgcaatcagttgcaacgtatcgctcacagctatccctgtgcgcttccttccataatctatagctactattctgctcatatggggtacaaaaatacaaaaaagacgcttcccgcgaaaggaaacgtctcttttattctattatttcaactgtggattattcttccacgatagcaacacggctcaacttagcgtcatcgtagaacatattgcctacaccacccttgtaatcaaccttcagttgagaagcaggtacaccgaattcattcaccatcaggtcacgtacagcttcagctctcttcttacttaacttcatgttgtactcagcagaaccagtacccttgtcagcatatcctgtaacagtaaatgtcttttccggattagctttgatacccttagccattgcttcgatgttcatgtactctctcttgctgatgttgctcttaccaatgttgaatacaacaaccagacgtggaacgaatccgccttctttcttaacgattacttccggcttcttgttgcgtgcttcaaccaagtcacgtttcagagattcgttttcacccttcagagagttcagtctgtttctcatgtcgtccaactggctttccggtaccatcggtacagtaggaacagcgttgaatccgcgttttttgaacttgtaagttacacctacagttacaccggccataccttctttagaagttccgccgaatgcatccttcatcaaaaggccacgcaattcaaggttgatatcccaagcatccgatacacggaagcggttgatcaaaccggcattgatacctaagttttgttgatgaggttctgaccaagaaagagccacacctgcacctacgtaaggaatgaatgaataaagacgatcctcgttgtaaccgcagaacatgttagaaaggttgaagagaacatcaccatggaagttagccatgttccatttctgcttgtagtaaccgttagaatacttgccaccttttgtatacaagtcattagcactaggagcagctcccttagcttgaagaccgttgtatgcaacacgcaatccgatacccggagtaaaccatttacctacggcaatatcaagtgccggagcaatgcgttttccgaaatccgctttaccgtcgttgtcgccaaagtacatttgaccaccaacgccaccactaatgaaccaattggccccaaaacgattagtctctacagtgtaggctttaccttctgtttttcctttttcctgagcagacaggcacacagaagcccctaccattaaaataaacaataaaccctttttcatctcaatttattttagtaaataatataatgcagtttgtgttacgctataaccacaactctacaggctctaaatcttaaacaaagagatataaatctctaccctttttctttaaatttagtgcaaatatagatatttattgtaatacacacaaaaaaac

SEQ ID NO: 294 - DNA, 4541 bp, Bacteroides thetaiotaomicron
ggtgtgcaggctgtagagcattgtatgaaacaactaaacaagcaatttctgaattgggttgcgatgtcgtattaattaaagaggaagatttattaaaaatcatggagtataatgttttaagtcttccggctttagtcattgacggaaaagtcgtatctgccggaaaaagattatcacttgcagaagtgaaagaattgataacccaataataagatagttatgaagaaattcttttatttactattctcaaccattatcttaatatcctgtggtaatggtgcaaaagcaaaaacagaggcacagagtacggaagaaaagctgcctgaccatattgaggtactttatttccatggagcgcagcgttgtatcacctgtcgggcaatagaaactaatacagtagcccttttggatagcctttattccaaagagcaggcagacgataggattatctataaggttatagatatttcaaaaaaggaaaacgggcaaattgcggacaagtacgaagttacttggtcgtccctgtttgtgaatggttggaaagatggaaaagaaaatgtaaacaacatgacagagttcagtttttccaatgcaagaaaatcaccggacaaatttaaagagggaattaaaaataaagttgatgaattgctaaaacagttgtaggatggattttcttcaatcactattagacaatagttctgtccctgttataacagcctttatcttaggaattttaacggcaatcagtccgtgccctttggctactaatataacggcaataggttttattggtaaggatatagaaaaccgtcaccgtatattcataaatgggttactttatacatttggcaggatagtgacttatacagtacttggggttattcttattccggttcttcgtgagggggcaagtatgtatatggttcaaaaggtggtaagtaaatacggtgagatgttgattgctccggtattaattatcatagggatattcatgctcgatattataaagctaaatatacccaaaatcaatattggcggagaggggctaaagaagaatacaaaaggtagttggggcgctttgttattgggtattttgtttgctctagccttttgccccaccagtggagttttctatttcggtatacttatgcctttggcggcagcagaaacgggcgggtattttttacccgtaatatatgctatcgctacagggttgcctgtaatccttgttgcttggatattggcgtatagtgtagccggattaggtcggttttataacagcgtacaaatttttgaaaaatggtttcgcaaaattgttgctatactctttatagtcataggaatctattatgcggtcgttttttatctatgaacaatttaaattaatttaaataaaggacagtatgaaaaagatagaaatttttgatccggcaatgtgttgccctacgggtttgtgtggaacaaatatcaatcctgaattgatgagggttgcagttgttgtcgaaacattgaaaagacagggtgttattgttacccgtcacaatttacgggatgaaccacaggtgtatgtgagcaataaaacagtaaatgaatatcttcaaaagaatggtgcagaagctttacctattactttagtagatggtgaaattgcagtttctaaagtttatcctaccactaaacaaatgagtgaatggacgggagtgaatttagatttaatgcccgctaaataaatgtataacagatttatattaaaaaagaaatgaaagcattcaatttatccgatatagaactgactaaatacctgttttttacaggtaaaggtggagtaggaaagacttctattgcttgtgccacagcagttggtttggctgataagggaaagaaaatacttcttatcagtacagatccggcttctaacttacaagatgttttcgatcaatccttaaacggacacggtacagctatttcagaagtgccgggactgactgttgtaaaccttgatcctgagcaggcagcagcagaatacagagaaagtgttattgcacctttcaggggaaaattacccgaaagcgttattcagaatatggaagaacagctttcaggttcctgcacagtagaaatcgcagcttttaatgagttctcggactttattaccgatgctgataaagcaaaggagtatgaccatataatttttgatacagcacctaccggacatacattgcgaatgttgcagcttccatctgcatggagtacatttattagtgaaagtacacatggtgcatcctgtttagggcagttatcaggcttggaggaacggaaaggaatttataaacaggcggtagaaaccctatctaatacaagcgcaactcggttagtactggtcagtcgtcctgaaatttctccattgaaagaagctgcccgctcttcatctgaattacagctattgggaattaaaaatcagttgttggtgataaatggtattttacagcaactgaatgaagcggatgatgtgtcacgacaactgcataacaggcagcaaaaggcattacagggtatgcctgctgaactatctgaatatcctatgtacagcgttcctctacgttcttataatttatctgatatagctaatatacgccgtatgttatacagcgacagccttgcggatgatatttgttatcagcctgtaagtggtgctaaaagtatagacgacttggttaatgacctctatacttccggtaagcgggtagtgttcacaatgggaaaaggcggtgtaggtaaaactaccttagcaacagaaatagctctgaaattaacaaaactcggtgcaaaggtacatcttaccaccactgatccggcaaaccatctgaactatgatctcgctataaagtcgggtattacagtaagtcatattgatgaagcggaagtattggaaaactacaagaatgaagttcgtagcaaagcggcagaaaccatgactgccgaagatatggaatatattgaagaagatttacgttcgccatgcacacaagaaatcgcagttttcaaggcatttgccgaaattgtagataaagcggacaatgaaattgtggtgattgatactgcaccgacaggtcatacattgttgcttttggatgctacccaaagctaccataaagaagtagaacgtacccaaggagcagttacgggagcggtagccaatttattgccccgtttgcgtaatccaaaggaaacggaagtcgtaattgttaccttgcctgaagcgacacctgtatttgaagctgaacgcctgcaaatggatttgcaacgcgccggaattaataacaaatggtgggtagtaaatgcctgcctgtcaatgacaaatacggaaaattcatttttgcaggcgaaagcacaaaatgaagtaaattggattaagaaagtagaacaattgtcaaagggtaatgctgccttgattggatggaaaaatatataggaattggattttttgaaagatacctgactgtttgggtaactttgtgcattgttgctggtattgctatcggacaatggtttccggcaatatcgcaaacattgagtaaattagaatacgccaatgtgtctatacctgtggctatcctgatttggttaatgatttaccccatgatgctgaaagtagattttcagagtattaaaaacgttggtaagcgtccgaaaggaattatcatcacttgtattacaaattggcttataaagccttttacaatgtttggaatagcttatctattcttctacgttgttttcaagtctctaatatctgccgaattggccgaagaatatttagcaggggcagtcttattgggtgctgcaccttgtacggcaatggtatttgtatggagttatctgaccaaaggggatgctgcctatacattggtgcaggttgcagtgaatgatttaatcatattggttgctttcgctcctattgttgcttttttattgggcgtaggtggcgttacgattccgtgggatacattattgctttcagttgtattgtttgttgtcattcctctttctgccggaataataacccgcatactggttatccggcgaaaagggatagaatattttaatactgtatttatccgtaagtttgataattatacgactggcgggttactattaacgcttatcattctgttttcatttcaaggagaaaccatattgaacaatccgttgcacatcgtattgattgccgttccgcttgtgttgcaaacagttctgatattctttgtagcctatggttgggcgaaatggtggaaattacctcacaatatagctgcacctgccggaatgattggtgcaagcaatttttttgaattatcggtggctgtggctatatcgcttttcggtttgcaatccggtgctgcattggctacagtggtaggggtgttggttgaagttccggttatgctgatgttagtgagagttgcaaataatacatacaggtggtttacaataaaatcaagtatgagtaaatagaatactctagacgatacgtacaagaa

SEQ ID NO: 295 - DNA, 4453 bp, Bacteroides thetaiotaomicron
tcttccagtgactttcctgtggtctccggcacgagtttccatacgatgagcatatacggcacgcacatgactgcgaacaggaagaatgttccggcgggggtgagattctggagcatccagggggttagctgtccgatcaggtacgttcctatccacagggcgaatcctgcaatggacatcgccagtccgcgcaccttggtggggtacatctccgaaaggagcacgaacaccacggcacagatggagacggcacagcagaatacatagaacaggaagaaaacgagcaggaagaggctggatactccccaggaatcaccgaagaggaagtaaatgccgatcagcaggagggagacaaccatccccgaaactccgtaatagaccagttgcttgcggccgaccctgtcaatgatcacaagagcaagaacggtggtcagagtgttgactagtcctacgagaacttggtaaaacaaagaatctcctcctgaaagtcctgcgttttcgaaaatggaagggccataataaagtacagcatttacacccatgaactgtcccaaaatagcaatgcatacaccaatgatgaccgctttaaaaattccgggtttcattaacatagcccattcagattttgtttcagacgtcaatacagatttcgtttcttttaattgacttgcagcctctgaaactgaattatatatcctttctaatatattgacagctttttcttctttacctcttacgatcagccaacgaggactctccggaataaagaagataatgatgaagaataacacagccggcaatgtttccattcccaacattcctcgccagacttcagtaacaaatatcttattcaaccagtccatacttaactgattaccactttcagcataagccagcaattgatagttaatcaaataagctcctaaaaatccaactgtcacagccaattgatataaagataccaaacgccctctatattgtgccacagccacttcagatatatacaaaggagaaacaatcgacacaacaccaataccaactccaccaataatacgatagactaccaattgggtgaagtctgcggagatcgcacaacctaaagccgatgtagaaaacagagtcgctgaaataatcatcgtcatttttcgtcccagcttatcactcaggataccggcaaaaagaacaccgacgatagaacctattaaagcacatcccacataccacccctgttgcaacgtatccagttgaaaaagttgagtaacctgagcgattgttccggatataacagcagtatcatatccgaacaaaaatcctcccaaagctgctacaacagaaaggaaaataagatagccaaagttaattgtagacttcatatcactcatttaatttcaaaatattctctgtatctatcatataaatgtccggcctgcaagtaggcagattgaggactcataaaatgagaaaattcgaaagtaatagccttatcataccctgcacgtttggcagcttccagcttcatccggagcttatcaaatttaatgggtagaaaacggataggcatatcacggtcaaaagactcggcgttggtccagcattgcataccatacttatctgctaattttttatttacagtaaagaacgcatccaactcatcataatcgatatgtccatcctgaaaagcacaagcatctaccacttcatgaattccatcaaaaatttcattccattctttttcgtgttgttgtacagaaaccgcatcttctcttgtcagtttccctgttcccataatagcctttttgccatcaatccacggagagataaaagtcgggagtccgttcgatatatctttacattgctttcccatagcgcggaaagcatcaatagcccctttcgtggcacggctaatctcgccgctgatgtaccagcctccaaaacttttatacttctctccgtacatcttccaaacctcatcaatcacatacttgttatcctcaatctcccaacttaaatcacctgtatcccaataccgtcctgaatcatacaaaccaaaataaaatttcatgttatacttctccgccagacgcaaatacatatctaccaaatcaaccgacggcatataacatccttttttcagcaaataaggtgaagggtaagtcataaacttacgataaccggaacgaatcataatcactgtatcgataccgattcttttcatatgctgaaaatccagatcccattctttctcaccccagttctgatgaggaatatcatgagatatttcatccaaaaaagttcctgtaatttttaagccattatttttgggaacaatcaatttgctttccaaatcgccagccttgatcttcggggagagttcccctctcccctctccgtcagctgcaaataatgaaggggcaaccaaagcggaagctccggccaaagctgccttctttaagaaatctctacgattattagtttccatagttttaattttttgtttttacttggatatatgttaacctattgaatatacttaccagtgatatcgatctgttttttattgaaaggatccaatacctgatcaatcattacagccatctcccctctcaaaatattccgtttcaaatccggttcttgcattccgtatgctttccaaagcgcttgcggatcaacagtagtatgtagtttttccatttctgctatcttctgaacaagttgaactgcctcctcaatacttaatttatccgctcctgtttttttgaattcatctttggcagccggatacacttcaaacagaccatccagttctgacgccagcaataccgtatccgctctcaaccaagtctgattggaccagtccacattcttaccgactcctttcagaatccccgtagagccaatccgctgataaggagcaaacttcacatccgagacaggaacatccagataaggaagcaaatatcctttagcatccagaatagcattctgaacatcacgaacagaaacatcacttatcttctgattattcttcacagcaagtgcagccaaagctcccgctgcctgaccgatctgcagtacaaccggttgcaaacgagtcgttccattcataatattcgatacggaaatagatttctctgcaacaatcagcccgtctacctcctgaggaatcaatgtacctaatggcaacccatacgaagggatcggatgaaaatacagattaggcaactcttcataaccatgatagcgggtatggtgatgatctaccggataatctcccacagcaatacaagtacggtacagtttttcatcctgtgtatatggattgagtgcatgattcaagttaaagcgtactaatccgtgaattcttctggactctctatgataagggataaagggcaacttatcctctgtcggatattcatcatccgccaatccaagtgtattatatcccagctcatgttgcaggaagtagacaaagcacatcgtataatgtttcgcatattccaacgctttcaagcgctcttccggagtcatttcaatcagattaatataataatcattaccttctatcggccaattaatcatatatttatgatttggtaaccgcccgtaagtaatcatcatatctttagaccagacgcgatccggctctttaggagttatgcataccggactggcacaggcacaggcaaattctttaggatcgtatccttcaggttccggaatagtcacatccttaccataatcttttaatatggcaacataagtaatatcctgcacaatattattcttcttttccggagcaatatcctcgtgcgtgtcatctctgctttccataccaatatcgtacttcactccacacatttttgccacatcccccagttcggtggcatcaatcataaccttcgcccgaaccgttttcacaccttgtccttccaccttcactttagcgacccactcatctcccgtcctttttacttcttcaaggcaagcctgtttccagacttttagattattttccgccgctaccatttcgtgaagaatcttatttccaactgacggttcaaacaatacgttacttacccaacccgtcttcaaagaatccagcccgccataataatcagacaatctattcttaaattctccccaaagtccggcaggcaatctgtaatttccatccacagcactcacaccggcagaagtcagcatcccacccaaccaggtgctttcttcgagaatcagtgtattggctcccatacgagcagactggatgccggatgttacaccactggcacctccacctataataagtacatctaccttatcttcctctgagtgcatacaagaagagtatgatactaccagaaacagcccacagagtatttggaataagtttttcatcataatacgatttggttacggtacatcttaattaatatcacggtacaaatatagc

SEQ ID NO: 296 - DNA, 4433 bp, Bacteroides thetaiotaomicron
ccttgggcgccccccaagggacaaactccggcagtattccgatacgcttagactgcaccgggctgcctgctccgcaagtgcgtccttttcaagttcggtacatcggaatgtaatcttttcgttccgtcttagttccatgccacaaaggtaatcttaaaatctttttgagcaaagcgagaaaagcaagaattgtccgacaaggacacttcttgctatatatacacatgccgcatgggaatacatccacgccaaccgcccggcaaaaagcccaggcatgttagaaaatcccccacagcctaacaatttctacccaaggggattacacgccgcagaagtcatccgggaacatgtctttcagttcgtccaaatcaatggcttcttcttcggacacctccacccattcaacgttttctttccctcttatcgcacatgagtacatctcggcggcggcaaggttagagaacacctcgtgcataggctcgccgttctctaaccagtaaacacaatattcgaccataacagttttatcatttatcgttgtaatgcccctctacctccaaaatgtagacctctaccacttcctcgtaaatgtcatagattatccggtcatgggcggtaatgtgtcgagaccatgtaatatccccaccgccccttaacgcttcgggatgcccaagcccagtcttagggtgctctaacaattctttgtagattttcttatacttcttgaacaaattggggtttgatttcttccatttggcaatcaccttatccaccccgtcggaaaccctaattgtgtacatcatagactgtcgaaataagcatcaatatcctcactgcttttgagggtaacacactttccggatttgatttcttcccttgccttgtcaatccttgcttgcagttccggggttatcatcaaatcttcacgaccaacttttaccaaagcgtaaatctcgtttttcctgcgaattagtacctgctcgccattgtcagctttggtgaaagacgctgcgaggttgttacggtattctcttactgataatgcttccatatctgtttgcttttaaattcagtacaaagatagctatatttcaataaaatacaaactttttgcacacaaatgtgtacacgccataaaaagccgttcacagtcctaccgcccgttggttggttttgctttgcttttttcccctattgtttttctttttccgacagtaaatcaaccacttatccgtaaaaaatcaatgacttgttataaagcataacttgtttatatgcttatcagcttttttttttaactaaaaattatgctgaaatccaataacttacacaatctatttaacacattactacgactttttgaatgctatttaacacattactacgactttttgaatgttattttcccttccaaatacgactttttgaatgttattttgcatcatctacgattttcatttgcacaagtcgtaattacttattatatttgcgcaacatactaataatcaataaaggatgaagaaaatcatagttcattttaagaaagaagaatttgaaagggttaaaaacgcaatttctatcctcgcaaaattttctgaaatatacgctcctcacatagataaagccaacagtattttatcctttcgtgtagatgatgaaaacgaaacaacagaagaacaacagtgtaacagtcgtcaataaagaccaaatacaaagctatattatgacgacagccaagtatgacttttccgtttatgagaagcgcatactttatagaattgtagaaatggctcaaggtgaactccaaggagttagatttgcaactgattgtaaaaaaatagaacacacactttttgataccgttcacatcacaatgcctattgcttcattgctaaatggagaaagtgatgaaaactacacacgtgtaaaacaagcactgttatctctacaaaagaaaatctttacctatgaggatgaaaaagaatggataagcatttctattattgcattgccaaagataaagaagcgttcatctgttgtatcattccaaatagactcacacatatgggactgctgcttagatttttcaaaagggtttcgcaaatacgaattagccactgcgatgaagtttaagagtgtatattctatgcggttctacgaacttttaagcggtcagaaaacaaaactaatctatccacttgaacagctcaaagaaatgtttaaagtacaagataaatacgcaaagacaaacgattttgtccggaaagtaattgaacctgcaaaaaatgagctggacgaactaagtccttatacattcgaatggtccgcaaacaaggaagggaaaaaaattgtaagtttcaacttctatccaatattcaagccagagcatcgtgatgcagagctatacaaaaaagagctacaaaagcaaaccgggctttcatgggatttaggtaggcaagtgataagttacttaaaaacatctttggagttctccgataaagaaatcaaaaacaaccgggatttatttgtaacagcacaaatggaacttccagacatcatgacagaactcgccatacttagaggaaaatcaaggacaaaaacaaatccaaaagggtggattataaatgcccttaaagggaaaatcaaggataagtgacaagattaccccggctgaaatataccggggtaatcttgtcaaatcagaggaacgatttccatttctacaccaagctctttcatctgccgctgtatttcctcgctgcttagtttctctttcgccagtacaagcccatgaaaggcgtcccagcctgccggcttcgaaacgatactaccgtttaggacggcatgggtgatttcgccgccggacttcgcacccttgttcagtatgaagaagaaccggggttcttcgtgttccgctgttcccataattcgtaaagttagatgtttatttattccccttttgttcccttgcctgctcttggtagtattcataatactgcttgtagttgtcccggtctttggctgcatccgtccaaagatagcacatgaaacaagcgaacaatagggagataacagcacaaaggattgagtagaacgaaattcgtttgtccacataaccgccgtttttcattctatacccctgccgttcaaagtccgccaatacgttttttaggcgattttcggcactttcaaggcttttcccgtctatttgtacctttcgggctgttgcgtcctctatgcgcttcgtatagacttcaacacgctttagttcttgatacaccagttctaccgcaagctgcgggtttacccttggcgttgtgtcttttcttttccgggggctgtactgtccctgcttaacgttggaagctgccgcttccgggtgtgagtttgtttccatgagatatgttcattgagttgcacttcagtttgctttgtgtccgctcgatatgggcgagagtgtagcctttccctatctcgcttgccttatactccgtaccgcttcgggctgtgacatagtagccgttaagtttcccggtgcttgccctggcttcccggactttaaaacctctcttaccaagttcttccttgaatttggtaaagtcaaagccctgcatcttcttcaatacgccgtccatggcttccttgatttccgctttgttgactttgccaatgtcctgcgactgtacaaagttccgttccttggctatggcattggcggcttccgttgcctttttccctatccagttgtcccggtacagttccccggaaagggaaacccggtttgccagtatgtgcaggtgggcttgctctttcttgctctccgtaccgctgtgccggatgatgatgtactggtggttcgccaaccccatgcgctgcatgaagtcgttaccaagttccgcccagtccgcatccgtaaaggtggcgctttcctctatcgaggggctgacctcgaaacgtaggcagttgttttttacgttcggaaaatcaatgtgatacggtttcatttcctgcaccatttccgcaccagtacacccataaagttcatgccgggctatctcggtggctactgcctgcccgtttatctctttggcgaggtcgtactccaatgccgccacaccatgtgatatgcttttccctttccctatcatcgtgagagtatttttttgagctctgtaattagtgcccggttctcctcgaacacttcccggtactggcgaccaccgaagtagttgttcagccgttggagcgttcctttcaactgggctatgtcccggagaagctgccgttcctcctcggtgtacctctcccttgggcgccccccaagggacaaactccggcagtattccgatacgcttagactgcaccgggctgcctgctccgcaagtgcgtccttttcaagttcggtacatcggaatgtaatcttttcgttccgt

SEQ ID NO: 297 - DNA, 4422 bp, Bacteroides thetaiotaomicron
aaataagtaaaccggaggcaggaataataaataataaagtaaacagctgccagggttagtaatatttctagtcaacacatagcagctattagagataaacaagtcaaccattattagggaagtacatgtttcagaaagtttcaaacgcttgaactaatgattccaagctgttggaactaaagtttcaagcctttggaactatggtttcaagcctttggaactatggtttctcttcgctgaaactatagtttcaagacgaggaaactaatttagttgtcttatcctaaattgacattggaattacaggaataaaatgaagatactacaaaggttagagattggatttagaaaagtgagggcaagcatttgctctcatacctgctaccacagttgctaccacaccgaaaaccacgatgaataaagggatacagacagtttgttagagcatgagagcaaaagtgatgctaaattactattgagcaatccttgataattctctgcacaacaaaagtgcagaaatatgcataatactgcacttttgttgtgcaattatcacatcattgcagataaatgcacttcagctatggattgcttatacgaaaacttcaacaagttatttaaagagtacgagcacgaatatagcacccattcgatctatcccactttggtattttggaatgaattattagtaaactaagcaaaagcctttttcttcttttagtccacactatttttataaaaggcactaattttattgaattacctcactaacagagcgctagatttcaaaaagaaacttaactttgcacccgagttttatataaagagactgaattagtaactaaaaagattaaaccgcatgaaaattaagactttaatagcctgtttcatactagcttgtgctgcaacttcctgcatacaggatgaagcactgaactcagaagcagccattgatgcttgtacaggtgatgatgtacaattagcaaacatcaatgctgattcaaagctgatcaatgtatatgtaaacaagggagctgacttgtccaaacaaaagttagaatttgtaattccggaaggagccactataaaaataaatgatcaagttgctggagatacagaagccacatatgactttagtgaagagacacattcccggaaattcactgtcacatcagaagacggtcaatggaaacctgtttataccgtcaaggttgttttagcagaattacctacttctttcaactttgaagagttattaccttccaatgactacgatatcttttatgaattccagccgggcacttcacaagaaatatctaaagtattacaatggtcaagtggtaatccgggttttaaattgacaggtatggcaaactccaaaacagattacccaactgtacaggtagccaatggtttcagaggtaaaggagttaaattggaaactcgtgataccggtagttttggagcaatggtaaagatgtatattgctgccggtaacttatttatcggaacatttgaggtaggaaatgcattaacagatcctagaaaagccactaatttcggtttccagttctataaacgccctaaaacgctcaaaggacattataaatttaaagcaggagatgtatattccgtagaaggaaaaccacaagagggtgtaagagacaaatgtgatatttatgctgttatgtatgaagctgagaacaattctgtcatgcttaatggtgatgatgtatttacttcagataagttagtatcattagcgcgaattaaaccggaagatgttgttgaatcagatcaatggactgattttgaaattcctttcgaaccggtaaaaggacgagtaattgatgataccaaattaaagaatggaaaatacaaattaggtatagtgctttcgtccagtgtagacggtgcttattttaagggagcagtaggcagtacactgtatgtcgatgaagtagaacttatttgcgaagactaaaaaaacaagaaaatgaaaagatataaattactcaatattatagctgtactactattagtaagtacactttcagcgcaggcgcaagaagaaagaaatcaaggtatcatctggtcgtacttacacggatgggaatatggaatcaaggcaggtttcagtattggaggaacttctccattgcctctacctgaagaaattcgcaaaatagatagctatgcccctggtggcctcgccatttcaattgaaggaaacgcaactaaatggtttgacacgaaatggggaatgactgtaggggtacgacttgaaaacaagaatatgaccacagaagctacagtaaagaactatgggatgaagattatcaacaccaacggtggagagttacaaggcttatggaccggtggtgtaaagactaaagtcaaaaactcttatctgactatcccagtagttgccaactataaagtaagcaaacgttggaaagtctcagcaggtccgtatgtatcttatcttattgaaagaaacttctccggacatgtatatgaaggtcacttgcgtactccggatcagacaggttcgcgagtagattttactggtgaaagcattgctacttatgatttctctgacaatctgcgtaaattccaatggggattgcaactaggcggtgagtggagagcattcaaacatttaaatgtgtatgctgatttaacatggggcttgaacgatatcttcaaaaaggattttgataccatctcattcgctatgtatcctatttatttgaatataggattcggatatgcgttctagagaaaacactacaatttatttaaataaaaacaactaaaaaagccgttaattttaattgcattaatgtatacaattggaattaacggctttttctgttatatatttcttatactcaacacactattgaggtgttaccgtaaaactatcaataaataaggtactaccaggagcgcccataaagtagtctccttcagcacttgaggaacacacaatagctaaataatattttttagttgcatcataacttttcccttccaataatttaaatgggatagagaacttagtccaatcactcttcgctgttccatcttccaaaacggccttcattacaatacgtttagagcttccaatatatagatcaggatcattgtagtctccattcaacggaatgttgttattctcttcatccaaaagttcttcatacaaaactgcatatattgaacattcatctgttttatcagctacgacttcatttttattattataatatgttgtccctggagtatatttataatagccagtaaaagtagcaggttccccaacaaaaggaacaccaaactttgtactattcaaagtattattcatatcagttttaaagatacctgtaaataatgagcctgctgttacataaggtaccaaccctcctaataatgcattaaaatccataccatttaaaaacatgtaagtataaactgtttgcaatttagctgctttaccactttgtccttctacaggagaaactgtatatgagaacagctctggaagatttgaaccaaacatctcgttaattgtcataattcccggattactagtaccataaagtcctttaggaacatcatattgttctgtagaacccgatgtagatgatttgatagtctcccattcatcgaatccaaaatctcttatttgacctgatacagaaactgtatatttagtagttacaattccatcttcggaagtcactgtgtatattacaggagatgaaaaatcttgttctactccagaagcaggagttattgttgctttatcagaaataacaatagtaggcgcaaacgtcaagttctccaatccatctggaataataaaactaatattattcccatctattttcccctctacattcgcatctcctatcttaactacaaagctctggatcgcagcctctgaactttgatctgcagacagttttgttcctgcaaaatcaaccttcacattcaaagttccgccagcaacaacagctatattcattgccagtttatcaccttcaatagttccattcactgttacagcacattcaccaactaataatgtaatattctgactacctgcaaaagtataactattaccatttttttgtacagaaatctgttctactgcaatagtaccaagattcaatgtctgaaaactaaagtttctcagctccatcttaatttggttttcaccagtcttagaaatatatactttttgtgttatatcattaacttcaataactccagctgcatcaacatctaacttaccccaataaactccatcaatttcaccatcccgaatagtttctgggtcgtcatcactacaagccgtaaaaaggctgactgaacaaataagcataaacaaatacaacaaactctttttcataattc

SEQ ID NO: 298 - DNA, 4166 bp, Bacteroides thetaiotaomicron
gatttttattatattataagtacgacaaagataggggatccacctaaataaaaaggttacatatctgtcaaaggagggtaattatcattcataatagggaagatgatctaaatttggactttaatgaacggtattcggatgtccttttgtatctaaagcattatttttgcgctgaatctaaaaaatagttggttaccatgagagcgaagctgattttaccttttctgattttatatttgttctgtcatttgctgtcggtgcaaggacacgaagttgacattgtaaatgccggcagtgataaaaatgtagcatcttctcaagtgtatgaagtaacttccgaaggagcatggtgttggttcgctgatccgcgtgcgttgcattatgagaatgaaaaaggtacaataaacaagacatatgtcggctatattgatatacacggcaatattaaagcgatgcagtatgactttaaaaagaaaagacaggacgaggtactgattcgttcctattttcagccggatgatcacaataatccgacgtttctggtattgccggatgaacggattatgatcttttattcccgtcacacggatgagccttgtttctactatcgtatttcccgccttcccggagatattacgacattgggagaggaaaaggtgattaaaacaaaggacaataccacctatccgtctccgtttatcttatcggatgatccggaacatatctatctctgttggcgggggattggctggcaccctactatcgccaagctgtcgttgcccgatcagaatgatcaggtggcggtggaatggggaccgtatcagatagtacagtctaccggtgcccgtccttatgccaagtatatgtcgaatgggaaagataagatttattttgcttatacaaccggtcatccggataatgagaatcctaatttcctctactttaattatatagacattcactctttgcagttgaaggatgttaaggggaatactctttcgactattgctgacggtacttttaaagtgaataagacggatgattatgcgcgtcagtatccatctactctgatagataatccatccgcacgcgattgggtgtggcaggttgcttcggatgagaatgataatccggtcattgcaatggtacgaatcagtagtgataagaattcccatgattactattatgcgaagtggaacggacacgaatggaaaaagacattccttgccaacgccggcggtcattttcaccagacaccaaactcggagaaatgttacagtgccggtatgactatagatccggcgaatacgaatcatgtttattgctcgttgcctgtggaaggaaagcaggggaaggtttacgagatcgtgaaatttatcttgaacgaggtcggggaggtggtctctacagaagcggttacgcaagactcgcagcagaataatgtccgtccttatatagtaccaaattcaaaaaatacgcctttgcggctcacatggatgtatggcaattattacgattggattgtcagttcacggtatccgcaaggctattgcacagggattgcctgtgattttaaaggtttcccgggggcgaagaaggaaaagactgttgtaacggagaaggatttcaagttcaacccgaagaaggcttttgtattggaacaaacggtcactttggatgcagacaattatcaaggctcccttttacaattgggtgatcttcaatattatctgaacggacaaaccatgaaaccggaagttagatataacggaaaggtatatcctagcacaaatatacttggaacatctgattgctggaaaacaacttcgcgcaatacaggcggtgagtggtacactccacaaaagtacgggagtttcaagttgaagctggagtataagaagggagtattatgtgtgtatattaacggattgctggatcaaaaaatagaaatacaatgagaagaaaagttttaagagattgtgtgataggagttcttttattatttgttctcccgttggcagaactgtcgggcgctattgctcaggagagtgtgtttactgtacagcagcctgattttcaaaagagtccttatacgggaatgacacgtcaacactggatacaggcgggagagtatctgctgaaaggagcattcggttatatccatacgttggatgatcagatgtactttccgaagcaactggacaaaacatatcccaataatgacggacaagttccggttgctaagttggaggggctggcacgaaccttatttattgcagcacccctgttgaaagataatccggaactggtaatgaatggaataagagtagcagattactatcggcaccaattagtcggtatctctaatccgaaaagtccgagttttatttctcatcgtaaaggaggacctagccagacgttactggagttaggttctttggccatttcaatgaaagcggctcaggccgttttgtgggacccgctgacaaaagcgcaaaaggattcgcttgctgcaaccatgctgagctacggagaaggaccgaccataggctctaactggatgttctttaatgtctttattttaagttttctgaaagatcagggctatgcagtgaatgagagctatctggagtcgaatttaaagaaactgctggcacgttatcggggggaaggctggtataatgatgctccggcttatgattattacagtgcgtgggcttatcagacatacggccccatttgggcggaaatgtttggaaagaagcaatttccccagttggcacagcagttcctggcaaaccagcatgatatggtagctaactatccatacatgtttagccgggatggtaagatgaatatgtggggacgaagcatctgctatcgttttgcagcgactgccccgttgtctctgtgggaatatgataaaagtggcgatgtaaattatggctggataaggaggattgcttcttctaccttgctgcaatttctggaaaatccgaaattcctggaggaaggagttccaacgatgggattttatggcccgtttgctcccgctgtgcagatttatagttgtcggggtagtgtatactggtgcggaaaagcttttttgagtttgctgttgccggaaaattcagacttctggtctgccaccgaaaataatggtccttgggataaagaactgaaaaaagggaatgtctataataagtttcagccgggaaccaacctgttgattacgaattacccgaatagcggaggcgctgagatgcgctcatggtgccatgaaactgttgcaaaggactggcagaagtttcgtagtacggagaattataacaaattggcttacaatacggaattcccgtggatggcggatggtaagaacggagaaatatccatgaattacggaacaaagaatcagaaaggcgagtgggaagtattacggctttatacgttccaaagttttaaagacggtatctatcgccgtgatgccgtacttgaaacagacagtacagtaagatatcaactggccgatattccgctgccgaatggaatattgagagtggataaagtttcggtctccgaaccgacggaaatctgtttgggacattattccctgcctcgtttgaatggtgtatttaaagaaacatcccggagggtcggcaagctggatattccggttattgataacggagagtatgaactggctatgataccattggctggatgggataaactatatacatcgtatccgaaagggctgcaccctgtcagcgatgagtgtgctttgattatggcttctgataaattggctggcagcaagatttatgtgacgcttcaactttggaagaagaatgaaggtaagaacggctttacaaagaaagagttgaatccggtccgggcgatagatatttcggaagataagaaacaagtgacagtgcgtctggatacgaaagagataaaaacggttctatttgagtaatttagaaatatgagaagtgtgcagtgggaatattttcccactgtattttttatgtataatggtgagccttaaatgcctatatggtgaattttccttcaaaacgttctacttatcagtatatctgtatagctggaactgtctaatcgttgtttattaaattttttattcataattttggtcgtatgtatag

SEQ ID NO: 299 - DNA, 4140 bp, Bacteroides thetaiotaomicron
atatataatatactttgtctttatattgtctctctcttttcagtcattccgcacatacatcgcggctccggcatccataaagagttcgacattctccgcatgatgcgctatataagccgccggccccgtatctcccgagtggcaaatttcttccaccacttccgccttcgcctttccggtaatcagaaaaataacaaggcgagcggtcaagatcggaaatccggtcattgcaatacgtttctgtccgttgcggggatgagtgctggtcacataaatctggtcggaagagagcaaagcctcctgtccggggaagatagaggaagtatgtccgtcatctcccgctcccaacagcacaatgtcaaattcgggccagccatttttcttgggtacctgctggctgacaagttcggaatagcggaccgcttcttttgccggtttcacttctccgcggatgcggaatacattttcgtaaggaatgggcactatccccaaaagcagggaacgcatcattccataattactatcagaatcttcgggaggaacgcaacgttcgtctacccaataaagtttcatacgcttccaaggagtaatatcagcgtattcatttgcccataaatcaaacatcaaggcgggagtgctgccaccactcactgctatgttgaacgttttgtccggttcagcattcatgatatccaccaggtggaatatcaacgaacgggctgtctccatagacgacgggaaaacagatagtttcatagttcgcaatattggtctgtatttgttaaattcttacacggattggtccagtctgccccatgctcgtgcatcatagcttcactttcgagaggtccccacgtacctgccggatagccgtacaaaggtgcgtccggattatctttccaataacgtaagaccggatcaaagaagttccaggaagcctctacagcatcacttcgagtaaataaggtcggatctccctgaatgcagtcgtcaatcagacgggcataagcgtcaccgctcggcacgccgcccaactgtgcgtaactgaaatccatcgtcacctgacggacttcgaaacctgcacccggaaccttcattccgatcttcaacacaataccctcgtttggttgcaaacgaaggatcaacttattagccctcggacagttaccgccggaacagcggaacatctgatggggcgtctcgcggaagtgaacgacaatttccgtcaccttcgtcggcatctgcttaccggtgcggatgtagaacggtaccccgctccaacgccagttactgatgcccagcttcatcgcaatataagtctccgtacgcgagtcgggagccactcccttttcctcacgataccccttcttattgcccgaagccgtatattgtccgcgaacgatatgttcattcaagtccgtctccgtaagcggagtcagcgactcataaaccttcactacctcattccggaaattatccgcattgaataccgccggcggctccatagccgtaagagctacgagctgaatcaggtgattctgcaccatatcccgcaaagcccccgccgtctcgtaaaaacctccgcgctgctcaatacccagattctctacagcagtaatctccacataatcaatataattacgattccataacggctcaaaaataccattggcgaaacggaaagcaagcacattctgcgccgtctccttgcccagaaaatgatcgatacgataaatctgatgctcatcaaacacagaagagtaaatcttattcaactcaagcgccgactccagatcatacccgaacggcttctcaacaataatacgagaatgaggagtattcagcccggccgccttcaaatgcaaaggcaccaccccatacagcgaaggcggagtagccagatagaacaacaaattatccggatcgacctccttcgtaagctctaccaaacgctcccgcaactgcgaatatccctccactttcgcaggatccatcggcaaataatacaaatgagacacaaaagaagacatcagctccaaattctgctcttcagcctttacaaactgctgcaactccccaagtatatatgaacggtaatcttcatcagaatagacagtacgcccaattcccagaacagtaaaactccccgtcagccgtttatcccgatacagagagtacaatgcgggcatcaacttgcgtttagtcaagtcgcccgaagcaccaaaaataatcattgcaaatttatccatcgtcgtatttttaactttttaccttttatccatccatcaccgcacctaaaccgaccagcctcaaccaaccgacaaaccgaccaatctcaaccaaccgccctaacgcataatcacccacacacccactactacccccacctacaacttaccatccgaacggtctcccggcctcaccgaaggagcgtcaagcggaggctgtatctccggcgtgaagaagggcaggctgtttgagcggagcgagttcctgccctttagccggagatgcggccggagtagctccgtaggtgcagccttgattttttcttttggtacctttcttttgcatcaaggcaaaagaaaagtactcatacattataagtccccgacttcgtctcccctccgtgccccgtccaattctcatgaaagaactgtccgcgcagctcatccttcctctcaaacgtatgcgcaccgaaataatctcgttgcgcctgcaccagattggcaggtaaattgtcagaagtcagcgaataaaaataattcaaagccgaagagaaagccggaacaggcaattcctccttcatcgcctccgccaccagattcttccatccggggagcaaagacttgatctcctcacggaagtaaggagccagcaacaaatgcttcggcttatccgccgcctcaaaagcagcagctatatcattcaggaaaatactgcggatgatacatcccccacgccacatacgggcaatggaagccaaatccagattccatccgaaagaatcagaagcccgctgcaacacagcaaaaccctgcgcatacgacaccagcttggaagcgtaaagcgcagaaaatatctccttcaccaattccgccttattatatataggtaatgtatgcttgcacaagaactgcttggaagccagatgacgcaactccttctgagccgacagactgcgttcgaacaccgccgtggcaatcaagcccaacggcatccccaactccatcgcattgatgacagaccactttcccgtccccttctgtccggcagcatcgagaatcttatcgatcagatacccaccggatttatccttgtgacgcaaaatattagaagtaatctcaatcagataactgcgcaacttcccttcattccaacgggcaaaaacgtccgccatctcctcattcgtcagatcaatgagattcttcatcacccagtaagcctcggcgatcaactgcatatcaccgtattcgataccattgtgaatcatcttcacaaaatgtcccgatccggcagggcctacccactggcaacagggagttccgtccggcgctttcgccgcgatgctctgcaagacaggcttcacttccggccacgctttctccgatcctccgggcatgatggaagcaccgttcaacgcaccttcctcaccgcccgacactccgcttcctacaaacaagaagcctttcgattctgctaattttacacggcgattggtatcttcgtaattagaattaccaccgtcaatcagaatatctccgggagaaagcaaagggaaaagctgatccatcagttcgtctaccggactgccggcacgtaccatcatcataatcttgcgaggggtggcgattgattccacaaaagcctttatatctgtaaaaccttcaatgtttttaccttttgcacgaccattcatgaagcggtctactactccttcttccactccggggacggtacgattgtaaacagagacgtgccagcccttgctttccatattcaaagcaaggttctcacccatcactgccagaccgatcaacccgatatctgttttattctgatttgccatatcttatatattttaaaatattgtttatgtaagaaacacttgaaaagcacatttgttcgctagttttagat

SEQ ID NO: 300 - DNA, 4100 bp, Bacteroides thetaiotaomicron
gtattagtaatcagtatatatatgtgtgtgttacttcttaggtaacggaaataataatggcgcaaagatagacaaaaaaataaataacaagcaaataaactatcctttttttcttttttgatttaaaaataagataaaaatagcctagaacatgaaagaacccttttcttcatattctaagatttttacgtcccataatcaaaggaatttcaccctacgcttagactgagcctcctttagcaacttggtatgtcctatttttcgtgttttaagagatttctcccttcccctgtgttttccgttacctaagaagtaacagaaaaaagaatggtaaaaatagaggatttatgaatcaaattggggtaaggtctctatttaggaatatacatagataaaaaatgaaacaaactgaagctattttgggggatatgcgatttattccattaaagggtgttgtattaattctgattctcatcttgacaacaagccgggttcatgcacaatatgctcttggggcaactgggcagatgatgatacctacagccgagatgcaggaaacaggaacctttatgggaagcgcaaactttcttcctgaagaggttacgcctaataagtttaactatcctaccatgaactactcggtagatatgtctttgttctcttttgttgaactgacttaccgtatgacgttactcaaaatgcgaacgtataatggcagagtcggttatcacaaccaagatcgttccaatactatccgtatccgtccattgaaagaaagccgttatttccctgctgtggtaattggtgctgatgatctttttacagaaaaggctactcagtattggggagattattatggtgtcttaactaagacgtttggtttctgcaaggggcatcagttggctgttacagcaggctggtattttcatcagggcaatcaaccggctttcaagaaaggcccttttggtggtattcgttatactcccgctttttgccgtgagttaaagctgatggcagagtatgataccaatggatggaatttgggtggagcaatacgtttttggaaacgtttgtccgtccatgtgtttacgcgcgaatttacctgtgtttctgccggtttgcgttatgaatgtacattaatacattaagaagatgaaaagagtatttagtatactatatataatatgttgctgcactttggaaagtgtggacgcgcaatctgctgggatatctgaagtcctgaaagaattgcaaatggaaaatatatctgtggcacagaagcaggatacgattacggcagcatttgagacttccgtatataggggatcttataatggtataggcattgcaatacgtcgcctgatcactcttccggaagtctctacattgcagttggtcatattggataatgctttgccgcaactttgtatcactttgcctgcgaagctgattgaggattatcaatcgggaaaatgtgatttggatggagtttactgtagtatgcagatgactacttccaccaaaactgcaatggaggccttaaaaggaaccaaacgagagtctactacttttgggaaagtggacgtagtggtttatccgggggtaatgttagttaataatgttacttacaaattatataaagcagcttttgaattgcaaccggctgtagaaatgcaactttggaaaggtgcttcattgaggctgcaggtttgcttacctatcgtcaataatgagccgggcaaatgggattgtatccgactggggtatttgacattgcgtcaggaatttcgtctggataatcattggaagggatacctgactggtggaaatttctcggatgatcgtcagggactcgcagccggtattggttatttttcttctgacggccgttggacagtagaaggagaaggtggtataaccggttcgtctcatttatatggcaacgactggggaatgagtaaatggaaaagagtgaatgggcagctcagcgtaggttatttcattccacaagtgaatactcaattgaaagttagcggtggacgttttatatatggagattatggggtatgcggaattctttcacgttacttcggtgaatatgtcgtgggactttatggcatgtatacagatggagaaacaaatgccggatttcatttttcgattccattgccgggtaagaagcgtagtcgtcacgcggtacgtgtgatgcttccggattatttcgcttttcaatatgacatgcgtagtgggaatgaatttgctcgccgtgctttgggggtaagctatagaaccgaaccgaaatctgctgaaaacagccgtttctggcagccggattatatccgttattgtttgattcgtaccaatgaaaagacaaaacttaaataagagttgatattagtaatttaaacaaaaattgaacaattatgagaaatttaaaatggttgtatgcatgctctttggcgatagccttcggtgtgttgtcttttgtaacagtttcctgtcatgatgatgacgatgaaccaaagcaagaaccaggtgaagtgattgaaactcccgctccggttgttgagtattatattatgggtactgtgacggatgccgggaaaggtgtgtctggtgttgatgtaaaaattggtactgagacaattaagactgacaaagatggtaagttctctgtaacagagaagaatgtaggtaagtattctgtagaagttgctcctaaaggttatcttgctcaaagtacttctgtagaaattgctgctaatgcggaaaatcgtagtgtggtgactgttgctgtggctttgactaagcaaagtgaacctacgactgtagaagttggagagactggtaatacagaagaggttaaggtagaagataagagtgcttcgaatgaggaagttaaagaaccgggtactgttgaaccggaggatgtgaaagaagatcttcctcttgtaactcctgaattagaaatcccagctggggcaattcagacagaaggtaatgaagacgttctggaaggtggtaatgctgaagtcagtgtaactacgtatgtaccagccccagaaactgtgactacagaagtgaagaaagaagaagagaataaagaagtagaaaagaccatacctttggcggcagcacactttgaacctagtggtttgacatttgcaaaagaccactatccaactatttcaattcctaatcctattcctggcttgactttcgctgatgatatggtacttacttatttggagaatggaaagtgggttccacaaacagaggacattaataaagttgtttatgatgagaaatcaggtagctacacaactaaagttaagcatttctcttcctatgctatggaaaataaagtcactagtaaagttagtactgaaaatgtagtgaagagtgagattttaggacaggcaagttgtgataacagtgaaaatcctaaagctgtaacaggaattgcattgacttataaagaaaagtcgggttgggaatgtaaagatgcggatattaaagcggctgtagaaaaagctttgtcaggtgcaaaaccagaaacagttaatgctatggtagctttcttcaaaactcgtttatactcattgatgggatcggcatcaggtattacagaaacaactcgtacctataatactgtaaatgtgaacggttatacaacaatgacttatacttgctatgccaagactcgtactactacattgtcgaccacagtgaagtataataataaggatgtgaagatttcagtaactgcaacacgctataccggaactgaccatcagtataagacagtgactactaatcctactcatagtggtggtaagggtggaagtaactaataaataattaagatcataaaaataacccttttttaataaaccccttttttataaaccctgttgggcaataatcatatgggatatgaggaggaagaggtcactgtgaagtggtttcttccttttcgtttatgagatatatggatgtttgttgaatgttcattttatacagaattctactaatataagttaatgtttataattatgatttgtatcctgtaaataaagcctatctttatcacccaatac

SEQ ID NO: 301 - DNA, 4063 bp, Bacteroides thetaiotaomicron
gatatcattatggcaaaagaaatattattcaatatcgatgcccgcgaccaattgaaaaaaggtgtcgatgcattggcaaatgcagtaaaagtaactcttggcccgaaaggacgtaacgttatcatcgaaaagaaattcggtgctccgcacatcacaaaagacggggtgacagtagcaaaggagatcgaattggcagacgcttaccaaaataccggtgcacaactggtgaaagaagtcgcttctaagactggtgacgatgcaggtgacggtacaactactgcaactgttttggctcaggctatcgtagctgaaggtttgaagaatgtgactgccggtgcaagcccgatggatatcaaacgtggtattgacaaggctgttgccaaagtggtagaatcaatcaaggcacaagctgaaactgtaggtgacaactacgacaagatcgaacaggttgctactgtatctgctaacaatgatccggtaatcggtaaattgattgctgacgctatgcgcaaagtttctaaggacggtgtaatcactatcgaagaagctaaaggtactgacactactatcggtgtagtagaaggtatgcagttcgaccgcggttatctgtctgcttatttcgttactaatacggaaaagatggaatgtgagatggagaaaccttacattctgatctacgacaagaagatttctaatctgaaagatttcttgcctatcctcgaaccggctgttcagacaggtcgtcctctgttggttatcgcagaagatgtggatagcgaagcgttgactacattggtagtaaaccgtctgcgttctcagctgaagatttgtgcagtgaaggctccgggcttcggcgaccgtcgtaaagaaatgctggaagatatcgctatcctgacaggtggtgtggtaatcagcgaggaaaaaggtctgaaactggaacaggctacaatcgaaatgctcggtactgctgacaaggtaacagtatctaaagattatacaacaatcgtaaacggtgctggtgtgaaagaaaacatcaaggaacgttgcgatcagatcaaggctcagatcgttgctactaaatcagattacgaccgtgagaaattgcaggaacgtctggctaaattgtcaggtggtgtagcagttctctatgtaggtgctgcttctgaagtagaaatgaaagaaaagaaagaccgtgtagacgatgcattgcgtgcaactcgcgctgctatcgaagaaggtatcatcccgggtggtggcgttgcttacatccgtgctatcgattctcttgaaggcatgaagggggacaatgcggatgaaacaacaggtatcggtatcatcaaacgtgctatcgaagaaccgcttcgcgaaattgttgccaatgcaggcaaggaaggtgcggtagttgttcagaaagtacgtgaaggtaaaggtgacttcggttacaatgctcgtacggatgtttacgaaaatctgcatgctgccggtgtagtagatcctgctaaagtagctcgtgtggctcttgaaaatgcagcttctatcgcaggtatgttcctgactacagaatgtgtgatcgtggaaaagaaagaagataaaccagaaatgccgatgggcgctccgggaatgggcggcatgggcggaatgatgtaattcttcctttccggacataaaaataaggtatggaaccgctttccctgtgggggaggcggttctttttttgcgcagctttgtgatagaaacttttgtgtgtaacttggcgttatttgtttggaaagaagtatctttgtgtattgcaaatcaaaaatccctgagaatatgagtagtaaaatttatcctatcggtatacagaactttgaaaagattcgaaaagatggttacttttacattgataaaactgcgttgatttataaattggtaaagactggcagttattattttctaagtcgtccccgtcgttttggaaaaagtttgctgttatctactcttgaagcttattttaaaggaagaaaagaacttttcgaaggattggcgatggagagtctggagaaggactggattgaatatccggttattcatttggatctgaatgctaaaaagtttgatactgaaaatgaccttatccgtctgatagatcgacaacttcttgtttacgaagctcaatacggttcatgttccagtgatgaaacgatcgatgaccgtttggttactttaattagactggccgcagaaaaaacagggcagcgggtggtgattcttgtcgacgagtatgacaaaccgatgttgcaagccattggtagagatgagttgcaggaagaataccggaatacattgaaagccttctacggtgtgatgaagtcgatggatggctatattaaatttgccatgctgacaggtgtaacgaagtttggtaaggttagtgtattcagcgatttgaataatctcaacgatatctccatgtggaatcaatatatagatatatgtggagtcagtgatcaagaattgcatgataatctggaggttgaactttctgaatttgcagatgctcgtggaatggcatataatgaaatatgtgttgcattgcgtgaatactatgatggttaccattttactcataattccattggcatgtataatccgtttagtcttctcaatgcattcttacgtaatgaatttggcagctattggttcgaaaccggtacacctacctatctagtagaattattaaaaaaacatcattatgatcttcagagaatggcgcacgaagaaacgagtgctgaagtcttgaatagtgttgattctacttccgacaatccgatacctgtcatttatcagagtggttatctcactataaaaggatatgatgagcgttttggtatttatcgtcttggatttcctaaccgtgaagtagaagaagggtttgttaaattcttgcttcctttctatgctaatactaatgcagtggaatcttcttttgaaattcagaaatttgttcgtgagatagaagccggagattatgattctttctttcgacgtttacaaagtttctttgctgatacaccttatgagttgattcgtgatttggaattacattatcaaaatgttctttttattgttttcaagttaatcggattctatgttaaagcagaatatcatactagtgaaggacgtattgatcttgttctccagacagataaattcgtttatatcatggagtttaaattggatggtacagcggaggaagcattgctacagataaatgagaaacattacgctcagcctttcgaatccaatgattgggagttgttcaaaattggagtgaatttcagtgccaagacacgaaatatagagaaatgggttgtagaaaaaggaggaaactaagtatttaaaattagttggtaaagtctttctgccatttagcttcgtttataatattcttcgctttcataaagcaatgctttggatatccaaaagctatgctttatggttgctaaagcatagctttaagttgccatacgggagatgttataaatattatcttcaccttcactttaccttcgaaatcctttatttatcggcgatatcgggtgaaggactagttattcaccctttgaactgagaatgacattcgttcatgaaagtatcattccttttgctataagctaatttatttttgctataatgatatttgcattagctataacctaatggaaagatgctaatagattatttttttcttctcaatgtttgttttaaacatcttattgattgtatctgacttgtttgaagaaagaggtgaaggtacctcccttcacccactatcactgatgaataaaggttttcaaagaaaaggtgaagggtgaaacctttgtttgaaaacttgtggtataatgcgtaaaagcaacagaaatcaacaaaatacgtgtttttgatgctgatccaattaaaattcgtttctttgcctccaaacttttatcaagaggtctttgtttttttgaccgttcgctcctattataataataggaagtgtatttatattatagtgtatatctaatagtttatgcaatgg

SEQ ID NO: 302 - DNA, 4059 bp, Bacteroides thetaiotaomicron
cacctttccttcacagtactggttcgctatcggtctctcgggagtatttagccttaccggatggtcccggcagattcacgcaagatttctcgtgtcccgcgctactcaggataccactacgcttaatttgacttcgtataccggactatcaccgtctatggttcaactttccagaggattctactcatcaaatgtcttgcgacatcgtggtcctacaaccccacacatgccgtaacatgggtggtttgggctattccccgttcgctcgccactactaggggaatcattattattttcttttcctacaggtactaagatgtttcagttccctgcgttagcttccatcaaagatggatgacattccttcagaatgccgggttgtcccattcggaaatctctggatcaaaggttatttgcacctacccagagcttatcgcagcttatcacgtccttcatcgcctccgagagccaaggcatccgccatgcgcccttgcttactttctttcaaacttacttttaagtatcaggtattaagtatcaggtattaacccaaagtacttaatagtgttgtacttaaaacgtacggttcgatatatacttttagctctttactaaattttactttttgtacatcatgtcaaagatcgtttctcttttcagagactgtggagaataacggattcgaaccgttgaccctctgcgtgcaaggcagatgctctagccagctgagctaatcccccaagagtaattgaacattgcaataatgaattgacaacgacaatttttgttcggagtagtcccaggcagagttgaactgccgacctctacattatcagtgtagcgctctaaccaactgagctataggactagttcaaccttgtctacctgatgttagactcggcttctttcttttctcttgtttatctctatctatacttctatagatggttgatctatatgttataaataaacaagtaccagtagtacaataatagaacctatgaaatcgttgttacgacatcgctccagaaaggaggtgttccagccgcaccttccggtacggctaccttgttacgacttagccccaattaccagttttaccctaggacgctccttgcggttacgtacttcaggtacccccggctttcatggcttgacgggcggtgtgtacaaggcccgggaacgtattcaccgcgccatggctgatgcgcgattactagcgaatccagcttcacgaagtcgggttgcagacttcgatccgaactgagagaggcttttgggattagcatcctgtcaccaggtagctgccttctgtaccccccattgtaacacgtgtgtagccccggacgtaagggccgtgctgatttgacgtcatccccaccttcctcacatcttacgacggcagtctctctagagtcctcagcatgacctgttagtaactaaagataagggttgcgctcgttatggcacttaagccgacacctcacggcacgagctgacgacaaccatgcagcaccttcacatttgccttgcggctaacctgtttccagattattcaaatgcaatttaagcccgggtaaggttcctcgcgtatcatcgaattaaaccacatgttcctccgcttgtgcgggcccccgtcaattcctttgagtttcaccgttgccggcgtactccccaggtggaatacttaatgctttcgcttggccgcttactgtatatcgcaaacagcgagtattcatcgtttactgtgtggactaccagggtatctaatcctgtttgatacccacactttcgagcatcagtgtcagttgcagtccagtgagctgccttcgcaatcggagttcttcgtgatatctaagcatttcaccgctacaccacgaattccgcccacctctactgtactcaagacagccagtatcaactgcaattttacggttgagccgcaaactttcacaactgacttaactgtccacctacgctccctttaaacccaataaatccggataacgctcggatcctccgtattaccgcggctgctggcacggagttagccgatccttattcatatggtacatacaaaattccacacgtggaaaactttattcccatataaaagaagtttacaacccatagggcagtcatccttcacgctacttggctggttcaggcctgcgcccattgaccaatattcctcactgctgcctcccgtaggagtttggaccgtgtctcagttccaatgtgggggaccttcctctcagaacccctatccatcgaaggtttggtgagccgttacctcaccaactgcctaatggaacgcatccccatcgataaccgaaattctttaataatcaaaccatgcggtctgattataccatcgggtattaatctttctttcgaaaggctatccccgagttatcggcaggttggatacgtgttactcacccgtgcgccggtcgccatctccagtttgcaagcaaactgaaatgctgcccctcgacttgcatgtgttaagcctgtagctagcgttcatcctgagccaggatcaaactcttcattgtaaaagtattgttagtcagcataaagctgatttttgctctgttcaggatgccgtacaatttattgacttcattaataccttacgtctcacacatattatatatatataagacaagtattgacggttctatttttttcttgtactacttgtattgtttatcaatatttcaaagaacatcttgctttcgttttaaaagcgggtgcaaaggtaagaggttttattttaactaccaaatattttcggaagttttttttcgtttttctttttctatcgtttttcaggctctcttagcgaaagggaaagaaggtaaagaagaaaagcgtaacaccttttctttgcgaatcggactgcaaagataagaacttttagctttatcttccaaactttatcggaagtttttttgttcttatggttaagcagacacttgcttttacactaagtcaatttatcaaggctttcttctcttggaaagcgggtgcaaaagtagccccttttcaaatatactccaaacttaaatcactctttttttgaattatttttgaaaagactcgctaaagtgttgaatcataaggatgttatagaacatatttttctcggatacaggaggaacagaggaaaggcatacacattattatattcgcacgcgcgttaggtgagtgagcccaggtggatgcaccagggaaatgaagaggaaatagggggaagaacaaagtttgaaaaagaaaaaactctgccatccgcaacaattggattaacattcttatggggactgactaaaaagtcggttctacctctattggcgctgactaaaaagtcaatagtatcttaaatctcctccttcccgaaggaggagtacccgtagggggaggtggtaggtgaatacataatcctatcatttacaaagaaataggaacaaacattatttatcctaccacctcggtctgcgaccactcctccttccagaaggaggagaatagagatactaccgacttttcagtcaacccctacttacgtgtcagccaagctctctatgaaaataaaaaactataatttgctgtcatctgtcacgttattgggggtaataatttgaatatgagtgattaatgaggtgacaacagtaggtgatggcagtgtgacggcaaattttgctgtcacactgccttgttgtcaatggttacttatgggctgttggttggtctatacagagctttttagtttctcccgcttgaaacttttgtttctccagcttggaactaaagttccatcggcttgaaactaaagtttcaaagccgtgaaaacaaggtttcggacgcttgaaaacattgcttcaagcgtagggaatgagtgaaacaaccgtatggtccgattagatcgactgtacttccctaataatggttgacttgtttatctctaatagctgctatgtgttgactagaaatattactaaccctggcagctgtttactttattatttattattcctgcctccggtttacttattt

SEQ ID NO: 303 - DNA, 3991 bp, Bacteroides thetaiotaomicron
actaaatatagacaaacagactgtccttcaagcagaaaaaaactttcttcggaaaaactttcgtatatcgtggaaaagtagtactttagcgtggtttttcacagaccatacaatgtataattaataatcattttaaatgcttgaacaagacagaattataaagattaacatcgaggaggaaatgaagtcatcgtacattgactactccatgtcggtcattgtttcacgtgcccttccggatgttagagatggatttaagcccgttcaccgtagaattttatacggaatgatggaattgggtaatacttcagacaaaccttataaaaaatctgcaagaattgtgggtgaagtactgggtaagtaccatccgcatggagactcttcagtttattatgctatggtgcgtatggctcaggaatgggcaatgcgttatcctttagtagatggccaaggtaactttggttctgtagatggtgatagccccgctgccatgcgttatacggaggctcgtctaaacaagttgggtgaagcgatgatggatgacctgtataaggaaactgtagacttcgaacctaactttgataatacgttgacagagccgaaggtgatgccgacccgtattcctaatcttttggttaatggtgcttccggtattgcggtaggtatggcaactaatatgcctcctcataatctttcggaagtaattgatgcttgtgaagcatatattgataatcaggaaatcacagtagaggaactgatgacttatgtcaaagctccggatttccctacaggtggttatatatatggtatcagcggagtacgtgaaggatatctgacaggtcgtggacgtgtagtaatgcgtgcaaaagcggaaattgaaaccggacagacacatgataaaatcgtagtgactgagatcccttataatgttaataaggctgaactgatcaaatatattgctgatcttgttaatgataagagaatagaaggtatctcgaatgcaaacgacgagtctgaccgtgacggtatgcgtatcgttattgatgtaaaacgtgatgctaatgcaagcgtagtgctgaataagttgtataagatgacagccttgcagacttccttcggtgtgaataatgttgcattggttcacggacgtcctaagacattgaatctgagagatatgattaaatacttcgtagagcacaggcacgaagtagttatccgccgtactcagtttgatctgcgtaaagcaaaggaacgtgcacatatccttgaaggtttaatcattgcttctgataatattgatgaagttattcgtattattcgtgcagctaagactccaaatgatgctattgcaggtttgatagaacgttttaatctgacagaaatacagtcacgtgcaattgtagagatgcgtttgcgtcagttgactggtctgatgcaggatcagcttcatgctgaatacgaagaaatcatgaaacagattgcttatttggaaagtattttggctgatgatgaggtatgtcgtaaggtgatgaaagatgaattattggaagttaaagcgaaatatggtgacgaacgtcgttctgaaatcgtttattcttccgaagagtttaatccggaggacttctatgctgatgatcagatgattatcacaatttctcatatgggatatatcaaacgcacgccattaacagaattccgtgcgcagaatcgtggtggagtaggctctaagggaacagaaactcgtgatgcggactttgtagagcatatatatccggctactatgcacaataccatgatgttctttacacaaaaaggtaaatgttattggctgaaagtttatgagataccagaaggaacgaagaattccaaaggacgtgctatacaaaacctgttaaatatagactctgatgacagtgtaactgcatatttgcgtgttaagagcctggatgacactgaatatattaatagtcattacgtattattctgtacgaagaagggtgttatcaagaagacattgcttgaacaatattcacgcccgcgtcagaatggtgtaaatgctattacaattcgtgaggatgacagtgtaattgaagttcgaatgacgaatggtaataatgaaatcattattgctaatcgcaatggtcgggctattcgtttccatgaagctgcagttcgtgtaatgggacgtacggctacaggtgtacgtggtattacattggataatgatggtcaagatgaagtaataggaatgatatgtatcaaagatttggaaacagaatccgtaatggttgtttctgaacagggatatggtaagcgctctgaaattgaagattatcgtaagactaatcgcggtggcaagggtgtaaagaccatgaatattactgaaaaaacaggtaagttggtaacaattaagtcagtgaccgatgagaatgacttaatgattatcaataagtctggaataactatccgtctgaaagttgccgatgtccgcattatgggacgtgctactcaaggtgttcgtctgattaatcttgaaaaacgtaatgatcagattggttctgtatgtaaagtaatgacagaaagtcttgaggatgaagttcctgcagaagaagcagagggtactattgttagtgatctgactactgatcaggatgttgacaatgcagatactgctacagatgttaatgaaaataacaacgaaattgaggaatagacataatattaataattaatcaaacaacaatcatgaaaagagtattattttcaatggttttattgatggccgtaagcttatcattcgctcaaatgaagaatgtaaaagaagccaaaagcattgccagtgatgtaaaaccgaattttaatcaagctgaaaagctgattaatgaagccattaagaaccctgagaccaaggatcttcctgacacatgggacgttgctggatttattcagaaacgttttatcgaagaagaacgtgataagaaaggtgttctgaaacagccgtttgacacattgaaggcatacaacagcattttaaaaatgtttgagtattatactaaatgtgatgatctagctcaagtacctaatgaaaaaggtaaaattaaaaacaaatatagaaaagcaaatgcttcaactatattggttgaacgtcctaatttgatcaacggtggtattcaattctttaaccttgataagaataaggaagctttgcaattctttgcaacatacgtagaatcagcttcttatcctatgttggcagagcaaaatttggctaaaacagatactcttttggcacaaatagcatattacgcaacattggctgctgacagagtaggagataaagatgcaattattaaatatgctcctgctgcattggatgacaaagatggcggtaagtttgcaatgcaattgatggcagatgcatataaagctaaaggtgatactgcggcatgggttaaatcattggaagaaggtattttaaaattccctggaaatgattatttctttgcgaatttggtagattactatactagctctaaccaagcttctaaagctatggaatttgctgatagaatgttgtctactgatgccaataacaagttgtatctttatgtgaaagcatatctttatcataatatgaaagaatatgataatgctattgagttctacaagaaagctattgctgcagatcctgaatatgcagaagcatattctaatgtaggattagtgtatttgatgaaggctcaggattatgctgataaagctacaacagatatcaatgatcctaaatatgcagaggcacaagctacagtgaagaaattctatgaagaagctaagccattctacgaaaaagccagagctttgaaacctgatcaaaaagatttgtggttacaggggctttaccgtgtttactataatctgaacatgggtcctgaatttgaagaaatcgataagatgatgaaataattatattaagtcagttattataaaagac

SEQ ID NO: 304 - DNA, 3852 bp, Bacteroides thetaiotaomicron
ttggagtataatagactaatactgataaacattattacttttaatatgaatatataattattcactaatttctaaacacacacaaaaacgttgttattttaacatttagagattatgcctattttattgacagtggagaatcttgtaactgcggatttgagcacaattcataaggaacaagctacttacgtgggaattgattttggaacatcaactacagtagtttcttattcatattttgataatgaaaagagaatagttgtaactgaagtaatgaatctacgacagaagcaaagtgatggtgcggactttactggagaaaaagtgcctacagttatagctctttatcataatcgggtacttgtcggagagggagctgcaaacttaaagtatgaattagaaaaaaacaaggatgtctggtactcttttaagatggagttaggagaagatttaggtgcaaaatattgtaatagtattttgggtaaagataaatctgtccgaatccaaaatgcaaaggatgctactattttatttttcagattcttaaagaaagagatagaatcctatgtcgaacaaaaaggactatgtcagaatattaaatatgcagtaagtattcctgcttcgttcgaggcgaatcaacgacgcgatttggttgatgctttaataagcaatcaaatggatgttagcaaacagtccttgattgatgagcctaacgcagcttttttaaactatattcatgaatcggagatgaataatgaagcagtggtaattcctaaagatattaatcctaaaatgttagtttttgatttcggagctgggacatgtgatatttcaatattagaaataggtgtagattataagggagtatattctaaaaatttgtcaatatctaaatttgaaaaattgggaggaaatgatattgatagatacattgcttatgagatattgtaccctgaacttttgtctcacaaccatttagatatggatatctttattatgtctgagaagaaaaaaatcataaatgctcttttgactactgcggaaaacttaaaaataaggatatgtaaagccataagtctaatgagggatagtttcgatttgtcaggtcttgaacaagaatataaagtttctgtaaaggatattcgaattaatacatccaaaggggtattgtacatggatgagatttttttaacatctatccaattcgcagaacttatgaaagttttcacaaggaagaaaagcgatgttattcaaaaagaaaaacaaatatataatagtatttatgattgtgtaaaaacttctattcgtaaggctagattagaagtagatgatgttgattatgttttattggtgggtgggagtagtcttaatccttatgtacaagccgctctgaaatcatggttgccatattccaaattattgttatttcctgatcttcagacttgtgtgtctaaaggtgcatcaattcattcgttcatctataactcttttggacagaatatagtacagccaataaccagtgaaccaatatgtataattactaagaatgatcagctaatgactttggttcctgccggaactgtcatgccgacggatactattgaaatagataatcttgctattgtaaaagaaggccaaaaaactgtagaattccctatttgtatcagtaatgagaataaaatattgactaatttggttataacttcaaatgaacaaaatggattttctttggatacgcctattaagctgcaattagaattaactgcagataaattactgacaattaatgccaaggttggaagtgaaacttgtttagtaagtgcaattaatccttttgcaaataaagagttaacttcacaggagaggatagcattgagagcagagaaaaaagcttataatacaacagctaataatagaggagtaccatcaaaagaatgtttgttggaattggcaaaagcttacgaaaacgcaactctaaatttgaaggcagctgaaacttatgaggaatgtaatgaattatatcctggtactattagttataataaattaggatgctgcttttcttctgcaggaaataataggaaagcactacgttacggagaaaaagcttatgaatatagtaaggatgcggtttctgcttttaatttgggttatcgctataaaaatattgatacttcaatgttcttaaaatatattcacgaatctttagcaatgtgcccgaataagccacatcctttatttgaacttggaaagtatgaaaaaaaagaaggaaagaaaatagaaggagtagaaaagataaagaaagcttataatatatggaaggctcaatatgataatggtaccctcagtgatgtagattatacttggttaccaagtgctgcagaggaattaggtgagtctatttttgctgaagaggtcagaaaaaaggcaaaaaggatatcattggatgatttttataattctaataatacagtagcggtgaaaggagactaattatgagtactagaatacctacagaagaaagtttggatactcaacaaaaggattttctaaagaaactgaaagataatcattatgttggtcagaatatttggataaaagggtttccgggaagcggaaaatcggtgttgcttgtatatgccattaaatacttattgaataatgaggctactcaaaatgcaaaaatattattagtggtgtttactcattcgttgatagaactttgcaaagctgaacttgcagagttgaatataacaaatgtgaaaattgtcacgatgtatgaattcttaaaaacaaagagaaaatatgattatattttttgtgatgaggttcaagatttaacatctcgtattttgataaagatgaaagatcagacaaggtatatgctgattgtagcgggagatagtaaccaatctatttattcaaaggaccctcaatatcaagaagctgtagttattcctgagaaaattactcaattaattgattctgaagattggggacttttatacgtatataggttaactcgttctataatcactgcaattcagaaaatgataccatcgatgaatatttttagtgcaaagaggtatatgcttaaaagagatacgcaaatacgcttatgcaaagcagaatttgtggatcaagaagtcgaatatataatgagggaggcacgtaagtttgttaatcgtaatcagagttgtgcaatattatttcctactaaagataaagtattggaattttgtgataccgttttgcagttagaacataaacctgtatgggaaaaatggattgatcaatattatgaaccttattttaaacggcttaatgatcatctaaaggaaaatcaagttcctatagaatgcgttgtaaatagttatggatcgttattagctgcggaaaacgataaacgtattgttattatgacttatcatggtgtaaaaggattggattttgataatgtttttattccatttgcaaatacagacttatatattcctggagatagtaatattactcagaaattgtttatggttgcaatgagccggagcagaaataatctatacatcacttatacaggcatgcctttaagttatgtttctttatttagttcagatagcactatatgtgcaaatatttcgataagtaatgaattgcatcccaatttgtcggatgatataaatatagatttttgattatggctaaaatgagatatgaatacttgggcattatacatcgtaatgatttaaatattctgtttaagaaaggatatattgtgttatgcactattcacgtgaaaactatatccggcaatgatagtgtaccggaagaatatataagggagctgttgaagaa

SEQ ID NO: 305 - DNA, 3837 bp, Bacteroides thetaiotaomicron
gaaatatattgtttatcagccttataaaactcttctgaaaagaatacctttactgattagtagaactttggtgccttctatttccggttcggttttaaaatgtttttgatggaacgtattttcgtaaagagtaagaatgtattaaaatattaaatgatgtcccatgaaccaaaaacaattctaatttgtttttataacggcaaagtattttttaattttgctcctccaaaataaatctttgatacattcaggataaaacaatcattttatttttagcttatgttgataaccattatcattctcgttctttcggctatcttttttgtaaacggtaagatacgttcggatcttgtggcactatgtgcgttagtagctttgcttatctttcagatattaacacccgacgaagccctttccggtttctccaattcggtagtcattatgatgatcggattgtttgtcgtgggcggagctatttttcagacaggactggcaaaaatgataagttcgcgtatccttaaacttgctggaaacagtgaaattcgcctgttcttccttgttatgttggtcacttccgctatcggtgcgtttgtcagtaataccggaacggtggcactgatgcttcccattgtggtcagtctggcgatgagcgccaaaatgaatccgagtcggttgctgatgccgttggcctttgccagtagtatgggaggtatgatgacgctgattggtacaccgcccaaccttgtcatacaaaacacattgacttccgcaggcttcgaaccgctttctttctttactttcctgcctgtaggtttggtgagtgtggctgtcggtacgctggttctgatgccgcttagtaagtggtttctttctaaaaaagggcagaaagatgataacagccgttcgggtaagtcgctgaaacagttggtgaatgaatatggtctttccagtaatctgttccgtatgcaggtgattaaagactcccgccttttgggaaagaccatcctcgatctggatattcgtcgtaaatatggacttaatattatggaagtccgtcgtggagatgcttcgcagcaccgttttctgaagactattactcagaaacttgccgaaccggatactatgctggaagcggaagatattctgtatgtgacgggagaatttgataaagtgcagcaatttgccgaagattatctgctggatatattggatgatcatgctacggaagagacgaaaagcactactaattcgcttgatttttatgatatcggtattgccgaaattgtattgatgcctgcttccaatctagtcaatcagaccattaaagagtccggattccgtgataagtttaatgtgaatgtattaggtatccgtcgtaaaaaggaatatctgttgcaggatttgggaaatgagcggattcatagtggtgatgtgcttttagtgcagggaacttggagtaatattgcccggcttagtaaggaagattcggattgggtagtgttgggacagcctttggcagaagcggctaaagtaactttggactataaagcacctgttgctgctgctatcatggtattgatggtagcaatgatggtattcgattttattccggttgcacctgttacggccgttatgatagcaggtatcctgatggttttgacgggatgtttccgtaatgtggaagcagcttacaaaacaatcaactgggaaagtattgtattgattgcggctatgcttcctatgtctttggcattagagaaaacaggcgcttcggagtacatctccaatactttggtaagtgggcttggatcttacggaccgatagcattgatggctggtatttattttacgacatcattgatgactatgtttatcagtaataccgctactgctgtcttgcttgcaccgattgctttgcaaagtgctatgcagatcggagttagtccggttcctttcctgtttgccgtgacggtgggtgcaagtatgtgtttcgcttctccgttctctacaccgcctaatgcgctggtgatgcctgccggacaatatacttttatggattatataaaagtaggattaccgttgcagattatcatgggaattgtgatgatattggtgctgcctctgattttcccattctgacagatagaagggaattagtataacgttttagcaactgccttgtagtctgatatcagattacagggcagttgttattatatcaatagatgattgcttttatcataatgttcggtgataagtctttcttctgtcatttgtttgtagaaagatccgatttgctttcctgcctgttttttaataatcttctgttagcttggaaaggtggttgaattatcgcaaatatacggttgatttgcatgaaatgaccgtatgattcggtgaaaaacaccgtattgtttgtgaaaaagatgcggatgaagtaaccaaaagatgcagatggtgtcactaaaaggtaggtatgatgtaagtaaaccattgctatagtgtcattataccgataaaactgtctttatttaatacttttgaccttctctgttttctatttcgctctttggaaagtttagatggctaatgttgaaaataaacagaactgatgaaaatataatcatgtagatatataagtagagtataatatattaataagtgctgaattggatgtaaatgctgattttttgatatatgctagttgcccaacaatcgcgaaaaaatatcaatagtagtatgaccggctaaagaagcccttcttgatgcattacgaattacaaactgtcaaaaacatacttatctttcagaatgtcattttatacatgaagaaagatggaatttatagaaaaaggctcctgatgcaaatgacttatcattcggatatcaggagccttttatctatttattgaacctttggtgcgacaggtgtattcatcttctgagtgtacaggctgtcgataattccgtcggacagtccgatggtaggtacaatgattccggtagctttcacattcatagctacttccagaaatatctccgcagccggaacgatgacatcagcccgatcaggttttagcttatactgtttgatacgttgctcggcaggaagagcttgcaatgcttcgtaaatttcacgtagcgattcgacgggtaggagagaagcctttttgtctttcttgtctgccagacggaaaagcttattgatgtttcctcccgaaccgatgatgctggtaggcgcgtattccgcggcaagccctatgaggtcggtgcgtaaagcctctttttcttcttctttcaccatgccgctgagcatgcgaaccgttccgatattgtatgaacgggaatttttcagttctccgttactgatcagattaatctcggtgctgccaccgccgacatctacatacaggtagttttgtccggaagcaaaaagttgctcgatatggttgtcatatacaatgtgtgcttcttcttgtccgtcgatgatatctacgcggataccagttttcctggctatttgtcgggcgatgtcctttccgttgcgtgcgtcacgcatggcggacgtagcacaggcacggtaatctactacgtcatatatcttcatcaactgtttgtaggctttcatcagccggatcagtttcttttctttttcagcagaaataactcccatggtaaaagcatcttctcccagtcgtaagggaatgcggatgagttgtaccttgctcattaattcgggagcgttttcttcgtttacgcattttatcaatagccgcacggcattcgaacctatgtcgatagctgcataattaactttcttcatacttatcataatgt

SEQ ID NO: 306 - DNA, 3832 bp, Bacteroides thetaiotaomicron
ttaatatactatgcatcaatattttaatattaaattttatatataaatttatatcttataaaacaaacactattttcaagaagcaataaataaccaattaaaaaacaaagattatggcattatttgtaaatcccggcaaagattgggaaaagaacatgagtgaagaagacatcgcacaaatggaatcacaaggttatgatgtaacagaactacgcgccaaacgcgcaaaatctgcagaggaagaagaaaaagagcgcctccgcgaaaaagaagagcgggaaaacttcaagaatccaactaacctgaacaaactcgccccttacctgcagacaccacgtgacatgagcacttcttttttcaaagctatggcaggcagcgccccctggctattcaaagatcgttggaaaagaaaatataccgaggctcctattgtttatgccgcggtagtgcaagctaataccgccctatggatgcccggtaataacgattattatcctgccgtatttgtttttgcacttgatcaaaaacacattcacgacaccgaatggctaaaacaaatagcagaagaaataaatgtattgcaagatgccgaccaaatccccggtgattgccgcaaactaatacagacattacgcgatgataccagcgaattctgttttcgtatcggcaaaagtgtatgtggtgacgccaacgcatggtgtgccacctataaattcgacaaacagacagcactgccacgcaaggctttaccatccgatggcatcgtcccttttctattaaagtccgccccggtagaaaatcaatttgttgatttcaaactaatcccgactgaattttatatcggctaaaaatagataagcagaaataggcaaaccgaaagtaaacaatatttttttcatcatttataattatatctcacataaggaatatgcatgcatacattatccaacaactaataagaattatattgtttatcactatcagtttgcctataggactaaaaagttttgcccaagaaacaaaacgtttctatatggaactggacactccccgcaatggagccaaagcaggacaagagcttgaattaaaatacatcagcacagccgatttcgattctgtatctccacccgacttcggaacgcttatagaaacagttgaaggagcaacaccacacaaagccggtcatacagtaaaaaacggcatattgacaaatatctacgagcagggattcagctaccgcatacgtttcaagaagccaggaaacaccaaactacctctggcatccatcaaggcaaacggaaaggaatacgaaacacctctgaccagtgtatgggtacatccggtcgataccaatatcgacagtgtaaaatgcagcattcagctggaggattcttatcgcaaaggagttttcactgccatcgtgatctgtctcttaatcgcctggttattgatccgcttatcgtttcagaaacaaaaaaaaataaagagacaggataaataaaacagagaataaccctatctcattaatccatcattatctgcatctgcttatttattttttaagtattctctttaaatgttcgacatctaaaagtaagttcactgtttcaaaatttcctttataaaaaacgccccagttattgaaaacacaaggcaggtctttcgctttttggagtgtatccacttgaattaaagatacaggaacgttatttgtatcacaatactgttttaccatttcaatcttttgataaatataagggcattgcatatcataataaatagtcagatcttcgctttcaattttcatttttttcgcgttttgcgcaaatttcggcattgtcccgtcaaaagaaagtgcaagcagttcatatccattatcagtcgcatcaacaacttcaaaaccgaatttcttcgcaaacgattggtcagaaagccagttcttccgcttctttgagccaagcatacaaacaccggatttgcctttttctttggcgtctgtcaggcaatattccatcaaagctcttccatacccattccccttaggacttcctaagacccataagcaatacagataataatagttatcaccaatgatgggaacccaagctgtctcaagaggtgcatactcaataaaaaccgtagcttttgcatttagctttctaaaaacatgaccttcatttagtctgtcggaaagccattgccgcttcgcgtcaatacctgcatgaggctttttactgcgaataatgcagcatagatgctcatcactgaggttttcctttgttaagtttacaaaatctgtattcatatacgcattcgttttaaattagatatcatcaatcaaccgatcttaacggtgcactctgccattttggctgaatataatagttatagtttcataagagatagtgatttagtattaaaatcctctttaaatctttctctctgccaaaaagagataagattcttttttgctcttctatagttggtatcttgataattaaattcccaatgaatatttcctcatattcttttacacaaacagactgccaaatatcgtttttcttaatttgaagatcccccatgacctcaatatccattaaaggaagtttgaatctggcaaaattagaacgaaacaaatcatcctcttttgtttccggagatatttccatatatgtttttagcaagtgttgcaatttgcatgaattcatttcggtagtcaaaatatcgatatcagcagtttctccgacctctatacctgataaaatcatagcagatgcacctataacataaaaatcaggacttatttcctgtaattcaacagttatacttgcaagactctgagttatcttatctttaattttcatatctccaataatatataacaaaaatacaaaatatatttcagaaaggtaaaagaacaggctttaataataccattaatgaatgtaatgagagcaactatcgacaaaattcctctttttctatgtagctcctcctgcaaatttcatcaatcgccttattataacaactacaaggttcagtactacgatattccaatgtcagggcttgataaaaaatattaagagattggtcgcttcctatccttggttgcataatctttacgcattttaattctaaatattgcctccatattagcaaatccttatttttccctagcaaacttttgacacctcaacagcataaacagtatttatgggataattttagaaaagctgaaacgagtaagcaaagaattattctatttccttaattcgttcaatctgtctatccagaaaataatcagtatataggctgtagtcttccatttcataaaacgctatcagtccttttctgtaattcagtatatccgaatctttgacaggatatacgggaatgatgccaacattcatcaaagaaatactttctatcattcttgcagtccgtttgtccccgtttgaaaatctcatcaaacgacaactgaaaggccatgacatacatcaaacatcatcccggccggattgcactcattttgctaaatacaggaagcgatctatagcttattgtcgaagatatgttacaagagaatgtatatatcctgtgatctggtgaagcggaagctcaggaaccgggttatagtagacagattggaactaaagctatgtacacactgcgagaaaactcttccgttacaccggttttacgctggcaggatatatatggtcaattttaaacattatagtaatgccatgaggaatagatatggatacaataagagcaattgaaggagagttatcgatacaaaacttcaagaagatattaaacatatataaat

SEQ ID NO: 307 - DNA, 3791 bp, Bacteroides thetaiotaomicron
atctaacatttaaataactgaatattatgatgaataagtttagacttcttttactagcatcaagtttgtttgtactgaatggaatagggcatgctcagacttctaccatgtcactgaacagttccaatcctaagatagtatgggaagtcaaaccgcaggcagatttgaataatatagggggagaacaaatctctacccccggttttaaaatgccggactatgtaaaaggcgtagttcccggagctgtttttacagcatatgttgaagccggaatcgttcccgatcctaattacgctgataatatatataaagtagatgagacgttttataaccgtcctttctggtatcgtacggagtttgaacttccggcatcttattcagcaggtaagcgtgtctggcttcattttgataataccaatcgtttcgccgatttctactttaacggagaaaaaatatcggggacaaagacatcgactaaagatgtgagcggacatatgttgcgttctaaatttgatgtgacacacttgattaagaaatcaggaaagaatgcggttgcggttctgattactgatcctgatcagaaaaagactcgtaaaggaaaagatccgtatggtgttgcttgtagtcccagctatctggcaggtgccggttgggattggatgccgtatgtgccgggacgtcttgccggaattacaggaaatgcttatctggctattacaggtgatgctgtgatggaagatccgtggattcgctcggaattgccgactttgcaacaagcagaactatttttctctacaggaatcaagaacgtttcttctgctccgaaagaagtggaagtttccggtgttattcagccgggaaatattactttctccaagaacattcgggtggaaggaaaagaaacagtacagttgtcggtggataagagcgattttgctgcattagtcattcgtaacccgaaactttggtggcctaacggctatggagaaccgaatctttatacctgtaaactgacttgttcggtagatggaaaaatatcggatgaaaaggatattacttttggtatcaagaagtatgagtataagatgatcaacaacgtagtgaattacccggtccttacattctttatcaatgggcagaagatttatctgaaaggtggaaactggggtatgagcgagtatttgcttcgttgtcatggcaaagagtacgaaacgaaaatcaagttgcataaagatatgaactacaacatgatccgtttgtggacaggttgtgtgactgatgatgaattctatgattattgcgataagtatggaatcatggtgtggaatgatttttggctgtatgtcgcttataatgatgtagctgagccggaagcattcaaagcaaatgctcttgataaagtgagacgtttaaggaatcatccttctatagctatctggtgtggtgctaatgaaacacatccggcacccgatttggataattatttgcgtgaaatgatagctcaggaagataaaaacgatcgaatgtataagtcttgttccaatcaagatggtttatccggaagcggatggtggggaaatcagccccctaagcaccattttgagacttcgggcagtaatctggcattcaataaacctgcttatccgtatggtatagatcatggttatggtatgcgtaccgaaataggaacggctactttcccgacatttgaaagtgtgaaattgtttattcctcaggagtcatggtggcctctgcctactgatgaacaattgaaagatgatgatgataacgtttggaataagcacttcttcggcaaagaagcgtccaatgccaatcctatcaattataagaaatcagtgaatacgcaattcggagaatcttcgagtctggaagagttctgtgagaaagctcagttgctgaatattgaagtaatgaaagggatgtatgaagcatggaatgataagatgtggaatgatgcggcagggcttttgatctggatgagtcacccggcatatccatcattcgtgtggcagacgtacgattattattatgatcctaccggagcttattggggagcaaagaaggcttgcgaacatcttcatcttcagtggaactcatctaataacagtataaaagctgtaaatactactaccaaagacttgaaaggcgcttatgccaaagcgaccatctacaacctgaacggaaaagaggttgcggcatatggacgtacaaaacagatggatgtaccggcaagtaacattgcagaagcgttcacgttaaacttcaatccgtacaatttggcttttggcaagaatgtgatagcttcttcatcatcaccatccagatcggcttctttagtagctgacggaggggcaggcagtcgttgggaaagtgatgcgagtgactctcaatggatttatgttgacttgggtaagaaagaaaaaatagagcatgttgtgttgaaatgggaaacggcacgtgccaaagagtacgagatccaagtgtcgaatgatgcgaagaaatggaaaacagtctatacaaacaaagatggacaaggcagtacagatgagataaaactttctccggttactgcacgctatgtgaaaatggcaggagttagccgtgccacagactttggatattcactgtatgaatttgaaatatatggtaagaaacaaaagaatgttgaggaactgactccgctccatttcatccggttagaactgactgacgcaaatggtaatttgatttcagataatttctattggagaaacggcgtgacagatcttgactatacagctttgaatacattgccggaagcagaactgtcgtgcaaattagttgataagtcaatgttatccgaagggaagatgaaattgtcggtaaagaatcattcgaaaactgttgcttgtgctaaccggataagattggtgaatacggctacacaagaaagaatccttcctgttatcatgtctgataattatataactttgatgccgggtgaagagcggactatttctgttgaggcggaaccggaaatgttgaaaggaggagtcagtgttttgctaaaacaatatggtaaggctgaacaaaagaagttggatatatgatatacgtagaaaactaaggggcacctttttaatttgaacaccagaagacattacctgtcctgtcttctggtgtttttaatttccctctatattgtgcctgatatattcaggaagagtagaaagtgaactttcttttttgaataacctgcttgatttaatagacaatgatcagtttattaatctattatgtgtacttgcttaatatcttttggaactaacaacagttcgtttcacatacgtggtcctatcgcttcacatacgtgatcccattagctcacgtacgtagaccgaacgctccacgtacgtgaaactaagaaatgttactgacaaagtttattagtcttgccttcttcatatattaatgttaccgacatttgttttatttgtaccatgataaatagtcctatgtatgaacagaatgaagaaaataaggctttagagttgaataaataagtgagcatacttgatttgtagtgggataggggtgacaatagaaacttataaaattctattatcacccttattatcaccagttattatcaccattacttgtttgattgatagctgtttatctttaaaaagtgacaagtgacaataaaaaactgtttttttcttagtgggagttacttgaaaaataaaacatttattttagtggttaagtaaacttgaatcgtctttttt

SEQ ID NO: 308 - DNA, 3781 bp, Bacteroides thetaiotaomicron
ataatgaaactaatctttacgcttatctttactgcatatagcattgccgctatacctatatctgtaacgaaagggcctgatgggataaaaatacattgtctcaactctgcaaataatcctttgctaggatctcctgcttacaaaaatgtgagaattgttgaactggaaaaagttccttttttccagcggataaataatatccggaaactggaaatgaatgatgattatttatttgtccagacatctgaaaagctatatacctataccttaaacggtgaattaatggctgaaatcggaagaaaaggcgagagggaagatgactatagtgagctaagtacattttatattgataacaagaagaaacaaatcaccattattgatggtgttcaaaacaaattgatcaattataatttttggggaaactatatgtttacagatactatttctgaaggtgctttcaaatggtgctatcaaactttattaattaataataatcaattgttgaattatcatgggatgagcatggataacacagaaccttattctttattcgacctgaccaaaaaagaagtcatcaaacgatacttttcatatcagccgattactttgggcaattatgtgtatcctttttcttggcatccaatgacacgtgcagataaagatattgatgtaattatgccattatgcgatacggtatacacatattcagctgcatcgtcttctttccagccaaagtatattatcgaaatgactcagaaaatggcgcctaaaaataaaatcagaaagaatacgccctcttatagtggagatttattaaagttggatcagcaggggtacttcaccggatttgacggaatttatgagactgatactaaaattttgttacaatatatgtatggtataactttaggatatttcttatttgataaatatactaaaacaggtagtttttatctgtattcacaaaatgataaaggcaaaacattcccttttaatgtaatcgttcattcctataaaaatgaatttgttgcattcggaaaagggaaggagttacgctcattaactcatataaaagacaaaaaggtccgagaaaaaatagaaagtctgggagataattctgcatgcttaattttttatgaacttgaataagaatagaaagcaatgaagcgggcattaaaaaagtttggttgggcattattgggacttttcatattgttccagatttatttttcagtcagagtatactggctggtatcttgtacgattccgacttattcaatgtctcccaccttggttggtggagattacatacttgtttctgtgcaaattcccggacgtagaatatacaagaaagatcctttacggccggaacattatcttattcatcgaaggaaaggagcacatggcgtgaagaagggagacgtggtagtattcaattttccatacgcaaaacagaatgagaaaatgattctgtgtgatgaagtgttttattgtaaacgttgtgtggcacttcctggagagatatatcaatggaggactaatgaaggaacaaaaactgtatatctgcctaaaataaatgatactatacgaattgatactactaactacagtgattactataaatgtattgaatatgaaacgggattacctgtgagagtatctgaagagggcaaggtgtatcttgcaaatactttactggaaagttactgtttccgacacgattactactttatgcggggagataatgtaaatgattcgtatgattcccgctattggggggtattacccgatgattttattttaggagtagggaaatgtatctggttttccagagatcctaagaccaaacagataagatggaatagaatatttaaaacaatataggatgatgatgaaatatataagattaataattccttgtattgtgcttgcttcggtattcgttgcatgttcatcagctgataaacggttggaatatgctctctcttttgccggagataatcggggagagctggaaaaggttttggaacattatggacaggaacctgaaaagttggaagcagcacgtttcctcatccgaaatatgcctcattggtatgcttacgaagggtggcagctggattctgttcgtcaaatgcttgcattgagaaagttggataaggaatcgattaagaaatggaagcaagtttcattttactctttacctaaagtttatgatgcacaggtaattactagtaattatttaatagagaatatagacctggcattcaaggtatggaagaaatatccttggaacagaagtcttgactttgatgatttttgcgaattcatcttgccttaccgcattgataatgaacctttatcatcgtggagaaaactttattatgaacattatactcccattctagactctctttatcatggagaagatgtggtgtatgcttgtcggatggtatgcggagaattgaagaaacgagagttgtattattttacagaacttattataccacacatggatggagaatttctgtatcatcatcgtattggctattgtagagaatcatgtgatataacactgtatgctatgcgcgcttgtggcattccagttgcaactgaattcttcagatattctcccgagtatcagcattatcatacatggaatacattacgggatacaacaggacgtttcattctatttgagcccggaaaaattgatccaacacgagataagataactacggataacagaaagaaggggaaagcatatagatattgttttggtgaacaaaaatcaacggctttactacttaatgtaaaggatataggaatacctaaatttttcaggaattcctatataagagatgtaactgccaattattttggtgaaaacgaggtgacggtacctatacaaaaagaagaacgatatatttacttgggggtatttcgtccgaatggatggatacctgtagatatggcgataagtaacggagataaggtgactttccataaccttgagcctaatatcatttatcaaacgctcattttcgatggtaagcagttgcatccggctggctattcgtttattttcagaaatggcaaggccgagttgcttgaacctgacaggataaatagagaggaagctgtgttgaagagaaagatgtctatcaaaccaactatctccgaatggttatatagatcaaccagaggcgctaggatagaagcagccaatgatactactttcagacaagctgatttattatatcagattaaagattcgtttacaactaattattatgagttctgtccgttgcattcgcatcagaaatataaatatattcgttatgttcctccggtaggcactagagtcgagttggcggagttggctttgtatgaagatactttaggtaaggcgaaaatttctatgcatgcgatgacttctttgaaaccgattgacaagatagggaacattacagatggtaatattctaacttattttcaggcaactgatatgacatccgctattacttttaagttagaaaaagaatcttccatcagtaggataactttttctccccgtaatgatgataattatattagtccgggcgatgtctacgaattgttttatcaagatggagtgtctggttggcaatctttaggaattcagactgctgttactcgggaggtccgttatattgtaccgaaaaatgcattgttgtggctcagaacccttacgaaagggcgggaagaacaaatatttatttatagagataaaaagcaatat

SEQ ID NO: 309 - DNA, 3729 bp, Bacteroides thetaiotaomicron
ataattatattaagtaatacatcagtagagttctctccttctttctcttttccttttattacaatatctatttttttaggtggttctttctctgtaaaagagatatcaaatcctgtttccttttttgttttcttgaaataagttgcatcatattctatgtcagttatctgaaaatgacgattgagttttgaaggctgtgattgtccttcaactaaaaaacacgcattctcaccttcaataaaagaaaaggcttttcttttaggaacaaactgagcatcaactctatatgtaagagaatccacttttccagtagctgccacaatagcaacaatactaccatttgcggtattacttacatcatttacaacagagggagtagattcttgatgagtttgcttcggctgtgtcaatgtcatatcttttaccacaggaacaacaaatttgaatatcttcacagagtctgccaaagaaaaacgcaattgttcgtttttaaactcttgtcgaaacactaaaagacggttaccatatgccacatcaatatcctcatcatactttaatgaatcacttgacagagcacggtttatttctatcaccttttctttttctttgcccataaggatctccgtatgtccttgcttataatttatttctaaaatatcttcacctttctggaacttaatttcaggcaacataataattgtatcccttcgcataaaggatttatatatagtaatagattccgacttaaaatgcttattccaaaaataataacctccactggcgccaatacatatcagcaaaatgacagttaatatgatcattcctatttttcttctttgaggtttagaaggcgaaccaggagtaatagaaaactctacaatctctaccgttatattgtccaatcccccattgtcccttgctcgttgtactaaatagtccacacgttcctgtgaccccatttcagattgtctgctgacgatgcgttctatctccctatctgatatcattccgctcaatccatccgaacaaagcaaaaaacaatctccagcttcgggtaaaatcgcatcaggcagtactgtagccggtttcatattggcaatgcctaaagcatttgttatttcgtttttccgtgggtgatgttctgcctgctcattagtcagttgtcccatatccaccaacatctgtacataagagtgatccttggttagttgttttatacatctgttacgtattaggtaaacacgactatctcccacatgacctatataaactttagagtcacggaccaacaacaatacacatgtagaccccattccctgcaactcaggttgtatcattgcctgatgaagtatagccttattggcagcatcaatagcttctccaatggcttcacgaggatcttcataatactgtccgtcaagaaaaccatgaatcgcttctacagctaagcgggatgccgtagctcctccgacgtgccctcccataccgtcacatacaacagcagcaaggccattgatcgtttcgaagttgcccatactgtcttcatttgcctgacgtttgcagccaatgtcggtacgccctgcaatgtgacaatagttatatatattttcttctttcattgcctaatttgctttttattgaggaatagccaagaaaatcattttggtagctcccaaaacaataacatcattcgtatacaactgtacacggtcacctacaaatgttccattaatatatgtaccatttgatgaattctgatcagcagcccagaaaataccttcagcctctctgtaaagtatcaataaatgctgggatgacatattgctatctcctggaataggaatatctgaagtagcagcacgtcctatcacatttctcccctcatagattttgtatacttcgcccattggattctggtcgtaagaaaccagtaagcctaccaaacgacgattgtcagaagccattcctgttccacccgtaggattaacgtgacgaataacagtagcacctcccggattattttgaccacttttcccaaggtctattgtatccgtttctgcgttcatatttccacctagcacttgagttttacctgtcgttgtatcatcgtcgagtactctagttgaatgggaagaaggacaaaaaggacaattatccccataaatactcgaatcatattgatgtccgtttatacatttttttgttgccatagttattataatatttagtatgattatttaattaattccaccgctcgtttgggttgtacagcctgattgtagccttgcgacaatcctaaatatcccgaaacgataacgcccgcaaactttcctctttcgttaaatactggcgaaccgcttgccccctgatgtatcgtaatattatgcccatactgatattcgcctctttgctgagtaatctctccgctctgattattcgcttccaaaccgatctctgtatctcccaaaataaaagattgagggaaacctatagtatatactttcttgcctaactgtaactccttatccgtaacgatatcattcagatcaactatattaactactccatctggagtcttctttgtatttacctgtataattgcaatgtctatcttatcatcattactcactttacaaattgagcatgggataaagtcgtttaccgaactcacatgagtatcattcaaagcaactcctgtataaaagatattatattttactgtaacagcacgcgccaacgctaatgctcctgcattattgggataccttttcacaatagccatttgaatagtttcctttactttttccgctttttctttttctccgtccagcaacgacacaacatgtttattggtcattatcttaccatctgtagaaatgaaaaatcctgtccctgacgatccgcctactccttgacacacatcatctttatcgtccaaatagaaataattccacgaatcatctcccatatattcgcccaacaacttatcaccaacactcgctacataagcagttttttgataaatcaacacaaccgatttctggtatttttcgtagatttcttccggaggcaacgaccggtgtgtccaataataccagatacctacactcactgccaacaaaatcaaaaaggcactgccccactgccacaagtaccctcctttgggaggagtcaaagcaaatatattctcccactgcaacggatactttttagaaattagcactacatctcctttcaccaagacatgagacgaaattctgtttccattcacataagtaccgttcgtcgaattgttgtcaatgattaacacgtccccattagatcgttggcataatatagcatgttcactcgacacatcatcaaaattcaaccgaacttgagcctccgaagaacgtccgatactccgtcgatcttttacatcaggcggaataatcacctgtcccttaccagcagataccactgtcttctcaggttgctgtattattctattccaatcaatgcttgtattacccaacttcactttgtcaccatttgacaattgcacctgattttgtatacgcatgctgttaacaaaagttccatttttagaattaagatctttaatacatactataccagaactcgacacggtgatgacagcgtgctgtgatgatacgcccgggtcacttaccacaacatcattaacgggattccgcccaaccttgataactcgcatagactcttccttat

SEQ ID NO: 310 - DNA, 3726 bp, Bacteroides thetaiotaomicron
gttaaatacaataaataaccgtcattattatcaattgaataacttaattttccattggataaatccgctttcaagttccttgcaaaacagattaccggattctctccatgcatttgtgttcctttttttatcaaccatagcataaaagatttattaccctctgcgagattgatttcaaaaggttttctttctgtttcagattcaatatttcctttttttacagtaacatcctctccattgaaaataatatttactacaagctgttcattggttacaatgaatggaaaaaaagtttctataaaccattgtttaaatgcttttgagtttgggtatttataaaaaaaagtttttgctcgtcctaatgtgttttgtttgtttaagtatgctgtcagcttggtataggtatcttttatttctggcatttcttctacaaactcatcaaaattaaaaagtccatcagatgtatttggatatggaatggttcgcttttgatatgtaccatctttatccttatacaccgtttcatattcagatgagtcggtaaagtatacaatagccaatctcccttggcccaaaggatggaaattaaactgctccttttccaggttttttttatcaagttcttcaaaatagagacgatttttttctgtaaagccttcaccattatcccttaattcgattttacattgattttcatcaaaagtaatattcaggtctagctgagggataaaattcgtttctttattttgccgaattaaaacggcatgtatggaattggaaattatctctcttaataaaagaaagaatttttcacggctattcttatattctttctctgccctgtattgaacgtttgatttctgttccatgatgatactacaattttttgaaggctattttaaactcaacatatattctacttgacgataaaagatcacttggccacttcaaccgacatcttacggaattccttaagcaaactccttaattccaacgtagctttacgtgctttcatacctgccacattgttgcctttggaaaccagctgttccacatctttttgaaaacggcaaattttctctgaatgtcaacaagaagtttgtttatatccttaaaaagtgtttattgatgagtgattttataatcatagttacaaaaataagatttaaattccaaataattaaatgttccagtctctttttattgaaaagactacgaaggacaaataaggttcaggagcaattcctcgtttggaaccacttgttgaaatcgcaatgataaagttcttagcctatatggagcactccagaggttttatactcatttttttgatacttattttgtacggtggggattttttctttacctctttcgcatgacaatagccgactatccatgactattcctgccagtgtgccggtcgtgcttgcctctcatgtttttttcccttatattcgctccgacatttaaatgagttgaaaatatggaaatatgctacatcgagaccggtgtccttgagaggatgctggtacgcgtcgagagcctgtccacacatgtggacagattgtatgagagaaaccgctgtaaggaacccggcgagtgactggacggccaggatgtctgcctgcgccttgacatctcgccgcgtaccctgcagaccctccgcgataccagacggctggcgttcacccgcctccagcggaagttctattacaaacccgaggatgtggagaggctgatgacctacgttggcatcagacgcaaggagaaggcggtgagggaaagaagaaagaacggaaacctttaaagaacggaagaaatggaaggaattatcgataaggaagacgggcgcatccgcaggttctttgccctgctggacaatatagagaaaaaagtggaacgtcttgcctgtgacaaccgtcctcccttcaacggggaacggttcctgaccgacagggagctttccgagacattgaagatcagccgcaggtgcctgcaggattacagggaccaaggacggattccctatatccagctcggtggaaagatcctgtacaggcagtcggacatcgagaagctgctggaggagaattatcaccctgcattggtataatatcgtattcaagtttaaagattgccgccggaattgcatttacgattccggcggcaatccttatttagtcggcggtttccttgccggccgcatccgcggactttcttctttccatcagccggtccatgtccgaggatatcttccggtcggtgacctgggcgtagacctgcgtgctgtcgatgtttgtatggcccatcatcctggcgatgctctctatcggaatacccgcggtcagcgtcagggtcccgaacgaatgccgggccatatggtaggacaggttctccctcatccccagcgccacgcccatcccgtgcacctcgtaccagaggacgtcgcggacaggcagcgggaatatcggcttgccctcatccgtggtgttgtaaagccccagtatctgttcggccacggggtgcagcgggatgaacgcctccacgtccgtcttggcccggcggatgcggatataccttctcccttccgaggtccttccgatatgacggggatggagagccctcgtgtccgcgtaggcaagaccggtcatacaggagaagatgaatgtcctgcgcgccagctccatcatcgggtcgggcatcggggtctccatcatccgcttcagttcactgcggctgatatgccttagtttaggtgcatctttcttctcgtatgccacatcttctatcgggttggcccgcaatacttcccggtccacggcgatgtagatgagccggttgagccagcacaggcagtggttcacatgcccgttcctgtgtcccagctccttcttgagaaagaccttgaacgattcggcgaactccccggtgatgtccgaaaaggcgatgtccctcatcccgcgggattcgacgaactgtctcaggttaagctgcgtggtcttcgactggcggtaggtcgaggtggagttgatctccttggagcggaccctgagacgttcgcgttccacctctccggcctgcaggagatattccggcacggaattggcacctgacacggtggtcttgagcagctcggccgtgaccaccccctggttcctcagcaggttggcgtacgcctcctccagccggctgcggaaggcggcaaggcggttgttctccctgactgttttgatttcacacttcttgctgtcccagtcaccgggcctgcaatagatgccggtggtaacggctgacttcttgccgtcaatgctgatccggcagaggacggcggtcgtgccgtccgatctgaccttgttgcggttgatgtagaataagagtttgaatgtactacgcatgataatgatattttttaggattaaagaatgagtttcaaatcacgggtcgcctcgatgaacctgtccatgtcctcgaacagtttcttaggggtcacgcgcgcgtagacttgggtggtctttatattggagtgtcccagcattttgctgatggtctcgatcggcaccccctcctcgagcgtgaccagggaggcgaaagaatgtcttgcacaatggagtataaagtaaaaagcaagagctaacaagattgaatagataaatcgtaacgtgttggaaataagcagatattcattattttgcttaaagtttaaaaagcaatgaagcgcagaatatt

SEQ ID NO: 311 - DNA, 3663 bp, Bacteroides thetaiotaomicron
ggtctttatttactaaataaaagccatcgtaatatcctccccaacccatattcgcatggaaatagaaatcaaagtttttaactaaatatcttgtttggggtctccagtatgcaaaaccatctaaaataaaagcatggcttcccccacgattagaggttgcagctatccataccaacttagctagttgtaaagattgaaatgcagcattaccatcccaaccatttttaagaccactagttgaaaaaaaacgatagaaaaagctagatgtatcagaagaataagtaccagacccagtaacataaccacttgaatttctaacaggctgtgtattagttgctatatagatatattttatcaatttagcaaccatttctctagttgtttcagaggaaggagtttgccaagatgaaggagcaataatttgtttttgcgctttcaagatattccaatcaattttcagaccatcaaccgttaagtcaggttctaaagaagccataatctgtgctattgaaataacagcacaaccagcagggacagcctcgtaagtaggtgagcctgtatcataaagatcacaattttctttctgtagcaaatcattatatggtgcgtcttgattccactctgtactactacagtacagaccagcaaaacctatcggatttccaataggaaatgttggttcagaacgggatagaatctcatcctttactataattatatcttgaatctcatcatacctcacagccttcacgtttaaagtttttgctattttcgctaatgttttagctctcagttctgattttaccttttcataatatttggcatcttccaacagactcaattctgataaatagagcatagacttagaatctacatatttaacagagtcttttaaatctgttttaggcaaataagccattatctttgcaaaacgttcatcagcaggaacataagccacacctttcccctcatcacttaaaaattcaattttataaacaggaatagtagtaagattagttgaaccgactcttgtttttaatccagaagaactagatacattatatgtagaaatagccataatttttacattattatttctagtctgtaatcctgttggattaaagtccaaaacaagttgcttagcctcttctgaagtaattattccaggattatcataagcaatgctaatatactcatctgaggataataaaattttagaatcattcagattatcttgcatacctagttcattactacatgaagtaaataaagcaaggataactaacaaaaaatagtatttcaatttcataagttatataatttatggattttgctttattgtatatgtgctcattgatgagccaatataagaaagccataagattatctccctaatatcaccagatgtattttcgtctacaattactgtcatcaccgaatcctcctgttctttttttattgaaaaccaatcttcttcaagcaaaaaagtatgggtcatttttacattgagagcaatagaatccttattcacaacagtcccagcagcatgcaatctccatccttccgcaggagtcataataataaaagcagtatcacctttattatctaataatggaggctctgatatcctgtggggaaaatcattgatatatatttcatcatcttctgcatcattacaactaacaatagcaagaagaaaaatcagaataatatacttcattcttttacaatataatatcacagatcatattaaagcctgtgtttaattcatagcctccagcttcaaaagatatcgacatatctttattaactaaatagaagccatcataagacccagcccatcccatattcgcacggaaataaaaatcaaagtttttaaccaaatatctcgtttgaggtctccaataagcaaatccatctatcacaaaagcatgagaagcttttttagaagcatctgaaacgccaacccataccagtttagctttctgtaaagacaaaaatgcagcattaccatcccaaccatttatcaaatctcctgttgtaaaatatcttctaagaaaatccctagtttgaggtccagatgtaccagaacctgttacccaatttgttgttttgtcatattctggatgagtaccagaaaggtcataaatatgtttaaataatttagcaaccatagttctaacaatctcaggtgatccctgatttggcttccagggtagcggcattagtatctgcggctgtgctttcaatgcttcccaatctatttttataccatcgatagttaagtttggttcaagtgaagccataatttgtgccatggcaacaaccgaacaacccgcaggaacagctttatatacaggttccttcccaacatttggtgcacaatatgctttctctaataaatcattatatacaggttcttgatcccaatttgtcgccatacaaaaaaaaccagcccacccaatagcattgccagcaggatcttgaggggttgcacgtgaatctagacaatcctcgacaagaatcctatctttgatctcattaaaatttacggctgcaacattgagctctttcgatattctttttaatgtttcatctctaaattccaatttcattttttcataatgtttggcctcctctaacaagctttgttctgacaaaccaagcatagccttcgcaccaataattttagctgtatcctcaagatttaccttgggcaaataagccataacctttgccacacgctcatcagcagaaacataagcaagtcctttccctgcatcactgactatttccatttcatagacaggaagaagaattgatttgtctgtaaccgatcttgttaccgcattgctgcccttttcttcaatattaaaagaagagcgaaacttcacaacaatattttcattacctctcgtctgcactctgttaaccccaaaatctaatacaagttgctttgcctcatcaggagttattactcttggattatcataagcaatactaatgtattcatccggagataatacaattgagttagattctatcggcttattatgtaaatccaaaccttcttcatcattacatgaagctaataacgacaatacgaaaaacaaaaaataatactttaatttcataataaatatttttaagtttcaattgaatatgtaatctgtacaataataaatcaatgttatctttttcttatatcaggtataacacttaattgcgtatcccaataggtattaccaccagtctcaaatgaaatgcttccatcattgtttaccaaataataaccatcagaattacctgtctttccaaaattacaatgaaaatatgcattactgctagaagattcgttctttgtcattgcataaccatccactataaaagcacttccattacattctaccaaaacaggacatattttaataacagaatttttaactgtttctatactccatttttgaatattaccacaattggttattccacttcctgaatttagatatttatacacattagataatggagttgatattgcagtaatgcaagacactaatttagattctgagtccggccatacatcagtataggcagttccccaaactggagaagaagatgtactatcatatacatatttaaataaagatgcaaccatattcc

SEQ ID NO: 312 - DNA, 3585 bp, Bacteroides thetaiotaomicron
gagttatttaacgcctgatggtgttaaaatgtccattggtggcgttcagacatatatatataatttgtgtgcaattttcacagaagaaggatatgatgtctcaatttatcaactttctaatgagttctttattaagacttttggtaaagttactgtttacggtgtagacagaatgaatgtatcagtcaaaaaaagggctggtacactttatgaatttttccgtcccaaatgggaagaaggtgatttgctaatttggggtacagatggttgtatctgtaagaatgacataaagaacagcattgttatccagcacggtattttttgggatatccctaatgagtcaaattcgtattactataatagcctaattgggtatttgcataaggctatgatggcttggaggatgatacagagagcgaatatggctgctaagatagtttgcgttgattataattatgtgaattggcatagagctattgtacaaaagcccaaagtcttatttaatgttgtgcccaattttactcatttgccagcgtcggttcctgttaagttagaagatggaattgtgagaattattttcgctcgtaggttttatgagtataggggaacaagaatatttacggaggctattaaaaggattctgaatgaatatgctaatgtagatgtaacgatggcaggtgatggtcctgataaaggatggatgaaggcacagttagtggattattcaaatgttcattttatcagttataagagtaacgagtcgttattgattcacttggataaagatatagctgttgtaccaactgtaggatcggaggggacgtctctttctttattagaagctatggcttcaaaatgtgcggttatttgttctaatgtcggaggaatgacgaacatcattcttgatggctataatggtttaatgatagaaccgacttctgacaatatttaccttgcgcttaagcagttgcttgataatcctgagcaacgaggttgtctagcatgcaaagcgtatgagacctcaagtcacgcattttcttttgaaaattggaaaaaacgttggttaaacattatcaagtaatttatgaaatctctatttcagatattcaaacttcgaagtttcaattcgcctcaagatagacgaattacttttatgctagcagcgttgttgctcgttccaagtttaaacttttatgccaattattatgtgcagtatgttttcggacagcagtcaataagtgtagtttcttatcttgtattggcattaattggtatcttctcgtataagtatttatttactagttcaagtaaacttcttattattgtcactttagcagctctatttggtgctgtattgtcataccttttgtatccttctattaggttaacccttttgttacctgatttcaatccgattgagagtggtatgctgatgcttggcttctattgtgttccagctttgctattgggatacaacaataagaattggacattcattagattggcattttattacctagcattttttgtcattccctcttctctgtatttctataacgcatattatataggaatcagtttgattgatagggtagattatatgacttactcttataatgtacttccttatacatgtgcttgtttatacgagggctttacgaataaaaaaaaaatgggtatcttggtagggcttgttggcgtaattgagatttttgcagtaggtgcacgtggtgccctagcttgtgccttgttatttgctttattagtgacttttacaaatagttccttaaaactcaaattcttttctgcttgtgtggctttgaccatctatctcaatcttacaaaagttttgctatggttctcaaatttattcgactcattccatgtgtattccagaactctaagcttaatgttgaataatgagtttgatacttcaaattcgagagaaatgattagaaatgcattgttagaaaaggtccttgattgtcctatggggtatggcttgtttggagatagatacatcgcttctgtatctgcatctaatagtcttacttcaagcacttatgctcataatcttgcagtagagtttatttgtgattttggattaattggtggacctcttttattaatgtggtatttgtggcgcatttataaatctatgagcataagaatagaagatcgtagtattcattttgcagtattgctattagttgtttgtgggtttgcgaatctctttatgagtggttcgtatcttgcctctattatgttttggaccttaacaggcttgcttattagattacgccgatttaagcaaaattaaagactctatgaagaaaatagttcatataaatgtctccttaaataagggaagcacaggaagaatagctgagcagatatgcttgctggcagaaaaaaaaggctttgattgtaccatcgtacatgggcctatagctgtaaatgatagtaaattaaagtcgattgaatgcggaaatagatttactaataggttgcatgctttgtttactcgtctttttgacttggaaggaaggtgttcttatttttcaacaagacgcgttattaagaaactaaaggtaattgatccagatattattcacctacatgtaatacatgaacattacataaattatccattgctgtttagatatttatcggaatctagagcaaaagttgtatggacaatgcatgattgctgggcttttacaggacattgttgtcactttgactactacggttgtcaaaactggatgttatcatgccaaatatgtaaatttaaaagcacttatcctagaacagttctgtcttgttcgagaaagaattatgccaaaaaaaaaggaagtttcttatctgtttctaataaacttactatcgtgccagttagtcattggttggagcattttcttgaggattctatgcttaagagatgtaatgttcaaacgatacacaatggtacgaatttacatgattttattgtgtataataccgatgaagtgtctgctataaagaaaaaatacaagttgtgcggtagacaggttgtaataggctgtgctgccaattgggaggaacgaaaaggctttaaggattttgtggaaattcgaaagaatttggacgataccgtagatgttttgctggttggcttaaatgagaatcaaatggatcaagcgacagaagctggaatcattggcataaaaagaactgaagatgtgcatgaattggcaaagttgtatgctttatctgatgtgtttgttaatcccacatatgaggataatttcccgacgacaaatattgaatctttggcatgtggtacccccatcgttacttataatacaggaggaagtcctgaggctattgatgaaggaaccggttatgttgttgagaaaggagacacagcttcattggttacggctatagtaaaagttttagctaatggaaagtgtttctataccgataaatgtagaaaaagagctgaacaatattttgatatgaatgataggtatcaagagtatataaatctatataatcacatattagatgaaaaagaaaaataggatttgctttatatttaac

SEQ ID NO: 313 - DNA, 3460 bp, Bacteroides thetaiotaomicron
attatatatttaactattttcatttattagctatacattctttgtattccttgtttgctatatctttggctctatcatattttgcagctgcttgtattaagcagccagatggcattgaaccattttgacagttagcgatagcattgtcataatcagcttttgcctgcttatatgccgcttgtttttgttcttcacagctactagtacttcctccttcttcgcgtgttttcaggagttttacttttgtaagttcgttactttctgcatatagtataaagagttgtgtccgttcatctgcgcttaatcttaaaaatcttgtatgtttaatcaggttttctttagcttttgccagttgctgtagttcattttctagattggctttcctcatgaagtcttccacgtagtcatcatcattcagattttccataagtttgtcatattcttcttcacttaaaatagaagtgtactcatgaaacttatcagctaaaagctcggagctcatttcgaattcccaaaattcatctgaactggcgatggaatcaataagagtgcttccattatttatcatttttgatgaaagtgcacgtgtattagttacctcgtttttttctatttcttcagagtaatatccgtctgcgctacaactataaataaaaaaggaagctaccagtccgcaggctaatgccattacataatacaaagtgtattttttcttttttgtgatcatattctgttttatttaaatgtgtatgcaaagtaacgaaaaatagacttattttagggataataatcattcaataaaaggaaaatatttggtctagtgtcaatttggtcatgtttgtgatgttacaatttagtgtaaaatatgaaggagaatcgctcctagaaagctcacaggcgctatatgatagcttattggtgtaacacattcgttgttaaggtttagtccagtcgttattatccgaaataaaaaattaagcttaactacttactgataagtacaagacttgataatgagaagtacttaagttgtctgattcttgtacatcagttgagtaaaagatgtacaacgttggagtagacgatgtactacgattgaactaaagatgtacagcgtttgatctatactattaggatgtcaaatctgaaagggctgaatgttggtatcactttaaaggataatattcattcaaaaaaggataatatgtggtcagagaaggaaagtttggggtatttcggttgttacaatattagggaaaataaaaaaatatcctcgctgtaatcctcctgtggcacattctacatgctgtaggagtgtaacgccctctttttctatggcaaaagaacttgtaaatttgcagaaaaataacacgaaatcatttatctctatttttctgataattatgaaaatattcacaaagttggtatctgtctttttgctcgtagcaattggtagtctctttttcttttcatgtgctgaaaaagaaaaatgcactccaatggtttcattccttgaaaccgctcttcagcaggcaggagagaaccgtgtggaactggaaaaggtcttatctcattataaaactgatccggcggatagtttgaaatataaggccgcttgttttttgatagagaacatgccttattacacctattataagggcaagcagttggaccgatatcttacttactatactttactacaggaaacacgtggattggggatttctccccaagtagtggctgactctgtttgtcacatgtatggggcattgtatttagattctttgcaatcctatagagatattgaaactgttgattctgcttatttatgtaataatattgaatagtcatttaaggtgtggcaggaacaaccatgggggaaacatgtttcgtttgcagatttttgtgaatatcttcttccttatcgtattggtgacgagaccttgactagctggcgtgaatctatttatcagaagtataatcctttgctcgattctttacgtgcatccggagtacttgataaagaagacccgattgtggcagcccgttgtttgctcgattcaattcgtaaaggaggagtggtatttactactgccgttcctgccagccttcctcatgtgggaccggaagttgcgcaactgaaagcaggtagttgccgggaactttcagactttgtcgtttatgtttgtcgtgcgttgggtattccgtgttcaattgatttcatgccgattcgcggtgatgagaatgatagccatcaatgggtagcattttcagataagtatggcatactttattatcatgaatttcctaacggtgtgagtgaagtacgaaaagacgcaatgtgtggaatgcccaagataaaggtctatcgcaatacctttagtctgaatcgtgctatgcaggaagaaatgctgaaattggatactgctattgttcctcttttcaaagatccgcatatcgtagatattactttcccttataccaaagatttcaagaaagaactccacataccaaaggacgctctatataaaggtaagccacgttcaagaattgcttatctatgtgccagcaaacggatggattgggagcctgttgcatggacagagttcgatggtaaaaacattgtctttacggatatacaaaaaggacccgtcatgcgggttgccacttacgagcgaggacgacttcgtttttggaccgatccttttgaaataaatgtttccaatgagtttcattttttcactccttcggatagtgtacaggatgttactttgtttgcaaaatatactttgcgggcagatgagatgtttttgaatcgtatgataggcggaacatttgaaggaagcaatgatcctgattttcgtgaaaaagaagtcttgtacttgataaacgagaaaccgaaaagactacagactgttgttcaatcgtattcttcaaaatcgtatcgctatgtcagatatataggtcccaaagattcacactgtaatattgcggaggcggctttttatactcctaatgataccgcttctttaaaaggtaaagttataggtactcccggatgttttcaaaaagatggttcgcatgagtatacaaatgtatttgatggggatgtcacaacttcttttgattatatcgaaccttccggtggttggtcaggtcttgatcttggaactcctaagcagataggaagaattgtttatacgcctcggagttatgataactatattcgttcgggtgatgattatgagttattctattgtgcaaggaggaataattggaaatctcttggagaccaaaggtctaaagcggactcgctgatttatatcaaaattccagtgaatgctttacttttattatgtaacaatacacgaggaatacaggaacgaatatttgtgtatacagcagctgaacaaatttggaagtaaattcagatatgattttaataaaaacttgatttatt

SEQ ID NO: 314 - DNA, 3441 bp, Bacteroides thetaiotaomicron
ggttgcgacagggctctttcaaatttgttatatctttaatgaggtatatacatacgagcactgctcccttacgactgtcggagttgtaacgggcgccaccaccaatatgtatttactaacattgttctcattgtcttttgttatttatcggggacaaatatagacactttgtttgaaacaacaaacaaaatcttactttttttctttttcctcttcatttttctgatatagaacaattttctgcctgatctgttcttataaatattgaatatttaaacgaaaaacaattatgaaacagagaaaagtcttagtaggtattgctattgccatttttattatattattgctttattggttattggtagctgaagatatgaaaccttggctgtccgctatggttccttcagccttgcaacaattcattgcctgatcccgacaggtttcagataattggcgtatatttgcaaggttagtaactaataaccaaaataacaacaatagacagatatggaaaattttatctttcagaatcccgtaaagctgattatggggcatggaatgattgcccggttgagcaaagaaataccatccgacaaacgtatcatgataacttttggcggaggcagcgtgaaaaagaatggtgtgtatgatcaggtaaaagaagcgcttaaagaccattttacaatagagttttggggcatcgagcctaatccggccatcgaaacgcttcgcaaggcgattgctttgggcaaggagcagaaagtcgattatctattggctgtaggcggtggttctgtgattgatggtacgaaattgatttccgcaggtttgttatatgacggtgatgcatgggatttggtacttgccggacgtccggttaccaagactgtgccgctttctaccgtattgacacttcctgccacaggttcggaaatgaataacggagctgtcatctcccgtcacgaaactaaggaaaaatatcctttttattccaatttcccattgttctctattcttgatccggaagtaacctttactctacctcctcatcaggtggcgtgcggattggcggatacattcgttcatgtgatggaacaatacatgacagttgccggacaaagccgtgtgatggaccgttgggcggaaggtatcctgcaaactctggtagaaatagctccaaagattcgtgagaaccagcatgattatcagcttatggcagatttcatgctttctgcaacaatggcattgaatggcttcattgcaatgggagtgtctcaggactgggcgactcacatgatcggtcatgaaatcactgcattgcatggactgacacatgggcatacgctggtgattattctcccggcaactttacgtgtccttcgggaagcgaaaggagacaagttggtgcaatacggtgaaagagtatggggaattacttccggaacgaaagaagaacgcattgatgaagcaattgatcgtactgaagagtttttccgttcattgggcttgactactcgtctgcatgaagaaaatatcggtgaagaaaccgttttggaaattgaacgccggtttaatgaacgtggtgccaagtatggagaaaatgagaatgtgacaggagccgttgcccgtaaaatattggaggctgccctctgatcgcttcttttgacactgttttgaactaaataatagtcggttctatctttcattctcctccttcccgaaggaggagaatggagttactattgtgtactactgtttagttcattcctaaacagaaaggagtaaaactgtacaagtatgaattagtgtgtacagccatttacagttaattatttgatttttgggttatcggaagtctgagccaaaagcacgaaccttctccttctttagaatctgctccgatagtgccgcctaagcgctctacgatcacccggcagatagccagaccgagtcccgtaccttttgcgaatgtattcagcttgacgaaacgttcgaatacctcgtttattttatcctccggaatcccaatgcccgtgtcttttacatagaagtagatttcatcttttgcttcgtcaatccgatatcccatttggatggaacctttcggagtgaacttcatcgcattgtttgtgaagttgatgattacttgcgaaagacgtacgcggtctgtgttgagaatacattcttccgctttctccgtgaaggtgatcgccacgtcgggagaagtgtttttctcttgcatttgcctgcaaataccttccatcagatcattgatatcggtaggggcgaggctaaattccatcgttccggcttcgattttggaaagatcgagaatatcatctatcaattgcagtaacaactcattgttactggacactatcttcatgtattcctgtttctcttcctcttcacccgtttggcaaatcatgtcagagaatccaataatcgcattcaacggagtacgtatctcgtgactcatgttggcaaggaaagctgatttcagacggtttgattcttctgctttttcttttgcttcctgtagcatcttgtccattttcaccttttcggtgatgtcttcgaagcgcaacagaccgccgatgatttctattccttcattatcataaaccggagtagctgtcacttcaaagtctacctgatctatctggatagtatggcgtatgatttttccttgttcaatcgctttctgaaaggcgcattgttcgcatggagtatcccggagtgcacttgttttgtagcagatttgtcccggtgtataatgccttcctttcacgaggctggcaatttgcgtcgtttcttcccattgtaccagatagtttttgtcgatataaatgagcccgaagttgacgctcttcaaagctagcttttgtttgttcagcgctttttccagttcttctttggcggcaatcagttctcgttcgtaagtctttagccgggtgatgtcccatcgggtcactaacagccattttttcttttccttccatttgataatcgattttacggcaattgtatcatgtactgctccgtccactgtgctgtagctttcttctgcccggtatatcttgtctgcctgcacaagtgattcatccacatcacggtattttctgccccgttcttctccatagatttcgtagtctgtgcatcctattgcttcttcccgcttaatgccggattgcagttcggattctttgttccagtaatagtatcggaaactattctggatatcttttaccataatagggaaagggaggttatcgagtatatcgaataaagaatgatagtaatcctgttcttttcctatattctttttaagttgtcgtagtctgtataataaaaagcagatgatcaggagtaaaaagcctattagtaaataataataactccaatgctggtctgtaatccatataacggatagtatattgt

SEQ ID NO: 315 - DNA, 3428 bp, Bacteroides thetaiotaomicron
ccttcatagagtgtttctccttttattattctttaatattaatgtaaaagaaaggggtacaaaatgccccttcgtccgtcttcttggtatgaagaaaaaagaacgaatgaaaatatatacattactgcttggcgcattggtcgcttgcccgatgcaggcacaaacaatgcatgactgggagaatcatcatgttctccagattaatcgtaaaccggcacgggctgcttttactcctttctccgtacagaaaggagactgctcgatgtctttggacggaacatggaagttccgatggactcctgttccgggcgaaagaatcatagatttctatcagactgattttaatgataaagactggaaggactttcctgttcctgccaattgggaagtcaatggatatggcacgcctatttatgtatctgcaggttatccgtttaagatagatcctccgcgagtaatgggagagccgaaagctgactatacgacctataaagaacgaaacccggtcgggcagtatcggcgcacattcgttttgcctgtgggatgggaagcggacggacagacttttttgcgctttgaaggagtgatgagtgctttctatgtttggataaatggcgaacgggtagggtatagccaaggtagtatggagccaagtgaatttaacatcaccgactatctgaagactggtgagaatcagatagcattggaagtgtaccgttatagtgacgggtcttatctcgaagatcaggacttctggcgttttggcggcattcatcgtagtattcatctgatacatacacctgatgttcgtatgcgtgattatacaatacgcactcttcctgcatctgccggcaattataaggactttattttgcagatcgatccgcaatttagtgtatacagaggtatgaccggaaaaggatataccctgcaagctgtgttgaaagacgcaagtggaaaggagataataaagttacagggagaggtggaagaaatactggatctggagcataaagcaagccggatgaatgagtggtatccgcagcgtggaccacgtaagacaggacgtctgtcagccatgataaaatcaccggaaagatggacagcggagacaccctatctttataaattacaccttactttgcagaatgcggaaggaaaagtgatagaacaggcggagcagtcggtcggtttccgtactgtagaaatcaataaaggacaattactgattaacggtaatccggttcgcttcagaggtgtgaatcgtcatgaacacgatccacggacggcacgcgtaatgagtgaagaaagaatgcttcaggatatactgctgatgaaacaggcaaatatcaatgccgttcgtaccagccattatcccaatgtgagccgctggtatgaactctgtgatagtttagggctttatgtgatggatgaagcggatatcgaagagcatggtctgcgcgggacactggcaagtactcccgattggtatgctgcattcatggatcgtgcggtccgcatggcagaacgtgataagaactatccaagtatcgtgatgtggagtatgggaaatgaaagcggctacggaccgaactttgcagctatttctgcatggttacacgattttgatcctacacgccccgttcattatgaaggtgcgcagggagtagatggcaatcctgatccgaagacggtcgatgtgatcagccgtttctatacccgtgtgaaacaagaatatctgaatccgggcattgcagaaggagaagacaaagaacgtgcggaaaatgcacgttgggaacgactgttggaaatagcggaacgtaccaatgatgaccgtccggtaatgacaagcgaatatgcccattcgatgggaaatgcgttgggcaactttaaagaatattgggatgaaatatatagcaatccccgtatgctgggcggtttcatatgggactgggtagatcagggaatttataaagaattgcctgatggccgcattatggtggcgtatggcggagacttcggtgataagccgaatctgaaagctttctgctttaatggtctattgatgagtgatcgtgagacgactccgaagtattgggaagtaaagaaagtatatgcaccggttcagttggccgtcaacaatggacaattgatcgttacaaacaggaatcatcatatagacttatctcagtatcgctgcttatggacattgacaatagatggtaaacagaaagaacagggagaaatcacattaccgaaagtcgctccgggtgagagtgaaacaattactttaccagctttccgttccttatcggacaagaaggctttaaacagaaaaggcaacaacagcaactcaacgaatacgctttctgattgtctgctaaaagtaagcatcgtattgaaatctgatgctctttgggcgaaagccggtcatgaagttacttgggaacaattctgcttacagcaaggagaattgttgtctgccgatctgatcaataaaggagcgctgcaagtaaaagaggatgataaatctttatcagttagcggacgcggtttctcggttcagtgggaaaagaaagcagtcggaagtataacttcccttatgtacaatggcaaagaaatattgactcagaatcattttccggttcagcctgtcacgcaagcattccgtgcaccgacagacaatgacaagagtttcggaaactggctggcaaaagactggcaactgcatggcatggaccatcctctgattagtctggagtctttcgatcatgaagtacgtgcagatggggcagtcatagtacgtatccggacgactaatttatataaagaaggtaacgtgacaacgacatccgtctataccatttcttccgatggagtcattgatctgaaaacaactttcttaccgcaaggagtacttccggaattgcctcgtttggggcttgcattctgtctggctcctgcctataatacctttacatggtatggcagaggaccgcaggataattatcccgatcgcaagacatctgctgcaacaggactctggaaaggaacggtagcagaacagtatatacattatcctcgtccgcaggatagtggaaataaggaagaagtacaattttttacgctgacagacaaacagaataaaggtatccgtgtagacgcggtagaagatgtattttctgcctctgctttgcattatactgcacaggatttatataaagaaactcatgactgcaatctgaagccacgtcccgaaattattctcagtatggacgcggccgtgctcggattagggaatagcagctgcggaccgggcgtactgaagaagtatgctattgagaaaaaagaacatacgctgcatatacgcatcagcaagcagtaaaataagaattgatacaaataaatagtaactaacacaataataa

SEQ ID NO: 316 - DNA, 3382 bp, Bacteroides thetaiotaomicron
gtaccctatttattataaagataaactctatttacgcccgaagatgcttactgataatcttcgctttgctccgggggatttgttcgatgaacaggatgtgcagcagacttattccaatttcggacgtctgtccgccttgaaatataccaatatccgttttcttgaaaatcaggtaggggatacggcgaagcttgactgctatgtgatgttgaccaagagtaaacacaagtcggtagcttttgaattggaaggaaccaattcagccggtgatttgggagcagcagcttccgtctcttttcaaaacaggaatctctttcgcggttcggagacttttatgatcaagtttcgtggtgcttatgaagtgatttccggacttcaggcaggctattctaacaataattatacggaatacggggtggagacaagtatcaactttcctaatttcctgtttccttttctctcttcggactataaacggaagattagggccactacagagttcggattacagtataattatcagatgcgtcccgaatttctacgtaccatggcatcggcttcatggagctataagtggactcaacgccagaaaatacaacattgtatcgatttgattaatatcggtttcctttatttgccgagaatttcggagaggtttaaggatgattttattaacaaagggcagagccatattcttcagtataattatcaggaccgtttgattattaatatgggatatagctatcattacaatagtattggtggtgccatcattaataatacaattgcttccaattcatattccatccgttttaatttcgaatcagcgggaaatatcatgtatgctttatccaaagcaacgaatatccgtaagaataatgatggggaatatgctattctgggcattccatatgcacaatatgtgaaaggagaatttgacttttctaagaatataaggatagatcatcgtaactcgtttgcgtttcatataggtatgggcattgctgttccttacgggaatgcgaagactatcccgtttgagaaacaatacttttccggtggtgccaacagtgttcgcgggtggacggtacgtgacttggggccgggctcttttgtgagggatgaaaataccaatttactggatcagtccggtgatatcaagctggatgccagcattgaatatcgaagcaaattattctggaagtttcagggagccatctttgtggacgccggtaatatatggaccattcgtgattatgacaatcagccgggaggagtctttaaattcgataaattctataagcaaatagcggtagcgtacggattagggcttcgtctggatctggatttcttcattcttcgttttgacggaggtatgaaggcgcttaatcctgtttatgaaaaggggaaagatcgttatccgattatccatcctaagttcagtcgtgattttgctttccattttgcggtaggatatcctttctgatcaatcattgctaataaaaaaggagatgaaactggttgtacggtttcatctcctttttgtttatggtatatgcttttaacgagcggcaaacatcaggttgctcatagtagcctgacgggcagccatcataccttgagcgtccaatgtaacgttcattttttcgccgtttggtaagaacagatcagcagtaccgtcgttattcatctttagcaactcagagctttcgccgtttgcaactacattccaggtattagcttctttgttgtagatcaaatccatagaagctgtttcgccttccttcgtaattgaatagccattttcaagtgttttaaccatatagttaccgttttctccttttaccttcttcacgtcgcccacattagccatcgggttggaaccactccagaattcgatagagttgattactaaggcatcagcaaggtatgctacgccataaaccggaacaatgttgaaagctaaaaatacaagctcatttacaaatttgtttccgactccttgattccaggaacttaaacggttgaataagccaaatgatccaacacaggagctgaataataagctaccactaagtacaaccgctactaatgtcagtttgctttttttcatgtttactttactttttgattaataaaatgttgataaattctctttttaatagatgcaaatataacatttttaaattaatcaaggttattatttcttgtttttatatcatttacgtttgttgtgtgccaacttgtttccaatgaaatgatctatggaaaatttaccgggtccggcaatgtacattaatacaaatactactaagtagatgaatgccaattcttttactgcaaatacgtcattagcatggatgacaaaaaaggcaactatcatcgtaaaaatcatcgggatcattgccaagcggtacagaaagccgaagatgaagcccattgaacataccaactcaccaaagatcgccaaaccgagggatatggaactgcccagcccgatcggatcaggaaaagccgtggataactcctggaaattgctccatttctgtataccgtggttcattaataatattccgaaaatgatgcggactgccaataaaaacaaggatacttttgttgtatttggctttgtggggaataagaaattataaatcataagtcgttctttttataagtttgctttttatttatataaacataaaaaatattgaaattgttctctgaaaacgataaaacatagaaacaaaaaaagataccggaaataaaatgactgatcagccgctttgtttccggtatcttttgataaggacaggattttcttgtctattctttgtttagaatataatgttcggcaagtgctcccgttatttcttgtttgtcatcgtttaacagacgaactttgttttcttctactttataataagatatttctccaccttcttcttttaaagtcaggatattaccttccagtgtataagttcctttttcatcaaatgaactgtcccggtcgatgtatacagagtgaagagtaaacgtcttgtcaggatttaatgtcagagttgtttcaatgcccggacagtcggcagcaggaaagacacctttataggtcccttcataatcaagcgatgtttcggcattatgtatatcagccacttgggttgctgtactgtccgcacttgtactattgtttgttttcgcactgtttccgcatgctgccagaagaaagcaggaacatgccagaatgataacttttttcatgatcgttacttttaatagtttatctaattaagtttatagttcgtaaaggtataaataataagttgaatccgggcaataaaaagaaccgaacaacttaatttatgaatttataaacggtcaatac

SEQ ID NO: 317 - DNA, 3278 bp, Bacteroides thetaiotaomicron
cgattatttagtcaccaaaggactaaagataaacaactattactaatcatgaagtttttttcactcttccttcttatcggaataggaaactgtttggctacaaacacgtattcgcagaataaactattcaccattaaatcatcacaaaagactataacggaagtctttcatgaaattgagaaaaatagtgaatatattattttctacatggaccaactcattgatacgaaccgcaaagtgaatatcaatgtcagaaagcaacaagtaagtgctatcctagatcaactttttgccggaaccgataacacttacagtatcaacgatcggcaaattaccatttaccgcaaaggagagcagccaactcctcaacaagaaaaaaataaatttgtaatcaccggtgttgtcactgattcacaaggagagtcagtaatcggagcatctgtgagaatcaaagatacaaccaatggagtaatcaccgatatggacggacgctatacaattactgcacccggaaaaaacagtattttggtaatttcatatattggctattcaactgaagaagttaaaatcaatgatcgtcgaaacatcaatataagattgcgcgaagacacaaaagcactggatgaagttgtagtagtgggatatggacagcaaaaaaaggaaagtgtagttgtatccatgagttccgtcaaagtttcagacataacagctccaacaagaaatctgactaataatctggccggacaagtttccggtcttatagcaatacaacgatccagtgaaccgggatttgatgatgccgaattttggattcgtggtatcagtacatttgcaagcaactcggcagcttctactcccctagttttagtggacggtattccccgtaaaattacagatatcgaaccggatgaaattgaaactttttccatcctaaaggatgctgctgcaacagctatctatggtgcagaaggtgcaaatggagttatattagtcactaccaaacgcggtaaagatgaaaagccgaaaattacttttaagaccgagcattctatttcaagtccccaacgtttgccagaatttgtgggatctgccgattatctaggattatataatgaagcattgcgtaacgacggtgaacctgctttattcagtgacgaaaccatagaaaagtttcgtaacagcactgatcctgacctctatcctaatacagactggattaaagagttgctcaagaaaactacaaataatcatcgatacacactaaatgtccgtggcggttccgcacgtgcaaagtactttgtttcaggtgcatattataatgaaagtggaatttacaaaggcaaccctacagacaagtatgatacaaatatcggacttgaccgttttaatcttcgttcaaacattgatatggatgtcacctcaacaactaaaatttctgttgatttggcaggacaatacttgatagctaactatccaggctcatcttcatccagtatcttccgttccatgttaattacccctccatactgttttcctgctgtatacagtgatggcacagtagccacttatgaacaggaacgaggagttaatatgaggaatccatacaatctgttaatgaactccggatatacccgccaatggcggacaggaatccagtcgaaagtaggcgtacaacaaaatctgaaattcataaccaaaggattaagtgctaaaatgaatatcagttatgacttcgacgcaactttcaaatccatacgttcatacaatccatcacgttatcatgcaacaggcagagacgaaaacgggaatcttcaattcgcacaagtagtttccggtactccagaccttagcgacctgaaggacaacggtatcgaagcgaacaaaaaaatatatattgatgcttccatcaactataaacggacctttgctgaaaaacatgatgtaaccggaatgttgctctatatgcaaaaagaaacacaatataaaaccgagccactaccataccgtaaacaaggtgtagtaggacgtgtaagttatgcttatgacggacgttactttattgaaggtaacttcggatataccggttcggaagccttcgccaagaatcaccggttcggtttcttcccagctgtaggagttgcttactatctatccaatgagccattctatcccaaagcaataaagaaaatagccaataagattaaaatcagagcttctgtcggaaaaaccggtaatgatactaccgataaacgttttgtttatagagctacttataatatggcagccggttcatggtcacaaggtataggaagtaacggaggtaccaatgcaataggcaatgctatcatcgaaggattccccgaaacgctggatatcggttgggaaattgaaactaaacaaaattacggcttcgacctaggactgtttgacaacaaagttgattttgtattcgattatttccgctctgaaagaagtcatattctgatgcaaagaaatactactcctactgtaggcggattccgcgtcaatcaatatgccaactacggtattgttaataatcatggcgtagatatgtcactgaatattcatcagcaaataggaaaagtaaaactcagtgcacgtggaacctttacctatgcaagaaataagatcgttgaatatgatgaattaccacaaagatatccttggatggctcagacaggtatgagaataaacgaaaattatttatatatagcagaacgtttatatacaaaagaagactttattgtcagcaaaaacggtagtggcatcgaaacttatactctacgttctgaattaccccaaagcacattggggggactgttaggtcctggtgatatcaaatataaagatataaatggagacggcattatcgatagctatgataaagtaagaggtgtaggacatcccaaagttccagaaattgtatatggatttgggctaaatatagaatataaaggattttatgccagcgcattctttcaaggtgccggcaactgttccgttttgctgggaggtaatacccctgaaggatggtttcctttctcatggggagtagaccaatcgaattaccgtacattcgctttagacaggtggactgaaaaaaatccaagccaaaacgtattaatgccacgcttacataaagacaacaccaatgccgctaataatagtgtagcaagcacttggtggttacgcaacggaggattcttacgtctcaagaacgtggaattaggttaatacctttataaataatataatat

SEQ ID NO: 318 - DNA, 3197 bp, Bacteroides thetaiotaomicron
gtatttatctaatgtattaagatgcaaggcatgtcattgatgcaaagataataaaaagactaagatttacagctttcaatactatttcttaatggctatagtgctaaaatctaagtctcgcattgcataaaactattcgtctgacagttgttgaactttcgtctgacaactgttaatctttcgtctaacagctgtcagacgaaaagaaaacagctgtcagacgaataaattcaagcataaacaatgttagtttacggctagcagaagagtaatctcatgctattctccaagtaatccgtcgcatacgaaaaattaaattatactatcaacgccctaaactattgtttatcatcggcaaactacgtacttttgcacgccatttttaagaggctaaaataatgaataacaagaccaaaggttttatttatggagccattgccgctgcaagctacggtatgaatcctctcttcacactcccgctctatgctgccggcatgagtgtcgatactgttttattctaccgttacgcatttgccgtaattgtattgggtgtcttgatgaagctgcaagggcagtcttttactcttcgcaaggcagacattctccccttggtaatcatgggattgctgttttcgttttcatctctgcttctattcatgagttacaactatatggatgccggtattgcttctaccattctgttcgtttatccggtgatggtagctgtgatcatgggcgcctttttcaaagagaagatttccgcaatcaccgttttttcgatcctgttggcactttcgggcattgccctgctctatcagggagatggcaacaaaccactctccaccgtaggaattatctttgttttactgtcgtctctctcctatgccatttatatcgtaggagtcaaccggtcttcattaaaaacattaccgactaccaaactgactttttatgctatattattcggattatcggtttacatagtccgcttgaatttctgcacggaattgcaaatcataccctctcccttattgtgggcagatgttctggccttggccattctccccactgccgtgtcattgatttgcaccgcattagccattcaatctataggctccactcctactgctatactcggtgctctggagcctgtgacagcgttatttttcggggtcctcctgtttcacgaaaaactgactccccgattaatggtcggtattttaatgattatcactgccgttacattgattatcatcggcaagtcgcttataaaaaagatgagtgtgctgttgcagataagcaaaaaatagtatacttttgctaatcaatcaaccaaatagcaactttaattatcaaaaaatatggtagacgtaaagacttgccttgacaatgcacaagaaaaaatggatatggctgtaatgtatctcgaagaagcattggcacatatccgcgctggaaaagcgagtacccgactgttggatggtatccgcgtagactcttacggaagtatggttcctatcagcaatgtagctgctttatccactccggatgctcgcagtatcaccatcaaaccgtgggacaaaagtatgttccgtgccatcgaaaaagccattatcgactctgaccttggcattatgcccgaaaataatggtgaagtaatccgtattggtattcctcctctgacggaagaacgtcgtagacagctcgctaaacagtgtaaagcggaaggcgaaactgccaaagtaagtgtacgcaacgctcgtcgcgatggcatcgacgcactgaaaaaagcagtaaaagacggactggcagaagacgagcagaagaatgcggaagccaagttacaaaaaatccatgataagtatatcaaacagattgaagatatgcttgctgacaaggataaagaaatcatgacggtttaatggaaaatggagaatggacaatggataattactatgcagtcccattgcccattctccattatccattctccattatccattatccattaaataaatgaagggattagtaatcaagaacacgggcagttggtatcaggtgaagaccgacgacggacaatttattgaatgtaaaatcaaaggtaatttccggttaaaaggtattcgcagcaccaatccggtagccgtgggcgaccgcgttcagattatactcaatcaggaaggtactgcctttatcaatgaaatagaagacagaaagaactacatcatccgccgttcttccaatctttccaaacaatctcacattcttgccgctaacctcgatcaatgtatgttagtggttactgtcaactatcccgaaacatccaccatttttatcgaccgttttctcgcttctgccgaagcatatcgtgtacctgtcaaactggtatttaataaggtagatgcttataacgaggatgagctccgttatctggacgctcttattaatctgtatacgcatatcggttatccttgtttcaaggtttctgccaaggaaggaaccggagtggatgccatcaaaaaagacctggaaggcaagatcacacttttctccggtcattcgggagttggaaaatcgacgctcatcaacgccattttaccgggaaccaaagtaaaaaccggtgagatatcgacctatcacaacaaaggtatgcatacgactaccttctctgaaatgttctctgtagacggggatggatatattatcgatactccgggaatcaaaggattcggaacgttcgatatggaggaagaagaaatcgggcattatttccctgaaatattcaaggtttccgctgattgcaaatatggtaactgtacacatcggcatgagccgggatgtgcggtacgtgaggcagtggaaaagcatcttatcagtgagtctcgttatacttcttatctgaatatgctggaggataaggaggagggaaagtatcgggcggcatactaatctcttaactaatcagcaagaaattacacataaaaaataaatctaatttctattaaaaaaacgacaacaatcgaacattctgattccaaaattcaaacaacaaacacaactttgattttaatttaaacttcaagcaaaatctcactaatttaaataagtaaattagatgaaaagtcgaaattctccttttgtctgttattaaagccagacacaacattaactttcttttactttatccagcattaaac

SEQ ID NO: 319 - DNA, 3098 bp, Bacteroides thetaiotaomicron
caaagataaggtttaatagtatgataaacaagaaatgataggatattaatgataagtctggttttcaaaaaatgaataggatgaaaagttgcaaatggcttttttttgatattatattcgcatccattaatcataaaaaaaagaagaaaatggaacaaaaaaatggttggtttgccttttggcaaaaattgatgaagtgtctttcaaaacaagatgaaacgggagtaggggatacaaaaagtgtagcacctgtcaatactattattcagtcgattaagggggtatcatcgtctaaagaaaaagactcatcgaaagtgaagtcactaactgagagcgtagatacttttttaaaatcccgctatgatttccgctacaatgtgctgacagaagaaacggaatatcgtttgttggaacgaatggaggaaggatttgcacctgtgaatcagcgtgtcttaaatacattctgcctggaagctcacgaatcaggtatttcttgttgggatcgtgatctttcacgctgtattttctccacccgtattgcagagtatcatcctttcaaactttatttggaagaattgccggtatgggatggagtggaccgtttggcggctttggcacgcagagtttcgagagaccaattgtgggtgaaagaattccatatatggatgcggggtatgacagcacaatggatgggggttacgggaagtcatgccaatagtgtggcgcctttgcttatcagtacggagcaaggatatttaaagtctactttttgcaaatcgctacttcctcctgcgcttcagcgttattatatggataaggtggatttaaccagtcaagggcatatagaacggagattggcggagatgggacttctcaatctggatgagtttgataaatatgctccgacgaaaatgccgttattgaagaatctgatgcagatggcttcattaagcctgtgcaaagcttatcagaaaaattatcgctcgctacctcgtatagcatcttttatcgggacatcgaatcgaaaagatttattgactgacccgactggtagtcgcaggtttatttgtgtgctggtagagtatcctatcgattgtgaggggattgactatgcacaactttatgctcaattgaaagcggagattttggcgggtgaacattattggtttacaaaagaggaagagacggaattgcagcaaagtaacatgacgttctatcgtcagggacctgtggaagacgtattgcgttcctgttatcgggcggcagaaaaaggagaagggtgtgaacttctttcgtctgctgatatctttcagcgattgaagaagataaatccggcagctatgcgtggggcaaatccggcgagtttggcacaaatactgatagcagtggggatagaacgtaagcataccaagtttgggaatgtgtatcgggtagtctccgtctgatgggaggtgaagcggatggtgaacaggagaccttcacccgcaatcgtcgtgccagagggagttgtgaagggtgaagggaggaaaggagatttgcttatttgggatgaaaaattgtatcctttttggggacactctttccttttctttttcgttttttcttcttatcttgcgaatgataattcatctcatgtaaaaaggtgaagtagagagatgtttgattatggacaacataaaatttaatagaaaatgaaaaacattattttaatagtaagtttattattgatgggtgtgagtagtcgggcagacatattgaactcttctgataataagaatgtggcagataaatttgatccgatgcttaaagcagcgttgttccaaatgaagattatagctgataccagctctattttattatcggatattgattacgtggaggatttggagctgaaaaccagtttatggattaataatgacgtgaatagagcgaaaactacgagacatgaaattacctcattaaaaggccttgagtatttttcttctctacgtcggttaaagttggtgggaaatcggactgatacattggagtgtattcctgatttttctagatttaaagaacttcgtgagttggaaattatacaaatctaccttccgaaactggatataagtggttgtaaaaatctcacgaatttaagttgtagaagttgtgatttgaatacgatagacttgaaaaagaatattcaattaagaactttagattgtacttataaccgactgatagaattggatcttagtcataataaacaacttcgaacggttattgttaaatctcaaagaaataaaggattactttcggaaggaggtcgtgccgggatattatctaagttgattcttccggataaccgatcgaatacagaaggaataagtatacttgaatgttcggataataatctggagaaattggatattagtcgatcaccgcatcttagaaaaataaattgtagttggaataagctaaaagcacttgaaacatcacataatcaagaattgcgggaactaaattgtgaagcaaattatattggagagttggattttagtgctaacctaaagatggaatttttaacttgcggattgcagggatatgagtggatacgccaagaagggaatgattatcgtttattgaagaaattgatactccctgagcaaaaagagaatgtggaaggaggttcgctgcgtaaactttctattaaagaaatatcagaagaagcaattccggtttttagtgactacccttatttaaaagaattaaattgtgctgataacagactaaaaacaattgatcttagtgcaaatatatatttggaggttttggattgtagtagtaatgctatatctcagcttgatttgcattcaaatgtcaacttgtattcgttgaatattttaaattgtccattgcaagtattggacttgtcccagacaaaagtgaagctaattatgtgtgatttctatgatagaagagagaagggtgtgaaaaatggatacatatctggtttgtatttaaaattgattgttcctaaaggataccatgctgaaactataaactttagaacccccaccttagaaactgcctcttttgaaaatggctctatatataat

SEQ ID NO: 320 - DNA, 3029 bp, Bacteroides thetaiotaomicron
cccggacaagcacttttagtatttcaccttatataatatagatttcccgagagtgaaaagatgcctttcatgctttcctggcattaatcaaaagcaaagttgtcattcacttttattagtgttaatttctttattccatatttttattgtatgtttgtgagcatatagcttcttgcagcaatcaagaagttgtataaattaatcaatagcaaacaaatcagagcatcatacatagacaaaaacaaaggacaaatgaacccaagtgaaacagaacctacccaaaatgtaatgtcatcttcagcaccagaaacattccctttaataaaagatcaacttctatttgcagaaagtatctacgcttgtctgccaatgagtattgagatctatgatacaaatggtatcttgcgcagtatcaatgaacatgcattgcagatgtatggagtcactgataaaacgactgtagttaatatcgtcaatctttttaatagtccttatgtggacgaaactctcaaaaatcgcattcagagaggcgaagatattgttctggaattcgaatacgactttgaccggataaaagacaacgcatacttctctacccaaaataagaacacgatcatttatgaagcaaaggtcgttcccctgcgaagcaaggagggagaaatcatcgggcatatattgctttccaacgatgtgactgccataaaagaagctgaattccgtacggatgaaagcaaaaagaatctggaaatggcaatggaagcggcctctatgtcgtcttgggtatatgacgtgtataaaaaaacattcaatccattacatggagatcctatagctaaaaaaaacacgacattagatcagattctaaatatactgcatccacaagatcatgaacctttaatacaacttttatcacaactgaccaacaaagaaattctgcaaggaaacatcaccttacgtttctataatgaagaagaaaagcaataccgctattatgaaagcatgatgcggttatctttcgaacattttgggaaattgctgattataggaacccaactggatataacggaaaggatgcaaatggtaaagaagacgcaggaattaatcgccaagcgtgaactggccatgaaagtcagcaatatcattcattgggatttcgatgtacggactcaagagttcgaagcctataatgacccgatcaatgattatgccagtgataaactggtgagcatccaacgatacatggatgttattcatcctgaagaccgttcttcatcctatgatgccatacagtctatgctatcaggcaaggaactcaccattaacttcacttgccgtatgcaaacgaagtatgatgaatcctggcaatattgtaatatcataggcgttccattcgagaaagacgaatatggcaacaacgtacgatataccggtttcaggcaaaatatctccaagcttcatcagctgaatgaagaacttgaagaaagaaactacaaaatgcagctcaccttcaaaactgtaggcatgtcttactgggattttgaagtaaaaagcaaacaattcaaagcatttaatgaccccgtgaatgacttccattctgaaaatgtaatcacacctgaagactatctgcatgtcacccatccggaagacatcgagctggtccgcaaccatattaattatatgattggaggaacaactaaggatctcaacttcaaattccgatccaaaactaaatgggacaaagaatggcagactctcattgttaccggcataccagtggaaagagacaagaaaggcaatgtaattcgctacaccggtattaaagtcaacaatacgaaatgggagaaaatggcacagcaactaaaggaactgaaagacaaagccgaactttccgaccgtctgaaatcggctttccttgccaatatgagtcacgaaatacgtacgcctctgaacgccatcgtcggcttctccgaactgatggtatattctgaagatccggcagaaaaagaagaatacatgagcatcatccaatccaataatgagttgttattgcgattgattaatgatatcctcgacctttccaagattgaatcgggaattcttgaacgcaaaagagaaacattcaatttagccaaagtatgcaacgagctttataccatgatccagccaaagataaccaatccggatgttgagtttcaaatggacaattccggtccggactgttggattttcctggatagaagccggctcaagcaagtatggatgaactatcttacaaacgctgtcaaatgcaccaaatccggatatataaaaatgggatacagcatcgaaagagaaggaatccggatctatgtggaagattccggagtcggtatcccggaagaattacaggaacgagtgtttggacgtttccagaagctcaatgagtttgcccagggcaccggactcggactggctatctcaagagctatcattgaaggagccggaggagaagtcggatttacttccactcccggtattggatcgactttctgggcatggattccttgtgaaatcagcactcagaaggaacataccccaactatttcactgccattgcaacaccagctttctttgaacgaaatcgacaagaaggaactgaagatattaattgccgaagataatgaaagtaactattcgttagtgcaacatattctcaaaagctaccatctaacccatgttcaaaatggagcggaagcagtaaataaagtacgtgaggaagagttcgatcttgttctcatggatatgaaaatgcctgtcatgggaggactggaagcaacccgcaaaatccgtgagtttaataataggatacctattattgcacttacagccaatgcttttgatgctgacagaatcagcgctcttgacgcaggatgcaatgaatttcttgccaaaccattgaagaaaagtcagttgcttgaactcttctcaaagaaatggtaagttatatgttaacatacaattataaagtttatctaagtactctgatagta

SEQ ID NO: 321 - DNA, 3028 bp, Bacteroides thetaiotaomicron
agatcttgaatagtccattatcactatcatagttttccatattctgccgtacagattttttctttttgccgacaccaaaattccacgaaacactcagcgcaaacgcatgatctttccgtttaatatggtagtccgtcttatgataaactatactgccaggtatggtttcgtttgaatatttgtcttttatgaatgggaaaaaacattgaaggtttatattaaaacttttgtatgcatatcccaagttaacatacgagactttctctatcccagttttataaagtcctgataaaaatgtaccgccaaatttttggtaaagatcaaatgagaaattcttatattgggcagaaaggtataatgaaacaggatatgaccaataattaaattctcggatctcttttgaaggttgaaaaacctgttgattggctcctatgcttccaccgattcggagaaattcccatggtgtgtaattcagattgatttcaacacctctccgtatatctttttcagcgttaccggtttgaaacagtatgcaatcatcgccatattgatatgaatcgaatagactattgctggtataatcataaaataaatttgccgatgcagaaaactttttcaagtacaagtcataacttaaattcaatgactgcaagtgtgagttttccaagttcgtattacctgtctgatagaaattgttcattatcaagattcttgcatcagacatttgtaacatgtccggcatctgtgtactggaattatatgtaatacgtatgctatttgcatcattgatgttatatccagccataatcagcggagtaaatgtcaaattatgaaatccgtttccttcagattgcatatcataattggcccctaaactgacacggtacatgaatgattttagttttccgctaatctcaccatacgcataatgcttttgtgtatttatattctgtttctgcaactcttcagacatcgagttttttaattcatttgttagaaaagataagtttcgccatagtctggcacttgaaaatactcgtctgtggtgcttagtggaacaaacttttcttcggtcaagtattcaagggagatttctcgtttccacttggcaaacagcatacgggcagcgtctatggaagcatggcgaatgactatccggcaataggcgttatgggtgtactggatatgttctttgtattctttctcggtcatggaaaatccccctttctctgatgatagtgaggggcggcagcactccctgctgtcgccccttgactacccaccagcaaggacaggcggggctgtcaacggcgggcgcagcccgttcatcttgaccgttgactgctccggctggctttgctatttactaactgatttgtggaatagtacaacataacaagtgttgcactaagcaatattccacccacaatatcagtaaaccaatgcacaccagataaaacccgcccaatgaccataaaacttgcatagataccacaaaaagcatttactatattccttaatcttttgcttgaaatcaaatggtgaaattgcataatagccgtaggcataatgcacatcataagcattgttgtagaggacggataagaggcttccaaaacaccctcaatcaaaacaggtctgtaatttacaacaaaaaactcaaaaaagagatatgccaaaaatacaagcacataaaaaccgcctaataccaaaatactgctatctacacgaaacagacttttccttttaataagttgcacaagacctaccattgcaaatccgaacatgataaacagtacagcaatactcaaccagtctgttatactatatagcagcatattcacaccaaacagcgtatgaaaatattgattgacttccgcaaacccgacagatgaaccctgtgggccgattggctgcacatcaacaaacataattgccactgtgtagagaatgaacaaagccaacagtccggcagctacaataaaattgttttggatttttttcttttcttcttcctttttctttccaaagttaaataatgccataataataacctcctaaaattaaacaattaaatattcaagtttcgcaagtaaaaaagtatagcttttagttctgtatttcgcagaaaatgagtatttccagtttcgcagtttgaatgattttattgtctggattttattgtcagacttcaggtatcggatcaccttacatggattcccgacagccacacagtttgccgggattgattttgtcacaacacttccggcaccaatcacacttcctgttcctattgttatgcctgccagaattatactgccgccaccaatccacacattgtcctctacggtaatcggaagagatcgtgtacggaaaaagagttcccccgaattttcattccagttctcgacaaatctttcgttgtagtttatcggatgtgtggctgtatagaactgtacattcggggctatcagaacctgattccctataaggatatgattctcgtccatcattgtgcagttgtcattgatgacagacttatccccaatgaaaatatgctttccgcactggcataagaaattacgtcctactgccgaccgttggcctatgctcccgagcatatttcttaaaataccgcttctctcagaatcttccaagtccgggctgtcaagtctggcaagacaggctttagtattggatatcatttcaagtacctccgggttcagactgttgcaatattctccggacatgaatcggtcgtaattgcttgtatgatgttgatggtgttctttctccatgtttttctttattatgccctaaagatacgcataatccacaaattcacagtattagattaatctttttccaagtatatgttctaattattattgactaaaagaaaaaaaacaaaaaatcgtcacttttatttaacaagaacatttattatctaaatagtttctcttaaatacaatctgaccaattttcgagttgagttattaatttcaagtagtctcttataattgttact

SEQ ID NO: 322 - DNA, 2998 bp, Bacteroides thetaiotaomicron
ttcttatagaggaatgtattctacaaatgcctccattgcctcatacgatgccagtcctaactgatcatacaacgttgctgtgccacggttacggtcttcgctacgttgccagaacagacgttcgtcattacctaagaacggagcgctttccatctgcgactgatgcttcaggatagaattacgttttgcacgaagctcttccggactgataggcacagccatttcgatgttctcaatttcccattcagcccacgcaccacgatacatccagatacgacagtctttcaaccatttggctccttcttctttttcaagatcgacagcagcgaatacggcatccgtacatacacggtgtgtaccgtgtgggtcagccaaatcaccggctacgaaaatctgatgaggctttatttcacgaagcaggttacgtacgatctctacgtcagcctcgctaatcggatttttctgaatcttaccggtttcatagaacggcaagtcaaggaaatgtacccgatctagcggaatattattgtatgaagaagcggtacgggcttcaccacgacgaatcaaacctttgatagtcagaatgtcacggctgtccatatcaccgtctttcttttctttcaggaatttgcgtatttctgcatatttctcgctgattaccaagtcttcgctgttattgaaaatctgattgaatccgttaatgaaatgcatgaaacgaaccacttcctcatcacctacggcaatgttaccggaagtttcgtaagctacgtgtacctcatgcttctgttctaccaggcggcggagggttccacccatggagataacgtcgtcatccggatgcggagagaagataaccacacgtttcggatacggtttggcacgttccggacgataagtatcgtcagcattaggtttgccacccggccatccggtgatggtatgctgcaagtcgttgaaaatcttgatatttacattgtaagcagaaccaaacaatgccagaagttcgctcagaccgttttcgttgtagtccttgttggtcagcttcagaatcggtttgcctgtcaactggcacagccatacgatagcgctgcggatcagtttatcattccactcgcaggatgttaccagccacggacgttgaatgcgtgttaagttcatggaagccgaaaggtcgatcgctacatgagcattgttgtgagtttgcagataagatgcaggaattgtgtcactaatcggaccttccacacattctttgatcattgctgccttattttccccccatgccagcaaatatacctttttagcgccaagaatggtagatactcccattgtgatagaactgatcggagtattttctattgttccgaaaatcttggatgcttcgttgcgcgatgcattgtccaataagatcagacgtgtggtagagttcagacgtgaacccggttcgttgaatgcgatattacctacacgaccgatacccagcagggcaatgtcaatacctccgaaactttcgatgcgctgttcgtacagacggcaatattcaaagatggtatctttggcgatggttccatcgggagtgaatatattctgtttgtcaatatcgacatgatccagcaacatttcttttaaagcattgaagttgctgttgatagcatcggctgtcaacggatagtattcatacatattaaatacgatcacgttacggaagctcagtccttcttccttatgcatgcggatcagttccgaatagacatggctgggtgagttacctccggggagtgctagtacgcaaaagcgtcctgctttctgtttttcgcggatggtttgtgctatttcgcaagcaatgtagttagccccttcttctacagactcataaatgtctgtaggtattttctcgagtcttgtcaagactgatttttcaaatgcattctccggtctgtagtatctgggggagaccctgtggagagtgatttgagaactaagatttgttttcataaagttgttaattaagttatgtaagattagagtccttacgactgtattttcacgacaaagatacaaaagaagtctatataattaactactaacttctaggtattgttgcaccttcaaatcgtttttaacatttgtttcatcacgaatggcggagttggaattcgtctgcatctttccataccggaaacttttctctgaactgatgaagtgcggtcagatgaagcgtagcggttgctatgccctccgtttcgtcgggcacggaagccgcttcttctccgagcgctgaatagattttgcttcctccgttgtatttcagccgatatccgtctatacctactctgttaaccccgcacacgtaacactgattttcaagggcacgggcacgaagcagcgtatcccatgccaggcggcgggggataggccagtttgctacatatattaataggtcatattgattggctacgttccggctccacaccggaaaacgaagatcgtagcatacaagcagacagatattccagccacggtaagggataatcagacgttcatcgcctgccgagaaatgttctgcctcacgtcccatgcgaaacagatggcgtttatcataatagaattcttctccttccggtgtcagaaagaaggcgcgattgtaatatcgtccgttgtctacagtgatataactcccgcagatggccacttgaaacaaagaagcccattgtttcagtgttgtaatcgtttcgccggaatttgcttccgccagcatatcactttgcatgctgaatcctgtagaaaacatctccggtaaaacaacaatctccgttgttccacagagactttgcagcttctcgtggagcaaacggagattttcttgtttgttttcccaaacgatatcggtttgtactatggaaatacgaatcgaatccatgatgcctgttttaagtaatagggaataagtaataggtaataagtaataggtaatataccatgcggagcagcatttcag

SEQ ID NO: 323 - DNA, 2944 bp, Bacteroides thetaiotaomicron
aaataggagagtgccttataaaaaatactctcctgtataataataagtaacttttattacttagctaaggcctgagctacgtttacagcgcaagccacagtgcaacttaccattggggggtaccaattcccaagaatcctatcatttcggcttcttgtaaactatagcaatctgttattaatcaatactataatagttattcataaatgatttgagttggcaaaagatattaactcttcgatttgccctctctcatagctttctgctggttcaagcgttcctgctgcttcttttgattatgattttatgtaaatgtagctttcattgtatataaatctatcattcaacaattctaaatgataggtgagataaggtatctgaaactgccatctacttcaaattaccacaaataaaaaactcctgtaatcacatggactacaggagtttatttatataatgtaactttaattacttagccaaagcctgagctacgtctacagcacaagccactgtacatcctaccatcgggttgttaccaattcccaggaatcccatcatttctacgtgagcaggaactgatgaagaaccagcgaactgagcgtctgagtgcatacgacccattgtatctgtcataccataagaagccggaccagctgccatgttatcggggtgaagagtacggcctgtaccaccaccggaagcaactgagaagtatggcttaccagccaatacacgttctttcttataagtaccggcaaccgggtgttggaaacgagtcgggttagtagagttacctgtgatagatacgtctacgccttctttccacatgatagctacaccttcgcgaacatcgtcagcaccgtagcattttacttttgcacgaggaccgtcagagtaagcgatttcgcgaactactttcagctcaccagtgaaataatcaaactgagtctgaacataagtaaaaccattgatacgagagatgatctgagcagcgtcttttccaagaccgttcaggatgcaacgcaatggctctttacgtactttgtctgcttttgcagcgattttgatagcaccttcagcagcagcgaaagattcgtgacctgcaaggaatgcgaaacatttagtttcttcgcgaagcaacatagcagccaggttaccatgaccgataccaaccttacggtcgtcagctacagaacccgggatacagaatgcctgcaaaccgataccgatagcttcagcagcttcagcagcgtttgtgcagttcttcttaagagcaattgcagtacctaccacataagcccattttgcgttttcaaaacagataggctgagtttcttcacacgttttataaggatcaagtccggcagcttcgcagattgcgttagcttcttcgatgtctttgatgccgttagcgttcaaggcttcaatgatacctttgatacgacggtcttggctttcgaattttacttctctaatcatagtttctttcctccttatattattcgtgacgtggatcaatgtgtttaactgctccctgttctgctgttacacgaccataagtacctgtaactttcttcaatgcttcgttagcatcagttcccttcttgatttcatccatgaatttacccatgtgaacgaattcgtatccacagatttcatcattcttatccaagaagatatttttgatgtaaccttcagccatttcaaggtaacgaggacctttagccagagtaccataaagggtacctacctggctgcgcagacctttacctaagtcttccagacctgcaccgataatcaaaccaccttcagagaaagcagactgagtgcgtccgtaaacgatttgcaggaagagttcgcgcatagctgtgttgattgcgtcgcaaacaaggtcagtgttcagtgcttcgaggattgttttacccggaaggatttcagcagccatagcagctgagtgagtcataccggaacatccgatagtctcaactaaagcttcctggataacgccttctttaacattcagtgtcagtttacaagcaccctgctgaggtgcacaccaaccgataccgtgtgtcaaacctgaaatatcaacgatttctttagattttacccatttgccttcttcgggtatgggagccggtccgtggttaggacccttctttacaacacacatgtgttccacttcgtgtgaataagtcataattagctcttttttttagtgatataattaaaaatacgtagtcacgattctctaaatcgcccacaaaggtagtcgatttatttgtttctgcaaatcgccatatcttacttttttgtgaaaagtgacaaatccgtttacgttttttcttcgtttgctaagtcgggattgcatttgtgaaagattactatgtgtcgaactatctattcgttgctttgttgttatctgaaatataaattttatggaactcaatcaggttgatatacattatttgatagcggcaatctgcgttatttcatctgcattggtattttatactatcggtgtatggggagaaaggctgcaaaagaaactgaagttatggcatattattttctttcttttaggattggtgtccgatgcagtcgggaccagcctgatggagcatattgccgaattaacgcatttgcatgatgaaatccatacggtaacggggacgattgccattcttctgatgtttgtacatgcttcatgggcgatatggacttatgtgaagggatctgccgaggcgaaaaggcattttaatcgttttagtatcgtcgtttggtgcatttggttaataccttatttaataggtatggccataggaatgcatttacatgcataaatagttatatgtttttgcattagatagacttaaaagagttccttctttcagctaactcctgcaaagaaaaaaatattttagtctcacggtctcactgtttt

SEQ ID NO: 324 - DNA, 2922 bp, Bacteroides thetaiotaomicron
tcagagaatatatctgcttccttatatttatatttattggaatcgaaatatactgcaaaatcttgcattaacttcttggatagttcagtaagatataaattacttccggcaaatgtatttgaaccggaaactgtaacatacttcttatctttcagattttgtatctgataataaccatcttcctgtaggttgaacacccagcattgagcatcatctttcttctcgggattcaggcgtaaagttccgaacagtgattccaaaaactttccggttttggtatcttttattttatatacgttgggtatattagtctttataaactccagacttagattgatgtcatcatcatcatccgctatactgaaaccattggcaggtttagacactaaacgatcagaggtcttttctaataatgagtatatattaccgggtatgatttctgcagctcttttatagcgatacatactattaaacacggttaaatcccattgatcataccattttacgacaggatagcctgagcgcatactaatgggcaaccacacatgatgagactttcctacatccttagagttccaacggtcacccatgtatatataagctttttctttaccctccactttaaatacataacagctttgtgagttgtaagtaacttgtttgagtttatctacagcaaaattgttccctgttgtccagttccccagtatatcagtactgtaggcacttctcccgggattgggttcccagcctgtgcaaccggaaaacaatccaaaatacatatccccaaccttaaaaatagcgggtgcctcatatttaagtccctttaaaattttagtttctgttggagtcggctccagataatcgtctctaagtaatgcaatattcatgttggtattcatatccgtagaacagaaatgatatgcttttccgtctgtatctacgaataacgtctgatcacgggactcgtttttattagggcgaaatgttttgtaaagtacataaggccccattattttatcgcttgttgctacacaaacacgtgcagctccatatccatctccactttcccaatggctccacattacccatttcttagtttggggattataaattactttgggacgttcgaacaaacgtccctgcgatatatcattcatgtcttctctggcttcacctgtcgttttcatcgacaaccccagccgtttccagttgtataagtctttagattgataacaacttaccccatttgatttaaaacctgtacgatcttctccaaaccaataataagttcctttttcgtaaacgacacatccaccgtgtgcgttaatttgctccccatctatgtcattccacaaaacacccggactgatctgggtgttttgtgaaaaaatagaggtgaatgagaacataaagcagataaatagagttattctcatgttttcgttattttagtcttcaatattaatagttatttcgggctgtgcaggggcataggctccagattcgtcaattgtgaaatattccacatcagcagtattatctataaaaccgaatttgggcgagtatgtacgtgatgtgccggtcagtttagcgttgtctacacggacagctccgatatcatttccccatcctccacgtcctactgtaaaggatacgcgaatttggttacattcggcagaagtagtatagtccattgaataagtttcccagttgtcactggcaatttctgttatgacttttttttcagggtcttgcacttcttctataatcattttaccggtgagttttccttctttttttgctattcctccttttaatagagcagatagtgtgtaattttcattcggtacaacatctaccacttgcattaggataccatcactccagccagctgcccatttatagggtctaatttcaaaaacatgattgtccaggtcctgattattatcaatttcttcaggaagaatttgttgttctgaattccaacggtcgctaataacaacatcccatccttccactctactaactaacttcgtttctggatttatatcaaattctccttcgaagtttgggttctttaaaagattttctactggtttgccaactttctctgcaaagtttggctggggagcgtagtctataattctaacggaatctacaggaattccatctctgtaaatgaaggcacggttatctggtgttatggcaaaacgataaatatgtgcttgtccatcattattatagaacttaccttttcctcctgcttttccatttgttgcaggattggtaatttcttttttgtaggcattgaataatccgatttcattagaggtaatatatgctttgaatccataacctttttcgtttacaaaataaggataaaagcttttctccgagtcatctgtttttattttgaattcgatagtatatccttttgaatttggagtgaatgctttggtaaattccttatcatttcctttcttgtaagcaggagatgctgcaatgtctttcacaggaagagcggttccatatccttttacttttaaatatgaacggacgtctccacttcgcagaataattttcccttcagtcagtcttttagtactgtttaaggtcactttcactttttgttttccagagttggctgctataacagtcggagttacggtgaaaccgtttggagctgtaattgttatttctttgccgagtaaagcctcggaattgacaatgaaggatgatgatgcgtttgtaccattaatcgttagtaatggtagatgttcctctgttgaggtttgtaaggcttcattttcttttttatcatctttgggttgaactgcataagtagctgttgtgctaattgtcagcaatgtcaatgataaaaacataatcttcacatatttttttttcatgatacagaaa

SEQ ID NO: 325 - DNA, 2880 bp, Bacteroides thetaiotaomicron
ctaaccttcatgcccatgtagttttcgattggacgcagccgaatgggaaaagtgtgcgtttatcgcgtgatgacatggcagaactccaaaccatagcatctgaaacactgggcatggaacgtggcgtttcttctgaccgcaaacacttatcggctatgcagtacaagaccgaatgtgcgaaagaacagcttcaggaactatcaaacgatatatccagtgcattagacaaacacaaggacgtacaaaaccagcttcttcagcttcagaaagaactacgttccattgaaacaaagaagaacgtccaaaaactcatttctaaggcttcagagaagttttacggcttgattggaaaaacagtcaacgatagggaaaaggatgccttaaaagccaaagtaaaggctttagagggggaaaatgaacagctatccgatagactgggaaaggctatacttgaaaaagagcaaaacggcacaaaggcattcaaagccgagaatgacaaggagtattatagacaacaaatggacaacgcaaggactaccagtaaccgattaaggacggagaaccaagaactaaagaccgaaaccaaggaattgaaaaaagaacttggtaagatgaaagacttgttcaattccgaacaactggaggctttaaggcatcatttcccaaacatatcaaaagctatggaagaggggaaagacctactcaagcaaatcaccagaagcagaggtttcggtatgggtatgtaacccccccccccgcccccaaagggggagcgaccaaacggcagcctctctcaatggagtgttacgtcgttcggattcggaagaaattttgcagggttcggaaaacggttgtgtgcttattctaaaaaaagtttatggtgtggcgctcgtcgggacgggtggtcccgccccttgccgctgggcgctccccgaccgatgatttttaagtgactgattttgtgctgttttgggggtatattaagaatagaagaaatagaataagttaagtacttgatacacaatatagggcattttccatattggaaattctcattttccaatctagaaaatactgatttcctaatataatactaaacaggaaaataatatttcccttaatattgtttttatggaaaataatagtttactttgtggagaataatatttcccaaaaacacatcaaaatggaaaataaaaaagcagttaagttaaccgattttcaaaagaacgaagaaaatccttttatgaaacaagctatagaaggtattgaaaatcatgttgttaaaaagtataagagtaatagtggtggcgataagagagccgtagtagctttagccgacactgaaactggagaagtgtttaagacttcgtttatccgtcaaatagaagtagatgaagaacaattcactaaattgtatctttctaactttgctgcattctttgacctatcacaagcagctattcgggtttttggttactttatgacctgcatgaaacccaaaaatgatttaatcatcttcaatagaaaaaaatgcctagaatataccaaatacaaaacagacaaagccgtttataaaggacttgcagaacttgtaaaagctgaaatcatagcccgaggaccagccgataatctttggtttattaatcctctgatagtattcaatggtgaccgagtgacatttgctaaaacatacgttcggaaaaagactttagctgcccaaaagaaagaagaagcagagaaacgacaattatcacttggctttgatgaacagtaacactccattgagtgaagctgccgtttggtcgctccccctttgggggcgggggggggatagataaagttcctctatgtaaagttataatgggggatgaaaggcaaggttcgctaaccttaccccgattgtttatgcttcccagcattcaatctatccccgtttatgggtttctctttcaccctacaaagataacctcatgggggaaaaatgtccaagaatatggggtaaaaactatcaagtcggtagaaaataagtatctttgaagtacatttttagtagaggtactggtatgcctagacgaagcagataggcaaaaataaagccgctggagatgtcggatgtccgtcaattaactccagcggcttgtattttggtaactctcccgtatcggtcggctaccgtttggtcagcaacaaaggtagtactttattgtcgcaaatccaaatgttttcccctttatttgtgcatttacagaacatttgctaacttcgcacctatgcagtatggtgatagcacactagcaccctaaagggtgcgtgtgtaaggggacaagcccccttaaccccctgtcagccggctgtcaccggctgttatcgattgtcacaaaaatgttaacttatgggagcaacaagtattcatgtacaagcagtgaagccggggagtgagattcacaactttagggaaaaagagttggactatgttcgtcccgaacttagtcatttgaatgaaagctgggttggagatagcatctcccatcggctggaaagtgcgaaacaaagatatctcgatacggttgggcagaagatgcaggctaaagccgcacccatacgagagggagtaatagtaatcaaacaagaaaccaccatgcaggaactccagcagtttgccacggtctgcaaagaacgtttcggtatcgaagcatttcaaatccatatacacaaggacgaaggatacatgaacgcaaagcaatggacacctaaccttcatgcccatgtagttttcgattggacgcagccgaatgggaaaagtgtgcgtttatcgcgtgatgacatggcagaactccaaaccatagcatctgaaacactgggcatggaacgtggcgt

SEQ ID NO: 326 - DNA, 2847 bp, Bacteroides thetaiotaomicron
caaatatacttcctcttagggttttaaccatcacaagaattattttatttcgaacgaaaatcagaaagcgaccctcactcacgtgaaagtcgctttctgattttcataacgtaatgaacaaactaataaataattaaccttttcttaaaaatctcaaacattatatcttaaacggttgcatcttcaaatataccttatagtctttaatcatccccgttttaccggcttcagccctgggtagataagagaatcccgtaataactttatcttcaccaagatctatcacaatctgatgagggaatgcaggtttggaagaggaataattggtatgccagaatgttgattcctgcaaatcaaaaacatttgttgcaatattgttcgcggcatccgtttcctcactatcggcataaatcactttccaatgctgacgggataccggtttgccatcttcgcccaacaactccaattctgcaatagccgcgaaatctttcccatcatgggcgttcaaagcctccagacagaagaaacgagtctccaccttcttaccgaatttcacatgttgccaaccattgcctgacttaaatatcccttgataaacaggagtttcatttgttaagtccaagttctcacccatcttacgatgagcataagctccgttaccacgttgtacatccagaattggttgacgcagaccttcagtttcagcttttgaaggaccagccatatccaatataatgatttcattctctcctttcttcaaccagcagcccggtacatataaggtctgttgaggtccgatttcccaataacgaccaatcgcatggccattcacccataccatacctttactccagttcatcatattcaagaatgtatcccctaactcattgaggttaaacgtcgaccgataataagccggttgattttcagcattctcctgttgtttatactgcttatcacgggcaaaactataatctaccggaatagtatatacctgccagtccttcaccagttcaactcctttatcagattgcagttctactttctcggtaatacctttccagtcataaatacctttgccgaaattcattcttcccattgcttccaccaggatatccagtctgtcaccttctttcaatggtggtaactttactacaccttcccccttcaaacggctcagagtagccagtttcttaccattcagaaagacttgtgcccagtcatgagcttctgtgatcagtaatgtctgttctttatcagaagcggataatgaagtccgatacagaatactaccccatccctgatcaaaagcttccattgtccggatatcctcactctctttggggtgaggcagattatcaaataagactgccatttcagtcattttaatagtaggaatagctatagtcggtatcgaatccggaatttccggcaaggtttcaccttccggcaggtagttaccaagcagattccgtacttccagatatttaggagtcaccttaccggattcattgataggagcatcataatcatacgatgtgcaagtcggtgaaaagttcgggaaattcgcgcctccccaatgcccgaaactagtccccccgtgagtcatatacaagctgaaagaaatattgcggtccagcatttctttcataccttttaccaattcttcggcacttcttgtttcatgcttggctccccaatggtcaaaccatccggaccaaaattcactgcacatcaatggagtgtccggccgtagttctttcaaccgtttaaattgctcgtcgatgttagcacccgtaccgaaattaatagtccagagcaaatcatccagtgcattattctcaaaattcgagttccagtcacactggaataaaggaacacctgtaaaaccggcttgttttaccatgtcacggatttcggatatatacggcttatcgattccaaatgctccatactcattctccacctgtaccataatgatattccctcctttactaatctgaagatcagccagctgtttgcccacttcgttcaaaaagagtttcacacgttccatgtagtatgggtcttgctcgcgaagtttgatatccttcttcttcagcagccaccaaggcaagccgcccatttcccattccgcacagacataaggtccgggacgcactatgacatacattccattctcttgagccaaacggcaaaacgcagctatatctttctgtccggcaaaatcataccttccttcttccggttcatgaaaattccagaacacatacaagcaaatcgtattcatacccagtgccttgcacattttaatacgatgttcccaatattctttcgggatacgcggataatgaatctctgccgcttttacaacaaacggttctccattcagcaagaaagtattcttccccacttcaaatgtgccctccgaagattgagagcatgagctgccaagaacagccactactaaaataagtaaatacaataaaggtttcttcattttctatctattgttttcatgatatatctcatacttaataaagagaattcactatcggctaatgtttccattaaaccgacagcgaatttgaaaataatccaagtgttcctaaaaactaaaataatacctattgaaaactgagtacggtgcaaagatgaggtattatgcgtaaacaaaggtcctcaaataagtcaaaagggtatgaatatcgttcaaatgaactttatttatcattttatgaactctttttacagaaaaaatcaagatatttgcaagaaataccataaacactaaaacacctcataacgggagaccttatgaataaaacgacttttatactactaata

SEQ ID NO: 327 - DNA, 2846 bp, Bacteroides thetaiotaomicron
atgagtatattttatctattatccaaatacttatttgccgttttagtctattgtgcagcaatacttaccttaaaatatccatcagggaaattctgtatgtaatccccactaaagtagaactgcacatatgctacatctcctgagccaacatatctcaacataggatcataaatttgaccagttcctgtaagtgataatgttccactaccggtaagcttataatttgaatcatacacctcataacgcaatcgcttgctatagtttacatcattaaaactaccaagatactctaaatttatatgcatataggtggatttcctattgaacttgaacacatccacatctctagtagaagacaatgagaatttcattgactgcccatccttgatggtgtttgcgttagagaaattattgttatactcactctctatatattctggtattacatttacatagactctctcatttccgctacttaaacgtgttatgtatcctgttggtttaattccaactatacctattttcaatcctgtagcagtcccatctgcatcaatagaaattactgatggttcagaaacaacatttacaggttcatagaatacaaaatcactcagattgccaaaaatattcaacacagaactaccttgcttagaagtatagctgattttctgagattctcctacggccaaagttaacataggataaatagagtaagtctcacctgtattactccaagagaaatcagatattcgagaatgaacagtatattctttagatactccactatttttatctttaacaacaacatttgcttctccataacctacaattttaacagttgcattgccaccactaccactgactgtcaagactctgatatcagaagaactccattcataatccgttacagcatcacttggtttacaagtgacaaaaaagttataactatcacctacataagcatataatgttccattgaacagtatatcaagagcagtaactttcactaccgttgcctgtatgacggttactgtttccgtcttctttccatccgaagaagtaaaagttatcttgccagtacggctcttacctgtcgtattggacattatattaaatttcttcatactgtttgatatagagcgtgtaggtatttctgtaatccaatcattagaaattgacacaccatagtcgatattactcttcagttgaacgttaatgcttgtagtattcccatcaatattataagaagactgagtaagtacaagaattgcgccaccactctgataaaccttcagagtatcactgatgtcgttgtatttgaaatagatttcaccttcacgcttatcatattcatcactgcttgctacagaaaatgcagatgttgtttttgataatccacgatgaacattaactgaagagttagccctactaatccagctgttgcatgaaggaggaatttcaatagagtactcaacattactattaacatcaacaaaaaatgttccaccattttgggggacttcaaccttgttgtttgaaagcagtatagcatccttctgattttgcttaatggaaacactttctttcttgtttccgttggcatctttgaatactataacagcctcacggtcagcatatgtgttatttgcacttatctcatagacaagagtatggcttgaaactgcacgagataaatttgcagattgaatccaatcaacattaggcatatctatttcatattcaaagttgctgctgatgtcaattgatgcccgtccaccatcacagccaaaagtatattcattttgagaaagaataagaatagcagaacccgtctgatacacctttactgtttcatccgattcgccggaagtgataatgatttctccttcacgtttatcatattcttcacttggggatattgcaaaagaataaaagctagtagacaagccacgtgtacgttcagaaataactggttcaatccaagtcctgctattttcagcaacagtcacattataatcaatatttgactttacctgtaaattaataattcccccatctttatcaacctcaaatcgattcgatgtcaatgttaaagcatctttttgtttctgattgatcatgatgcttttagttaattcatcaacactgagctttaaaacaacattcctgtcatcatatccagtattactagccaccacaatagttaatgtgacatttccagctttaccactcgaaggagacactgtacaccaattatccccattctgcgtctcggcaagggaaactgaccagtccttgttagtggaaaaagaaattgtagcccgttcaccttctgatgagacattgattccttgactaaaaattgtctcacattcagatgtaggtacgatttctgtttctactctaacttcattcttttcgttctcttcaccgcatgaaaacaaaaagacaagacataaacacattaataataatgttattcgactaattttaaatttacggttcatattatattactttaaaataaactctgctgatgagattccatatctttctccagtttctgataataaatctcattaatagaatcaaatcctaaacgcaatccaactaagtatactgctagtttgtactccttttcatatagcctcttaaaactatttctacaataatctttcattaatgattgataatttggcaatgaaaacaaatttaataagtaaaaataaataggtatcaaaatatattgtcgtatacctttccgtgtacatttctcaatatatctctctgcacatttattgttctttaattcacatactatatattcaaaatcatatctactctgt

SEQ ID NO: 328 - DNA, 2800 bp, Bacteroides thetaiotaomicron
accctaaggtctgacattctggcatattttatgacttatcttatttaagtaatcttctttcaagatgcaataactttcatctccaattcacctttctctttattcagagagacttgaatgacatctttttctttcagagaagaagttataatgagttctgacagtccatcctccaaatgggtttgaatagctcgttttaaagggcgggctccgaattgcacatcgtatcctttttcggccacgaatcttttagcttcatcatcaataactagcttatatccaatagattcaatacgatcatatagtccttttagctcaatatcaatgattttcgtgatagcttccaaagagagttggtcaaatgttatgatttcatcgacacggttgataaattcgggcgcgaatgatttatttaatgctttttgtataacacttcgcgagaactctttgtcatccagacggctttgtgtagcaaagcctacaccacgtccaaactcctttaactggcgggtaccaatattggaagtcatgataacaactgtatttttaaaatcaaccattctgccataactgtcagtcagacggccttcgtccatcacttgaagaaggagattgaacacatccggatgtgctttttcgatctcatcaagcaagacgatagaataaggtttgcgacgtactttttcagttaattgtccgccttcttcatatcctacatatcccggaggagctccgaccagacgtgagacggtgaatttttccataaattcgctcatgtctatacgaatcagtgcatcggaagacccgaacatatattttgccaattctttggctaaatgggttttacctacaccagtcggacctaagaacataaaggttccaatgggcttattgggatccttcaatcccacacggcttcttaaaatagccttgaccagtttctctatcgccggatcctgtgcgattactttcgattgcagatcctccttcatgccagctagcttgattccttcggcttgtgccatacgctgtaccggaatgccggacatcatagaaataacattggcaatttcctctgcatcaacagtctgtctattctctttcagactgttttcccattctcgtttcatttcgtccaactgaagcgtgagctctttttccttatctcggaaactggcagcgagttcaaaattctgcgatttcacagcttcatttttcttgcttttagcttcttcgatgagtttttcctgctcttcgatttccttgggtacattgacgttggtcagatgtacacgtgatcctgcttcatccaaagcgtcaatagctttatcggggaagttacggtccgtaatataacggtctgtcaacttgacacaagcttccaatgcttcatctgtatagctcacgttatgatgatcttcgtatttatccttgatgttacgcagaatctgaagagtttcggcagcagtagtgggttccaccataactttttggaaacgacgttccaaagcgccgtctttttctatattcttacggtattcatcaagggtagtagcaccaatacattgtatttcgccgcgtgccaatgcaggtttcagcatattggctgcatccattgaaccggctgcagaacctgcacctacaattgtatggatctcatcaatgaacaggattacattcggattcctttgtaactcgttgagaatggaacgaatacgctcttcaaactgaccacgatattttgttcctgccacaactgcggtcatgtcaagagctactactcgcttatcaaacaagatgcgtgagactttcttttgaataattctcaaagcaagtccttcaacgattgctgattttcctacaccaggttcaccgatcagaatcggattgttctttttacggcgactcaggatttgagccaagcgttcaatttccttttctctgcctactacagggtccaaacgtccttcttctgccgcttttgtcatatctgtaccgaaattgtcaagtacaggcgtgtcattagccggtttttttgaagctgtttgtgcctgttgctggcgttcttcagaaccgcttccaccagatcggggagaagacatttcttcatcatcatcgtcttccgggaatcccatgccggaatttacatccggttgcaatgtggcttgttccaacactttcacgtaattaacgtcattagcttcgagcacggaagcagccatattgtttctttctcttaggatcgctaacaaaacatgctctgtatcagctatattacttctcattccacgtgcttctaaaatacacatttttaatatttttgccgcgtcattagacaacggtatctctgcatcaggcaatagcatatcatcagcttctgtcttcagccgagcttcaatctgctgctttactgcagctaaattggtgttgagttttgacaatatctcgatagcttttccttcaccgtcacgaagcaatcccagaagtaggtgctcaggtccgatatgcctactcctcaaccggttagcttcttccttgctatagacgataatgtcggaaactctttgtgagaattgattattcatactttttccttttcttctaaggggttatttactggcaaatatacgcatttaatcaagtttgtattgcatatttgctttatttcttatatctacaaatggcgtgccataaaaacaatgctttgtattatatatataaggtataacaaataccactccctgtttttcacagatatagtctccttaatggtagtatttattctttttctcatttcttt

SEQ ID NO: 329 - DNA, 2796 bp, Bacteroides thetaiotaomicron
gattattattgtgtgcgagcacataaacctatataaataaggtgatcgtatgaataaattgcccgaaagaatcagaatcaaagacatcgcccgtttagcagacgtgtctgtaggaacagtagaccgcgtcattcacggacgcagcggagtatcagaagcaagcaaaaaacgggtggaagaaattctgaagcagcttgactatcaacctaacatgtatgccagtgccctggcttccaacaagaagtacacattcatctgtcttctgcctcaacatctggaaggcgaatactggacagcagtagaactgggtatccacgaagctatcgcgacctactcggacttcaatacctcggtaaagatcaactattacgatccatacgactatcattcgtttgtagacgccagcgaagctatcctgactcagcaaccggacggagtgatggtggcccctacggctccgcaatatacgaaaggctttactgatcagttgcaaacgttggatataccttatatatatatagactcaaatatcaaagacgtacctcccctcgccttcttcggtcagaactcacgccaaagcggatactttgccgcccgtatgctaatgctgcttgccagagacgaaaaggaaatcgttattttccgtaagatacatgaaggaattgtcggttctaaccagcaagagaacagggaaatcggattcaggcagtacatggaggaacatcatccgtcttgtactatactggagcttgacttgcatgccgaacgcaatgatgaagataacgaaatgctggatgaattcttccgttctcacccgaacgtaaagaatggaatcactttcaattcaaaagtctacattatcggcgaatacctgcaaagtcgcggaaagaaaaatttcaatctgataggctacgaccttctggaacggaatgtcacttgcctgaaagaaggaagcgtttccttcctcatcgcccagcaaccggaactgcaaggcctcaacggcatcaaggcgctctgcgatcacctcattttcaagaaagacgtgacttgcatcaactatatgccgattgacttgttgactgtagaaacaatagactattaccatagcaaataacaacaaaatccaactaaacaagtacatggaaacaaagtatttaagaattaatcctgccgacaacgttgccgttgccattgttaacctcccggcaggagagcatctatccgtagatggaatagagattacactaaacgaagacattcctgctggacataagtttgcattaaaagattttgcagaaggcgagaacgtaatcaagtacggctaccctatcggtcatgcccgtatggcaaaaaaacagggagactggatgaatgaaacgaatatcaagactaatctcgccggactgttggagtatacctaccatccgactcaggttactctggatatccctcataaaaacctcacttttaaaggctaccgccgtaaaaatggtgatgtcggcgtaagaaatgaaatctggattatcccgactgtaggttgcgttaacggtatcatcggacaactggccgaaggcctgcgccgtgaaacggaaggaaaaggggtagatgccatcgtggctttcccgcacaactacggttgctcacagcttggagacgatcacgaaaacacgaaaaagattcttcgcgatatggtacttcacccgaatgcaggcgcagtactgatagtaggcttgggctgcgaaaacaaccagccggacgtattccgtgaattcttaggagactatgaccaggaccgtgtgaaattcatggtaacccagaaagttggtgacgaatacgaagaaggaatggatattctgcgcgatttatatgccaaagcatccaaagatgaacgtacggaagtacctttgtcagaacttcgtgtcggactgaaatgtggtggttccgacggtttctcaggtatcactgccaatccgttgctgggcatgttctcagacttcctgattgcacaaggcggtacaagcgtgctgactgaagttccggaaatgtttggtgcggaaacaattctgatgaaccgttgcgagaacaaagacctgttcgaacagaccgtacacttgatcaatgacttcaaagaatatttcctgtcccatggcgagcctgtgggtgaaaatccatctccgggaaataaagccggcggcatctccactctggaagaaaaagcactgggatgtacacagaaatgtggtaaaagctatgtatccggcgtgatgccttacggagaacgtctgcaaaagaaaggactgaacctgctttccgccccgggcaatgacctagtagctgctactacccttgccgcaagcggatgccatatggtactctttaccaccggacgtggtactcctttcggcactttcgttccgacgatgaagatttccaccaattctactttggctaaaaacaaaccgggatggattgatttcaatgccggagtcatcgttgagaacgaaccgatggaaaagacttgcgaacgctttatcgagtatgtgattaaagtagcaagcggtgagttcgttaataacgagaagaaaggttatcgtgaaattgccatctttaaaacaggagttacattataagcgtttcaccatcaaaggaaatattacagttatggggagggtgaattctaagtcctctccaaacaatatctataaaatcttacccaagtttacgaacattaacgtatccttgggtaagtttgtatatagacatacctactcttcagaagtgtatagctacttccta

SEQ ID NO: 330 - DNA, 2786 bp, Bacteroides thetaiotaomicron
agataataaatagagtaccctttaaaatgaagagaatcattgatatccatactgttcagcgcagaagattgcaggacatcataatccgtaataaagttaatcttatttatccaatattgttggtgtgctttcaccgaatcgctcacatgcgctctgtaggcgtgcaaatgcaaggtcaagtctacctgataagtaccccgaaccgtatctgccgtataaccgacataatccttattgaacttataataaccattccgaagcaacttgtcagtaattcgctgacgctcggcatccagcacgttcacatcaaatatcattccttctttcagcagacttttggcggaatcctgcttcagaaaatcagcaatcttaggatcacgaatatcatattttaatgaattgacaatataaggatcgccggctgtcacctcataatacagcttgatctttttcttctttattttagtcgaacgcttcactgtggccgccatatagcccatattgcgcattgcctttgtaatttcatcttgcgagcgctgcgcttcagtctcactatagattacaggagcatccccgattcttctcaggaacttatttccccatttagtagagtctcgtcctgaaaggttgtaaacataaagctgtgttttgattaaactgaaccatttggcattagggttctgtcgcacatacattcgtaaggaagaaggacggacatttttctgatctgtatgaatcttgacttcatccagcagataagagccatccggcacatacttagtggcagtgcacgaagcgagcgacagaatgataacggcaaaagtaaataagtaaagaaatcctttcctcatacagtatctctataaaagcggaagcaaatatatagggacaaagatagagcatatttttcgttcggggaaattatcaaaacaataattaatgcgacaaaagttcttttcaccacgaattatagaaatttgcaaggtatgctttgctaatacctatatattactgactatgtatccttgcaattacttctataaatcgtggcgaataagattcctaatttagttgatttctgaatacaataggaactgtaaacttcacagatacaggctcccctttttgcattcccggcttccattttggcatcgaattaatcactcgaagagcttctttatccaaatccggatcaacgctacgtactactttcgcaccaaaaatactaccatctttgttaaccacaaactgtacaataacacgaccctgaattttattttctatcgccttcgtcggatacttgatattgcgactcaaaaaactcagtagttctttctgtcctccggggaaatccggcatcgtttccactactgaataaatagaatcacctttcgtctccgtgatcgttatatcaacttgaggttctgctgttttctccggttcagcagtcaactctatggtatctgctttttcggtatcagactggactttatccgctttcttattggcgcaattactgaataacagcaataatgcggccactggtataaacatcagatacttacctaccatgatgttatgagttctttttctgtttagcattttaattcgtttttttaagggtaatacactaaagttgttatagaagtttgctgcagccaatgaagtatgtttaattcccaacaaatgatattgatacgatttcttgtcatagccggacgtcactacttgcttgtccgccagatactcatgattcatacgtatttcactgcgtatcaaccaggagaacggattaaaccaacataataatataaccagttgaaccagtattatatccaatgaatgcaactcacggacatgagtttgttcatgtatcaatatctcattaatttccttatccgaatattgcatcggatttatgaatatccaatgaaaaaaggaacagggctcccctacgtcttctgactgataaacaggtacacctttcagagaatagcgctgagagcagactaaagagcgatgtattttactaacttctaaaagattacgcagtaacaacatacctattcccaatccataaataatccataaccaagtaccggcctgccaggttgtcacttcaacttctgttgtagcaacgggtaaagccgtagtaaccagcacttccggtaacagtttattgtaaacggtagtaaacgtttctcctattgcatactcgtccgtccagcctgaaaaatcaatcaatggataaatcagcgaagtcacacatatcagcagcaacatgatccgtctcagcctgaaaaatgtatccttgctgaaagagagcttatagaatgcatataatacaatcaaagctatatttactttaatcaaatagattgcaaaagattccatgcctatcttgatttatgattcttcatcctcaataatattgattaaatcctcgagttctttcttgctgattttacgatcgcggacaaaaaaggaaaccatttctttgtacgaacctgtaaaatagttacttactactccattcataaagctacgcttatagtcgctttctttcaccagcacatgatactgaatagaattccctaacttgaaaggagacaagaatttctttttctccagattacggactacagaggcaacacttgtatatggaggttttggttccggcatttcattcacaatctcccggataaaactaggccccattttccaaaagtaaatcatcacttcttcctcttgttgtgtcaatctttccatattgtcatcttttatac

SEQ ID NO: 331 - DNA, 2779 bp, Bacteroides thetaiotaomicron
gggacttgataaatactcacgaatataagacattcgttcatcatcactgtaatagttgtacttctttttcgaatatttcatctttattttcgatttttgaagtgtcaacttattcagtacactacatattgatatctagctgtatagagtactatcggtaatgctatagagtttatgttcatgtcttaactgatttgaatcatttcagtataattttgattcaactactgattcacatttttaattttaaaatatgcaacagggttatttgtagtttaagaaataattcatatctttacaagacagcataatacttttgaaactgaaaaaataattattgcacatattgatactatctgtgttttcaagggttcaacggaaaaatgggaaaagaattttttatcccctcgtttaacttacttgtttgttttttattcatataagcaaaactataataatgaaacatttatcatatgtgttaacactagtgctaatattttttgtagcttgtagacggcaacaatcagtgtctactccgttaaatgctgcagagcgaatactcaaagacaatccggatagtgcttttcgtattatacaaagtattccttatcctgataaactggataaggaagatttagtgcgttggtgcttgatagctggtaaagctgctgacaaattgaatacgtctcttcctccttcttactatttcgatcatgcatattcttggctgattaaatatggaataactaaagatcaagtagatatagggttgttttgggggcgctctctagtggctgatggggaatatgataaggcaatgagcatttatgcagaagtattggcaatcgcaaaagagaaagaactatataatgaagcaggctatatatgtacgtatatagctgatctatatgattttagggatatgcaaaaggaggccagacatcaatatgaagaagctcaaggactgtttaagaaagcgggaaatatcaaaagtcatgtatttgctttacaaaatatagctcgtgaatgggcctttttcgattctctggaatgtgctttaaaatatatgggaatagcggattctattgcccagcagttgaatgataatgaggttagctcttctctagataatgcttttggtaacatttatttggcaatgaaccaatactctaaagcagaatatcatttccttaaatcaacatctttggataaagaaaatgaattgtataatacaaactgtctgatcaagctatatctgcaagtaggtgatattttaaaagctcgtgagcttttgtatacactacctttagatagctctgaatatgaatatggtatagagcgggctttttatcgggtaactaaagcggaaggtagctataaagaagcacttaaacatttagaaacatgtgaatccattagtgactctattactatactacagaataatacaaaaatactggaagtagaaaagaaatttaataatttgaggcttaaagaaaagaatcatcaattggaactcactcagcaaaagtatatgattataatttgtatatgtttgatttttggtatagctatcacattactctatttgctgtacaggcaaaaaaccaaaaatgaaatgaataagcaagcccttgagttgaataatataaaactagagttggctaatgcctttatagagttggataaaaagaaaaatcaattagtggtttcgcaaaaagagaatgaaagtagtcaaagtcgattagaaaatgaaattaaaaacttaacctctaattataagaaattgcagcgaagaagaattgttacgtcaataatttttagaaaattagtgaatatcgctgaacgtagtacgaattgcaatgaaccattactaacggagcaattatggttctctattgtttctgaaataacagaaacttatccgaatttaaaaatgtatttattagaacgatacccaaatttatcaagtcaggaatgggaatattgttgtttatgcatgtttaattttgattcgaaaaccgaagctagattgcttggtattaatcctagttcagtttctacaaagcgattaagattcagacaaaaattgggaatctctgctttataggaagaagctaacttgtgtgagtacctgattaacgagcttttaaaataatcctatttaagtagttcttttctgaataaggcaatgcatgctgctatattgatagtggcatgcactttttttattttaatgctctgaaagtccccttgaaatagtgaatgtatactatatgtctatgttgtttttataagttgttgataatcaagttctgcctgtctattttgatattgttttgaatataacaaacgaatcatctatcccctatatttgcaaaaaacaaaattaataaatatgaaaaagtttgagcttgtattattagtgatgttattaatacatagtttttcagttatgattgaagctaaacagcatgttaaaactaaaagtgattgggttatacaaagaactcctgttgaccccgaatggcttaaagtgtatgtggatgatgaaagcaaaagactttgtcttaattttaaagacagttttgctcctataactgttgaagtaaaagatatcgaaaaacaaatcgtatttcaatctataatattccctgttgcggcaggagagtatactctttatttaggtgatctatcattaggtcaatatgagttgtatatgtacaatgcgagtgttaaggttgtaggaaactttactctttaaggattgatatataga

SEQ ID NO: 332 - DNA, 2721 bp, Bacteroides thetaiotaomicron
gtaaaaaggcatggaagattatcttccgtgcctttttgtcatatttgctgccattgaaattataattctgccttataacaaataaattaattgatgcaaatcaattaatatgctataaaacataaatttctttcctttttcggctcaatctataaacaatggtcgtatttttgtgttataaaacatgtaattaggaggataacaaaatgaaaaagttagaaagattgtttagaaagatcggcaatgccgatgtacatgtttggggatactcaacacttggcatactccccaaagagaagatttaagttttttagttttcaggtattagtaattttaaaggtttaaagattatggcaaagaaaatgagttcattaattagaaaaatcctcagtgaagtaggtcgcaacgaaatgctttcatgggggtacagaattgaaaaatgagattcagtacattaactaagcttgagtggggatgcgttattgaaaacgttatccccactttttattctgtcatttaggctgtatagtggttaatccgcgttctttatctttctgttttccatgttccgatagttcttgtcgcactatcaaagtttacccccacttttattattttccagtctcccacctgatagggaatggcatactccttactattaatctgcgccaatgcttcttccggtgtaccgtccactttaaattcaaagacataaagggtatcttgtaattttacaatggcgtcagcccttccgatagctgtatctacttccacatctatatattgccccatcagcctgaaaaatagatagaagatggtttggtaatgtttctcttctttattatttaacttattagggatagaagcgaagaaggactttagtctttccaggcatccatccaaatttccggcacgtaagtctttaataaatgatactatataaaatgtattctctcgtgcgggcaaatgtacataagcaggcatgagagattcgagaaatcctttcctgacttccttgttggggtaagctagggtatagagctgaaaactcgggtcatatcctttaatagtgagatagccgctttgataaagtactggaagagggtcggtaattctattagtgggagcatcaaattgttctgctgtagcagtagtgtcatccaactcacggatatcaaagttactttcttgtaggagatctatcaaaaaagtgggagtaccggtagaaaaccaaaaattggaatactttttttgtgcgaaagcattgaacagactgaatggattataaatatcctcgctattttcactaaaatgatatccgtcatattgttgtttcagatgagtacaagcttcttcatatgtttcgttattggcttgagccatctgttcgatatcgatttgcagtgtgtgtacctcttgttcggtaatgccgcatatagcgctatattcatcccacatactgatattttgcaagttgttcagttcgctaaagatactcatttgactgaatttgctgatacctgtgataaaaaggaaacggatatattggccttgcgctttcaaagggctgaagaaatcgcgcataatatcacgaatttctatttgcaattccgtattgttattactgtccagcatgggagcatcatattcatctacaagtatcacaactggtttgccggtctgtgtatatgcgcgttgtatgattccctttaaacgaaggctgaaagtcgtttctccttcttcgcgtccatataatttttcccattgcagtaactggtaattaatgacggctgataacgcttcggcagtcatatatttactcacactgaaatcaatatgtagcaccggataaacagcccattctttttccagagtttccattgccaatccgttgaacaagtctttctttccggaaaaataagcttcgagtgtagatactagcagacttttcccgaatcgtcggggacggcttaaaaaataaaccttatttgtgtttgtcaaacggtaaattaactccgttttatcaacgtacacataaccattatttcgcaaatcttcgaaattctgtattcctatcgggtatcgtctgagtctctcgtccatctaaattacatttttatatgaaacatagacaaagatagaactaaataggggaaaatcaaagatcaaaaagtatattgttgttttcttccatttttattttcgtatttcttttcacataatatactcttgttttcttcccatattacgatacattcttttagctcctcacctgttttatttctatttgtgtatatatcggtctcatggtgaaaaaatgaccttcttaaaaagggaatatttaaacagtcaggaaggcgctaatgccaacatcatataaatatagaatgaaaaagcttcggcatttgtaactatgatatttactctttttatgaattggatggttttgtgattaaattgaagctgtcttgatcttaaactggttatttggtaactttattgaaatttgatgattcattatgctattgttatcatgtttgttattgtcgataaactagagaaaaatagcctccctatgcctcttttattactttttggccagtgataaataagttcctcggtgaggaaagagtcgttggtttaaaaggaacatcccgttggttttaaaccaacgaaggttttgttggtaagaaaagatgcatatttcacgtacctttatgt

SEQ ID NO: 333 - DNA, 2694 bp, Bacteroides thetaiotaomicron
cctcaataaactaaaacaaaacaacttataaaactatagtattatgaaaaacattttattcacactttttgctattctcatcttaactagctgcagcaaagatgaagaagattggactgaacttaacagcaataacattataggttattggtcgacaggaatcgaaggtactcacaaattattaagtttcgatgaggatggtactggctcttttggaatttacagcaatgctactccaatttcctttcaaatgttcgattataaaatcgaggaaggtagaatctatatttatgatgtatatccagatgaaaagactccatattatttagattgtaagatatcaggcacgactcttaaagtcgaaaccggaagtgaagctggaacctataagaagcaaaaataaaagaatttaggagcccaattaattgattatataacacaaaaaacaatatgatgaaaaagtttttttatttaactgcaatactaaccatagttttggtttcatgtaattcagaaaagaagtataaagaaaaactctctaatgctgcttccatgattgagaaagaagctaatttaagtgaagctatagttcttacctattgtgatacttggagaaaagtaatttatgatcatgaatacaatggggagtattgcaccgatttcaatgaagccttagctaagcttaatgagttcataatcacaacagatacgtataaaaggttaaaacaaaagagagattcaatcgagactataatgccactactaaatgattatccttcaaattgcaaggatgcttataatgagttagtatcaatatatgcggatgcagatgaattattcagatttgcagatgatcctagagggtctttatctacatactcaacaaaaacgacagacctttttcaaaagatagaaaagtccatgaaagaatttaaagttaagcatatacaaaacaaataaataaggagtctagttaattgattgtgctactaaatacgaaatacagaaatctaaaataaacttttatggtaaagataaatataactgcggaaacaaatggatttgttttgttagaacatggagaagtttttataaagaacaacaatgatgtttctttgaaattaatccccaatgagcaagaagttccccttattattaatattgaatttgctaacaaaggaggacgtatagcttctgttgatagaaatatagtgaatgataaactggttttcacttgtaataattttcaaagtgagccaggcaattggggtggaataattgaaccaatgctgattgcagaaatggatgattgcaatctctatctaagctttttagtttggaacattgatactacaaactataatcgtcttttgaattattcattttggctaaaaaagaaataaaatggacagtaagttaaaagttacctcccaagacgatataatctcaacgagcgatgaaaatctagtaaagacaaaaaactcagaaaccccaataaagctaaaaagcccagaaacctcaataaccaatattattggcagtggtgaagatgctaggaattctataatttacctagttctaaagtgggctttcatagcagcagcagtaattagcactttagtaattataaacaattggctttttagagattgtgagaataaagtacctgatataacaagtgaccttaaagtaatatgggagatagttactcctattataacattggctttgggatatgcatttggcaaatccgagaaataaataaaattgattgtgtaactaaaacatacgacattatgaaagattatattgtaaaatttgaattgaatgatactacttacgaattacctttctctgcagatgtaaatagtagtacagtattaaaacaatgcgccgagcaatgggttgaagactatgtaaaccaaacaattaaatcaggaatggtacaatggcggattttaagcgtgagagaagatgaaaaataaaatatccatttggctatcatcaattgccttatttttcgctttactggctgcaggatttacattttttagaaccactccgatggaagctgattggctaggcatattagtcggtatccttgcattgtctactactatattgcttggatggcaaatcattagttatataggatttaaagatgaagttaaaaaggagatggaaaagactaaagcagaactcaaagaaacaacggataacatagataatatgattcaacaaaagataaatgaaactcaaaatattatctacaaaaagaatgaattatatatacaaggaagcatagcttacttagaagcttatgctaaaattcttaaagacgacgcaacgtctgacaattacagtttcgcttatggaagtttagttaactctcttaattgttattgtaaatatggttgcgccgctgaagtaaatatagataagtgtttatcggcattaaaacgtataatttcagatttcgacaatttacagaaacaaagacatggagacaatcctttcaatcaatatatacaaaagaatttttctgatttagaattctctagagataatttatttgcaaaattaaaagcgggaattttagagtcgaataagaccggcatccctcaaaaatacatagatgaattccttgaaattgaagaagaaagaaaaagaataatagaacaaaataaattaagt

SEQ ID NO: 334 - DNA, 2678 bp, Bacteroides thetaiotaomicron
gttttaagtattaagtattaattccatgcggaatatagcgtatatcatattgcatagccggttaatacttactactttatacttaatacttgttttttatctcttgtttatcggtcgatgtccggaactacatagtccagtgttcctccgatggcaatcaagtcggcaattttcgctccgcggcaaatcgtgtcgattgcagcaacaagtggcaatcccgtagcacgatagtgcaggcgataaggcatcttgtcaccctgactttcgagaaagactccgaattctccgcggcttccttctacggcggcataataactgccttcgggaacgcggatgatcggtttcatcttttcctgatacgggccttcgggaatgttgtctatcaactgctcgataatcttcagactctccatgatttcgtccatacgtaccagataacgggcgaaacagtctccttccgtataaacaatttcctggaagtccaccttgtcatatacaccgtacggtatccgcttacgtacatcgcaagcccaacccgaagcacggcctgtacccccggtgcaaccgaatgagattgcatcttcacggcttaacactccgacgcccttcatacggctctgagcgataatgttgccggtaaatatgtcgtggtattcgtgaatgatacctctcatataagggataaattcttttacccgcttgacgaagttaggatgaaggtcggcctgtacaccaccgatggtattgtagttcatgatcagacgtccgccgcaagtctcttcaaaaatatcgagaatcttttcacggtcacggaatccgtagaagaaagcagtcagtgctccaaggtccatggcgagggcggagtagaacagtaagtgagagtcgatacgttgcagctcatccataattgtacgaatgtatttgacacggtcactcacttcgatgcccatcgctttctcgatgcacatacacaaagcgtgacggttctgatgtgcgcccagatagtcgaggcggtcagtcaatgccaatgtctgcggatatgtaagactctcgttcattttctcgataccccgatggatataaccgcagttagcatcgatcttacgaataatttcaccttcaagagaaacgcggaagcgcattacaccgtgagttgcagggtgttgcggaccaatgttgactacatactcttcttctccgaagagtttcatttctctgtttttaatcgttccgtccggattaagttctatttcctgtgttgtatcgaacgtctcttcgttagccatacaaagcggattatctttctccggatcattatctttacgcatggggtatcctacccagtcattacgtaagtaaaggcggcgcatatcgggatgccctacgaaaacaatgccatagtagtcgaacacttcacgttcgtagaagtcggctattttccatatatcgctgactgacggaatttccggtcgttcacggtcggtaacggctgttttcagtgctatccgttctcccgtaacagtcgattccagatggtagacaacgcctaaaccacggagtttctccggtgcgtctttttcgtctgctactccccagtccataccagtgaggctttcaaggaagtccatctgtttttcatttcgcaagcgcagcatttcgtcgtgtaacgctgcagggactataaattgtatttcttgcataattcttcgttcctcattcttcatttcataaattccggtttcttctcttttctgttcgttccaccaaagaatttctctattttcactttgcgttgtagttgcatcatgccgtaatagaaagcttccgggcggggcggacatccggggatatatacatcgaccggaagaatcttatctactccattcagcacatgataagacttcttgaaaggccctccgctgacagcacatccgcctacggcaactacatatttcggatcgggcatctgatcgtacaaacgtttcagtaccggtgccatcttgttggtgattgttccgcagaccatgatcatatcagcttggcgcggactggcacgtgctacttcgaacccgaagcgggccatatcataacgcgcggcacccagtgccatgaattcgatgccgcaacagctggttgcgaaagtaagcggccacagtgaattgctgcgtccccagttgacaaggtcgtccagaaccccaagaaaaacgttcgctcctccggtattaagttccttgaccaacttttccaatgattcattgtcgatgaactcatcatacggaattgattttattttcggttttttggttatttccattccaaagctcctttcctccaggcataagcaaggcccagaaccaaaataataaagaagaagagaatactaacgagcccctgaggtcccatgtcatgcataactactgcccaagggaacagaaaagctgtttccacgtcgaacatcaggaacaggatggcaaacaggtagtaacctacacggaactgcatccatgatttaccacgcgttggtataccacattcataagcttcaaacttttgtacattgtacgaacgtggtgaaatagctcgtgaaagggctattactacaccgacaaaagcgagcgctgtcagtaaaacaacaactaaaaatgtaaaattcataatttcaatagctgtttagattg

SEQ ID NO: 335 - DNA, 2654 bp, Bacteroides thetaiotaomicron
ttactattgtatacaattatatgcttgaaacttggggtattaatttagatgatttgcgtgagattgtgttaaggcgtcagcaagaaattccggagctggatttaagtactattgaataaaacaggaagattatgaaaaagaatataatgatttatttgttgatggctcttgtatgctttggtttgcaatcctgtcttttccaggaagaggattattttgatgattcttcagcgaaccgtgcaacagaggaagtgaagcaatatagtgagctattagaatcggcatctaatggttggagaatggaatattacataggtcaggactatgctttgggaggcataactcttctgtgcaagtttgatggtcagcgagttacaatggcatctcaaggatacgaaggcgatgagactatttcctctctttataaggttgtatcggaggaagctactatgcttacattcgacacttataatgcttttattcatgcatatgccaagccacaaggcggaggttccaaccccaatgccaacctgcaaggagattacgagtttattataaaggaagcttcagccgagaaaattgtaatgcagggcaaaaagtatggaaatacgatagtaatgtatgcgcttccggatgatttgaactgggaggcatatataaactctgtgaatgatgtagaagagaatgctttctttatacaatatcagttgttggttgatggaaatttagttggtatgacgcagcgaagtaattatacttttgttatagcctataatgatggtggtaacattgtacaagagcaatctcctttcctttttacaaccgatggctttcgtttccgggaaccagtttcactggcaggagtaactgtgcaaaattttgtgtgggacccttcctccgagctttttacttgtactgacgagggggcaactaacgttaaaatgaaaggaatttatccggagggatatattaaatataatgattatctaggtaattatactcttacctgcaagatgtataaagataataatttgacagacgaagaattaccaatatctattatggaggatgtagaaaataagagttatattctcaggggactaattggtgatatagtgctcgattatgatagaggtgaaggaattatgtcctttaagactcaaaaggtaggttatatatcaggatattatttgggatgtactacatattgttatgccatgggattttatcctacatatattagttatcaggcaggtctgatgtttggttttgtggcaaatgtacaacagtctccgtttggatttacatttgaggatgatggggtattcgaagcagtaggtggtgcaaaagctgattatatggccttcgaccgctattcggcacctgattatagtcaaagttcatatgttcaaggggtggaacgtatgtatggagagatggtctttatgaaagttgaggaataaataaaaaactagattatgaaaaatatactgaatttatacttaataatattctgcttattttttgttgcaggatgttcttcagatgacgatgctgccactgtaaaattgacaattataaaatcagatttggatatgaaagctagtggtggcactggaactgtcgaatttgcagcaactggaactgtcacggctacggtgaatgccgattggtgtcaggtaatcgaagttgcagatcataaagtttccatttctgtagatgctaatacaggttatccggggcgtagcgcacaaatcgttttaactgatggtgtgagtacgcagcaagcaaccatactgcaggaaggagctatttggaaatataatagagatgctacctatttcacattgacagatgctgcagaggaggtccctgttgaaatgtcgagtaatttgcctattcaggtatctattccagcagatgcttctcaatggttatcctatgaaatgacgagtgatggatttaagtttattgcaaaagagaatctcactggtaaaattcgttcggccattgtaaaagtgactactggcattcgtgaaattgaatatgctttattgcagtacgatattgatgacttattgggacaatggacaggtgttgtgaaagtcgttgctacagcatttggtattaatcaagttctttcattagaggaaaatactcaaattgttaaaaatccgggtggtaatggctatatattccagctaccaatgacaagactgttgggagcaacgattgttttagcggtcacctatcaagatggagctttagttataaccactccacagcagcaaaattatgctttgtctgatgggcaaggaggagtgatgtacggctcaataataactaaaactgatgatggtttgtatttacagggaaaaattattctttctcctgtattaatgaatgatgggcaggttgcgttagcttatattacagatgcatatatgtcaatgggattatttaagggaagagttccgtctactgcaaattatgcaggactttctattgattttcctgctattttgatgcaatatgctgaataatattttgcatgaaatactatttttatatagtggtttaactgtttgttatgagaagaacttgcattaattgatcctaagagctattatcgtaaggtagtagctcttaatatt

SEQ ID NO: 336 - DNA, 2613 bp, Bacteroides thetaiotaomicron
tagaatatatctgatacatttagtgaggaaaaaaacacggatttcattttttttatgaaatccgtgttgataagggagattagtttttatttgtttggaataccttgtttacatcaaaatcattccaccatttttcattttctgtaccaccgctcgttacccagtcgctgaattgtgaataagcagttttgatatttacatactctaaaggccatttgaaattggaaggaaccatgataccccatgccagattctctttactgatataatattttttgctgccatgatgactgttatcgttgtttccgccaaacagatcggtgtttgcgagtttggttggttgatagcctgcaacatgtatttccttacgtgggtttctgttgccgtctacgatgataaagacattcaaattgttgacattaaaagcatctgctgatattgtcggattattgaaggtaatggagaaactgatattcttaggtttggtattgcctgcatagtctgagacagtattaatctgctcataccgatctcttcccaatactttatgagcatcatcaaacagaggaatcacagcataatcctgaccactttcgatattgttattatttagattgaaattcttggcaagagtattgtcactgaattcaactgactgtgtaatggcattggcgggtacattgtccagcataatagctgctccgatgcttttggttgctccggctgcggataagtcaatacttaactcgaattttgttactttattctctttattagtatatattttccttttctgaatggtcagaacgatatcattcatatcataatctccatatagtggccattggtcttcgaagaggtaagtataatctttgttgtcttccacttcaatagggaattcaggatcttccgggtcaggggtagggtcaggtatttctgaaagttcaccacatgaagtaatgattgttttggaaccattcgggatatataattctactgaattttccataatgtaattagggttattggcaggtacccctttggcgaattccccttccgggcattcaatatccaaattaccattgaacttagttgtccaaccagtagatatgctttttgtggattttattaatgaacgagttccggcagctttaaaagtgacattaggaatatccattatctctgcttttatcatagaaccattattcagttcaaaagtgcttccgctattaccgcatttaaaagatggaatagctataaaagtaccattttctacgccaccagccaatatacctttattcattatgatagttccgcttgttcctccgaattcgaaagaattttgggcataaagactgcaattattagtaaaagtagggttaccgccattatcattacttattttttgagcattaacagttccatcatttacaccaatcccacctataatgaaagttggagtattaattgttgcttcagttccattataaaaatagcatgttgcatcttgagaattaaactttaatgcaccttcttgaatagtcaattctccaaagttataaatagctcctttggtaaatacggactgttcccaagaagcaacagattttcctgtaacattaattgtggctttaggagcattgtataaaatagacgtcgtattcaagtccttcatactattgacactaattgttccaaaatttttcagtaatactcctatggcagcaagattgatgttattgccaataagacttccgcctgattgaatcgttaatattgagttgtcagcaataagaaaactcgtgaatgaatcggtgttgatttttccacccttcaaaataataatatctgcactttgtatttggttttgcgagggtgtccattcaccttctacaaatatggtaaatcttccgccattcaaatatccactggtatggttgatttcaccattaaatttgttttttatgatatagcttttgcctgcttccaaatgatgatttgattgattccaattagtattacctgtaagttcaatagctcctgtggtatcataagtttcttcgggatatttttctggaatattatagcttccgatggtcgcttttgcaactcttgtagtccttgaacctacaaattctttatttttagatacatcccatgtactaatagacactctgcttctagagtctgtcttacgaatatataggtaattagttccttctgtataatttatttcttgtgaaaaagcttgacctttcttggcaactcctttggcaagtatatggtaatcagacgttgaaaatggatttgcgtccaatatttctatttggttgtaaagttcatcatcaatttctatgtttagaatactagttgtagtcatattccagtcaaatccatccggtgcagcaaaaccgtctcccattggattggctgtctgataagacggatcatatagatccttctcggaatctacgcaactggataacatgcttactattgctatcgcaataatagatgtaagcagaattgtttttttcatcataatgtctattgtttgattgtttttttgtttgctgcaaagatagttgtatattttggattaaagatgtattt

SEQ ID NO: 337 - DNA, 2560 bp, Bacteroides thetaiotaomicron
gcgatcaggtagtattaaatataacctcaaatattaataaagaagataaaattttgaatgctgatttacagatttcttactctactattaatggcataaaagtagaaaaaattccactaattatagataaaggaaagttgacatttgtgtataaaatccattcggaacagaatccttttattctaccagctgaaggtggtagatttgagttaccttttacttgtaaaaaacagacatatttgaatggccagtttatagaggaaacttattcatcattaaacggattgagatttaaaacgataagtagtggtaatgtctggttccttacagtcagaaaagacggagaaaaaattggtttttacaaattttcttttgtgggagaaggaccatataaccaaaaaacagatccagagtgctattttaacatatatacccatgatgcagatttaattacagataatcctacagaaatattcagacaagattttatacaaccccagaccccgggtgaggattattataaaccttcccggtcctcttataaacatggcacttttgacttttaacgtattcagtattaaccttaattatataaattatgaaacaacatgcacatttattgattttgacaattatgtttttaacttcatgttccgatgacacagaagtaatgaaacaagaatcttcgccaccatctttaacagaaaaagccccgacttatcgtactaaagagaatgctattattgaagtggaactttttattaaaaataatagaaacaatacacgaaatagctcttttcttaattattcaataaacaatgaaatctatttctatagagatacaattactaatcagacatatccctcattttatatagccaatgcagagggtggcaatggctatgcaatagtatcggccaacctatatacaactcctattattgcttattcagagtctggcaatctttctttaagtgacacgcttcaatatcaggaattatctttcttttttgatttagttcaaaattacatttctaataataaaaagtatgagatagagttcaaagaagaaaatgatgacgataactctttagacacatctcaaacaaggggtagaagacgtcctatttatataaagaaacctggagaatgggaagaaacggaaagagtacaacctttgatttctgttaaatggggacaaaggagtccatataacaatgcggcacctcttatagaaggacaaagagccctcacaggctgtgtagctactgcaatagctcaagtaatggcatatcatgaaaaaccttcagggtataatggggtgtcatataattggtctgaaatgaaacaattccccaccactccagcagttgcccatttattccgctctataggtgatttggttaaaatggattggggaacagatacaagcggagctaaaagaaaaaatataccacaatgcttcgagaaaatgggatataggaaacccaataatcctcaaatttatagtcaatgggatgttataacatctattaaagctaaatgtccggttataatatgtggcaattcggtaagaaagaaaatactgggtattaaatattaccaaaatggtcatgcttgggtttctgatggctattttcatagagagagaaatgttgatgtctatagaaaaggaagcgataaagttcatcattcgtatacggagaaagaagattacctgcatctaaactggggctggaatggtaatagtaatggttattatttggcgggtatttttaatggaggtgaaggacctacttttccttctactagagcagccggcaagggtaattatccatataatgtagaaataattccatatattaacataataaaataagaaatatgagacaaacttattattttctgtctttcgtgttacttttatttgtattcatttcatgtagcaatgacgtcgttggcaagggaacagatacgataggcctagagactaaagaggtattttttaaatccagtaaagattctatagagttacgaaccaggaaaggtgacgactggtggctgactgaaatctctactaaagacacgatatatagaacacactcccttaatgttcaagtaatagaaggtggtggactttatgtggagaaaacaggtcgcaaatcaatctttatcaggattgattcaaatttaacaggcttggaaaggagatttacaacagttatacaagcagggaattactataatacaattactataatacaaaaggccaaagaataaataaaaaggtggagactgctattctccgcctttttgtttacttactttttagttctagaactaagttttatatttcaagtgatactataaagaatcaacctccattaaaatcagctattgattttataaatggattacgggatcttccaatgaaacgtatggtggctgacgaaggtatccttgctggaaaattaataataaattggacggtatgattataaaaaaataagtttctatgtttaaaatctgaagtgacggataacagtagatagcactaaaa

SEQ ID NO: 338 - DNA, 2533 bp, Bacteroides thetaiotaomicron
attaaaaggtgatgaatatacactaatagtatgcaagttggttattttagttttctacttttttttcttgtcccttttttgttttaagcagatgtctttgtttaaaaaactttattccaattcatctgcgcacgattttatcttatcctttcattccctaagaagatggagtagttgtgatctgtggcggatataggtggatgagaagatttaaagtataaaccgacctatgaatttcatcttccatcttttttttagtaattttgcccaatcaactcaataacaaataaataatggatgaattaaacaatggggaacaagggcaatatgtcgaacccgggaaaaatgagaagaaaaataatacacgaaaaattgtaaaaagaactttgattacggcaggactagctttggctgtatacatggtatactccatcgtttatctgtttatttcgcccgaccgtaatattcagcagatctatctggtgccagaggatgcagcgtttatcattcagtcatctgctccgatagaagactgggaaaagtttagtggaagcgaaacctggcaatgtctgagaaaagcgaaatcatttgaagaagttgcgaagagcgtggaaaagcttgactcggttgtcaaaagcaataaagtactgttatcactggtcggtcagcgggatctgcttatctcacttcataagacccgcgctaccgattgggattttctgcttatagtagatatgcagaaagcttctaaaatggatttattgaaggatcaggtcgaaacagtgctggcaatgtccggctttaccgtcactaatcgaatgcataatggaattaacattcttgaaatgcgtgatccggatacccgtgatgtcttttatactgcttttgtggataatcacctggtaggctcttatacttccggccttgttgaatctgccatcaactcccgtaataagcctaagatcggacttgaccagtcttttattgaaacggaaaaattagtttccggtaaagggcttgtcagggtatttatcaactatgcccgtattcctcagtttatgtccatttatctgggagcgagaaatgaatatgtcgatctgttcagtaattctatgaattttgcgggcctttacctgaatatggataaggaccggatggaagtgaaaggttatacgttgaagaaagattcggtggatccttatatcactgccttgctgaattcgggaaagcataaaatgaaagctcacgagattttgtccgggcgaacggctctttatacaaatatcggcttcgatagtccggtaactttcgtgaaggaactagagaacgctctgtctgttcatgataaactgttgtatgactcttatcagagttcgcggaaaaagatagaaagcctgtttggtatttctctggaagagaacttcctgagctggatgtccggagagtttgccataacgcaatccgaaccgggcttattaggacatgatcctgaagtgattctggctattcgggcaaaaagcatcaaagacgcccgtaagaatatggagtttattgaaaagaagatcaaacgccggtctccggttaagataaagtctgttaattataaggactttgaaatcaattatgttgaaatgaaaggtttcttccgtctgttcttcggaaagctgtttgataaatttgagaagccatattatacttatgtggatgattatgtcgttttcagcaataaaccggcttccttgctttcctttgtagaagattacgaacagaagaatttactgaagaataatgcaggatttaaggatgcttattcgtatatgaaatcaagttccacaatcttcttgtatacagatatgcacaagttctactcacaattgaaacctatgatgaatcccgctacatggaatgaaatacaatcgaataaagatatcttgtattcatttccttactggacgatgcaggtaatcggagataacaaccaagcttctctgcagtatgtgatggattaccgtccgtacgagccggaagaggtggtggccgttgtcagcgatgaggaagatcaggatatggatgaagaagctgtgaccgaaaaggagcagatgagtgagttaaagcgtttctatattgagaagtttgaaggaaatgttctgcgtgagttctatccggaaggagcattgaaaagcgaagcggaagtgaaagagggaaaacgtcacggacgttaccgtgaatatcacgaaaatggaaagctcaagcttcgtgggaaatattcaaataatcagcctaaaggcacatggaagtattacaccgaagaaggtgaatttgaacggaaggagaagttttaaatgaacttctcctgattggatatatatcttatttaatattttcttctgtgctgggacaagaagttatctataaagcggacgatataaacgacagcaactccggctatgaccaatacgataatacgactcaacatagtttttgattttatatttgacaggcacaaagataaataagatatatgatatatggg

SEQ ID NO: 339 - DNA, 2462 bp, Bacteroides thetaiotaomicron
tggagtgcatacaagagccagtccattccaggatatattacctttaagaatggactggatagattttatacacagtttgaactgtatgagttaatcagctaagacttgtgtataaagggtagcttcccgaaggaggagagttgtgatagaaccgactttttagtcagcctcttttcagcctgttattttaatctatacttgttattttaatctataaatgaaatagtcaggctagttcttctatggctgtaaaagcctgcttttaaagtttacgtatttctgcgtccaaggacaatgcacaagacatttcaaacaggtactgcatccatatacatcaattatatcatctcttgagattgttatattccaggtggttcctttcaatacttttctttcgcatatatccctacaaatattacaattaccacacttcggggaaataggggcatacggtacagtttctaacggtgcatcagttaaaacagtaccaagacattgcgctgcaccatattcaggagtaataaacagattgtttttcccaatccatcctaatccactaagttgcgctactgttttgtgaggtaaaaccgactccttcgtttcaaaattaaacacaccttctgccaaaagtcccgcatcagattgtgaaagagctttataccctttgctgacaagaaattcagctaactcgtctgttacttctcccactctattttcagtttttacatactcatcttcaagaacaggtttataatcaggattattaaatacatcttttacaaacttcggatttattgcgattcctattaatatagcacatggcaaacctctattctgcttattggtcaacttggatatatctacgaaatgaacaaaatctacccttgactttttcaattcattctctacttctttattcatatttctttctttttgacagggatataaatatctgtgattagttccgaaaccggagttttttcgggtgtattgatataagtctcaaaagtaaatggttctcgcaagctataatcatttgcaggtagccaatcaagataaatataacgatataccctattcagttcatgatatagtcctttaaaacgaaatatagcatattcacccgcaggaacttcataaacaccgaaccccttcggaattttaaatgattgtggtaatgttactccaaccataaaacgactttgttcttcaagcgtgataaaaggataatcaagagtcaggcttacatatttacatccttttgataataatccatagctttcagaaaattgtagcacctgtttccataaaactgaaaaactatggctgacatgatgtgttctctctaattttaaatatgcaatccgtgtatgaggcactctttcaatacttggttcaatctgtattggattcttaccttcagaacaggcatttgaatgtcttttacgaaattcaggtatagagcaattaaaatagtttttgaatgcccttgaaagagtatgtttattctgataattgatttgactaagaatttcggagacacttacattggtggatattaacttaaaagcaatgtactccaatcttaatcgttggatgtaattcccaaggctatcaccgcaaacagctttaaaaagtcggcggaaatgatacttggaaatgcatacaatttgggataacttttcagaatcaaggtcatcaaataaatgacaattgatatattcttgaactctgatcaccaattcatattgtatgtgagcggtattaattttttgcttccatcttttaatttcaggtaaccgtctggacataatttctctcaactccgacgaagtatggcgtatgccgacctctttatagtattcttcgggaaaaagtccccaaaggtagataagataatccattgagaagtcatacagtttaactccatttttcagacagtaatcacaatattcctcattttggtccgccttcagattggtataatcaatatccaaaggtatcccgcaagtctggcaatattttgtttcagaattgatgttcataagttttttattattgagtgcaaagttaaccaatatgttatgcaaaaagttaccagaaatagccttctttcgctttaatttgctttttattggttctacacatctcccccatgtaatttgaatgcgtttttgctctcatgctctaacaatttgcctgtatccctttattcatcgttgtttcaggtatggtagcaagtgtggtagcaggtatgagagcaaacgtttgctctcatacctgtcttgtatctatgttgtcaattccatcctgattcttctcatgcaaactgcaatttgtcttaccctggatttggttgactactataagtatcaactaaaatgaataaaagatgaaaaagagtgacatgacctttagtccttatcagcttgaacttcttggcgatttctatcgttcgaatt

SEQ ID NO: 340 - DNA, 2458 bp, Bacteroides thetaiotaomicron
aaattcaggtggttatagcacgagggttccacctcttcccattccgaacagagaagttaagcctcgtcacgccgatggtactgcgtaacagtgggagagtaggtagccgccatttttagagaagccccgccagtctttattgactggcggggatttcttgttttggcagtttaggaaaaaatagctatatttgccgacgacaattattttattaaacgtttaaagcaaattaaaaggtatgaaaacaaaactttttttggctgctgtagcagtaacattttctttcgctgtgatctcttgttctggtaacaaagctaataacgctgccgcttctgaaggtgaagaagcaacagttgaaactgtagaagctgttgctgttgaagcaactgactcttgctgccaggcgaaagactcttgtgctactgcttgcgataagaaagctgattgcacagaaaagaaggaatgctgtgataaaaagtaatctattgatttagaacgataaattaaaagggggtatagtgtgtccgcactatgccccctttttctgtttgatgaaatacggagctttattagtaatacttttctgctaataaccgactttaacttatgaaatgaaattattttcgataaaaaagtaacgtattatttggtagtacagaaataatccatacctttgcaccgtcaaactataaaagagacaaaaaatgaatcagatgtttatacatattctactatgcggtattattattctactatcaaaggttagtggaagtgagtgctgcgcgtaaatgtgtatactgaaaatatacgaaagcctttctcacttccaagtgtgaaaggtttttttttgagccaataataacataaaatgatagaagatggacaataggttatttatttttgataccacccttcgggatggtgaacaggttccgggatgccagttgaacacagtggagaagattcaggtagcgaaggcactcgaagctttgggggtcgatgtaattgaagccggcttccccatctccagcccgggagattttaattctgtgattgaaatttctaaagcggtgacttggcccactatttgtgctttgacccgtgctgttcagaaggatattgatgtagcggtagacgctttgaaattcgccaagcataaacgtatccatacaggtatcggtacttctgattctcatattaaatataaattcaactccaatcgggaagagattatcgaacgcgcggtagcagcagtgaagtatgcacgtcgttttgtggatgatgtggaattttatgcagaggatgcaggacgtaccgacaatgaatatctggcacgtgtggtagaagcggttatcaaagcgggagccacagtggtgaatataccggatacaacgggttactgtctgccttccgaatatggtgcaaagattaaatatttgattgatcatgtagacggcattgataacgcgattctttctactcactgtcataacgatttgggaatggcaacagcaaatacgattgctggtgttctgaatggagcccgtcaggtagaggtgaccattaacggtatcggcgaacgtgctggaaataccgctctcgaagaaatcgcaatgattatcaagagtcatcatgagatcgatattcagaccaatatcaatacacagaagatttatccgaccagccgtatggtatccagtttgatgaatatgcctgtccagccgaataaagcaatcgtaggtcgcaatgcttttgcccattcatcgggtatccatcaggatggtgtgttgaagaatgtagaaacttacgagattatcgatccgcatgatgtaggcatcgatgataactctatcgtactgactgcccgtagcggacgtgcggcattgaagaatcgcctgtcgttgttgggagttaacctggatcaggaaaaactggataaggtatatgaggagtttctgaaactggccgataagaaaaaagatatcaatgatgatgatgtattggtattggcaggagcagaccgcagccagaatcatcgtattaagttggagtatttgcaagtgacaagtggtgtcggtgtacgttcggttgctagtctgggactgaatatttccggtgagaagtttgaagcttgtgcgagtggtaatggtccggtggatgctgccatcaaggctctgaaaaagatcgtagatcgtcacatgacattgaaagaattcactattcaggctattagcaagggaagtgatgatgtaggtaaggttcatatgcaggtggaatatgataatcagatttattatggcttcggagcaaatacggatattatagccgcatcggtagaagcttatattgactgtattaataaattcaaggcataaaggaacagcgaaagtggtattgaaatacgtaccctgcattaattataaatcatacatagtaaaaatagatataacagatgaat

SEQ ID NO: 341 - DNA, 2454 bp, Bacteroides thetaiotaomicron
aggttttgaataaaaaattaacaggtttaaagtagaattatggcatctataaagttattgctcaataaacagcgaatgcttaataatggtacatttccattggtttttcagtttatccaccggaggcgaaagttactttattataccaagtatcatatctttcagcaacaactggctgatggagctttggaggttgagtattgtgaagcatcgctttattccatgaaagaaataaaggagataaatcgtgagttgaaacgggactataagcgattccagaatcgtatattggagttggaaaggaacaatgaggagtatttagtagatgatatcgtagagtttaaaaagaagaagagtcatcgttcgtatctacttatgcagtatatagaaacacagatttcttataaaaaaaagatggggaaagacggtattgcagccgcctatcatagcacctatatttctctgaaaaaatatataggtatgaaatctgcgcgtaagtcggatatcaggatggaggaaataaacttcagctttgtggtagggtatgaggactatttgaatgcacaaggactggcgaggaatacgattaattattatctgcgtaatttccgaacgatttataattcctctatccgggatggatttaagcctaaaagcgagaatccttttacttacattcagacaaaaccatgcaagacaataaaacgtgcaattaataaagatgatatgaagaaactttcttcgcttattttacctgttcattctggaatggacattgcgcgggatatgtatttatttagcttctatgcccaaggaatggctttcgttgatattgtatttctaaaaaagaagaatattcgtgatggaatattgagctatcgacgtcataagtcacaacagctgattcatatagttatcactcctcagatgcagggattgattgataaatacgcgaatgacagtgaatatgtgtttccaattattgatacatctttgtcgacatctatctacgatcagtatcgcctggctttaggcagggtgaaccggtatttaaaaaagatcacttttcggttaaatataaatgtccggctgactacctatactgcaaggcatacctgggctacactggcaagagaaagcggggcgcctatttctatcatcagtgcgggattagggcatacttcagaagaaatgacgagagtatatcttaaagaattcgatcaggagacgctggcgcgggtgaatcgtattgtgaccaatctgttataatatgaaacatgaatttgttcttcaaattttgtaaaactcatatttataacttatatttgtaaacggtatctattttgtaatagagagtatatcaatcgcttaataatagcgatgttgcaaaataagactattttttgcgaatagccattatcaaaaagtacattaatactctccttttgtacgatcccgcagttctccttaaagattatcggttttcgcctgataacggtctattaattgctttggagtacagcgaaaatgctgtttgaagtagcggtataactgagcttgcgactcaaagttgcatacctccattagttgcttgacacatatacccggttctataacttttcccaaaatacgtttctttaattgtttcatcatccattgttttgcggtaattccgaattcttctttgaatttaataaagaagctggttcttcctatatttgacagtgtaattagctcatcaagattatttacttttgaatagttctgcatgacaaaatctctaaactctaattgcctgccaatgatagggtggaaaagtgtagcaatttcttttttattatagaatcccctgagtaggaagaaaaattcacgttctattacattatgtaggtatgtacagttcatttcattcctcaaacagtggactacagtttcaaggaatggcattagtggataacgcatggggatagggctgaaatcatagtcaatattttcacaaatggagctcaaaccttgaaataaaagtttgtcacagttgctttgaggtatatcaaatgccatagccagcatttgggatttgtctgttgcggaaatctttatcattgaagatttaggcaacactaccatttcattgctatgaaacgtgcggttacaaaattggttacagtatactgaaaaatctccttctaaaaaaaataaaagataatttttgtgggtatactcttcctctatgcatttctcagtgtcgaatttaatatatttgaatcctgtatcaatatctgtcatgtaatttttgcatgacaaatgttccctggcgtaatgtaatccgttcggtgattgttcccctctcatatctttccctttttgatggcaacaaagcgattatactccattatgcttcataattgattcagtatggtctaatataatcactttattaccaatgtattataa

SEQ ID NO: 342 - DNA, 2357 bp, Bacteroides thetaiotaomicron
ctattatataacatcgttctatgcaggagatccaacgttttaataaagttttaaaatcttgtgtcctttttggggatataattttgttgaattcattgctatggggatttgaactggttttgggcagtcgcttttattctggtaatttaacttctctttatcaagggatggttctgcttagtctatgctatctggtttgcaatattcaatcaggggttattttgcatcatccagttgttcgtccggaacagattatgattcgtgtacttcgtaatatggttccttttattttattttccatttgctttttgtctcttttccattttgaatttttccgctctcggttgttcggattgttttatgttgctttactgatcatcttgatttgttatcgtcttgcttttcgttattttttggagctttatcgtgaaaaaggaggaaatgttcgcatggttgtattggtgggcagtcacgagaatatgcaggaactttaccattcaatgacagatgatccaacttcaggctaccgtgtaatgggatattttgaagattccccatccgattattatccggaagaagttgcatatttgggacagccgaaagaggcgattgagtatttagaaagaaattcaggtaaaattgcacaactctactgtagtcttccttctgtacggagtgcggagattgttccgatcattaattattgcgagaaccacttggtgcgtttttttagtgttcccaatgtccgtaactatttaaagcgcaggatgtattttgatttattaggtaatgtaccagtattatctattcgtcgtgaaccattggaacttcgtgagaatcgtgttttaaaacgattttttgatataatattttcattgatattcttgtgtactattttcccttttgtttatataataatagggattgctattaaaatcagctcgccggggcccattttttttaaacagaaacgtagtggtgaagacggtcgtgaattttggtgttacaaatttcgttctatgcgagtaaatgcacaatgtgatgttcttcaagctacagcaaatgatcctcgtaaaacacgtataggtgagtttattcgtaaaacgagtattgatgaattgcctcagtttattaatgtattgatgggtgatatgtctgttgttggtcctcgcccccatatgctgaaacatacagaggaatatgcccaagtgattaataaatttatggttcgtcattttgtgaagcctggtataactggttgggcgcaagtaacaggctatcgtggagagactaaagaactttggcaaatggaaggacgggttagtcgtgatatttggtatattgagcattggacgtttatgcttgatttgtatattatttataaaacagtatataatgctattcatggagaaaaagaagcgtattaattagtaataaaacaacaaagtataaaagaatagatatctaattcatcacagttatgagaatattgaataaattgatttttgtagtgttactgccttttctgtttacggcctgccagtcctacaagaaagtaccttatttgcaggatacagaagtagtaaatcaaatagaacagaaagagaatttgtatgatgcaaagatcatgcctaaagatttgttgactatcgtagtttcctgtactagtccggagttggctgcaccatttaatttgacagttgccagtccaacaaatttgtctgttactaatattttagctactacacaacctgtgttacaaacttacttggtagataatgaaggaaagattttttttcctgtattgggagagttaaaactaggtggtttgacaaagaaacaggcagaacaaatggttgtagaaaagttgaaaccctatatgaaagaaacgcctatcgttacagtgcgtatggtaaattataaaatctcagtgataggtgaagtcactcgtccgggtacttttactatttctaatgaaaaagtcaatttattggaggcgcttgctatggcaggggatatgacggtgtatggcttgcgggataatgtaaaactgattcgtgaagatgccacaggtaagcaagaaattataactcttgatttgaataaatcagaaacaattctttctccatattattggctacagcaaaatgatgtcgtttatgtaacacctaataaggcaaaagctcgtaactcggatattgggaatagtacgagtctatggttctctgctacatctatcctagtttctcttgccagcttattatttaatatcttaaaataacgttttgaaaaaatgaaagaagaaatagtaaacgaaagacagtgtgaaactgaggacgagaaaatagatattcaac

SEQ ID NO: 343 - DNA, 2289 bp, Bacteroides thetaiotaomicron
gtatatatttatatgccaacttggagagaggataaacgtaacatactagagattattgatttcgacagattgaatcaactctgtattaaaaacaataatctatttttgtttaggctacatccaaatacggaaataaacttagatatgttagtgagttattcaaatttaaggataattgattcttcttgtgatatatatccaattttgccttttactgacgtcttaataacagactattcttcaatttattatgattatatgctgataccaaataaacaaattttgctatttccttttgacgaagaagagtattgtacttttaacagggatttggcttttgattataaaatatatactccaggaatacgtatatatagcttcgaagctttattagaaattgttgaatcgaaaaagaacttaaatataaaagaaataaaggtaataaaaaagctcttttggaaagggcgcaacgaatctattatagaccgaatcatcaatctatagaataatgggaaacgatgaaattattcattatattataaaatagtaatgaaggcgtatattataaatctaaaaaaatctgttgaccgtaaaaagtatatgcaggagcagcttgaaaaaatgttctttttatctgctgagtttgtagaagctgtggatgctagagggatgactgaaagagagaaaaatgttttttttgatactgagcttttttgtaaaagatatgtaaaagaggttcgtccgggagaaattggctgtacgcttagtcatcagaaatgttatagaaaattagtggagtcaagagataaatatgcactgattttggaagatgatatcgtgattcgtcataatattgatactcttgttcctgagattgagaaactattgaataccgatgagccccgtgtcatacttctgtctggttggtattggtacttgggtacaaagacaattaaacaacattattgtctagctcgtgtatatgatgcctttttgacccatgcttacattataaatcgagaagcagcttctttgttgatagaacagcgaccttttattactgctgatgattggttttatattcgcaagaagggggtcaaactgtatgccgtgcttcctcacttgttagatcaggactggagtggggagtaccctacatccatcaaccaagaagaaaaaaaacgatgtccagggttgtggaaaagaaagatagaaatttgttttcactcattactcttgaagtttttatatatcataaagcggtttgaaaaagcgtaactcacaatgctggaagtagatgttgttagaataagtgtaattgttccgatttataatgtaaagttatatattgagcgttgtgtacgttctttgatggagcagacattggaaaatatagagtttatttttgtgaatgattgtactccagatgatagtatggatattttacattatgtattggaggagtatccaaaacgtcgcgaacagattaaaataatagaacatgagacgaataggggtatatcagcagtgagaaatactggtttaaagaatgcgacaggacaatatattatatattgtgatagtgatgattgggtagagaagaatatgtatgaaaaattattggtaaaggcgcttgaaacaagtgcggatattgtagggtgtgacttctttgatgactatgttgctcactctacaatacgaaaacaattatttccgcaacaatcagaaaagtgtgtgaagaaaatgctaagaggagaattacattgtggtacttggaataaattagtaattaaaagtctttatgaacggacgaagatagactttcccgaaggtatcaatatgtgggaggatgtatctactatcattcctttatgctttcatgctactaaaatagattatattcctgaagcactttatcattatattcatcataatgtgagttcatatacatatagtgttactgagaaatctttagaaaatttagttgcttctattcaattacttgaatctttttttcttactaatcaatgtttcaaaacatttggggaagacttgtgctttatgaagcttactgttaaattaaacctattgttgggcagcaaaggtgaattgcaaaaaaaaaggaatatgttatattcttcagctaatcgttatatcttttcttattccggtatgtcatggtattggaaaatagctctttgggtggcttcaaaaaaaatgttgttttgttttaatgtcatgtcgtgtatagagagaataattaaaaaatggaaataaataataatatat

SEQ ID NO: 344 - DNA, 2252 bp, Bacteroides thetaiotaomicron
taagtcaatttatcaaggctttcttctcttggaaagcgggtgcaaaagtagccccttttcaaatatactccaaacttaaatcactctttttttgaattatttttgaaaagactcgctaaagtgttgaatcataaggatgttatagaacatatttttctcggatacaggaggaatagaggaaaggcatgcacattattatattcacacgcgcgttaggtgagtgagcgcgggcgtatacatcagggaaatgaagaggaaatatcagattcatgaaatagtctgttatataaaacacaggatagatacagtagaggggagctctggaagttgaaagtagctgtcatgagtagtcacacagcttgttgcatgtcttaaaacaaaatagggcttcgttcgccctctggacatatgaaaccccaattctttataagatacaatcatttagttatgtagaaacaggaagtagaaaaataatttcgaatatatcgaatagaactaagtattggcataagtttgcgcggttttaatttaaacttttgcttataatggggattaataaaccacaaaattcggtctacaattctgccattactttcttttattatgctttcaaaatgctctatagacagccccgcagcttttatattcaacaattctttaatacatgaatcattttcaccaaaaataaatagaattttattgtacacagataaaggtaaaagatgaataaatggcattttagaacaaaatccattacggcatatttgttgatgtccaccaaacggcatttgccaagcaggaaatccccaaaagattatacctgtttcagacagaaactctttagcatgaagtataaattcaactttccgacatttatctatatgttctataacgtcatgtatcaaaattatatcatatttattcatatcctcttcagaactaaaatcaaaaaaatcagaataaataaaccgcccattaaaacctaaaagtttaaaataactaattgcctgagagattcgttcttcggaacgatctattcctgttacattgcattctttttcggcaaatggtaacaaatttcctccttccccacaccctatctccaatatattcatacctctttttatagcaacaaacttctcgagataatcaatataaaagtctcgagaagttattgcaagttcattaaaataggaatatctatctatatgtctttgctgcatagtcgatctatttatttgctttcaaagcctcaacttctgcttttaattccttgattgattgaatcattataggaataattgctgtataattaattagtttattcccatccgggtcagtcaatactatattcggaagaactttctcaacttcctgagccaacaacccaatttctttaccatctccacctactcgaaaagcagcagctgccggttcattcttatctttgaaatcataacttacagcattcagtttagacagaacatttaaaccataacctaatggattaatattaatttttgctctagcatcagaatagttatatacatttttcacctgaatactattatatactccggatgctgtattatagaaaacaacttgatcataatgactagccaatcgagttgcagccgggctacaatcaatttgaaagaagttactagcattacatttcatatatattccgtttccactaaacgtcgtatgataaaatgaataaggttcggtattgccaatagttaatttaccattcgaataatacttaatttgtgcatttgcaagaactgcaacagccaagaataccactaagagtatacttttaaaaaataatgatttcataatattacaagttttaattaataacctttcgatataaataaaggcacatatcccttagacatcattttgttactgagccatccaatcctatggttacagcttgtccaaaaggaatatctacagtgccaggttgagcttcccatacaaccacaccaaccgccctagtagttataccagtagtagtttcattgttcgtatttacttcctccgattcgtccgtacatccacagagaatcatcatagaaaaagaaaataacataaataactttctcatgactattcaaattaaacattaagtgtcaaaaaattacttgataaagattagtatctcacctaaatgtaggtagtcttatccttaaattagacattgtgtttgctctcataactttagatttaaataattattgcat

SEQ ID NO: 345 - DNA, 2184 bp, Bacteroides thetaiotaomicron
gttttatatttatagtataaaaaagataagcctgccaagctctatcaagattatcaaacgctattactggcaactcatagttaccattaaaattttgattatcttcaaatgcccataatcgatgctgtccatcaattatctctataggcttaagttctggattccagtcatcactaaatacaccttctggaatatttaatattgggaaaggaacttctttagcattttcccaagcatcttgatctttcaacctgtcatctattgtgagacaatttctagcttctagtattttcccattccttttttcattaggagaaagaatattaataatgatagcagtaggaagcaatcctggcatttttaatttagcatgctctactgttctttgctgttctctagtcaaagttgaccatgggaaccctccttcaatataatttgttatttcctttacacgagcatcgctcttttttctttgaatggatgtcctatcttcactattcctcctatgaacatcagatagtcgttttaaaagacgagcatctatgctaaaagtataaaagtacggtttaggttttctcctcaattcctctgaattaaaatttatatcatcccattcattcatccattggttaaccctaagcataggtaatcgagaataaaccttcaaattactaatggaaaaaacgtcttttttagggtctaatgattcacctaaagtccatttcttaaactgttccttatctaaggataaagcatcaataataaatgacttgtcacaagcttcccaaaacaattcttgatctgctactagctctgcctcattgtacccaataacgcatagcctatttatgaataattctttagctaataatcctacattaccatcttcaaataaggtagctaatgtgtacggtacttctttttctcttctataattttgtaaagctgcacctgacaagaccaaagcacttcttaggtttgtcgaaacctttgtattaggttcatatttgtaagtgccagtcatggatgattttgaagaaaatcgagctaataatttgagcaaagaataatgcatagataccgctgctacaaaagcaaatagcctaacttgtttagggtagttctgtatctctttccaaaaagaaggtaattcatcggacaaatgattaatgccaagaaatccttttagaacaggagtatcaattgcctttaaacctacaatgtatggttccaagtcattatctgctgttatatctatcaacttgacaatatcatactttgtccatgatgactttaactttttgatatttattttctcattcatgattattgtcttttatatgatatgattagttcattaactcccatagaatgaatatctgatcttcccattttactatgtatatattctttcacttgaatatctcctttatattgatttcccataatagagttgccaatttccataatttcatcttgagtaatcattccattatcactataacttagtattaaatgtgagttcttatttttgacacctttaaataacttaccaaatgcgtttttcacctctgtttttttcccgaaaggagattgatgtcgatcttcacgatatcgacctttatatttaacattcggataatcataccttatcaaggtttcaatagcatgataaaatcttgaataatgaacggagctataaggaggatcagcatatacaattgtatttcgttcaatcaaccttaagcaatcaagataatctaatgtagtaatagtatatcggttagttgcttccacgtctaccatatttaatatttccagaaatttcttttcaaaataagtccaaatatctcgtatgcgatataacattatatcatgcatattactttctgtaacatccctaaattgagcaaaatgtccagtactttgagatgtgtaggacatagcatatattaacgatgatagtatgatataataatcactttttcctttatactcttctgctactgcacgaatagaatcaatccagacgcattgtgtatagctccaatatgtaccagaataatacttcacaaataaatgaaatcctatttcaaaattactataaatcaagttttgctgttgaatttcaagcttagttaatttttcataattatcaatcgaattataatcaaagattaaatc

SEQ ID NO: 346 - DNA, 2172 bp, Bacteroides thetaiotaomicron
tttctaactcggttgaatttattaatttatttatattgggtaaatatgtgttggcaaatatggaagtatatatctgtatgtcatttatttgaacattatattcatcttttaacgagcatccaacgacagatgttccagagaaaagatcacagaaccaattagattcaatatccaaatcatttatagatgatattatgaaatcaaggagttctctttttgatcccatatatttcattaaatgtggcaattttgctgaatctatcataaaaagtcaattatattaaaaataaaccaaattcatatagtcatctgtttttcaaaggaataagtaaatatattcttttgatcgcattgcaactttatactatttttcaaagatacaactaattcaagaaattacaataatctctcccactttatttccagtgttcataatgtcatgacattctgcataaacgtcactacaacactgaaaagatatcaaaaatacactatctttgccttcagtattctccatgagcaaactaccgcaaaaacacgtagcaaattagtgggataattcatgggatatgcttgaagcagaaaatataaagttttaaatatcagcgtggtaaatctgcaaggagaatcccaggcgaatcactaaaataagagagcaattcaaagttattttttgagttgctctttttcataacgcaagatgtacaatatcttaaaccaaggatgatggtaaaaagaataaagaggcatactcaatgtctacccgaaagcagcactataaggaagtaactttcctattataaagaatctaaaacaaatacaaatgtcgaaatcatacaataggaatcctatacgattgcttatatttgtactatcagatcgtttttcaacagataccctttctaaatatgtacaaagaatacttaccatgccatatacttgctccttacgttgataaatattgggaattcaaaggccaaacagaacaaggtatgcaaataaaactatctacagatggatgtacggactttatgtttatattagaaaacactgttaatcatggtattatcatgcagccttatcattcttattttgttggtcccatggatatctgttcggcattaataacattatcaggtactatcaatacatttggagttcgctttcgtccatgcggactatcccgttttatgaaaatttctctaagcgaattgacaaatataaggttaagtgtgaatgacttaaacactatttttagcgattcttttgctgaaaggttattcgaagaacagggcattcagtgcaagattaatttaatagaacgctatttgaaaaaacacctatataaaagcaaccatacaatggatacacaaatctcatacgctgtgaatcaaattaatgcgcatgaaggcaagatatccataagccatttaatggacgaagttaatctgtgccaacgacactttgaacgaaaattcaagttacatacaggtttcactcctcaaaaatataatagtatagtaaaattcaagaatgcgattaaaatattgaggaacgaatcattcgacaaccttttatcagtagcagtaaaagccggatattatgatgcttctcatttatcaagagaagtgaaaaagttatccggtagtactccaaatttctttttatcattaccacccgataatgagactactattatttatacaaaataaaaaagtcgaattcatccaatacccgtgtcttactatcctttatatttgcagcattaactaagtatataaataataagaacatgaaactttggaaatatagtgggacatttttaacagcgacaggaatcattcatacgatttatgcactatttatcggaaaagatgctttttcggaaatgctcagaaatggattagtaaattctattggggagaattatagtcaaggtttcgccttttggttcttgacctgtggaataatacttatccttttggggcaaacacttcaatattatatcagaaaagaacaaaaaccggcacccgtatttttaggttattctattttactgcttaccataatcggttgtattattgaaccagtctccggtttctggctctttttgccgcaagcaattattattatttattcaaataaaaaataggattgtgatatcctttaaat

SEQ ID NO: 347 - DNA, 2090 bp, Bacteroides thetaiotaomicron
aattatgtttacctttgcatcaccatttcataaggcttttatgaaagatacaagtaatgcggtagtagctcagttggtagagcattagcttcccaagctaagggtcacgagttcgagtctcgcttaccgctccactgaaaaaacaggtagtcagacaatgactatctgtttttatatttttacaagagttcttttaactcattttcttgatattttatgtatcagataaataccataaaatcccagtaaagcagaaatgaatattaggaatagtagtccaataacaataaatttcttcatctgagtgaaatccatagatatactcttccatgacaccaagtaaagtgactataatagtaactataaatggataaatcagtcacataaggcgatataaagaaaataatgcgagaagaatagggcagttcgttcctttttcgtatttttgcaccctgttttaacatccaagaaaacttaaatagaaaaatataatggcaaaagaactgaaagacctcaccaaacgtagcgaaaactactcacagtggtacaacgatttggtggtaaaagctgatttggcagaacagtctgccgtacgcggatgtatggtgattaagccttacggatacgcaatttgggaaaagatgcaacgtcaactagacgatatgttcaaggaaacaggacacgtgaatgcttatttcccattattaattccaaaatcattcctgagccgcgaagcagaacacgtagaaggtttcgctaaagaatgtgccgtagtgactcattaccgtttgaaaaatgcagaagacggctccggcgtagtagtagaccctgctgccaaattggaagaggaactgattattcgccctacatcagaaacaatcatctggaatacatataaaaactggattcagtcttatcgtgacctgcctattctttgtaatcagtgggcaaacgttttccgttgggaaatgcgtacccgtcttttcctgcgtactgccgaattcctgtggcaggaaggacacaccgctcatgccacacgcgaagaagcagaggaagaagcgatcagaatgctgaatgtatacggcgaatttgctgagaaatacatggctgttccggtagtgaaaggtgtaaaatccgctaacgaacgttttgccggtgcacttgatacctataccatcgaagctatgatgcaggatggaaaagcattgcaaagcggtacatctcatttccttggacagaactttgccaaggcatttgatgttcagtttgtgaataaggaaaataagatggaatatgtatgggcaacttcatggggtgtttctacccgtttgatgggtgctctgattatgactcattccgatgataacggtctggtattacctccacatctggctccgattcaggtagtaatcgttcctatctataagaacgacgagcaactgaaacaaatcgacgcgaaagtggaaggcattgttgccaaactgaaagcactgggcatttctgtgaaatatgacaatgcggacaacaaacgtccgggcttcaaattcgcagattatgaattgaaaggtgtccctgttcgtctggtgatgggaggacgtgacctcgaaaacaatacaatggaagtaatgcgccgcgatacactggaaaaagaaactgtgacttgcgatggcatcgaaacatatgttcagaaactgctcgaagaaattcaagcaaatatctacaaaaaagcattggattaccgcaattctaaaatcacgacagtagatacttacgaagaatttaaagagaaaatcgaagaaggcggctttatcctagctcattgggacggaacaaccgagactgaagaaaagattaaagaggatacaaaagcaacgattcgttgtatcccattcgattcgtacgttgaaggtgataaagaaccgggaaaatgtatggtaacgggcaaaccttctgcctgccgcgtcgtttttgcacgttcttattaaaaatatctatttcaatagtaaaagagtcagatttttaaaattgagaatctgactctttttttatccatttcagttttatttcagaaatatctcttttctttgtag

SEQ ID NO: 348 - DNA, 2055 bp, Bacteroides thetaiotaomicron
ctataaatataaaaccagtaaaaataaatacgagcttaggatttgatttgtaccctatgctaagaacacaaagttggttagaagcgtcgaaagatggaattctcgcttatcgtgaaagtcgggctcaggaattagtagaagccttgtgggtatcaccactgagtgtttggcacaatcgcataaatatgattggagaaagtggaggtccctctatgtctcaagcagcttttgttagaacttttataaattctttttttagacaaacaaaaggactgtattcatctaatctagtaaaaaccgagttacaagttctcaattggaatagagcacagcaggcagcttttattttcttgatatgggagagtatagaaaactctttatcaaacaatagtgatttacattgggctaataaactaagagaaataaaccattcagatgaaatcgagtatgatcaagcatttgtgagtaaagaatcttttttatctagagatcaaggggttcgtgctgtcatggtatatgctaatgattttttctatactttaatggatgaatctattttcaatttgaatgtatttttatgggaggcaggcatagatgacttgtctattaatgatgaatcacttcaaatggcaatacagttatttaagagaaatgagttgtttatgaattatttgcaccagttcgctgaacttgttgtaaaaatagattggagaacgcctagtgctccttttgacagagaagaagacagaagaaatcaattgatatataaaggtagtggaggatatacggaatttcaaaaagctttgaaagctgttttcgaagcagaaacaagtgatttattgaaggaagttgtatcaaaaatgagttagagatgccgataaatagattaattaataatgctgatattgaaaaggtttctgaaggtctcttatcggtaaaaaataattgtttcattaataagatgcttctgtcaccaacaaatccattattatgtaataatcctggaggaataataaaaaatcaagtgggtttatctgctgattcgttaaaagaatatatgtctgtttgtacgtttgtgcatacaattgatggttggtcttatttaagtaatgcgattaatgcttttttaaatggtgagccttcaataacagtacatctatcatattatgcagaactaagggctgctatggctttcttatgtacagaagggatactgatagcaaacaatgagcaagcgtgtatagatagttctaataatatatatatacctagttgtcagccaaaaagtatgcgaataactcgaacaggaacacactctgcgacatgggatattattaatgaatggatattaaatagtacaaaacagacgaatgtacttgaatattttacatataaaggacgtactttcaaagaactaatatcatttattcctcatgctgcaaatactaattcggggcaagttgctcttgtgaaaaaatggttgcaaacatggtgctttgatattagaaaatatgaagaagatcgagaggggcggaatacttcatcttataatgccaatattgctcgaaatttcactcctaataatctgcgagatagtttatctatattgaacgaattttggttacttttggaaccatcagctgataatttctctaaattagatcaatatctttttgctttatatttaaaggaagtttataataatgcagttttaaatggtttttctatcactaaagatgattttatcaaagggctatataataatagtggtttgactgaagatctatttttatctagagtttttataaatgatgaagaaagttcgttacttaaatatgcaaaagatcatcaaattgatcctggaacaggagaagttcattcactaacaattatagcccgagctattcttttacttcgattttgttgtggtgcatgctctttcttatttaagaaaaacagcatatcaaaaaatgatttggatttttatatacataaggtaggtcaaagttatgggatatgggatactgtaaatcctgaggatctcagggacctatg

SEQ ID NO: 349 - DNA, 1991 bp, Bacteroides thetaiotaomicron
gttttacataaatatggataattccatctgatttttctattcttgccgggacagtccgtattagtgtctgaagaacttcgtcaagatcttctttcaaatctagtttaccactgcaggtaatggtcttcaatggactgtctatcatgatctttttgccatagtaatcgctgagttttgtagcaatgtcttttagtttttctgtttggaagaggtaaaaaccatctttccaggcgatatatttttgtacgtctaccgattggatatggatgccttcctgttcattataacttaataagttattgggagaaagtgtcttactttcatttttgctggtttttacttttattttaccacttactaatacaacactttgcgtttgtttattttcataagcactgacgttgaatgtggtgcctaatacttgaatgtccatttggcttgttttcacgatgaatggccggttcgggtcatgagatacactgaggaaagcttccccctctatatatatttctcgtttgtgttgtttaaattccacaggataaacgattcttgagttagcgcttaaccaaatacatgtaccatcggtgaaagtgatagatgaacgtttaccggcaggtacgattaattgattataaatattagtcttttccttgtcatcagtttcttgaataatggtttgggagtttacattaatcttgccctgatgatcatattgtaattgactttcttttccatcaatatctatctgtttttttttcgaaagtacgagttggatattatcagtaggagtagcgttcggcctttttacagctgttatttccagttccgttttttcttgcataatgctgagttgtgattgaaaataccatgccgaacagagtataagagctaaactggcggcaactaatatactatgattaataaaaagaattttcttttttcgttgtttttctatattgttgagtctggaaatattcttccacactgtttctacttcgttttgcggtaagtgtgaaacaggaatgtgtcgaatatcatgcagaaaagaacgtgctatttttatttcttttgctaatgctttatctttttgctgcatcgtttcccaaaaagcgatactttctgggctgggatgctgctcagactccaaaaagtagaaatcattgagtagttgatctgcagagtagtgagtatatttgtttttaatgtccattttcaatgttgatttatcttaggacaatctcaattgacaaatctactcaactgctctttattttttttgagatttttattttttagtgtaaataggtcagttgatggagtattaacatccatattccagtgactccataggcttctcttattttttgtagagagcgttgcaaaaggttataagccgattggtaattgagccccattatctggcaaatatcatcgtaactcagttcttctataaagcggtaataaataacttcccgttgtctgggagtcaggattttcatcattcttttaatattattcatttcttcatgccgggcttcctgatcaatgaattcgtttttaacagtaagctgctcttctgtttggtataaactgaaagcatagtttttttgcaatcgttcttgattgaaagtattatagatgttattttttaaagcaatcattaaatatactttaggattttgaggtacagtaagtttctttttggctttatatatctttacgaatacgtcctgaatgcagtctttcactatttcagaatcaggagtgatttgtaagccataattatagagcacttggatgtaatgagtatatatccagctgtatgcctggtcatctccttctaaaaataacttccatttgatataactttcgtcttgagtgaacatagaattattacttaaatttgcctgtcgcattacacaatgaaagcaaagatagtattaaaaaataataataaaagatttatgtttaataattcttttctgaagaaa

SEQ ID NO: 350 - DNA, 1965 bp, Bacteroides thetaiotaomicron
atattatggtatgcactaaggattctattgatgaatgctacaatatctcgacccattctctttggtggcattgttgctattggttgtatgttgtctatatggggattattgcagctttatggattgcaaccatctaatcacagattatttgccatcactggacctttttataatcctggaccttattccggttatttagctatgatttttcctattaatttaggttgtctgctccagtctatggggaagacacgatatttgtggctagtagctttcgctttgatgctatgcattttgcctgccgggatgagtcgttcggcatggttagctttgtcctttagtagtctgtgggtattggttatacattttaagtggatcactaaggcaaagtcttatttgcagacgcatttctatactgctactttgctttatataactgtagctattattattgtgtgtgcatcagtgttgctttatcagatgaaagctgattcggctaatggccgattatttatatggaagacgacgtgtaaagtaattgcgaataaaccgttgttagggtatggcccgggaactttttctcatgtatatggtgagatgcaatcaacttattttgcatcggaaaaatatacggaacaagaagaaagagtagcaggagcacctgaatatgcttttaatgaattgttacaattatgcgtagagggtggcattattttgctgatgctgtttttgatgctgatagtttgggtagtcggtaaaggaatatctaataaagattatatcgcttgttccggccttatctctttgctacttttttcattatcctcctatccttttcaagttcttccatttctaatgatgggagtattattacttgtagtttgtgtcactaatcctaaagggataatagagaagaatgcctgtattccacgaatatgtactctattgttactaatatctatgttggcaggaaatattttgtgtctttacaaactatgcaatgtaaatgaactttcccaacgtttatattatataaaggtattacaggatcaatctttacaaaaagaggcttcgacaggatatggacggttatatgacttctttaaacataactttaattacctgatgaaatatgcaggaaatttatttgctcaaaaaaggtatgatgaagcgatagtcattttagaacgtgcaaaattagtaagttgccatcctagtatttatactctacaaggacaatgctatcaggctttaggaaactttgctgatgcggagaaatgctataaagcggctgctttattattgccaattcgtatttatccttattatttgttggcaaaactttatgctgaaccagacttttaccatgaaacgaaaatgaaacagatgataaatattgtattgactaaggaacctaaggtatactctaaagcaatacatgaaatgcgcatggaaatgaatattttattaaataatcgaattactaactaattaaaaactaatcaaaatgaaaaagaaaatgatttatgttgttgccgctcttgtactgggtgctgtaactgtgtttaatgtgaagacagtgttggaagcaaatcacgtgtatgatttgacgatgacttccattgatgcgctaagtgagaatagtgatggagaaagtggtgaaagcggaggaagtaccggagatggagaaagtgatacaggtgctaatatcactgacgaaagggaatgtcataataagaatggctattggaatatggcattaatatgtacagattcggggattgagaaactaacttgcgaaagaacaggggaacttacgctttggggatttactgtttttaaagtttcttataagaaaggagaaaaatatgaacttgcatgggaacgttgggcatgtacaactagtacaggaaattgctgcttatctgataaacagggacttagggttagataaccgtatatatg

SEQ ID NO: 351 - DNA, 1883 bp, Bacteroides thetaiotaomicron
atattattatgatatttattagcatagttccgatcaatcaaataaacaacattatggcaatctaaattttcttttgctataatagcttttgccatataatacgaagtactactatgtatccaaaagacatatttcatatagcgttcaaaatattagcataagattcaatcattgaatcaagcgtaaatttctgttgatatagttcataagagagtttacccattgcactccaattataagattcaatatgacacaagatatcatatatatcttcaagacatggcgaaattacaattccattgatcccggaaaaaaccatttccggaatacctgcaatattagtagatataataggaagtcctgctcgcatagcctccaaaatagaaatagggaatccttcatctctactaggtaacataaaaatatcactcctcaacaaataattttctacttgattcgaaacacctataaaatctatatatttagagattcctttctcaaaacacaacttttctaattccccccttaatgtaccatcacctacaatggtaaaatgcactttctctctttgaacaggagacatcttcacaagagcttcaacaatcatatcttgccctttacgttttgaaacagatcccacacagcagatttcaagtggccctagatgtttttccggacatatatgcatttctttgctcaaaatgccattataaacaaatcctactttttcaataggaatatctggatgtaattgtacaaaagtatctttaggattctcagcaacaaacaacaccttatccacttcagataaaaccttcctttcaatgtataataatatactataaagccttgatttattaagcacaggataatattgtctaagcatattaaaagtatcaccattattgtgtaataccaacacggttttttgtcttctagatcgatacttcaaatagtaataacatgtaaaaatatcatgtataaacaagattctcgattcctcaagcccttgatcaaaataatatttaacaatcttacgagcatgccgcaaatatattgcataaatagaaatgaatgctagtatagaatttgcattagcattctttttaataaagtaccgtaatcctttccgttgatttatagctgctatattttcaaatgactttaacacaatcaaatccattgaataaaccgaaagctgaataccgtattcttcaaattttgaagtagattcagctaaagtcctaagaacagaactagccccattaggagccttaagccatccaccatgaattatatctacctttttcatcttttacaacaactattgaatcacagcaataaaatcttccaaatttataccaagaactttttcaacaaattctctaaaaacaccttcaccacctcttttttctaagaatatagtagacaatctacgaatataaaatggagcacttgcaggtactccagctatacctacacgcttaagtaatttagcatcgttcaaatcatcccctatataggccacctgctccaaattaatccctaattcattgcataattcttctgcagcagacaatttatccactactccttgaaataaataatcaacttttaacttctctgctcttcgtcgcactatctcagttttttcacctgttaaaatacccacaggaatacctttattatgtgcccaaaaaataccagcactatcagatgtattgaattttttccattcattacctgtttgatcataaaacattccgccatcagtccaaacgccatcaatatctgtaagtataagctttatctctttcatttttttagtattttacccttatttattaatcactacttagcttatagcaggcagtactctatac

SEQ ID NO: 352 - DNA, 1865 bp, Bacteroides thetaiotaomicron
attacaactttattaattgagtgagaagagtaccgacataaatatttaatcgatactcctccattaattccagcatcaaacaaagttttcttttttcgtcaaattattccgtatccacctcttcgcgccattcttctgaaagcgcatagttattgataaacacgtatccatctaatgtggatggcaccgagatgcctaaccaatagagaatttgcggtactatcagcgtattctcaacacagattctttcagcattgacattggtaggcaatgtatttgcaaacatggcagaagctttctgttcgatatccggagaactgcttgttttatctttaatataatacatattgagtccaccttgtatctgatttttaattactaatgtatcctcctctaatttctcaagttgctctgttggcttgaatttccaatagccgagcatatcaccagaaggttcaatatcaatttctcccgatagttgcaaaaattctctttcagcaagatcctttttccatagacgtacttccgatatataataggaagttggtacagaataaccacctatcgccaaaagacttgaatccggagccaatccttgggtatccgtagttccagatccctgcaacttaccatctaaagtaatgagccaatttctccttccggaggcagcggaacttatgctaacaccatagtgatgccatttagaatcattgtatccggtaatagcttgctcaagagcaggaccttccttaggatttgttctcatggatacagttcctctctgcctatatagtccccagccggcttttccaagtatgcgatcccaattgttaccattatatgtaccgtcctgcctaggaaccatacgcattatgatctccattgaaaatgcatccatacctaaagaataatatttacctatactatcaaaaacgacagccttgtattcattctgagaatcaaaatatgcaccgtatagtctattaccattcaattgtttttccgtataatgattgtagtaaaacagaccaaacgtgttacgctccacttccgaagtgccaccataacgaccgtcagccgatccaccgtgattggaagttacaacaataagccagtcttcgtaaaatgcattctcacgggcatcaatcgccgacaaaaattcaccaatgtatccgtctatagttttaagtgcactgacataagcggcgttgtccgctttgaatcccccactcttcccagcctccaacattcctgaaaaatcggccagaatgaatgtgtaatcttcattcgcaatatgattgagaaccacatcccgagtttgaacgtcattttctgaagtaatggtagtcttagcattgttaagcatatttttgttcagtttcgcccaaggtgtcacacacaatgaaagcatattcacgtcattattcgaaatatagctaataatgttttgatagtgaattaccttttcattcggattgttcggattgtactccacattagcagtataagattcatcggttatactgtgcttttcgggtatgaccccagtgagcatggttgcccacgttacagggtcttcgttcctctcgacagacagggttcgattgtcactaactcctgtccacgaatatttactatttttcaacatcttagcaatggcaccatcggcaggaagggagttcttcaccacttcaccaaccgcaccatctatatttatccataatactttacgatggattttggtagatatgccggtatctatagttccatcgtctgctatttcagcaggtgtatcgtattccgtgcaagcatagttaaatgccaggacacaaacaacaagcaagctgtatgtgagaatatttaat

SEQ ID NO: 353 - DNA, 1849 bp, Bacteroides thetaiotaomicron
ggggctgtgtcaaaactaaggcacatccccttctttttttaatataaaatagtcgttcctctttttttgtctatgcgactattttttcagtaattaggtaataaggcttaatattcgtcgtattttgagtcacacgtggtctgataaagataaatatagtgtgtgcactccttctctttcctgcttttagtagttttgtacacatctttttgatattaaaagctatagcaaagaaggcaaagtccattgtaaccttgtcttctcccacatgccggaaccttttgtatgccatgttgtgtttcatttgtccaaaaactgcttccggttctatacatcgccttcccctatgcctgatgccttcttccgagagtaacctttcccgtgcctgccgtttgtattggtttaaccggtggttgacttctatcatacggttccccctagctttaaagcaactgccacacaaaggacacccttcacatctttgtgctttataccgggcactttcggtgatgtatccgcttgctgttttgtcacgtctggttcctatacggttcatgtgctgccccataggacaaacgtaataatcctcccccgcattgtaatggagactctccgcatggaatggattgggggtataacggggacgctgttctttatggaagtagttgtacttgacaaaggcttctatcccattatcttgcatgaaccgataattttcttccgagccgtaaccggagtctgccacaccgacagttggtaagcggttatagcgttgctcaaaggagtggaagaaaggtatgagggtcagtgtatcggttgggttgggaaacagtcggaagtctatgaggaattggttctcggtacctatttgcagattatatccgggtttggtctgtccgtttctcatggcgtcttctttcatgcgcatgaaggtggcatcaggatcggtcttggagtaggagttgcgttctccaagagtatcaagatggttgtcgtattctatcaacttgtcacggtactcctcaagttcccggacctgtttcttcttttcccggatgaccttcttttgttccttgtcctttgttacaggctggtgttccagcacctctttaagttcattcactatatctgagagcatggcgggagtgaactctacgggtgtatctttcatggagttctcttgggctatgacttcatccacctgcttcaggagaatgcggatcttatccatcagctttgtacggttcttttcgactgtcttgcgccagacaaaagtatatttgttggctttcgactcaatcttggtaccgtcaatatactctacgtcaaggctgatgaaacctttgtcggcaaggacaagaaccaactgcgtgaatacagtatttatttcctcttttacacggtttcgaaaacggttgatggtaataaaatccggatgttcattaccggaaagccagatataatgaatatcacgtaggagaagcttctctattttgcggcacgaatagatattgttcatgtaggcgtaaataatcaccttaagcatcattttaggatgataaggacaacgaccggttgctttataaagcttcttgaaattgtcaagattgagattatcaacaacagtatgaactatgcgaaccggatcgttcgctgctatgttttcatcaattcttccgggaaaaagaactgtttggttgggaatgtaaggacgaaaatgtaactttgccataacgaaaaactttatgcctaaagatacaaaaactttgggtaataacaaagcccgggcttgtgaaagtctgggctttgtgcataaaaaaaggttgtgccagcgttttgacacaacctc

SEQ ID NO: 354 - DNA, 1823 bp, Bacteroides thetaiotaomicron
caatttaatgtactcatatttatgaaaaattctttttttagtaaatttacgcccaaagaaccaaagttctttcctctactgaagcagttatcagatgttttatctgcctcatccgttctacttgttgaaagtatggaacatgatctgcccacagaaagagcagattactacaaacaaattaaagacatggaacgtgaaggtgacagattgactcatttaatctttgacgagttaagtacgacatttatcacccccttcgaccgtgaagatattcacgacttggcttcctgcatggatgatgttatcgacggaatcaacagtagcgccaagcgtattgtaatctataatcctcgccctatttccgaaagtggcaaagaactgagccgtctgattcacgaggaggctatcaatataggtaaagccatggatgaactggagactttccgcaaaaatccaaagccattacgcgactattgcacccaattacacgatatagaaaatcaggcagatgacgtatacgagctttttatcaccaaactctttgaagaagaaaaagactgtatcgaactgattaaaataaaagaaatcatgcatgaactggaaaagacaaccgatgcagcagaacatgtagggaaaatattaaaaaacctgatcgtaaagtattcataaaagcagagcaagacacatggaattattagtgactatcattatactagctctgatattcgattatatcaatggctttcatgacgcagcaaactcgatcgctaccatcgtatcgactaaagtactgactccttttcaagcggtattgtgggcagcattctttaacttcgttgcgttcttcatagccaaatacattatagggggctttggcatagcaaacactgtgtcaaagacagttgttgaacaatacatcacgctgcctattatcctggcgggcattattgccgctattttctggaatctgattacctggtggaagggtatcccgtcttcttcctcccatacgcttataggtggtttcgcaggagctgctatcatggcaaacggctttgaagctattcagctcaatatcattcttaagattgccgcttttatcttcctggctccatttatcggtatgattatcgctttcggatttactctacttgtgctctatatctgccgacgtacaaatccgcataccgctgaaatgtggttcaagagattacagttggtttcttccgccatgttcagtgtaggacatggtctgaatgactcgcagaaggtaatgggtattatcgccgccgcaatgatagctgcccactctatgggtctgggaatgggaataaacagtatttctgatctgccggactgggtagcgttctcctgttttactgctatctcactgggaacgatgtccggaggatggaaaatcgtaaaaacgatgggaaccagaatcactaaagttactccattggaaggtatggttgccgaaaccgcaggtgcttttactctttatatcaccgaaatgctgaaaatacctgttagtacgactcatacaattaccggagcaatcattggtgtcggagcaaccaaacgtttatccgctgttcgctggggggtgactaaaagcctcatgactgcgtgggtacttactatccctgtcagtggactcctagctgcatgtatttattgtgtagtttctctgttcctgaaataaattctgcttcaagggaaacaactcgaaatttaaacaagaaaaatagctactcttaacatccctctacagtattttgtagagggaatactataaaatgatacacatagaaccttaaata

SEQ ID NO: 355 - DNA, 1769 bp, Bacteroides thetaiotaomicron
caactatttgaatatttgttgttttagtatcggattatagaaaaaagtaatgttttagcgaccgtcctatttttatcattttgtgttgcattactattggaaaactttttcacaggcaaaaataccagcttttctgaaaatatgaaattttgaaacgtttttctttcggaagcatatcaatattgattgatcaatcaattggacgtttagacggcaaatagagtgtttaggaagatattggcgggtagtgtgcctctgcattcgaaataaattttgtatctcacacatggggaagattctccaaagccgaatctcgtatttttctattttcctccatagagctaactccacatgccaatttgtaagggaaggtttcatcctccggggcacaaagatcctctattcggtttgctcgtactgtatttttgatctttgtgccccagacaaatagtttatgatttgttggctggttttcggtaaataagaagaaatgttattttttttggtggattatccactttgtcattttatcactatatatgtagttgacgagatgccgggaataattttaatgagtatcctgataccatagcgtttgattataatcatttgctttaacattatggcttggttcagatgttgttattccagaatatgaatttattggcactgcaccacggcttgctgagtaatatttttctgtgtgtgttttgtaaggaactactttgtttaaagtttcagaaaattgtaacagcagagtgctgtcgtttttacataatacttttacataatccccgtaatcgtaaaaaataacaggactgtatccatccataggctgtacaaaaccttcttgggtattatcaaatatgtattgttggtttattcgtttcatcagtgccgccaaattatctaattcgctacagtttgttacggctaaagttccataaggatattgataggtggaataaaattgatggaaagcatcacatgccgccttataatttggttctcttgataaaagatgttttcccattgtggaataaggcatgccgaatgccattatttccgtggggcaagctattatgtaatctgttatatgacgtagctcgtacgcagtctctaaggaggacatatagcaatcgtcgaataagatatattccatagataatccactattttttatactgttggaaagggtttttatatctgtttggtattcggcggatagcccgccaaagaaacgtgtttgaggtacattcttgtattcccagtgatgcctgaaatcctgcaacattcttgacttgctgccattaacaggcagccatcccataccatggcaacctataatcatggaataggactttgccggggcaaatgtcttcatatcattgagaatatctgttaatacaggttctatggtaaattggggattttcgtattctttcaaaatggaatggatacaatttccatttttcagaataatttcaaacatttgggctttgatggaacttgtagaaagaaaaacaatcactctttcattcttcaagcttgtttcttttatggcatattccatatcagaaatattgttatagaaatagtctattaaatcctcggaccatgggaaatacataaaggtggttctttgattaatttccggttcaaattcttctttttcgcaggagaataagacgaataaaaaagataagagtgttattagattcttgattcccatataacttttatttataattttatactcacttttattc

SEQ ID NO: 356 - DNA, 1767 bp, Bacteroides thetaiotaomicron
cttccagccaactaaaagacgagaagatagaagctatttatgcacaagacccggttaaatatatgtattggcctatcttccaggttaatcttgattggcattaagattaacctggaagataggccaatacatatatttaaccgggtcttgtgcataaatagcttctatcttctcgtcttttagttggctggaagatatccatgttttcgtttcacccgaactgttggtgtattctgtgtaacctgccggattgatattttgctcatcgcggttcagaccgtatgttacgagactgccatcttcgattgtatttgatgctccgttgcgcgtccatgtgtaatcttccattttataatataaatgcccgcttaattcagcatattctccttgcaaatcacgtaaacgatacattttagctttagcctcatcaagtttggtttttaatagattccaacggatcaagtcagctttgcgaacaaattcaccgcaaaattccaaagcgcgttcttgaacgattgcatcaaacattgcatctttattaccttgaacagctgcgacatattggtctacttctgtattccaatcggcttgatcaaacgcacgttggcgaatctgtttcaaatatggagctgctgaggccggaccatttaattcgttttctaattctgctctcatcaatacgatatcagcataacgcatatattgtttattgataccatcgtcggtgctttcaatatagcggttcatccattcataacggagttttccgaaataccatttatctattgaattgagttcttggactcctttgttccatttgtaaggaacacatgttacatcacgtcgtttatccttttgggaataatcaaagaaaaagaaaggagtaggacctgcctgtccaccggattgtttgtagtttactatgacatcagcggtctcatgtcttaaaccgaaagtatatacttggcgtccacgtgcagtcggttcattgttgtatggtatttcccataatgattcactacctgctttaataatatcacgacagttatcaataaaaatatcttcgaaatttgtttttaaagccacatattttccttcttctgccattacgtctttacatgcctgcagggcgatagggtataatacagattttgctagttctggatcactgcttaatgaactgttaccatcggatctcaaagaataaccggatgcctgaaggcaaactcgtgctaataatccttttacaaaagctttgttgattcgttctacagtagtagttgcatccatttcgttgggccatgctaccatattttctgcttcctgtaaatcttttatcagttgtttgtagataacgtctttgtcagttcttgcagcatacattgtttctgtggttgttggttcaaagcgagcgggaacatctccccaagcgttaatcagatcaacatatgccatagcacgcatggtaagagcctcaccataaaggtgtgccatatttttatctgtcaaatctgcgtatgttctaagtccttggatggcaaggttagccttttcaatgccttgataaatattagaccatggttctttaccatcagcgagattcatctgactattattcgaagaaaccttataaaccgctaaatctgcttttccgtcacctacctgttcagaactactataccattctatgtcagtattataaccataccaaggcaaataacgagcacgatagttctgttcgccataatatatatactctctctcata

SEQ ID NO: 357 - DNA, 1758 bp, Bacteroides thetaiotaomicron
gttcatactcactacggttataactgggagtatctttgcaataatcagtatcggtacacattgaagtggtccctccttctgagaatacatgacgtaatcctaaatagtgtccgagttcgtgtgctaatgttattgcagcatcgttttgattaattctttcatctgtactttgctcataaatatatgaactattgatcgatatacaatatgggaaactcaaattctctaaagtgatccacgaagctgatacttgttgagtcccttctaaaaaaaagtcctttaaactatatggaaatgtagatatgcctaaaatctgcgaatccgtaaaaggatataccattatgttaatgtattcattgggttcccatagtaaagatgtatattttcctgtattatctctcataaacttttcgcaatcaataggaagctcattaaatggcactctttctactccaggttctggtagtgtggttccattcttatctttggttgctaatacaaattcgagatttatatcaattccacacttttcagattgatagaaatggttagttcgcactaatacatcttttaaatggtcttcttttatatattgatttatgtcattttcgttttgataaagaacatggaaaataacgggtaattgatagtgtattttatctaaatctggattaacttctcctttttgttgtgaaatcttgattgtttggtttatcccttgggcggatatgattagattagtttgtctgtttgcatgtttggtgttagctagaatttttatagtaagtatatcgtttccttctccttgatatttgtctggtatgcaccaatcagctgaatttgcgatgatccattcagaattagatgtgatagcaacagttattttccctccgttattgtcgatgttgcggaagatgttttgtgaaatttcaagttttatatcatcgattttctccgaatgatcacagcttgtggctagaaatagtaatgtaaagagaatagtgttatatacaattttcatagcttttatttataaaagccgtaatttctcattttcaagaaaagggaaattacggctttgggatatttgtaacctttactgaatttctacttttactgtaaagattggtgggctttaatcacgagttccggtaaaagtggtcatacttcctgcattattaaggaaacttatagtcattgctttacctgtaacagttatgttgataccagatgagctttcgcttgaaagaatgtattgattgccttctttagtaacattgtaattttcactaccgttatctgtgtagaagtcagcggtaacttttactacagaagaagatactttggtgacagtgactacatatgcatcagctgtaacattagttccaactttgagtttacctgtataaactcctgctatgctggcactgaaatcaccagacgtttcatcatcatcatctccacatgatacaaatgacaggcttgatataagcacaatcatcaacatacttaaaattctaaattgtttcatcttttttgtttttaatgtgtaatctttttagtcatatactttggttgtcttaaaaaactttgcaaagatacatgctctttaaacataaatatccttttaattgttgctgttttatatacaaggttgtagaagatatttctatgttctgttgttatatatatcagaatatatttggaagaaattgtattctaatataatggatatacgtaacaacagttctgtatcta

SEQ ID NO: 358 - DNA, 1736 bp, Bacteroides thetaiotaomicron
atcataattagatcaaaacagtcatggaattctttgtttttattcctggtttgggagattgatacgtagatttatagtatggttctatgaagtatgcttaataaattggtataatgctatatatcttttcttatatttatcaggttggtttaaagcattctaccatatgaattaatgaattcttgccagctattagccgcttgttgcttatgttttattctgttgcacttgcgtagctacagggatgcataactgtagcagacttgttgcacaagtctgcctgtctgattactcgactgtaactttattgtttctttatgattggataggggggagtgaaaaaagtgcagttttcttctatgaaaaagtgaaaagtatatagatgatttttgtaaacttgtaggaaaaagaactgttttgtgggcttaaagtgttgattagtaatgctgtgacatttttgcttttccccttataataattagattagatacaaaaatgtcacagcattcatctgattatcctcggttgctacttctcttctttttttgcccgtaactttcccgccagttaattatatgagcgttggaagagtgagtagcttccgaaggatatattatctaataaatgttgtatgagtaattcttcacatgtttcctttactaaaaaggaacatgtgaaaaaatacattactctctcactttaaactacttccccctcttttgttgaaagagggagaagttattttaatacttcatcaagtgtgatgctttaaaacttttggttaataattctttggataagaattaccgtcataagtacaagtagacttgaaagctccttttgcaacaccattcaatacgcttacgatattgttggctctaaggtcatagtaaccgatagcaccataacctttacttgcaacttgtcctgaataaagttgagcactagcagcagacggagcactattcagattaatggtataaggtgcaaatttactattcggcataccaaaacctgtactccacgatggggagttgaagaatgcgtaaatgccataatcaatatagctattaactcctgtaagctcacttgtgtagccataattgaatacagtaatcgtcttacctggcattttgttatggagcgcagtaatcaaattagagaaagaacctgtacttccagatggataaccatttctaccgtattcagcccattcgtcgtcaaagtctacaccatctaatccatattgactaacagcattggcaacggcggtagcaaactgttcagtctgagctgaattcatgtttgcgaatccgagtcctgtatggtcacctaatagaccgagtaaaactttgatacctttgtcttgaagaggcttaatcagagtgtctttgtggtccaaaatgtactgtacatttggattgttatataaagtagcgtctgagcctacacctcttatgttggcagcgaacagaattacataatcgaaaaatggagcatcatccataatatatgaccctgcattaagaggattgatatcatttacttcaatataaacgatgtttttaatacctgtggccgaacgggtgactacttcagattgattattatctgattggtttactggcatttcttcttgtgagcatgcgcaaaatgcaaatatagcgatagatgacgctaaaattttatacaagtttttcataatgtaaattttaaaattgatttaatgatttttc

SEQ ID NO: 359 - DNA, 1732 bp, Bacteroides thetaiotaomicron
tataagggcttattctcagctatacaagcgatttcggaaatgtgcgttaataagttagttaatataagaaataagcatataacatattgatatacatatatttatcaaattcatattatttattcagcacactcagcaaataatgtcccggcagtttaatcttcccaccgcttccacgaatgacgctaaagcctttccatatatcaccaccgatttcaccgtaattacttttcagcactatagcatattgttccgcaggaggaacacgaaagagacggagattctccagcagaccggaaaaattgcggggacatccgtccgggggaacctgcatccggtcgatatcttcctgcgtcagattccgtttcctcgtggcagatcgctgatcgcattcttctctcatcccgcctccggctccttcagctactttctctccttcactcccttcttcttcatcccctccttttgcgaaaggagggttagggaagatgttttctttcttttctttttcttttctttttatgagagctgtttttgttgcagtatcccgggatgccgttgcaatattcggggatactgcaacattttcccctgttgcggcaacagtatctggctgctcatccgttgttttctcttccggcagcagacaataatccggacagatatggtgacgactgcgacgtttggtgatgaagagatactgccgctggacatcctcagaagtcagaatgctgtaacgctcataaagcgcagagtcaaaaagcccgtattcaagaaacagacggatgacacggcggacggtatcgttgtccgtactgaaaagctgatcggaaagttcgtcacagaaatcggtgtcggcacggacatagtagccctcgcccgaatagagataagacataatatagattaaaacggtgaaagcggaatcgccctcacgcttcatgacacgacgaacgatacggtcgtgcatgaagtcggtgctcaggggaaagtagtccagtccctgtttgattcttcccatagttgtattgtttttataaatagtttatcagtcagttttttcattttgttaatcattcagttccgcttccacttcacaaagtttctgctttttccgcttgatacttgcccttacaatctgcagggcggacagaatcagtttctgacgaagatcggggtctttcgtagaggtgataacgggataaggttcacggtcgtcacgtgccagcgtgcgcttctcggtcttcctgtatttccggctggcggatttgcggcattccttgcagtagttgtttggaaggccggttttcttatctacgtaaaaggcttctgaaggaagcgtgtgtttgcaacagccgcaaacgtaaagtgtttgtttttgtaatgtttccattccggttattctttttgatatacttgatatgttttcagataaaaggtaaggcagcctgcgcacaggaggttcacatcctacacaatgatcattggcaacttgcccgtcagatgttaacagccatcacgtcagctgttaatacccaatataacaactgttaactcctgacaaatcaactattaacagctgacagctctcttttcggagggggagaatgcggtttttgaaagtatttcgcatctttttcttgttttctcatggtttatctaatttttatttctaattttgaaatcaaatattcatttcgaataccacaaaggtatagtaagtcgcatatat

SEQ ID NO: 360 - DNA, 1705 bp, Bacteroides thetaiotaomicron
tctttatacatatcaatatgggtgttactgattgtattccattttatctcatgtaaaatattatgccttcgtttaatcgcttttatgcattgtttcatttcttcagtctgttcctttggcacctttatataaccaatacacatgacaggaaaatgatcatgttctaaatgacagctttcatctatatagaatgttaattgttctttattcataaggttgctatatattattccttccaattataattactgaattctccattttctcgcttcgggtaatacttgcttatctatctttacattgtagaaggtaagagggtttagtgtattccataatggcaatgctttgtttgtaccgtatatgctctcaaccatcgctccaagtaaagcacgcaccattggaggatatttttttgcaagcataagtagctcatccctatcttttttatccaaattctgaataatagtcattatacacttacatgattggctggtagtcgtatccggtatttcttttataaacttaatggcatccaatagctgcaataaaggtatattttcctttgttatgggattagattgaatcacgaaactaatcgtgaacattcctcttaccgttttgtttttacgtacatttgtgccaatttggatgatattcggcacttgtgtagtcaatcctaatcgattaaaagctaagtatccagtcatataaccaataacttctccatccttctcaagaaagtcttttacaacttcttctaacttaggctttagcgttccaaaagcactttttttaggtttatagaaacgtccttttgagattttggcaataataccttcagctactaaacgatttaagattttgataactctttcactccgttctggagacaaatttaaatcttgatatgtaaaaacataatcagactcaatattttcaattctttgtcgaatttcctttatcattaccatctttcttcaatagctatgtcctgctaataagattattaccacgaggttgtattaatgacatttttaaagtactcgctattctttgtctttcatcatattttacataattattgtataagtatgatttaacacgtgcttttagtattcttaatgccacaggattattctcaaactctttatataataattttaactcgggtattgataatttcccatagcacgtctttattgaaaatgatattaatttcgcagcaggagtattcaattcatttgctacatcatcaaaaataggtttaagatctctattccctactgaattgatcacctttgagaagatacccaagcaaaaattaaaagacattagttgaaagaataaatttattctttcagcaatttctgatttagaatcatccttttcaactttactctgaatagaaatagtcaattcttctttagtgcttttgattattttccccaaaaaaccgatagttctaaaagcagttagatacaactcctttatcatttcatgtaacttttgttttgaaatagaacctttcctatttttaataatttgtcctacaatttccaatgatctgactgcttgatagaaagatattatttcagaaggcatattttgataatcttcttcgtaagtattatctttcatctgcaattctaacttatccctactttctaagcttttctcacgttcctgtataggatctgtattagat

SEQ ID NO: 361 - DNA, 1683 bp, Bacteroides thetaiotaomicron
atggttcatacggaaccagataatttttatctattactaacttttataaaaacatgtattatgaaaaagattttattaatgctcgcaagtgcttttttcatgttttcgtgttctcaagaggaaggaacttctcctatcaacgagaatacaagtaatttaccagtatcggcaacagccgatgcgcaactcaaatttgccaaattgttatcacaagccgcctccggtagtatcgaagtacgcaacttcttgaaaaaagaagctttagtacagtttgacaatgactacgacattttctatccattaattaaagataaaaaagtatttggcaaccaaagttttagagatatattattatcatactgcaaagaagaaaacgaattgagtcaaattgagcaatctcttcccttgttaaacataatggttccagatctcactctattttgggacttcaatgccacaacatgggatacaagtgataaagaaatatcagtattgtgtagagatgacaaaaacaacacactatatgaaaatggcgaaaacattggtaatatgacaaacggagatattcctggtttcccttgccttgttgtgaaaaacaatgaacgcatgaaaattactagtgttaatacaagatcaggagaggctacttatgaatttataagtgatgcttttgatgggagcaaaaaggtgcaaacccggcattatgatgctgataatgatttagaagcaaccgaagatttgaataaatatgttagtaaagatgtagtagccacagctattaacgcttggcgagaattcaaaaacgtccctaatgcctgccaaagagattatatttattatggtatcaataaaacaaatactcctggaagcttaaatagaaatatcagagaaaaattataccgatttagaattagtgctactgcatttggaagaatcgcagatgccgacggtgatcaaagattacaagacttgacccaaactaaacgttacctttcaaatgaagaaattcttcaaaatatatggacagatggaaatttcgaattccgattcaagtcctatattgcaggagaaacaaataaagatgcgatggaacatttgctcacattttccgtaaaagcaaaagatgtgttctccatagaaaagatacatcttcatcataaaaacggtaccgcatttagacaatcaaagaatttctattcagtagatatcaacaatttaagatcaaaatggatttatccggaaaaacttgaacccaataaggataaccaagttttcacattaccatgggatttatacaacaaagctctttccattcatatgtatgtagaagaattcgatgttgatcagacaatagaaaaaacaataactgtagtaaatgaatttacaaacaaagcagatttttccatcgaaggaggcggaagcatagatagcgtcaaattatctgccaaattaggatatggtttttcacacaccaataccacaactagtagtactaaagttacaactacagtcggttctgacgaattaggaactctttccttcttcttctatgaccctattatcagagcagaatctaacaatacctataaactatatgacgtatctagcggtgatgtgacagcaactatcttaccgattaatcttattattaccagataaaagatataaatacaacatatatag

SEQ ID NO: 362 - DNA, 1636 bp, Bacteroides thetaiotaomicron
atataatgatgattctctttttgtgagaaaataaaaaagaggctataccaattttctattaaacataatcatcattattccctaaacgtaaacagcttattttcgttctttctcatcatccgttaataacaagcaatggcgtatcagaatggaaaatcattttacgagcaatgctcgggttaaataatcgtgcaaatatattcctcttataggaagttaatgttattatatctatctgattatctttgatatacttgtcaagtccttttaatagattatcattcattaccacatcataatgaatttcaagcccgggatattgtttttggaaatagtctttgatacctgcaagtttaatttcattccaagtatctttggattcagccagatgtattaatgagactgaaaaatggaaagatttccatgtgttgaaaaatgcttcaaaagcaatcaagtctctctgatcaaaattggttaagaaagcaatacgttttacttcattgaattctttgaatggagtattttccggaatagccaatactgctgtgcggcttcgatcaataatttcagctgttacactgccaattaagtcaatgtctttctggctttttccacgcgttcccataatgataaccttaggacgttgctccttggcatatcttaagatttcttcctccggaattccttctcgtaaaatgcaactatatttgatatccggaaattctccagatgcaactttttccttaatcttatcagatagtgcgttgagatctgaatggacctgctggatgattgttttaacagattcttcatctccgatctgataattgaatacatcgccatatggtaatgacgaagcgtatatcggtgtaaagtaaacatgtaatagaatcacttcagaattctcagttttggccaaattaaagccaaattcacacgctttcatcgaataattggagaagtcgacaggtattaaaattttgttcgatttactatctaccttaggtgtcttctctcccactatactttcagataaccaagtagaactttccgttatttttaatgcacgtggtagatcactttctttaattcgcagacgtactcctgaagatacaacaggttgtatttgatttacgttatgaatgtatgtttctattccttcattttcgaggacattctttagaatctgagcttttgtataagtcagaatagctaaggttactaatttatcttccataataatctgtttttgaaggtaaacaaataagaaatcccaattgtttgggcaattgggattcttgttttatattttaaatttgcataggttcggtagcttgttctttttgcatactcatgtttatttcatctaaaatttttagagcccggtcgagaacagttgtgtcatctagcattacaagcccgccatccggaccaggctcaagatgtattccgacactttttccttccttgaaattatggcctccgaagaagttgcgcactgtatctacgtgcaaaccaagttcgtctgctattctatgcatgctaccgctaggcaatgaatctttaatcttgcgaagttcattaaatgttattgttctcatgtctcataaatttaatggttaatactatattgtat

SEQ ID NO: 363 - DNA, 1621 bp, Bacteroides thetaiotaomicron
taattgtcttattatttgcgacatttatagaaatttgctatctttgagtattgaaaataaagagataaacaaacctttaaagctggtctggctgccagtataaagaacagcaaacaaaattatgaaatctacttttgataaaaatgcagagaagtttgtaaaccttatggttgagaaaattgaaagtttgtctatgaattggcaaaaaccttggttctctaaagtcaattctaagcagaactttttaccgcaaaatttaacagggcgtacttatagtggtggaaacgcttttttactttatttcttgtgtgaaaaatataattatcaaactcctgtttttttgacattcaatcaagcacgaaacgaaggtattaatgttctaaaaggtgctgctgcttttcctgtttattatacattattttgtgcttatcatcgtcagacaaatgaaaaaatttcatatgatgaatataaaaaattatcagaagaagaacaaaaagaataccgtttagcagcttatacaaaatatttccaagtttttaatttagaccaaacaaattttgcggaaaaatatcccaatagatgggatatattaaaggctaaattttcaggagaggaacagccacaagaagagaaagaaatgtatgtaaatccaatacttgatgaaatgaataagaatcaaaattgggtgtgtcctattcaaacggtttctagtgatagtgcgttctattcaatatcaaatgatagtattactttacctttaaagagccaatttaaggacggagaaagtttttatggtacagaattacatgaaatgggacatagtacaggtgttaaaaatagactaaatcgaaaaggattttatgaaaatgataaattcaattatggacgtgaagaacttgtagcagaattaatatcggctttgtctggtgtatatttgggtatttctgtaaccgtcagagaagaaaatgcggcttatttaaaatcatggtgcaaagcaataaaagaagaacctaaatttttatttactgtattggcagatgctattaaaggtagtaagttcatagcccagcatctaaatataagactagatgtggaagaagtagaagaagagaaaaatacaaaggttgcttaaagattcctccctcccaaatggggggagttcttttttcaaacgccaaaaaagaaccaaaaaggcttaatcgcttcactttgttacgctccaatagttttgctatcgataaacccacccacccttctaaggtatgtttctttatcccttctgcaatccttagtaaagttccactaccttttaggtaactccactttagtaagcattgcagaagcggaaacatgacgcaaattaaaatacattctcactttgagaatacattttaatgcgtcttgttgtctaacccaataagaactatagggaaagaaattgataccgtacttttcggagttccggcactgatgggcaaacatggcatgatgaaatgataccgaattttcattcctggcacaccctgtagaacgaccttttgataccaaatacaaaaagttgccggaagccggacacaaaaaattgataccataaaacgatagggaaaaagaacaggaacaa

SEQ ID NO: 364 - DNA, 1552 bp, Bacteroides thetaiotaomicron
acctatattattttttttcaatgtttcaatcaattcaaaaaagcccaagtctttatgttcttctataaaactctcacttggctcattttccggcatatttagataatatctagacataattttcccctcctcatatacaaaaagctcattcgataaaactgatataaagaaatattgatcatctaataacgctattggataatgcaaaaaagaataatgtacattttgggttgccattttttttgcttttaataatgtttcgccaattaataagttattcttgattctaaatgtactgtattcacttttgcttagagaataatcattggataacggataatacgcaataagctctccttcaccacacatcatagcagattcaatgttagcatctttggcatttaattgaattgtattagagtaagttccaatatagctatactgcaaaatctttctcgctgaattacagataagacatactaacttattatcacgatctaaatagaaattatccgaataaacatattcatcaggccctattcctctatgacttatttcattaataaaatgtccttcttcatcaaaaacaaataatcctctagaatcttttacaaagtaaaaatttccatcattctttatacattcaatatcactcaacaagcattcacttgtttccaaaggaatatatttgatactatctacaatgtcatacaagtcgatttgtataggacaatctttattcaaaatatcaatgatttcaatgccatctttatgacatgaaacctgtcgttgacaggatgacatagttagaaaaattatcataataactcttcccacatgtaccaatcctatcaacgaactattatttctaccaatcatcactaatttgatataatatttctcacttcaccaattctactattaagacaacagttacctggagaatctttgtcacaatttcctaattcataagttaatgctaaatcggaaataggcttcgcattaactagagaaaagaatacaccatatcctcctataaagaggacaataattatcattaataatattttgtttttcataatcatcattttatatcatatataattccttcgacagaagcaataacagataacagaattatgcttttaggtctcattttgttttactttatgttgttttgcactacaaagataacatatttcgcaacgatttaaggtttctcatctaaaaaagatatagttcaatagaagaaaagccactttgtagtcaaacaaatattcataatataaatattgtagcattaaaactcttatttattaagctatacttatataaatattttactatttaacaagagtgaaaacagaatttcccaaacctttgattatcaacaatatacaaatcgtcatttttcctttaaaaccaaaagggcgttcctttaaaaccaagaccccgtttctttaaaaccaacgggcctttggttttaaagaaacggaccataaaaaggcaaaaagaataagtttgttaacaatattcaatatccgataagaat

SEQ ID NO: 365 - DNA, 1547 bp, Bacteroides thetaiotaomicron
taataataatttgtaatttaaagttttcatggctttaactttttaaggttaatatattgattattctcaaaggtagtatattaatactagaacttatgctaaaattcaatgtttgatggcatgaatgcttttaatttttaattaattggtagaaataagctcatgttggactatggtttggtaaaaatgtatggtacaaaggcgaagtatttcaaccggtcggtaataaaccggtcggttaagaatacccccaaacgcttccccgggtctttatgtttgaaataacaaaggacgtatgagattctctaaggtgcaattttagtaccttttgaggttataaatgacttatcagaggataattgtaaagaatttgatagattatatcgccttttcgcagttggtggataagatgaggcgatcaaaaccatgtagacctataggcttctcaattccgaataaatatatgaagaaagaataactacggctaattactgcatgatctccgattgctccgttgattatttattaaccttaattggaaaccataaaaaagccatccccggaatagacgaagtagggatggctttttttgtagtgtgcttactattgttcggcagactatgttccgtgagtttttggaaaggttattccttgacaggctcagccggtttgtctttggatgcagtgtcagtaacgactgtatcgttgacaatagcggtcggtgcactcagttctgtcttaacaggttcctcgctcttggttacagtatcttttactactgtatcattaacgatagctgttgcattaacttctgccagggctgtcgcagcttctgcagagttctgagccttaacaaggaatgaaccaccacaaacaaacataaacattgctactactaatactaattttttcataatcgtttgctttaatgattattaaacatatattttcaattctctcttatgtgttaaggaatcggttgttacattatctaacggctaattaaagatcaaagtgtgtgccaaagactgatgtgtgctaacaatgcgttgattataagtgggatatgtagattatgtacattatctatagtgtggaaacgtatggggaatgtgtggaaaatggggcagggagtgtggaattattccacaatagtgtgctttgctatgcaggtaataataagtaatgaaagaatggttgtgatacaatgaacttatgtttaagtgacagtgagttgaaatgtagtaaataagtgaccgttctgctactgtttattagtcggtcatattgattctctaaccattataaccctgtttttatttcgttgcacctaggtttgatagtcgttgcacgtaggttgaatagttgaagcaccttagtgctatattcgttgcaccttggtgcaacgaaagaaaactgctgacttttgacacatttacatttgcagtattaaatatcacaacaaaatataagtgtatatttgaaaagtagagttgcagtgaactaactttgacactagtcttaaatgactataggctgaatcagac

SEQ ID NO: 366 - DNA, 1520 bp, Bacteroides thetaiotaomicron
ttatcagcttgaacttcttggcgatttctatcgttcgaatttctcagtttctcgttttgcccaagaaaaagggattgcccgcattacattttggcgttgggttcgtatctttgaggattctaatcctgaaatatccgcttatatgaaaaagaacaagtctcccaagtcctcggatgaatcctcctcaattactgccttacgtcttgagaatgagcgtttacgtgcagagcttaaagatgctaaaatgcgtgcgcacgccttcgatacgatgattgatgttgccgaggagatgtttaatcttcctatccgaaaaaaagctggtaccaaacaataaaaaggctttgtaaagggaggcatgcctatacggtggtctctctttgcaaattgtttggtgtaacaaagcaagccttttataagtatgttgaccatagtacggatagttcggcccgtgaacgttttgttcttgagtttgtcaaacgtgtgcgttcaaaggaccctggtattggggggatgaaactttggctgatgtaccgtaatgagttcggcaccagccaggcctttgttgggcgtgactgtttctgtgctatattgtccaagtataagctgacaatacgcaaacgttttcgggctccacgtacgacagactcctctcatcacttgccacagtatcctgatttaaccaggacattgctattagaacatcctgatcagctgtgggttagtgatatcacttacattaccatatggttgcctgacggcagttatgtgttctgctacctgtctctggtgacagacgcctatacgaaggagatcattgggtattgcgtaggtgatactctgggaagctgttacacagtggaagctctggaaatggcagtcagacgcatagctgcaaaggagattaagggtttgatccatcactccgaccgaggcgtacaatatgccagtgcggattatattgccatattacgacataacgggattcttcccagcatgacagaggatggcaatcccaaggacaatgccatagctgagcgtgtgaatggcattataaagaatgaattgctgcaaggaatgcgctttagttcaatacaggaagtcagaaaagctgtagcaacagccgttcacttctataacaacgaaaggcctcatatgagcttggatatgcttaccccggtacaggcaggagaaatgcaaggacctatcaggaaaagatggataagctacagagaaaagtatctgaatgtagcacttgcttaaaaataaatatgtacatttgcttatgaaaagaccaagaatgccctgctagcgggatagaaagaggaaaaagggtgagttcctttcttttttcttctttcaaagagaagagtcaaccggttaaaggaataagaaaaaaataagtaaaccggaggcaggaataataaataataaagtaaacagctgccagggttagtaatatttctagtcaacacatagcagctattagagataaacaagtcaaccattattagggaagtaca

SEQ ID NO: 367 - DNA, 1503 bp, Bacteroides thetaiotaomicron
tataagtattcttcattatttagaatttttttttatttgttgtttcatcagttgaatgtattctgcatgtcttcgaacatagtctacaatcacttctatcgatatttccactcttttttcttgtaaatccctatatattctctgtgctacagaaaaatcttctaacgtatcaatcgtgagtcgaatattatgatgttttgacacgactggagatcctgaaatccattgaatattaaaaagttcaggatgactatatatataattagtaacatgttcacgatacaataaatcatcagtaaatcctataactcgcttcagcgcatcaagcgttacaaattctccccaaaaaccgaaatgagttttaattgatggagtaccatcaatatcaaaacttatataatcgttacaagatttcattgctatttcgaccaattgccttgccgcatgtacatctaaaaatggattatcagaacatattcggaatataccctgtatatcaaaatattcagcaacatcaatgaatcgttttaaaacatcattctcctcacctctgaagcactttacccctaatgcaagtgccttcttttcaataggttcattgataacagaatttgttgtagcaataattactggaatattcgatatagcagaaagcttatgaaccattaagtcaagaatcgattgattaccatagaaaggtttcaatatttttccaggcaaacgtgtagaacctaaacgtgcctgcaccacaaatgcataattcattttatttattatatttcatttaaaaatatgtcacatattctctttgttgaattatcatcttgaaattgattcatcaataaagaaatatgacgtcgatgttcagcatgaatatctttcccagccagaagtcccatcacagcatctatcaattcattataattgtaaacaatatcacctgcacaaaaaaattctattggctcaaatgagaaacctcttactctacgatattcttcaatatcgtagaaattaaatatgactggcttatttaccaataaaaaatcaaaataggtagaagtataatcagtaatcattccatctgaaaatgacaaaagatcatacaatccatatttatatgtttgttcaaaaacaagtatacctttgggtaaatctttttttaagactgttttattctgcaaaggatgtaatttaagaattaaagccgcattaaacttcaatagtattttcgataacttcaacaaatcacaatcaacatatccgagtattgaacgcaaattaccttcagtaacagtctcataatcacgaaaagttggagtataaactatatatttagttacatcatatcccgcaaatttcgaaatttctcttttaataacattgcaattatttttcgatatcaacaaatcatttctgggaaatcctaagactttgaatttatcatatgagattccacaatctattgaaattattctagcacttaaacaagaagtagcaatagag

SEQ ID NO: 368 - DNA, 1492 bp, Bacteroides thetaiotaomicron
gccaacaccaatataatattgattatcaaaacaactgcatatctcatattattatacatttaaggaaatacaaaatagaatacacagagaagcactgtggctataatgttccttatcaccccataaattttattatgacgaaaaaggaagtcaagcagcaacgttacaagataccaagctattacaacttgcgtcaaatcatattgccgttccaaagggtccatgaatactatatatatatatcaatggacatcaacacaatggttataatccaaaccattgtgttttttatagttatattcattttcaatgatagataaatctgtccaatcaataatagactttcttgttttctctggaaagtaccaaataatcgtccacttttacatcaaaataagacttagctttaccgtcatcattggaaggcaactcctctttatcagtcagcgcctctattatatcgatttccttcacgttctttttcaatttggggaacaacaggctgacatatatgtatttacgattgcaacctttaataatcatcaacttatccataggtgcgccaccatcgtatcctctcaccatgtattcatcaccggttttcttatctactattttaaatcccgggctatagtacatccattgccagtcgaaatagatgggttgcaggaacgttactttagtatcatctttccttctttcaatagaatgcaataaaggctttgtacccatgccatgctcataggttctatcggcaacgatctctatgctatctttaggagctgtataagccgcatcaaataacttttgatcgcgtgtcttggcctgttcggcagcgtcatcccttaccaactctcttgatttctgaagcttcggcatcatttcctgcaccatttccattgacagctgttgtatcatcggcattgattcagttgcaacggcagttgcagtctccccaagttttcttcccgcaggagattcataaaaagcaaccacttttttcagttcatctaatgtcatgtgttgctggtaaataggagcatatacttccatgactttatcttcaatcttccgtgtccattttgaagcaaaatctttccaataagcctcatcttgttggaaaggcccatttttcatactcgacatcaattgagacattatagcttcagaggatgccgaactgccggaaagcgtcatgatcttttttagtaaagttttgtactcgtcggtctggtctgaattctgagccgaagccggtaaaatagaagtaagcgatgtggctacgcagatcaccattaagaaaaggatttttttcatcatataatagttttgttgatgaagtcaagttaacttcattgtgttatacattcttacaaatatactctaattattattagaatacaaacaaataacggacataattataaactgcggcaattattgtctgatttaccggaatttctttattgcattccccaagtaataaataggg

SEQ ID NO: 369 - DNA, 1456 bp, Bacteroides thetaiotaomicron
gataaatagagcattaagtagttctgaaaaactattcaatttattacatttgcatgcaatttgcatatattcaaataacagatagatataaagaatcattttatgttcaaatattcaaaagatggagtttctgtattgaccatattagacaccagaagggctaaaattaatggattatttccagttaaagttcaagtcgtatttaggagaaagcagaaatattattctacggggaaagaattgtcaaaagaagactgggatagattgttaaaggcaaaaagtcagttattaatggaggtaaggactgatatcgaaagtagtttttctattataaaacaacaagttagcgaacttatccaaaaaggagaatttagttttgaaatattgagtatcagacttggaaggcatacgaaagaaatcaatctgcgtacagctttcgaattaaagatgaaggaattagaggataatgagcaggcaagtacatatttaaattatcgaagtgctttgaagagtttagaatgttttggtggtaccaatattccattagacagaattactgtggagtggctgaagcactgtgagcggttttggatttctaacggtaagagctattcaagtgtgagtatttattttcgaaccttaaagtgcatattaaaccgtgcagtacgagatggaatactgaaagaatcatcatttccttttggaaagaataaatatgaaataccagaaggacatggtcgaaagctggctctcactcttcctgagataaaaagagtcatgtctttccaggattctaccaatgaattagaggaatttcgtgatttatggttcttctcttatttatgtaatggaattaattttatggatctgttatttctccagtactcaaatattgtagatggagaaatctgttttatacgttccaaaacatccaggactactaaacatagtaaagaaatacgtgctactataactcctgagatgtgggatatcattcataagtggggaaaccctaatataagcccacaaacctatatttttaaatatgccaaagggaatgaagatgcttttgaaaagatcaaattagtgcgtcgtatcgttactaaatgtaatagaaaattaaaaaaaatagcccaaggtacaggtattgctcaactgactacttatacggcaagacattcatttgcgacagtactaaaacgtggtggagccaaaacgtcttatatttcagaaagtcttggtcactctaatttaactgttactgagaattatttagcatgttttgaaaaggaagagaggattagaaatgctcgactactgactaatttcgataataaaatgtaaatttgaatggtgcatgcaaattgtatgcacaacgctactttttgtgtttattgcataggcataaaataaatgagtatacgataatatgatgaattatagaaaaatctcattg

SEQ ID NO: 370 - DNA, 1408 bp, Bacteroides thetaiotaomicron
atataaagctatacttttacaactatataggactaataatagtacgattaataaaatcctaattatcggtttcatttatgatataaattaaagatttataggaatattgcaaaatctaatataccctcactaaaaatcttcttcagttgttgcttcgcactattcttcaaaccatttatagcgatgcttatccatcgcatatccagctacttcaccattaggatatatgtcgtatatactgtcatttacaaaaaaatgataccagctaccaaaagggaaatatgctgtaaattctttattccaaacaatcccttgaatagtatcaggcatttgaataatagtaggtgcaggcacataacaaatggagtcgtaaaataaatcatataatttgtgaacatattcatgtggagacgtatctttcaatttaataggttgttgtgcagtgctaagataaaaactcattcttccatgaggagcaatggaatataaaccgggagaatattcatgaaattcaccaaaatacctattgacttctacatctgccataagtggcattgaatattctccgttttttattataaagctaccatataaatcaggattcaatcctatcaaaagactagaatccgatttattatagacagacatatttaatgaaatcttatcaggcgaagaaaacttttcagacttccctttttctccatgaacacttatatcataaattgcaatatcaattacagcggaatctttatctccaccattaaaatatcgtaaattaggatattcccaaattttagttccatattcaatttgctcaaaagcagatttacccgattccttgtcttttacatatatccaaatccgttgatcaatttcgcgagaatcaggcatatcatcctgagacgatatgcctaatagtctactaatttccttttcacttagtctctttttaccttccagataaaaaagaatatatttatctttatatctcatagcatttgtaggcaaaattaacctaagttcatccccattttgaccagtatcaaaccaaaagccactttgcttaggccacatactatatacataagtttttctagaatcaaactgagaaacttttaaagtcttcccacaatcaggatagaaatctatcactgattttacatgttccaaaagtataggatctatactatcgtcatttgacccctgacaggcaactgccaggggaatagtcaatactattgatacatatatcaaagaaataatcactttttttctcattatcatcttaattgttgaaatatatatcgcattaaatcattcatggaattaactttaatagaatatgtgctattgttttgatcagtataattaataatattatctttataataaataccatatcgtatat

SEQ ID NO: 371 - DNA, 1381 bp, Bacteroides thetaiotaomicron
gtgaattctaagtcctctccaaacaatatctataaaatcttacccaagtttacgaacattaacgtatccttgggtaagtttgtatatagacatacctactcttcagaagtgtatagctacttcctaaacctaagatattttcgaagttaaggacctttttattatacggctaatgttacaaatggagtctgccttcgtatcacagcaaaagaccttgctatgattttggctcttacagcattgattacagatgctttatgtttcccctctgctattttccttttatagtatgctttcatctgcggatcccaagagatggcagtaatagctgcccgggtaaggtatacttttacttctttgttagccaatgaagaagtctgcgtttttccccgtatggaaatacctgaagtatgttcaaatggggcgaccccacaatagcaggcaaatttcctcgggttgtcaaatctttgaaaattgtcagtaacacacagtaatacaatggcattgataattcctattccttttatacttcttaatagcaagtagtttgtgtaaagcgatgtactggcggctattagttgctccatatcctcttccacctccaggattctttcttttatcgacttgagctgctcttccaaaaaagaaatggattctgtcacatcagccaacttagccatccaggagaatgtttccaataactttatgcttgatactttttgcttgaccaaattgtcacgtataataatccatccccgcagtctcaccaagtctttgtcaggcaatttgtataactccagttttcgatagtgtaataccgcatagttcgctattcttttggcgtcaatgcggtcatttttgcctcgttgcaagcctatggacttcttgatggtcaacgggcaaaccaaagccagggaaaatcccatggagacactggaaacagataactctgtgacataacttcccatgttttcagcacagaacaagagtttggataaagagagatgataaccagctatccaatccaataaagattggatcccagttggagtgttatcaaaagacttgtgagacaactctttttcgtctgcggacattaatgatgcatcgaaagttttttttcctacatcaagacctacaaaatgagaataattcataactttgtatttacagtattaaacatgaaggagaaacagctaatacatttattaggtcgtgagcctacaattctaactggctaggttctcctattaagagagttgcagtctgattcagcctatagtcatttaagactagtgtcaaagttagttcactgcaactctacttttcaaatatacacttatattttgttgtgatatttaatactgcaaatgtaaatgtg

SEQ ID NO: 372 - DNA, 1374 bp, Bacteroides thetaiotaomicron
ctaccctttatacacaagtatatattattttttttatctttgcttgatgttattagagacagatcaaattcgtgatcctcggcttttgcggcgtttaaacttaatttgctctcagatggttgtccatcaaagtgctatagtgaatcaatttagtaaggaacataaagaaaagatgggtgcttatagatttttgaacaattcctcagtcagctctgatgctatcttatcaggtctgatacacacttgctgtaagaatgcttccggtcgtcagcatttactgtgtattcaagatacctcggagataaactatgaggctcatgttgagcgaatgaagaaaaaaacagccagtcccggcattgtcggtcaaaagcaatgtggtacttttttgcatcctgtcttggtagtggatgcctccagtcatattcctataggcttttcttcggttaagcagtggaatcgctcaccggctgctttaagtcgtgaagaacgtaattacagatatcagcctatagaagaaaaagagtcatatcgttggatagaaagtggaatggctgccagtgagcaaatgccccgggatgcagttaaaacgatcatcggtgaccgtgaagcggacattttcgagcttttcagccgtatccctactgataatgttcacttgctgatacgttctgttcatgaaaggaattgccggttggatgatccagactgttctgtccatctgaatacattaatggagcaggctgttctacgggcagagtatagctttgaagtgctcccgggaagcggacgtaagaaacgggtagcgtgcatggaacttcgctttgaaagagtcaccttgtgcgctcctgttaacggtccggcaaagggcagtccccctgttagtctttattgcatacatgttaaagaaaaatcttccagtacaccggtaaatgagagccctattgaatggagactgctaactacacatgtggtggagactgtagaacaagcaattgaatgtatcggttggtatcgttgtagatggctgattgaagagttgttcagagtgctcaaaagaaagggattcatgattgaggacgcacagttggaaacagtttcggcattacaaaaactaatcttaatttccttgcaggcagccctgcaggtgatggtactcaaactttcttttgataaagaagatgaaaaactctcttcagaaatctactttacaagcaaagaaatagcattattacatatagtaggaaaaaagagtgagggaaatacaaaaatacagcaaaatccatataaaaaagaatcaatggcatgggcagcatggattattgcaaggttaggagcatggagtgcatacaagagccagtccattccaggatatat

SEQ ID NO: 373 - DNA, 1366 bp, Bacteroides thetaiotaomicron
gtgttggcaggcttctttttactttttggtgatcctttgaataaacagcttccaacgaaaatgatagctatttggttcattgttttagtgatattagattatcctctccgtcataataaaatatacaaagagataagaatattggtatacattatttttcttgctcttctatattggttgtttccgacataggtaaatcattgttttattcatattcatgctcaaataaaatagcctgttaatggatttgtataatgggaatgttttatctttgcagtgtttaaaataagatacgatgaataaaagagtaacaatacaattcgctgactttataaagagtaggttggcaggtggtttgctctgttgccttgtattgttggctgcttatctgtttcagatgtttttcccaggaatgtatgttgatgcattctcgtcatctttttatctttttgcgtggttgattctctttgtgggcgcactcctatggacacttcgtgagaaaggaacatctggattaccctccgagataactgattggcaatgcattgctgcctttttgttgattgttgcaaatcagatttatgttgttatgcctaaggaggttcacgttgaattggctcctgtaatatctgcttatactttacctgtgctggtcattgtcagtttggcaatagcagggatagttaagttgtctatctcattctatcgttcattggaaattgaacggcaaaaaacaattcttcaagagaaacggcttcaggaactgctgtcttctcctccacctgtgttggaaggcgtcatatttgtgcgcagacttttagaaaatcaatctatatatcaattaactgccagtgagaaccttacattaatagaaggatgccgtgcgattgatcctgacttttttgtttggttaaaagataagcaaataaaaattcctccacgtcatattgtatattgtgtacttattaggatgaggaaaactaagaaagagattttgtctatttttgatattagcgatggtgcttgccgtgccatgaggtctcgtgtccgtgcgagcttaggtatagaagatgaggacatggaaacctttttgcaggagttacattaggtaatctctagtatgtttattagtcctataaaagaatggattgctgatataaatcctcccataatagcatagtagaaccatacgcgtttattcgaatatttgttttgagggaatgtgtcgatggctccgattatgagcacaatccatgctagaagttcaaagaaagtaataaggaagtcttgaagagaataatttatatcatcaataaagcggtgaaagtaacacatagtgatgctaatcccccacattatattatat

SEQ ID NO: 374 - DNA, 1325 bp, Bacteroides thetaiotaomicron
cactactgtcccgtaaaagtggataaatagttctttgaaattattgaaatatagtcaattacacggttttttgaaatgaaacggacttgattttgcaactttgcagtctaatacaaatggctgctatgttccaagacaaatacgtattctctcaattaaccgcttttctgaacaggactcagtttaacaactatgttcgcaagtatggtggcaaccgatatgtgaaacatttcacttgctggaatcagatgctcgcgatgatgtttggacaactgagtaaccgtgagagcctgcgagacttaatcgttgctttcgaggcgcatagggccaagcaatatcatcttgggttaggtcgtgaaccgatagccaagacaactcttgcgacagccaaccggaaccgtgattatagaatttttgaagaatttgcattctatatgatgaaggaagcctgcgagaagcggacgaccaacatccttgacatttccggaaagaaatatgcgtttgattcaacaacgattccgttatgtcttgcaacattcccatgggcaaagttccgaaacaagaaaggaggagttaaggctcatgtcttatatgacattgaagcacaagttcctgccttctataccgtaaccactgcatcaaagcatgattctacattactgtcttcaatccattatgaaccaaatgcttattatatcttcgacagggcttatgattcctttaaagaactctataagatacatcttacagactctttctttgttgtcagagccaagacgaatttaaagtataagacagtccaatggaagcgaagaatgccaaagaatataatgacagatgcggaagtgaaactgaccggctatctctccgagaagaaatatcctgagtcattcagactcgtccgatattacgatgaagaagatgaccgtgagttcacttttttgacaaatgcaaaacaactttctgcactggatatcgccaatctttataagaaaagatggttaatcgagctgttcttcaaatggctcaagcagcatctcaagataaagaaattttggggcacaacagagaacgctgttcgcatacaaatcagtgtggctattatcacatactgccttgtggctattgtccaacatgatatgaagttgaaacgctcaacctatgaagttttgcaaattctcagcatatcattgactgacaaaacccacttgcgtgacctgttcgataagactaatttcaatgatgtcaaagatctaaataatccccttattccggggctatttgattaattgtttaactcgtcccattttaacgggacactaatg

SEQ ID NO: 375 - DNA, 1293 bp, Bacteroides thetaiotaomicron
gatatatatatactcttgaataaaggaagtatttttaatgcccttaatgaataatgttcttgataaacttgatatatcaaaggatggtttaatctcaaaaatgccttacgagtagaatttgaatagaacaataaatacatagcatctatttcatctcgtatttcctgataaaaagattcttttttcaataaatgatcaatataaaaagctgcttgaagagtttcttccgccaaagtaacagacctctgatgtgaagcagaagaagggtattgaatataattatataaagcttcattgattattttcactttacaagagcgtgctactaattgcatatatactgttgcatcttcaccaatcctgagatgacaaggaatatacataggttcatcaaacaactctctcctatatacttttgcccatagctcccaaccatattttcccctcaaaacttttttcaaataatcaatcttttctaatgttacatttgcttcttgctttaacacttttttattttttcgaaccacatgataaccagcaatcactatatcaacattcttttcaaaatgacaaataaatctctctaagaaatctgagactaacgtatcatctatatctagaaaactaatatattctccttgtgcctcttttattcctctatttcgtgcaatagcaactccttgattattctggctatacacaacaaacctagaatcacttttcgcaaaagactgaagtacagaaagtgaattgtccgtactaccatcattgatcaaaattgcctgccaatcagtatatgtttgctttaacaaggaatataaacaagcagagatataacgttctccgttatacacaggaataataaaagaaatagtcatcttaactcagctatatattttttagaatgaatctcatcgaaatagaaataagcaataagaaatatcactgaaaaagtcattttattaagtccaatagttactgctttacattccaataaaaataaatatacgattattaagagcttatagaaaaacatattaaaatgtgaaacacgttgaattttattatatttaatcggagcaataagtattaattgataaataataagtagtatatatcccccaattccccagtaaaacaaattccgcaaaattccaatatctatatgcttgtaatatgcacctgttatagtatctataaaacttccactaccatacaatatttcttctacagatgtagacactcgccacatttcttccagcctatcggtagatgaagtggaaaattcatcat

SEQ ID NO: 376 - DNA, 1285 bp, Bacteroides thetaiotaomicron
atataatcaattgtttatcacttgtataatcagtatttcatagattggatttatgagttagtttttaagttaggttttgtagattaggtgtttggcagctgccgtccgtgaggtccggcagctgttctgtgtttcttcagtctattcgcagaataggctgtcattacttattcatcgatctcaatcgtataccctcctctgaaagtttcttccggttgcaggtgttgcatccagtctttgtctttgtattcgcctgtgtaatgtgcgcggtcgcagcggccgtaccacggttcaatgcagacaaaaggggcattctttgcaggcggagaccatagaccgactacgggagcatgaaagtgcaggcttaaataagctttcttttccttggtataaagggttactttatggatttgctcattctctattatcaaagcatctttatcgaaagtatgtgtatccaatggcaataacccgtctgtaagttccagagaatattcagtggaaggatctgcacatcctttttctgaaatgaggatatacttcaatccttcttccttgtcaaaaccgaagaaaccacgattctgtgtatctgcattaaaatccggccaatagaatgcaggatgcgcaccgatttgaaaatacatttctttttctccggtattcttaacttcccatataacctcgatctgcttaccctgaatacgataacctatttccagacaaaacgggaaaggaaatttccgtaatgtctcttcattactgacaaggtggtatcgtacttcgtcttctttttctgaaacaagagtaaattccatatcgcgggcaaagccatgttgactcaatgtataagcgataccttcattacgatactggttttcccacacacttcctacaatcgggaaaagtacaggagagtggcgtttccaaaaagcagggtcggcttgccacagatactctttcccattggcgaagatactgcaaagttcggctccatgcggagatacctgaatagtaagttgttcgttggagattgttttcatatcattcagttttctgttggttactttgagtgattatatgcttgttatatgaataatatccctttttacaaggacttaaattactatacaaaggtagtattttctatgattgagagagaatataatcccgactttcttatgatggagaattattcttataaaaccctataaaatagcgttctatgcaacatatcttacagcatttgaaacatttttttcagtcggttgacttaaatcaaccgtaa

SEQ ID NO: 377 - DNA, 1280 bp, Bacteroides thetaiotaomicron
gtgttatagcaacgcaaatataaggattaattttatttaatgatgttcttatggaagcattttatcatctttcttgttaattatgagcaaatacttatttagaatgcctccgtcatgttgaaatagaataaattctgcttgttcaccatgtctctgccgaagtcaagacggacgttcatacggggctgaacttcaatgcgtaaaccgagtcccagattaggaagtacaccttcgattttgcccggagtagggcccatgaagccgcatcctccccatgctacgtagcctacatgattcagcatcttcttcacccaattgcttttgtccgtatttatcatctgacggtattctgccatcatcacgtgggatgacttgtcgcgaaactgtcccatataataaccacgaaggtcgaaaggagtgccgctgagtgcgtatttagtcaatggaacattgccgaatacattctttgtctgcactgtccaagccaatactttacgtttgcctagggtcttgtattggcggtagtctatttccaaacggtagaaattattatcgcttccgaaggctttgttgtacatcatcccacgaaagtccagatacgttccccgataagcattggcgggaacgtcacgggtgtcgtacgtcagcaggaaaccgagtccggaactgaggttagagtagccgtgatccgtaccgccggcggcaatatacgatggttgctctatcattcctgcggcaggtttagtgatcttgtcataattgaagtcgatctgcggaccggcaaagaagttgcttttccccagacggaataaaaaccacggattcacctgcacaccgctataacggtattcgctggtgtcttcgccacgcggatagtccttgttggtgctgtatccgatgccgtagaaattttccagtgtattcttatatgcaaagactccgaagatgcggaatcggtcgcctttgaagaaaagctgcggtttggtgaacaggttcagtcctccttcgaacatcagggcgatggccatcggcaccaccgaacgttgttgggtagtatcactcggattcatccgaaacgtcatcaatgcactaccgccgatcagtaatccgaagtcaggagtatagctggggccacctaatatattataatgtagattacgtttggctacacgctggcgtcgcaattcttttttggaaagggtgggggtgggatctgccggggctaccccgacttcgtcaacagaagttgtagtcgtttgcagttcatcgctttttactgc

SEQ ID NO: 378 - DNA, 1276 bp, Bacteroides thetaiotaomicron
acaacgtggtgtttgtgaatcgtccccttatccccgtaaaaggggttagcaacaatctatatttgcaacggaaaatgatttgacttccctaaaaaatgatatgaaaaagacaaaacttgaaaatcagcaacaggtttggaaaggatgcaaaaaacaaccggtcagacagcaagcatggcacattccgaaaatatggtcagccgcctatcgacacaccggaagaaacctctgcaattccttttaaaaaaatgaagccgaagaatgaagcatacaatattccacgtatcgaaaaaagtgactgcacgataaaatgaaaggctgcaacggaagaacagacttgcggattctgcggggagaacataaccatacaggcatacagccactacaactgtttccggaaaaagaagattatacaaccggaaaaacagaaaggcatccactcggagaaaagcaagcaaacgattgaagcggactgccgatttagcggcgaaatatccgactacctatatacagccctaaaaggctggggcatatgggtaagcaacagactgccgggcaaataaaaggagagtggcatagccgccggaaagaggttgtctcgatgtggccgaagctccgaaagcagaccggatatgcctctctcctttgccttccccattcctggatttcacacaatcacggagcctgcgagtgactatgagaaatcctgaaacggggacagtcactccgctgaaagggtgggtgggaaacatgtgactttctccaaaataacaaataggggtataaagatctcaaaagaaaagaaagccgttccagaaaagactggagcaactatcaccatctactgttctttaagttaattgcagcaaatccaaatcatcagtgaccaatccatccaatacatgttggattttatcaaatatagccttatctatgccatacgtggcgcataacgattgaaatttgcttacagcatcgaacacctgtaatatcttcttttcgggctcctctacaaaatcctcggcaaagttgacgaaatcacttgtagtcaaggcagaccttttgcccatcacgcccatcgaatgaatgtgtgctgaagaattttcccatgtatttgccgtgaacattacatcatatgcaggtgataaacgccatacccctgccttatccatgataaacgatatgttcttattatgatcatcggatatacctgcgacataattaaataccattctgataaatatctgatctttgtcttcctggggaagtttcagag

SEQ ID NO: 379 - DNA, 1251 bp, Bacteroides thetaiotaomicron
aaggattaagtttagcggattttcttgggagtatgcttacacgcactattggattgttccgaagaacgctccatactatcaggttcgactctcatcccggatttgcctgggatgatcaacatctacacccttcaacggactattccgtcagtccgcggcgctgtcactgctccgtctccacgtcactccttaaggtagtacaggaatattaacctgttctgccatcggcctcaccgttcggctgagccttaggacccgactaaccctgatccgattagcgttgatcaggaaaccttagtctttcggcgagggggtttctcaccccctttatcgttacttatacctacatttgcttttccacacgctccagcaaagctcacgcttcaccttcgacgcagagtggaatgctcccctaccgatcattactgatcccatagcttcggtaaaacacttaatgcccgattattatccacgccaaactcctcgactagtgagctgttacgcactctttaaatgaatggctgcttccaagccaacatcctagctgtcttagcaatctgacttcgttagttcaacttagtgtttatttggggaccttagctgatggtctggattcttctcctttaggacatggaccttagcacccatgccctcactcctgtgatagaactaatgcgcattcggagtttatcaagacttgataggcggtgaagccctcgcatcttatcagtcgctctacctcacattagtaactcacaaggctgcacctaaatgcatttcggggagtacgagctatctccaagtttgattagcctttcacccccaccctcagttcatccggaagcttttcaacgcttatcggttcggtcctccagttagtgttacctaaccttcaacctgaccaagggtagatcacttggtttcgcgtctactccttccgactcgacgccctgttcagactcgctttcgcttcggctgcacatctcaagatgcttaaccttgccggaaaaagtaactcgtaggttcattatgcaaaaggcacgccgtcactgcttaagcagctccgaccgcttgtaggcgcacggtttcagggactatttcactcttctattcgaagtgcttttcacctttccttcacagtactggttcgctatcggtctctcgggagtatttagccttaccggatggtcccggcagattcacgcaagatttctcgtgtcccgcgctactcaggataccactacgcttaat

SEQ ID NO: 380 - DNA, 1245 bp, Bacteroides thetaiotaomicron
ggctacacctatatataaagatgcttatattgattttgtaaatgaaattataaaaaaagagcggattgatattgttcaaaatgaatattttgaacagctatatatggtttatgctattcctaatactgtaaagaaggtgttcattcaacatgaaattcaatacattgctaaggaacgtctgattcagcagcgtgaatatccttctagcgtacgctatttagccacgatgcaacggatacaggaaattaatgcgttaaatgaatacgaccaagtaataacaatgactgatattgataagaatatcctgatgtgtgatggggtaagagcacctatttcagcttctccttcctttattcctttacctgataatatagcatataaggaatgtgaacggagtagtatctgttttattggtggttctggtcataatccaaacttgaatggagttacttggttcttagataatgtttggtctttgatactcaaagaaaatcccaattttacttttaaaattataggaaaatgggatgagaaaattaaaacagaatatcagaagaagtatagaaatttgtttttttgtggctttgtagataacttggctatggttatatctgaatgtattatggtaatacctattttaataggtagcggtattcgtatgaaaatattagaatcggtcaatttctattcgcctttcgttactaccacagtaggtgtagaaggacttgattttataaatggaaaagagtgtatcatagctgatgagcctcaagcttttgctactggtgttttaaaaatagcaacagataaggttttacaacataatctgacaaaagctgctcatgagaaactaatggagatgtattcaccggaagcttctgtacagcggcgcctgaatatttataatgaaatgttgaaacgataatgagattatgaatttatcggttgttctgtttatactaatagttgtatttattaagtattggttactgctatttacttctcctttactaatggcttattgttggctgcatcgtcgcaaaaacatggctaatcctgaaggtgaggtgagtgaaattagggattctggcattacttcttcttcttgttctaaaaaattgttcaaacgaatagataaaagaggattgatcaatattgtggatggttattttcgttggatgatcaaaataatttcggatattccttcacatcatatacgtgatttcttttacaagtatattttct

SEQ ID NO: 381 - DNA, 1241 bp, Bacteroides thetaiotaomicron
gctatacactcacattttcagatggttcgcatatcacggtttcagatggaaaagatgggattaatggaaaagatgctcccgtaatcaatgtccgttattataacggtagtgacctctattgagaaccaattgaaagcattgaataatgatatcacatcgattagtgctttagtaggggcacttcaaaataggttatatctaaccaatgttactacattgggagatggctatacactcacattttcagatggttcgcatatcacggtttcagatggaaaagatgggattaatggaaaagatgctcccgtaatcaatgtccgttattataacggtagatactattgggtacaaactattaatggtgaaacaacatggcttaatgatagtgatggaaacaagattcctgcatcaggaacggatgctatcacgccactattgaaagtagactctgatggatattggatcataagctatgataaaggttatacttattccaaattgcttgacgaatacgggaaggcagttaaagcttctggaatggatggtgattcattttttgaatctgtagaggcaacggaagatgaactcagattaatactcaaagatggaacagaaatagttattcctttgggagaacaatcactttataaagctgtaaatttaggacttagtgtgaggtgggcttcatttaatttgggagcaataacatcttcggagaaaggtggctattttctatggggagatgttgataatgtaggagttatgcctgattatcaggctcctaatattgataatatctgtggaagcaaatatgacatagcacgtgcaatgtggggaggctcatggagattgcccaataaggctgagcaaatagatttgattaagaaatgtacatggacaagagcaacaataaacggagtcagtggtatgaaagtaacaggtagtaacggaaatagcatctttttaccctctacgggttatatgcttccggcaagtggaccggcaggagctacacagctagtggacgagaatagtggttattattgggttggagaatcttacggtgatacttatggacgttttggctatgttttctattataattctacaagttattattataatgctagttggaatgcaagtatgattaaaatggcaattagacctgttaaagagtaatttttatttcagaattacatttcttccattaatcctttagtaatccaaagatatctttagat

SEQ ID NO: 382 - DNA, 1190 bp, Bacteroides thetaiotaomicron
acttatttccgctagacagtccttggtattattaagatgcgtgattctatttatagcatgtatggtgggatttcgttataatataggggctgattgggagacatatgtaattatttacaacaggcagattccgtcgcttctagatccagaatatagaattctcatggaacctcttttttggattttagggagtttatgtaaaactctaggtttaagttatgcgtgtttttttataatattgtcattgatatcgtttgtcgtattatttatagttattagacgaattggatgtggatatatttatttgccaattcttttatatttttgtttgtttttctgtcagttccagctaaatatagttcgccacgggattatggcttcatttgtgtggctagctttttcatatataaaggaatgttctttgaagaagtttgttttttttcttttgatagctgcaggctttcaacttgctgcgttggcctttttcccattttatttcttgttgaatagatgttatatgcagaagagtgttgttactcttatttttatatcattgatttttgtaatgttgggagtatcacaaaaaatactgttattgggtactaaaatacctgtttttggggaatttgtaaactattatattctagatttttatggacggaatgttgatgcttcttatggtttttctgtagggatgattgttaatttgttcctttttttgtttctttattttggaatgcgttccgtctataatgatatatctaatcatttgaagatttttgtaaacttattactttatagttttatattgagttgtttttttaatgcatatgcggtttttgtagaacggttagtgagcgttactaatatgactttactatttatattaccttacgttttgcataaaatctttattggaaaagttaataaaacaatagcatttgcttgcattgttgtatatgcgatgttgatgtttactaagacgctttatacaccagttccgttaggtggaaagtatgaatatcagtttattccttaccagtattcatttgttatttaagggattataacgtttggtagatgagtgtaattcaatttgtcttttctgtgatctaattggatgttctgagagtaatatatcctaattttatcaatatctgtttctttggatattgtatccatatgtaaat

SEQ ID NO: 383 - DNA, 1180 bp, Bacteroides thetaiotaomicron
gctttatatttaactatccccctcattatagactacctatttattctaaggttgatgaactcttagatacggatttttatttcggtgataaggttacaactgctataaaaccttttgatgttactctgcttaaaggttttaaagccaatcttacgacagttcgatttatgaaaattctgacaagatataagggcttatcagcggtatttaaggggggatataagcagattgttgttacaggtgatattaccaatatttcatcgtggtttatttcgttgtattgtcgttttactaataaggagtgttatctgtggacacatggtcttatggcttatcctcagtcttgggttaagcgagcgatacaaaagctatatcatactttgccatcggggtgctttgtttactgtgaacatgctattgaaaatatgattaaaatgggaatttctccctctcgactattccccattcataattgcttggatactgaattattgggaagatatgcttcgtcagtaaagctcactgatgtttattcttcttatttcaaaaattctcatccgaccatcatttatataggaagaattcagaagaggaaaaagcttggtcagatttttgaggctatcaaaatcttaaaatccaaaggaacactagtcaattgtgttttggttggtaataatatcgacgctggtgatttggagattttgacacaagagatgggccttgacgaccaagtatggttttatggctcttcgtataatgaagaaaaaaattcagaattgttatataatgcttcggcttgtatttctccaggtaatgtggggcttacttctatccactcactaagctacggcactccggttatcacacataataattttgataatcaaatgcctgaatatacagctgtagaagaggggataactggctccttttatcaagaggatgatatagaagcgttagctgcagctatcaagcgttggtgtacagctactcaggaggaacgtgaactttgcagagtacatgctaaaaagatgatagaacaacaatggagtgttaattatcaggcacaagtgctttgcagtgtgttgaaacattaattatttaattcgaagaatataagtatgaacatagtataagcacttaagtgtgtcacgagaaatatttgtatgatactttgtat

SEQ ID NO: 384 - DNA, 1153 bp, Bacteroides thetaiotaomicron
atataaagttcaccaaaaaattatttttcatacttcgtttatattaactcgctttaatagggaaatcttcaatattgaattgtactatggcagaatggttgtagtccttctttgtggcaatttcaataagcagtgttcgaaatcagtgacttagtattgtttcttgacttaatatcaatattcaaggtagtcttcaatcttaaacttttcatcttttacaataaattttaaatatcgaccatataacattttcttgtcaatggttatcagggggccaaaactgttttcaggaaacttccttatttgtttttctaaataagatacaatcattttctcgtcggtagataatgttttcggcaataagaggtgtggaataatttgtcctgttttagggactacttccaatagaaatgaatattccctcccaacatgtttgctaaattctgtaggaaaattttcattaattaggggagagattaaaaaatctatattccttttaatgtcatcataccaacatccgtcttcgcgtattaatatcatgcctcctttttgtggaaaacaagaagattcaaacttaccctcatctggagttatttgtttttcgtcagatatcctacctttatgaatggatatgagtgaagctttctttgatacaactgtattaaatagctttcttgggcaatgcaaaacgaataatctaccagtgaaccatttggcaattataccattataacctgcgggcacatcttgatacatagctgattctctcattccatatttctcttttattttttgtaattcaagagaagcttgttttaaggaatctttgttttgcggaaatatatcttctaaaaatagatacttacagtttctgtttgggattctccattgagctacacaacaaaattctttctttaaaggtgaaggatacataaaagaaggctcatagaagtaaccgggaacatatatttcgtcataatcttgaggaacactatttttactatctttgaaaagactaaacatgtcagttagagacagaatctcatatttgtcgtctgcattattttgagcatagattaaactaggcaataaatatatgaaaagtgatataattctatttttcataattgttgttctcaatatggaatatagg

SEQ ID NO: 385 - DNA, 1091 bp, Bacteroides thetaiotaomicron
tatttttttcttgtactacttgtattgtttatcaatatttcaaagaacatcttgctttcgttttaaaagcgggtgcaaaggtaagaggttttattttaactaccaaatgttttcggaagtttttttttcgcttttctttttctatcgtttctcagactctcttagcgaaagggaaagaaggtaaagaagaaaaacaaaacgacttttctttgcgaatcggactgcaaagataagaacttttagctttatcttccaaactttatcggaagtttttttgttcttatggtcaagcagtactgcgcttttacactaagtcaatttaacaaggctttcttctcttggaaagcgggtgcaaaagtacgcccttttcaaatatactccaaacttaaatcactctttttttgaattatttttgaggatagaagctaaagtgttgagttataaggatgttgtagaacatattttttcggatacaggaggaaaggcggaaaggggtacaccttattatattcacacgcgcgttagaagggcgagggcacgggcgtatgcacaagggaaaggatggaggaaaaggggattgaaagattgaaagactgaaaaggaagaaggcaggaagaaggggaaatcgtagcaagggaggaaaatacgaaaaaagggtagagacaggagtcttttaaagttctacactattggaaaaagaaaaaactctgccatccgcaacaattggattaacattcttagggggactttttagtcaacccctacttacgtgtcagccaggctctctatgaaaataaaaaactataatttgctgtcatctgtcacggtgtcgggtgtaattgattgagtatgaataattaatgaggtgacaacagtaggtgacggcagtgtgacggcaaattttgctgtcacactgccttgttttcaatggttacttatgggctgttggttgggctatacagagtgtcttaccctggatttggttgactactataagtatcaactaaaatgaataaaagatgaaaaagagtgacatgacctttagtccttatcagcttgaacttcttggcgatttctatcgttcgaatttc

SEQ ID NO: 386 - DNA, 1080 bp, Bacteroides thetaiotaomicron
atgaagaatacttatattattggtgaaatagggcagaatcataatggttctgttgacttggctaagttgattattgaattaatctcacgacctgtacatgaggatgtttttggtatggatttcatgccaatgaatgctgttaaaatgactaaaagagatttatcagaagaattggctgtttctcaaatgaatcaaatatatgacaatcctaattcttttgggcgtacttatggtgaacatcgtgcttttcttgagcttgatgatcaagcgcattttgagatttataaatatgctaagtcattaggattagattttatcgagacgttatgtgccaaaggatgtctgtctttgcttaaactgttcacaccggataggctaaaagttgctagtcgtgatttgactaacttaccattgcttgaagcattagcagaaactcatattcctattatattatcgacaggaatggctggtcaaagagaacttgacaatgcattagatgtgataacgagatatcatagtaatatagctattctacattgtgtatctcagtatccaactcatccaaataatttgaatctacgtacaataacatatttgaagaagcattacaataagtttgagataggtttttctgatcatacaataggtatttctgctgctacagctgctgtagcgatgggagcggaaattatagaaaagcatgtaacaattgatcggcatatgaaaggaacagaccagcttggctctttaggtccagatggggttaatcgtatgattcgagatattcgcatagcagagtgttggcttggtactgaagatctttatatagaaaaaggggtggagaagtctaagataaaacttgaacgttctattgccactcgaaaatatattccagcaggtagtattattcaagagtcggacattcatttactgagtcctggtgatggttataaatggatagataaaaaaaatgtaattggtcattttgctaaacaagatatatcagcgaatgaaataatatatcctgattttattgaatagatatattcctactgcaacttgtattacggtatagagtac

SEQ ID NO: 387 - DNA, 1075 bp, Bacteroides thetaiotaomicron
gtgctggaatgattcaaatacgtataattttaagttatctgattatagtgggataaaaatcattcagaaaggtttaaaaatagaccacatatgtttgtggtagttttaaattaatatattttaagtgatttatgaatagtgatagctatctttattttaatattgcacaagaaatacgtctttatattaattctactatgaaacatcaactgaaattttatatagtactgttttttattcaattatttccgtgtgcctttgcgcaacaaatgtcggtatctacgcttccgttaaataattatttgccttcaagtactgttttgcgggttcattgtgaccgggaaggctttttgtggttaggaactaaagacggtttgtgtcggtatgatggctatcgattacttgttttccgttctggattgaaatcaccggatcttttgacgaataatgaaattacttgtattgcggaaaataaaaatggatatctatttataggaactaaaaaaggtattaatatactggataaacgaacttatcagataataccagttacacacaatgatttgaaggatcaagagattcgaacaatgatagtggatagtgatggatgggtatgggttggaacattaacttctgtttttcgttgttctgccgatttctcatattgcaaaagatatgattctactttgcctgttactagtgtgaattctatttatgaagatgcagataagaatatttgggtaactttatgggaaaggggattacatcgatataattcaaaaacagattcatttattgctatgcctcagattggagatttaaataatccatttaaagtttttcaagataataagaagcaacattggattttaacatgggaaagcggaatctttttactttatccagaggagaaagatgatttgatgtatagtcatgtagatataaaaagtaatgaacattgggataagaatggttgttttagcataactcaggatgataagtatggttatatatggattgtatctacacagggactttatgcacttcaaaaacgtcctggaaatataattaatac

SEQ ID NO: 388 - DNA, 1066 bp, Bacteroides thetaiotaomicron
ctattatattatacgccttctcttctctcctcaacggataatctcctcgtaaggtttcgaatagttccggatgggattttaatcggttgctgtcttcgatgggattgtacattttcagcagagcttcttcgcggtcttttgcttcgataagaggcgaagatggggcgggcggggtgatttcataagttgcgcttaggtggaagaagcggcagatggagtccagcgacattcgggtggcatttgcttttccgtcggcagagtatccggcgatatgcggggtgcctatcagtaccttttctaataattcacggttgatttccggttcatgttcccatacatcgattactgcgtccgagattataccgttgttgatggcttccagcagggcgtttgtttcgatcacttctcctcttgaagtgttgatgacaacaggcttccgttggagagaccggaagaaattcccgtctgccagatggtacgttttatatttcccttccttatataaaggtacgtgaaaggtgatgatatcacattcttcggctattttctctagtgaggtgaaggtaatgtttccttctttctcttctcttggcaagtcgttcagtagtacacgcataccgaaatcctgtgcgactttggccaccttgcttcctacattacctacaccgataatgccgatcgtcagttcgtccggctttttattccgaagagatttccagatcagaagagaggattgtatatactgagccaccgaggcggaattgcatcccggggcatttgcccactcgatacccgcctgcttgcagtattcggtgtcgatatggtcaaatccgatggttgctgtggcgataaattttactttgctgccttccagcaattcgcggttgcagtgagtgcgggtccggatgatgagtgcgtccgcatcctgtaccagttcccgtgtaaaatcctttcccggtgcgtagattgcctcgtcggctattttctctgctgcctcttttatataaggtatcttatcatctataataattttcatatacaattccttttttgctcagacaaaggt

SEQ ID NO: 389 - DNA, 1061 bp, Bacteroides thetaiotaomicron
aaatatatgtttggaatttatctaactattgttgtattggaattctatctgttgtatctttgcatgataatgaacttatttaatgatgcaaaggtaatgagacatgcttttttaattctggcccataatgaatttcaaatattgaagatactactttctatgcttgatgatgggaggaatgatatatatctgcatattgataagaaagtcgtgctcggacctttagagcaagatttatttcggcttgcaaaagctcgtctttttgtacttgagcaacgtcttgacgtaagatggggtgatattagtgtggtaaaggctgaactgttgttacttgagacagccagtatgaaaggtccttatgattattatcatttgttgtcaggagtcgatttgccgataaagtcacaagactatatccatcatttcttcgagaaaaataaggggtatgagtttgtgccttactcttgtggtgaggctaatttaaaagatctcgaaagaaaggtttttaaatatcatttgttctgtcgttattataaaattccacctcgtatttttaaaaagcaagtacaatctcttcgaataagctttttaaagttgcaggatttcttccattataaccgacctaaagaaattgaatttaaaaagggttccaattgggttagtattacgcatgagttgctaacaattatattagcccaaaagtcttttattttaaggcgttttaaaaatgtttgctgtggtgacgaaatatttcttcaatctatattgtggaactcagaaaggcggagtcatatttatccaggtagtgagcagttgaatgccggacttcgtgcaattgattgggaacgggggaatccttatgtttggaaaatggaggatttgcaatatttattagaaacagagcatttgtttgctcgaaaatttgattcgcagaatatggatgttgtgatcaaaataagggagcttttttcttgaatgtataaagtgatgtgtggtggtaactcatgaagatgagtagagaaattgcaccttagatatcattctatgatttaatctaatgg

SEQ ID NO: 390 - DNA, 1032 bp, Bacteroides thetaiotaomicron
atgtattgtatatcgactttctttcaaaagtatctagtgtgacagttaccgtagttaatttggatactaataagacagtgtatctaaatacttttattagtcctataagtttaattactttagatttaagtttgaaggaaggggtcgcttaccgcttagaacttttgtctaaagattatgatttatcgggggattttgaactttaattaactatagtattatgagaaaaatatttatacaatttagtttgttagtcgtgcttattattattgcctcgtgtagtaacgagaatataatagatgcagaacggaatgcaattaaacaagtagatcctaatgcgttatctgaaaaagaagttatttctattgtagaatcctttcaaaagtctatcaaatctgagacaaatacgagaggcgaaataacagaaaatccaatttttgctattagtgagaaatatttaatatcgtctcgaaattcagaaattacccgttcgttgcctaatgatgtaaaagctttagtttatgaagttgaaataaggaatagctctgaacaagggaaagctattgtatctggtgatagaaaattcccaaaggtattggcgtatataccttcctataatgactccatttttgcaacgcagataggagcaaacgctatgattcaaatgtcgaagaatgcattattagacgaaatagccaataatagtgaggcaattacacgctctaggcctattactgatttagatggccaggtttggatgatgattgaacctttctgtactacagaatggggacagaaagaaccatatagttggaagtttgtaaatacttgggttgaaatacctatggatatttctcgtaaaatatgtacatgggaaagacgcccagtaggacttactaacactgcaatagcccaaattatggcctccttagagcctgaattaacttgtgaagggatatcaatggactggagttatttaaaagaaagtaaaagtattagttatgatgatccttatgagaaatggaatatggt

SEQ ID NO: 391 - DNA, 127004 bp, Eubacterium hallii
gtagtcggtggtggggttaccttcttatcgacatcccatgtaccctggttatcggcttttgttgttgtaactgttgtctcatttttaatcttaatgtctgtctctgtctttttatcgttctccacaatgtgtccatgcgcccggagtgtctcaatcgaaactttttttgcatcaatatgtgtttttataaccatttttacagttgttccggcattgttcccgtaaaaatctttgttattgagcaggtcagaagatgctgcatattccagataatttcccttgtttgcggaagtaggagcaaaactacttgtgacatctttatctcctgcataaaacttaacggaatcaatcgtcaggcaggaatcaacagcatccttgatcacaaacttggaatactttgcggtagaaggcatgttcttctcaatttctttagaaacagtataagtaaatgtctcatccgcattggtaagtgtattactcagcacattcttctcgtcatcatctgaaaccgttttcttcgggtctgggtctggattgtttggatcaccgatagggacttttgaccagacggtggaagtatcctgtgatgcagaaccataatctccgtctgttacatcgtacatcttatttttactgtcgtatgtcagcttcttcagatatttcatgctccttttagctgcatttggaatcaaacggtatttgttatctgaagtacgctcatgcccaagccagctatatgacgcatctttaatctttactttaaatgtaatagttactttttttccataaaaagctgtattacttaatgcatctgttttggcactaaatttgagatattgtccactcgaagaatctgtaaacttacttgtaaaatcttgcccacctacatttacttgcaaagaatttgatacatagctaagtccatcatctatagcgtcttcccatacataagaggatactgctgtttgactctgatttcttaatttctctaacgtatcagaagcatagtctggaatactatcttcataacggtatgaatatgtatcacctaattcataatttactgcagatgttttttcattactaatccatgaacctccattctgaattaattttttcggtacatctggatttttattttcttcaaaagaattcattgcccatggagccaaatcgaaatatgcgattgctgtatgacctgtccatccatatttgatagacatatcagtcatgtctttgacataaagcgaaatacatgttttgtcaaaactatcttggtctgaactcgcattttgatctttaattgctttatatgtccatccatcaggttcacaccatgtatttccgtcactgcctccaatataagatgtatttacgatattgtccatgccatcagtgatagtcacatactgattttggtcaatgtcttggaatgtggcgaatccagtaaatggagcctttgtattcgttccattatataagaaagtgtatttaaacttcacccatttgaatccagaaaacattactacacctgttttcttatatgaaaaaccaatggcatagcctagatgtgctgaattattatcatgtccgaacatatctgcactagatggcaatggttttgattcatcattctgcgttttccaatcagtgacttcaatctttaaatcaaccgattttcctccaacagtagttacatctttataacgtacccagaaatcttctggatcatgattcttggcatacgccgcaaaaccacgccattttgcccctgcatctgaattaccagctgctacctgctgtgcattaaaagatttattcggttcttcactatttgtatcgctatccgccataaaatttggtacgcttacctgactttttgatacagacctatcaaagttattagcgaattctaatcccatcttcgattttggactaatatatgctccttccaacccagaagctgccattactcccagagaaaaaattcctgttagtgccatcattatagcaaacaaaaatactattcccttttttaatatcatttttgttttcatagcttttctcctcgcattttttactttgtttatatatcttcctaaattacatggtggacctcgtatcacactatatttctccttcttcatctaaaaatgagtacaaaaaaaggacattcttccgaatatcctttttggtacctatttttcgttttattttttaatctttactttctttccgattcccttcgttttcagtatctttttataagtttttaattgtctctttggaactttaatgactgactttttatggattcctttaaatgcctgccttccaatccgactgttggttaactttgatgtttttacttttatattcttcagactggaacagccataaaaagccttctttccaatcttatttatatttgttcctatcgtgactttctttaactttttatagttcttgaaggcattggctgcaatccctgttactttatatctttttccactaatctttactgtcgatggaatgtttacagatataatatttttattagctggtttcacatataaaactgtcttttttgatcttgaagtaatcttgtaatagttcccttttatcttttttgtctttatcgaactttttttacttcccggtcttgtaatcttatttgttttcatatttttagaccatgtaatccgaccgttttttacttcaagcgcatatccgcctgcataacagttacctgtataatctgctggtatactagattttgatttccagtttggaagatataagagtgtatccgtatccattccgattatgtctgaaacaacatattttttagttgcctgtaagtttcctactttaactgtcactgtagcgattccacatttctttgccgttatatttccattagaatctacagaaactatagatggattagaactactccatgtagccccagtattcgataatttacatttaaagtgacctgaatctttataaatatgtccagcagctactggatactgccatactgccggatgtgcttttcttgtctctccttttttaattacatcatatgtatactttggtgttaaatagtttttgttagcattgattattaaataagtatctgatggattaatatacaaatccatctgtgtacgaacagttttcccactatttacatatttttcataagcactgtcatcatgtccaatttcatcgctgacaaaacaatatgttacattacaaaaaccgccatagttaagttctcttggtattccctgtggtacatctgtagcaacaacacctatccctattttagaagtaatatcactctctttataaaggaaagtacctacttttttgatatgatttaatattttttcttttccatttctagtttctttccataaattatcgctgtattcatcataaccatctatatcgtctatttccatagcatcttttcttacatatacattattatagatttcaggattacttgctgatgcatcgcctccctgtttttgcagtgctatgtccatcgctacttctgtaaaattggcatccatttttaaatctgataaaccgttatttcttctctgcctattaatctcctgaagaatttgctccgcaatcccataaaatttttttacatcaacttttgctttcaccgtttcggcatttgcatgaattgttcccagtcccattaaacatacaaaagcaagtaatgtcagtaacaaatgccctttcttcatcgttttttctctcataacttcctcctgttccgtaccgaatttcggcacatttataagtagatttgccggagattttcggtatatttatctatcatatcactccatctccaacttttatatttagctttaatatatcatattatttttcactattccagtgttccagtctgcttttttcagaatcttttttacgtttgtgtgtaccgaatttcggcacatattcctgacaaaatcctatagtacaccatgtcaaatctatacagaagattaacacgacacacccatatagccaatgcttaattttccacagatcataaaaataagtacacaatatatataacaacaaaaatatctgtaaatgataaagactccttctctgttcactattctttatcgttaaaagaatcggtgatatactgaccagaatactgaccgttataattagtcctctttttaatgacagaccttcacatattacatctgtttttatattctcgatcgctggcattaatgtcatgatagaaaatcgaaataattgaaatgcagcactcattcctatcccgatggatactaatattctgtctgttatttgtacaatgtccatgtcatcacctctacttatatttaatctgtgctgaatttcggtacaaaaaaagcagaaggataatatatcctttctgcttttctttcttccatatctaattgctaattctattataactcagttctttttacttttctgcatacacttactgactcctatttttcgcaaaagaaaaatttacattaaacctgacagactgacagatttattttataaaatcataaatacttgtaatctcaactttatatgtatgaccatactcaccaaacatattaatcagaatatcctacagactatttctagtaatttactttatctttccatacactttttgataatcacatgctgccgcaataaaaaaattcagcaatatcaatattatgactactaaaattaaaaattcccaatgggtaaatgccacacaccgtttacatatttccatataaaaagaaagggaattttgtatggaataatccgcaaattctgttaagttctttctctctgttacatatctataaaatgctaaagcaatgtttcctaataatacaccaaaaaaactttctgtaaaattatttttcaaaaaatatttccatattattattttttccattcctaactgatacagtgtctggtaccttcttattttttgtttctcaattgacaaacctattcctaaacgaataagtagtaaaaataataatccaatcacagttaatacaaatgtcattataacttttaatatgagattgtttagttgttcttctctctctacccgattattttcaaaataaagagaagtatttacttttgataattcaatatctgtctgatatggaattgttcctttttgtacaccaacagttacataacaaggtgaatattttccacaaatacttcgatatgtactctcattacacaatacaccatatgttaccattgggtttaatgaagcaggcatttcatctttaaaacaatggataacaccaacaatatttaaaattttttccccttcctttgtatttattgtgactgtatctccctcttttatcatcctttcttgtatattttccccatttttttgtgttgaagagtccagatcaagatctacctgtaacatttctttctctgtttttatataatccggaatatataaaataacttcattgtttttcaactttttctttgaactatgctctacttgttttagataactgccagttagattatcagaaacaccaactaaaggaccgtatatataattatctaattgctgtttttgtgtaaaatcatccctcattccctctttaacttttttcaagtatatatcatctgttttcccggaaaacatcagtttgatattagaagatattgcaactgattctacttttccaactccatataccccttttattaaacttaattgttcctctgtcattgtatcctcagacccaatatgtcccataagtcttccaaaggtataatcatccggataatttatgctggaaaatcgataagacctatatgcttcccatgtctgatacactgtcaaaagcatgaaagcagataatactgttacaagcatcactgataaaattttctcttttctctggaatatatttaagattttaaaaagattttttttatttaattttctccttctttttactatcttatattcggtctgttgctgtaattttccacgaaggggaagctttagtaaacgaataatacttataaaaaatacgaataaaattaccaatgtaaacaatactattaatcctagaatattaatccaggataaacgaagatacagtcgataatttccatatttatttattattgtaactaaaacactcggcaatgcaactccaaaaaatatacctgctataccagggaataacattacctctttctttttcttaatatatatctgaaaaatctgcgcttttgttgcacctaatattctcatgataagcaaattttctgtttgattctttagatcaatataaagtagcagaaatattgtgatacaacctattcctaaaataaaaaattgcaacatatttctttctaatataaacagcctgcctccagaatattctccataaacatagtcattcttcacaaattctcccctttgacaaagaacttgcagggcatctgcttcttccttatatttttcttttaacgaaataaaaatatgttttgttatggtaccgtttttattggtgccaatagattttctttttgtgataaaaaaagaaggaagttcattattttgtgttttccaatatgaagaataattttttataactcctgtaagaacaaattgatatactcctatctgttcattaccttctttatcataaaataaaatattcaagtgaatattctgtcctaattcataagaatatcccaagcgagtaagatacgatgcctctattgcaatctcatttgcattacgcggcatatgtccactcaaagttttaatatttccaagagaaaaaaaactattatctgcgctccctatcgcaccaatattatctccctctctatctaaaatatctcctaaaacttctacttttcctactttatcaatcgttgcatttttttctagtgtctgtatttcatcatctgatgtatgatatgatgcaatattccaagaaccatataacttttttctctgttcctctaaagtattttgataactatctgaataaataaccgtaataaggccaaagaaaaaaacaaaaaatgttaccatagctaaaattctattctggtatttagagattttcatgatttttccccttctaaagcggtatctgaaataatttttccatcttctaaaacaatcattctttgcgagagtctcgcaatttctaagtcatgtgttaccagaagaatagtctgatcaaaataacgctgtgataacaacataagttctaacagctgttcaccatttttcttatccaaattcccacttggctcatctgcaagcaaaatcgaaggtttaagcgataatgctcttgcaacagcaactcgttgttgttctcctcctgaaagttctgcagcatattttcctttcttttcatatatacctaatttttccataacagtctgaataaagtcttcatccggatctttatggtcaaggtaagacggcaaacatatattttcatatactgtcatttccggaataagattaaaaaattgaaatacatatccgatatgttttctacgaaaaattgttcttgatgtatccttcatatcaaataagtttgttccttcaatttgaacctctccagaagttggtctttccaatcctccaataatatttaaaagtgtactcttccctgaaccacttttcccaacaattgatacaaattcttctctggtaattgttaaatcaataccctgaattgcttttgtttctgcttcattttttccataagttttctctaacccttttatctctacaataatgtctttcatactttcacttccacattttttgcaatttctttcagttcctcataagataaagatccataaatcctacaacaatattttcctgcgttccattccagaactctttcaccctttttcatcttcgtgatttcctgtatctgctctttttcattgccattatatttaatattctctccattataaataaattgtgtaccttgacttccgtctatctcaatttttctcttttcttctactgaaattaaatctgtatccccctgttgaacctctacaacaaatcttttgttaccctctgcattactataacaatcctgctggcgcattggcacagaaacatatctaatctctgtatatcctttcggtatatcattaatagagatccatatgctgctttcctcagaattttctctttcatccattatattttcttctgttttctcactaccagctggcatatgacatgcattaagcaaaagcatacttagtaaaagtaaaaatattacatggattttccaacattttttttgatacatcgctttccctcctaattttgattttatctttttatatcataaccatcttacaagaaagtgactctttatatttaataaatcgtagttgcatccatctgtggaaataaaattaaaaattctgctcctccacattccctatttgatgctgtaattgtaccaaaatgctgtttgattacttgctgtgcaatagataagcctaatccagagcttccttcttttgtacgatctcctaaaaaatatcgttcaaatatcttattctcacgtccgaacatgaaaccttgtccattgtcccttattataattttattcaaatttttttctcttccataaaagatttctattttaccatttggcgaatgttctatacaattttttaaaatatttttcaatacctcctgcatccaaaaaggatcacataaccattttatttttaattttccctgtacacttatctctatgttttttggttcagctaatatttctatatcatttacaacagtttccactaatatttctgcagaaatttcttcaaatttcatttggaattttttacaatcaaatttccccagattaattaaatctcttatagtgtctgtcatataatctatctgcccaagacatttacccatttccactgaaaattttgaatatctcatttctattttttcacaaatcattcgcataacagataatggagtctttagttgatgagaaacatcttccatataatgcattatcttttcattatcttctatatgtatctgttgttgtttatcaatatcttttctgattttctcaatagattctaaaaaattttctgaaaaaaaatgcaggttctttttaatcggaacatgcttttttaaatataatataatttggaattcttctttttgactctgctttttttgcgtttttcctaatatgatcagtgtaaaaatcataattatagcagaataaatattaaatatcattaatttctgatacggcaaaaaaattaaagttgcatatgaattttcgtatcctgcttttttcatcaattgtatgccattataataaagatcagatttattttgactagaaaaaatcaaattaaccagatttgctgatgtcctgtaatccattgccttttccactgttccaaaaaatatcatattctgtctagcaacctctttaaatataaacattgtatatattgtcataaagataatgcacattattccaaacacagagataatccagaaaccttctttcccatagtatttttctcttttactcattaaattctcctctctgcactaaatgattccatctatacccaataccttttattgtttcaatataggaaactccattataaactcccaacttttttcgtaatcttgaaacataaactgataacgtattattttcaataaaatgctcatccatatcccataaacgttctagcaacaattcccttggcataattcttccatcgtttcttacaagcatataacacaaacggaattctgtgtcttttattgaaagttcccgtccttttttaaaaatcatattatggacaacatcaattaccaaatctccacttcttataatttctgtttctatttcttctgaccattgctttcttcttaattgcgagaaaattcgtgaacgcaatactctcaaagagcatggtttagttacatagtcgtctgctcctgccattaatcctgttactatatcttcttcattctcatatgcagtaaatataataattggatttctataaaattgtcgaatttttttacaaagtaaaaaacctgaacaatctggaaggccaatatctaaaatgcacagatcatatatccttgactgtaacaattttaatgcatcgtctccattgcctacgacctctacttcaaaatcattctcttttaaaaattcagaaatttcttctgataacattatatcatcttctataaaaagtatcataatttttactccttagtataaattatatatattttttagaatatcacactctaaattaaaaatcagtagataattttatttattttttcttcaagtcacactaatgtaagatactaatgctatgcttttattatcaattaatcaatttcttattatacaaggggtatatttatgaagaaaacattatcccttattttaatcttaagtatgtttctatgtagtaatctttctgtttttgctatggaaactacttctaccacatcgtctacttgcaacatatataatgatgtagaatcatcaggtgctcgaattgtacataactataaaaaaacaataacaaaagtttacaaatctcgttcttccattccagattctatcaattattcagaatataataattcattaaagggcacttttagtggcagattatatttaaaatctataaagaaaactgcttctggatggcaggctacgttctctggtactttaactggaagaatttaaaatttcattattttaaatggattattaaaaatcaggagaagacttcattttttgacatcttctcctttatatatatataataatattgttctcccacaaactggttcactatgactaatcttatttaaatgttatgaatttcagtacatttttctttacgtttggttaataaattctgtatatattttatcatctctaattttttttcttctccaataagatattcatataatttttttctttcctcctctgacataccatctgttatctgatttactatatatttttgtttggaatccactgggaaaaatgttctggcataatttttcatcgtcttgcgaaatcctacaacttctataactcctttatccaataatttatttattaataaatgaatagaactatccttccatgtctttttttctcctgcaatatttacaatttccgttgctgttaaccctttcccttcctcccacaatatttccataatagccatttcactttttgtcaatctttctctcattatacttttatcctcttttctcttatattctattaaatatatttatattataatttattatataagaaaaagcaacaaatctacatgattttgttgccttttcttctttatataacagttgacactacattttgtacttgttataatatagtcaccaaacaaccagcagggtgcttttaagcttcccattctggggttcatatcagttaataaataagctgcctattccgccaagaactaagggcagcttatttatttttcaaattcagaatcgcaactatcaataacgcaaccgttaatattatattaaattcctcatatgtactcataaatatacgccccctttctggtattctccagaacaggaggcagctaccctgccggttataaagcagacctacattttacaatgttcctctgcctgtctactatatcatgtatttctttttacttccacactattttcagatgatttgatccatttattttgataaaaaggagtatctctattggggatcaagatactccttatgcacaacaatgattggggatttttgctgtgcaaatcccacctgtgcttttgaagcaacggacaatgatgccggggaatacaccatctccgcaggcgggcataaaaataggatacttcttctttatattgaaggtatccctcttaatttttcttataaatgatcattttataacagcatttactaccagtcggtaatcatccccttttttctttccggaacaagtagacagcgtaaggatctgtccatcttttttcggtttctttttaatagggtagtaagcgtttttttctatcgtcatagataaccaatccagccatctgttatccttcttgtcccctgtgaaatccgttaggtatgttatacttttatccaggcagtcatatacactatatactgtatatttcattactttttccggctgatacagatatatcttgttattttttttataaaaatcttctgattcaaactcatgaagcgaaccaaacatagatcttgtacgcatattatgaccataaagaatcaaatgcttgtcctcaaacgatgtttctggctgaagaaagatggaaccggcataacagtattcccccttataatctttatggagatattcattccatctgcttccctgtaaaacaggataatcaatcctagttcccggaacttttatccatccaacaatgtcgggatttattttttttaatttttcccagtctatgccgggatcttcatcacctgtttcctctgcttttacatcggatcgcaggtcttctaatattttttggtttttccataatggatattcttccctgaatgctgcccctataaagatcattgacagactgatcaatacggcaatggtcagtaggtaaaaaaaatctcttatctttcccatactgtatttttctccttattattttttgtgctggatttcagtacatttcacagatcatgaacacacatatagatttcccattttgaccatgtatttataaaattcctctgtcggagctattgacatgatccttctgtgtggtctatactggatttgctgaaaagttttcagcatgatccaatctcgcagaccgtttctaagacggtctgtttttttatcccatcttatccatatcaaaccagatagatagataggttattatatatattattttatatatctggctctatatattttgcaggtaactctttcgtttctggaaacgtaatctcttcgcctttagaatcgtaatttcttcgcttctggaaccgtaatcttttcgctcctgaaaaatatcggaacactaaactaccgtattctccattttaaaatcatgctgtacctgtgctttataataaagccctattgtcagcggagcattatacagcgatgctaacaggtaattatccggctttcggatctctcttgtattccggttaaggcattctatgatatactctatatgttgtacatttaatgtctttatccggttctgcacctcatttactgggatttcttcccctgatattttatatgtatccctgtctgagatataaacatttgccattatctctatcatagcatctattatatttttatccgttttgtgccgttgcatcagtatttcatattctaactgatgccgtatcttttttctgtaaaactctctcgcatgtcttttttccagaatcgtaatttcttcgcttctggaatctccccttttagcttcctttcctgtaacgcttgtctctgctatagtttcttctcttttatttccttgcatcttatccatacgtgaatcctgcttcatctgttcttcagggacaatctcttttgcaccttctttatggacagccgtaaagttcatcacataaataatgtccggcttcccctgtcctctttttttcttctcgatcagtccaacttcggaaagctgtttcattgctttgctgatcgtacggtcactgcgtcccagtttttctaccaattgtttcaaattgtatgtgatatataagcggccggtatctttttcgatccagctatttttccttgataatgccagcctggataataatactccatataatattttcgcagtatcactgatccccctgtactcctcttcctccaaaagcaatgccgggatctggtaaaagcggaaatgttctccctctgtattgtaaaaatagtccaatctcatctttttttctcctctcttctcttttccaatgtaaaggggaatatcctggaaagggatcccccttacatgaaagtatatgctgcacacaaatagtgtgcgaattctgcctgtgcttttgcagctacggcatggtcttctccatccggcaggcagaatgtatgtaatactgatcttttatacggactgtccttcttcgtttacgcagtcctttagccatttttcaatcaatgccggacaccgcaggatctcttcggaaagaaagtggctgatataactggaaacctcttttatatctaaagaattcatatattcctgacgggttaatcctgctgtttcttcccttccttcttccactaacttatccatcgggatggaaacttcccttccttccctgtccggctttgcggcagactctttgcagtctgtattttctgtttctatttctggtaccatatctctttgttcttccctcctttctacaagctctggctcttccttttcttcttttgggcagtactggtcaagcatggccacataccgttcccatgtgatggatctctctgagatgctgatttttttatccgagcaggagatcctgatctccccttgtgatattttatatgatgtactcccatatctccctcttaagaactttacgagtgcttttctggagacagtagacctgtcatattcatctatacccaacagccggtacgatacccgtatctctactgcacccggttctaaattcttctgtttatattcttctatatccacattttttgtgatcccctgttcaatcacttccttctgcatcttttccggcagcctcgccagagtgagtgcagcagatttttctatctccccttccttaaatttttccattgcctctggaagtaaatttctggagatctgctgatattcctgtactgtagcccttgcgattcccattttttttgataagcgttctaccatccttcctttctgtaaagatggagggaattcttctggatgctctcttaaaagtttttccatctctgtgatctcatgcatcaactcatacggttttttcgtgtggtatccatttgaagccattacacgaaaactttcctgcaccgcactgacattattaacaatgcatggaagaaaagcaaattcttttaatcccctttcctcaacaagcaatttacaagcctgacagcgcttatgtcctgcaataatcttatactcatctgtatctagcttgcttactgataaattctcaatcacttctcctgtagcctgaattaaatctgcaagtgattctatctcttccttatcacgtgccggacaatactgttctacattttcttttaattttgagtaatgtatccatttgattattctgcgtggatgctgctcttctttttttatctcttccttgttaaatatattcccaagctttgccataaccgataccccctaatcctcaagaagttcttccaccagatctacaaaatcctgtgctacattactcataacacgatgctttgccaccggcttataaagggataacgcattatcaacaatcgctgtacggctgatacatgactgcataaacggataatcatgcttagcgatcagatcctctgaagataatttctgtgctttggtgttcgacaccatgtttgcgaatatcttccattccaaatctggattgttttccaagatctcatggtaagcatcttccaccattgtaagattatcccggcagaagttatcaaatttcactggggtaaggaacacatccgcagcatacaatgcattcattgtcagcatatcaaatacagggcgggtatcaatcaggcagacatcatagtctttctttaaatatcctaacgcttctttcagtctccacggagttttttgctctgtgatcttaacagagcctttcacaatatctatatcctggtattttgtgcgatagactgcactatttatccctttaggattctcaagaacatctcttatcgttttactgtatccgtttacctttgcaaaaaatcttgtacagttacattgtggatccaggtcaataactaatactcttccacccatttccgaaaatgtataagctacgtttactgttgtggtggtttttccaacgccaccttttaaatttgctactacatatactttcattttgtctcctcctataatttaataaaaagaatactccttgatggaatatattatataaaaaatagagatacctgttttttacaagtatccctatattctatcaattatctgatagctctctattcattttcatatttaagattctttgtgtccctcgtaccgaggtctaacgctacaataacagttatcttgttcacaatctctttttttctgtgattttcattaactgtattgaaattataatattctgcaaagtgtgtaaattcaaggatttctacatatgatcgtcttgtatctcttccatcgggtcgatgtgacttaccgccccatacatatctcttccgactacctttttatcttctctttccttctcaataagatcactcagcactctctttacctgcgcagacttcgcaatattctccagacggataactggggtggaacggtcttttgtgtgaagctcaatcgttcctgttccaaaaatacgctgtggaagactgcggtataatgtaatatctgtaatacgatataacagacactcatcttctcttgaagaaagaaatccgctatttacatataatcttccattccccactgtatattttgtaaaactaatcgggaaccataaatgatgctttctgtcctcccaaatatttgctgtaacttctctgatctctccattttctgcttttcccataatatgcctccttctatattttcgttcttttatccaacatatcacattctcattttccatgcaagtatgcctgacgttttgacattcccttcttatctatggtatcatgaaaaggctgcaaatcctactgtttttcagatatttttgccgcaatatcattctatacttttatatttttcatacaaaacagatacatttcttttgcatggattatttaaaagtataaatattatttcaggaggaattttactatggcttttgatggcgttgtaatagccaatattgtatatgatatgaaccgcctgcttaccggcggacgcatctacaaaatctatcagccggaagcggacgaactgcttcttgttgtaaaaaataataaagaaacctatcgactactgatttctgctggagcaagtcttccacttatctattttactacaaagacaaaggcaaatcctatgaccgccccaaacttctgcatgctacttcgaaaatatatcagtaacggaagaattatcgaaattacacaacctggtatggaacgaatcgttgaaatcacaatcgaacatttaaatgaacttggtgatacctgccgtaaaaaaatggttatcgaaatcatgggaaaacacagtaatattatttttattgatgaaaaaaacatgattatcgacagtatcaaacatatttccaatcaggtaagttctgtaagagaagttctaccaggaagaacttatatcgcccctccaggaaagggtaagatttctcttaatgatctatctgttgaatggatggaaaatacactgcttgtcaaaccagtttctgtacaaaaagcagtctatggcagtatttccggtatcagtcctgtgcttgccaatgaaatctgttaccgcgccgacatcgatggagattctgctgttgcttctcttaccccagtgcagcaaagttccctttacggtgaactcgtccgtatgaaaaaccagatagaaacacacgctttttctccaaatattatttacgaaggaaaagctccaaaagaattcggtgcgtttacattttccatgttcagtgatttaactacggaagaatatccttccatctctgaagtattagaaaccttttacgcacaaaaagaagttgtgacccgtatccgccaaaagtccgttgacctacgccatatcgtgcaaaatgcgttagagcgtactgcgaaaaaatatgacctgcagctaaaacagttaaaagatacagacaaaaaagaaaaatataaaatatacggagagcttcttcacacttacggctatgaagcagcccctcatcaaaaagaattaaaatgtataaactattatgatggcaaagaaatcacgattccacttgaccccgacttaaatgcaatggaaaatgccaaaaaatattttgaccgctatggaaagttaaaacgtacttatgaagcattaagtactcttacaaaagaaacctttgccgaactatcacatttggaatctgtaagtaacgctttagaaatcgcccgcgatgaaaatgaccttgctatgatcaaagaagaattaatcgagtgcggttacatgaaacgtcatggcagaaatcaaaaaaagcgtcagggaaaaagtaaaccgcttcactatatttcttctgatggattccatatgtacgtcggaaaaaacaacttccagaacgacgaattatcttttaaattcgctaacggaaaagatatgtggtttcatgctaagaaaatggcaggttctcacgtcatcgtaaagctcggaaccgtaaatgaacttcctgaccgtacctacgaagaggccgcaagacttgccgctcactactctaaagggaaaaacgctccgaaggttgaggtcgattacaccgaacgacgaaacttaaagaaaccgcctcaggcaaaaccaggatacgtcatttatcatacgaattactccatgctcattgatccggatatcagcggtatcaaagaaatttctgatctgtagatttggtgtagacgaaaaaaaataccttatcccagatgcggcttcggagcctatttaagatgcggacgagcatcttaaatatagcgactacagagcagatgggatatggtattctttcttttttcgtctacatcaaatctacaaatcagaatataatttttcgtattttctggaagatgctttccatgaatagtttttcctcattccttttgcagtaaggtttttccattcttctggattctttttatagacatctaaggctgcaagaattgcatctaaaaaggcttccgcattataatctgtaaatccaaaacctgttcctgttttgctttttggattatagatgcttacggtatctttaagacctcctgtctttcttatgatcggaactgctccgtaacgaagggacataagctgacaaagtccacatggttcaaagcgtgatggcattaatatcgcatcgcagccagcatagatgtattttgccattttatcggtatagtctaattgtacatatactttatccgggtactgttcctgataggaaagaaacatatttcgatattcctcttccccatcgcctaatacgtaaagctgtaccggcttcttcatgagacgttccatcatataagaaaagagtgcaaagcctttctgttcagtcaatcttgaaacaattcctaatgtaaatgctgttctcttctttggaagacctgtttttgcctgaagagatgctttattctttttctttcctttatcaaaggttttatcatcataatggcaaggaatgtattcatctgtagaaggattatagatatcataatcaattccgttgacaattccgcaaagatcatcacttctatgctgtagcacactatctaatccttctccatattctggctgtttaatctcctccgcatatgttttacttactgttgtgatcttatctgcaaaaacaagtccaccctttaaaagatttgccgaattattatattctagtttgtcgtaagtaaacatatcgtcaggaagaccggttatatcttttaaacggtcgatttccgtaattccctgaaactttaaattatgtattgtcatcacagttttaatattacgataaaatgggtcggcacaataaaatgcttttaaaaataccggcactaaagaagactgccagtcatggcaatgaataatatccggttcaaaatcaagataggataacatctcaagtactgctttagaaaaataactgaacttctctatatctacccacatgtcataatatggggaatctccgcaaaaataaaagttattttcaatgaaataataaataattccttcataacttaatgtttttacggtcactgtctgcattctccagccaagatacataggaaaagtcacaaccgtttccatctgatcacgccactttttatcaatacaatgataccccggtaaaacaacccttacatcatattttttatgatttaactgctttggcagagagccgactactgcacctaatcctcctgtctttacaaacggagcacattctgcactggcaaatagtatcttcttcatagttttctccatcctgttttttatttttagtaaggcaaaataccttttgaccctaacatcataacataaaagaaatagctatacaattacgatttctttcgttaaagaacaggaaagagaattcttctttttttgtcttccctagtttaattatgcattcattctatattctaatcgtagtttatctgcgataagtgcaataaattccgagtttgttggttttccttttcctgcactaatcgtatagccaaacatatcttcaagaacatcaatctgccccttgttccatgctacctcgattgcatgacggattgctctctctacgctgcttgaagttgttttatattttttagcaattgttggatagagaagctttgtaatataattcaatagattgatatcatttactgtcatcataatcgcttctcttatatattggtatcctttaatgtgagccggtataccaatttctcttataatatgtgtcacatcattttccaatgtgttttccgtatattgattcatgccatatttctgcatcgcatatcttctctctttttcctttatttgcagctctgcttttcttcgtacaagcattgcctaaaaaatacggtgtatcacactgtctaaattataaggcttcattatataataatgcactcctaatttacaggcatattctaccattgattgatttcccatagaggaaataacaataaatatcggttttttcttaatacttctgtttccatttgttttttcaataacagtaaatccgtccataactggtaagataacgtcaataagaacaatatccggaacttcatcaataatgactcggtaagcatcttttccgttatctgcaatatttaacaactgtattttttcattattttctaaaaatttttttaaattatttcgggcaaattctgaattatctgctactagcactttgatctttttttcgtttttcatattcattttcctccccatccatcttttttatataattttaaatcacatgactgcagaactttttatttttcctttatattccaaacgaattttgtccgcaattaacgcaataaattctgaattggttggctttccttttcctgcctgaatagaatatccaaataattcattaattgtatccatcttccctctattccatgccacttcaatcgcatgacgaattgccctctctactcttgatggtgtcgtattatgcatttttgcgattgttggatacaactgtttcgtaatagaatttaatatgtccatatcatttactgacataatgatagaatctcttaagtactgataccctttaatatgtgccggcacccctatttcatgaataacattcgttacaataatttctaaacggtatttttcatcctgatgttcttcttctagcttaataaacttttcctgatcagataggagttttccattttttatctgacgtatttttttaattagcgaagtccgttcaaaaggtttcagtataacatactcagcgcctaatcctattgcttcttccattacttcttcctgccctaatgctgtcaaaataataaatgccggtttttttaagctgctttcatctttgtttatttcttcaagaactttcaacccatccattttaggcataatgatatctaacagtacaacatccggatgacttgtccttatcatagacaaagtgtcaagaccatccgaggcactccccacgagtgtcatatctttctctttagaaataatctcctgtaaattctgacgaatttgctcattatcatccgcaatcgctacattaatatttgacatataacatcctcctgtaaattacaatatattacagcaagaatacctgagcattcttggaagtttgataacgcaaaaaactatttgtttttaccgcaattaccttgattctttaatatattatgatgttatttttgctattataccaaaaataaaggagtttacagacgaatcaacgaaacgcaaagattcgattgttaatttttattgactttttaaattttatgtgttaaagtttttgtagtttacacagttaaagtgcaaaagtaaatctattattcatgtactcttagaatcttcttgtactgttaatgaaaaatcactcataaaagtactgataccataaagactccgagcgtacatattacaaagagaggaaaaatgtatgaagttactaatcttaattgcttattttattgtacttattaccatcggttttgtctgtcggcaaaaggcaaccgatgtaaatggctttgttcttggaggacgttctgttgggccatggcttactgcctttgcttacggaacttcttatttttctgctgttgtttttgtcggttatgccggacagtttggctggcgtttcggaatcgcagcaacatgggccggtatcggtaatgctcttataggctccctccttgcatgggtgattctcggacgacgtacccgaatcatgacacagcatcttgactccgcaacaatgccgcagttctttggagaacgtttccaaagtaattctctgaaaatagccgcatcaatcatcatttttattttcctgattccgtataccgcttccctttataacggtctttcccgtttatttggaatggcatttcatattgattattctgtatgcattgtcctcatggcaattcttactgcgatttatgttatcgcaggtggatatatggcaacagcaatcaacgactttattcagggaattatcatgcttgccggaattgcagctattatcattgctgtacttaacagcaaaggtggatttatggcagctttagatggtcttggacatataaatgatcctgctgtatcctccactcccggaatttttggatctttcttcggacctgatccacttagtctgctttctgttgtaatcctcacttctcttggtacatggggacttccacagatggttcagaaattttatgcaattgacaatgaagattccatcaaaaaaggaaccatcatctctaccatttttgcattagttgtttctggaggatgttacttcttaggtggctttggccgtcttttctctgataaaatcgatattgctgctaacggatatgactctatcattccgacaatgcttgaaaatttacatcccttattgattgctcttgttgttattcttgtattgtccgcctcaatgtctaccttatcttctttggtcattgcctcaagttccacactgacaatcgatctgatcaaagataatatcgtaaaagaaatgagtgataaaaaacaagtattttgtatccgcgtacttattgtcatctttattgcaatttctgcaatcatcgcgatcatccagtacaagagtgccgttacatttatcgcacagttaatgggaatctcctggggtgcacttgcaggctctttccttgcaccgttcctctactccctctactggaagaaaacaacaaaggcagcttgctggacatctttcatattcgggtgtataatcatggttctgaatctcgttgcaggatctcatttcccaacattgttgcagtccccgattaactgtggtgcatttgcaatgctcgccggattaatcattgtacctgttgtcagcctttttacaaagaaaccagacactgcactaattgaaaatacctttgcctgctacgacaagaccaatacagtaacacaaaaaaccgcacttggaaaataaccatacgggaggatggaatcttatggcaggtaaaaacataaatattgtatctaaaactttagcggagtcttatatccgtaaacagataaaagcattaaaacaagatccggcacagaccatccatactttaacaaaacagcttttagaaaaaccagacagtcctttggaaaagtatcttctacatatcacgcctgaaaaacttcaggatacacaaagcggatattaccagcttttccatgatatccttcctaaaataaatacggaacatctggttactttagcaatgaatattggatataatagtctttttaccgcctcaaaaaatacacagctacactccccagagagcatttttaatgctctctgggcttttaagttgtcaattgatggaatctgttatgaaaaaaaagcagcacaatataaagcacagattaccagcgcaaaaaagaacggaacccactgttttatactttttattgaaaaaaatgcatggaaacttcttccattcataaaaaaagaaaaagactgtgcattcttcttgttttgccccgcttcctgcttaacagaaaaattcctcgatgccgcaaagctgacaaaaaatctttttatttctgttgcttataataaaaataatcataaacacccggcaccttccaccgatgtatttaagcagcttagaatccgaaaactcccctatgccgtacattattattattctgcatcagatatagagaactttaaatctggagaaatctttaaggaattaagtaaggaaagacctctgttctccttctttctttcaaaaaaatctgactctgttcaggatactgcaacagaaggagacaaaaaggctgtttatgaaataatcataaaagaaagatattggttaacatatccttcgattccatttgctatttgattcattgggaagagagcagacgagaataaaaagaatagcccatcgcaactgtaaagatatcactgcgcagaaaatgcctgtccggcatttttacttgctcttacattacagttgcaatgggctattctttttattttctgtttgttggctccagaaggaatgtattcaataatttttaggtacacgataaactatgagtacccactgtctaaaaatgtttacaattttcaaggttcaatgagcctttttctttggctctgttttttcataacttacttgacactacctctaaatctatactggaaacaatttgtttccacctgcgatattgtcattatagattcaagaatgccccggcgttcgtggtctacaaacactttttgtgccaacgcaagaaggtatcgccatcaggcaacaccctcacacattttttatttaattcatgctttccaaggacttctgcaacatctttttgtatgcattgcgtacttccactggaccttcaattactatcttccctgaagatccgaatacccagcgatagaaggtcgggctggtgcagaccttaactgttgtccggaactgctcctcaccaacgctactgattttaactttcttgccaaacttatctaccacagcgttcatacaacagttgtcgcagcgcaaagtcacgtcaaccgcttcatctgtcgaaaacatacggaagacctctgtcgtatatttggatacattatatcccttcggcttcttaacagccttctctttcaagatctccggccgtttcttgatacgatctactcgatatgaatgtcattcttgatcgagacaaacctgaaatcaccaaagacaaatcatctctataaacattttgagaccctgacttcatgagtcagagtctctttcatcacaaaccaaatatcttttaccatgctgcattcatcacataaaacagtaaaacgatttgcatacctataatcaaaggaagtcccactgtaaaataatctttcctcgtcttgtgtctaagcaaatacattgcaattatcccacctatagaaccgcctacgaaagacagacctagaagtgttactattcttattcttgacttacgttctattgcagcaatcttatcaatggcaaatgctgcgaaagttacaaaattaataatgactaaatatgctaatagtattttgtgctcatcaaagaatgaccaaaatgccaatgtaatatggtcagcataatgtccccgaaccacaagaaatataattatctgtatcactaggacgcaagcaacaaatacacgcgacatcatatttcctttttctgattttctatcaaaaataaaaattgaaataactattcccaatgatccaccaagcaaagatactactgtaattactgcatctatctgcccgtcaacagtcatacgatataacaatgtattcactaaatacagtataaatcctgcaatgtttattatgacaagatacatcataaatggactcaatccccacatcgttctttttcctatttcggcttattgcttcgatatgtatgatatgtaatcaccacctcggcatctgcacgatattcctttccagaagcaaacttcccatcatcatttacggttacagattttacttccccatcatcagttatccaccccgtaataatgtcatattctacttcaagtgttatattttcaaagcctgcttcttcaaatttttccatcacatcttaatagtttgcacctttagcttctttcagtaagccacgaccttctgacctctccccatttctctccccaaagactatttcattcattccatgtggagccaaaacacagaaaaaagaaacaatgtcatatcccagatgcggcttcggagcgggtttaagatgcgggtaagcatcttaaacacagcgactacagagcagatgggatatgacattgtttctttttttcgtctgtttcctctaaataaatgaaatagtaactaagctctattctgttgtgctacgagatattctgctccatattttttacggagtgcaggtttctcaatctttccggttgcatttctaggtacatctgcaaatataatcttctttggacgtttataacgtggaagcttcatgcaatattcttcaatctcctcttctgtacattccataccgtcttttacagagatgattgctccggtaatctctcctaaacgcttatccggaagaccaattaccgctacgtcttttactttatcataagcacttaaaaagttctcaatctgtactggataaatattctctcctccacttacgataacatccttcttacgatctacaagaaaataaaagccgtcttcatcctgcattgccatatctccggtaaaaagccatccatctttaagtgtctctgcagtcgcctttggatcattataataacaggtcatcattccaggaccctgcacacaaagttctccaacctctccttgtggaagtgctgtaccattttcatctacaatcttacaggaccagcgatatcctggaattccgattgctccaactttattaatattctctattccaagatgtacacaacctggacctgtagattctgaaagtccataattcgtatcatataaatgatttggaaaatattctttccaatgcttaattaatgatggtggtaccggctgtgcaccaatatgcattaagcgccactgcgaaagttcataattctccagcttcagatctcctctgtcaagactgtctaaaatatcctgtgcccaaggaactaaaagccatacgatcgtacaatgttcttttgacactgcatcaagaatgatctccggtgttgtaccctttaataataccgccttacttcctgcacaaagactgcccatccagtggaactttgctccggtatgatataacggaggaatacacaaaaatacatcgtctctgttcgtcaaatgatgcttctgctccatctgggcagcctgtagaagactttcatgattatgaagaattgccttcggaaatcctgttgttcctgatgaaaaataaatcgctgcatcatcttcatcctctaaaagaactaacggagcctgacttgaacaatctgctacaagttctcgataactttctgcgaatgtcggacagccatctcctacataaatcaaaagacgccctttgctaagttcttcctcaattgcttcaattcgaccaataaactccggtccaaagaaaagcacatgaacttctgccaaatctgcacagtacttaatctcatcagaggcaaaacggaaattaaacggtacggcaatcgctcctgtttttaaaataccaaaataaattggcagccattccaggcagttaaacattaagattgctacgcgatcccctttctgaacgcctcggcttaataacatattcgccacccgattcgccttttcatcaaaaacactccatgtaatctcacgacgatatggaacagaagaggtctgctgtacaaggtcatattccttccatgttgtctttcttgtatccttcattgtaggattcaactctactaaagcaacctcatctccgtaaagcttatgatttctctcaagtaaatctgtaactggcataacgctaccatccttttcttaaaaaatttaaatatttaaaatacagacacccctttctctgcgtctgtatctgttaatcttcctaattcttcttcactttttctcttttatttattaaagtgttgcactatgataaagtatcatattttgtgaaaaaagtcaacgctatctcgccattccagctctttttttaccagttcaaaaaaatattttatatgtggcgtgtatacaagtttttctataaatcatccagttgatttacgatgcttcgttgacagatttccttttttgcactatcattatatggtaaaaataaacagaaacgaggataaaattatgttaaatgaaaaaatggttgctctcggcacccagcgttctgttattcgtgaattattcgagtatggcaaacagcgtgctgccgaagtaggcgcagagaatgtctttgatttttccattggaaatcctagtgttcctgctcctgactgtgtaaatgaaactgcaataaaactgctgaaagagatggattccgttattcttcatggatatacaagtgcacaaggtgatgccggtgttcgtaagatgattgcagactcccttaactcccgcttccagacatcttttactgcggataatctttacatgactgttggtgctgctgctgctttatgctgctgcttaaacggtcttgcctgccctggagatgaatttatcgtatttgctccatacttccctgaatacaaggtattcattgaagctactggtgcatctatgaagttaatccctgcagatatcgaagccttccagattgattttaaagcgtttgaagaagcaattaacgaacatacaaaaggagttcttgtaaactctcctaataatccttccggagcagtctactctgaggaaacaatcaagaagcttgccgaaatccttgaggcaaagtcagcagagtatcatcatccaatttatttaattgctgatgaaccgtatcgtgagattgcatttgaaggtacctttgttccttatcttccaaagtactataacaatactttagtatgttattcctggtcaaaatctttatctcttcctggagaacgtatgggatatgttgttgtgccagatgaaatggacgatcacgaactggtttatgctgcgattgcaggtgccggccgttctcttggctatgtaaatgctcctggattattccagagagtctgtgccctttgtgcaaatgaaacttctgacatctccgtctacgagacaaataaaaacattctcacaaaaggacttcgtgacatgggatatcacgttgtagaaccaggcggaaccttctatatgttccctcgtacgttaattgatgacgatattgccttttgcgaaaaagcaaaattagagcataatcttttaatcgtaccaggaaccggcttcggatgtcctggacacgcaagaatctcttactgtgtccctaccgagcaggttgaacgctctctcgctgcattcgaaaaacttgccaaatcatataaataaatgtgtactgttggaggcagattatgattatcgattttcacacccacacttttccggatcaattatccgaaaagattgtgaatcaccttgcacatactggatgcatccctccacatacagacggctccgttatcggtctcttttcttctatgaaagaggccgatattgactattctgtaaatctgcctgtcatgacaaaacccggacaggtagagaaggttaattcctcattgatcatgcaaaaagaatatcttcttgatatgaagatcattacttttggaggaatgcatcctgattatgtaaactataaagaagaactcctgcgattgaagcaagctggcattcccggtatcaaattacaccctgcatatcaaaatgtagatcttgatgatatccgtatgatgcgtatcattgatgaggcttcttcacaggggcttattacattagtacatgctggcattgatattggtatttatgaccacaattattcttctgttgctcatattttaaaattattaaaagaagttgctccagaaaagctggttcttgcacatatgggaaactggggctgctggaatgaagtcgagagtgatcttgccggagcgcctgtctattttgacactgctttttcttatggcccggtaactccactccccgatgccccaagagctccgtatatttcctataatcttcatccaaaggactttgtacgtcttgtgagaaaacatggtacagacaagattctttttggcactgattctccgtgggaagaccagaaagattatgtaaaaagaatctcccatatggcttttacaaaaaaagaactcgaacagattctttctcagaatgcaaaaaatcttttacaatcctgatttgatggactaaagaaacgaaaagcagaaatttaatatagaataaaatgtgaagatagtcgcagcgtagaaaatgcctgaccggcatttttacttgctccgacatcacattttattctatattaaatttctgcttttctgtcctttggcaccagatgaaatcaggattttgtgtgaaaaaagggggttccccagaagtctatggtttttatttggaatgaaaatctccagaagaatgtgtcagttctttagaaatcaatttcctggaaagtcatatcctgctggtacattccactttgcccaactgtagatttagattagctagaaaaaagaaaaaaaatacatcccagatgcggcttcggagcgtgtttaagatgcgggcaagcatcttaaacacagcgactacagagcagatgggatgtattattttttcttttttcgtctatacgaaatttactaagattatttattatagagatctctcttatcgactactcgaaccgcttttccttcgcttcttgtaatagtctttggctctaagatgctgacatctactttgattccaagcatattctttaaaccatgtacgattttcttttctctagctgcgatagcaacatcttcctgttgcatttccggtgtcatctctacctgaacttcgattgtatcgttattaccaatacgatctactaaaatctgatagtttgcctgatatccctgttttaataaaacagcttcaatctgagatggccatacattaacaccttttactaccatcatatcatcgcttctgcccattggtttatgcatacggatatgggtacgtccacaggaacatttctttcttgtaagataacataaatctcttgtgcggtaacggagtaatggataggctttctttgtaatacaggtaaatactaactcgccgatttctccttctggaagaacttctcctgtatctggattaataatctcaggaatgaagtgatcttcctgtatatgcattcctttctgctcttcacattcaaaggatacacccggaccggaaatctcggtcagtccataaatatcatatgctttgataccaagagattcttcgatattatgacgcatttcctctgtccatggctctgctccaaaaatacctgcctttaacttgatattctctctatgtccgccttcattaattgattctccaaggcttgcagcataagaaggagtacagcaaagaatggtagatcctaaatcttccataaactgaatttgtctttctgtattacctgaagacattggaagtgtcatacagcccactcgatgagagcctccatgcagacctgctccgccggtaaagagtccataaccgtaggctacatggcatacatcatcttttgttccaccagctgccatgattgcacgcgcacagcaatcctcccaaatattaatatcttcctgtgtatagaaagcaactactcgacgacctgttgtaccacttgtagactgcattctcacacattcagataatggtaccccaagaaaaccgtatggatactgatctctcaaatcatctttagtaacgaaaggaagtttatgaagatcttcgattccttttatatcttctggttctactcctgcttctttcattttattgcgataaaattctacatgatcatatacatactttacctgctttacaagtctttcactctgtaaagcctgcagtttctctaccggcatcgtttcaatctctggttgataataatttcccattcttctctttctcctgttgtcacttaatttataatgatttcattttcttctattcttcgcctcttccaagtgcaaatgccttgtgattgagttcaacaaactttgccggaacacattcctcgattgctttctgccacttttctactggaatatcaaagtatttagacagtctgcccattaaaacaatatttactgcttttgatgaacctgcttcttctgctaaggacagacaatccatcgcatctactttaattcctaaagcttccatcttttcgataagattttcagggtactgtgccgcaccggtaataaccggcattggatcaatttcctgtgtatttacaacaattcttccctctggtctcaaatattctacataacgggcagcctctaacttttcaaaagaaacaatgaaatctgcctctcctttatcaataatcggagaatatactttatctccaaatcttacatatgtaacaacgcttccacctctctggctcattccatgaacttcagaaacctttacgtcataaccttctgataaaagcaaatgtcctaataacttgctggcaagaagggacccctgtcctcctacaccgacaatcataatattctttgtcatttcgcctgtcctcctatgcctgtaatgcatcaaacttgcataactgctggcatacgccgcagcctacacataatgttgtatcgatgactgctttcttatcctttatactgatagcagggcagccaagtcgcatacatgatttacatcctacgcagttttctttttcaacctttaatggtggattatgttttacatattttaagagcgcacaaggacgacggctaataattacagatggttcttctgcagctaattcttctttgatcactgtgtcacaagcagcaagatcatatggatctaccacgcgaaccctgttaaatcccatggaacgacacagactttctaaatcaatctttcctgctggatctcctttaatattgtaacctgttgtcggattctgctgatgacctgtcattccggtaatagagttatcaagaataattacagtggaattactctgattataagcaatattagcaagtcctgtcattccggaatgcataaatgtagaatctccgataacggctacagtctttccttcactttctttgccaagtgctttgttaaaaccatgaatagaactgatcgaagcacccatacaaagagtcatttccatcgcactaagcggtgcaacagctccaagtgtgtagcatccaatatcaccgagaactgtacatttattcttggacaatgtatagaacagccctctgtgtggacagcctgcacacataaccggcggtcttcccggaagagtttcgccaagttctttatgtgccggaatctctactcctaacttctcagcaatcagattctgtgagaactccccttccattggaagagtatcttttcctgtaaccgtcagtccaagttctttacagtgattctctaaaatcggatccaattcttcgataatcgcaagtttttctacctttgctgcaaaatctaaaataagctgatccggtaatggatttacaagaccaatctttaaaatacttgcctgttctccaaatacttcttttgcatactgataacatgtggaagaagtaataattccaagcttggtatcagccatctccacacgattaaaatcacaatgatttccgtattcgatgagttttcttgttctctcttctacaactggatgacggcgaattgcattacctggcatcataacgtattttgcgatattcttctcataaggaattgtttctggtacaacacgttcacccggttctacaatactctgagaatgtgcaacacgagtacacatcttaataataaccggtgtatcaaactcttcagaaagctcaaatgctttcttggcaaattcataagcttccctggaatcagatggctctaacatagggatctttgatgcgatcgcatggtgtcttgaatcctgctcattctgtgaagaatgcattcccggatcatctgcaacacaaataaccataccaccattcacacctgtataagaacaggtaaataatggatcggcagctacgtttaaaccaacgtgcttcattccacaaaaacttctctttccagcaagagaagcaccaaaagctacttccatcgctactttctcattcggtgcccactcacagtaaatctcatcatatttcgcagcttcctctgttacttctgtactaggagttccaggatagctggatactacactacaacctgcttcatataagcctcttgccagtgccttattacctaacattaattgtttcatggtaaatatcctttctataattgtttatttgttcctttgtataaaaagatacggctgtcctgcacagccgcatctagctatatctgactttgtagcacatttaaaaatcaggattcttctgttccctctttgtcctctttcttatccagtctgtcaattacctctccaagacagcctgttccataattaagcatacgattcacacgactgattgtagcagaacttgcgtttgtctcactcataatctccgtataaactttttccttcttcaacatacttgcaacttcaaaacgctgctccatagaccgaagctcagtcattgcacaaatgtcttcaaaaaaatcaaaacattcttctaaactttttaactccagaatagctttatacatgccttctttacgttcttttggaatattttttcccataagatgttccttcctttacgaaatataatcttataataccatcttttttcgatttcgtaaataaaaagtttaatgtgttaaagagtttttcctttaaacaacaaaaacactataataattcccttgattcattttttatgctatacttaatctatctttttgataatgaggtttatttatgaatttagaacaatataacagaattcacgattttttcatcacacattcatcggctttttctttactactaatggctaaccgttttttgaccgcctgtggtttttttctttacccgctgttattgttatttcttctattaaaaggagaacttcttatgttatgttcttttatttttattcctgcaatttgttttttaatcgtaacaatttttagaaaacttataaacaagcagcgcccatatgaaaaacttccaattcagtcactgattaaaaaagagaaaaagggacagtctttcccaagccgccatgtattttctatctttttaattgcaacattatggttttatttttggaaaccaataggaatctttcttcttattgctggcatttttctcgcaattgtcagagtaattggaggcgtacattttataagcgacgtatgtgccggagcgtttcttggtatcatcgcagggtggatttctaactatatctttttgatttgctaaaaaacagacaaaaaaagcctccgcatgcctttctggagaatcctcaaatccctcacaagcgaaattgcctcaaaggcagaaaataaaaaagactaataatagcagatgtaacctcggagcaagtgttggatgtaaacgcaaaagcgaacattcaacacgccgcgactaaagtcacaggtgctattattagtcttttttattttcgtctattcagccaattatgctaaattattcgttatctaaagctttgatgcttaagctgatcttacgatcatctttcttgaagtctacaactttagctgtaacttcctgacctacttttaatacatcagatggtttctcgatatgttctttagcgatctgagaaacatgaagtaaagcatctacacctggctctaattcaacgaatgcaccgaagtctgtcatacgagcaactttaccagttacttcgttacctactgcgtatttttcgtcagcgtgaagccatggatttgtctcagggaactttaaggataatgcaatcttctcaccctgaatatctttaataagaacgtttaatttctcacctactgtgaaaactttcttaggattttcaacacgtccccagctcatttcggagatgtgaagaagtccgtctgctccacctaaatcgatgaatgcaccaaaatctgttacgttctttacagttccttctacagtcataccagcttcgattctttcaaacagtgcttcctgttttgctttcttctctgctactaaaagctgtttacggtcaccgatgattcttctcttgcgagggttgaactcagtgataacgaactcaatttcctgtccgtcatatttctttaagttcttctcataagtatcggatacaaggcttgcagggatgaatactcttgtatcttccactacaacacttaaaccaccgtcaagaaccttagctacaggagcttttaatacttcatggttgttaaatgcctcttctaatctcttgttacctttttctgctttaagtctcttatatgttaagagaacctgtccttcgccatcattcactttcagaactttagcttccatctcgtcaccaactttagcgactgttgttaaatctaaattctggtcgttggaatattcgtttcttgaaatgataccgtcggctttatatccaatatttaagatgatctcatcctcttttacatcgataatagtaccctgaactacctctccatttctaattgtcttaaaactttcttccagcatctggtcaaaactcatttctgccatgctttcatgaacctccttgataatattatttggggttgaagcccctgcagtaataccgagcatcccgatattagaaaaatcctccatattcaaatcattttttgtttgtatataaaaagtattactacattcttttttacttatctcaaaaagcttttgagtattcgaactgtgtctgccaccgatcactatcatcgcatcagacttcttcgccagttctctggtctccgtctgccgctcctcagttgcattacaaatcgtgttaaaaacatttatatcataacccttttctgagataatttcaactaaatcttgaaacttattgtagttaaatgtcgtctgtgacacgatggatatcttcgcatcggcatctaactcaactccttctgcctgctctcgattctcaattacaatcggatgcgtctggcaccaacccatgatcccttctacttcgggatgatggttattgcctataataatgattactctgccatccccactctcccgctcaacgatcttatgaatctttctcacgaaagggcaggtcgcatccactaaatcaagacccgcattaaggatctcctcataaattgcttttgacacgccatgagaacgaataataatcgttccttctgaaagagacttaaactccttgctgtcattaataacatgaactccctgtctctccagatctgcgacaacttcatcattgtgaatgatcggcccaaatgtataaacgttcttcttagaagactctttatacaccgtatctacagctcgctttactccaaaacaaaagccagcagattttgctatgttaatcttcatcatttactccggcaatattattttatttttttaaattcggagataatcgtatcaatcacctgtggaatggacatatctgaggaatctaccagtatggcatcttctgccttacatagtggagcaatctccctctccatatcctgcttgtctcttgccatgatatcactcttaatctgcgcaatatcacactctgttcctttctcctgtaattcatcataacgtctcttcgctcttacatcagcggaagccgtcagataaatcttaagagaagcatccggcaggacattcgttccaatgtctcttccatccatgaggatatctgaagtcttcgccatattgcgctgtaaatctaacagtgcagctcttacttccggtacagcagaagtaactgatgccatcttcccgacctcttctttacgaataaatccggtaacattctcaccatttaaaataacctgctgttttccttcctcatcatattctaaagttacatgaatgttcggacattccgctgcaacgagcttcctgtcatgtccatcaatacctttacgcaaaaaatataaagcgattgcccggtacatggctccggtatctacatatataaatcctatatcctctgcgattgcctttgcaatcgtactctttccagctcctgccggaccatcaattgctatactatacatggacatttcctcccatttctttgaaacctgactgctcacacagtgatttcacttttacctacacttgattagtgtaacatatcttcgcgaaaaaaaaaacatttttttgcttattttgcaaaaaaaattacatatggtttaaaaatggcttaaatacaagctcttttatagggtaaacttatgttaattaagtcatataatttcatattctgccccttttttgcccctcaaaaaaatataaaaatgctatggtataatctgttgcaggtatccaaaatggatacctgcttattttttatacagattatttgctcttaataagtctgcctttcttcataaaattcagcaacttcgtattctgcattgcactgccggtataatttttaatgccgtttaaagttgcaattcgttctctgtttttctttgaagaattgatttttaatgatttcagggcatctacaatcgaactggattttccacgatatttaggataatatacagtctttgtcttagtcggagttttcttagtctcttcaacctttttactcgctggctctttatatactacatttaagtcaaaattaccagagttgccagtcgaaatgactttcggaaatctaccagagctagtatactgccatgcaatgttcgccatagtcggtttctttttttcgtccggatttgttgcaatctgcatccgtttattgccgttataatagcgagcaatccaccagttattacactttacgagttttctatcaatatgttcgttgtagtaactcatgccgctgtaaacgccaaatttgtaaccacgagattctactaccgcctgtgctgcattaataatggatgcaatctcatctttgcttaattttgcttgagcctggtcttcaatatcaaaccatacgcccagtttgaaatatttcttatcgagtttatcaagaatatcgcagacaagttccatatctgtccttgcctttttcggggtagtagcatatgtataattgtacacaccccagttaatatgattctcgttacaagcctgataatttctattaaagccgttatcacgctttaaatctttgcgaataatttttaaaatggcaccatcaacaccatattgctttgcctttttccaatctacagtcccgttataagatgatacgtcaaccaattttctcatgtctattcctcctctttcggcagttcatctgtcatatcgtctaaaaatttctgtatgtactctcttactcgctccggaaccggcaatccgcaaagtgtcatatttttcaagatactaactgcctcatatagtacaaatagaaggcagaaaaattcgcatactcccattttctgaatgcctagcaactgaatatatttgtccggaaccataaacagaacattgatgtgcataataatatctgtcagcatcaataaacctacagagagtaacatggctactttacggattgctccatcaatgccgacacaactattgaacttatgctctttaatcgctcgaagcactcccaatattgtatccagagctaccgcaatcaataaaatttcaaaaaatgaatttcctgctaataatttaaaaacttcatgtaacataattttcctcctaacttactttacaacaactactccacgatacttttcgtttgtacattttttcttgttttcttttgcagctgtcgttacatttttctttccatccgaaaatctccacactttcccacttttatcatctctcagtaaaactacagtatggatgggcgaaccctcttcgaataaaatcatatgtcctttcttaagatgtgcttcaagtctgtcattgctcataattctatgatagacagccggctttcccgagcagatcatgttgattcccctcgcaatttccgtcagcggatactttgctctgcattttaatttcttcctagcatattgcagaacctgctgcatatttttcttaatgcctcggaatcgcagcgccatatagaaagctaccaggctacagccatgcgtacggataaatgaactcttgaaatcatactgtgatggcaccggaatctgtcttccgttgtctagtacgattctccagggaaatttctttttactgttcttgtttttgtttgcttttactctcatcttaaccacctcctagagagcgaaaaaatacaccacgaagacaattatctctgtggtgtataaattaaaatgtgttattattaattcatgacttgttctcatatgtcatatttttttatttccaaacagctcctgtgggagctgttttttcgtatatcaaatagtaaggctgccgccttaataggtactgcaaggcaaaaagatattactgaaatatcaataaacggagctctgaaatttgcacttgttttttgtggcaataatatgtattttgcaaataccaattcaagtggaactcaagctttcgttagagctgtatcagcaccagaaaagactgtaacatgcacgactatccagaataagcttatcattcgaaatgatgatgaaaatacaaaagcttatatgtgtaaaattttttaacactataaaatagtaatgtcaaagtttacagaaaaaacattccaggtggagccacatgctgcataacgtcgttaaaagaagctacattcacaggatttatttttgttcaaggcggactagctagtctctattctatggcatatacatgtggatatgcacaaggcaaagggcgatatcatgtcaacgaattagttccttgctcgcttgttacatatgactgcctcacagacgaagacaaaatttatgtcaaaaataattctgagggatatgcctgggtaatcctagttgatttcgctgggctgaatgctttttctctcgaagctcaataaaatagtaagggcaaaaccatcgaaactacaattggagcgggtaaggaatatacggtttcactcgaagatcattcgatttatatgttggtatattatgagctcggtaatggtaatatcaacgatggtagcgttaactgtgcagtaattgtttctcgtcaagcggacgaaaaaacaggcggaatatatactactgcaacttccagcgaagaagatatatctctggaaaacaatatactaaaaattacagcaggcacctggtgggttagagtttgcattaaaaaactctaaatcaaatagtaagccattcatgatacgtcttcctgtgtctgtaagcttgcaggataccattgccacaatatcaattgatattgccgatgctgaacgaggtgtaattattctcactggtcgtttcggtggagaaatttatttttcctcaattatcaactatggctcaacatgggacgtaaagcaggtggtcttcgccggtagcaacaccattaaaaatgagcaaaacaaaaaagttcttaccataaccagcgcaaaagctatttccagcaaatatgaggtcaatgcactattgattaaatagtaaggtactaccagttgatgtggctttactttatattcctgacactggaaggaaaactgcttattctatctcgaccaaaaaagttactggaacaatcactaaaatatcaggaggaatatttgaaaatatatctgttgtgccaactgatgcaacgattaaattttacaaaacaagttcctcaaataatgatgcatttgcagtatcagaaaataacgaaagctgtactgttgctgttaacccatatactcctgtaactattctttattcaagaagacttgatttaaaagtatctccactttccgaataaaatagtaaggctgccgccttaataggtactgcaaggcaaaaagatattactgaaataccaataaacggagctctgaaatttgcacttgttttttgtggcaataatatgtattttgcaaataccaattcaaatggaactcaagctttcgttagagctgtatcagcaccagaaaagactgtaacatgcacgactatccagaataagcttatcattcgaaataatgatgaaaatgcaaaagcttatatgtgtaaaattttttaacactataaaatagtaaggcgatatatcgggaaatccctttcgataacatatctcttgaagaaaaatataaatcctctctgaatggattaagtttttgtcgaacacaatctgccacagatatgccagcgaaagaggcgttggcattgttgatcaacgtaaggtctagtgcagaatggggaatgcaatatgttttatcttcacgtggcgcaatctttaccagaagaattactgatggtgttttctccgaatggattcaagtttaaatagtaagcgtcttagggcatatacacttaaagcaaactctactctgactatcgaattagagtacgacacttgttattttcttgttacaacaggaataagcaataatgatatacctcctttaacaacaaatgtgtatacagttacggtagcagccaaaacacgaagcagtgatgtctctatcattcattcggatattagcaatatcgaggtttcaatcgaaggaaataaattaactttgtgtagcaccgcatggaagaaaatcttcattaaatagtaatttttgcactggaattatcaataattctatatgcgattgtcgctatataaaatcaggaaaaaatgtatcaatttggtttggtagcgcaatgatgcaattagaacaagataaaaaatatgaaattgctacgctccctgatcttgttaaaacagccggaaattttgaaatagagataacaggcaatggtcggaagtacaaaattggaatcaacggtaaaggcgtattaacccttgctttgctggacaaaaacactggggtagcacccttcgttggagcaagcttctgctatcctattatacgctaaatagtaaggctaccaatctcaaatacattgatgctggaagaatcgaggacaagaatacaaatgtggatgatgttgcaaaaaacattgttgatggcttgccaaataatgaaaagtgcttttattttgtatcatattttcatggcggcataaaaaagatgcttgtgcaaaaatatctaagcaatgattatgcagcatatatacttttcggatatggaatcgggactatttcatatcacgttaaaactaacggaatatggagataattttccctcttcccatttagtttaacacctcattttcttgattttctcttattctctcttccggtctctcgctttttaaacacgcagaataaaccgccatttctgccggtttgaaaaatctgtatagaatcattttgtcaggctatatatcttctaaaagatgctttcacattttcttcgctaaccgttacatatagcatcgttgtatctggtttctggtgacctgcataggcttggatttcctgcagtggaattcctctgtttccggcatccgttaaaagtgtccttcggaatttatgcggatgagcgtggattcctgtcttctttcccagtgtccgcaacatcgactgtattgcttgctttcccaaacggctgtgtggctgcttattgctcacgaacaaagctggattcatatccgttcgtgcgaacagatacttttttaagtgatatgcacactcatctgttagatacaccttcctctctttctttcccttttctccgtaaatgattacctctttcccttcccaattaatatcccttctgttaagccttatgacttcacctatacgtgccgctgtcgaatatagaaattccattatcgcaatgtctctctgacattccgcactgcatctcaagtgctccatttctgcctgtgtaaaaggctttttgatcgtctgcggaacctttattttcttcaatcgtctcatggggtttttttgaatatacccttcatcagacacccaggcgaaaaagctactcagatatcgtctaatcgtgtctaagtagctcatagatattttccttgtttcttgatacatcgctaagtaataccggatatcatttgttgttatatcctgtagtctcttattcagtgttgttattaatcttgttacacaatcattataacttttcagcgttccttctgaacagttttcgatcctcttgcttgccagaaatgttcgaagtattttctcccaatgccgctccgaagttaccagatctgtacattcctgcttcacttccactccatgaaattccaacaccaatacgttctctaacttctgtaattgttcattatctaaaacctcctgcattctcattaaaattttgctttgaattttctcgatttctgtcataaaaagcacctcctatggcttaattttgccataagaagtgctttgttcacaaatcaattaaatgggaagagagggaaatttaaattttccgatgaagacaggattttcgaataatgcgcaagtgaaaataatatctttctgattttcagcaagctttacagaggcatctcttacactcacggcatcaaaaactttgttcatgccgcaaccgttaaagattgtcgtgctttttgccaatgtaattaagtatatctcgcttctgcatatgcacaaaatgctctgatccaaaacaagaggagacagcttatatgaacgggttttctccccactttcaaatacttcaggggatattacacttatttttgtcttactattttgtgaagtaacatcctgaaaactgaaaatttgcctgacggtttacttctccatcggaataatactgtacttctccagtattcattattcggattatggtattactcgtagatgatcgcacaggaataaaagtagatgcaaacggtttatattcttctgggacgtcaaaaatttttgtccaagttcccttttggatggattttatgtcagaagaataattaatccagacaattttaccaatttttctgatatagcaatcattttgtaattcttctgatgttgcataagttgtgttcattattccattactattttatattcatccaattgctccaagttccgtcattcgaacacgaacgaatttttagcgaattattcgcagaatccggaacaaaaatttgggtgcaccatttgccgtaaatccagaacaagcagagtacatatcctgtatagccgggtcgatttagcgtgtcagtacgggcgataagtacggcaagagaaacttttgagctgatatattttgatgtatcaagattaaggtctgcaacatttgactcaactcgtaccttactattttattcggcagagaagtacttccagtctgtccaagcattgttatttctttttcggcgtatagcaatcttatcacttccgaaagaaaaagcaagctgacagttaaaagcattgttcggattctgttgaataacaatacacccattgctgccgagaccttcaggaaggccaacaggattgactgttgttctcaatattattgcgataggaggattatctatatcgtttatacctgtcgcaacaatctgagaacccttactattttatttaaagttttctaatatgaagccgtatccaaaatgagtttgtagaaatttttaatatattattatcaagtgaaaacacatttgtttttactgtactatcattatatatccctccgatgcgtccggcattttgtctagtaagcacaaaggcataatgcattgaatcatctgaattaatatcaccattattaattccggaatacacaataatatataaagaattatcctttaactctttggtacgctcagtatttgcttgaactataatacattcggaactcttactatttaattcattaagagccggtatgattgacttattttgagtctctaactgcgagattaccgccgttgctaatttgcctgcaatccagttccataatccgctgaatggggttctcttgcttacattagctttagagtcagcgatcataatctcatctgcatcttctggtgtcgtttttgttgtgtattctttccaatttgccatagtctattacttcctttctaaaatcttcatccagtcaaataatctgaaatctcctgtttcttgtgctgttgtacaaatatatattgcatcgtcagctatccaaaggtctcccaaataatacgggggtttggggactactacttcaacagttgttccgatttcatttcctgcaaggtcaagaatcgtattgcctgccgtatcgcttaaaatgctctctttagtagtaattgttgaatcttctgtagtttttcctggaaaccacgcctgaatcttcgttttaactaaagttgctatatcatttttatttgtttcaatctgctcatggtcttcggcgaactgtgctgccacctgctgcagcttaattaattcctgtgccgctgcttcggtgatatttacattctgctgatttccttcttcttcaaccgcttctatttgtgttgcccctgcatttttgactgccattacttgtgtatcgcctgccgtgttaatagcactaacctgttctgtgcctttatccgataccgccttctcagattcactctgctgtgtttcgaccgcacctaccgccacctgtcctgctacttcaacattctcaacttgttttttgcctgcggcatttacctcgtctgtctttgtaattccagcatcattaacagcttttgtttgcttagtcccctcatctgtaacggctttcgcggatgtatcctgctgtgtcgtaattgcatcaatagccgtttttctcgcttccccaactgctgtctctgctgcagatgttttctctgcagcgtgtacgtcaaagcctgttacttgggcattgatgttatcttctgactctttcgccgccgttctggaggcttctgctgactgtgcataccctgccgcgctgtcccggcttacagcagcctcctcggatgcttcttgcgtatcctgccgcatctggctcacgtctgcctgtgcggcttcaatctcctgctgagacagctctatggctgctcttgatgtctcaacctgtttggccttgttgactacatcgtcatgcattgcaaccgcttccggggttaactgtcccggtagggttagcatctgccaatgttctgtgtttttaccttgcgccggcgcaattctgctgatggtttttgttaactccgccaggcacatgtacgagccgcctttataacttaccgtatcaagatactcgtaagacacttcatccgaatactcgcctcttggatttagtgcaatattacccaaatcagtttcaacatatgtattttctgtctgcatctcctcgccttcctttctatagtgctaatctatactttaggcggcttccttctcttcggaacctcaccttgtccactgtagggtctgaatacatttttaaccggccttttacgactgcaaagccggcaaagtagacatttcctgtttctccctttagttctacctctttctgcttaacataattgtctatttcttcttttccttttgtgactcgccccggtacttcttccgctgcattcctggcctgttctgcataatatgcagcattgtctttctgccgatcaggatagtctgcgtgaccatgtgcccatgattccgcttctttctttgcttcttctgcttcaccggctgctttattaaccgttccaatgacttcatggaacatttctgggtcttctggattttctgaaatatccggtttaggacgtgtttttactggcatagtgatacgatattctgtattgccttctgtagaatccgcaatgtatataaatgcatatatattgtaatttgacgcggtatcatcattttctaatagtgtgtctggaatatgtactgtcgtgatgccgttttcagttagtcctattcttgttatcgagtctccgcttttatcatctaaggaaaagtgaacttctactattttgggaaggcttaatccttctattgaaagtgtttgtccgtaatcatattgccagaggcctgaggccttgcaataattgctttcttcaaaaagtgctgttatcgtttccatatttcacctcttaatatacaatgtccacgttaagatagacgtaatttggcgcaatgtagcgcggagatatattattgaaaccataattaatgtatgaacactcaatattcaccttcatgcatggagtctttacatcatcaaaatataaatcaacgtctccagttccaaacgtacccaaggcgtatattccgtttacgtttggacttcccgggctcactatttttttgatacttgctgttattttgattgcatctgaaccataggtcatccaatattttaaaaattcttccgatagcgaagtttctgcaagcataaattctacagatgcagtacatacttcttgcccaccaccctcaaagtctttatatcgaattctcaattcacaatgttctgaacgataatggtaaggtgcacttttattttcagaatcaaaatgtacaataccatctttgtcaagaatagtttttacgtttccatttttatcaagtatttttaagaagccttttttattatctttatttcctaagaaaatatttcccgaaacggtcactgttttagtattgatgtcaacctgaaatattatattttcctcatcatccttaaccgtcagagcgcccgtattaatccaatctgcattaacgcctattgtattcaatatcttagttatcgtagttccatccaccagcgttccagcgttccaggtttttccgccatctgttgacattccccagcctttcgcatttaattcaatcactactttagattctttccttgtaggtttatcgcaaaaatataaaatattgctcccgtcttcctgcttctctgttaccggataaagcccttgtttttcatccattgcattttttaaaccttcgagtgcttttgaaaactctgattgctgttgtgtcagagtttttcttagttctctatagacctgtgttgctttactgtatctcgttgatgagaggcgctctggtgataccgctccgcacagcaattcctgtagagctcttgccgtatatgttgctcctgtaaggattgttttgtattcttttcctttccggtcagtaactacggctatgtctccggcctctattgcagggtctccctggcattttatcgtcaagggtctgaatgtaagaccattgacttttttacctacgaactcggctacagaagctcctttcccgtcctgaatcaatttattttctttaatttctaagacgtacccttttgttccatagagatattctgtttcatttttttctgtgtccgaatcagttgtgctttcttctacaacctttattccagttactacaacgtcatctgtttctattgttcctgtgtagtcttctacttttacagtttccgtattttctttaatgttttcagattccaaaagggaagtattgtaccagctcgctgttaactcatcatcttcattgatcttaaaaaataggcaggcaatttctccgacatactggagaacctgcctaaaagttaaagatgtatctgagggtctggcagttacgacaaagttattctgaggaaaagaggctatatctgctgacatagacacattgcaagcactgcaggtatctcttacaatctgaccaagcgtggccggatactgcaatttgctttctgtatatgacttatcgaattttgtcatactgtcgagagctgtgacacttaccgtatctcctgaaagtgttccaggttctgcgtaaaaaattcctttttttagccattctgttgtttctgataattcaagtccgactctggccgtaatcttcgctcctgaaaagttacgctcgctataagccccctcaatattgtctatcttgagttctaactgttttgcaatagccgctccgatgtcaaaactatttgtatttgatgtattatcggaaatcttaaatgtatataggtctgcgtcttgcgctgtaataacggtcccatccgcgaactctatttttgtttcatgatgtaaaactctattttttaatattgtttttttatattcggctgatgtatttatcatttcatcacctctgtactatatctaccgaaacgcttttgtaataaaagatacccgagagccatccaagctgttccttgcttaatgttccccggtacatttcgattgtaatatctatcccatcatcgcgaaaagataccgggaagtatccgggaaccagagtattttttataatcttttcttctgcttccgttaaatattcccacttaagggatacggtctttttttgtgctaccggatctccgaccatgcgacctgagagtgttcttcctgtgtcagatgaccatatgatttcatcatttaccgaaagacttgttggtgcaggaagggtagtacttcctgaccatatgattcttttcgccatcaccctacctccaccgcgttaaatctacggtctgctgctgtgcgggccgcttgtgttgctctgcctacttgctctgaatcaatatagaatcccatttccgccagtgcagttacaattctcattaccgccctattgacgatagattctaattcttcttttgttactccgctgcctccggcttctctgacggcttgttttgccatttcttttaatttatcctctggggctacaaactcgccttgatgcatattgtcaccaatcatggcaagctgtggtgtatttggttttacgtatgcgccctgtgctaatgctggcacataagacatcttagggatgctaaaaccactgaatccccatgaacttcctccgaaacccggaatccagtctgggatgtcaatcgtaaacttaatgctgttaattttcgtaattaaagcattgattgtttttattaccgaattaaaagctgagattatcgcattaattggcttcttcgctaacgaaccaagtgcgctgaatacatccgagaaggtgtctctaatgtttttccaggcttttttccacttgcccaagaatttattatttacaaaagtaatgattccgttaaaatatgtttggccactgctaaacacgtttttaagcttggtcttgaacccctctgctacagatttaaaatctttaaaaaatccattccaggcaggagaaaatactgtcttgatatgggccaatgtcccgcccaaaacaccatcttttatatatttccaagccgctttgaaactcattttaaaactatctgcaatttcttttaagccgctgaatgcttttttccaatccccggaaaatactcctgtcaagaaatctatcaatcctttaaggagctttgcggtttctgatatcacgcctgatataacgcccagtacccagttaaaatcatcacccgtatttttaatgagtgacgctatgataggcatggcattttttactgcccaatttaagattggctgtagtagattttcccatagcacttttaacaggtcgaatacacttccaagtagctcaataatcccattcagcgcaggttgcacagaatctttccatgttccgtcaaaatctgttgccagcccctgcaatacaggtgctacataagtgttaaacccatcaagtaacgttccgacaatctcagagataccctgagcgatagaatcaaaaaatggagctatgtgtttatcatatacagcgtttatttttgtaaaagtatcttttactgattggtggattgtgtccattacaattcggattggcaataatatattttcaaacgccgtttttattttgtcgacgttctgtgtaacaggtgtgacaataagtttttcaatatctcttacaaatttcaggccaacagttgttgctccaagatagccatctgcaaaaataccgataatatcagctgttattccttttgcatcatcacttgaaaaaacgtcaaaaatatctgcaatagcaaccgcgaaattaccagataagtctgcaatttcaccagttacatcaaaaatagatataagattctttttaatataatctttgcttttttcgagatatttatctacgccaccaataagattatcagcgatagtaagaccaattcgagtaaaagaacctgtaatctttccaaatgcaagtgcgatggaatttgcacattcattcgccacacgaacaactgctggatccgtaaagatttctttgagattctttccaatatttttaatactggtgtttatcgaatcgattttcttatcagaatctccaaatccaatctgaaaaccttttttaaataaatctgcaagttctttgcaacggttgattaatccctgcattttcttgtctgttttatcaattacagtatccccttgcgccaaacttccaaaatctgttggagggactgcgttcccattaaggggcgttgagctgtctgtctttgaatctaacttattaatcttgtcaaatcccatcagggagcgcatctcttttgcggctttctttgcggccccgaccgtcttatttgttgattttgtagcattatccgccgattctgcagcgctatccattccggtgctcgctgcattccccgcatccgctatctgctgtgcactagatttttttcctgttataagttctgtaaaactcttaaatgcgctcgctaatacagcaagctttccaatcactgcattaataacgcgaaggacaggggtaaataaattaatcaacccttgtccaatactggccttcaaggaatcaaactgcagtttcatgatacggcattggttcgcccatgagtcagaagtccttgcaaaatctcctgttgctgctgtcaactgatcttgtacaaacgcatatctgagagctaccttttctgcttcgctcatctgagccgttgtcttgccaaaaccatttgccatcgcatacgcatctaaggcgctctgggtcattaccacgcctaagtctttcaaagactctgtctcacctgtgaagacgcttttcagcttcgtataggcttcatcctgactgatattgtaaaatgatgccacatcgcccgccagacccgtgagagtggttcccatatcataggcttgtttttccgtaaaaccaaaagctttcgccatcgctccaaatgtaccagtgtactgttttgccatcgtttctgacaatccaaagcttttagctgcactctgtgcaaatttgtcaactcgtgccgtcatagacggaaatgtaacatcaaccacattttgaacttctgctaaatcagagccaagttctaaacaagactttccgaaatctactacttttttaatcgaaaaagcggcagctaaagccataccggcttttttagcaagtccagtgattcctgccatctgtgttttaaattgattttgatttacgaccaggtcaagtccaatctcgcctacgcttgtagccgccataataccaccacctttttaaaaggcatcggcacatggcactacttgcccggattaatctttatctcaaatatctttttacagtgtcttgcctgacacttgaaaaatacgccccggcattttgcatccggggcgtactgaattttttgttcgtgtccacagtaaggacattttatcttctttctttcaatttttaatcacttcctaatccatccatgcttaaaaatgctgttttaaacatgttcattgtattattcatctgttcttttgttattgtctgagctaaatattttgctcgcttccgttgccattcatttctgattcggtgttgttctggggtgaagttttcaagatattccttcctgtcttctgcccggattgctacaactctaccaagtgccgtatccggtccaaggccaatcaggaggtctctaaattcatcccatttcattccagcaggaagttctcttgataaacggatcccgtactgcgattgaaaagaggaaataatcaagccaaaatcctctatcagatcatagtacgggtcattactctccctgctcgtctcccatcaccaaagacattgcagcctgtacgattgtcattagcgatttcgcagataatttctttccgtttctttcaatattgcagatagcttctacatcttgtggggaaaaaactaaattcagtgcttctcctactgcttcaagctctgtcttttctgcgaagactcccattaaacgaagcattgtttctgcgtccgcctttacttctacatccaatgttccgatttccaaaactggattttcttcaaaacacaatttatctgtaatgttgattcttttcgtcattgtatctccttttctatacagccggtgtgattgtcggctttccgttactgatcgtatcaaattctaatggtccgacatcggtactgttaccgccgccacagtttttgatatcaaagattgcgttttcccatgctatacttgtgccgtcaggcatctcccactcaaaatacccttctgcatcgtgcccgtttttgaacgcttttccagctacgaaatcatttcccgtatctccgacatttcgctttccattgagggtaattgtgattgcttttgctgtcattaatcctctctgccagccttcctggtccattggagtccatgtctgtactccatttgaaaacgccactgaaaaactttccatatctgcaatcatggttgctgattctttcgctgctcccgccttgaacttattatctaagaccgggaatacatttgtcgctttaccgctcattttttacctccttttcataaataacagccgcttcaatgacatactcataaacaccagcatcatctgttccaatctcttgtaaatcataaagtgtctgtataaattttattgttgtttcgtttattttcgcatctcttacaacatttattgcgtcaaataaggctgttgctgccttttctgtatctctgggcgacttattccagtgcacaagcaaagttacgtgctttatcccgtatccttgccagtctgggcctccaagggtcctgtggggtggatactgatgcttactgttgtaaactcctatggactgttccggtttatccggaagtttccccatgtatacttcttttgttaagtttaaagatgcgatataatctcttacatctgcaagtgtcataagcctgctaacctcttataaatctttttatatgcttctctgcaaaaatcagaagataccccatcaatccacggttcataccatttgccgcttgcaaaagcgttctcgtacttttgaaaatgatactctggatgaaaatacaagcggcgagcgtatggattactggatactagcgaaacttttccttgattgcttttggacgtatctacaaaagtggattcattttgaagatttccagtatcgcgaggcataatctccgcctgtatcacttctgtatgtaatgcttctgccgtctgttctaaggcttctacttgtgcatccgtcaattctctgatttttggaagattcaatcttattacagaacttactttcatcataccagtgtcacctctgtataattaacgcttccatccgggttgcgagtttttcttccctgttcgattcttctttttgctccgaagattgtcgcagttccactagagataactggaagttccgggcagatatcgcccggaaacagtgctgtgcctgtaacctgtaccgtcttcttttctgttgtcagtactgttctggctttatcctgatagttgcatttacccatgaactttatcgtttcgagaggttctccatactggtttaagccctctctttcaaattcacaggtaatgtttgtcttgcacaagctctttttcactaaacatggatatttcatcctctcacctcgctaacctgcagcataaacccgtctgcgacagcaaagcataggtatctcttttcatcgccacgcctttatcggtgtagacgttccaactgcttccgaagcttgctgatactccattgatgctgtaactagataagatcatattaatttcatcggcattctcatactcaaaatctgcctgttcgcatatgacttcttttatgatatcttgctgatattctgtcaaattaagaaagccctgacttacgatacgattataagtcagggaatcaatatgtcttgaagcttttttgagagctttgctgagctcctcttcagggattatgtcgccctcatacctgttcaggtaataatccgcatttacatatgatttatatgccatatgttcaccttacgctttaccgcgttttccttttggtgctggagtttcggtttgaacctcttctactgcctcttccattggaacctctgcttccattggttcttccactgtgtacccatgttctttaaaccattcaattaagtgagggtcatctgtctcccccgttccgttgcaaaagggaacggaagcagagattcctgtatattccttatttggactataaactttcattatatgcctcctattttactttaatatttctgaatacgcccgctgccttggatgtttttaatgcaatcgctgcattcatttctacttctccggtttttactgctccggcagtagaaaagtcaggaagccaggtctgcaccggtgctacccctgcaaaagaaaccgcatgaagtccatccaacgctaagcgtccaacatagagggaagttgtaccatcctctgacttaatagggactacttcctcatttgttcctgcttttgtcttcatatcgacaaatgggatacttccataactttctacctgattaccccagttatcctgtgttacctgatacatacttgcccggcgcgcacatgctcgaatcttagaaattaatttgttatttcctgcaatgaacgaaggtctaccatccagaccgccaagaaattcatcgagcatatcaagaaaatactgataatttttcgttaccagttccgatgtagataaatcaatcgtccctgctgtattgtattctgtactgctgccagtcagagctttgtcaagaccgtcaaaagcttttgtgtcttttgcggaatctccattaataaatgtatcattgaataatgcctgtgccgccttaatcttctgagcctgttgaagctcaacctcgcttacaattccgcccatgttcgcgataacacggtcaatctggtaagcgccaccgaagactttaatctctactgtgtggcgttcttttgttacttcacttggtacatattctttattgatttcacgaaatgctgccgttggctgtgtctttaatcttgtatagctgtaagacggcgttgctccgccgcctgttggtgtcactgcatcatcaaatgtgatgtgttctaaaatccagtttgatttttgaaattcatcaataacccccatctggagatcatcctgtacatttttctttgcctcttctaatgtaactgccatatcattcaccctttccttctgtgcctaaatttaatcttgctgcaatcgcttctttcattgaaacctgccctttctcgccttcgccccctttttctttgggtccaagtgggaagaatccttttttcccagaaggtttcggcccctcctgtttgaataaaaacggtttactctctttgatggtttttaactgttcatctaaacctgtaatctttccatcatcactcaagattaatttgttgcggtctaccagcccagcaacaagatcgctatcttgtgctgtcgctgctatagccattttaattgcatttgtcatttttaatgcgtctaattcttttttgtagtctgcatctttctgcttattctgctcctggagagttgtaatctgctgctttaactcttcattatttcccgccgccgctttcaaagtatctaactgcttctcatagtcacttaccgtagattctaactgtgtgcatttctgctgttctgcatcgtatttctcttttgatacatagccttccagttccttttttgaagcttctgctgctttctctgccaaactcttttcaataccgagtgcttcaaattcttcttttctcatcttatactcctttctggtagtttcctgtcattccggacataaaaataagatgcttaacccggcaccttatcgggagactctggatcaccgcctttcttctcttttacctcttttgcaactttaaagctaatcaggtattttcctctgtcttctgacacctcatagacttcaccttttttgcgaagtcttaagtcttcctctgcatccttgaaatcatgtgttactttaattttcatgtgaacctcctaatttttatgagttatcttagctccccactctggcaggaagttaatttcataatgatatttatctacatttgctcctgaaacatcttctacaacgtacattgtatagtcattcagatagactaaatcctttttatattttccctctgctgtttcaatgataacttcaagttcgttcgcaccattgttctgcagtgcaaatgttcctataagttctaacaggacggtatctgttctggcgttaattacggttaattttcttgttacattaaaattatccgcttcctgagatacattctgagacactttgtaagattccgaacatcctgtaaggactcccattgctaatactgtcgccatcaccgctaataaaatcttctttttcatcgtttcattctcctttcttgcccggcgcacttaaattgttaagtctacattctccattaccgctcttgcttcgagtactgccatgtaatctgccatagctttaagctgcatattataggtgctgcgcgggcaggtaggttcaaagacaagtgttccctcgtcccatttcttaagcatttttcttaatccgtcaaagcgaatctctaactgcttatattctgccttaaaacgttccttataatcttcgttcatcatacccactgcagttgctggaagtttattctcatcgtattctctataagcttcctcaaatgcatatgccggagaccaacttacataatcatcgctgtacttcacgagatagcctgcatcctccggattttcgtccgctggaatctgccagcctctgtaattattgtaatctcctcttgtcattggttttgcttcaattacttttgttccaacatactttttcatgttctcttaccttccttttcttaaaaatgggtataaaaataccaccagtcagaaatgacaggtggtattagtaccataatattgttttttcttttggcgggttatccagtcttgcaagacgttttaattctcttcgaacatgtgccgctgcaaacgaacttgtattattatgttcaacaattttgccatctttcatcttcataaatcctttaggttccttcccttctggataatagtccgccgatatggcatcatttgttttttttatgtttttcaagattaccataatactctgtcgcctccttcgggtaatcatatttttctgaagctatctcatgggctttccaatgttccatatttggattttctttctttattttcatttcaagaagttcatgttcaatcaaggttttgtcatgtggtttaatatctttaccaatcattagtctttgccaactctgagctattgcacaatctgggtcaaaccgtctccattctccggtatcggtatccagtaatgatttatcttcaaaaagatatgatttaatcttcctgatatcagattctttcttgttaaggtttcccgctatctttttggcatctgttgaaaaactacgaatctctttgtagtacatttctgcaaattcgtcagcttctttgctaaagatatctgtaattcttgctcctgataccattatatcagatgtaaccttcttttcaagactaacatctagtactttttctaactcttctttgaatatacttgcaaatcttcctggttctttacatgtatacgcttctgcaaatgcttctgcaaatgcttcttgtgcattttcgctgccatatgaccctagaacatccactagattacttgttttcgttttaaatatatcaccatcgaaatacttaagtaagcttttttgaataatgtcataatctgtgattgaaagttttttcgacaagctatcggctatataatgaccgtattcatgagcgaagaaatgcatttcataatcatctgacctcgaataagtaaataatttagaagtcggttttgtttctattgcctttttcataagtttaattgattgcgaatcgctatagtacgcgccggccgccgttaccccattttcgcttaaatcatcaacaacagaaagagattttaattgcaatttattcttaacaaaataccctgaatgttcttgttcaaatttctcggcaaactcaacaaatttattcaacgttgcatctgatatgccagttgaattatccttgaaatctatgcccaagccttcgaatgcctgtattgattcttcttttgtgcgaaccattttctttgaaacttgtttctcagaatttattttttcccttaatgacttgatttttttatctatttctttggctcttttaatctcttcctcactagcaccttcaaatccctcctcaacagactcgaaatctttcataaagtcatcatatgaatagccttccgtaatatcgtcaaactgtttttccaaatctttaagctgactctttacatcttcgatttcttcttgttttataactgtttgccagtcattttgtttctttttatacgctctttgattttcagaatctagcgaatgttttgccagtctttcaaatctcttttcctgacgctttgcatattgctgtttagcttcccgcttcgctgtatcctcaatatcagtaatctcttgcttattgtatttcggatccacagtagtgataccgggaaaataggtggtgtgaacatctctgcaacgtggatgatatagaccggccgctatggcgctagacatcaatggatatttcccatccttgctgctgccaccgctccacacatcatcaatcatgattttccctacgaacggcaaacatttaggacaaggacaaccacgtttattcatgataacaagatgtagaccccattcctgtctctttgtgccttctccttgcaaatacgcccgcttagaagctgttctgatcgccatgtctgcataatccgctatcgtatgacggcttccgttggcatattctatgcagtcaattcccgcacttaagaagtcttttgttgccatgtctactgccttctcgtatgttcctgcaccagtgttagcataaacttgtgcattaaatataaccttgcggtattgatcgtttgcccgcctcaaaacagcactttctgctttctgcatatcggaagatgtcgcctcaagtagtgcgttgagttttctatcatttactttaaaaaattctgccgtaccgccacgagaaacttttttagctggaaatccctttttaatcgcctttaaaatctccgcctcctggtccatttgtccatcttcgtttgctccaagaattagacagtctatttttttgttgatttccttaaactctttcccgaatttctttttattttgtttccggtacttttccaatgcctttaactgttccgcctgccacatggaccattgtttgtcctcttcaatctcttccagcttatgccgctccatgttgcgaatcattgaagaaatcaactcttcctctattgcttcaaatgctgatccaacatcatactctgtgtttatctttgccatttgaatataccttaaagccctgttttctaaactgtcgcgtaagttcttttaactgtgtgatactatcacatttatcgcatcttaattctgcgtaatctgctttttcaagagcatatattccaaatagaacctgctcttttgctactttgagaagtcctttatattccttcctgttcatctggtacattctgttcgccacttttaccttcatcaccctcaccgctttccagatttgctttaaagtctcctacttctaaattcacaccaggttcttctatttcctgaattccctgttctgcctttagccgttctacttctgcatctttttcttcttgcgtccagctatctccgtagagctggtccacggatgtttctaggctcatcacaccgtattgtttcgctttacctacagtctccaccgttgtgccaaagtcaggagaagcatattctccaaattttacagtcggttcatattctcctggtgtttttccacacataaggtcataacattgcagaaccgctgtaaaaagctgtggaagaaccttattcaaagtatccacaatctttcctcggatttctaacgtgattttttctttttctctttgcgagtctgcattatcggtcttttttaagtcgattccaagtgtggacggtgatataacgccttgaagaactaagtctaaaaaacttgcatagctgtttacataagcttcgtaagaaatctgtggttgggagatttccacctgcttatttgacttttccgacatatcatcgcctattgcaatgaagtcattatcaaacggattcgcaggcatgagttcgcctgtctctggatctcttggaatcaagctatctgggatatatctcttaattcgtcccatacggattgcgtccatccactgactgattacctcgtcaaggccgtctaaaacgtctgttttgctatcaaataatgctttccctcgattcttgtatttggcagagtttaaaatcctcatcggaacagctaacattaaatctccttctatcccaaaatcaatcaagtgtgctgtttccggtagtgtactcattggtacttcttttcctctgtcatcatataatttatatctgacacagccaaagccataggtttcttccaatcttaaatccttattaccgtttttataggtggtataaaacttaatctctcgaagtgtagaatgaatatagacataatctacgtcttctgcatcataaaactctacaataggatatgggctgcactcatcagcactaatcttaaacgcaccatcaccagcagccagtgtccctgttatcgcttttccgattacgtcatttaattctgctttctgatataactccttccataactcatccaatgtggttgcgttttctccaaattctattgcatccaaatcggcaagcacaatgtctttatatctatctactactatggcaacgataccgctgtgcatctttctgattgtcccttgtgcgtgcgccgcccagaacctcgctttttctacatcccatcttgctgttttcttaaaaaattgttctagttctgcactgtccccttggtaccagagcttatttttgattacattttcccggaaggtatgtgcttctcggattgtaatgctcctatctcgcgccggtattatgttgagcagtcttgcaacaaaattttgaaaccaattcatttttttattttccctcctttctataaattttactctgatatggtatgaaggcatattgtactgagttaaccatgtgatcatgtccatcttctggtgtattgtctttctcttcattccaactataaatttccatctcgtgaatgtagtttgtgcaggtgtcaagtacataaaagcatggctctattcctgcgttttcatcgaatgccatccagccaagctgtgcattgatacggtctataatctgcattcccttccaggcatcatttaagacatatatgcagccatttctgcgcttatatttattccactcctgcatcgttgcctggtctgcgttatcaaggaatacattccttgccaatccccattcttctttatttctgttgagaaaatctattaaattctttactgtatccgaaggggcaagtggaatattcaattctgcattgttatatactttctcatccaggactacacatttgcctttatttgtaattgctaagaaagaaaaggctatagtatccggagacttctgcgagtaagaagtatctaccgctgcggaaaagtataggaaaaattcttcttttcttctttctcctctcttttgtacaaattgttttgtccattctttcgttcttacatgttttgctctattaaaaatactaaatacaaggcctgttgcttttcctctcagtccttcaatcttatttttccagatcttcgtgccctttggagtgttctggataatctgttgttttttcttttccggaagtccggcattatcgtcaaaagaaaagaaccaatggacccagccgggctttggttcttcctttagttcatctttaatttctcttggtgtgctatcttcccattcaggaagtggtctgctacagtttatatattctttatatacatcaagtccggggtcgtccggatttagagttgccataagatagtcgcaacgcatagaggactctcggacaaattctatatctgctgtgttaatctcgtctatgtacaggcaaccatattgcccgcctaatgctttcttccacttcttcttgtttccatatccgaggacatagataactttatctccgtttggcgaatgaaataacaaatgaggaatcttatcatcttttgttccggatccgttatattctaccagtactccgaaatcgtccaggattcccagatccttgtttatgatgttcttttctgctgtcccggtatcatctgctgctaaaatgtgaagctttttgggggactcagcaactttgcacatgaacttgaacaaccccactgtcgttttgccggctgctgtagttccttcgaggaactcaaccggggcattgcatcttaggaacgctttatatttttttgaaagtgccagtctttctgtgctcactacccatcaccacgcaactgttccaggatatctcccagtttctttttctcctcttccagaccagacacttccatgcggtctttaaacattccgagatgcctcccaagtagttcgagcgctttttccttatcatttagttttacttcgatgccatatttaccttctttaatcccagcaatagctttaacttgctgctcatcgaggtttactgtatcttttatgattacctgtccatcctctacttctgcataatcagtagctttagcaaatgcaattgccgctaattcttgtagaactctgtcttgggtgatttccgtccgtttctgacgttctcgcatccgctcttgaatatatgctgcaaccttaacatttcttaacattctagttgctgccgctgctgctgtttcatcttttttcacagacggatatgctactcggtaagcccttgtggcatttaagtcaatcaaatattcattcgcaaatatcttctgtttttctgtcactcggactcaccttctttctaaaaacacgtatgccagcaccttactagacagccggttgccgcctgatagaaaggaggttaacaaataccacaacttgtgttaactatggattgcaggtgctgtacattgtgtcgtcaaattgcataagaaaaacaccctgcaaaatacagggtgtctctctaacaaaaaatatctcacgaagtaaaagacaaaaggatgtgctttcttctgtctctgctttaagttttaacacactttgagcgaacgtgaccgaacatttttaaattttttcaaaaatattttactcttcttcgaaaaacctgtttcttttcattctacagctattttccgtataaattctttttgttctggaaaatatctcattcatctgatgagccacttgattccaagtcagtccctcaatatagtacattctgaacatgattcgaatttcacttttcttaatagattctatgtattcttctatctgattcgtaagctcaagaagttcgtcttctttcattctcaagcgttgccgcctcgatatcaacaattgttttacctttgcgtgttctggagtaggaaaacccgtcactttaaaatgctgtattcctcccatacctccgcttactacatcgctcaccgctccttctttctcaatcttctctaatcgctcctccgtcatttttatgagtctccttaactcttttatctccgcttgcatatcgcagtactggatcaggactgacttttccaacggaatcacctctttcctgctatctataaatcttgcctgttttcttatctctgagtttaatccgtccaaatacttcaaattcatctattgccgctactgctttcatagcattaattgttcttgttaccgaatctggcggcttatccgctgccttaatcgcatcatgtgctgttttgtctttgtagtgttcgtgatttcgtgtatccattttatcgtccctttcttttactttacaaataaactggttattattccttgtgcataatggtttttcaagtatctcttatttttcatgttattttgtaaaattatatgtgttcatgtggtctgattggttcccagtgtttttcagcatcttgttcgattaacctattgtaccgctccacgaactcttcttcgcctatttcacatttcatgaacttctctgccagtcccatataggtatccgttttgattgcatctatccgttctttaaattcgttcgtatctatcttcccgacaataagcatatcttgtagtattctggattcatggttcataggtcgcttactacctttcctcctcttgttttatatattttgcatttctaaattcaataatttccagtgggtcaaagtattctttgcacttcggacatctcggaagcatattttttctatacgattcttccatctcgcgaaacaccctgctcttacgcattctttttagctctttatttgcttcttctgaataaaattttactttttcttttaatcgattggtttcttctcttagttgctcatgatatcttgcgattgacaacattgcctcaaatggatccacaaccgctccgcaatctctacacataataattcgattttcaacactaagctcataatgtggaggattgcatgtacatattttcttcattccattattgattcttaataaatcaaagctgacagtttttttcttatccatccatttcctccaaatagttttttccaaagaacttcataaactcttctcttgtatgattctgttcaaaggctttttgtccatcctggcgaagttctctcattaattctgcgttgttgtgtaccgcttccttaccgtttatgtgatggtctaaacataaatagacttttaatccttctgcttccgatttgtctctattcgaacccccaaagatgtgatgttcatggactgctttctgccattcgtagtgtggccgcatcttcatgcatagatagcatggacttcccttctcttggagtatacttggtttatgtttctttcgtcttttcaatttaggtctcctttctcctccggatttattccggaggaataacaatggcatatagttcacatggaaccgttgacaagttactgtgtaatgtgtaaacccttagagggtgtccagctatttttccatttcctcactcagccagttttctacgtctgtaatgctgttaaaggttaggtggcggctcttgtatcccaaatgtaataattcggccacttctgggatagacatggatttcattttttcccaacggatgattttatcctcttttaaaactgcttccttacttgggattaatgcgggttttggcgatttttgcgccggcgcaattacttctttttcggtgttctcttccggctttctggtatcttctccggttcccatgtcattttttctggctcctgtgccattttctccagcatttcttctctttccaataacatctcgttcattgttttctctgtcttccttaaatccatctatagtacctccttctgactcgtacttttctaggattctagccgttattgcggtaaattcttcccaggatatttcttttgctaccccggagtattttttgatatttatcttgctttcgtggaacaggataaaccagataccctttcgaaaagaccggctaccgcttggagcgattaactctcgtaaggctttggggtcatcttttaccgttaccgcttttcttacaagttcttgagatatgtagaagtctctgataagctgatctatgtcgtcatccgctccctgttccggatttgacttgttaaaacggttcaactctctaatgtcttcccggctcgtctgtggggtgatcatgtttaagtcggcatcaggaagagctaacatggctgcaagcttactttggccatattctaaaaattccggccggagttcttcagaattgccgcctacagaatattttttgtttatctgaatgaatcttgttgtatctgacgaagataagtcacattctgctttcgcaaattctgcgatacttttatagccatcctgcttgtataattcgttatcatctattttgcgcaagagatagccgatacggacaaaatctttcttcaatccgtttagcttgtcctttgcggacgagatattctgttttaatttctgtttgatatctagccactctgcgagtgtcatttgtttatattccatattgcctcctatactgccgctgccataatcggttgtttcattgttttaagtctttttgtatatttgttcagcaacttctcaattacttttttatctggctgtctatcaaattctgaataaaactgtatgatcttatctgtttttaggttaatttccactgtgtaatatgctttttctaaatcttctttcttacgaaggaataaaatccacgtttctcctgctgccattttcttcatgtagatatcacttgctcctacacaatgatgaagctctcttccttctttcattagctccttgcacttaccggccggaataatcatgtaggtatcatcttcatagaaatatccttttacttctggcaggcgtttctgtatctgcttatctaattctgcatattcatttagtctttctttatctttcttttcatttctacgctctactaactggtcatgacgaagttttaagtctttcgggaagcgaactatgctatctcgtgtgtcgtatccttctaagagtgccattcggaggtaatctctccaggttgtgatcaccttgcttggtgctattttttgtttttttaaatagttaaccattttgttgacacttcctaaatcattcaagatttctttgcattctgataaggtcattttttttctttgacagccactccaagctttccttggagatcttaatcccctgcttctgctcatattgcagccattctaattcattaactccgccatcgatctgtttcattcgatttacgcgatttccatctacccttaaaagttcttttagatttctggcctttgcagagtgtattgaaagttcgccccaccaatatccactacaaagttctgtcaccagttcgtataatccgcttttcactagatactcccaatatcgtcttgcatgaaagcacatgatatatctattcacgtagaatttctttcctttatctgcaagaatatccatcccgctcctctccagatttccacatggcaaaacttcctttagatttcccggatatagatatgaaggtgaaaatcgttttccggccggattcttatcccagaagtcctgttcaaactcatctgcattattgatcgttccgtaatagacctttccgtatgtttttcccattggaataagtgcccgacattgttcaaataacttaatctctttccctcccttgctccagcggcatattgctttaaattgtcgttctacccatctatcattacatttctgcaatatcactactgaagtatgttcaactttttgcttctgacggttatttacagatgctacttgattgcacttaggacagtggacaatctctttatgtttccatttttcctttactgatccgctccttttgcaggcagtacaggtatatgccgttcccttaccttctctttttgaaaataaaatgtgacccggaaatactttttcatccagccaacgttccatgtcttctgtgacgcaaggaacgtctgacatttccttttcaatcctttcagactttcttttattcgctcttgctctcttgatttcacttaaattagtttcataatcatcgacatcgcatgaatccaagaaatctgttactctttgtttatcctcttttgtattccagataaattctttgttgctccaataataagcttctttttcaacaggtaagttcttgcacattcttgctacattatctaacctgcaggttgtccatttatcgttaatccaggcataatgattttcttcgtctgcgaaatagcgggcttttaattgatttttataatacaggctaatttctgcggctttttcaccaccaacttccagaatccggctttttgctattacttctttttcgctcttcacatctgacaaagtgcatggaggtattttcaaaaactttgctcttttcacgcccttttacctcctaagtaataatcaagaatgatttcttttgccttacccatgttcggaatgccaagagtcactttactgttactcactcccgccatttttaacatttccttctcaatcggaacttgatttttaaaggaccatttgagtattgtcgctatgcagccttttaaacttttacctctttttcgtacctggtgagcaagtaaatcattctctgaaatctgtactcttaggtactccacccagtcttccatgattcccttcaatttaagttctgctacttccacatcgatctttccgtacgctgccgtttcggcgtcacatagttccatgatgtctcctgatagatataactctacgaaatcttctgcgatgccgttttcttttgccatctctttcagacttttaatgtctccctcgttaaataaattttctgcaagggtgttgatctctttgtagctgctcatttccccaaatttatcaaacatctttcttcatcctttctatcatccattttgtgtaggtatgtttgcccggttcggacaggagcaaatgattttgcgcaatatcgtgaagttccctccattgatcagcgttgctcaccggttccccttttgatgtgagatagccgttctctgcccagttatccacattgttttccagcatggacaaaatatacacatcctctgtgtggatatgtacttcacttggttttgtgagtcttttcattgcttcgataagcgcacgaaggactatgctgtgatacgttccggccgcttctccgaacttttcctttgtccatggtgtccctctcaaattacattccagtacatatccgtactttcttgtacatgacttcggggctttactatctgtccctatgtagatatgtacttccatctcattccctcctctttaatttcaacaaggtatattctcggtaaggatagccagtaaatggattgtttccctcgtacaccgattcctcgtctaagtaatatcctttcggaatcctgattttattccaggttttccatcttacatatgtcttcttttttggttctggcaacggaagattccttgatgtggaatagcttgtctccctaagacgcttatccgtttctggtgtcttggtaagataggctgctaaatctttaaactcacctttctcatatgtgagctggcaaattactttccctttcttccatgcctttcttaatatcaaatctgtgtcaggtattctgttaattaccaagtgaatatgccacccgttcttgtttcctacctcgatgtttcgtatccatctcacttcatgtccagcttttctatattctctacggattactctcatagcatctgaaaaatctttctttgcttctgtcatatcagtgggacgttcttctcttttgtatgtaagacacacgaagtaatcattctctctgaaatactttctcaatcttctccggcaagttttctccttgttctttcgattgacctcttgcatttgaagaggggtaagcttctttttcttttctctcttcattcctggggaacggtacttgtaagtgtgtctttcttctacctctatcgcattctcaaattcatatatatttttggtataactcatatcttttggtcctatctttaatacgtttatcaagctttatacgggactttcacccgattatttcttgacattttaaattgcagatagtacactctagatatggttttttaggcgtgtaccatcttggtatttgcttaagaggagtcaaatgtttggctcctcttttttcatacaatcacataattctgtttaatcactttacttctttgttctgcataactttctacttctgcttctgttccatggacgcactctaagcttccatcttgccagcgaattattttcactggatttcctttttgtttatttttcatattccttcatcatcacaagcacatttcctggcgcgtacttctggtcacctctatatgggtcattatgtgccaggacattgatccagctcacgcatacccacagaagaaatagaaaggatatgattgctatcgtatttcctatgaacttcttcataacaacacctcattctttggccaactggtcaaggtaatctatgcagtcattgtattcctgcatcgggtcgccagcataagtttctatttcaaactgtttatcccattctttttcctcagagatttcgcccttcatagcaattacttctgttgagcagttactatgtctaaaaatgacatagtttcccgcctgctgtgctgcatatactttttcaagcaaaagcttaatctcttctaatcccaaaaaacttttttcttctgtggtcataattttctccttttctttttcctcatcgtgaggtatactttaagtggtttatttgctatgtgcccgatcgggagttgccgctctcgcaggcacatttttttatttgagcatcctgatccgctttccgtagccacaagacgcagctatttctgctggattataatccggaacgtgctttctcattatcgggtcttccaagtctttgtgatacttgtcgtaatctatgtaggcatagatatttgttccagaagagataatggcataattaccatatctcttctgttctttttcaatccctacctttctgcgatggacagtccccagagaaacaccaaatgtctctgcgagctgattgtttgagtaatacatttgtccatgtacaatttctaaaagtgccataccttccatgcggtccacctctttttcaatatttttattgacatttttttacatttcctctattatattgttacaggatgttgctgcattcgagtacgtaagaaaggagaccttaaatatgcaactaaaccctaactgcattcgtgatattttaattgcagttgaagcacacagcgatttttacacgcgagctaagtacaaagttgaggacccattccccgaactttcctcttatgctcatcctgaaattctgtatcacatccgtcaatgtgaacaatctggactgattcaagaagtacattactatgacaacggaaagcacactgacatttccgatctcactccggcaggtcatgaatttctcgccaatattcgtaatgattctgtttggaaaaaagtaatgtcaaaaggtgctggtgcttctttgagtatccttatagaacttgctaagcaagtagcctctgcattttttcttggttaaggatactttactttcatctttatcgagagttcggctgtgccagagataactgaactctcgattctaatttcttttacatgatgaagtaatttatcatccagatatacatctgttccctctgtggtttcttttgtatgcaagtgaataagattctctttgtccattgatactcctaactgctcttgcgttctggttcttctgtttcgaataaataatctaaagtctttccaggaaaagctttatgcttaatttctatcatttcacacaatttaaattctgttatccctctaaatttcaacttaagggtttcataatttatatttgtaattcttgatagcccctttattgttaatttcgctctggccatttctgcgttcaggttcggaaacatctttctccctccttccttttaccctgtagggtaatttatgattctaatatatacgttgcagggtaatttgtcaacctgtaaattatatttttttactttatggggtaattttttactttacaaagttaattttctatgtataataagagttaacaggaggtaagtatcatgtcatttactgataagttagatgccttaatggcagaaaagggaattaacaaatctatattgtcaaaagaatccggtattccatatacaaccatagctggcttttatagtaagggaacagataacgttaagctttcaacattaaaaaagctttcttcttatttaggatgttctattgattatctagctgacgataatcaagatgaagcatctaccattgctgctcattttgacggcaacgaatatacagaagacgaattaaacgaaatccgtcaatttgctgaatttgttaaaaataaacgtaagtaaggtaattaatgcaatatgctagagtgggaggtgtactatgaatacatatgagaagttacaagatgaagcctgcaaggacggtatagatgttgttgattatccatttgaaagtaaaaatatcaaaggattatattgtgatggagtggttgctattagagaaaatatcgatacaactgctgagaaggcctgcgttcttgcagaagaacttggacatcattacaccagcgcaggaaacatattagaccagaaccaaacagaaaacatcaaacaggaaagaaaagctcgcatgtgggcttataataagcaaattggtttatctggtatattatctgcttacaaatatggctgtcgaaatttacacgaaatgtcggagcatctggatgttacagaaacttttcttaaagatgctttggaagcatatcatttaaaatatggaaaatgcactgtaatagataattacatgatattttttgaaccattgggagttgtagatatgaattatggaattgaataaatttatatatactatataaattattttctctttattgtataatattataaaaatacatataggaggattgatttaatgaaatcacctacaacacgaatgcttgtcactatatttcttggtcctttcggagttcataagtttatggatggaaaaatcggtatgggatttttatatttctttaccataggacttttcggaatcggatggataatcgactcttgcagtgccgttctagcatggtgtaaatggatcatttcgcctaataaacattctatgaactattcttcatcttctgagcgttatcatcattcttcatatcactcagagcctgaaccatactacaatttaaatcagccattcgacaacatggatggacatacatttgaacattattgtgccgaacttctagctcgaaatggttatgataatgtagaggtaacaaaaggtagtggggaccaaggacttgatattttggcatataaggatggtattaaatacggtattcagtgtaaatgctattcgtctgatatcggaaataaagctgtccaagaggcttttgctggaagaaccttttataactgtcatgttgctgttgttttgacaaatcaacattttacaaaatctgcaaaagaattagctaaaagcaatcaagtattactttgggatagagaaaaacttgaagatttgataaaaactaaggaggaaagatatggcacttattaaatgtgaagaatgtggaaaggaaatatcggacagggccgtagcttgtccaaactgtggctgtccagtagaacataagaaacaaattgtgaaaaaaacttcccacacaaatgcggatggcaaacgtaatatgcctgctatggtttgtttattcatctctcaccttatgggatttgcatattctttatatagtattatttattggagtaccgctacgagtggtacatccggatttgaaaaagttggtgctggtattgcaacttttctagttgttccccatgttatcgttgcaattatcgcgacaattttcaattttgctgctttatttgcataccgcagaggactaactttaacagcggctatcctttatgctgtttctgctgtactgtttcctctttactgctattttgtaatgatacaatctgttttatgttttattgcttttgctttgatgaaaaagcctataccgcaacaaaattaattgtgccggcacaattcaaaaattaaataaaaagtccagtgctggtaacaccggactttctcatagattacctgtcaacatggatgctgacgtataacctaacctcaacaattagattataccacagcatccgattttttaacagggtgtattttttatacccatttttatgaaaggatgatgtatatgtggactgagaaaacaaagaacggcaagttcaagcatgtagaacgctacacagacccgataacaggcaaggaaaagaaggtttctatcaccacagagaagaataccgcacaggccagaaagtccgctcagcgagcacttcttgcgaaaatagatgccttgctggatgcaaggactgtttctaatatcactcttgccgaacttagagaaaaatggctaaccgacaaaagaagacgctggaaggagagttcttatatctctgaaaaacggaacagtcataaggttgtggaaatgttaggagcagattgtattgcaaacaagcttactgcccgttatgtcagggagcatattgttgatcctggcgaagatcttgaacttgctgccggacgaatctctgtatttaaaagaatgataatttggggatttaaaaatgattacatcgaagataagtcttacttggacaaattggaaaagaaatctcctttcgaaggtaccgatgaagacatcgaacaaaaatatcttgaatctgacgaagttgcaaaacttcttaaagaaatgaaaaaagaaccatggcgaacacttacccgcttcctggtccttaccggtgccagaattggagaagctctttcgcttacagcaaatgatattgatctgaagaaccgctatattatcatttctactaattatgattacataaacaaacttagcagttcaccaaaaacacgctcttcgaagagacgtgtgtacattcaggatgagttatttgctctcgcgaaagaactgaaaaaatgtgcgctcgcaaataagctcatttacggaaatgatctggtttttcagcaggagggaaaccctctggcctatcctacctatcgttaccagttaaaccaggtatctaaaaaggcattagggcgcacgatcacccctcacacccttcgtcacacccatacgtctcttttggcggaacagggtgtagacatcgaaacaatctcccgccgtctcggacatgaagattctcatattactaaaaagatatatcttcacgtcacaaagaaaatgcgagagagggacaaccagcagatacagagcattaaaattctttaaaaaccatttctgcccctttttgccccttttccatatattgcagattccgcagaatcgctaatatctactgtttatgcggatttcagcctgcaatatatggatgttacgaataaaaaaacatttttttatattttttttgaaatttacgtagtttttacgcattttttcctgctgcatagcctgttgtccatgcaatctgcagattatatccacctgtaacggcatctaaatccataatctctccggcaaaaaagagatgttttaccttctttgattccatcgttgccggattaatttcttttacattcacaccgcctcttgtgacgattgcttcattaaatcctcttacaccgctgatatgcatctcaaaattcttcataagttcaatcatgcgtcttctttcttttttgctgatatcccttatttttttatcctctggaatctgtgccgtatcaagaaagactggaatcatctttttagggagaagacgttccattacatttgaaatatttttattacgatacgtatcaaattctcttaaaaaacgtttgtctaactgctccggtgtaagagaagcttttaaatcaagaaacagtttcaattctcctgcttctaattccttttgatacttgccaaggcaggtgcttgcagtaagaacaagcggaccactcactccaaaatgtgtaaacaaaaattctccaaatccttcatagattgttttcttctttgtttttatgcgaaccataacattctttaatgtaagtcccatcaactctttgcaccagttctccttcatttcaaacggaacaagggatggctcgatggatttaattttatgtcctgcctgttttgcaaggatatatcctgccccatcagaaccagtagatgcataagaaaatcctccacaggcaagaatcactgaatctccttccatctttctgccatcagacaaaagtacacctacacactgatctttctcttcattaaaaagcagttcttttacctctgtatgataataaatctttactctgcctttctcacactctctttttaatgcctgtattacatcagaagatcgatctgactgcggaaagactctctgtcctcgttctgtttttacaggaagaccgattttctcgagatattctatcatatcttcattattaaattgtgaaaatgtactatataaaaaacgaggatttgttactacatgcgtaagaaattcctccgccggacaagcatttgtaatattacatctgccttttcctgtaatgaaaagcttcttaccaagcttctcatttttttcaagaatacataccttctttcctgctttagacgcagaaatggcagccatcataccggctgcccctccacctacaataattactttgttcattatagtaaactcctgttataaacatcatattcgttccagagttcctcaagagccatcaggcgcttctcaacatcttctttacgaagcagtgcgattgctgtaaccatcgcatttacaacgcttaacggacatacaagagaatcaacgatcgtcatcacatcactctttgcgattagtttacagtccgcatactctatgatcggcgactgcatattatcggtaagtgcgattgtctttgctccatgattctttgcatactgaagagcacagattgttcttttggaatatcttggaaaagtaatacccatcataacatcattctcactgatatcataaatctgctctaatgtctcagaggtactgttagcatccacaataattacattgtcaaataacatcttaaagtaatatcccatcaaacctgcaagatatgcagcactgcgcgcgcctaaaatatataatcttcttgcatcgttaataagcattaccgacttgttaaattccttttcatccaccccactctgaatcgtatctctaagtcgttccgcatctgtataaagaatgctctttaagacacctttttcctgatatctcttagaggaaagagacatcctctgaatagagtttgagttcgtctttacgataacctgaattgccttctgtaactccggatatccttcataatcaagctgataagcaaaacgaactactgttgattcactgactcccgcttcctttccaagcttggatgcagtaagatatgccgcaatatcataattctctgtaatatactgagccagccttctctgtcctttactaaactcagaagacttctgctcaatcctctgtaataaatttaaatgttccactctattactccacctattctgtaaaattaagtatatttcataatactccatttttctgtttttgtaaagcaaaatgaaggatttaaacaaaaaaattgcaaacaggaatcgttttttctgtttttgtaatttagcaaaaagttttccaaaaagaaaaactgtgtttccgaaaaacttcggttgcacagttttcatttcttaatgattcattactgattactttccaggataagtgataacagcttctacatcatagccttttaaagcatctcgtccatgcagtccctgcagttccataacaaaaagaacctttacaacaacaccgccaagctgttcgatcaaatcaatcgctgcttttgccgttccgcctgttgccagcagatcatcgacaaatacaactctctgacccggacggatatcttctttatgaatctctatttctgctgttccatattccaaagcatactccctgcttactgtctctcttggcagcttgccctttttacgtacaggtacaaaccctttactcttattatatgcaagaggcataccaaataagaatccacgagattccgctccgacaacaacatcaaattctgttccctcaaggcagtgcatcaattcatgtacactaagtttcaatccttctggatcacgtaagattgatgtaatatccctaaaaataattcctggttttgggaaatccggaatattgatgacataatcttcaagtttcttcactttgtccaccctttctgcccgaaaacaggcataaaactactacttttttcttatgttaattatagcagatttttcacacaaaaaacaacaaaatctgcatatttctattatctttctataaaacttatgacaacaagatcatttgcgtcctgatacaatttatatttgtcatttgccttcgtaatttcatttttattttagatgtcaggatcaacattttactttaaatcacaaaaatattcgatggcatatgccaccccttcctcatcatttgtctttgtgacaaagtctgcaacttcttttaaagactcttctccattctccatggcaacaccgacacccgccatctttaccatttcaaaatcattgtttccgtctccacatgccataatactttctaccggaatatcaagaatcttcccaagatgtaacatcgcatctcccttattgcatgttgccccgttaatctcaagattatttccaagagagcaggtcactgccagatcttttatctctctaagatccttaaacgctctttgtctgtcttcttctctggcaaaaaacatattaattttttcgaccggagccttattctctttcatccacactctcagatcatcaattcggttacgtgttgttcttactaggttttcaatatgcttttcaattccataattgcctacattatcataaaaacgcgcttcacaccatcctgttcccaaagcatatacatcataaaatgtatgataagtttccagcacatcaaatagctctaaagctcttttccatggaatacaattttgataaagtactttatcttctttcaaatccaaaacacttgcaccatttgataaaatgacatatcgcattccttcaatctgtgttaaatactctggaatacctgttttcactctgcctgtcgccggaaggacctgaataccttcggctaagcatttttctagaacttcctttgtatgtggggttaataccttttctgaagtaagcgtagttccatctaaatctaatcctatcaatctgacatttttattcttctgttccatacatctttactcctttactggtgtttaaaacgataattctgaataacaatctgaatacttttctgacctctccactcattaatctgtggataataggttacatccatccatatatgatgtggcaatcctctttgaactctttgtgcttcttcttttccgcaaaaacaagaaagttcttctaaaaaaccatccgattctccaaaatacattgcttctatgttcgtttgacttccatcagaaagaaacagtttcaaacaccgaccggttgttccaagaacacacatcccctttatgtacaaatctttttgcgcaaacaacggttttgtattttcatttccaaacggttctagcaattcaaattctttaatcaggctttctgacagatacgaaatcggtaatgctacatcaatatgtactttttctacaaaatcctcttctgtaagcgtagtattcgtatttaatttctcccggaattcctctaacctgtcttcctgcatagaaagaccggccgccatcggatgaccaccaaatttatcaaaacattctttgattttattcatttcctgatacatatgatatgcttcaattgatcttccggagccttttaacccctcttttgttcttgtaatgacaaaaaccggtttgtgataatattccttcattctgccggcaataattcctgcgatactttcatggcaatccggcagatatacaactagcactttatcttttgcatgacctgtactttccagatatgcttttgctgctttcactccatccgcagtcatctcttttctttctgcatttaaagcagtaagtgcttctgctttctgtctgcagatttctttgtccttgcaaagaagaagttccaatgcctcctttgccgaagtaagtcgtccggaggcattaatacatggtccaaggataaatccaaaatgataggaagataacttcttatcttcaagatgattcgcctctatcaaagcctgcagacccacaatctctgtctgcctgattcggcgcagcccttcctttacaagaatccgattttcatcaaatagaggcatcacatcacaaaccgttgccattgctgcgatttcaagaaatgcctcgctttctttttgatcaatctgaaacagatcataaagcacctgaataaacttatagacaaccactgctccacatatacttttaaatggataggaacaatctttctgtttgggattaatcacagcagcagctggcggaagtagataggttatttcatcattttctttttgaaacggaatatcatgatgatccgttacaacaatcgtcaaacctaaagaattaccataagcaatctgagccgatgcagcaattccattatcacaggtaataatcgtatcaatcccatcctctgccgcctgctctatcagatgctcattaataccataaccgtcttctacacgatctggaatcttataatccacatctgcaccacagcgtttcaatccctggtataaaatatagtttgaagaaacaccatcgacatcataatctgaaataatacgaatctttttccctgcttctatcttttcttttatgatttccgcccctttatctgcatcttttaaaagatgaggatcataaagatccgacagggaaccatacaaataacgctgcatttcttctattgttgttaagtccctattccgcatcagacgtgccgtcactggactgatatgaaatacttctccaatcttattaaaatctgctctttttgaagcgacaaaccacttttccatttattcctcttcgccctctgtatctgctaatgctgccttaatcataattgcgcactctactcgtttacgttccatatcacagctcagatcataagaatcatcgattgttccatggaaattataagaatttgcaggacatccgccactacagtagaatcttgcaaaacactctttacatttcttcttggtgtatacgttacaggaacggaattcatcacaaatatctgtacgtttaattccatcaaaaacattaccaagaaggaacttatcttcccctacaaactgatgacatgggtataagtctccccaaggtgttactgctaaatactctgttccacttccacaaccggaaagtctctttgccacacatggtccgcctgtaagatcaagcataaaatgaaagaaattaaatcctcttccctctttttctctctgaatcatttcttttgcaagtctgtcatactcatcaaaaatctgcggaagatccttttcctgaattgcatatggctcttctggctgtccaacaaccggctccatggaaatctgttcaaatcccaaatccgcaagatgaagaacatccttagaaaaatcaagatttctatttgtaaatgttcctcttacataatatttctgctgatgtctcgattctgcaaagcgaataaactttggcatgatcagatcatagcttggcttgccatttcttgtaggacgcatatagtcatggacttcttttcgtccatctacacttaaaacgacattatccatctctttattggcaaattccatcatttcatcatttaaaagaacaccatttgttgtgaaagtaaaacggaaatgtttatcataatctttttcaagagaacgtccgtactctacaacttcttttacaacatcaaaattcatcgttggctcaccgccaaagaaatccacctcaagattgtgacgattaccagaatttttcacaaggaaatcaagagcagcttttcctactttagcgctcataagctcacgatgtcccttatattctccctcttctgcaaaacaatagcggcaggcaaggttacaatcatgagcgatatgcagacaaagagcctttactacagtctttctactcttaacttcgttaatgtactcttcataaatatcttctgtaaataataaaccttcttcttttaaagaagtcacttctttatatgcctcttcaatctcttccttattataggtatcagacaattcctttttaatttcctctaaattcttttcttcatataaagcaattacatcatatgtcacatcatcaactacatggatcgcaccactgcacacatccataacaatattatatccattatttttatactggtgaatcacgttaattatccctttctactctcttacttctcttctatatgtgatatcctcccacctgtaatggcagaagaattcttatgatatttatcaaataatcataaagtgatcttaggaaaatacttttccatacaagattcccatacaaaatttttatataaaatttatattataaaatttctatacaagagataaggtgaactgaccgcaaagacagttcaccctacttcaagcatatgtcaggaagcaatcttcctgttgtgctttttaattatttattactctcgcaagtctggttacctactgtacaagatgtcttgcaggcagactggcaggatgtctggcattcaccgcatccacctttacacatggtagtaccgtatgtcttgtttccggtcagtgtctttacacgtttcattaataacgcctcctcacttcataatctagtatgcaaagcatctaagatgacactttgtaggttattataacacaaaccctcccgtaagaaaagacctttttaaagagacctctacttaactcaacattcctccaagcatccctccggctgcacaatataaaagtgtcgtaaaaaatgctgttttatctgccataaaaggctgccccattcccacacgtatcactgaaaaaaacaaacaatataaagcaccaactcccagtccccataaataccttttcttcgtatttttctttccgcaaaaaaatccaccgacaaagcaggcaataacgctcattacaatcaggcctatcttttctacagaagcagataagcttccctttaacatagcaaatgcaaatacagccagaaagagcattgttagcaaaacagcaattataacagacactagcactcttcctatcctatccatccattttttataagaaatcccgtccatgtatctccgtacccgaatatttttatacagtgtatgaattctatttttatttagaacaaatcatgataacaaatactgtgtcttagcacattctcttactctacgtaggagcgattttctataaaacaaaaagagctgaagacttatcatcttcagctcttatgcagttgacgggacttgaacccgtacccagtcagcccggactagatccttagtctagcgcgtatgccaattccgccacaactgcttatcagcgaatctcttgctcaccaacgaaaattagtataccataacattacttctaatgcaagtatttttttattaaatttcatatcatatttttatgataaaaacaaagagctgaaaactttatgtcttcagctctcatgcagttgacgggacttgaacccgtacccagtcagcccggactagatccttagtctagcgcgtatgccaattccgccacaactgcttatcagtaattatctctcactgacaaaaattattataacacagttttttcaaattgcaagcacttttttaaatttttttaattttttcaaaatttttaactataagtaaaataaacttacccttttcatcttctatttctggcaaattcaagtcgagccgctgtcactcaccacctgaaagaagtgggagtcttctcgactgagataaaaatcccctgtagcagatatgatattcatacaattaaaacctacttaaacttttaactgtatctaatttcccatctgctacagaggactttttatttttcattttctgatgagtctgcttccgttgtatagtcatttaaatactgaatgtctgtcgtaagataaagtcctttatctgtaatataagcagattctccgttctttcgtgtaaccttgccttttacctgtactttatcaccaacataaacagactttactacattatccgcctgaaaatccgcccatttacgaagtcttactccagtggaactaatatatgtaatagctacatatccttccaatttctcataagaagcaagttcttccatgtacttttcgctggcatacaaatacattccatttttcagatgataatatgttttatctttatatgttccctttttgcttgcccaaagaatctgcccactttttaaataagtagaactattttctttctttcccggtaattctgatatatataacccttttgcaggcaaatcctttatcataatatagccagccttaaatgatttatccgtttccagatattctttatgcgcatcataatcattctttcgttcttctttttgaacattcgcacccttatactctcttccgctcaaaaaatatcgaaacccaaaaataaacagaagaacagctactaccaataccaacgagaaagacatcgacagaatcatcttctttaccgataccaattcctggtcattttctttttttaccataaatcattaattatcccactttgtcagatcatattttttgataagcgttgtcagctctgatacatatcctgaccatgtacagtatccgcctttttgaagaatcgtaagctgagaaaaataactctttgtgtctgtaagtccatcatatcgtcttctcgcaccattcatagcgttagaaagatatgcagaatgatcagcgatagactgtgctacagaaggatatttacggaacttcgcagtaatagtcactttctttccgttatactcttctctcgtcttcacttctacataacttcttccatcccacactgatcctgaccagctattaccggaaagagaagttttcataccgaacatattgttggaattctgtgtaagccctgacttaccccagccactctcattaattgcctgcgccaaagtaacagaggcaagcacacctgtttttctgtaatcttctcttgcaatcggtcctactgcattaataaattcctgtgtactcatattcttaaaagctgttgcctgaagacctgtattcaccgccggttcattcacaatcggtgttgatgccggtgcatttgttgttgttgtatttcctgtcacatagattgcctttttagatttgttatatgtataatgaaatcccagttcctcaaaagcaactcttgccggaagcattataagactagctccccctatctttgctttaacaggagcggtacgaattctctctttttttccatttacttttatgtactttttatttagataaaatcttactcgatttccattcgcagaaagcgttatcgtctttcctttattcgcttttgatacagacacttttggtcctctttttaccattgtataatgatatggaatcataatatttccgttaatcatcaaagatggtcttgttacactattcactctcttactattataatatactttataattcgcacctctgtagcgaacagtacgattacctgttttataagtaactgctgctgctgcacttaacgagctgaatgccagaacaaacaccattaaaaaaattgcagcctttttaataacctttacatttttcataactatctcctcccttttagaaataaaaattaatgttatttaataaatggacaacttttttgtaaataaaaaagccagcagataatatctgctggccttaaccttcattatgctaatttgctctttgctaattctgcaagagctgcgaaacctgccggatcagcgattgccatctcggaaagcatctttctgttaacttctacacctgctaactttaagccgtacatgaacttgctgtaagaaagtccgttcattcttgctgcagcgttgatacgtgcgatccataactgtctgaactgtctctttctctgctttcttcctgcgtaagcgcttgttaaagctctcattacggactgtttagctactctatactgtttagatcttgctcctctgtaaccttttgcaagcttcagtgttctgttatgtcttttctttgcgccaattgcgccttttactctagccattaattacttcctcctatatacgattaaagatatggtaaaatcttcttcatgttctttacgttagttgcatctgtcattgcagcttttcttaaatttctttttctcttctgagatttctttgttaagatatggctcttgtaagctttatttctttttaactttccactacctgtctttttaaaacgttttgcagctgctctgcttgttttcatttttggcataatattagtcctcctaatttctaatcttaattaacgtttttcagttaaaaacattatcatacttcttccttcaaatttaggctgtttatcaacaacagctatatctgaaagctgctgtgcaaaatcctcaagaattcccttactggaattcacatgagcaagttctcttcctctgaaacgaagagttacctttactttatcgcctttagaaaggaactttcttgcctgattgatcttggtattcaggtcattcttatcgatattcggtgaaagtcttacttccttcacatcaatcgtcttctgctttttcttagcttccttctctttacgggcaagctcatatctatattttccataatcaataatcttgcacacaggcggctttgcattcggagcaatctttacaaggtcaagttctgcctctcttgcaagcttcatagcttcctttgaagacataattccaagctgctctccattactgctgataactctaacctctctgtcacgtacctgttcattaatcattaattcgttaatagtagtacacctccataaaaaataaacattagtccggcaattcaagtacaccttgtgcccaaacacccatgaaaaacatagaaaaaatggacagtcacaagaccatccacaaaatatctcataatccctgtcaaaacagttcattatatatacgatattaacccgagtcaccatacgtgctaaggtgagagtggatactctgcttttctgttactcaataaccttaattactatagcattacccagacaacatgtcaagtcttttttgtcacttttttaaattctattcatctatcaagacatttatgtcttttacaaatccagaaccagctctttttcttctttctggtactgcctgtaagtaattcctaccatatcaaacattcttttcgctgcgatcgtagaatctgtatccgcatacttatcagaatagtagattacttctgtaattcccgcctggataatcgccttagtacactcattacatggaaataaagtagtataaatacgcgctcctcttaaagaaccgccactataattaagtatagaattcagttccgcatggcacacatataaatactttgtatcaagcggagttcccttccgttcccatggcattctgtcatcactgcatcctgtcggcattccattataccccatagagagaatcttattatgcggatcaacaatgcaggagccaacctgcgtattattatccttacttctctgcgcagaaagaagggctacacccataaaataggcatcccacgataagtagtcttgtcttttcatcgcttactctcctgtcctcgatattttctttaatcataacacaaaaagatttataaaacaatcctgatctgtagatttcaggtagacgaaaaaagaaatcatcccctatcccatctgctctgtagtcgctgtatttaagatgctcatccgcatcttaaatacgctcccaagccgcatctgggataggggatgatttcttttttctgattactgtaaatccacagttggtgaaaatggggaatctccaaaaggttatggattatcggggaattaaagcctaaagaattacctcatttcttctggaagtttctaattctcttttctttactatactttccttacaatttagcaaaaagttctattacagtgcctgcttaaccttattctgcaaatcagtcaaaaaaataaacgggggatgtccagaaatctacgatttttattcagataaaaactccagaagagaactttttttgtcgtgggatgtcatgtagaagtgaagttatcacgcatctgatacaactaatttccaagtatatacaacaatttgaatgtcaatccttttgaatttaatttctcggaaagtcataaccttctggaacatcccccattcttgcaaactatggatttagagtagacagaaaaaagaaaaactggcatatcccagatgcggcttcgaagcgtgattaagatgcggtttagcattttaatcacagcgactacagagcagatgggatatgccagtttttcttttttcgtctatacgaaatctatagttcagaattagtcgcctaatgcaaacttgtcatgtactgcatttaacgctctttctgtatatttctcgtcaatgagaactgtaacacgaatctcagaagtgctgatcatcttaatgttaactcctgcatcatataatgcttcaaacatagaagctgcaacacctggatgtgtcatcatgccggcacctacgatagaaatttttgcaacatctttttcttcgtcaatcttgttatactcgctctttggaaagctcttctggatgatcgctactgcctcatctgcttcatcttctgctacagtaaaggaaatatcctttgttccattacgtcctacagactgtaagataatatcaacgttaatgttgtattttgcaagggcattaaagagatggaatgcgattcccggttcatcctttaatccaattactgcaattcttgtggcattcttatcggctgcaacaccgcttacaagcatcttttccatgtttacttcctccctgacgattgttccttcgttattatttaaacttgatctaactactaactgtactccatatttctttgccatctctacggaacgattgtgaagtactcccgctccaagagaagccaaatcaagcatctcatcataagtaatctcatcaagctttcttgctttcttcacgtaacgtggatctgctgtataaacaccatctacgtctgtgtagatttcgcaggcatctgcattaagagccgctgccagtgctactgctgttgtatcagaaccacctcttccaagtgttgttacgttatcaaacttatcaattccctggaatccggtaacaagaacgatctttctctgttctaattcattacggatacgatctgtatcaattctctttaactgtgcattaccataacggtgtgttgtatgcatcgctacctgaaatgcattcaatgaaatcgccggcacacctaatgagcccattgccattgccatgagggatacagaaacctgttctcctgttgtaacaagcatgtccagctctctttttgatggtgtcggattgatatcttttgccatattgatcagttcatctgttgatttacccatagcggataaaacaacaacaacatcattacccttttgataatcttcgatacatctcttggcaacatttaaaattctttctttgtttcctacagatgttcctccgaattttttaacgattaacattctgttcctccctaagtctttcaatattctcatctattattttaatctaaagtcagtgtattccagatgtaatacaggaaaaccaactattaaaattactctttgattatatgcaaactattctacatatttttttataatcagtcaagacggatacggttaataatatttcctgctttttctgctgccgcattaaaggcactttctttcataagccctgtgataaatgctttttcatcaattccatccactgaaatcatctccactgccccaaatatattctgtatggtttcttctgcagtgtctgctggcattcttacaaaatattttctctcaaagtttccaagatcgcttaatgtaagtttttccggttcccaaagaattttaatattctttccgatatgttttgcacaatctataacatccgctgccactgcactggctgtaggaagctttccagctcctttaccataaaacattgtctcatctatcatatttccacgtacaaaaattgcgttaaatacatcttttactcctgcaagtggatgttcattatctaaaagcatcggacataccatagcataaaacttgtcatctgttttccagctgcttccaagaagtttgatactctttttcatctttgcagcataacaaaaatcttctgcagtaatttttgtaataccttctgtataaatatcttcaaaatcaacctgctgtccaaatgcgagagaagataatatcgcaaccttacgacaggcatcataaccttctacatctgcttccggatgaagttctgcatatcctttttcctgtgcttcctttaaagcttcctcaaaggaaagtccttcttctcccattcttgtaagcatataatttgttgtaccatttaaaataccactgactttttcaatcacatctgctgtgaggcagcgcagtaacggacggacaatcgggataccgccgccaacgcttgcttcaaataaaaagtttatgttcttttctcgagcgatcgcaatgagttctgccccatgttttgcaaccagttctttattcgaagttgcaacactttttccattaagcaatgctttttttacaaaagtataagccggttccacgccgcccatacactctacaacaacctgaatatcgctatctttatcgataatatcgtaatcatgaacaactttatccgcattcggatctcccggaaaatctctcaaatccaaaatatattttacggcaatgtcctctcctactctctttgcaatgactgcggcattggtctgcagtacttctactacacctgaaccaatcgtgccatgtcctaacaccgctacatttatcatctttatcctccttattcttctgaaacaatcttcagattattaattccatccgcattttcaattctatcaaaaagttctgccacatcatctgtaattggtaaaatcattacacttaacgttataagagcaatatgattaaccggtatactctgatgtattgacaaaatatttgccttacaatctgctacaacctttaatatgctggaaagcagacccggccggtcttccatttccattacaaaggtaatcgttttcccctgtatcttctcatgaataggaaagatatcatctttatatttgtaataagaactccgactgataccgacagcatctatcgcttctttaattgtccttgctttccccctgtttagcaaagcattcgcttctgccacttttaataatatttcgggcaaagctttcttttttaccatataaaatttagaactgttctccatattcttatctcctgcctgtaacagtcaggattcccttctcgtatttgttcgtctatgaaatacaaatgttttcacctcaaagatattatcatactattttcatccttgcaactgcttttttttaaaataatcttaaaaaaacaacttctgttacattctttttcaaaaacaatatcgtttttcgcattattttcttcatttattcaccgcaaaaaagaacaggtatcccgaccattccatcgatgatacctgctcttttattatattactctttttttgttaaaaacagatattataaactactctacaactacaccgcgaaacacataagcaatcaattcacaaaattcccaatactctggaaactcctccatatcttttaacgaatcacataaccccctgtaataccaggcctgctgcgctttgtctttcatattaaaacgctgccatagcttatcaccaactatttgataatctcgttttaaggaacgtgcatttgaaagcttatctgccaaagcaaccaacttcacatcagaaactttctcttcttttaatcttcttactgtattagcctttcgctcgttccaggtcccccccttttcctcactctcggctcttacaatctctgccaccctttctccaaattcctgacagagtacagaaaacgttacttctttacaatcttccaatgtgtcatgaagaattgctgctgcaatcacttccttgtcctgtgtcattcgtgagacaataacccccacctctaacggatgcacaatatacggaagctttgttccttttcgaaattgaccttcatgcgccttcgtagcaaatgtaatcgctttatcaaccatagtttatttaatattctccttttcagccgctgcttcttttaatactttttcctgagcatctgccggcatctgctcatatctgctaaattcataggagaattctccacttccacctgtcatggaacgtaaatctgtagaatatccaatcaggcttgccaaaggaatatctgctactaattcctgtcttccgccttctaatggattcattccaagaatacgaccgcggcgcttattcaggtcacccataacatcaccggtattcttatcaagaacatctactttaagatttacaatcggttcaagaagaactggttttgcatccatcacaccattcttaaatgctgtgatcgctgccatcttgaatgccatctcggatgagtcaaccggatgataagaaccatctgtcaaggttgctttaattccaacaaccggatatccagctaaaggtccctttagacaactttctgcaatacccttctctactgccgggaagtagttctttggaacagctccaccgaaaatcttctcatcaaatacatatggtgtttctaaatcgccagatggttcaaattccataagaacatcaccatactgaccatgtccaccagactgtttcttatacttaccacgaacttctactttacctcggatcgtctctttaaatgctacctttggttttacaagttcgatttctactttatatcggtcggcaagcttactctttacaatttcaagatgctgatctcctaaaccatataataacatctgacggttcgctttgtcattaacttcttttaacgtaagatcttcatccatcagcttcttaagagcagcggaaactttatcttcatcaccttttgtctttgtgacatagcggacaaatgtatatggttctggcatctccgctttctcaaagatgatagggttagccttcggtgataaagtatcccctgtctttgtaacagaaagttttgcgattgctccgatatcacctgcataaagagcattcacttcaatctgttccttacctcttaaaacatagagcttgccgatacgctcttctgcatctctgtttgcattatatacagcactatctgcctttaaaataccatctgtaacctttactaaagaaaaacggcctacaaatggatctgcgattgtcttaaatacataagcacttaccggctggcttacatcgtaagctgcgctcaccggttcatccgtctttactttaattccaacaaactgatctgtaacggtacctggtgcggagaaatacttcaccatatcatgaagaagaatattagcaccataatctgtattgattgctccacagataacaggcataagatctctctttgcaatagaagaaacaatcgctgtcttaatctcttcttctgtaaatggctcttctgcaaagaacttctccataagttcttcgcttgtctcagcaacaccttccatcaactgctggcgatactcatcaagctcttcattcacaccttcttctacttctttttcgtagtaagttccattcggctgtaaacgacactctaacatcttcgctgcattgataaatcctttaaattctgttccttccttcattggcatatggaacggtacaatcttgttaccataactttctcgaagttcatcaataatcgcagaagcatctacatgttcatcttctacgcatgtaatatatacgataaccggaatacctctcttcgcacaaaattcaaaactctttcttgttccaacttctactccggacttaccattaataacaatgatcgcgccatctgctacacttaatgcttcgtacacttcacctgaaaaatcaaagaaacctggtgtatctaaaagattcaccttaactccatctacctccagaggaataactgaggactgaatagaaaactttcttttaacctcttctttatcgtaatcacttactgtaccgccttctgttactgtacgaaccctcttaataatccccgttgtaaaagccatagattcaattaaagaagtcttgccacagccaccatgtccaagtaatacgacatttctaatactttcggttgcatatacgttcataatcagttcctcccatgttgtttaatcatatttgcgagattttcagctttatttttgtaaaattaatgaataattattcttgcatcaagaatctcacatgactattttactaaaaaactcatcattttacaagagtatttttggcattttgacacatttttttgaattcgtttaaattcatagaaaatcttattactatatccctctctccaacacatcttatcctcctcttctagaataaaacatagaaaaatcaacctgttttctaaatagttcaaacaattttcccttctttttccgattttgctttaacgctgaaaagtgttgacacgtttcctttttccatgtacaataaataccgttgagagcatcgtattatttactattttacggtatcagattttcaagaatgccccggcatttttgaacattcgtgatgctctaaaacttacattaacttacatcacttggaggcttcaattatgaacgcaaatcatatgacaatcggctttatcggccttggactaatcggtggctctatcgccaaaacaatacgaagaatacatccagatagcattatttatggattcgatacaaataccgactctcttaaagcagctaaagaagatggtactttaactcaatactttgaaacacttgattcaacattttcttcctgtgacattatctttctctgcgcaccagtttcaaataatattgaatatttaaaagaattaaaagatattgtttccgaaaactgtctgcttaccgatgtcggaagtgtaaaggaaccaattcagactgccatcaaagaacttgatatggaaacaaactttattggcggtcatccgatggttggctctgaaaaatccggatatgcttacgccaatgatcatcttcttgaaaatgcatactattttctgacaccaagtgagcgtacactgtttcaacttacaacaaagttttcttcctttattcagggattaggcgcattagccgtttctttgaaaccggaagaacacgattttatcacagccgcaatcagccatgtaccgcatattgttgccgcagaactcgtacatctcgtccggcgtgcagaccgaaacaacggtatgttaaaacagcttgctgccggaggttttaaggatatcacacgaattgcttcttcttccccggttatgtgggaacagatctgtgaaaataattcttccaatataaaaactttacttacctctatgattcatgatcttcaggaagttattgatcagcttgacaataagaatggcacatatgtcaatgaatattttaaagaagccggtgaatatcgaaattctgtacccgaccattccattggcttatttgataaagtacataaactttatgtacatattccagaccagccaggtacgatcgctacagttgcttctctgcttgctttcaacagcatcagcctaaaaaatatcggtatcatatacaatcgagaatttgaagaaggtgttttagaaattgttctttacgatgaggaatcctgccaaaaaggggctcaggtgttagaagagagaaattacattgtacatattcgctgatttatattacatatttttattacaaaacatgtacatgactatttataaatttacataaagtgaggatttatttatgaaaaaaataacaagaattaccggtcttaaaggaactcttactgttcccggagataaatccatcagccacagagccattatgtttggctcacttgcagaaggaacaactaccatccatggatttttaaaaggagctgattgtctttctactattgactgttttcgcaaaatgggaatttctatcgaagaaaaagaggatacgatttatgttcacggaaagggacttcatggtcttcacaaaccagaagaaactttagatgtcgggaatagcggcacaacaacccgtcttatttccggaatccttgccggtcaaaactttgatactgttttaagcggcgatgcttctttaaattcccgccctatgggacggatcatgaagcctctttctatgatgggcgctgatattacaagtattcacgatactggctgtgcaccactttccatcaaaggtcgttctctaaacgccattcactatgattctcctgttgcttctgcccaggtgaaatcctgtgtactgcttgccgggctgtatgctaatggaaaaacaagcgtgaccgagccggcactttccagagatcacacagaacgtatgcttcgttcttttggagccaatatcgtatcagataaaaacacttgcaccatcactccacctgaaaccttgcatggacagcatatcgaagttcccggcgatatttcttctgccgctttctttattgtagccgccctgattacgccaaattctgaaatcacaataaataatgtcggtatcaatgacacgcgtgctggaattttgaaagtatgccaggatatgggcgccgatatcacattattaaatgccagagaagagggcggggaaccagttgctgatcttcttgtaaaaacaagcagtcttcgaggaacaattgtagaaggagatattatccctgctcttattgacgaacttcctgtcattgcccttatggcatgttttgcaaaggggcagaccattatcaaagatgctcacgaacttcgtgtaaaagaatccgaccgtatcgctattatgacggaaaacttaggtgctatgggcgcagacatcattgataccgatgacggctttattatcaatagccgttctgataataccatccctactcttcacggagcaagcatcaactgttccatggatcaccgcatcgccatgacatttgccattgctgggctaaatgcggatggagaaacgattattactgactctgattgcgtggatgtgtcttatccgggattctttgcacagttagaacagcttttttcacaaaattaatcacagaaagattctgagaatacgttataaaatatggagaaatttatgaaaaaaattaaacaactattatttattacttttactcttactatcattacaggattattttgtttctgcggaaacacttcctatgccaaaaatgcaaaaaaagcttctcgaaaaaaaataacttaccatcataaggtaatcgcttatcaagactctcctgcaatttatgatttcattccaacaggaagtgctgccggaaatcgccgggctttaaatcatttaatcaacagcgataaacctaaaataattaatatcaacaatgatatttccatcgatacctatttacgcccgggcaacaacacaacaatcaatgccggaaaccatacgatcacatccggaagcggcgtaattataaacgacccaactgcagcatcctatgataattttaaaaaccttaccattaacggaggagtatggaaaaattcatcttcctctggattaaaaggaaccatgatgcgaatttcctatgcttctgatatttctatcaatgatgctaccgtctattgcaattacaccggacatggtattgaattgatcgcatgcaacggtatttccattaatggatgtaaattaatcccacagggtaaatgtccaaaaaaatgtgtagaagaacagctccagattgaccttgccacaccaaaaacagctcccggtctttaccgtttaagcccaaagctctgtaacggtaccccaagcaaaaatatcagcgtaacgaactgtactgttagcggagcaaggggcatctgcgcaagttttccaggtagtgaatcaaaatatcgaaaagctggaaactatcactctaatatcacaatagaaaactgcaacattactggaaagtctgcagaagcactcgcactttttaatacaaaaagcgccacagtaaaaaattgccgcataacaacaaaaacacctttaaaacgtaattcctactccgtaggactcgctgttgcttatcagaaaggttcttctccaaaaacaagcattaaaaataaagttgtcattgaaaacaatatcgtaaaaggcggcagacagggaatctttatattctcccatacattaaaaaaattcggaaaagtaatcgttaagaaaaatagagcctatgccagaagcggtaaaagaaatgctatccgcgtgatttctgcaaagaaaaagcaggtttcaaaaaacaaaacaaaaagatggtaacaactcctgatttgtagatttcgtgtagacgaaaaaagaaaaaccagcctatcccatctgctctgtagtcgctgtatttaagatgctcgtccgcatcttaaacacgctccgaagccgcatctgggacaggctgatttttcttttttctgattactctaaatctacagttgatgagaataggaattctccaaaaggttataactttccaagaaattaaattcaaaaggattgacattcaaattgttgtaggttgtagaattttagcttagatattcattgatttttatgtcaaattatgtatataacaatcacatagcaaccaataacacattataatgaaggtagcgtaaatggcatattctacactcttacagccagaaggtctagaacaacgctacgaaagatataaagaaaagataaaatactttacagatggcaaaaatataattctggttttctatttgtctacagatgaaatcttcagaaggaagcatattcctgttaaatcgcattcaaatttcaagtgtagacaacatacaacaatttgaatgtcaaccctttagactttaactccccaagaatccataaccttctggagattccccacccttacaaactgtggatttagatagccagaaaaaagaaatactgccatatcccagatgcggcttcggagcgtgtttaagatgcagttgagcatcttaaacgcagcgactacagagcagatgggatatggcagtatttcttttttcgtctgtacgaaatctacagattcatattttagtggtggaataaacgaattcctgtgaatgacatttcgattccgtatttatcacatgtttcgattacattatcatcgcggatagatcctcctggctgtgcaatgtattttacaccgctcttatgtgcacgttcgatattatcaccaaatgggaagaaagcatcagagcctaatgctacatctgtaagtttatcaagccatgctctcttttcttctcttgtaaatacttccggttttactttgaaagtattttcccatacgccatctgcgagtacatccatgtattcatctcccatgtagatgtcgatcgcattgtctctatctgcacgacgaatctcatctttgaactgaagtcccattacctgaggagactgtctaagccaccagttatctgctttctgtcctgcaagacgtgtacagtggattctggactgctgacctgctccaataccaatcgcctgtccatcttttacataacatacagagttagactgtgtatattttaaagtaatcatggaaatagctaagtctctctttgcctcttctgtcagttctttattctctgtaacgatattatcaaagaacttatcatcgatatttaattcatttcttccctgctcgaaagtgattccaaatacctgttttttctcgatcggtgccggaatgtaagctggatcgatctgaattacattgtagttccctctttttttagattttaaaatctcaagtgcttctggttcatatcctggagcgatcacaccgtcagatacttctcttttgatcatgttggctgtagaaacatcacatacatcggataatgcgataaaatcaccgtaggaagacatacggtccgctcctctggctcttgcataagcacaggcaagaggagataattctccaaggtcatctacccagtagattttagccagtgtatcgctaagaggaagacctactgctgctccggctggagatacgtgtttaaaagaagttgcagcaggaagccccgttgctttttttaattcgcttacaagctgccagccattaaaagcatctaaaaagttaatataacctggttttccgttcagtacctgaatagggagttccccctcttccatataaatccgggatggtttctgatttgggttacatccatattttaactctaattctttcattcttattctacctcttttagtttatgttctgactttgtgatttcggttattcttattgcatatttagagcgtgtttgaaatatcaaaaagtaacctgcacgcctccatttgcatattttaaaatttttctatattttagtccagaattgcaaatgcgtatctgtataattttaatctgcaactttgcaatatgtttttaaataattactttttattcgcactaattacttgtcttcaataattacttatttttattaataattttagattcatattttcctgttgcaatgtcaatataacgtacaaataaagaaactttattctcttcattcaaactattccataaagtatctgcaaatgcatccatatcatctggaattgccatccactttggctctccttcaaaacttggtaaaggattaccatcatgcatataagtggaaatgaaatgaccctctcctgccggaacatcactatatgcaaatgtgtagcggttacagctttccggattaccgttattactctttaaaatagacattgcataattgaatttgcccttttccaaatgaagaactgctgaaattctaggagtatagtttggtccgtccggctcaaattctctggaacgtaaagactgctcaaatgtaagctgtttatccattccttcatagattgtgtctgtctgatccccgtttgtcacgattgttttattaccaagcactctcactggcgcatagataataaggcttggatcttctaactttgacggatcaaatgcctgtgtacgaataccttccccgtcttccacaaaaatacggttgcggctgttcgaacttcttcccataataaaataagcaattgctgccttttttccgtcttcggaacgtccgacaataattcctcttcccggataagaattctctttcagttctttttcgattgaaatcattttcatgaatcaagctcctcctttgaatctaaaacatttttaataaaatctatttataaaatataatacaataagatactgacaaacgcaactgtcagacctttcgaattataagaaagatattaaaaaagatttagatattttccctacttgtgcctgatatgtggtagaataaagtacgtcttttttacaaaagctaagacgtatcacataaatgtgtgtctactacgcacagaaaggacctattatgaagaaaaattttttattacttttcaccacctttttactctttacacttactgctacaggctgtagcaataaggtttcggggaacctcggtaaagatggcatcaaactggttggaacgtggaatggagttgggaatgctttaggaagagatgatagttacaactgtgattatctgagcttttccatagataaagagggacagtttacgctgaaagatatcacacagaataaaacctgcctaagtggaggtctctctgtaagttcatcaaagttttctttaaataccggaagtgaaactgctgtgggattgccatccggatgggatgatcttggttcgggcagtacgctttcttatacaatgccttctgaaaatatccttgtattaacttatgataatgtcagctatctttttaagaaatataagaaaggtacacagtccgattcttcaaatactacaggaccactcttaaatcttacagaaaatgacgtatggtacagcaaagaagactttacaaccgatacaaaccgatacaaattaagtttatatgataattacatggaacttcattctcttgatgagaaggctgctactaaaaatgaacctacttttgttactaattttttctatctttcaagcagggataatgaatttactttttatacgtacaaagatgattctatgaatcttcctgctgtttttaaagatttaccgaatggtttttcaaaatgcaccatgaaaattcatgcagaaaacaactctcttactctgtcttataaaggacagaaccttctttttacaaataaataaaacaaagaaggaatataactaacaaagaatctttttattcacatttaataacctgtgtacacctggaatttttctgtacttatttttaatatttttaagaaaaacaagaagggtacatcacaaaccatggagtaacatttatgattgaagtagaaattaaacttcctctgttccgaagatctgtaacggaacggacgttaacagagtttggatttaaacccggcaatctggtgaaagaatcagatttttattttaccagcgattttcatgattttatgaaaacagacgaagcacttcgcatacgaacatgcgataacttcaacacaagagaaacggcttctttcctcacctataaaggggcaaagcttgatactgtttccacaacaagaaaagaactggaaacccgcatagacgatgcagaaactacaagggagattcttatctcccttggttacaaaagactctatccggttacaaagctccgtcagtattaccataaaggaatgatgactgcctgcgtagaccaggtagagggacttggttcttttttggaactggaaattctcgtaaacactctggaagaaaaagaaagtgccctgcaaagcatcgaggcacttctcttagatatgggcagcagcctgagagaaactacgcggaaatcttatctggcgatgcttctttcaaagggttctctcgattaacaatataaattcctatacatacaagaactaatgaggtcaggccagctaatgaaaatgcctggcctttttcttttaataaaagagctgatagcattacaccaaacaccggattcataaagccaaatactgcaattcttgagggcggattatatttcaaaagcaaagaccagattgtataagctaccgctgaaatgcaagccatatacagcaaaaggaacaatggtgcgattccctcaaaacgaagttttccacccattatttttcccataacgataagcactgtaccacccatcataaactgccagccgctaaggagaaccgggtttgcttttgtagaaaactttttaataaatgcagaagaacatgcagcggacactgtggaaacaagtatgaaaaattctccattccagtgaaagctcatatctaatcctccgccaccaagattaacaagaaccactccggcaaaaccaataacacagccaataattttcggtccggtcagcttttcctgatgaaatataaggctggcaattaaaataaccagaaaggaattcgctccgttaataattgaagactttactcctgttgcatgagccagtcccatataaaagaatacatattgtaatattgtctgaaaaactgccagtatcattgccatgggaatttccgtcttttttaatttatactttccggaagtcccaagcaaaagcacaagaaaaccagcaagaaaaaagcggcatcctgcaaacaaaagctgtgatgaagcatctgctgatgcaatatgaaacatcttgtatcctatttttatacagggaaatgcacttccccaaagcagacagcatatcatagctaaaaaccatacaacgcctgtcttttgcatccattgttctttcaaattactttcctcctgttttatcacatattttacaaaattatcgcaatcctttaacatttgattttgctgttctattctatactagctatccctcgtctgtcaaattcatttctcctaagaaactttgttctgtattcttgcatttaaaaataagatactatacaatgatgtcagggtcaaaaggtcaaaactccgttcgtgcctgtacgatagggtgtttgactttggaacccgcggaacatgataaaggaggtgattaacttatgaagttaatccacactgccgactggcatcttggaaaaaatatcgaaggttacacccgcttagaggaacaacggcagtttttaaaagactttataaaaatatgtgaagatgaacaagcagatatgattattattgccggagatatttatgataattataatccgtctgccatggcggaacagcttttttatgatacattaaaacaactttcaagaaatggcagctgtatgacggttgtgatttccggaaatcatgataatcctgaccgcctgactgcctctggaccactcgcacgagatcatggcattgttatggccggcaccccaaattccataatcactcccgggatatatggacaacacgaaattacggaaagtgccccgggatattttcacgcaattataaataatgaagaagttgatatgcttcttgttccttttccaagtgaaaaaagattgaatgaagtatatcttaatgaaacagacgatgaaacacagaaagccgcttcatatggagaaaaaatgtctgcactcttctcttctcttaaagaacattttcataaagattccatacatcttatcgcaagtcatctctttgtaatggacagcattgaagatggttccgaacgaagtatacagcttggcggaagctatatggtcggaggagatatctttcctgagacagcagactatatcgctcttggacacgtccataaaccacagaaggttcccggctgtccaaatgcaagatacagcggctctccacttccttttaatattaaggaaacttcttttcataaacaggttatctccgtagaacttcgtgccggctctccctgcgttattcatgaactgccgcttcctgtatataaaccaatcgaaatatggcattgtgaaaacattgaagaagcgattgaaaaatgtgaagaaaataaagagcgagactgttgggtataccttgaaatcaagaccgaccactatattcacgaagaagatatcaaaaaaatgaagacattaaaaacagacattctatcgatcactcctgttttaccagagaatgactctgatgacttttccgcctctgatattagagaacagccatttgatgaacttgttaaaaatttttaccggaaaagatttcaggttgatatcggagaagagacactcgctcttttgatgcagattatggaggagaactaaatgagaccacttcaattaaaactgactggtattaatagttaccgagaagaacagattattgattttgaaacactgacttcgcaggggcttttcggaatttttggtcctaccggaagcggaaagtccagcattttagatgcgatgactcttgccttatatgcgaaactcccccgcgatactaaaaactttatcaataccaacgaaaaaaaggctaacgtttcctttcttttttccatcacaacagacaagacacgcaaatacttagcagaacgttcttttcgctatcacacaggaaatagcgcttctacagtaagaaatacaaccggacgtcttatcttgtatgagggagatactgaaactgttttagctgacaaacctacagaagttacaaatgaatgtatccgtcttcttggacttacaagcgaagactttatgaggacggtcgttcttccgcaaggacagttcagtgaatttctccgtctgaaaaacaaagaacgacgcgttatgcttcagcgtatttttcaccttgaaaaatatggaatagaacttaccggtaaaattgcccgcgcaaggcaaaaacaagatttacttttaagtactctttccggagaaaaaaagggatatgaagatatctcttcccaaaagctttcttcattgaaaaaagaaaaaaaagaaaataccaaacagtgcgccactctctctgaacagctcactgttttagaaaaaaactttgaaaaaacaaatgaacttttctccttacagcaggaactctctcccctagaagaacaaaaaaaagaaaatgaaaagaaactttcttccataaaacaaaaggaaaaacagcttgatactgcaaaaaaagccaatcagcttcgttctttttctgatcaggtctcacagacaaaaagcatttgtgaagaagcagaaaaaagattgcagcatattcaaaaagaagtagattctcttcacattgcttttgaagcagcaaaaaaagcatatgatgaagtccatctatcacaaaaagaaactctctctgcccttcaaaaagaagagcaattattagaaaactctctatccactatcaacacaatacaatcctggtctaaatcacaaaaagattacgaaagacaaaaccaggaacttttaaaaacattgtctcctttaaaagaaaggcagcaaagccaattaaaaaaagaagaagacatgcgaaaacagattgaaaacatagaagcggaactagatgcagacaaagttactgctgaaaaaaaagctcttttagaaaagggcaatatcatggaagaaaactatcgggaaaagcatcagaattatacaacaaattcagaggttttatctgacttaaaagcaaaaatcataacagaaaaagaagcctttactctaaaaaaaaggcaattagaatacagctatatacaactttcccatcgactttcttatttagaaaaacaacattctgatcttactgaaaaattaactgattttagagagaaagaaactcaaaacaagcagcagcaaaaattattgcagcaaaatcatatggctcagcttttacgcgaagaattacaagaaggtgtggtctgtcccgtctgcggtattccttatgaaaaacatgatctgccaacagaatcctccccattttcgttgaaagatctagaagaaacgcaaaaaaatctagaaaaaaatatacagcaattgcagaatagaatcatgcagattgaaaaagaatttgcctctctaaatacacaactcccaaatctaaaagaggctctggaaatcactacccaaaacgatctctctgatatgatttctgcccctgatctacagaaaaaaactccgaataatccccctatcgtaccggattattctgccatttccagacagcatgctgaatatttacaggcaaaaggacaccttcaacagcaggaaaaccagtatacagagcagaacacactcctgaaagaacagcacgctaccctccaaaactatgtagaaaaaatattttctcttcgaaaagaaaataacatcgaaaatttttctattgctctcaaaaaccttcgaaatagggaagaacatcatcaaaaacaagaaaaagctttaaaagaaaaacgcctttctttagaaatcctcctttctgagaaagaaagtctttcctcccagattatatctttagaaaatgaaagttcatccctcactgcaaccattgataactgcaaaaaagtaattgcagaacaaaccgaaaaaattccaaaacagttctctttcgatatggattttcctctggcattaaataaggtcaaagaaaaacaggaaaatatcaaaacttgtttttccaaagcagaaaaagtctaccaaaacaaacaaaaagaactgcagcaaaaacgagaagaacttggctcctgcgaaagcactgccgtctcttcacatacacatttaaagcaaatgacgcagctttatcaaaaccaaaaaaatatgctcggttttaaagaagaggaacagcctgaatgttactacatggaagaaatacaaataaatcaacttcacaacgaaattgacacctactatacttctgcaagaaaaaccgaagaacaaattctttatttaaaaaacaagcttggaaatcgtcatattgaagaagaagactggcgcagacaaaaagaagaacgggactctgccagaaaccaaattaatactctaacttcttcccttctccttttagaccatcagattcaggagatgacagaaagactcactgaaaagcaaaaattagaagaacaatgggaaaaagaaacacataaaaaagatatgataaaagaattagaacagcttttcaagggaaacgctttcattgaatatgtggcccaggcaaagcttgcttatatcgccagagaagcttccgtcattctctcaaagatatctggtggaaactacactctcgaaattaacgaatccgctgaatttattatacgggataataagaacggcggtgccatacgcccttccgatactctttccggcggagaaatgtttattacatccctcgcattagcattagctctttcttcctccatccagcttaatggagctgcaccacttgaatttttcttcttagatgagggattcggaagtttagatgacgatctgctagacactgttatgaatagcttagagcaacttcaatctaaaaagagaagtattggcatcatcagtcatgtagaggccattcagacaagagttcccgtaaagctccttgtcactccatcagatctatcacaaaaaggcagccagattacattagaatattcctaatcctgatttaatggactaaagaaacgaaaaccagaactttatataaaataaaatgtgaagatagtcgcggcgtagaaaatgcctgactggcatttttacttgctccgacatcatattttattttatataaagtttctggttttctgttctttggccacagaggaaatcaggattttgtgtaaaaaaataagggggtttcccaaaagtctacgctttctatatcaaatgaaaatatccagaagaaatagtcaatcctttagactttaatttcccgagaatccatagccttctgggcaatcccccgtctcaccaactacggatttagagtagacagaaaaaagaaacaataccatatcccagatgcggcttcggagcgtgtttaaaatgcagataagcatcttaaacgcagcgactactgagcatctgggatatggtattgtttcttttttcgtaaactataaatcagtaattaaaaacctttgtagtatcttcctaaggcatctgctgcaaccattgctgcgtataccttctctggtgtaacttcaaatggttcattacctaatgtatcatctggtgaagctgctaatgttgctgcttccataagagcatccttatctggattctcgattccaagatctgcaaatgtagtaggaagtccaacatccatgcagaaagtaattacttcatctaataaatcttcatcggcattctcaagtacaagctgtgttaatgtaccaaatgcaactttttctccatgatataaatggtgacattctttaatacatgtcaggccgttatggatggcatgtgcgccagctaatccgccactttcaaatcccataccagataacagtgtgtttgcttcaattactttttctactgctgtagtacatacatcagcttctactgcaagttttgcttttacaccttcttctattaatgtctgatagcaaacttttgccaaagtaatcgctgcaattgtaatatgaccacctgcacagctagttgcattgcttgcctgacaggcttttgcttcaaaatatgttgcaagtgcatcacccataccggaaactaacagtctcgccggagcctttgcgataatatcggtatctactaaaacaagatttggatttgccggtaaccataagtattcttcaaatacgccatcatctgtataaactacagtaagggcagaacaaggtgcatctgttgcggcaatggtaggacatacgataaccggactgttcacataataagcaacggcttttgctgtatcaaaaatctttccgccgccgacaccgataaccatatcgcagcctttttcttttacaatagcaaccaggcggttaatctcgtttttagaacattccccatgaaatgcttcaaaaacaagttcacatcctgtctctttgaaactatcttcgataattccaccaacacgtttctttccgctttcactaattaaaataaaaggcttctttccaagctttgtagcgtactgcgcaatattagcaagctctccctttccctgcacgtacttcgctggactgataataatgtttgccataaaaaaataccatcctttcttataatagaaaaaaattgctacaaaaaccgctttgtaaccccggttttcttgttataattataacaattttctaataaaaaagcaatagttctttgtataattagacaaaaacaggaaacagatgcgatagttgtttctgtaaagttactactataatatccatttcccgtttctatttattttattcgaagttattatcgaaaataatattaagtttagcttaatgctgctgtaacaagtgccattttataaacttcctgtgcattacatccacgacttaaatcattgatcggtgcattaagtccctgaagaactggtccgattgcttcatattcaccaagacgtgcagcaatcttatatccgatattacctgcactgatttctgggaagataaaagtatttgcctgtcctgctactgtagaacctgcacattttacttttgcaacttccggtgctaccgctgcatcaaactgaagctcaccgtcaatatctaagtctggcgccatctcttttactttctttgtagcattcgccattaatgttaccatctcgccctttccagagccatatgtagaataagataacatagcaacctttggatcaataccaaagatttttgctgtctttgcagtctcaatagcgatctctgctaattcatcttcatttggagcaatgttaattgcacaatctcccattgctaacttcttatcaccttttaccatgataaagcaggagcttacaatcttgttacctggttttgttttaattaactgtaatgcaggacgtactgtatctgctgtagaataagttgctcctcctaacagacaatcagccttacccatctttactaacattgttccaaaatagtttgatttagaaagagcatcgcgaacctgttccggtgtcatcttgccttttcttaatcttaccatctcatcaaccatcgcatcaatatcagcatactgttccggatcaatgatctgacatttatcaatattaaatccggtttcttttgctgctgcctttacttcgtcagcctttccaagaagaataacaccaagaactccctctgctgtaagtttatctgctgcctcaagaatacgggcatctgttccttctgtaaaaacaatagtacgtgggtttgcttttaactgttctgataattttttaaacatgttttatttacctcctgttattcagtcatatacctaactaaatccaaataactaaaatctttcgactgcagatcgcgcaatgaactatcgcacgaacttgcacacacattttttattgtatcggttttgtttccgcttttcaagctatttcgaaagaaaatacaaaaatttatgcacttttctttgtacataatagaattccactatggatcataaaacaatctgctaagcaaactgcacaacaaaggtattactgtacagattttttatattcataacgtaatattccactctggaatacgccttctttccaggttccttctttcacaatatcccagtctggatgttgtttatccaaatatttcttttgtccgtaaccttcttttattccatccgaatcaaaaacggcatcacataaaagtcttccatcttttccgtatactttataccgatctttatcccactcaaaagcacgaacacctgtggaatagcgatttcgatatcctggtctgaactttttaccggtaagctgctggaacagacgtagcgtattcggatggagaagcgcagtataacgaagtcccccttcacttagctctttgtaataatatggataaaacggcatcataaactgtaaaaacacttgctttaacttctcgatatcatttacatatcctacaattttaccttcctcttcccgaaaatctacacaggtaaagtattcttttaccattcttcctgtaatggtagaaagcccttcaataatatcattcttttctttatataattcctgagatatctccccaagctttttgagctgactccattcctctttattataaacacaaaccaaattctgcagctcctgagtcatataatgatataactgctctttttgtttcactgcctgcatatctgcagatgcctcttcttttatcgaaatattctgtgactctttttgcgtagtaccttgcgattctccctgtatcctgctttgtgactctcttttcgcagtattttgcaattcttcctgtgtcctgctttgtgactctcttttcgcagtactttgtaactcttctttcgtagtattctttgaatcagacttactagccataaaaaaggcaatcccagcaataataattccaattactacgactccgattataagattcatttcttctctccctctttttcctcagtaattatagcaattttgaaaaaaatactatattatatttatactatacgtttttcacaaaaaattcaatattaaatgttatatttagtaagtatatataaacgaagacttttatggagattctatatgattacctgtttcgtacagcttaatttaaagctgcttttcgttttaatcctgttgggatttattatcgggaaaagcagacactcagccattcaaaacttttccaataaaaaatgtggctattttattatggacttttttaatctgatcggtattcctgttcacgagcttggacatttactttttggacttttctttggatatcatattgaccaggtttgcctgtaccgcaccacaaaaaaggcgattcattcaggtggaactttaggatttgtaaaaatgcaccatgaaaatcattcctttttgcaaaaactgcagggagatttagggcagttttttatcgggatcggtccactgttgtttggaccggccgttatttatattatcagccggtttctcccagaaaatatcagaacgctccctttttccttccaaaaaggatgggcaatttccctgaaagccttgcaacaattacgagcttctgatataatctttctgtttgtattcctgtatatcattatgggaatttctttaaatatggaattaagcagacaggatatgcatcttgcctgcaaaggcctgattcttcttgaggttatatttcttattctttcaggtctttctgttttatttcactggaatctgcaatatagcattgatattctctttcgatggaatctactgatttcttctatcggaatcatctccgcactgattgccaatctgatttctctgatttaaagctcataaataaataatacaaaggggtatgtataaattatgtcagtattaaaaaaattcaaaaagaaattcatttcaaagttacgacgaatccgcaaacactatcgctacaaagtatattttccaaaagtatattcttcctactgtactgaacctgtacaggagaataaagtcctgtttttggaaatgcgttttacaaagctttccaattcatttgaacttatttataaagctttagaagaatccggcgaatatgatttaaaatgttcttatgtacagtttaattttatccgcggacgcgaatttacacagcgcgttaatgaaatgctcaaagaacttgcaacagcaaagtatgtatttgttgatgatgcttctttaattctttcttctattccattaagaaaagaaacggtagcgatcaatctctggcatgcctgcggtgcatttaaaaagtttggccgcagtacagcagaattgaaattcggctcttccgcagctacattagataaatatccaaactatggcaaccttactcatgtaactgtcagcagccctgaagtcatctgggcatatgaagaggcgatgcaccttcctaaagggattgtaaaagcaaccggtgtcagccgtactgaccagttctatgataaagaattcgtagaaagccgcaagcaaaaactatacgaaatcatgccagaagctaaaggtaaaaaagttattctttatgccccaaccttccgaggtcatgttgctactgcttcctccccggaccgtattgattttgaacgtttttgtcgtgaattaggcaacgaatatgttatcgtttgtaaacatcatccatttgtcaaaaatccaccgatcattccggaagaattacagcattttgcaagagaccttaccaagtacctttctatcgaagacttactttgttgtgcagacatttgtatctctgattattcttcactggtatttgaatactctttatttgaaaaaccaatgattttctatgcatatgattatgataactactgtgactggcgtggcttttattatgactattctgaattcacaccaggtccagttgttcagacagaagatgaacttttaaacagcatcaagaatattgatacacagtttgataaacaaaaagtcattgatttcaaagaaaaattcatgggaagctgcgatggacacgcaacagaacgcattatcgccttaatgaaagaaaattaaaatcctgatttgagggactaaagaaacgaaaaccagaaactttatatagaataaaatgtgaagatagtcgcggcgtagaaaatgcctgactggcatttttacttgctccgacatcatattttattctatataaagtttctggttttctgtcctttggctccagatgaaatcaggattttgtataaaaaaaggaatttccccagaagcgagcatctttctgctgaattacattgagttttctaaagaaaaggggattctccagaaagttatgattttccatggaattaaattcaaaaggattgacattcaaattgttgtctattaaaaaattatggaaaaagagaaaaactgtttataaatattatattttatgactttgagctatggattttagcagaaagcgtattccttttggagattttcattctaaataaaaaccatagtcctctggacaatccccttatttttcccaaaatgaaaatactaatttccatttggcgccaaagaacagaaaaaagaaacaataccatatcccagatgcggcttcggagcgtgtttaagatgcgaataagcatcttaaatacagcgactacagagcagatgggatatggtattgtttcttttttcgtctatacgaaatctacaaattagtattttttagatgacatgcgagttcgtgtttttcgcctactgtttttaattctggtttttcttcttgacattttttcatgcagtaagcacaacgattctggaacggacagcctttttgttctcctgtcgctccattcacttctccttcaagaggctcgattggttttgaaaaatccatatgaatatcaaatacggattgtaacaatgcttttgtatatggatgcattgcttcttccgtaaccttttctcccggaaggatttctacgatgttacccatatacattactgcgacctggtgtgctatacttgatatcattgccagatcgtgacagataaatcctaatgcgatctgtttttctttttgcagctttacaagaagctcaaggattgtcttttgtacagaaacatctaaggctgaggtggattcatcgcagaaaatgatttccggttctaaagcgattgcccgggcaatgcctactcgctgctgctgtccgccactcatattatgtgggtagcgatcaacaaagtctcctggtaattctaccatttccagatactttcttgcgatggcatctttctcttttttcttaatcagaccgaaattcataagtggttcacaaattatatcccgcactttcattttaggattaaaggatgtcgcaggattttggaagaccatctgcacgtttctgcggtttgctcgtaattcttctcccttcatctttgtgatatctttttctttgaaaaaaatctttcctgatgtcggtttctcaagctgtaccatcatccgcataaatgtggactttccgcaaccgctttctcctacaattcctaatgtctgtcccttatagaacttcaaactgatatcatcattggcaatcaattcttttccgtttgccagagggaacttctttgtcacatgttttgcttctaaaataggtctttcttctttagacatacctctccccctttaaagatggcacagccagcaatagattctttgtatagtctgactttggattatgtaaaatctcttctctgtcaccggaatctacaacttttccctgcttcattacgatcattttatctgccatatacgcagcaacaccaatattatgtgttacgataataatgctcataccaaaagtgtctctaagttccatcatctcacgtacgatctgtgcctgcgttgttacatccagtgcacttgtcggttcgtctgcaagaaggagttttggttcaaatgtcatagccattgcaataccgactctttgacacatacctccggaaagttcaaatgaataactatccataatacgctttccattcggcagacgcatcttttctaacatctgaatggccatatctgctgcatcttttttggaaatgtctctatgcgcgcggatatactccacatactggctcccaattttgcggacaggatttatcattgccccagcattctgaaaaatcatggaaatctgagtccctcttaaatctctccactgctttttagaatagtgaagtaatgattctccttcaaaaagaatgtctcccttggttacctttccaccgccgggcaaaactcctaaaatagaacggattactgtggtttttccgctaccgctttctcccacaatgctgcagatttctccaggtttcatctgaagatgaaacccttcgattgtcggtcttggattttggctgtatgttacggttatatcctgaacattaagcataaaaacctcctatttcgctggagcaatttctgttgtaagccaataataatctgctgtgtgaatgtctgctcctgtaactgtcttatcactgatcattgaactgttgtaataaccatgaacaacaacagctgcgtcatcaatcaaaatctgctgtaattgctcaataatctttgcacgttttgcttcatcaaattctgtttctaactgttcatataacttgtcaaatttatcatttttgtaattacagaagtttgcatctgatttaccataccagtttgcaagatattctgtagggtctccattacctacagtaatccagttagaatcacaaagatcatactctcctgcaaccatcaagttccactctttatctgcgttcatagaatcaatctttacatcaattccgagatctttaagctgtgtctggattgcctgtgcaaagtcggaaagtcttctgttctcatatgtgatatatctaagtgagatattctttccattcatctcgcggattccatcgccatctgtatctttataacctgcatcatctaaaagtttcttggctttatctgtattaaactcatatggattctttaaattatcatatccataagccaggctggaaggaagtacggaaattccctctgtatataaaccgccaactgtaacttcgcacatggtcttatgatctaatgccatctgtaatgcctgtcttaatgcatcgtcttttaaaatacctttttcattgacatacgcaaatccacaacgaacaccctgtccgatagatacattaaagttatcatcttttttcaaagtttcaagatcagatgcagaagtaatattttctacaagatttacatcaccgttctggagagccattgctttattatcttcacttaagaaatcaatttcaacgttatcataagacacttcaccattccagtaatatttattctttacaagagttgcttttgtcttagaatcaaaacttgttaatgcataaggacctgtaccgattggattctctgcaagatcataatctccacttacatcaagaacaacgaatactggatatgcaagatcttttctaaggtcagcctttgcctgttttaaaacaattgttaaagtacgtgcttcatcatctgctgtaattgattcgtaatccataaacttagatggattagaagaacccgtcttgttagcataaagaacatcccagcaagctttaattgcagaaggagttacatcctttccgttagaaaactttacaccatcgcggatgtggaatacccatgtcttattatcctctgtagaatattcatcacaaatcgtattctctacacttaagtcatctttatacttaaagagacattctccaacaccataacggctgttacaccaggctgcattgatcatatttgccgggtctaaagattctgagtaagaaaaacatccaaactttaatgtatttccctctgtgctgtcactgtttcctttaccgtttccaccacaaccggcaagcatggtaactgccatgatcatagctatcatgattcctaaaaatcttttcatcttcttcataaacttatcctttctttatccttttttgttatttattatacataactgttgatttctacacagactgcaaaatgcatcatatcatttgcagttaacatacataggaacgaacccatacagttactaatataatcctttattcttctcttacatcaagtacatctcttaaactgtcacctaaaagattaaatactacaacaacgataacgattgccagtcccggataaatcatcatccatggtgcattttgcatataggttcttccctcattgagcataagtccccattctgccgccggagccttggctccaaatcctaagaaggataaaccggcaagttccagcatcataccaccaatatctgtggcggctgtaattatcaatgttggaataatatttggaagcatatattttcttaaaatatagcttgtttttgagccagttactattgctgcatatatgtaatcttcatgacgtatcttcatgacaaggcttctggcaagtcttgcatatttaggccagcttactacagcaaccgcaatcaccgcattctttacactagctcccataatacctgcaactgcaatagcaagaaccatacctgggaaagaaatcatcatatcggatattctcataataaccgcatcgatccatcctccaaaatatcctgctaacgttccaagtaaagttcctattgcaaaaatcagtacaacgagtattaatgttgccgggagtgaacttcttgaagcataaatcactctggaaaatatatcccgccctaatttgtctgttccaaaccaatgagcgctgctcggtggctgtaatgcgttctttaaatcagatgcataaggatcctgtggtgcaattaccggtgcaaaaatagtaataagagcaagcaatataactagcaataagaaaaaggaaaactgtttattcttttttataaaatctaatactttatgcattacgttcaccctttctcacttcttcgtattcttggatccacaaaagtataagagatatctacaagtaaattaattaccatataaattaatgctacccagagtacatatccttgaatcagtgaataatcataggaactaattgcctgtactgccagatttccaagacctggatatgtgaaaataacttctactactgccgtacctcctaataaattaccaagagataatccaagcagggtaatcaatggtaataatgcatttggaaatacctgcttccagagtacttctttttctgtcattcctcttgctcttgctccagtaacataatcttggttcagttcttctaaaactgctgttcttacctgccttgtatattttcccatcatcgcaaaagctaatgtcgctgccggtaaaataatcttttcaaatccttctcctgttgaaataacaggaagtaaactaaacttcagcgcgactacatataaaagtattagtccaacccaaaagttaggaatcgataccccaagaaaagtaatccccctgaccagataatcaatccaggaattcttatagactgccgataacatcccaagcggaatcgcaaatagcagcataagaagcaatgccgcaaatgccagttttaatgttggaagtaatctttctgataaaagctctgctactggctttccattcgaataagaagttccgaaatctccatgaagaactttactaaaccatcgcccatattgtactaaaatcggatcatttaatcctagtttttctctttcctcgtttaattctttttccgatggaatcataccactcacagcatatcttgtccgcaccggatctcctggtgcaagatatgtaagaatgaacgtacaaaaactaattcctatcagtacaatgacaatctgaagcagccgtctgcccaattgctttacattcaatctctttcctcctttgccctcgtatgtactcttggaatctttttgtgcttgattttgtgagaagattttttgtcatttgtgcccaaatttttgaggcgtacgcagtgcgtacgttgatgaaattcaggtgcgactggcggaaaatcagacacaaaagtaagtgcaagaaaaactccgagagtacatcgtataaaattaacatgaaaaagtatggattttaaaatagaaaatcattaatataagaccctgctgcatatcaaaccggaggcaacagactgttatgataggacaatcttagaatatcccaaaaaaaaggacatataagtacaattccaaaaaaattcttgtaattttctagaaaagcctatatggactgtacaattttctacatatatctacaatacttttcaataatatcatgacaatttttctatgtcaaagtgtaattttaccttttttgatgcttattttgacaattaaattcttttatctatgtatttttttgtccaccacactacttaatattacctgtcctgtttttaaatgcaaattccttgcatattttacacttgaaataatccatataaatttttaataaaaatggaaatatccataccagactaagtatttttgattcaatattgctatatttacttttctattttataataatgatattatttttatatgatatcagggtcaaaaggtccaaactccattcaggcttgcacgataaagtgtttgactttgggacccgtggaatttgaggctgaatcaaatcattacaacaatttacatggcacaggaggcattgggatttatgcaaaacagtaaagagaaaaatttagattttatagaaattttgtctaaagaaccagataatattctttctttagacgtttcttctgtaaagacattacagattgggtatcaggcagagactcttcttctacacaaagcagatgatgatactcttacaattaaggaatacattaacggtctttccggaagtgaatattatgcaaaagttactgcgaatcgttttaaaacaaccatacgttacggtcgaagagaaactgtaaatcccgctacctgtatcgaaattttcctcccggattctttcaatggcgaattactcctttcatcccaatatggcaatatcattacagatgccgactggaatgtagaacgatttgctgccgagacaacagaaggttctatttctttaaatacgatcactgctccacgaatccggcttgtttcttcaatcagtttgattcacattacacgagcagagggatttacggatatacactctgtttctggtacaattatcgctgactgtatcgaaggtggtgccaaattagctacttcatccagtccgattcaggctacattctcttctttaaataatattgtagaatgtgaaacattaaatggaaatattcaacttacacttcctgaaaactgcggaatgaagattgatggaatcagcaaacgaggctctattcactcgaacatcgagggactttctattaaagagaaacccggaaatgtacaaaatattactggtattttaggtgaaaaacctttttataatgtacgtatatctacaattaacggaaatatttctctaacctaaaacatctactaagcctctggcataaattcttgtatcacacatagaatccatgccagagaattcttaaaattcaagtcgagaagactcccacctctttcaggtgggagtcttctcgactgagataaaaaaagctgttatagttacgattataaaatcatcaaactataacagctattatattctatatctatcttacttatcatgtaccttcaaaactacacacaaactatcttttttctattccaataactttctaaggtcaagctttcgaccgattagtaacagtcaactccacacatcactgtgcttccatctctgccctatctacctcatcgtctctaaggggtctctcactctttcgagtctggatatctcatcttgaggggggcttcacgcttagatgccttcagcgtttatcccttcccgtcttggctacccggccgtgccattggcatgacaaccggtccaccagcggacggtccatcccggtcctctcgtactaaggacagctc

SEQ ID NO: 392 - DNA, 89141 bp, Eubacterium hallii
  modified_base (59709)..(59806): a, c, t, g, unknown or other
  misc_feature (59709)..(59806): n is a, c, g, or t
atcagttgttgctcatccctgccgagataagcccgacgcttttagcatcacatggccataagtctatgaagtattaccctcatagcgtgatgtttgtgcgtcaacgtgtcgcaccaaagatattttctatctcacggctggcaagcaggtcttttacattctgtgtgatacccgtcggaataccgccccatttacggaatcgcttccagatctccacgctgtacgcagctgtctgctcttcttttaaaagcagatgaaattcatcaatgtaatatctggtactcttattcgctgaacggttaatcgttactctgttccatacctgatcctgtacgatcagcataccaagctttttcagctgttttcccaagtctttgatgtcgaaacataccatgcggttactcagttccacgttagttctgtgattgaatactttcagagaaccattgacgtagatttccagtgcagttgcaagacgctgtgcctcctgttccttctgctcacggagaagattatataaatcctctaagatcggcatcttttccggtactgggtcagaaaggaagtcctgatacaccagacgcacacaacggtcaataactgttttttctaccggctccagtccattcttcccaccaactaccagctcacaaagagacaggataaaatcggactttaaggaaagtgggtcatcatcatctgcgtaatccagattgatgtccatcggattgatataatcatggctggtcggtgaaatgcggataacctgtccatgaaatgcccggaacaacggataatattctccttccggatcgcacacgataatgtcatcttttgtcacgataaatgcgttggtgatctcacgctttgccgcaaatgacttaccggcacccggtgtacccaaaatcaaaccattcgggtttttcagtttctttctgtctgccatgatcagattattggaaagggcatttaaaccatagtaaatggattccccacccataaacaattcctgtgtggtaaacggaacaaagattgccgtagatgttgtggtaagtgcccttttgataggcacaagattcatagcaagcggcaggcagctcataagccccggctcctgctgataatccagacgtttcaatgcacagttatatttctgtgcaataccggcagtctggaatacgacattttcaagctcctgctttgtctctgccgtatttaaaaacagtgccgttacaaggaacattctctcattcctggactgtaaatcttccagaagtctcttggcttctccaccatatgtatttaagtctgatgggataatgtccatatcatatccggcacgaactgcctttttctgctcctcaatcttcatccggttaatatcggtcaccttgctctttaccagcttgatcgctttcatctggccaatggactggatatggaaattcaccataaggttactgtccatctccaaaaactctgccagcatcttgtccgtaagctctggggcaagaatctgaagataagaaacggctcctatcgttccacccatctgaaagtcttttccattcttaaatacaaagctggtcggtgcgatataatcctttgtgctaagacctgtccgaagtacctcatcataagaaaaatggaaagggactttactatcctgattaaatgtctcatacatgatctgcagcctttcggctccattcaacggatacgctgtcacaccaagaatcttgaagttattcataatatccgactcgatacgttccagtttcggtcgtgcttcccggatactctctgcttcgataccaaaggtgatatacttggtacgcatcagaccattatttccttttgccagctgattattaagcatctgtgcaaactccatacgcagatcatcaaactcatcctcctgcggattgatatggataaccttttcatactccgccatgttgctgtgctgattgataaaggaaagctgaaaatgaatcgtgctgtcaaaataatttaagaagtcacaccagttttcaaagatcgcatttttatcctcattctgagctaactggtagttgatgtcataaaaacggatggtcttggaataaaatctatcctgcacacggcagataccatctctccccatctcatgataaggaatggactgctgtgctgtaatccgtttatctttggcagtatttgctactttcttttcagtggttccaccttttcctcctgaaaccttcttcccttccggctgctgccttggcggtgctgtagctgaactgctctttttcttctttgcacttttctttgcttcacgcattgcctgtttctctgcttttgccgcaagcttcgcttctttcttcgcatttttcttatccgctttttcatgctctttatgaagtttcgcttcatatttctgtgcccttttcaaagccttcttttccctgcgggtcagctttctgtttggtcggcgtacccctctctgtctttccaatgcttcataacccgttaccattggctcactgtgcagtctgccgcttaccggcttactgctgaccgccagatctggaatatcttctccaccatcctctttatccagccagtaatcatttggataacattcttcttccaatctctgcggtggctgtctatcgttttttctttttaacactcttctgtcctcccttcttttttctgaccatgataaatttcttctcatacagattttccatctgatacttccgtaccggaggacggataaatttcacggtgatcatatttttcaaaaccttttctaacggaagtccatccttttcatacatggcaaataaaaatgccggaagcatcaaaaggcacatcccggtggctgcgttactggaaccgatgatccctctggtaaggaaataaaatggtactcccactgccgctgcaatcccaaaacagatcagctgccgtttggtcaggttgaagatgatcttatttttgaccttggttaagtctttaggcactgatacaaatgccattgtcagttcctcctttcttagtgagcgttgaagatactacgggcaaagtttcctgttttcattaaactgaaacaaaggatcaccgtgtatgccatcacgccgaacaatgcagaatgaatgttatctgacatctggatattcgctactaagactgcgtaaattcccacgcagaccatcataaagaatccctgaaatgccagtgcaaacaatccacgaagatagttgtttccaatctgcccccattcccggttagacatagttgcaaatggaatagctccaacggacgaatagagatagatttcaatcatacgcccatacaaaatcactgtaataaagactgagataaccttcatacacaggctcacaagcatcgtttccagtgccagtatgacaagttcaccgatttccatagattccattgccgtttccatcgtggtaatcatcgtatctatattgatcgctgtatcggaactgatgacaccagcggcccggctcactactgactgcccgacatcaaataccgccatggtaatcgtgaaagtatggctgacgatccagactgccacccacatcttgaaaaaatatttaaagaacatccatgtatcaatgtcatgcatattgttcttttctgttaacatggaaatcagctcataacaaagcacaaaggtaataatcataccggcaatcggtacaatgaccgaatcggaaagattttgtatcatgctgaaaatgttcccattccagccctgcggtgtctgcccaacctgagcagcaatctgaccggtcttttcattgacatcggtatacattgttgtcaggttggaacttaccatgcctgtcagaagattcctcatccattcttcaatcgcttcaaatatccgatccatgagtcatctccctcctaagtttctcagctaaacaaaccggaaagtaacggtacaagctgggtgccgatcaaaacaacaccacctcccgccatcagctgttttatgtcttttatgagaaaatatttgctcgaaatgagccttgaaaagattaaaatagattaaattttgatagatttttcttatttatgggagccggaacctctttcgatggttccaagctccggtattggttttaagttgaaatgaatttccattgtgaccgtttcaggagtacggcagtaattttctgttccgtctttctcctgcggttctgagataacgattttactgatcagccggttcagaagattggcatccagttctttgatgtccgcatactcgctaatatcgtcaatccactgctgggactgtgcatccagtttttcttccgtattcagcacactctcattctggaaaagttcctttttgatatctgtctgctccttctgtgtcttctccagcatcttatcaaaaacagattctgtaatcttgtcattgataaggtcatcatacagttttgcaatcagccggtctaacgtttccaggcggtctttctgctttgataccagcttctccagactttccctgtgtccctgtgtatcttcctcgcataactcctttacccggttttccagttctgttccgtctccggtaactgcttttgcacattcctggattctggtaaggactgcatcatacaggtcatcagcgtccacccggtgctgggtacaatgtgctttccccttatggatataagtggaacaggtataaacttcatgctggtctttggtgtgcgtcttcttcaacgtcaacgcaccgccacactctgcacagcggagtaatccggcaaacatgctgtattctccctgttctgtctggcgtttcctgcctttcatctttgcctgtaccagatcaaatacatcctgcggaatgattgcttcgtgggtatccctgactgtgatccagtcctccggagctttatctccctgattgccaatcttgaaacggtagtaccttttctgggaagccatgtcaccacagtaaacgggattcatcagcagggatttcagataggattcatcccatacatatttcccattttccgggtctttcttttcccattttgtgtaataggtgcggagtccccgtttccggtgccaccatgacgggcagggaatctgctggcgttccagttctctggatataaagttaatcccatgaccgtccaccgcccactggaaaattttccggacaatcggtgctgtctcgtcgtcaatcaggagatgtcccttttcctccgggtctttctgatatcccagtggtggaacaacacctgtaaactttcccttggttgcctgcaggtgataggacgcatggactttcttggaaatatctctggaatacatctcgttcagcacgttcttaaatggggcaatctcattgtctccggcaaaggtatccacattatcatataatgcgatataccttactccatgctttgggaaaaactcctccatcagaaatcctgtctgtacatggtttcgtcccagtcggctctggtctttggtaattacaagattcaccagtcctttttcacaggctttgagaagtctctgcaaatcaggtcggtctgtgttcaatcctgtataaccatcgtcctgaaacacatccaccacctgccagccctgtgactgacagtaattcaccagtatgtctctctggttggagatgctggcactctctccggtcaattcgtcatctttggaaagtcggcagtatacaccaactctccaggttgcatttctttctatattgttactcatatatctgttgttcatctgatacctccgttactttgcacatcctacgcagatttcagattactgaactcataatcattatactgcttatctttcattattgcaagtttatcttttgttttcgtgtcacgtattttctgtgcgatcacctctgcaaacacttcttttgcgtcctgatcaccgtcaaaatatactctgatgttgataattttcttcttcactgccattgtaaaacctccattttttgcaaaaaaagagcagctaatccatttttacagattaactgcccagactgttggttacatatattaaaatttttgtattaacatttcagaaattggggatataataaagacagggataaatccctgtcagatgaactgcatattttaattttcccattgaaaacaagaggaatgtgtggtacatttgttataggaaaagcacccactccaaagtggatgccgcctgagttgactaaatggtcttacgaccaccgcctatcctgttggcagacaggataggcatttttatttcctcttgttcttccgatcaagaaaggcaataatcgcaattaacaggctaccaaaagcgatcagtaaactgagtacgcctaagaatattgagataatctcataagctgtcatatcacgcacctcctttctttcatctcagaaccccgaaaggctccggtctgtaaatatcaggaggcagccacaccctgtcacaggtgcttccccgtaacattgctgttaccggataatcataccattatatccgccatattacaattcatttttgttccagattcacagcaatccttattctgtatggatacctgctatttccgtttgattgccttgcaccggcagacggcagacggcagatagggtatctataaagcctgccgttcactccaaaattctgccgtcacccattctcccttgtttttttaatcgaatggtattttcctgcttttcattcatccgataatccagttcttctttcatccggcttctggcttctcgcatggttctctgggagattccctgtgcttttgccttttcatccagttcccggattgtgactgcatttccgtctgcaagcagttcatagatcagtttcgttccccgttgcagttttgtttctgtcggctttccttcctttccgtccagaagatcatctgcggaaatctcataagctcccacccagcggaatccttcttcatctccaagtttaaatgccatcgtctcacctggaggtgcaagagaacttttctcatggatcagtactcttgttgtcgggtctttctttactttcccgataaaaagcaggcttctcaccgccgccatgatatcaatagaaccaagtccccggtaagtactctgtgtccctgaagatttattcagatgtccgatcagcacaatcgcacaaccggtcttttcagcgatcattcccagtttccggaataccggacggacttcatttgcccggttcatatccacatcggcaccgataaaagcctgtaccggatcaatgattaaaagtctgacctgattctgacggattgctttttcaatacggtcatcggataacgtcaatgcttcctctgtatcatcaatgaccatcacccgactcaggtctgctcctgcttccaccagcctcggcttaatcgtatctcccataccgtcttctgcagtctgatagatcacattaaaaggttcaatctcttccatgttcgggaaagtcttacggttcgtgcaggctgcggtcagcatcatggcaaaataagtttttccctctcctggattgccctgaataatcgtcagttttccaaatggcagatagggaaaccacagccattctacactggtctgttcaatgtcttcataacacaacatcggcaccagttcttccttctccggtactttcattgtaactgtttcaatgattgatttcttcctgtctgcatttttatcacagaggatttcattccagtcctttcgggacggtttcagacggatgacactgtatccgtccgggatttctattgccaatttctcactggcttcattccctgcatggtcattatccaggcacaggaaaaccgaagtaatctgagggcgttcagaaagaaaagccatcagtgccgcactggaaatgccacccagactcaggtagctccgctttttccagtctttgggaaataattggataaaagaaagcagatcaatggctgcttcaaacacaaacaactgattatccgtccctctgtgacagaatccgtaagatttatcagattcagccacatctccccggtattttgtttcaccagttcccctgcaatgggcatatcttggaataccgtctgcatctctgccaacaaacaccacattatggtgcttcttttcttcataaatatccccactgccgatccattcctccaccatattcttttcaatccctctgttttctgtcagatatctgatgattctatcattattttcctctttctctggtaatcggaagtcaggggacggggcggggcaggtactgttcctgccttcgccttcctccccggttagcatcttgacagcttccggaaatgtggcattgtaaaattccatcacaaaatccaccggatagccacccctcccctgactgtgcctgtaccaccggtttccggataccgttacactgtcatgctttttccaacggtattcctttccgcttttccctagttgttctccctgtgcgctcagaaaagaaacaagatctgtctgatttgctcttataatttgttcttctgtatactgcattttgctcatcctttcccgtctgtcctgctgacagactgttataaactcatgtcatagtttcgctttttcttcactgcctgttgttttgcatcacgctctgcacactctttctttttttcatccagttttctcagaagagaggtcttcttttctggattctgctccgactggttcaacggctgttgctctgctttcccgttttcttcaagaatctctttcgcctgaactgtgtaaaatgtcgggaacttcacctgcttctcccttttttcttctgaacgcccggaagtatctgcttctgccatttcccggtcacgtctggcaatatccgcacagctctgtacctttttcacaaaagttagttcctcctggtacggctgattatctgctttcagctcttcgatccccgcctgaagttcttctttctcccgtttccatctggcagttggcacttttccatttttatccagatgttgtttcagttcccgttcacatttgcggtaataattgatttcttttttatgctgctgataatatctctcccgtcttttctgaaaatagaaatggttatactcatcaatcaatggctgatttgtttttattacctctgccatcttttccagattctcaagttcctttaactgtttccgcttttcagaaatttcttttttactgacagaaacaacaccgttcagttcctcaatccgttcctgcaagtcatccatcgtttctatctgatgtgtctgaagataactgatggattttgcaaactcctgtaaattggagagattcttacctctctgtttcatctccgcataaaaattgggaagtggtggtctgccctgtgtctttttatcataataatcctgcaggctttccagcagtgtcgggttctgcctgcgatccagctctgctttcatttcctcataagctgtcttcatccactgaatggattctttcagagaaataaacatctggttaaactgccggattgcccggttcaattctccgatcaccgttttgattccctttttctccattgcccggacttcatatccctcatggatggtcgggatcaggtcaatcccctgttctttgtaggaacggtggtcgattctggatgccatgtggcactccctgaatttcccatttactttctctgtccatgcccgccgccattcttttaaaagctccggatcattccatccggtagtagaaacagcattgaacatatcttttcctttggcatccttcacccggtttccatcctcatcaagaatatattcccttctctgcttattgccccagattccttcctctgtaaaaggacggattgggacaagcacatggaaatggggattatccggttcttcttcattttccgcttttccctcatggactgccagatccacgatcatgccacgtgccacaaactgctcctggcagaactcttttgccagtctgatattttcctcaagtgtcaattcattctgcagtgcaatgtcaaacgaataggcaagctgtgccttgttgttccgttccacatgctccacctcgttccagagtgtttccctgtcagtcagacgctctggcacatactccggtgtcaggatttctgtaaatatcacacctgacttgctcgtataatcgtgtatcttgttgtaataactgtcaaaaatcctctgcccggaaatataggctgcggaagcgaccaccatctgccctttccctctggatacattccttactgaaaaatgatacagtgccattaactgtcatctcccttctctgtcttttttactgcttctgcaatctgctgttgatctttgtgtaaggcggctatatgagcctgccgcacaatactcttgttgtaactgctgttctgcagttgattcatcatgtcctggacgtcttcctgttccagatctctggacagcggaaatactttctcaaactctgcccctttgacaatcagccggtgggaacgttccctgcgttctaccagcttcttccgctgctccagaatgtttttgtggtgaattgctgcctccagttcctgtctgctcttttccatgttggccttcagttcctccaatgacatggattcatactttggattttttgctctgctcattttcttgtactccttcttttttctgtaaacaaaaagaaccggcttattcatgaatgccgattcctgggtataaaaaactgaggtcgttgtcctgtgattaggaaatgctgacctcagcgtttttgaaatatttaattgttgctccttggaatgaaagtctttgtcaccattgtcgtataaatttaaactcacatcccatatcaggatttctttaattcttccatatacagttcagctatatatgccggaccagtgcaccacagctttgtcttctcatcatacagtgcttttcctgtctttgaacacaaaaaatctgtcaatacctcgtttctgtccttgcctgtctcttctgcgatttcatctgtcaccatagtgatcagaaggtcgattgtataattcattttttcctttggaattgttacttcagccatatcttctcacctttcacaaatttcagacactcaatagctgcctcagttttaaagcagtattgatctttcaatttattcggcagcaactgtctgatacagaaatcgtctgctactttatcacctgcagtcccaaaagcacccgcaagataagcggtaagagtagcgtttgttgcatcatccgcaatctttcctgcaatgatatcatattttgccatttcacgttcaacctcaataaacatttttttctttcggtgagcggcgatacaatgtaaccagtccacatctgcattttcaaaaatatgcgtttcaagattttctgaaagtttgaattcaaaagttgaaatatatccaaacttctgcccctcttcaattgttccggttgcgatggctttggctattgaggttctcagaaaactttcttcctgttcctttgatgtggttaaataaaatccctgtccaaaatcttttctctttgcacatttggcaagatctggctcttttacttcacaataacttccatgatagagaacaaatccatcttttaactcaagcactaatctctatcccctttctttgcaaaaattcagtaatatcttcaagcacagcttcatcgccttcacaatgaaaaatcccatagcatttttctatatatccaagaacatcggcttctttaaacaagtggataatctgttcaacaggtaaatgccactcttctgaagcaagccggattagtcttgtttgcataaaagtaatctctgttttctcactcattatgaatcctcctcattttcttagtcagtaaaaccggaattgttgattaccaaggcatatttccaaatcgactaataaaagttactgttagtccggttttatcaatcattgcaagttttacgattgcgcctgtactgtttgctttcctccgtcgacattcaaatctgttgccgtggcacctggatcagcgcagttcacctcttatgtcttggagtccttttgcatacttccaaaagaacccagtccgcttgaaacatttacgataatagttttattttttctctcattgtcatacaatgcacctacttccccagaatttattttaccacgtattcttctgttcgtctgtcacctgcatcgtatctgcatttaccagataaaaatctaccaattcggtctcgtaattgccatccggatatactttttctaacaccagttcttcgcaggaattaccatctgcatctgtcttggaaccattatcgtacagacagtatctcacatttaccgtattaccgttctttgtttcctgcgtttcgctgacgacagcatagacttctccctttgcattcgccgtgtaactgaacgccatattttgaagtgtattctgctcctgaaggtaattataaactgccagcattgcattttgaattgtcagaccatcatgctgcccttctgtctcgtaatcttctatggtatttccactctgaatatcctctgaatctgttgaattctctgtatccaaatccggtaattctgtagtatcctcttcttgattatcttcttcatctattgtatccgaagaccaccacagaccatccatactctgcataacaaatggattattggttctgtatctccgttcaccaccataatcttcctgcacagttatatacgtatatttgctgtcacaaccagtcaccgtttctgttccatccattccgaacactacactcagaccactcattccaataatcaaaagtgcaaatatcgcagcagctccatagacaattatcaatgccactttgtttttaccgaattgtatggataatgcctggcaattgtgtctgtataaactcacgatcccccagatcaaaagaaccgccagactgattgtaataacagtaatcgatatttctgcgaaacgatatctcacttcatatcccatatcacgttttataccataccacaatccatagaagaaggtactatacgcaagaaccaaagtaatgatactgatccgtatcggatgctcttttttatccggcactgccttcttcagtgcctctgccatctgcgctgccgctctctgctctatccacatagcaagctctgcttttgacggatatgtgcatttagtatccggaatccctgcgtaacacatctggctctcttgaatccctgtcgcatctcctgctgccattgctgtaaccactttcaggtaataatacaacttcaactgtgctggattgaatttatctatacgaatatctgccagctcctgtgcagcccgttcataattgttaaggagtacactcatccgtgccataaccaaaagcatctgattcgctacagcagggtaacggtgatattgcttctcatataaataccgtgcatactcatgtcgttcttccggtgttaaccgataggacttctttctattctgtgccagcatcgcaattcgcagaccataagccaattccaaaattgcaatcagctggcagataaatgcaccaaatccccagatatccgttgtataccgcacataggtcaccaacacaatgcctagcattgccggaatcacgatcaaccattttgtccaacctgatcttctcataaaaatctcctgaattgtttttctgaatatagtatattaccgcacacaccaatcgaccatatacatattgtgacgatgctgttacttaccataacagttgctgtttctaaggtcatctatttatagcctgagaaataactggtttcccatctctgtccaacaatggagtcagtccacctgaatacccacatgcatgatataaataattcacaccagtttccttatccacccatatctcagtagtagttaatgctccctgagaatatattttttcaaatctctcttctttcgccattttcaatttcctcccataatcaatttttcggttttataaaaaatgtttctctgttactttctcgattgtatcatgacatacagttccatcttcggcaatcgtcgattttctgataaatctcgaatgatgctttaatactccataagcataccagtcatggttgcaaaatactttgcagaactctgcatagccatgttccttacaggtatcgaaatacagacacctgctgatttcataagtaaatccactatcatcatcctgcaaaatttctgtctcccaacatacctttttttcgccctccagatcatctaccagagactgtctcacaatcttatagccattcggcaataaatcgacatgcttttttctctttttccgttaccatattttctcccaacttgcacactaagtcataattttccaaacactaaaacttgaatttctatttctgctgccatgccattacatagtctttttctccagtagcttcatccaaaccgctatactgaatctcaaatccttctctttgataaaaggatattgcccgtgtatttttttgatatacatttaagattaatttgtttctttttccctttacatagtttagcaaaattttacctataccttgagattgcatttcggcaaaaacaaaaataccttcaatgtattcgttacttaaccctataaaaccctgtatttcctgtttatcctcgtaaacatagacagttgcctgtaatagaagttcttttactaactcaaaattacttttccaatattgagcagagataaaataatgtgtctttatatttgtatctaaccatatttctgcaactttatttatatccactttccgtaattctctaatcataacggtgatgctcctcaaactccgattttctcaatttttcaaactggaatttacgaactacaatatcttttcgagaaaaagatggtttttgtgtgcaattacatctccaacttttttagaagcactagcaattatttcaaatccatttttttgatacaaagatagcgcaggaatattttgacttcctgtatccaaacgtagtgccctgcaactatttttttgtgctaattctgtagcgaattttattagtgatgatgcaattcctttaccagacatactcggacgtaccattaaaaggtgaattaccattacctcatcttcagataatttttctttccaaggaatagttgcatattctattggttgaactttatcaataatgatacttccaacaattgttccgttttcttcatatacaaacaaagcaccagcataaatagcccgttctgcatcatctttcgttggataaacccctttcttaaatacagtaaaggctgtatgattcagttcatactggaaatgctcattgtaagtatcttcaatcgaattaacatcttttagtattgcttttctaatcataaaatctctccacaaattttgatttcacactttctttccccttatatgtctatatctgaaatattcagtcacaaactttatcagggataggcatctgtgccgcaaggggatcttccccttgtacgaaatctctgatttcgctgtatttcccggtttgagatttcttgaaatcgggaacagcaccgcaggtcgcacgatacaggcagatggaattgcctgtatagaagtgcgctcttagcgttgctaagagatttatgccgtatccggcgtgttatcttttttcaatttcttttttcgacttctgaagcattcttccagttttaataatttgacatgtctgctcttgttactcatcatctgtaaattccagcatctcatcaacggtgcagtcctgcttcttgcagatcttctcaatcgtctccattgatacatactggttttttcccatcctggcaagaatatttccactgatcccggtgaggtactgcatctctatccgcttcatatttttatctatgagcattttccataatctgttataacttacgcccataagcaacctccatatttttcatctgaacatattttgattatatcacgatttcgttaggttgaatacctgtaatttttgatgtcttctgtaaaatggaaaagaggatgccccgacaaagggcaacctctccaaccatttacttcggtttagtcgaatggaacctcaccttccggtgcttccataaatccgtccttatctgttttcggtgtttccgatgaatcagctccaacaccattatccttgttctgggcaaattcatgttcttccacgatcacatctgtagtataaattgttttcccgtccttgtccttataattgccagtgctgatacgaccgccaatcacaatcctcattcccttgtgaagatatttctgtgcaaactctgcactctttccgaatgtgacacaggaaataaaatccgcttcctgttcaccgtcacgtttatatcttctgtttaccgccagtgtatatcttgctactgccatatcattatcttttccggcatatttgatctccggattctttgtcagtcttcccattaaaaccactttattcataatcgttactgtcctttccgcagctacgctgccattgcatattcttcatcatctgtttcatcgtccggcataaacattgcacatgcttccggtggattggtatcatccggtgaaaatattttccggatcatttcatacatgatcggataccgatatgcgatttcttctcttgcaaggaatctgcataccctgtaaagattctttttcatttcttcatctgttgtaagcatggcaaccagatggattctctcccttgtataaatcagattcgggcatccaaaccagttaatcaactgcatttctttcattttcagttctgtcataaactgctcctttccgggcattttgccctgtaaacattgtcatcagtttcattcgtccggcggtctggcgtgcgtttccctgtcacctgcagccgtctcagactgcctctgcctgcatcagcaggtcactgaccataaggcttcggtcagccgcccatcatcgggagtgtcattataatttcgctcgctctcagaaaaagaaaggtcatggcataactcctgttaggcttccagggtgcacttatcggttgtcaaggttcatcgaaggaacattccaaaacgtcctctgattactagagtcaaatgacttcgcaagatgcaaaagattcgtgatatttttttgcatttttatcattttttcttttacttttgttagtcccttcacatactctgtactgagacaggcaaaagcggacatctttggggtaaaatttttaaaataattgttcctctacctataaagcctgggaagcggtatttaccaacccccttttgcaagtttttttcgcataaatgaaatattccctcactaatagcaagtttcagagggcatttggacggtacttttgcagaaaaaattatttttccactaatcacacgtgggaatttgaagaatgtcagataattttgaaaaaatccaaaaaagaagcaccgaccgttatagtcagtgcttgtaagatattatattcgtttttctcaggaaagatcatcccagtttttatatgttccattgtacagacctgtaagttgttttattgtaagattttccagtggattttcttcatttatcacaatagctatagcatcttttccaatgacttttgtttccagaagctctgcttcataatcctttaattctctggatgacattgcgaaatcacactctccacttatcaccgccgtaatccctcttgaagaatctgttgcttttacttctatttcagcatttggattttgtttctgatagtcatctgccagtgcttttaccattggttccattgaagtggatccttcaatcagaatctttccttctgacttgtcagaaaggaatgttgttgtactgtcagcctgaatacaatattgtttcacaatatcctgtcctttactctttacataagtcaggaaatcctgttccacatctgtcagttctccattataagccagataataatccctgcaaagaggataactgttattgtctattgttttctcagaaggaagaactccgttgatttgaagtatttttccattcgtatctgttgcggaactatatgcgacataaccaactgcgtttttatcttcttccacctttttcagaactttctctgtagaatcaacaactattcctgtatcactctcaggcagtttcaaaagattctcaaattctgctctggttcctgacccttcttctcgtgatacagctgtgacagttcccatagcagacagatccggcaatggctcttcctcggttccacatgctgttattcccgttgccagcattatcattatcagcagaagtgcagattttcggatgttttttttctttaccattttatactgcacctctttccatcattgattttcccgtctcttcatcaaggtttataaaagccacattatcacaggcttcttctgcaatgctgacacaattatctgccatacggtcaaaattatacatgatcccagaaaaatatcttgtcatagacgcatcacaaacctcattttttacacggtttaaatgtgccttactgtattttttctctgctttatgcatttttttcttattttcaaaaactgtttcagccactacagcatcacccttacggattgcctccattgctttctttaaaagctgctggataatatcaatgcagtcttccatttctgaggaggcttcactggtcagtctttttccattgttatttactttttcacatatctggtcaatatcttcacatctgtctgcaatcctctgaatactattgtttacatacagtaaccctgccgtctgctcagactgttgttctgtaaggtttccgcttgcgaataatctggtaatatattctgtcacactgtcctgtaactgatgtacaatctccagattttctataaacgaaccatgagtttttgagtctccatctgctacaatcgccgtttttaaatcacttaacagagattctgccagttctccaagtcggttcagttccttagataccagaaccatagcagccgccggctgttcaatcactttcatatccagatatttgggttcaaaagctgctttctctgttttgtcatttccacggatgattgttgtaacaatttttaccatcagcggaatcagtggcagccagaccagtgtacagacgatattaaacgttgtatgtgcatttgcaatctgtcttgaaatcacatcaatctcatttccctttggtgaaataaactggacaaattttgcaaaccacggaaccaggaaaataaaaacgcagcttccactgatattaaaaatactatgcgcaattgctgtacgttttgcatttttagattgtccaattgatgcaagaagtgctgtgatcgttgtacctatattatctccaagaagaatcggaatcgcaccggtaagccctattacactgcttactccgtccggtcctgcctgtgatgcaaaattctgcagaactgcaatcgtagctgaactactctgcacaaccaatgtcatgaccgctcccagtacaacaccaagaaccggaatggatgaaacttttcccatcagatcaacaaagaccggacttcccgccaaaggtttcatgacttcacccatgatttcaattccttcaaataaaagtccgaatgaaaaaattaccataccgatatttttaaccttttcttttttgctaacaaagttcagaataaatccaacaaagataattggataaatataattgctgattttaaatgccatcagctgtgccgtcatagtggttcctatgttggcaccaaagataacagaaattgcctgcggaagactcataagtcccgcactgacaaaaccgataaccataactgtcgtcgctgaactgctctgcaatacagctgttacaagtgctccggcaagtgctcccataattggatttcttgtaagaaatccaaggatttttttcattcgttctcctgcggctttctgaagtgcatcactcatgctgttcattccataaaggaacaaggcaaggccaccgatcagaccaaaaaccactttcacattctcgttcatttctctgtcctctcctgttattatataagatctacattttcctatacaattatagaagacagaaatcaaatctatgtgagtgcttgtgtaaaataggtgtaaaaatcaatggaaatctttataatgttataattgacttattcatttttcacctgctgacatatagttttcattacgatttattattcagtctacgtaataccaacatcgcctcattccttacatttttgaacgttctgtccggtcttccaagaaaatatccttgtccgtaatgaacacctaatctacacagacactccaactctgcttctgtttctatcccttctgcaatcagaattgctcctgtctcattacagtaatgcaacagaaattccatcataatttcctttttcttatgtttttgaatatctctgaccagttctatatcaacttttaagtagtttggcgatgtatttactacacggttcagaccagaatatccagctccaacatcatccaaagctatttcatatccctgatctgcataatgcttcataatctgttgcagaatctgatagttttctatatccgaccgttccgttatttcaaatacaatgtcacaggacggtactccggctttcgcagccttacggtttgtaaatccctgtatgaacgatttatcctgaatgatattaccatctacattaagaaataattttgcatgttctggtttattcgccgctgccttcaatgctttatttctgcacaatttttccaatttccaaacacagcctacctgttcagcaatcacaaacaaatctgaaatcataagagtcgtatcatgcctgtcgatacgactaagagcttcatatcctgccacatctccagtctgtaaatttacaatcggctgaaataccggatatatagcctttctttctaatattttataaaattcatctgcattttttactttcattatttcttctctgcctctgtgaatacattttctgtaaccctatcaacccactatatgatatcatcactttttcatccttcaatcagatttaagtaaaatcatagtaaattttcaccattgttcagccagaccaattcttatataacacaaagcaaatacgtactaccacctgttttttattatgaaaactatattaaatgaggctcttactgtctatacaataaaagcctcgttatatatagtctatgttctgattattcagatcttactgtctttttcacacaccagtctttcataatccagaaatccccggatatacatttcttttgccacaattccctccattgcatttttcgctgaaataatcctgtccagtgtctgccacatctcctgtccgccatctctgaggaccggttccagtatttctatgtaatgatgaatttctgcttccagagtgaacatctccgggtcagattcaagaaatctttccagctcccgctggtattcttcataataactttcaatcagttctcttctcatatctagaatcccccttatacataaatcagttcctgcttgatgatctcagcagcccggttgcggatattgttacagtggcatagccattccataggattctgtctcttcagttcctcggaaactccctccgcacttcgcatctgagtttcgatcaattcaaagcgttcctgtgcctgttcattcagatctgccaaataactgtccagcctggcggtcagaagaagatatgtataagttccagatttatgttctttcagatattccttccgaagcattccccataagccaatcggtctggtttcctccgggtagtaaagattcggtaaataatagtctcccacttttgtgtattcgattttcatggtgtctcctttcgctttgcatgaaattgtcatgttatctgcgtaggatgtgcattttctctttaaaatcttttcacatagaagacattaagtgcttgattccctgtgacttagccccaggattgtcgttgccgtatccttccagaagattaataactccccatactgcaagacctgctccgattgctactacaagtgtctgtaaaatattgattgctgaattaaaaaacgacatatgttttatctcctctcaagttttttgctcataaattcctgctgtattctaaccggctctgccctgatgggcggtcgttcatacctgtgcatcctctcacctcccaaaagggcaaagaaaaagagctatgtagttggattttctacatgctccgcttccttgttttcactattttcctgttccataagactgtcccctgagaacacatacaggtcaaactcctctgaccttgtaagttttacttccattctgtgtctcatgtacgcttccacatcaaattcattgcgtttatcgtaatcagacagttccttatagcgtttatgttttgtaatatcatacttgtcactgaaaaacggacggacacctcttagctggaggatacacttatttccatccatcaccgcaagttcatctctgctcatcagttcttttccggttttctgatagttcatcccgtaagaacggctctgccctctcgtatccgaagtattatataaatcaatggtttccttaccaagtgtttctgaaatctcttttaaggtggaactttcttttcctccaaggaacagcattgtgtcacaattccctaaaatggtttctgcagcatctttataaatagtctttaactgtgactgcgactggagtataatagaagcagatatttctctgcttcgtatggttgcgatcagcttgtcgaacttcggaatttgtccgatatttgcgaactcgtcacagaggattcttacatgatacggcagtctgccatggtgtacatcatctgccctgtcgcataataaattgaataactgactgtacatcattgctaccacaaagttaaaggtatcatctgtatccgagataataacaaacaatgcagacctctgatctcccatcatatccagttccatttcatcgtaactcataatctcacgaagttccgcaatatcaaatggtgcaagtctggcaccacaggaaatcaaaatcgactttgccgttttgccggcggctaatttatattttttatactgacgtacagcaaagtgttccggctctgttttttccagttcctcaaacagcatatccactgcatttttaaaggtttcgtcatcttcccttgtttcactggcattgataaattcaagcagtgtcgcaaagttctgttcttcctccggtgcttcataccagatataaccaatcaaagcacagtataaaaggcgttccgctttactccagaaatcttcactggacttctcgccttccccttttgtatttaccataatcgtattcaccaattttaaaatatccttttctgaccggatgtaatggaaaggattgtagtgcatactctttgaaaagttgatggtattcagcacttttatcttatatccattccttactaacatcatgccgcactcaataataatcgttcccttgggatcggtcacgacataactgatgtattttcccatctgcatcagattcggctttacatagaatctcgtcttaccggaaccggagccaccgattacaatcacgttcttgttccttgcaaatttcggcagctttggtctgctgttcatggtcagcctttccgtcatagtaagaagaatattgttttcaaatattggatcaatgaagggtgcaatgtcttttgcagttccccatcttgccgaaccatactcttctccctgtcggaactttttggcatttttcatcttcatcataaccagaagttttacagccaatgccccggtaaaacctgccagtagtggcatcttttctatgcttggcagaacagaagtaaatgccatttgaaaattcaaaagcagcaccatcagccgttccaccgatgaatctccctgacaatactgatacagccatgcttctttatctaccagataaaagattatgacataaggagtattcaatgccagtatccgcagggaatttcttttcagatactcccctaaatctaagattttttctctcagccagtcagctccccattgaaagccttgcataagcagtggcgggattctctccagataccccttgcatactttacgcatcttctgaaatcggttcatagtgtcggctccttttctttctgcttcgttttctcccgttctcggttcttatccttcgcctgtgtgatcgcatccttcagttttgtccttacagacggtttctttgtcttattgagagatttaccagtatattccttaaatgctgcggtcatgacatctgcatcccttgctttgaagaaaacaaaatatctcggcggctttgctgtcgtatcttttttcagactgaaatcaatactgtactttttcgccacccgttcaaaagatttgatattcccatcagtaatttcaatattggaaagctgtacattctgccgcatcagcttatccatggtttgttttcctcgataagatttatccttcgtcttgtcatcctgctgtttttctactttactctgctgcttctgttttgctttctcctgttccatctgggcaagagcttttctcatggcagctttaagcaactgggcagttatctttccaccccggatacacagggataccgttttttcatttacttcatcttgcaccgttgtcctcctctttcttaatctgttctttctttaccagctctttcagataagcctgtactttctcataacagtcatatccctggctgatcaggttctcactgtattcatacagttcctccaccgttttaccaattttgtttcttggaacttcaccaacttttttaatgatgtacccatgggcacctgtttcatccatacaccacaggtagattgttgcttttttattttgcttggctgtatgtactccactgacttctacttcaaagcgatttccaaagtttctgtaaatacaaagctccaggtcaatctccataagtttataattttcgcccagaccatcacataatgcctgaagcactttatccttttctttcattttcgtctgctcctttatgtcgaatcaatcttcattaccatacatatcatgctgcaccaatgcggaataataattactaatcgtaagtggtgcattatacaaaactgtgagaagatactgccggatattcaccactttactggtgttttctcttagacatttcatcacaaaccggatatgttctgcatttaattttaaaaactgactttttaccacatcaaatggtttcctgtctctgccaatccagataaattcccggtctgaactgataacatccaccaccaatgcaacaatctcattcagcatttccctgtcacattcttctatcaggtactcgtacccgatgttatgacagataattttgtaatacgcttctctttctatctgtttcctgcggctttcttcactctcatccgcagaaagaaaagatagatactcagtatcatttatctcagtcttattcttatcagtatcattaccaggcactttggacatatctgtatctgccattttgatatatccagaaatgtcattttgacatgtctggatattcccttctgataaatctacacagatgcaccgtcgtacataaatcctgtccggttttcccaaaccctgccgtatcctcgttatcaatccgattccctttctgctgtcaagctccgcaagcaggcttccgacctttttcagcccacaacccatcatttccgcaatctgttcctgggaaaaatagatataaacctttccatctgcatccagccatcggttcttcactgaaagctgcatccggtcgagtaacaatccatacagcagttttgcctcacaggacaactttctgaacttcggactggtaaaaagaactttaggaatccggtaaaaagtatattgttctgcttcctccccataatggtacggaaatatgcagtctttatccggtgttccgatgcgccttcacttctttcagtatttttgcaatacaatatccaaggcagggatgatatttgccataaggacagcccttacatggcttccaatgattcttaaccgccattttcctttccctcaccctttgtcagtctgtcatagtctttctccgattctgcacctactttgatacagcagtacatgacaaatccatatactaaaaacaccgcaacagatgcagcgatcaatactgttttcattttatctgttcctcctgttcttctttttctgggaacctgccactaccagctttccacagatacatctgttatgaaaaagggcatttatgaactgtttttgcccataaatgcccctatcctgtttcaaaaccttacagtttacttatttttttcctttttttacgtaaatataccgcagatgttccaaatccgatcattcctaatcctgcaagcagaatccagaacatcacaggtgtgttatcacctgtttttggtgcatcagtggatattgtactggatggagtatccgttgtttccggtgtctcagaaggagtttctgttgatgtctccgttggcgtttccgtcggcttggcttcatccttcatcacaactttctgaatttccccggtatcttttacagtgaatttcacatcctctgccaccagataaccgtccggtgctgtttcttcacgaagcgtatattctccaatcggaagcatctcgatatagtgtgctttctcttcagaagtccagctttctacgacctttccgtctttgtcaagaatggtcagcttcgctcccggaagttccttcccagaaatatccgttttggaaatctgcactttcgtcacatcatccttcatctcgattttctgtgctttagaagaatcttctactgtaaaagtaatactctccgcagtcacatagccatctgccggttttgtctccgtcagagtgtacttttttcctgcaacaagctctttaatgatatgagcctctttcccggaagtccatgaatctactaccttgccatcttcatccgtcacttccagtttcgccccttccagttcctttccatcagtcaaagaagtttttgtaatctccacaactgttggttcatcttcaaaggtaaactcataagacagtgtttccttatctgcaccatcatattcaaaagtaaactcctgtacctgatccgttgttgcaaatcccggtgccggggaagtttctttgacatagtaagtgtaaccaatcggaagatctgccgtaaatgtcagttttccctctttgtccgtagcctgctcctcaataacggtatctgctttcagaatgacatcaccatttgcatttacaatgtcctctttattgcaaagagcgaatactgcaccttccagtaccctgtcagaatccttttcttttttcagcacctttacttccgctttctgacggttattctgccagtcggaagaataagttacctcggcagtatcctgatcccggtatgtcaggtcaatctcacgagctgtaccatccagtacatagccgtttgccgtttccttttctttgacataatatttgccaagcggaagatctgtcagttttgccactcctgtttcatctgtcgtgatcgttgctatcagatcatctttcttgtaataatcttcactctcaccatccgcagctttaatatcttccagtgcataaacctcaaaagtaacttctttcagggaaccggaaatatattcaaataaatggctgagccatccacctacggaatcaagtgcagatactttttccagaaattcacccttcttattgataatcagagttccagtcggcacatcatctttcatttccactttctggatttcagcagtatcctctacagtaaaggtaatctcctccgctttcagataaccataaggagccatttcttcacgaagagtatatgtttcacccacagtcagccgctcaatcagatgttcctcaccctttacagatttccatgtatctattacatttttatccttatcgagaactgtcagtgttgctccggaaagttcaactcctgttgtaatgtcagattttttcactgtgattttggtcggctgatttttaaattcagatgcaagttttactactttcacatcctgtccctgataagctgcagtgacatccaatgtttcatccgaagacacataacctgccggtgctgcaagttctctgatataatatttgccaaatggcaggtcaaggtcaaagactgcattgccatcttcatcggttactgcttttccaagaagtgtatctgctttcacaatcacattttcatgtgccagaatatcctctttcgcatacagaccaaactctgcaccagcaacaaccgcatccgtttctgcatcttttttcacaacagatacttctaccttctgacggtcattgtcaaaggctgctgtctgctcgatcactgctgtatcctgatctttataagagaaagtaactgtctgtgcttcctcatttaacacaaaaccatctggtgctgtcttttcgacaactttataagttccaagaggaagatccgcaatctgtgcctttccatctttatcagttgtaaccgttcctaccagtgttccggcagcatactctaagatacggtttccattgtcatctttctggaaatccgcagtataaatatcttctgccgcataaacctcaaagactgcgccttccagattctcactctggtaagtaaaatcgtttttaaagccatcaagaacttcaccttttttcacaatattaagttcaccctttaccggatgattctcataggaaacctcgatgatcacatccccggaagtaccatccatctgatatgctgtattggaatctacatcaacctcatagtaattctcattgagcgtatatccataaggtgcatttacttcctcaatgcggtaatgcccgattttcagattttgtggaaggatcaaatatccatcctcatctgtaaaataagacttatgcttcacagtagttggataagtcgttacctgctccacatattttccagtgtccatgttatagattttgaactctgtatttttctggagtaccgctttctttgtttcatcatcctttttgataattttcagtttggcttcaaattcatcatctaaaagcacacgccatgtctgcggtgtgttcggattattttctgtaatgctgactgtaaaatcatctaccggagtataattatgcggtgttgttgtttcacgcactacatatgttccatatgggattgcaatactgcaggcatatcctttttcatctgtaaagatttccgttgcaccattatctccgatcactaccggttttgcagaatcaaaatcataactgccatcttctttcaccttcaaagaagataccagataagcactaaatcctgcccctttcagtaaatccgcatctgtctttccattattggctgctttgatgatctgaaatggctgtttcattacctgttccagcgaagtacactcacgcttcacctcagcagtcatatcaccctcataatcacaggaaaggtcatattcattctcatctgccagataaccggttggtggtgtaatctctttcacataataacttccaagatacagcccgctgacggaagcctgtccattttcatccgtagtaagtgttgccacctgatctcctgctttatacatcacaccggttgcaccatccggatggacaatgttctctctggcatacagtccataaactgctttttccagagtcgcatctccctgcggaactgctttctttgtttctgcatccagcttctgtaaagagatctttgctgtcacacgttcatttttaaaagtatgattaaatgtcacctttgcttccttatcgtttgtatataaaaaagcaaactggtaaacatcttccgtatttctcacatatcctgttggagcctgttcttccttaacttcataggaaaatccaagcggaagatctgcactgaattttgcctttccatctgttccagtggttgccttttcaatcagtgtgcctttctttgcaactacagtaccgtccacatttgtaatgtcactggcagcataaattccaaaaatacctccgttcagaggattttctgtatccttatcctgctttgtcacaataacttctgctttctgtctgtcattcgtaaaagttgtttcagaaaataccacttctacattctgtcctgcataagcaagttttactgtcttttcttcccctgcattataaaaaccagacggagcctgtacttcctttacaacatatgtaccaagatgcagatttttaagaattacagcaccattggaatctgttgtcaggttctcctttaccagatcacctttactgtaaacttttgtaccataagcagttgtaatatctgctccggcataaacattataaacagcacctttctgtcggcgtttttcatatcggaatgttgttccgttttctgtcacatcggcacctgtgaggacttcaccctctttatacacagtaagctgtccaagctgttcttcatccggaacagttaccgtagtcgtcttgctgacttccagcttcacattgtaggctgtagcattaatacggtaaccgcttggtgcagtaatttctttcagataaacggtatcctgtgtcttaacgatctgtgcagatgcttctccattcgcatccgttgcaggcagttttgtaatcagattcttacaatctgcatcactgtataagccgaatacagctccggacagttttgcatttgctttggaatcctttttaatgactttcacactggcatactgtacccatgtcactttaaaatccacatacttttcatcatcgacaccctcaccaaataccaatgccaaatcctgtgaaccagaaccggtactgatcttataagcagaataatcttttgtgatacttcccttcattgtcgcggaccagcttcctgctacatcacttacctgagtaagcggtgcagacagatagaactttgttccgccactgatcactacggactctcctgccttgcttgtctttcctgttgtcacattatgaagctttactccacttggaagtttcattgtgatactttgcagttcatctgccttaaaagtaatctcctttgttctctggctgctgccatctacataggcagtcacattcgcatctgaaaagctcatctcaacatctggaatatttggctgcgaaatacagtaattatacagtttcatagcaagtgtttttgctttgctgcttgcaccggaaaaagcagaatctccgctgttggcataagatgctgccagatgcaccagaataaatcttgctcctgtactcagatttccatagccattctcttctgtaaaaaatccatcatccccggatgcctttgttccgtaatagcagactttcgcaagtttcttaccatcactcagcttggtaatatcataagttccacttcctggactggatttttccggctgaatacagtaagcagtagcagaaacacttccaaactttacagtgtactgataagtcaaataacttccgtaaccataatcagaatactgatagcaggctcctcttgtcactgttactttcttggtgcttgtcgtagatgctacccttgccataaaagtaactgattccccttcatctaaagaataaaggtcgattccttcctcgtcagcctgttccatcacatcagaaactgtcagtccagtttcttcgtctgttgttgtttctgattcttctgtgagatcagtcactacttctgtttctgtctgcctgtccgtctcttcatcatctgcagttccaatatcctctgtttctccggcattaccttcacccgtagtattctcagaagtatttgacattgttacggcttccgtttccgcttcccttaccgtcacatttctgctgacacgataagacggatttccactgactggctctactttataaactgctttataggtatctgccctgcctgtatcaaaatcttcacctgcttcattcttcgcttcataaagttctatctttaccttggcatcattgattccctctataccggaaaaatcaactttgatgtcaaaatcagaaccatattccaccgtataatcactggccgtcacaatctcatcctctgccagtttatccttcaccgtttccagttccggatactgagattcaaaagaagaagccgtattatccggttctgctgcataagttgtaatcggctgaaatactgtggttgcaatcgtaagaacagacagcacaccagacattactcttttccaagatcctttcatttctcaatacctcactttgttttatttttctgttactgatttacaggctttcacctgtctgatacaatcataagcatcactccgttttaaattatttgtgcgaacatcacttctgataacagcacagtcatacgccggagcctgcatcatgcaaaagttccggcgcatagtctactgtcatcgcccggcgaaccgggcataacaaaaataaggattgagcattttccgatcagaagaaaacttttgctggtcgcagaatgcgtaactgagcatccgctcccttctgaccttttattcagttatcaaggttcgccggattgggattatcttaaagattttctttcagatgtttacctctccactaattgcaagtttcagagagtgtttggacggcaaaaattgaaatttttttatttttttctcaaaatcatctcggttctccattttcatcaaaacttctggatattttcattaatgctttatgcactgcatcagacacactgcttctactcattccatacatactcgcaatctgcttatgcgttttctgttcccagtaaacctttttcaatatctccttttgtttttccgtcaatacactcatcagcagttcaaccatctgctcctgactgacctgttcctctatttttgtaagtttgtcttccagctccccataatcttctgcaatcgcatgataagaaaaacatttatggttacggtcacgacttaaactattgctgacaatacggtcctccccgatcattagcagactcagataccattccttttcatcaaagaaactttcttccatccggactgtttttccgttcattaccgattcatactcatatcgacagctactcactggaaaaaccgttacccttcctgctgtctgatacatcgcatacccattctggtacaccgctacgagtgccattctctctccgtttccaatcttcttagaagcaactaccggaatctttctctccttcagtagcttatccgtaggtatcttttcgttcttctccggtgtctggatcattttctttaactctcttaatgtcagcataatttgccacctttcctgccagaatcggtggcaaaaagaaaggcagctaagctaaatagaccccgattccgctaattttttttattagcggaaccgaagttccagcctgctgccttctctatggaaaaccatggcataagtgttacaccatatttatccagtcttatttatttctatttgttactgatacggtatccgtctttttctccttctctttttggcgaatttccttcaatacatccgagtaatctccaaaagcatcatagggacacatccggcgaaatctcagttcttcttccagtgtcatcttctgtcctcctgttcttatcagcctgtctgctgttgatgaaatgattataaaataaacatttttgctatacctcatcagatgtggggaatcttcatgctttccaccccacatctgtggaatctgtaaaaaagcaaaaaaataccgctgcaaactctttataaaaaagaatctgcaacggcataaaattttctattccatcgaggacaggctgtttatcatcgctttcattgtttccagtaccactttctgtttcttatgttccagcctccccagttcaaaaatcagagatacgacttctggatttctctccggttcttccaattccagtaacaactcatacgggcttattttcaaggcattcactgtctttgcaaaagtatgtacatccatagtgttctccgcattctcatatcgggatattgcattagaacttttgccaatgatctgtcccagttcttcctgagaaagaccactttccctacgcttctcgctcagcgaatttccaaaggcaatccgttcttctgatcgtatctctttcaaatcgtgcaataccccctttctgacataatcttctgagaacaaaaaaaccggaataaacagcaaagattttacattccatgcatcataggcttattaggcacaacttctgtcatcctctgcctatgatgtctgtgtaaaatacatttaccgtttattccggcaggacactacacctgtatcaaacgaaataaaccaaaagtatcgaacctctaaatgtctgtgaagtcaaataattgttacgattaatgcaaatgaattttaacacatttgaaatctttttgtccacaaatacacagttttttcacataaatttccatttttaaacataaaaaaacggcaaaacatcatgcctcttctgtataaagacaatattcctgtctttttacagatagctgcatatgttttgccgggttcctgatgattctgtgccatctccaacacgttcagcaaactcttgaatatctacgctgcatctgaggattctgctgtccaatcttacagttcataaatattctcattctttgcatccaatattctcttctgaccatccatgctgtcattcaatcagaactcttacagttccgaatcacgcctaccagatgtgtcatataacgctccagacggtctacatcttccttagaacgcttcttattcatatcaatgccaactacaacaccaaggtctgcaaatgccgtcagatctctgtggcatctctgacatctcacttctgaataggtaaaaatacttttctgagttactttgccacataccgggcaggttacaactaatacatcttcttcgctcatcaatcaatcctccaagtaatatctacacatactatcactcaaacggataagggaaattgaaaaccgttgatgagtaaataacaggcgattccgcagcatcgagccatgccacctgttatatcctgttttcactgggatctgctctgacaatctcatcgcaacttacacctgctgccatcactctgtcatcacttttgcaatgacttaatcacatgaacagcaacaccttgaatactgcaattctgcgtgtaaatctccgggtacttcggattctccggatgcaaatgtacacaccttctttccgtatcaagaaaaaatcgcttcaatgtcgattcattctccaccagggcaacaacaatatcaccgtccgaagctgtattctgcttccggataacaaccatatctccactgttgatacctgctccagtcatagaatctccattcgcccgcaagataaagaactctccatctccaaatagtgaaaccggcagagaaacatattcttcgacatattcctcctcaagctgcggcataccacaggacactgatccaagcaccgccgccggttttgtatccggagataacttctccgtcctctcagtaacaatctccccattgtggtagcgcaacattcctctttcgttcatctcaacgaggtatctgtatactgtactcttgactataccgagcgcatctgcaatttcgctggtataaggtgaacgatgattcagcaataaaaacttctcagcgtaattcaatatctgctgcattaactcttcgctcttatgccgcatcttttcaccttacctttctatcggaaacgatacgtttctgatagctgtattataccgaacatatatacggaagtcaatacattttcccaattttatcaaacatattttcttttattcgtcttcgaactccatttcattcatttctggaaaatccagcaactcagaaacagtcatattaaactccatagcaatcttacgcaaagtcttcagctttggattctttgtttctcccctcatcatactattaagcgttgattgcgtaattcctgacaatgtagcaagtttatttgtcgttatccctctctcaacacacagatcagtcaatctctttattatggcatctgaatacgtcatgcaaattctccttaaatcacaatatatattcagtataaaggattttcctttcgtttattaacggtgtgccgttgacacctctgcaaactgatgataaattaacgttataccgttatttacttgcacaactttaaggaggaatttatctaatgagcaaaaaagaacagaaactaaaaaagaatctctataaggcactcacagaatatttcattcataatactaaaaacagtctggcatcatcagaaagtattctggatcagcttgcctcttttcgcatggaaacaggattacctgccgcactcagacaagataaaaaatatcaaaaagctcagaaaaactgtaataaagccaatgaaaaaatgcaggatctaaatctaactccccagcaatgggatgcggttgatgccgctatcacagcagaaaacattgcatctatagaatatgtccgtattgcctataagcaaggaatcattgatgcgttttctattttacgagaaactctttaatatatccatgttaatctaatcacttgcaaacaatgaagcagggatttatctctgctttcccattttcttctctattgcttccggcactctgatcaagccaaatcgccatagtatcggataaatgtatgaaactcctctaatgtctccaagtgccttcggtttcttcacttcttctgaaatcctcttactattttcaaatgccagcaccacactactccaggcaaggctcttacttttctctctccggtctatcagcagctctctgttatactctccatttttgccaacctttaatttataccgaaacggtaatcctgttgccgttttaaatggataatcctgaaatgcaataacagcttgccacaaattttcttctgatgctatttcctttagaagccgaacctgctcttgccgaatcttatatgcccggcaccgctccgcatttaaacttatctctgctgcattataaattcccttagtgtagggcagataggaatgaaccgatgctctggaaagacctgtgagtttcataatctccggaattttttttcctgactggtgcaaatcattgatttgtgtacatatatctgatgtgaatatatcagcagtaataagtagcttacgaagtttaagcagactaatatttaactcatctgccagtgatcttaatgaatctgcttcttcatagacatctcttaactcttgaagaaaattattaaattgaagttctggattatattctggtttctttttgggtcttcctgccattttttaactcccattttcatgtgaatccaatcatcttgcacctaaaacagaggcttccttgctccagactaatgctccgatagctgtcctctgtttcttattttatttctttcgctttctggaatatcccaaataatagatgacaccgcctactgctccaccaagtgtattataggtcagatctgatatttgaaatgttccaagatggaataatagctgagtaaattctatcagaaaagaaaatactgctacaacttttgtggcttcccaaacggtttttccaaatctaatattctcagattcatcaagtaattctttttgaaatgcccacaatagtaaaatagaaaatggaacaaataacatgaaattctctatagattctgttgtaaactctccatcttcatatagtccccatcctcccaaaagctttccaagtggatcaaaccatatctcacgatttaaaactgttcggagtaatatcattgctgtataaaaagctaataagaatgtccggcgaaaatttgaagaacttctaaatgctctccaccatgttgcaaacatatttcggataaaattattctttttccacccatgctccttaccatataaatataagaacattgttaaaaaggcaaggagaacggcagcccagaagggctgataaaatgctgataatacattatatgctatcttattaaatatttcgattatcttacttcccatcgttctcctttattatttatttcaaatcttcaaataaattcttctgatatacaccatcttctatcagcttggcaaatgatttcactacatagtctttatcttctttataggttactccaaaccacttgtcattcgtatctaacacttttacggaaactctgcttgcctgaagaagttcatctatgtaaattggcagtaaatattctgctttcaaaatatctttgtcccccatgttagcaaagaactctttaaatccatcttctaaagtctgcatgaattccggtgtaagtccccacatattcatggatgcgtaggattctgcattaattgaagtgagctgtccatcgttatctactgctgcaccctctggagtcttaacaatattggaagtttcatgtactgctgtgagatagccttcctcatttgtctcacagatacctctggtaacggcaccattctcacttaaagtattttttaaaatgaaacctgccatacagaactgattcgctttttccggcgtatagcctacaaggaaatcatgaagcttaacaaatgcttcctttccatagtagtcatctgcattgataactgcaaatggctcatgcaaaacttctttacaggcaagaacagcatgtcctgttccccaaggtttggtacgtcctgtaggaagctccacaccttctggaagttcgcttaattcctgatatgcgtaggcaatctccacatcaagattgttgcaaatcttttcgatgcggtcaccgattgcttctttaaatgcatccttaatatctttacggataataaaaacaattttgttgaagcctgcttcgattgcatcatggatagaataatccatgatgatttctccatttaagccaaccggagcaagttgtttgattccgccgccgaatcgggaaccgagaccggcagccatgataactaatgttgttctcataatttgttctttcccttaaagataattattctacagttacacttttcgccagatttcgtggtttatctacatccaagcctttagctacactgatgtaatatcccaataactgtaatggaatcactgcaagtgatgttgcaaaaagtggatctgtctttggaatgtagactgtaaaatctgctgtatcttcaatgttatactttccaaaagtagtcagtcccatcaaatacgctcctcgactcttacattctagcatattagaaatagttttttcgtacagttctggctgagtcaatacaccgactactaaaatatcgtcttcaattaaagaaattgttccatgctttaattctccggcggcgtatgcttctgaatgaatatagctgatttctttcatctttaagctaccttccatacagattgcataatcaatgccccttccaacaaagaatacatcatgggcatttacctgttttgatgcaaaccattggatacgttctttatcttctaaaatctttgcaattttttctggtaaagtctttacttctttaataagctcaacatatctttcttctgaaatttcttcacgaacttttgcaaattggattgccaaagcgtaagttgcaacaagctgtgtactataagcctttgttgtagcgacagcaatttcaggtcctgccaaagtataaaatactgaatcagcttctctggcaatagatgagccaactacatttacaattcctaatgttcgtactcctttttcctttgcttcccgaagtgctgctaaactatctgctgtttctccagactgacttataactactactaagccattcttatcaagcaaaggatttctataacggaactcagaaccaagttctacacgaacaggaattttggctaaatcttcaattacatactgtgctgcaataccaacatgataagctgatccacacgcaacaatataaatctgactgatttcttttatatcttcttcagaaagccccacatttgataaatcaataaaatcctctttcacaacagaattaattgtatcacctacaacctttggctgttcatggatttctttcatcataaaatgttcatatccagctttttctgctgcttctgcattccagtcaatagtttttaattctttctcaatttcatctccatcaagattatagaaagtaatttcaccttttcttacacgagccatctccatgttaccaatataatatacatttcttgtatattttaagatagcaggtacatcagacgcaatataagattccccatcttctactccgagaatcatcggactatcttttcttgcaacatatatttcttctgggtattcattaaacattactgccaaagcataagagccacgaatacgaaccatagcatgattaattgcatctactggtgttccttcatattttgtataataataatcaataagtttaactgcaacttctgtatctgtatcggaataaaatgtatacccttttctcacaagcttttcttttaattcctgataattttcaataatgccattatgtactgctacaatatttccatcatcacttctatgaggatgagcattattttccgatggttctccatgagttgcccatctggtgtgaccaattccacatgaaccaattactgccttcccatcattggttttttcagcaagaattttaagtcgtccctttgcttttacaatatcaacatccctatctccatcacgaactgcaattcctgcagagtcataaccacgatattctaacttagacaagccctctaataaaataggtgctgcctgttctttacctgtaaatcctacaatcccacacataattatttactcccttttactcgtaatcttgccttataataaatcttttatagcaaaattattatcttagcttttactttattgtttcccttattttattatgtttctttaaatggacataccttcagacattgatagcatttaatacacttcttttcgtctatttgaggatattcaaatccttcttcatcttcaatcattgaaattgccatttgagaacaaattgcatagcatgcggtacacccacaacattcttttttttctttaaatagtacaggtattttcctgtccatcttttcctccctttatacgcctattacataagcatattttcctagtattctatgtgccatcataacgcacactgtagaaatcatgattacaaatattgcatttatcggaaatacatttgccattggaactaacttatttaagattctaattatcagcatatgacacagatatattccaaaagaattatcacccaaaacttttaaaaattttttcaaaataactggttgctcattcaaatttaaatcaccagcttctatatatatgtatgctcttatacaaaaaagccccgttgttataatggaactcatttttaattgtgttgtcgccatatcaaagtttcccatccaataccaaataaatccttcaacaccttgaattaccaatgagaacagacacaagttagttaaacattttttagataattgtaaattaatatacccgttttttaaacttacccctaagtaataaaatccaaaccaaaaaacaaataattcgccctgaaatggaaagcctaattcaagattaaaccacaagcttatataacgaattagaaaaatgctaacgggtgttacaaaccaccctaatttagaaaatctactccgcaaaagtttaaacgtaactggtattaatagtaccatctgtatataaaccagaataaaataatatattccattacattttgacataaaaacatccggtataaatgtatttattctccgattcacgaccgcaaatataaatgaccaaattatataaggaataattatttttttaattctgcgatatattatatctctatatactccattttcgttttctttggttaaataaccggaaagaaatataaacatacctactgcaaaattaacaaatggtcgaattattactccgtacccccccccaagcatatgtattagtgttatatgtatggataacaattactgcaataattgataaccctcgcattatttgtatttttttattcattcttctctcccatattgaactgcattaacataccgtaatcaagatttgactttatacccccccccgtcttgctcttttaagcaccggttttaatactttcttaatagcattttttattctttgttttattggcaaagataaataactttttcttaactcttcaaaatccattttcttcatatctataaaaaaagtttctctctcttttggtctataaacagaacggaactctgctggattttcttttgtagcgtcgtcatattctacttccataacttttacagatgacttagatatgagcctgttaaatattttttctccttgattcgttcgaacaattaccaaagatgttcctttactatcattcatttctggagcaatagtgtcaatcccccagaaatctcctatcgttaaatctgataatcttaatgtcttagctttgcattcatagcaggatggtctaaggcagaaatcacttaaaaacatttgcatatacgggtctttgcttttagagatgtaaacttctttagatgaaccatactctttcattccaaagttttcccatccttgatctttacatctaaagttgactttctccatcttgccttgcattttattttccatataacctacatattctttccacaatgcaggtgatggaaccccatggcaaataatatcaacacaaataagatttttataatctttctgaagaaatttctttaatccattaatttgacatcctgttccagtaaataaaaccaatttatttaacactagattttcacgaacattcttaaaaatatttttaattttagcttgtaaatatttagatcctagaagtttctctaaatcttgcttttctgtaactccaatatactcagcttctgtgcaagatgcattcattgcaactccataaacaattccttttttttcaagaacctcatttgccaataaagaaaaaattgcacctgaagagcttttcatccttatgtcattatcataatatgccgcatacgcttttttttcgtttatcgccatattctaatctccctccaaactgtaaattttcccaaatacgccttatttgatcttctccaaatccatgagttctccccatttcaaatctgtctcaagcgtaatatccgtatcaaaaccgccttgatcaaaaaaggttagttctccaaaataaatttgcccatctatattatataaatctactctcatatgaaccaaattctctgagagttgttcggcaatccttatcattttttcatagttttccggtctttccacatttgattcgggttctaattccggtttttgatataataagcgattccactctttatcataaaaacgaaaagttggatgtccagatgccctattcgtacataccatcacgctatccatttttccattaaacataaaaaatttataatcatttggtacggtattcgttatcattttttctgctataatccgatgtctcaaatttttatatggccattctcggcatagataatagtaattattttttaaactcttttccaatacatcttttgttctatctatgtccatattgtttttatcatttataagtactactccaccagaatcatgtgttgtttttaaaacaaaattagatggcaattttgaaaaatctatatcttcaaaacgatcccacgcaccataagtaggtataacatattgttcaccaattttatctgcaacatatttctttgcctcatatttatctaccattatttggtagtgttcttttcggtcatttattttcaaccaattaagtttttcattataagattttggattactcaaattcagctttctcttcaatttactaaaaaaaaccattcttaaataaattgaatccggcaagactttagctaaatttacaaagacttttttatataatttcatatgttttttcctttcatttactttcttttggcaaatttatgaattattgctttcatttcctcacgatacataaacgaagttatcatcaaagaaactattccaaataaaaatgcctgtatttcaccaaatgaaataagaataagtgaatgtataattagcaatacaaacgaaaaaatattacgcttgaaacttatccctatgttcatttctattttcatatcacgtgcccttatcaaaagcacagcaaaatatcctaaacaagttccaatcgcaattccctgcattccaagcggcttgactaaaataaaattgaataaaagattggtcgcagcacctaatgcagttgtaataaaaactttatttgttttagctcctaccgtatacacaacactaaaaaaagatgcatagcaactaataattgttgacactgataataagggtacatattcccatgctatggcaaactccttgctcataacgcctacatagaccggcttaataagcataactattccaattgtaataaataccattccaaatgacgtaacattaaaaacattttgataaaatccttttttatcttcacttgattcaacctcaatagcagacatttgccaagcctgaacaaacaaagaatataccatatttatgatctgaggtatttttaaagcaagtgaatatattccatttgcactatcacccaaaaagtaattgataatatatttatcaccagccgccataatccaccacattaaactgttaggaactaacggaatactatacttcaaaatcattttcaatatttttttatcaatacatttaaaggaaacaactttaaaaaaatcactgaatacaagaatatatattgtgccaataactgctgccagcaacgtcgcatataaatatccagccattccccacttaaaaactaaaagaaaaagtacattgaatcccaatgtcgtagctgttgtaattaagccaaaaattgtaaattttacattctgatttattgctcgaaaatactcactatatatttgattaaatgttcgaacaactagaagaacaacaaatagccaaatatattcatcaaatttgaaaatcattttatacagtggagtaaatgctatagatattacagttccaaataaaaaaactgcaaaacaattacttgctgcctcttttggcgttaagtcttttccaagaacaaaacgtataagtgcttcattaaccatcatagttgaaaatggaattaccatacctaatgacgttataaacaaatcaattgttccatattctgctgttgtcaacacatatgtatataatggaacaatcaaaaaggttaatattttgcttccaaaattccccaccgcaaaaattgcggtattatatactaattttttataattattctcactcatttatttagcctcgcattatcctttctgtactatcattattcatctaatgcatggtgaataaatctgtatgccttttccctttccttttttaatgactgattggttattgaaaaatcatattcaaacttgacatcttgaaaatttccagtataatgcagtttttccaaatgaaatgtttttaataaagtgtttattctacttcccattcctgtgtgttttccatttctatcaaatactagaaatggtctattatataaaattgagaaaaccgacgcatgaaatgaatctgtacatacaaattcagctgtttttataagatatacaaactcagacggtccacaacaataaaattcactttctaaattagataaatcaataatttcacaatctttttctgctgcgattttatgtatagcacttatatattcctttgtttcagttcccaaaaaatagcaaacaatatatttatccggaagtatttccttcggtttttttacaattcgatcccattcttctttttgtaacatcattgttggatcaatcagtacttctacgtcctgacggtttgttattttttctattatattttttgcagcttcctctcttactgatattgcatcaaattttgaaatatactgttccactcttcctttataatctaacggtatctcttctattccaaatgatgcacttattgcaatcttttttttctgagtaaaagtaagcaaatccaaatcactcagcccgccataaatcggattccatatctgatctgaaccgacaaaatagtaatcatatttatcaaattcttgcaatcttgaaaaagagaaaaaatgttttgagtttacaatttttttgttaaattccaaaaagtttttctttctttctttaggatctttgggatcaacacagtcctttattttgtcgcctttcaaaatataacggaaccaaccttttatgtataactttaatacttcaatatgattcacctttttgttattcaaacagggaatatttacaatattaactgtatttaatccttcttttttcagaatctcttgcaccgcataattttgtagtttattcccaaaatttgaattaccatacagtgaaacaatcgctgctgtttttttattatttttcataattaatcctctatataagttcctcatagcaaaaatgtaataatatataatttggggactattattcacatttttttttgctaatcattaaaagcatcttatatattaataccttaatatgttttttcccacttggttttataacaattttattttctttcaaaattccagcaattttttgaatactatcatttatcatttttgaattataagaagtatcatttttcacccgtgctttccaatatgtagtaaagagaagtgccatccataattccaaactatatcttagtgaacttttctccaatttttcatgtaccatcaaaatcatctctaatgattttgcaaaagattctgcagtaggttttgaggacaatgacgatgaatcaatatcatgatatatagtataataacatttagctgaatagaaaaaattactgcatttatccagatagatatatgtagtatataaatcttcaaatatagttgactcataaaacatatcttctgttaatatactttttctaaaaatctttgcacctaaaccaggtctgacaacttcatttaattcatcaatattgtgcaatccttccctagtttcattgaacccagaaataatatctttcgtatcaccaataatatcctccctatcaaaaaagagaacatctattttttcatttttttcaaacagatcattgatttctctaagtacatcagaagtcgtaatccaatcatcactatctacaaagaaaaacaaatctcccgatgatttttcaaatccaaattttcttgttaaaccaggtccagtattttctttcgtatacgctttgattctactatccatttcttgatattttttcatcaatgaataactattatcttttgaactatcgtcgactaatattaattcataatcctcatatgtttgactcaaaacagattgtactaatttatctaaatacctttccgcattatatacaggtacaattatactaattttcatacctcttcctttccttatgagcttgtcctaaaataattccatatgcaacagctattggctgtataatatttgattcttcaaaaaaataactaaacgcacttaggaaaacagtaataatcaataacatccccataactggagcatatttatttttttctcgtataaattttatttctattataattaaagataaaacaaataatactaataatgataatcctattatcccataatcatataggtactctatataactattatgtgaaaagcgagaaaatccacctggtttaaggcgataataaacactttggaaaccatgtccaaaaattttttcccttatatttgacgtcttgaacgcttgaagagtaatcgcccaaataatatctcgaccgcttcctccatctgtacttaattttgaaaaacggtcaaaaatctcaagtcccgatctattctcgagatacaatactgctccactacctatacaaatagcaataaaaagatacatatattttttccatttttctcttaatgaaccttgtatatgtgcatctaatactaacatcaccaatattcctaaaattaatgctatcgttccagttcttttcgttgatgcaacagatatagcaatacataataacatacataaatttcgcaaattcttttctttaagaaaaatgataattaacggtaatgcagttaagcaataatatgttaaaaatactacctgccctatgtttccatttccagctaaatgtattcttataagtgatactgagataagacacattattaagtaatatataaatgtctttttttcaatatttttgttcatttcattatgacaagtaaagtcataatacacaataacacttaacggccaaataaatatatcaattggcgtatagggtaagtaaattgaattatttaatatagtaattacacattgatatacaattaaaattcctaaaatcaaagtaatactgtttattgatttcctctttagcgttatcaattcctcaaaaaaatagcataacaaaacaattgcctgcataccaaaccccaaaagtcttatagtgccattttggtttgtttgatatagcattttaagtatgatggaaaaaaacaaacaattatatgctattcccataaaaaatttttttaaatttattttcagcacttttagataacctccgagatttttatgctatattaatcatgttttttatttatttccaagctgatttgcaatatcctcgtccacaatttcctctccagatttatgttttaactgctcttttgaagcctcacttaagccattatcaattacacaatttatgtcacatgtactacatttatcaagttcttctttcgtaacttttccatcacgataatcacagcaaattttgttttcatacatactgtatggttgtttagtaaataaagctttaaatttatgcactaaaacccatgttgctggtttccaaatatatttatgcatagccggagaaacagagcctatcatccagcaatctcgatcacaacaacgaactttttttcgcacctcttctgcctgagaactattccacagttcatcccaagattgattattcaaatttcccataacttctttatccttagttccattgcaaggcataacatcaccatatggatcaatgaaaaatgtatcaaaactcatgtcacatggaagaagcctcttttgcccataaatataattaattaatccatgattaaaatatgctctgaaccattttttaggactattactacgtaataactcattaactaacttttcaaaattctttgcaaccatcggacgatcatgaataatattttttgcttctacaaaatagaaactattatgtaaagaagccgttgcaaattccatccccatttcattactaatttggtataatggtacaaggtctggtgcgtttttatcctgtacagtcataccaaatccaacatctttcattcccatttctctaagtttttttaacgtaccatatccacgctgataaccattctgaaggcctcgtatttcgttatttgtctcctcaagtccttcaatggaaatacgtatgccaatattagggaactctttacaaaggtccacaatacgatctgtaaaaaatccattagtcgaaataacaatacgatcggatttcttatataactcacgtacaatgtctttcaaatcagttctaataaaaggttcaccaccagtaatatttgtaaaatacatctttggcaatttttttattgtgtccaaactgatttcttcttctggcttagatggtgctttataacgattgcacattgaacatctggcattacaacgatatgtaacaattactgttccatttaattttttttcagtattctttttcatctttattaattacccctttattttctatttttgacagcctcattaaaaattttcatcaaagcttcataatgtgattgcggtgcgaatctgttttcaagcctttttctactagcttgtcccatctttttaaccaaaatatcatcatctagcatcttaatttttttaataagatcctcaacatttgatggttcaaataaatatccgttttccccatcactaaccaattctggaagacttcctatattgctagcgataaccggctttgaatattgaaacgactctaaagcagtattaggtaggttatcataccaaattgaaggaatcaatgtaaatctagctccttttataatatcctctagttcctctccactcttaaacccaaggaattcaacattcttcattttatgatcctttacatattttttcagacgctttgcctcatctgttgtatcgtctcccataattttaactgtatactcaggcaatttttcatacgcttttataacagtttcaactcccttttcttcagtaacacgtccaaaatataatccatacgatcctatctgcggttcccctattgttgttttacttgctgtaaaagtaggaatacaatgaattcttttttcatcaaagccatttaatgccaattttttcttcaaaaattctgatggtgttataaatgcatatacatttttatatacatttatcattttatgaaatttcatagaaaacactcttacgacagatgcaaatagtgatcctttcacacatctctttttaatacaactcctatatccctttgataaacattcttcacagactttcttttcatacataaaatcaaatcttggacataacaagaaataatctgataatcttaacacaaccgggattcccattttacttgcacctgtaattacactcggagacaatttattaacaaaatgaataatatataccaaatctggctttacatcctttatttctttttttattgctttttctacttcacgagaataaatacttcgcgtaagtaactgccaaattgatttaggtgtctttttcacttcatcaaaatatgttgcatctcgtccaccaattggttctacaaagtattttgaatattctgttgcaacatttttattggaatgtatggaaaaaggtataacctcatgcccattatcttcaagcatctttttaatattaaacatatacttttctgggcccccagaaataaagtatctataatttactataagtattctcaacgttttctccttatctttataaatagcattatttactattttttatacacaaatatttaataaacaataaacctactcttttttattcccctctgtgatggataatcgctttttataaagatctcttgtatctccaattatttttgccggatttccacccacaatcgcaaaatcaggtacatctttagttacaactccgccagctgctactaaagcattttttccaatagtgacattatataaaataatactccttcctccaattacagcattatcttttattactaccgggccagtataataatcaatcattggaccagtgtaattacaatctctattccacattctagctactaaatcatgttcatagattctaacatctgccgctacagtgacattatttcctatactaatttgatccggatgggtaggaatccaacatggatgccaataccccccccgaccatattctttaaagatattagattttctaatcacttcagctttagcatggtttttctttaaaactgtcaaaagtaataatttaaacaaaataactaattttttcactaatttcaccgttttctatttttagtttattaatctctctgaaaaatatcccttgtataaactttgtcttttacatcatccaaacaactatcgtaacgattggcaataattgcctgactctgcctcttaaactcatctaaatcattaaccactttgctgccaaagaaagtttcaccgtctttcaatgtaggctcataaataatgactgtagagccttttgccttaattctcttcatgactccctgaatagaactctgacggaaattatcactattactcttcatagtaagacgatatacacctaccacaacatctttttctttactttcatcccagtcatcatttgcttcatatgctccagcaatttccaagactcgatcagcaataaaatcttttctcgttctattagactcaacgattgcttcaataagattttcaggaacatctgcgtagttagcaagcagctgctttgtatcttttggtaaacagtatccaccatatccaaaagatggattattataatgtgttccaatacgaggatcgagacatactccattaataatctgctgtgtattcagacctttcatttcggcataagtatctaactcattgaaataagaaactcgtaatgccaaatatgtatttgcaaacaatttgactgcttctgcctctgtaaagcccataaataaagtatcaatatcttctttaatagcaccttcctgtaagagctgtgcaaacgtatgtgcagcttttactaaacgtgcattattaatatctgttccaacaataattcggcttggatacaaattatcgtataacgccttactttctcttaaaaattccggactaaaaataatattatcacaatgaaatttttctctaatacttgttgtatatccaacaggaatagtcgatttaataaccataatcgcttccggattatattcaatgactaattttataactgcttctactgcagaagtatcaaaaaaattctttttgctatcatagtttgttggagctgcaataacaacaaaatctgcatccttataagcttcttctgcatccaatgtagcagttaaattcaaatttttttcttctaaatatttttcaatataatcatcctgaattggagatttcttattgttaattaactctaccttttctggaataatatctactgctgtcacctgatgatgctgactcaataaagtagcaatagataatccaacatatcctgtccctgccacagcaattttcaatgaattaaaatctctcattttttctctcttcttcctattcttaaaatatatttacatataaaactctttgtaccattctgcaaacttgcgtaatccttcacgtaaagttgtcgatggtttaaaaccatagtctctttccaatgcttgcgtatcagcatatgtcacaggaacgtctcccggctgcatcggaacaagttctttatgtgcttcaaaatcataatcttctggtaagacttttgctctaattaattcttcctgaagaatttgtacaaaatctaataagttctctggatgattatttccaatattgtaaacagcatatggcggaatcggcaaaccatcttctccgttctttttctctggtgccccctgcattacccgtacaacgccttccacaatatcatcaacgtaagtaaaatctcttttacaatttccataattaaaaattttaatagtttctccatttaataatttatttgtgaatccaaagtatgccatatcgggtcttcctgccggtccataaacagtaaagaaacgcaaaccagttgatggaatattataaagctttgaatatgcgtgagccattaattcattactttttttcgtagcagcatataacgatacaggattgtctactttatcttctgtactgtatggaactttcttgttacttccatatacagaagaacttgatgcatataccaaatgttctactggataatgtctacatccctctaatatgttgtaaaacccaatcaaattaccttctatatatgcgtctggatttgtaatagaatatctcacacctgcctgtgcccctaaattcacaaccacttgaggagtatacttctcaaaaatcgaattaataagttccttatctgccaaatttccttttacaaaggaaaatgtcttactagatgaaagtttttctaatctatattcttttaaacgaacatcataataatcattcatattatcgagtccaactatttttattccttctatttcttttaataacctttcagccaagtttgatccaataaatccagctacacctgtaataaaaatcgtcttgtttttcaattcaataaattctttgctcattttatctcctatacaattctaatgttctctccacaacatcatcccaattatattttccacaaatataacctgctgcttcatctttatatttctgtacctgttgtgcatcctcacatgcttcttgaagcttactctgcaaatctgctacattactttttttaaatatgattgccttatcttccactacagaagcacattcatctatgtcagataccaaacaacaatttccataactcattgcttctaaaagacttaatggcattccctctaaatcgcttggtaaactataaatataagcattgctgtatagttcatctaacaactgtccctgaacaaatccggtaaaaataattctgtcatcgtcttttgccatttcttttaactggttagcaaattcatcagtatccgaactgcctcctgcaatgactaacttcttatctgtttttacgttcttaaagctttctatcagataagtaattcctttttccggaacaagtcgtcctaaaaataaaatataatcatctttctttaaaccaaatttcttgtcaataagttctgcctttctaataactggacgattcacaccattagggataaactttgtatcacgtccataagtctctttaaaataattttgtactccctcactgagaacaataatttcatctgcaaatttaacagcacatttttcgccaagcataatatatgtgctggctaacttgccccattttgctctttgatgatcaagtccatgaaccgtagcgatacaacgttttccaaataattttggcaaccataacattgcacatggtccttctgcatgaaaatgtaccacatcatattttccaaacgctgctgctaccgctgcaaaaaatgaagcactcatcgctgctagtccttttttatctatcgttggtacatatttcattcggatacctttatattcttttaatttcttctcatcaaattctttaccacttacatgatgtccattacggttatatactgttatcttatgtcctagttttgccatgcgaaccgttaattcttcaacgacaatttcaattccaccttggcgactcggaattgtcttatgtccaagaactgcaattttaagtggagaagtattatttttccttttattcataacttcctcttattatatttataacttatctattattactttctgtggcttaaattctttttacagaaatcaagccacaatcatttcatcacatagatccatcttttctaagaactaccattactgttttaaacaatatttttatatctagcccaatgttccaatttgtgatatactccttgtcaagacgaactacctcttcaaaatcagtaatgtcgctacgtccgctgacctgccacataccggttattcctggcttaattgccagtcttgcacgatggtgcagctcataaaaattcgtttccgaaatcaaaggtggcctggttccaattattgacatatcacctttcaacacgttaaaaaactgcggaaattcgtcaatgcttgttcgtctgataaaatccccgataccagtcttatgtgttccatctggaagaatcttatttccgataactcgtgggtcaaaatccaatttgaacatcttttcatcacccaatttgttatctttcatcaattcagccttacgttcttctgcatccatatacatgcttcggaacttatacattttgaatctctttccattctttcctacacgttcctgtgcaaagaaaatcggtcccggtgatgctatgtaaattgctggagcaacaaatataaacaagattccggtaatcaagcatcctaccagacctccggcaatatccatcagacgtttcaacatcagatctcttgtagatgcataattaatactggtagtcagtacagtataatcgcctactctttctacaaactgtttcttacctggcacactttttacctttgccagattcagatgaaccgtaacgcctgtttctgtaaactgttcaatcagttctcttggataaggcacaacacctgatgtcacaatcagtacttcatcaatccattccttgcaaacatattcagcagcattatccatattggcaactacttttataccatcaatgtgccttcctatcatttccttatcaataacggcaattccagaaatcttatagcgagcataattatgttctttcatgctctctactactgcacttgccacatctgctgtaactacaagaagtagggaacgattttctccatcttccattttcttcctaagtaaatgtttccacagttctcttaccagataagtaagtagcatatagataatgatattcagtaccaatgccagtctggaatattgttgtccttcctgaagcataaacaaataaagcaataaacatgctccaagaattactccatgctgtgctgttacaacaaaatctttatagtatcctcttttcaaaacgtttttcaatgttcccattgcaaacagtactaccaaatctgccacttccataaagacagccatatttctgtaaagaattagctggtatggattagctccatatccgcttaacgcatacgccaaaacgaacgccacctgcaagcagatcaagtccaagatgataaaatccacatgttttatccatcctgtagaatcttttctatacatactttctttcccctttactcatttttcagatcccattacgttcgttttcaactaactgctacaatcctctgacttaccaacgaacaaagactttttataagaaaatacgaagtccttcacagaactttgtatattacattcaatactactaagaaacaatctatgcccggcacataacccgattatcagggcaggcaaagcacaataaaaaaatggatttgtattaattaagaaatgtgattctatttgataatagatagcagccataagcaaacagcctatagaaactgccagatagattttccgatgtttcatcagattcttgccatattcaatttttccgtttgcttctttcccactataaggggctagggaattgcatttgcactcagcgatcctcatttgcttcatttttcatacctcgctttaccccccccccacacacatacgcactctgggggattttaattttttagttttttattattcatatcggcaacctaacgtcccttagcccgtcattcttttcagattaacaggctcaagttttctccttttcgatttttattgctctatgattgggtcaaactgagcatccaaagagccatccaatatctatgaaccgctataatgtgaccctgctgcagcaatgaaaaatcgaattatcataaaacgtttacgccacacatgccgcataaatactagagttttctctggttgtccctattatattccactcccctataatcgacatatcgccacgtaatacgttaaagaattgcggaaattcatctaaacttgttcgtctgataaaatcaccgattcctgtcttatgtgtcccatctggaagtatcttatttccgataacacgaggatcaaagtccagtttaaacatctttccatctccaagtttgttatctttcataagctctgccttacgttcttcggcatccatatacatactgcggaacttgtacattttaaatttctttccattctttcctactcgttcctgagcaaagaaaattggtcccggtgatgcaatataaattgccggtccgacaaaaatacaaatgattccggtaaaaatacatccaactaatccacccgcaatatccattaagcgttttaacattaactgtctggttgatgcataattgatacttgtcgtaaggactgtgtaatcaccaaccttttccacaaactgttttttccctggcacacttgtaatctttgcaagattaagatgaatggttactcctgtctctgataattgctcaattaactctgtcggatacggaagaacttctgaaacaacaaccagaacttcgtcaatccattcctgacatacatacattgctgcagtctcttcgttggcaactaccggaactctatgaatttctcttccagtccagtccgcatcaattacagctacaccagccaatgagaatctggcataattgttttcctgcatacttaacactacttgttcagccacatcttctgatgttacaatcagtagtttacgttctccgccatccttcatctgttttcgcagaagttttttccaaagttctctgacaacatacgtcattactaaataaattattatggtcagcatcaatgttaatcttgaaaagtcctgcccttcctgaagcaggaataaatataaaaccgctaaggcacctaccataatcgcatgatttaatgtaactacaaaatcacgatagtatcctctctttaacacgcttttcatggtgccatatgcaaaaatcataaccagatctgccagttcaaggaaaactgccatattgcgataaataattgtttcatatggattaaatccatatccgctaattgcatatgccagaacatacgctaattgcaaacagatcatgtctaaaattataaaatctgtgtgttttaaccatccttcagaatcttttctatacatagatttttttctttccccttccatttttttgtaatctatctgttaatctacaatcgtccccacaactgtagagattgccttcaaatttgagtgatttaaaactagataggattattgctacacaaataagagcattaatccagaatatgttaagatttgttgagatatgtaattccgtccatagccataccccaaacacaagtaagcaacacatggaaatcacattttgaacatttagatatgcgatataagagtttcgatattcagttttcttttcattcccattaatatgtactggggtatccatcgtacactttcgttttgatattcctagcatttcatatctcccttactgtaccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccccccccgacaaaatcgagggctactttcttatctcttttttctcatttatttcttatatttttcttcaacgacagataacctgtgaacgtcttttgagggacatccgcaggctcagccattacctcctattatttatgattctcatttacttatttatgattgggtcaaataagcatccaggaaaccactttattatatatattcccgctgaaaatacgattggtttcctttaatgacaaatcataagaatcatactaaggaacctagctaagccagcgaaaaccctgtaaaatcaagctttttctcggttggctctattataccgccgactcccttcaacacattaaggaactgcggaaattcgtctaagctccagtcacggatgaagtttccgacaccctttttgattgtgccgtccgggagcttcttgctgccgatgattcgagggtcaaagtcgagcttgaacatcatgccgtcctgtacacggttttctttcatgagttcggctttgcgttcttcggcatccatgtacatactccggaacttatacatctggaacatctttccgttctttccgacacgggtctgcttgaagaagattggtcccggtgactggatatagatggcaggtcctaaaaagatgcagaggattccagtgataatgcagcctgcaagccctcctaagatgtcgagcatacgctttaagacgatctggcggcggcttacgctgttaatacttgttgtgaggacggtgtaagttccaagtcgttcgacgaactgcttcttgccgagcaggttctgcgacttggcaagcttcatatgtacgacaacacccatctcaataaatttatccagaaggtctgatggatacggttcactttccggaatattgagaaagacttcatctacccactcgcgacagacatattcaacgagatcttccttgtctgcaacaaccggaacaccttcgatcgttcgtccctttgccttatcatcaaggatacatacgccggtcacaatataatctgaataatttttattcttaatattgtcaatgactgtatcaacaatctcagatactgttacaataagaagggagcgtcttccgtttcctcccagatacttacgcagtaaatacttccatatattgcgggtaatatagcttagaagtaaatataatgctgctgtgtatgtaagcaccagtctcgagtaatcagcggcctctttaaatgtaaataaataaaatacggaacataaagtgatgagacaggtctgcttgaccgtcacagtaaattcgtgataaaaaccacgttttaatacattcttcaacgaatcgaagaaaaagattaccacgatatccatgagagcaaggctccacatcatatcacggtataaagaatttgcaaatacattcagcgacccatgccgcataccgaatgcaagcgtaaaagaaatccacagacagactacgtccaggatcatgaaatccaggtgcttcaaccagccctgtacactcttcttatacatatactttccccaatcttatttttcttgtgctgattatcctataaatgaacttctatccccgcaaaatccatacttcttatatgataatcctgttttcatacttttttggtgtgtcttaacagacagtacacaaatgattcagagttgaactatagatgtaaattaaaatattctgatgtactgatctttttaataaaaccacacacctttttatagtgagtaaagtataacatatatttcttatttgtagtattcttaaatatgactaatttcgaccttttaatctggctatttttggtcatgtcggactatattttcaattttccactaaaactttactttatctgtgttatttccttgtcattttttactgtttgtataatataatgtatattttgtaaaattataaggcgaaaaagattctataaaaaaagacatatctgacagctgctaaactgctttgatatgtctcctttattttataaggttctatctctcattttacttacttaatagggttcattacttcccgttatactgatagcgaactccttttacaacatatcctgctgctgtcttcttcaacttcagtgttgttgtaccgatgttcgttctgcccttctctccgtagcatcctaaacggttctgtgttgttacggtgtaggtattcttaccggtacgggttacctttgtgatcttgtaatctggaatcacatctccgaagtctccgccacagtacatatatggatctttatagtacttgctgttggagctgcatactaacatcgcatgattcttattcttcttgttcctgatgttattaacagaagcactcttaccaaaaagcttctttgtctcggaacgaagttcctttgctgtgtagctgtagtctcctttgtaattatatcttacaaatacggcgatggataacttggcattatcgttaagcttcatctttaccggtctggtggtggactgttcgcttaagttcatcgctgtcgtatatgcggtcatcatcttgctaatgttcttaatctcacgattccctgccatcttaccggttacgtctgtagatgctgcctgcaccggtgtaaatggaatgagtattactgccataaacattactgctaaaattgtacttaatctcttcttcatagggaacccctcctcgtcttcctgatatagtaaggaatgtctttgcatttcctgtacttttattttaatatttttacagggaaactgccataacagaagtattatctttggttacaggcgggataagaatgtataacaaaagtgttaacatggattttaattggtcaaaattgctgaaagaagcccccttctctgctttcacaaagaagggggcttcttttgattccatgccctactatactggttccgtagattagcttatggcactttatctttcgtatacacaaaaaacttacagtagatgtaagctgtcctcgtgaagattactcttctgtcagcttatatccggcgattctggcaagctcgcggatagaatctcttgataccttcttacctctatattcaatgaggtcttcacactgtcctgtaaagatatcactagggttatacttcttaatgatgatcttatcttcttctgtgaagatttctaaaggttctctctcaccgatgtcgaaacttttacgaagttccattggtaatgtaattcttcctaatgaatcaagctttcttactattccagtactctgcataacgtactctcctctctggcgcagcgtctacttcttattttactttttaatgacctgctgcctgtgcaatgtttttgtgatgactgtagtatatcatagggcgattcatttgtcaactaaaaaatggaaagttttttttaaaatgttaggcggtgtgcaaactgttattttgaagttcttattacatttcgccgttatattctcattctagtataataatggaaattcttgtactttcccttgtaaaaagttgttatctgtctctaagaatgagactatctcgcaaatgcgatggcaactttttactttacagttaacaaaatacccccacttacagcaattgaaaatcgttctttaatgagttcttactttaactttactttaacttaagtaaatactgtccataattggtcatctttaaactttctccaatctcgtgaatcttgtctaaagatataaatccttctttccatgcaagttcttctaagcagcctacatagcatccggacttctggagtgccttaacgatctctgccgcttctaacatgctgtctgcagttccggcatccatccatgtgagtcctctgtcaaatgggataacctttaactggcctcttcttaagtattctaagttaacatctgtgatctcgtactcacctcttgcagatggctcaagattcttagcgatgtcgattacctgattatcatagaaatataatcccggtacgatgtagttcgacttcggattcttcggcttctcttcgatggatacggcctgtccgttctcatcaaactctactacaccgaatggtcttggatcgtctacataataaccgaataccttcgcaccatggtcatccttgatggcttccttcataatctcatcaagattatggcagtggaaaatgttatctcctaatacaagacatacggagtcatctccgataaagtcttccccgatgatcagagcatctgcaattcctcgtgcaaccttctgtacggcaaattcgatatgaattccaaactcacttccgtccccaagaagattcgtaaattccttctcttctcccggtggaatgattacgagaatgtccttaatccctgcctgaagtaaagtagcgatcggataataaattaatggcttgtcatatactggtaataatggtttacaaaccggcttcgtcatagggtacagtctggtacctttgccggcagctaatactattcctttcatattaaaatccccttgtcattcgttaaatgtcttattatattgtcacgttacagactttataatgtcattcccagtgttgtcaatcttatgcagatgatagtaaattcccattacgaaatcatcttacttccaatattttatattatttccttccatttgtcaaactttctttgcaaatttaactaaatatttatatagttggtttttatttttctgcaaatgcgttctgtactgtgtccatcaaccatatttaggaaaactttgcggaagttatcgaggtctgattgttctacttctgacacaatattctcaagcatggaggctgccttttcacataaagcttcgaagtctgcgacaaccggtcccggagtgaactggtcataatcaaagtaaaagtctctgctatccatatattccttctcatcaaatgcataaaacagcatcggaagttctaagattgccgcttcaaatacactcgagctgtagtctgtgatgagaaggttgcttatgagcataaggtcgttaatatgctcctttgtactaaggtcaaatactctgtccttccacttttcttctacaaaaaagctctgcttgacaaacggatgattcttgaggataagcaccatatcttccggctgtcgttccatgaagcgattaacgtcaaatgcctctggtggatagtgtgcatctttattcccatctcctcggaatgtcggcgcaaacaaaatgactcgattgtccttaaatgccggatacttctcataaagttccctgcgcttttcttcttcgtattcccagtcaaaaagccggtctgtacgaggcacgccgagcgcctgtaccttacttggtgagatgccaaatgcttccgcataaatgtctcttacggtatcgctgcttaccggtacgagatcataattcctgtgattcatggaagtctgtggcgcaccgccctttttccccatgcgggtaagcccgaacgtcttaaaggcaccgcaggcatgccataactggatgatctttgtctcgttccgcttatgaatgctgtgaagctgcggataaaagtcttctagaataatgactgccgatgtcgcgcactttaaggcacactcccgcagttctctcttctttaactggtctaccgtctttgtattaataaatgtagtaatctctacttccggctcattctcctcaaaccacttctttacaagcataagattcccgccctcttccggctctctttccgacagaaaaagaatctggttcggcttcaccttattctttgccacgtatttacggtatctggcagcaaaatagtcggtattctgctgacgtgcactgtaattatatccactgatacggtacactgtctcattcgcccgcttcgccgcctttataaagttctttccttctttaaaataatctcttacgagcaaaaatggcaggccgagagaacatcctgcaaacttaagcagattcctcttacgcacgatctctgcccttgcaaaaagctccttctgtaccggaaatggctggtcatcaaggctgatctcttctgctccgcaccagagcgcaaacacaacattcaccttatggcgtggcggactgtaaaatacatatggcagaagaatctctgcatcggcgcggatctgctcgcccacttcgccctcttcaatcactacttccatcggaaaacggcgttctacctgtctttgcgtaaataccgcctgcacacgtatgcgctttccctccatctcctccggcatcttggcgcggaatccgagcttcatcgtcttctgcgtaatattcactgtaattctgtaattaatctttctcataactcttatcgttttctttctcttatgatttttaagctcctaaattgactttatcaaacggagaagtcttcgtaccttcttccttctttctttttatatagttaatgtagattttttcgtgacttattgatataatatagcaaataacatatttttacaataggcttttctattcttttgcatatttaagaattgcctattttgcccggaggaggggcatactatggataaaaagtttaattttcaggaattacaggcaatcgtggcaacacttcgcggagagaatggctgcccatgggataagtcacagacacacgaatcgcttaaattatatacgttagaagaagcctacgaagtgaatcaggctgtatctaatctgactaagactggagactgcaccaacttaaaagaagaacttggcgaccttcttttccaggtgcttttacagtcacaggttgccgaagataacggtgaatttgccatcgaagatgtgattgacggcatcgcacgcaagatgatccaccgtcatccacatgtatttgccggccgccattatgacagcgtagaacaacagcaggctgactgggagaagttaaaggcacaggaagaagggcataaacagacctctttaaaagaggacatcgatcttatcccggaaagcttccctgccctcatccgcggtgaaaaggtagcgaaaaaggctgctgctgccggtgtactttccaccaatgatgaagatgtattcaaagatcttctcacttccgtcatcaatctgcagctcggcaccgctggcgaagaccctgaaaagaagttcaacagcgatgaagaactttccgaaaagttaggagacaccctgttcgcgctgtgccgcttctgcgcaaaatataaagtctcaggcgagatagcacttttaaagaaactcgaagaattttagaaagcatcatcgcagaaacgaaacaagaattcttctgttcggattgccccgaagataatagaaaaagaaggaatggtttctcatttgattttgttccgttgcgctaaacatttcattttgcctcaaaaagcaaaaacttcggaaaaacgagtccgaagtttttagagtcaaaattccatagcgcaaagtcacaaaattcaaatgagaaaccattccttctttatttttctttcgagtaatccgaaatccagccttttatttgcgaacacatatttggaggagtcggagcaaatccggctcctctttaattttcaacagaaagcagatattttaatctgtcacgacgttttttcgctttcaggaggactaacgagtaattgctgctccattagacaaacgaatatcaccaatgacagaaactaaccagaaaacaggaaatccattgctagtctctgcggctttagagcaaagtcaagatgcgattgagcatattgactgcagtgatacagagcagagactaacaatggatttcctgttttcgtctgtttcgtttgtttcgtttgtttcttaaaatatctcatctatcagaatgctgcagaattcgctatagtagtaaaggaactgattcatatccttttcccccatacgctctttgaccctctctaagagcgttccacacttctccagctcttcggtaataagcttcttccctgcctgggtaaactgtacttttacgtagcggtgatcttcttcactgcttttcatttccagataccctttccgttccaggttatgaagcattcgggatacggctggtcttgacagcttcagcgcatctccgatatcggatggaatgacaaatgttttggctagcagaagccgctgcagagtaagtaacatcgtcagttcgcctgacgggatgttacacagctgttgaaactgaacattcgcccttctcatctgaatgattaactgttgataatcttctaaagtcaccttctgttctgtctgaggttcgtcttctgaccagtcagaactgcctgtgtctttcgtttccatatctcctccaaaaaatacttatatttttttcatatacttttcatatactgaaatacaaccatttactttgctataacgatcctgtccttcatcggaacgtattctttatccatggctatgctctggtatgccggacggatgatcttgtcgcagttcatcagctcttctaagcgatgtgcgctccagccgaccatacgggcaacggcgaacatcggggtaaacagctgatccggcagtcctaagatacgatacattaagccgctgtaaaagtcaatgttggcgcttacgcctttgtaaatgcggcgcttttcctggatggtttctacagcaagtctttctactctgttgtagaattcaaattcttcatcgtatcctttctctcttgcaagtttatcaaggaatcccttaaagattcttgctcttggatcagagatagaatatacggcatgtcccattccatagattaaaccactatggtcaaatgcttctttattaaggagcttcagaagatagttcttgatctcgtcttcgtcttcccagtcttttactgtctgcttcatctcatcaaacatatgtacaaccttgatgttagctccaccatgtttcggtcccttaagagagcctagggatgctgccatcgctgagtacgtgtcggttcctgatgatgttactacgtggtttgtaaatgtggagttattaccaccgccatggtccatatgaagtacgagtgcgacatctaaaactctcgcctctaatggtgtatacttcttattcgggcgcagcatacgcaggatattctctgcggtagatagttccggtttcggtgaatgaatataaaagctcttaccttctacatagtggttatatgcctgatagccataaactgcgagcagcggtacggtacttgtaagctggaggcactgacggagtacgttcggtatggaaatattatctgccatgtcatcgtatccgtataaagtgagtacacctctttgtaaagtgttcatcatgtccttacccggtgccttcataataacgtcacgtacaaagttcgttggtaatgtacgataacttccaagaagcttctgaaattctttcagttcttcctcttctggcaaacgtccaaaaataaggagatacgcgacttcttcataaccaaatctctgctctgctacaaaaccgtctacaagatcgtggatatcgtaaccgcggtatcgcagctctccatcgcagggaaccatctttccatcaacttctttggaagaggtgatggtggagatatccgtaagtcctgccagcacacccttaccattcacatcacgaaggccacgtaacacatggtactggtcatacagacctgaaggaatctgcccatgttccatagaaagcgcggccagatcctgcaattcctgtgtcatcattgaatattcattcattctatcaccatctctttcttaattaacaatgttagttatctatgttaattattatactgaaaaagagatactttgtcaaattaacgtgatgtattgcactgtctgaaatctattctgacaatattttaccctgcttataagtagtttacgcaaaaacactgtaccttagcaccaaaattttatgtaatatgtacaagttttttctgttttaaaatatttgactgtgctatactataaataactttatttatataaggggttagtatgcacttttcccctgttttagtgcgactggtacttatttagaatgtagttttcattgcggcatttggaatacgacatttcgattttgccggatttttctacaggataaatatttactgctattataatttatcatttaaaaattttttagaaaggagcgtatcatttatgcaaatacaacgtctcgtagatctggaggactacgaatttgatacattgctcgttacgtataatcataaaaaccgcctgagtatcgaacttggaaaggtcagcgaaatttttgaaagtcttcaggctgacggtcttgttggcggaagcaaggtatacggacttcgaggaaaggacttctcctatcagggccagccttactataatctaatcttcatcggtatccctgagaaggcaactccaagaagatttcagttacagtttggccaagctatgaaggaagcgaagcgtttccatggtaagaaccttcttatgactgcgatcggtgaagaggtttcctactggttaagttccgctatgaagggacttctccttgcagactattccttcgataagtacatttctgacaagccagaagcctctgaacttcatcttggaatcctgacaggaattgattctgcatcctttaagaaagaagagcagtacacaagaatgatggcgaaggctgttacaaccgctcgtgatctggtgaatgaaccagcgaacgttatgacaccggctgctcttgccgctaaagcaaaagaaatctgcgaaaagaacaatatcaagtgcaccatccttgaaaagcaggactgcgaagcactcggtatgaattcttaccttgccgttgcccgcggttcaaaacagtctgcgaagttcatcgttatggaatataacggacgtgttactgatgatgaaaagattgccttaattggtaaaggactctgctttgactccggcggatataacttaaaacctggcactgccatgaaaggtatgcatggtgatatgggcggcgcagccgcagtaatcgctgcaatgggcgcaatcgcagaagcgaagctcggcattaacgtaactgctgtcatccctgcctgcgagaacatgatttccggcaagtctatgaagccgggtgatatcgttaagtctatgaacggtaagtacatcgaagttgttaatacagatgcagaaggccgtatggctcttatcgatgccatcacttatgcaatccgcgaatgtggcgctacaacattaattgatgtagcaaccttaaccggcgcatgcgttgttgccctcggtgaccgctacaccggcgcattcagtaacagcgatgaactcatggctaagatcgttcaggcatcgatccttgcaggagagaacatctggagactccctatgggcgatgaagaatatgataacttaaacgcatccaccgtagctgatattgcaaactgcggtaagaagtgtggtgcaaccgctgccgcaagattcttaggcgaattcgtagaaaagaaaccttgggtacatcttgatatcgccggaacatccgaatcagacgaagacaaagagatttactctaagggcggaaccggagccgcaacaatgctgctttatgaaacagtgaagttgatggagaaaccgtataagagttattaagggacaaagcgacaacaggtaaagagacggaaagcgagcaaatcttaatatagaaaaagcttagtttcacaaaaaaagatggcttggatgccatctttttttgctctaatgcgctttttctatattaagattcgctctctttcctgttttttggctgttggcttttgccttttgccttttaataagaactctcttatacgctttctccatatgtgaatatggggatgaaattcaatattctctggaaactatcttttttgctctaatgcactttttctatattaagatttgctcgctttcctgttttttggctgttggctttactgaaacagctgtgcttctctgattacgacatttttattttttgcccagatagagccgaattcgcctccgcctaatggtgctgctcctcttccaacttctactgtaatgaatggaatttttttcttataaaggtaatatgttctggagtatccatgtggaagtgcgtagctttcatgctgtacaagctggtaacctgtaaggctttttgcagtctggtacattcttgtcgttgcatttcttactgcctttggtgcgcgactggttgacttaccgtaaataatggagcctgtagagtgatagcttacaataccgacaatcttgccctgtttctggattctatttgaccagtttactaatgctcttgtctcgctctcgctttctgcctttggtccacaatatcctgaacttccttttcttccggatgtcttaaatgctacgttccagttacggtttaaatctacacctcttgcattcgctttccatctgctggagctgcctcccatctttctaagagatgaacgaagctttttattacggattgcattaaatccacgctggctaatcgctgttccgtccggattacaggatggcacatagtgaattgccactttatccaatgtagcagaaaccttcttgccgcttatctttttattgtaattacttaaataatattcaatctgcttcatacaaagctgtactgtcatatgctctcttgcatgaaggttccccataacaagaagatgcttctttgcatcaggattaccgattacaacttcataaagatttctcttatcttcactctttccgatcacattcacctggcaatgattcttatactttttcttaagctgctgtaaatctttctgcaattcgctatagctgtaattcttcttaccaccggaaacaatcgctgcgtctgcagtcacgccctttgttgtaaatccgatacagcagatcaataccgctgtaaaaatccagcccatcattcttttcatgttctttttcatgatatttttctctctttccctcttatttgccttgtttattcctactttttcttagtatatgccttaacaaaattgtatacaagacacgctgcaacaatgactgctgccattataagaaaatctgcaagtgtcatcctctattcacccctttattcataatccagtcatatgataccagagtcaaaaagtcagaaagccgatgcaaacttgcttgcaagaggatttttgaactcttgaccctaaccgttatgtgtcatatttgtgacatgctcccaccacttaaatcatagattttgaagtggggggcttcttgctcaatggctctactgagccaagtatctacaagctatcctcgcgtgccccgcgattcttttgcccggatacgggcatattttcttattatcagcttgtccggatacggacagtttatgctgtcaacatccttcttgcctcttcacgtatgttgattgctgcattacgatctctgtccatctcatttccacacacacagtgatagactctttcagataatttcagctctttctttatccttccacatttacagcattttttactggaaggaaagaaacgatctacctttaccattttctttcctttccacgccagcttatagtctaacatttccctaaacattccatatccattatcctgtacgctttttccgaaatgcaggcactgacccattgctttcatatcgatatcttccactgcaactgcatcataaccgtctgcaatctttcggctaagtttgtgcagatgatcccttcgctgatttcgtatcttttcatgacatctgccaactttctttttctgcagttcataattatgacttccccgtacgcatcttgataactttcgctgctccctcgccagtcttttttcattttttctgaaaaatcctgcttcttctgtctcaaccttttctgaaaacactgccatcccctgcattgcataatcaatcccaagtatctttgcagtactgtaatccggtccagcagcttggttttcacagctgtatccttcataaagcaggcttgcaaagtattttccggatggttccatactgaccgtcactgatttcaggcgaaggccttcggctggctccctgtgttttttcatggcgatccattttaatttaggaagccggatccgcttactttccaccaggatatttccattgaccacattcgttgtatagctgtttttggaatgatgttttgacttaaaccttggaaatccaatcttgggatcccgaaaaaaattcttataggccttttccagatgaagctggacatttgccagtgccagcgaatctacttctttcagaaatggatattcctttttatacatggccggtgtgttttttaacattttcttcgtcttttcatactcccggatcttatcattgagcatctgattatacagaaaacgacaacagccaaatgttttgccaagaagtatcttctgttcttctgtcggataaattcggaaacgatatgctatgttcaatactttttccctccttggattgcaatgtcttgatggattacttctaccagagcccctcctgttgtcagcaaggcagaaactctgactccaaaaggcttctttccaaagcttttctctgatttccagatactcctttttcaatagtctgctactggcacttttacaggcattgataaatttaccaacttccgttctcggctgcgcatggaacattacatacacataatcaatgtcatgattccattcttccagaacaatcccataccttggagcaatatgttcccatatcccttttgctctttctgaaattggattatcaatgacttttcttcgatatctcactaccatgatcagatgatagtacatcatatatactgaatgcgcattatgatttatttttccttttctactaactctattataccatagattgctttattgaacaagtgttctctttttgtttttacacaattcatctcccacctgcagaggaaggataattcttgctatattatattaaattatatcatattttccaagaaaaaaatatgatatccatagcaaaaaatgcaaaaaacagccctcggcattgggtgtggcatagcaaaacgcaagatatctacacttttatacatagagccacatttatccataaatttatatgcgattttctaatggtagcctcaacctacaaatgcaaaaacagcccccggcattgggtgtggcatcattggcaggaattctcatagaatataggtaatcgcatgcaaaaatttatgaagatgcgcggtacctatgtataaaagaagcagatgctttgcaggttttgcgttatgacacttgagaacgaacccgccaccgagcgccttgtttgagctttagcgagttttggcgcgaatggcgtttttataaaacgttcgaaagtggcatagcaaaacgcaagacatctgcgcttttatacatagggccacgcatcttcataaattttcacatgcgattgtctatctctaaatataaattcctgacatagggttaggggctgtttttgcaacagcccctcgccccttttatagggaaagttactttatccgccttttccttttggtaggggaatggaaaaggcagttccaaaaaaagttactttgctcttattacttttttcacttccggaccattaccatatcctttacctaatgctgtactgattctgatcgtcagctttttccctttctgtgctccgttaggaacccatacggtataactctttttacttccttttacccaattaccagcaacccacatacctccgattttcggtacttttttctttaaggttacttttactttatacttcgtataggtatacggtggtacccattcataacgtgaaatgtgtccgccaacccagtgtctgcgccaccagcccttaaccgttacctttttcctctgtacgatttttatggacttgatagccggtttcttcttagaaccagtcttcatcgttacgatatcggatggcgttcctgtcataccatttgcataagcctgtacgcggaacttgtaattcgtcagaggttttaatcctttgatcgtcactggattactgttaccacaggagaaatatcctaacgtctttgctgtcgtccatttacccttctttaaaacctgaatccttacagacgtctgcagcttattcggataatctacccagaactttgcagaattataaccggtagccacacgtggctttttcaatttctctgccggactgatcacataagttgtaaatgtctttccgtttgttgtcttaaaggtgatccatgcatgtctgcctggtgcagtagcggtagatggaattccatcataatcaactgtatttgaattataccagtcccatgtctttccggtaagatggtcatataccgaaacaatcttatcatcagaattcgccggtacggtctgtgcaatcacctttttcttccctatgtcggaaagctgaatctcacttgatgaacaggtaattccattcgcagggatccaatcatgaccgtttaagttaaacataaatgttgctggataataagcctgtctgttattaattatctttacataataagtgccacttgttaaagtttttgaacctatattccatatgttctcgcctttatattgtgtagcggcttctttgtataccagttcatcacgagaattatatattttgataaatgtttgactttgatgaaaaaggctgcatctttctttctcagctagctcaaatatcggattaattactgctctatccttaacatcaaacttataccaacgttcatcttctccagagccagtaacaccttcataaagactgttctgcataccggataatggaatttccactgcggtatttttattaagaccaatcgcctgatctttctttttaacttctttactgagataggctgctttaacgttaaatgttacagaagcagaacttgaagctgaagaagagaaaacaacttcacaagccttctctatacgctgatatggatataaataaagcacatttgcatctttcgctactggattttctttgcttacacactcatgatttcctacatatattcttagtttataattatgatccgtttgtgcaatattatgctcaaaagttacttttaccggtttatcagagttattggttatattaatatatggattactattttctcctttcgtaaatggaaccatttctatcgttcctggggtaaagtttttaggaataccgacttcatcggcattcaccccggcatctgccataaaccagaacccaaacaccaaagcacataacaataatcccttcatgaaatagttacatattcgtttcgttctctcttttttcataatgatccctcctgtttattctccaacgaagttgcgggagtgtcgtttttaaaccattaagttttctaagaaaattataacaaatatgctcatttttcacactgtccttaagtacaggttttcttcacaaagaaggtggatttttttccggactgtttggaataataaagtttttattggtgactgcgattgcaagtcgtgttttattggcatagccggttttggataaaatattggatacatgaaactttactgttctctgggatatatgcattcgttcagcaatttcactatattcaagtccttcgcagacgaagcgcagcacctcgatttctttggcagtaagttctgaactgtccgcaagccccagctttacactcggtgttttatccgggaaaatgtgttctcccgccatcgtttgttctatgacatcaatgaggttctctgggctgatatctttataccagaagctgtcaactttcgcttcctttgctctttttaaatagccgacttcgaccatggaagtgacgataattatttttacatctggaaattctgctttaatttctgctgctgcttctataccatctttattcccggctgtacatacgtccatcaaaatcaggttgattttctcctgtctgcatacggcaagtgcaacatctgctccatttacactggcagaaagtgcgtatttcccactatctaaaagtattctttccatattttcacgaggcatcctctgatcctctacgatcaatacctttttcattctttctccttactctccctctccttttgaaatgttattgtcaatgcaaaatacggcatggattgtatatgcatttccccactataatcaaatatatgccgggaaaggttatataatcctcctttgggaacaacttcttttttcggcgccaccccattatttgtaatacgaatacgataaaaatcatcattttcctgcattgtgatagaaagttctgtcgcaccggcgtgacagacgccattcgtcagacactctctcatagcaagtatatatatattggcgtactcttcgttctttggcagggaaccaaggcactctatctttacgccaagcgttttcgcatcctgcagaaatctttcaaattctccttcatctaacgggtactgattatcgttccagattgcatttaccgcctggcggagtaatctgaccgcatcgctgtaatctgcactctcctgcattaaactctgccggatagctgtcagtcccgctcccatctgatcatgcagctttgtcttcgcggcaagcacttctctttcccttgtcaagatcaatacattgtccgaaagatatctaagttctcttgagatttcttttaacttttccgtctgctttgtcaaatttattttttcatgatattgctttgtaatatccataaaaacagcttctgtatacacatttccatcgctgtcttttacttcattttcctggtaatcccacgcctttccatcaggaaaaaggtacatctcttttttatctgtgagtctggtcacaccattttgcgtactcgtatgaagagcatcccgcaattcgctgagtttctgcagatctttatgcgcaagaacccggaaaagccgatacatctgtgtattggcaagcttcactgcaccattggaattaaaatagcaaatgcctatcggaaggaggttcatcgcttcttggatcgaattccgtcccacttgctcctttgttatccttctcagccggataccttcccagataagtaaaaaatcaataatgccgacaatgcaccagattacccagattggaacaggcagcacttcataatagttttcccccttatctatctgtccaaatgaatacgccagatgattcaacagaaaaagcaagaatagaaatgcaaaaatattccaataccatcttcttttatctatccgcatatcataaaacataagaagcaaaaataaggtaacgatcaagctgagcagcaccgctgtcattaacagcgtctgcattaccttatatgaaagatagaatgtctgcattacttttcacccgccttttttacagtaaatgtaaatttccatacaccgtcttcgtacttgcctttctctgccttgtcaaaaaatgagctcagattcgcttcactttctacttccatacaaacaatcagttcttctccacaaggacgaatcttcacccacataaactgaatagaatccacgcaggattctactattgattcaaaaaagctataaatacgaaccgcatcccgcacataaatgcgctcacccgcaggagcagtcaaggcacattctatccccattaacttcaaactgctaaaagactcttccagacaggctccaagctccgcaacatcggatatctctgctctttctccgataaaaatcaaatttccatatctttttatgtatgttccgatcacactgatcttcgcaagcagcctgcggctctttaccagatcttcctccgcttcgtattggctaagcagctcatttaacagcccaatctgtccggcagtctgcgtctgtaacttatcgtataaacgattcttttcccgcagcatattaatctttgcctttgtctgataattctcctgttccaaacaattactctcctctattgttttcctgttctcttccattctttcaagaagcataataatatattcaatatcttcctgccataaaatatgtccgccctgaatcggtctgttttggatcagcgtcttcttatcaacaacaacgcctcccttctccgcttccctcatcaccgcttccgaaagctccattgcattagcagaagtataccggacacaataatttcgatccgtaatctgcgctcccatcgtacatacttcaaatagttcttcataccctgtattcgtctgaatcagcccacagtaaatacagctctcaaatatacatacaaacatcaggcataacgccgctgtaatatctccaccaataacctgcatccactctgcaccgcttgcataaataatcgcataaagaatagaaataccgattccgatcaccggcaaatacttctttctctgagacagccggcacttataaaccattaaagcaaacgcagccaccgcgcagacaacttcccacaacagcacagtataatatccccacgcatagctgtagcctttatccgtccatacctctcctgccgcaaaagaaaacacacactgatgaaaatcatttgacaataccaataaaaaacagagcgttgtaggaacatataaaagctttaaccacttcggtaaaatgtactcctccggctgcccaagaagaactgctgtctgtaccgccgcctgcggaataaacagcatcggcaggtaatagctgtaccataaataacgctctacatttacatccatcgcaaaaaaatactttatactacgtacaataaaccagaaaatcattaaccccgatataaagatcagtgtatttttcgccgctttttgaacgacccgcttatgaatactgattccccacccaatatataatccaatatatatcaaggttcgtaaaatcccccaaaaaagatatcgtggacttaccttccctacaatacggcatagcagcgcagcgataaccagccccgcaaaaataacttgattccaattcctttgttttttctgttgtttttgttgtttctgtcgtactttttgcatcacagcgctcatgccacttcctttactgaatcgtatcgtccatctcttaagattcattgtactatatttacaggctttctactatatttatatttttctgcacagcaaaaaagagagcacctcgactactattctagatgctctctctagtaatttgaattttcaattatgtccaacggactatacctcctgtttcccttttaactttaagctaaccatccacagtttgtattgtaatcagtcattccttctatcttctacaaaaggattatgattcttaatacacttacttctgattccttaaaatctccggtcatatgattcatctcaactttgggcgattattcctttgaattctaagctgattcctggattcttcaattcttcttcctactactacctaaagtgctatctatctgatattatcactcacaatctttgaatctttaaatctgcaatctcacttaaattctaaaacttatgtttttgttggtctatacctcccgctatggtatcgtttcgagtcttaacttaagtttttgttggtccgtacctcctggtttagtatcgtttcttaaatcttaacttaactgtttggtggtctgtacctcctgctatagtatcgtttcgaatcctagcttaagtttttgttggtccgtacctcctgattagtatcgtttcttaaatcttaacttaactttctggtggtctgtacctcctgctatagtatcgtttcgaatcctagcttaagtttttgttggtccgtacctcctgattagtatcggttcttgaatcttaacttaactttctggtggtctgtacctcctgttataatatcgtttcctaaataaaaattatgtttttggtggtctgtacctccttctggcttatttaaattctgaaattaattttaatctgtttgcactctcacctctttttcatgataaaagcaaaacctctaatttcaaaatctatatgatggactgtgccgtccgttctttgtttatgtctgtattataatgcagagttcttgttttgtcaacactatttttatattttttattgattttctaattttattctttgaatttaattctttttagtttttatcatattttatttataattttcagaatattcaatctttttacgagcccaaattataatatcaaatacctttcaaaaccatcttaatccccacatcacagataactgttcctttttcgtcagattttcttcatttttttctcacagactgttcacaaatttccggtatcataaaaccatcaaaaacatcaacaacttatttttgatagatttttttcatactttcctctcttttaaaaaaccagccttcattggctggcttttttattttatatggaactttttctgtatctcctttcttccccacagttccacttcattccggtgggcaagatttctggcacttttcgtaaaattactatttgtaactaccatggcattatctgccttatagtacgcaatagaaccgacaacttcctgtacggcagcaatcccaacattcctttcataacgctttgcctgaacaaccgtcttttttccccatttacgaagaacaagatctgccccgtaatcatgactgtaacttgtgagtttcacacgatatccaagatgccggaactgaatagttaaataccgctcaaatgcccgtccactcagcttatctattcttttcattgtcatatgaagataatacaaggtacataaacgtctaataaactgataaatacaaatagcacagagtaaagcacagccgactgccgcctctccctctctccttgtataaaatgtatatccttgcagaaacgtatatagaacacccgctaaccatagccactttttaatatcgaaatatcgcatcttatcttttgcctttctaacacatttaaaatgatatctcaaagtatacactattttactatttaattcattagggaacagacgaaaataaaaagaatagaccattgcaaatgtaaagatatcactgcgtagaaaatgcctgttcggcatttttacttgctctcacattacatttgcaatggtctattctttttattttctgtgttttgactccagaaggaatgaattcaatagtctttgggagcgattaagggggaggcggcagatgtctactgctactcagaaagtattcctgcccgccatttttacttgctctcacattacatttgcaatggtctattctttttattttctgtgttttgactccagaaggaatgaatgtaatagtctttgggagcgattaagggggaggcggcagatgtctactgctactcagaaagtattcctgcccgccatttttacttgctctcacattacatttgcaatggtctattctttttattttctgtgttttgactccagaaggaatgaatgtaatagtctttgggagcgattaagggggaggcggcagatgtctactgctactcagaaagtattcctgcccgccatttttacttgctcttacattacatttgcaatggtctattctttttattttctgtttgttggctccacgtgaatgaattcaatagtctttgggaggaattaaggggggaggcggcagatgtctactgcttttacattcattccttccggagccaaaacacagaaaaaagaaataatgccatatcccagatgcggcttcggagcggatttaagatgcggataagcatcttaaacacagcgactacagagcagatgggatatggcattatttcttttttcgtctgttttctcttcaataaatctaatgagctacatcattatcaagggctgcgattcctgtttcatttgttcggattcttactacattttctacatcataaaggaagatcttaccatcgccgtactcaccggtgtaaagtgctttctttgcggcttctacaactaattccggtggtactgtagatacgacaatgtctacctgaagctgtggcagaaggttcatatcaatcttaacaccacgatactgtccagtttttcctttctgtgttccacaacccattacatgggatactgtcatacctgttacaccaatctggctcatggcatcttttaaaatggcaaaacggtcttctttacacataattgtaagttttgtataacgtccgccagcttcttttgcaccgccgatgactggagcgagtttcttgtctcttaagtcggttacatcgattgtttctgttgttacaccgcccattgttgttgcggaaattggaaggaagtctgcgtatgctgatgcaagatcatgttctgcgatatcaagtcccatgatttcttcttctgcactgacacgaagtcctattgtatgtttaagaatcgtaaatacgattgtcattgcgactgctgtgtatgctgcgatacatacaacaccaagtacctgtactccaagctggtggaatccgccaccatagaatacaccattgttataatcgaaaagtccgactgctactgtgccccaaagaccattacatccatgaacggctacagcacctaccgggtcatcaatttttaatttctggtcaataaattctacagctattactacaatgataccatcaacaagtccgataatcgttgcaccaagggcatctacattcgcacagccggctgtgatacctacaagacctgctaaagaagcattcagacacatggaaacatcaggtgctccatttctgatccatgtaaacatcatacaggcaaaagttgctactgccggtgcgatagttgttgttccaagaatctgtgctaactgtgtaggatccgatgctgctgcaccgttgaatccataccatgcaaaccataagataaagcatccaagtgcgccaagtgtaagggaatgtcccggaaatgcatttacaacagtttttccgtcttttccttttgtatatttaccaatacgaggtccaagcattgcggcaccgataacagaagcaataccaccaaccatatgaattacagaagaacctgcaaaatcaacatagcctaattttgcgagccatcctgcactgttccatacccatccagcttcaatcgggtatacgattgcactgataactgcggaataaatacaatatgtagagaactttgttctttctgccattgctccggaaacgattgttgctgctgttgcacaaaatactaactggaagaagaaattggaccagtcaaagtttgcgaagtctgtgaacatctgatattccggtcttccgatcagtccaaagaaataattttcactgttcataatcccgtaaccaagaacgaagaatacgaccgttccaatacagaagtccatcagattcttcataatgatatttccggcatttttcgctctggtgaatcctgtttccaccattgcaaaaccacactgcataaaaaatactaatactgcacctaaaaggtaccaaacactcatatccatacttttcactcctaacttttttgcaggtctttcctgctttttcaagaaaatgctttctcactcgcgaagtgtttttattttataaatttctataaaataaaaaatggacgccaaaacaattatgtttcagcgcccttgcttttcatgcatttatttttgcactttttaaccagtaagtcaatgtcagttttaacttaacttttttagctgtccgggggatattttattatattgtgacagtcagattgtacagaaaaaaataatgcttaattatcttaaattctatgtcgttttggcttaattttcttaacagaatttaatttattaggggaaacaaacgaaaataaaaatagcagcccatagccaatgtaaagatatcactgcgcagaaaatgcctgttcggcatttttacttgctctcacattacattggctatgggctgctatttttattttctgcttgttggctccagaagaaatatgttcaatagtctttgggagggagatggggaaggggacagaaggtcgtagcttattctgatactgtctccgcgatgctgtcaatgataataagttaaagaaagctcctaatcttctggacggtatacctttcgagcaaacaggagtcttctgatttctcccctctctccaccaaagactattacattccttccttctggagccaaaacacagaaaaaagaaaccataccatatcccagatgcggcttcggagcgggtttaagatgcggatgagcatcttaagcacagcgactacagagcagatgggatatggtatggtttcttttttcgtctgtcttttccaaacaaatgaaatagttaattattctttctccatcccgcgggatatttatttttaagattattgtttacgagttttccaaatcctaatggatgtcctgccaccatgaccagctgccagccttttcgtttcttttcgccggcgatcaagtcgcttacatcgagggtttctccgcgaagataacgtgacaggcgttcatcgtctgccgggaagtcaagtacctgatcaaagtcctgtgcgtggagtgccagggcaaatggctgagatggttcaaatcttttctttttaaattcgcccatgaagagtccatttctaaggaaatgtaatcctcgtccatcgtattttggtgctggaagatagtacagattatctcctcgcacatcgattcgcttctcatcatatgcgatatttacatgggagaaaaagtcttctgctgctgctttttgttctttatttaagcctttgcacttttcccaccagatagaactttgcgagactgtctgttgtacttgctgctgtacaccgttctttttatgaagaagtgccataaaatgcccctctccggacatcttatgtggccagattctgcggcaaagcttacagctttcatcgaaaacttctcctctgtaggaggtcagtccttctgcaaagccttcataatcttccatcggaataacttccatatccgggcgttcctttaaaagatgtgtgatcgtcttttcattttccaatggtgaaaatgtacatgtagaataaaacatcatgccgcctggaagcagcatatctgccgcctgtacaatgatttcccgctgcagttttgaaaaatattccggtcctttttcctgccaggaatccacaaccgccggattctttcgaaacattccttcaccggaacaaggcgcatccaccataatcttgtggaaaaattccggaaatctctccgcaagtacatgcggtggctcattcgtcacaaaactattagaaataccaaatagctcaagattacgaagtaatgctctcgctcttgctgtattaatatcatttgccaccagaaggccttctccctgtaaggctgctccaagttccgttgccttccctcccggtgccgcacacagatcaagaacccgctcgcccggctgtactttaagtcttgatgccggagtcatcgcactcggttcctgtaaataataaagtccggcactgtaaaatgggtgctttgccggcgcatcttctgcctcataaaaatatccatttgaaatccacggaacctttttcaaatgaaaaggagcaattctttcgaattcctccaagttcatctttaaagtattcacccgcagaccatactgtctctgtccgtcaaatccggcaagaaacgcttcataatcttctcctaaaatctccttcatagaatcaagaaaagactgtggtaaatctgccatctaaaaatctccttattacttaattatagattatatgcaattattttgagaacaccaaaacattctcgaaataattctgtatattaatgaaaagcctgtcctgcctgttgcacactgtccgcacgctgttctactagcggactcttctggatcacattactgttcttctgcttcaataattccttaataatctcttttctcgtaatgatcccgataaatacgttacgcccgtccacaaccggaacaaagttctgattaagaatgtgcttatctaactgtgcgatatctgcatcaatacttactgctttataatcccagcgaagacgcatagactccacatgagactttctcatcacttccatatccatgtgatactcttcgatcagattccagagaaaatctccttccgaaatcgttccgacataatgtccttctttatcaataaccggaaccgcctgatacccatgcttatgaatgaggcgtaatgcctgtgctacagtatcttcctgatgtatgtatgttacttcacttttaggaatcagataaaatgatatattcatatataaatcgctccttctcgctttcgtttcaatttacatgaatctcctccaatatatatacatcataacataccaaaagggatttagatagccttttgcaaaagcttcataaaatcttcataaaaatgtaacttgtgatttgatgggttgaatagacgaaaaaagaataaaaccgctatcccatctgctctgtagtcgctgtatttaagatgctcatccgcatcttaaacacgctccgaagccgcatctgggatagcggctttattcttttttctgtgtaatccaatccctgaaaggacttgttttgtctccaaaaaatgtgagaatacaatctatacgttataaatcactccaatatgagttttaattcgcccaaaaacagaaaagcagaaatttactataaaagaaaatgtgatgtcggagcaagtaaaaatgccggtcaggcattttctacgaagcgactatcttcacattttcttttatagtaaatttctgcttttcgtctgttttcgtctatttttctagcttatgaatatttttgataatttcccggacttttgcgagtagttcttttttgagtgttccttcagattcaaatacgaataccgggttagcttctggttttattttcattttattgcgatactgcttgaggaagtcatcgatttcttctacgcggactttggcgcgtgggttcatagtgaagagaatcttgcttcctttttgttcgatggaaaggagccatgcctgatgtgcttcttctcgaaggagtgctacgtccataaggctgagtagtggttttggcgggtctccatagcgatcggtcagttcttcgatcatatcctcatattcttcttctgtttca

SEQ ID NO: 393 - DNA, 77315 bp, Eubacterium hallii
gtacagggaatctactcctccaagatctgatgtcttcattggaataccgataaccggcattgggaaaatagctgcgcacattcccggaagatgtgctgccttaccggctcctgcgataatcactttataacctttttcttctgcaccttttgcgtaagcgaaaaattcttccggctctctgtgtgcagagataatcgtcatatcaaagtcaattccaagttccttgagtacatctgcagcttttgccatgattggcatatctgaatcgctgcccattacaatacctactttagccattgtcgctcctttttcattacatatactctaaaattccaagagtatatttttatggtgaaatgtttataactaacttataaaattataacaaaatgctttattttacaaaagcgttctttaaatcttccttcatatcaaggactgcctggcggctggcatccgcatagtctacagaactaaacttctctttatacgggtctttctgataagcacagataattccacgactggagtttacgatagcaccaagtccatcctcattaaagaacggtgctaaatctttacctgttccaccctgtgcaccatatcccggtacaagaatatagtttttaggcatgatctttcgaagtgccgctcccatctccggataagtagctcctacaacggctccaacatagctgtagtcttcgcccataacatctttgccccattcagctaccttttcagcaacgatctcataaagtggctttccatcaatctgacgatcctggaattctccactggatggattggatgtttttacaagaataaatacacccttatctgtgtctttgcacacttttaagaaaggctttacaccatcagaaccaagatatgggttcaccgttacaaagtcttctgtaaatggagaatatacatgttcaccaatctttactgttccaaggtgtccgatcgcatatgcttcggatgtagagccaatatcgcctctcttgatatctccgatgataacaagtcctttgctctttgcataatcgcatgtctttttgaaagctttcaatccctcaacaccaaattgctcatacatggcaacctgtggctttactgccggaataagatcataagttgcatcgataatgcccttattaaactgccagattgcttcacatgcaccttctaacgtctctccgtatgcagcaaaagcatcttttacaagatgttttggtacataagaaagcatcgggtcaagaccaacaacgataggcgcatctttttctttgattccttttactaactgattaatcataacttcctccagaattctactgatatccttttcattctagcataaattttttcagatgtacactcacgatatgccaaaaaacgacatgattattcttagccgcgatatacaactttaccatcacaaatcgtatattttacttttccatataactgtgcaccaagaaacggagaattttccgcttttgactcgaaagattctactgttcggacttcatccggtgcaaaaataacgatatctgcagccgctccttctttcaatgttccacagtcaaaattataaagctttgccggattaaccgtcattttttcaaggagctgcatcatcgtaagatagcctctttttacaagacttgtaataccaagagataatgatgtttcaagtccaatgatcccacttggcgcctttgtaaattctctctctttttcttctatagaatgaggggcatgatcggtcgcaatcatatcaatcgttccatctgctaacccttcgataatctttgttcgatcccattctgtacgaagcggcggattcatctttgccatcgtttcataattaagtacatcttcttctgttaaagtaaaatgatgtggtgtagcctccgcaaaaacctttgctcctcgttttttcgcataacgaaccaaatctacagaacgaccggaagatatatgctggatgtctacctttgctccagtatcaagtgccagcatgacatctcttgccaccatcacatcttctgaaattgccggtgctccgccaatccccatctttttagaaatcacacccttgttcactccgtttacttcgttaagtgcaggatcttcctcatgcaatgagattggcatatccattttcactgcctcttccattgcttttttaataaatccggcatctgttaacgggattccgtcatctgtaaatccacaggcaccagcatctaccatcgcctggaaatccactaactcttttccctcaaatcctttggaaaccgcagacacctgctttacgtgaatcggtaagttctctgctctttttaaaatatcctgaattacttctggagtatcaacgattggttttgtatttgccatacagacaaccgttgtgaatcctcctgctgctgctgcatgacttccggtttccagatcttctttatacgtaaaacccggatcacgaaaatgtacatgcacatcaacaagtcccggtgccgcaatacagccgtccgcattcagtttttcagcatcttcttcccattccggatgttctccaaatccgatgatccgcttatcttccacccagatatctgtaacttcatctcttccagatgccggatccatcacatgtccatttttaattactaacttcatctttgtatctcctcactttattttaaccttcaaatgcttcatttaactttaatgtaccttccagcacaaatcttccatctaaaagaatcggaatctctacccgttcctctgccagatcatgcatgacctctgattccacaacccgcacagttacggctgtaattcttgaaagctcttcatacggaatcgtaatatctgtatggcagttaaaataggctttctttggatcctcttttcgaagtacagaacattcattttcctttgctacgatttctttcccatccggattatatacacgaacatcttcgcaataagaataacaggtatctccgattgcgatatgcggtcccattttttctgcaataaggataggcagtttagacataataccatacttttcagccatcacataggcagttgtatttgttccgatcgcacactctccaatcggaagtgtttctctgttatataaaagattctccttaatgaacttctgtccgtcctcttcatccgggaaatttgcacatgaatactcttcgatcataccatctttaaaagtaatctttaaatctttatagtaaagaccattcaaatagacttctgtcacatgtaaaagaccatttgtaccttttagcttaggtgaagtaaatacttcccctaccggaatattgacatcggcaagacagttttcaaacttcgtttctttgctggcatctttcagatcgcatagagcaaccataagattcgtcatatttcttccacgtcccatgatatgcaccgcttctgactgatcaagcacatcaatcatattttgctgaatctctttgtacacttcgttatctaacgtatttactttacgaatctcctcaaaaatttccgggaaattctctccgatcgaaggaactgggtacgcaataatcgtaaaactcctttcctcctgattgataaattcattcaaaagttcgttagataaagaggaatactctgtggaaagaatctgctgccgctcacttaaatgatagctttccggcttatttaccggttcaaacggttcttctccaaagacttcaaagcatgccggacctgcaaatcctgccgcctcctgttcatattcttcgtatgcctttctcatacagctaagcttccgatcaatcatgcgcttatcaaggtaaatagcattatcaaaacgatggtcatagccatactgtggatttggatctgttgaaatatatccgatacgaagattctggcgtttatttaatgtattaagcgcctctctgtaaataaccggtttcaatcccatgtcggcaaactggcggattgctgcgcggatcactctctcaaagccaatcggataacggatattcactgtatctttctttgaaacatctaccccttttagctcaaatcctcttcgatatccttctgtaaatgtttccgctatctgtgaaatctcttcttccgtaaggctgtttaaaaactttgccgtttcaatttccacttctgaaatatagtccccataagaatacagatacgtcagatccgaaagggcagagtccatgataatcgatgttgcaaaatcaagtgccgggtccaccagttctcgtactctgtagcctgcccagtcatctgcataatcatagaggaaccagtagatcgtatctttaatctgtttatatgttacatccccttcttcaaacatacagtatatttccagaaaaagttcatttaaaatcgtgattttttcaaggttctgttcaaaaacaaacgctctttccgaacgtaattccgtatataaaaaactcagaatccgaccaaactcttctcctaattcctgcactgcaaatgccggatctgcaaaagaatgtccgtaattctgaggtaagatatcctgataaaataatgcattctcactctttaactgctcaaaagaacgggacttccacacatcagaagaaatacatacaaaatcctctgcacatttctttagaagctgtgctgtcttcttaaaataattctgaatcttttcgttcatgccgttgttctccccggcagcaatctcttcgattctttctcttgtcagtaaaaagcgttcttccacttctttattgctttctttaaacaactctctataatccatataaaatatatcactctctttctgttattcccaaattcaagaatgtcccgtcattcttgctgcaagatgcgcgtcatgcaaggcatgacatacttcttatcgtattcctacatcatgataaaagtaatccctataaaaatagccacaatattaatacatattccagatatcttatacttctggttggtcttagcatcatcataactcatcacgccccaaaggacacaaaagaatgccagtacaacaaaaatacatccaagcagacctccgacaacattcaatcttccttctgtcacaatagacaacactgtcaaaatagcaaatccaatcagtatgcctattcccataaccagagtaagcactgcattttttgaaacttttttctcagaaaaagaaatatttcctgtattcatatctctgcctttcctttctcttctttctttttataatcggccttccatttatgataaataaaacggatgatacaatagctgatccatccgagcagccctccaaaagtattcatcatcagatcatccacatcaaacactcctacttttgtaacaagctgcaatgtttctatgcaaagactaaataaaaatgtatatataataatccggatacatccggttttctccaatctccatatcggaactaaaaaacctattgggaaaaatacaagaagattaccaaataagtttaataaaaatgcttcgatagaaacataattcctgtatataataaaacgacggatttcctcgaaaggaaccagattatagcgataagtactatatccatctacccgtcccagtcggtcactgaataatacaaaatatattacaacacagccatataaaatcaatattaaacggctcagagaccccagtctctttctgctttcattcattctttttccagccttttcttataattattattctcctataatacattttaaggaaccggcataaagccggttcctatcatttttaaatcattattttcccttttaacttgagagcacgcgctccacttacaatagaaatcactcctgctgtaattccgacaattgttgtgataattcctactataattcctgcagcaccaatctgtcccaatgttttgaaaatcttttcgttcatacaaatctcctgtcagaatactactttactccatactggtcataatatgcatcaattgcttttttcaattcatcatcaataatgacttttcctttgtatggtttgttgtaaagatgctctacaacttctgccatcgtaacgatagcagttgtcttcattccgtatttctcgctgatttctgtaagcgcactcttctctccctgacctctttccatacggtcaacagaaacaactaaaccaccaacttctacatctccctgtgccttaatgatcgggagtgtctcctgaatagacgtacctgctgtagtaacatcttcaataatgataaccttatctccgtcctggatcgggcttccaaggagaattcctttatcaccatgatcttttacttctttacggttactgcagtaacggatatctttatcatacttttctgaaatggcgatcgttgccgctacgcttaatggaattcctttataagcaggtccaaacagtacatcaaaatcaaaaccgaaatgatcatgaattgcctgtgcgtaatactcacctaatctctttaactgagagcctgtacggtagaatccggtattaacaaaaaatggagtctttcttccactttttgttacgaagtccccaaacttcagtacattgcagtcaatcataaattctataaactcttttttgtattgttccataacagcctccgatttatccttttgatttatctcagtcgagaagactcccacctctttcatgtggtgagtgacagctgctcgacttgaaatgttctcttgaaatcttcctcgtacttaagattccaaaagtacatctgttgttttgattctaacacagtttatttgtattttcaacttagataaaatatgtatagacagattcttttaatcaatacatccgataatctcgttaatatcttcaatatgatatctttccatgtaagcttttattccatctaacacatccattgtggcacgtggattgtggaaattcgcagttcctacagaaaccattgtggcacctgccatcatcatctcaatggcatcttctcccgtaaggattcctcccataccgatgatcggcagcttgcaggcatggcttacctgatataccatgcggacggcaactggtttaatggcaggacctgacataccgcctgtcttattcgcaagaacgaactttcgtctgtgaatatcaatcttcattccggtaagtgtattgataagagaaagggcatcacttcctcctgcttcggctgctcgtgccatctccgtaatatctgtgacattcgggcttaacttcattacgattggctgttttgcctttgccttgattgcttttgtaatctcatataatgcatccggattctgtccaaaagcgataccaccttcttttacattcggacaggatacattaatctctaataaatctaccggctcatctgctaatcgttctacaacttctacatagtccgatgtacttcttccacatacattgacaataatagatgctcctttttcttttaaatggggaatatctcttttacagaataagtcgattcccggattctggagtcctactgcattaagcattccgccatatgtttccgctacacgaggagtcggatttccttcccaaggtacatttgctaccccttttgttgttacagctccaagtgctgcaagatcaacaaactgctcatattctgcaccagaaccaaacgttcctgaggcagttgtcacaggattcttaaacttctttccagccagtgttacttctaaattcatgagaatactacctcctttgcatcaaataccggaccgtctttgcagattcgtgtattgtttacgtttgtgtgatgatcttttgtctttgacttacagatgcagccaagacaagctccgattccacatgccattctttcttctaaggaaatctgtgcttccattccatgttcttcggcatacgctgcaagcgcttttaacattggcatcggtccacaggcatagatgaccttcccttctacaccatacttttcaatcgcatcaattactgtacccttagcaccctggcttccatcttcagttgcaatctttacatcgcacacttcttcaaattcttcttttaagaaagtggacgttctgtatccaagtacaactgtcttctcggcatctaactgttttgcaagctccagcatcggaggaattccaatacctccgccgataataattgccttttcatttttcattgtaaacccgttgccaagaggccccataacttctaatgtgtctcctgctttcatttctgaaaactcttttgttccttctcctgcaacacgataaacaacccgcaatgttccttctgttggattaatcccgcaaatactgatcggacgaggtaaaagcttactcttgtcattacagtacattgcaatgaactgtcctggttttgctaaggcagctccctttggaaaggataattccatatcaaatattccttcatcgatctgctgctgacgaacaactttcgctgtttcttttatcatctccatatatatgcctcccttttttattaaatatgtactctcggagtctttcttgcacttgcttttgtgagaagattccaagagtacataaatcaaacgatccacatactgctgcttttcattgcagctgtcatctgatctaaactgtctcattctttataatatacactggtaacggcggatgattcggcttattataaaatgcttctacgagtacggtatattgatcatccggcaattctttaagccactgcagcacctgttccttttcgtcaaaaccactgtctcctccgctgtagatcagcaaagatatcataccaccctcacaaagtaaggtaagtccctttttcagcgcttctattgttgtctctgcctttgtcgcaagatgatgatctccccctggaagatagccgagattaaacataatcaaagaaacacttccttcatcggcatatacatccatatgtacatgcgtatctaaaacaacttctgccctgtccgaaagatgttctttgctaaggcggtttcttgtctgttccaccgccgtttcctgaatatccatggcgataaccctgccattggcacctgcgagagacgctagaaaaaccgtatctttccctgttcctgctgttgcgtcaatacacagggacggattctttataagctggcggattctctcatgacaatactgtgtaataggtgttcttcttttcattataatctatactctccgatttttaaataaaattattatcgttatcccgtctgatcatcctattactttatgaaaaagtacacagcaacaatgatacctaaaataatacgatagacaccaaaggctttaaagtcattgttcttaatataacctaacaggaacttgatcgctaaaatagaaacgataaatgctacaaccatacctactacaagaatagcaacttcattccctgtataatggaaaccatattttacaagttttaagaaacttgccccgaacataaccggtatggacagaaagaaagaatactctgctgctacaaaacgagaggttccaagaagcattgctccgatgattgttgctccggaacgggaagttcccggaataagagcaagtacctgaaaacatccgatgatcaatgcaatcttataggttaaatctgataattcttttacctgtgattctttatgcttattatgattttcaacaacaataaataaaataccgtaaaggatcaatgtaaaagctactgtctgcgcattataaaaaagtgcatcgatcttatcgttaaatgcaagaccgattaccgctgccggaagacatcctacgattaccttgccccatatatcaaacgtttcccttttctctctggctgactttttaggactaaatggattgagtttatgaaaataaatcacacagaccgcaagaattgctccaagctggattactacaagaaacatttccataaatgctttcgatacattaagtttaatgaattcatctacaaggatcatatgcccggtagaactgattggaagccattccgtaattccttccacaattccaagcagaattacttttaacatttcaattaacattttctataattacctcctgtaatattttatcgcttcattctatcacagattcctgtatttgtcctctttattgtatactaaaaagaaaaaagtctttccgtactttttacaggaaacttatttttcaagttctaaaagtccctgttccatcagatactttatggaaaacagccgcggttttttactgttatcaaactttattttaattttatcttcttttaattcaagtaccgttcccttaccaatatttttatggatcactcttttccctttttgaaattctttcttgtcataacgaagttctcctatatagcgggaaatctgtgcatccttttgataaagttcctttaccgaatagagaaacaaatatgtttttgcccttgtaactgctacataaaacagtcgtctctcttcttcaagatctgcctcttttactgcttttttatgtggcgttaccccttcatttatatccatgacaaatacaacttcatattctaatccttttgaactatgcattgttgtaagtgtcacaccgcttttttgctgccttccggcttccatctgttttctaagttcctctccataagattctatgtaagcaaaccactcttcaaaactgtgatattcctttgcactttcctgaatctgattcaagacttcttcaaggtcatccgggttcattcttcgaaactgtgcatactcattcatataatcttcataaccaatcccgttacgtatatattgaatcgcagcatatggctccatctttcttagaagatacaaatccatttctaatttatcaatcttctcataaagccacttttttccaaaggtctgctgctttagtttttttaaatctacctgcggttctgtgatcatacttcttgatatgtatcgttttggccggttcattacctgtaaaaacagctttcggtctctgtttcccatagcaagctttatatacgttaatatattccttgctatccagtgatcaaatatatttggaataacatcccgcatctgaaatggaatattatattccattaaccgtccaacaagtaatctcggctgcgtattggtgcggaaaataaccgccatatcttctagtggaattccttttttataataaaaacgtattccttttaaaatatctgtacactcttctcccgcatcttttagatttcgaaatgtaataggcactttactccctcgagccgcctgcatattctttggaaaacgctttgtattatgactgatcagatgttccgcactctctacaatttcttcactgcaccgatagttcgtatttaaaatcaccttttttgcctctggataatcctcctcaaatccaagcataatttccggtcttgctccccggaagcgataaatagactggtcatcgtcaccaacaataaacagatgatctcccttacctgccagcattcgtatgatctcatactgcactttattaatatcctgaaactcatcaattaaaatatgctgaaacttattctgccataaagtccgaatgtcttctctctcttttaacaattcataacaaaaaaccaacatatcatcaaaatctatgagattctcttcccgcagccttttctcatacccttcataaatctgagcaaacaattcgtctgaacagttattactatgatagtaggaaagggacatcatctctccttttacataactgatctcattgataattccggaaagaaattcattctcatcttctatctcaaattccatattctccgtcatctcttttatgtatcgccgctttacatcttctctgataatatttgcagcagtataacggtacgcataacgaagaatcataaagaaaacagaatgaaaggtaccaaaggttaccggagtatttgccattccgtcaaacataaaaaatcgttttttcatttcctctgccgctgctctggtaaatgtaattactaaaatattagacggatgaactcctgcattttctataagccactttacacgataagtaattaccagtgtctttcctgacccaggtcctgctaaaaccatcagcggaccacctttatgtgtaatagcctcttcctgctctctattaaatgtacctggcacgtttcttcctcctttcccctgatatatattctctaatcactgaaatccttgcaaaataaaagggtgtctctcaacacccttttatcattcacgcagttaaatcaccattcaaggatactctttctgctattctttgctattaatgttttgcaacagttttaagatatgcctcaacttctgcttctgttgtcatagacatagcctttgctgcaacggcatctgcttcttcttttgtccaaagggagattccctttcttgtagctaaaatagaagtagcacttacactaaattcacttaaaccaaaggaaattaataatggagcaagtaatggatctgcagctgcttcaccacacataccaaccatgattccctctgctcttccggccttgatcacacgctcgatagaacgaagtactgccgggttatacgcagagtaaagatatgcaacttctgcattacctctgtctactgccatagtgtaacctgtaagatcgtttgttccgatactgaagaagtctgcttcttttgcaaaaacatctgccattaaacttgctgcaggtgtctctatcatgataccaaccttgatatcttcattatatgcaacaccttctgctttaagctcttccttaatttctgctaccatatcttttactgcacgaagctcatctaaacaggtaaccataggaatcataatacgaatatcgccatatgcgctggcacgaagcaatgcttttaactgaggacgatataaatcttctctctttaagcataaacgaatcgcgcggaaaccaaggaaaggattctcttctttttcaagagcaagatatggaatctctttatctcctccaacatccaatgtacgaataataaccggcttgccttctaaagtctcagctacttttctgtaagcagcaaactgctcttcttctgtaggaatctgtggacgatccatgaaaaggaattctgtacggaataaaccgattccttcaccgtcacattctactactttcaatgcatcttccggtttaccgatattagcgcaaagttcaactttaacaccatctgctgttacggtctctttgccaataaactgagcaagcgctgccttctcttcaagatatgcagctcgtttctgctcatattctgcctgaagtgcttcatcaggattaacatatacctgtccttcagaaccgtctaatactacattatcgccattagaaatctcttctgtgattcccggtatactgagtaccgccggaatttcaagcgcacgtgcaagaattgctgaatgagaagtcttgcctccaacttctgtaaggatacctgttacgttctttggattaattcctgctgtcatagaaggagttaaatcttctgccactaaaacagttccttccggcacacttgctaaatcgacatcttcgacatcaagaagtatcttcaataatcttgtctttatatcacatacatctgttgcgcgctgctgaaacatctcatcgtcaatacctgcgaacatctgcatataataatcacagatcttctctacagcagcttctgcgcacatcttgtcatctgcgatgcttgattccatctggccggtcatctccggatccataagaagaaggacatgtccttccagaatctctgcttctttctcccctactctttctttcatgtcatctgccattgcctgtgtctttgcgatacatttgtcaagggcatctgttaatctttgcttttcagcatcaacatcactgactgctttattatcgtatgcaagggaaggttcttttacaataacagcggaaccgataccgattcctgctgatgcaccaataccagtatacattatcttcacctcaaattttgaattacaattattctcctaaaccggattcgatcatctcgatagcagtctttaatgcgtcttcttcatcaggtccgtcacactggatctctacttcagaaccacacttaatacaagcaccgataatgttaagaaggctcttaccattcgttgcttttccgttgaaattgattgtaacatcgctatcaaacttagccattcctttagcgaatactcctgccggtctcatgtgaagtccctgtgggttgttgattgtaactttctgtgataccatagttatttctccttttcttaaatagggtaatataaaaataaataatagctaaagaaaacaggatattgtgctgctggctgatgcattcggttagtattataccctgcgatcatacctccccttattcctttagtattcattattttaccattttttatatacactgtcaatataacagcgtcccgactccggtaaaatcatctgtaactttctttcagaaatgtaatttaaatccttgtcgataaaaacgtatactctttcttcccagcttcatcatctggataaagctctacatattttttcgctgcctcgtatgccttatcatacgcctctgctttttcatagatgacaatctttccatacataaaatctgccttcgtttcaccgccctgttcaatccccttctgaacatacttcagtgctttatcataattctgtttttctacgtatatttcacagattttttccagaaaatcagtatcctgtgtatgattccagccttgttcatacacttttacggctccttgtgcatcaccggactttgcgacacactcgcccttcaacatataatattgtgcatttttactgtcattattaataagtttattgtatattttttccgctttatcatattcttttagctgataatgactctctgccagataacaggtcatatccagatcaatctctctggcaaacacagactgtctctttaacgcttcttccaggtatgagattgttttagaataatcttcttccttaaaataaagcaatgcttcttttcggtattcgatcttctgctgataattatgccactgaaaaacacctgttccggctaataaaatcacaacgacaattgcaccacgaatgataattttacgcatagaaaacctcatttctcttaaatgacgcacttttgaaatcaagtgcaaaagctttgggaatacttgaacgaaagaaaggatgccgcagcatcctttcctcaaaaattattattttcttaaacctaactgttcgattaaggttctgtaacgttcaatatctttaccttttaagtatgcaagaaggtttcttctctgaccaaccatctttaaaagaccacgtcttgaatgatgatccttagggtttgccttaaaatgattctgaagatcattaattcttgctgtaagaagtgctacctgtacttcaggtgaacctgtatctccttctgttcttgcatattttgtcataatttcctgtttcatttcctttgtaatcatgttacaattcctcctattattataatcacctttacgaagataaggtcggagactccataccctggcaaaggttctagctaaaagcatctttcatagattagcatactattctttttttgtaaagtttttttaggaatatttttcaagaagtttctggaaatattcaggaagcggcgcctcaaattctacatactctcccgtccttggatgaacaaatccaagtactctggcatggaggcactgtccggtaagtcccatatcattctttggaccataaatcgtatctcctaataaaggatggcgtatacttgccatatgcacacgaatctgatgcgttctgcctgtttctaactgacactcaatatgattcacctgatgatttaaatgactgagtactttataatgtgttactgcccgctttccatttttaggctcgacagccatcttctttctgtcaaccggacttcttccgatcggtgcatcaacagttccttcttcctgcgtaaagttattatatacgattgcttcgtattttcttgtgatcgaatgttcttttaattgttctgccagacttttgtgcgccatgtcattcttgcatacaacaagaactcctgttgtatctttatcgattctatgaacgattcccggccgtaaaacaccgttaattcctgaaagattatctttacaatgataaaggagtccatttacaagtgttcctttataacgtcccggacaaggatgaacaaccatatctttttgtttattaatcaaaataacatcttcatcctcataaagaatgtccagatccatttgttccggaagaacttctaattcctttaatggagggacacagatcacaacggcatcgtccacacgaagacggtatcctggtttttgttttttctctcctacctgaacctgcccttctttaatcagcttttgaatataagaacgggaatgttcttttaactctgctgcgagaaattgatctaaacgcatcccctcctgttcttccataaccgtataataatatctttgttcctgcttactttcctgatttactttctcttgctttgccgtttctgtcatagttacaactcccgcctgccctcttttgtttttttaggaaatatcctgtcaaaatcttcttcctgatagaagaataaaattaaaataacaagcataaccgccgccactgtcacataaatatctgccacattaaatactggaaagttaatgaggctgaaataaacaaaatctacaacgtacttcctgaaaatgcggtctatcatatttcctacagctcctgctcccacgaaatacaggcatatctttaacggagtaaaatgtctttcctccggtatctttcccgaaatccatataagacccgccagtaccgccagagtaatgatcaaaaagaaccattgcttattctgcatgattccaaatgctgctccccggttttccacataataaatctcaagtacattccggataacaggaatacttcctattggctttaatacctttactgcccataattttgtaagctggtctgctaacagaagtataataaaaataactgctgcttttaattttttccccattatacttctccctgttctataacggcaagcatttcttccggagtgacatcctgataaattgctgcctttccaatctggtctaataaaatgaacttaatctttccatgttccatttttttatcgtgttttgtttctttcacaacttcttttgccttaagttctttcggcaatgctggaaaatcaaaatatgcataaatatttttgatttccttgttttcctgttcactaatatatcctcttttacttgatatatccgctgctaacaacgaaccaattgccacacattctccatgtgtcagtgagaaattcattaacttttctatagaatgtcctaacgtatgcccgaaattaagcagggcgcggacaccatgttcctttgggtcttcctcaaccaccgctcttttaataaggcaacttccctctaccatatgtgtgagtgcttcgtcttttctttctgcaatggcttctttattcgcttttatccattcaaaatatgctctatcacgaataagtccatgtttgatgacctctccaagtccactgtgatactgtcgctcagaaagtgtctttatcgtatttacattaatgtataccagttttggcatataaaaagcacctaccatatttttatatgcatgataatctactcctgtttttcctccgatactgctgtccacctgtgcgagcagacttgtaggaatctgtacgaagtcgattccccgcagataagtagcagcagcaaatcctgtcagatctccggtaactccgccgccaagtgcaaggagcatatcttttctgtcaaattcatgtgtaatcagaaagtgatacagattatctactgtggataagtttttactcacctctccttcctgaaaaatatatacttctacctttgcacatctgccttctaaaatacttttaacttcttccagataataggaagccacccttcgttctgtaacaatacataactttcgttcctgaatatcaagagcagaaagttcttttaccaggtttgaaaaactattttcaattacaatatcatatactttttttccttctgcacttacttcgagtcttttttctaacattgtctgtcctcctgaaataaacgaagcagagaggatctatggacggcctccactccatccataaatccactctgccttttgtttctcgtccaactattctctctgttattcttctatgtatatccggtatgtatatccgggtgtactaaaagtttgaaagctccggtgacagcatgtcttcactgacaagctcttccctgaggtctcctgttacttcaatatttcctggagctacgataaaaatgttattagaaattgcctttaaggaaccatctactgcaaagcttgcacctccgataaaatcaatgatacgctgtgcctttccaatctcgattccctcaagattcaccacgatcgtcttcccttcctttaagaattctgctacgatctgtgcttcattaaatgtctgcgctctgattactttcacactttcaccttcttcttttccatgaaactgaattactcttccctgattaccatcgaactcttctgaatcggatacttccttcttcttccgtctcagagaaagaattggtttatgaggctcatcatcttcttcctcatcttcctcttcctcatcactgtcatatccttcttctgtcacttcgttgtattcttcatcaaatggttcggtttcgtcatctgcatcgctcaacttcatcatgtttaaaaacttttccgcaaacttcaccccatgtacctcctgttatttattgtaattccgcgccccaaagattccggtaccgacacgtaccatcgtcgaaccttcttctatggccacttcgtaatcgttggtcatccccatagataaaatgtccatagatacattatcaatgtttttctctctaatgtcaataaataattgatgtaattttttaaaataacagcgattttcttctggatcgtccacaaaaggagcgcttgtcatcaatccccttacatgaacatgcggcaacttactgatttcttctaccagtgcgatcacttccggtccatcgattccaaacttggtatcttcctgtgcgatgtttacctgtacaagaatctgcgcttctacattcttctttaccgcttctttttcaatctgctttgccagatggaaggaatctacggagtgaattaattctactttatcaataatatactttactttattcgtctgaagatgtccaatcatatgccagtgtactggtttggaaatattttcatacttctcacacagctcctgcacatagttttcaccatattccatctgtcccgtctcaagaagctcttcaatatcagaaagaggtttcatcttacttactgccactaacgtaacttcttccggttttcttcctgctctttcacatgcgcttttaatatttgtctgtactttttttaaattatctttaagcattaataaatcacctggtcttcctttactgtatcactatttaaaataattcggtcataaagttctattccactgttttttgcagatacaatacaatagtcttcatttctctctaccatctcgatctgtttaaaaacagtataacctctgtttacaatataaacaccctgtatctgactcttattctttaatgtatagatcttttctttattggtttccgatagaactgtaccttttgtcagattcgcagaataaacatagacataatcttcatccgatttataaacattcacagctgcctgtgtcaaaaccttttctccctttttgtttgtcttcatgatgttgacctgctcttttttcgaagagttgccgccatttacaagaaaactttttggaattttatatacttccttttttacaagagaacttgacggaatttttaatcccttggtttctgataaagtaagtgacacataaagatatctctgattcaaatatctttgtatataattatcaaaactcagaataacataataactgtcattctgttttaaacaatgatattgtgctgctgccacaaaattatctttatggaatgtcacctgaatcgtctgtctgtcttcttccctcttctttaaacgatcataatcattcttattaacaggaatcattagctgccagtcctgtccctctacaagacgatatactggttttcccgctttttgttttttatctgtgcgaagatccttcatcttcactttattgacaaaaatattttttgaaacttttgcctgttctagcttttccattccatcagataaaaaagaaaccaagccttctttaggcgatgcggctgtaatatatgcactctgtccgtatttctgtgcaagctcttctttattctgcgcaagcattgtatctgtatatgctaaaagcgtactactgatatcattctgtgtttcatacagaagagaaaaattattatctgtataaccttcactgaatacttttaatttctctactacctgttctttttcatcctgactgacagaattctttttctcaagcatctgtttcaaatactttcgtacttttcctgtagtatctaccgtatagactgtaccattttgacgaaccattgaaccttcctgaacataataattaatatatccactttgttctgtatgcaccagagtttcttttcgaagaatcactcccgttccatcgatactgtctacgatatcacttgcgctcacctcatagattgccagtttgctttttccaagatagctcaatatgtatgccatcagatagatcacaataatgagaaatatcaaagttccgagattcatatgcaaatgtacacttttctttttttgttttgccatattatatctcccatctatttaaagctgccccgttgagataattgtactttgttccctgaacataccctttctcttccatgagcgccttccattcatctgttaatttccaccagctgtttccccaatttgaaaaagcggaatctttttcagggatacggctaaacaatctttccactgtaatgtccggtcttaataatgcaataaactctgttaatctgtttaaatattcttcttttgggcaaatttcgatttctccacgaatatacttatcatataattcgcacttcttaggaatgtataaagaatgcagcttcaccatggaaatcggcaatgtagatagaattcttgcagattcctccgcatcatccatcgtatcccccggaaggttcagaatcatatgtacgcaaacaggaaaatgatacggcgcaattcttaaaaccgcatcaataaattctgcgagtccatgacctcggttcatctccattaatgtatgataattcactgtctgtaatccaagttctatagatacttctattcctgtccggctgctgaattcataaaatgcttccaggtaatcctgtctgatgcaatccggtcttgtcgaaattgaaatctcaacaatatcctctacttttgatgcttcttccatatagccaagtaatctgtctaaaggaagaaatgtattggtataattctgaaagtaagcaataaacttatgtgcatgataacgtttttctacttttgtccttgatgctgctaactgttcaaaaacagaaactgaactgtcacttgcttcaaatcctgtccctgcttccgcgcagaaaagacagccctttccatcttttttatttgggcaggttacgggaagattcacaggaagcttatatactttctctccgtatttatcttttaaatattgtgaatatgcataataatattgtttttccattttagcttaaaccataaaaaggcagcctcataataatatgaggcgccttaaccttttcgtatcttattcaaattccagatatccgccatgtatgtaatattatcggacggttctgcatcagataataacgaattataatgcgtgagaaacgtatttctgtacagattccggcatattttctttatctacggaagcgctgattacaaaatcaaccccaaacttgtcagataaagcaccaagtttttcaactgcgtaatcaagattatcatcaatacatgctgtagtaaggaaactatcaagataaatcttatctaagtcatggtcctgagaaataattcctgcaataaagccaaggaacatatctgtatctgttacattaaattcaggaactacaataagacgaatctgattgcttaattcatacatatgcttattgttcttatcaaggtaaacgattgtgccttttgtcagcttaatgtcatcatttacctgctgaattaagatcttagtttttccttttcctttcgcacctgcaataatatcaatcatgtgaatatcctcctttagatatattattggactgtagtcctttcttttgtaatgagaaagactcgtgccaactctcttatatgttatattataatttatatcatataaaagcacaacctttaatttgttgttttttctaatagtctggtcattgacgaatacaaagcttcctttgtttctgctccaagtacaacggagaaaaaacgctctccttttttattcttggtcatcaatatcagacaagacttcgccatagaggtcgttcctgtcttgccaccatacatcactacaccttccggtacagggaattcattcagaagataatagtttgtactctgcatatactcattaatctgtgttttctttgctgtagtatatgtcattgtatagtcctttgaagatactgtatcaacaaattcttcatgcttcactgcctctttaaaaattagataaagatcgtacgcagtcgtataatgatcgttattgtgaagtccgtttggattgacaaaatgtgtatgtgtcgctcctaattccctggccctctcattcatcatatctataaacttagcttcagaacctgctacatactcagcaagtattactgcacagtcatttgcagatttgatcagcatcgtatggaaaacctgtcccacagtgacggtgtctccctttgtaagggtactgatcactgctccgtcttctgttaaattgatatcatactttaacgtaatctcgtcatccatatttccatgctctaatgtcagcaatgcagtcattacctttgtaatactggctggatataacttatcaaaacaatgatacgattctacaatctcgttcgcactgtcattaatcaataaatccgcataatcattgctctgataattcgggtctgtcgcttctgaatcagacactactgcaaggtctgctgccatcccctctaaatctgaacctgcctcttctttattctctgcatagtaagatgcaaaagaatctgtgatcttaaaaggattcccactgcatccactacacaacgctactactaacacaaaaatactgattgtgcatattattctctttttcatagtcactctttctctttgtctgtacgatctgtattatctgtacatttctctccactcaaggtctcctctttcaagagccttaactaataactctgctgttgcaagattcgttgcaagtggaatattgtgtacatcacataaatgcattacattaaatatatccggctcatgaagctgctgattctgtgggtctctcaggaaaataaccatatcgatgagattatgttcaatctgagaagccatctgctgttctccaccaagtggtcctgccagatatttgtgtatcgtgaggttcgttacttcctcaataagtcttcctgttgttgcggttgcaaacaattcatgcttattaagaattcctcgataagcaatacaaaaattctgcattaatttcttctttccatcatgtgcgattaatccaatattcatatattttcccctcctagtagtgtctttgtaatcctatatttagcacaatccctatacctgccatataacttaacaatgatgttaatccataacttacaaatggcaacggcaatcctgtattcggaagtaattctgttgccactccgatattaataaatgactggaaaccaatcagtgcagccattcctactgcaatgagccgtccactcatattcttcgcgacatatgccgtcttaaaacattctatcattattatagccaataatgcaataacaataacacttccgataaaccctgtttcttctccgactacagaaaagataaagtcggtctgctgttctgacacaaatcccgtatcagatactgtaacatctgcgatcgtattattattcagtccctttccatatagtttgcctgagccgattgccataacagaattatcctgctgatatgcggtcgtagacgaatattttgaaggctctaaaaatgtcataattctggtaacctgataatcatgaagtaatacctgattcggtgtctgtatgtaccagataaaaaggaagcccagcggtatgatgatcggtatgattattttgagacattttttaatcagtgtaccggaaagacctcctacaaaaattacagacatcaatatgaatgtaatatctaacgtagttgaaaggttcggttctatcactaccaggaaaagaggcaacgcacacaatagagcaagtttaaaaagtactttccattccatgaaatcttcttcatgttcctgtatgtacaccgccacaaatattatcataataattttggtcaattctgacggctgaagtcttgtaaagccaagattaatccatctctgggcaccatttactttaacaccaacaagttttacgagaacaaggagcacaatattaatcaggtacaaaatcctgctgaagccacatacaaaattaaaattcacaacagacaacaacaacatgattcctgcacaaaatattagtccaatcaactgtttactcgtatagctgctgtccgcactattgataaacatcactcccatcccgcttaaaataagaactgcgcttatcaatacccaattataatttttaaattggtatttctgttttaacatgtttctcctcctgcgttcgctatctaggagatcttagttctttgatcggtatattggcataaattgccggaacatttccatgtcctccatccgactctgtctgggttatctgaatatccagtccttctgtatcaatctccatgtattttgaaattacttttattatgtcgttttttattaattccatcgtttccggtgaacagtttgctctgtcagataccagaacaagcttcaaacggtctttcgccgtactgcccgatgttttttttctaagaaagctatccatgaaccccattagattctccccctttagtaaccacgtttaaacaaatttgctatttttttcagtatgccttctgtctcaaactccatgatcggaacttcttctccaagcaccctgtgacaaatattagcaaacgctcttccagcctgtgtgtcagaaccaacaagtggttctccttcatttgttgcaatgacaatactctcatcatccggaactacaccaatcagatcaatagcaagaatatcaacaacatcttctacagacatcatgtctccacgcttcaccatatccatgcggatcctattgataactaattctatctttttcagctcttctgcctctaaaagtccgataatcctgtctgcatcacgaatggcagaaacttccggagttgttacgatgattgcccggtccgcacctgcgatggcattcttaaatccctgctcaataccagctggacaatcaagaagaatataatcaaactctgttctcagctcatccacaagctttttcatctgttctgggcttacagaacttttatctcttgtctgggcagacggcaagaggaaaagattagaatatcttttatctttgatcaatgcctgttttaagcggcagttcccctctacaacatctacaagattatatactatacgattctctaatcccataacaacatcaagattacgaagtcctatatctgtgtcgatcataaccactttcttatccagttttgcaagtcccgttccaatattcgctgttgtcgtggtctttccaactccaccttttccagatgtaataacaattacctcactcatctttgttctcctttatctcacttaactaatactaatctcactgatcaacgacctcgtaatcgtttcaataaaaatattgtcattctctacaaatgccagcttcgcaagcaattcctgctgattctttcttctgacattcttttttgtactcttccccctctggtctggtgagcgggcaatatagctgccaatctgtatctgcatcggctccatcataagtgctgccacaaatgcactcctatcatccggatatccggcatgtactgttcctttcagacatcctaacaccacaacattgccccccgcaataatctgtgcgcctggattgatatcgccaagaattactatacttccatctacttctatcttctgacctgaacgcaatgttccacgataaaactggccattctttcccagacgattctccggaaaagattcttccgttttatgttcctctttcttttcctcttctttaagttccgataacactttagcaaactgtgtctcatatacttttgcgccatcgatcacgcagcttatattaagcccactgttctcagctatcgtatctactagaagattctgttctccggacgtgagttcccgtcctgtgaaacttactgcgattggcttttttaagtcgaaaaaatgagtagattccttaaacttgtcccccacttcccgaagaagttcttcaaaaggaagtgtaggattcagcacaatctgaaatccatatttattccctttaattataacggaacttttcatatctcctcctgtttgctagcatatactccgggaatctttcgcgtccgaacttttcaagtcgagccgccgcaggagtatattaatcattacttccatctgaaccgctaggcagtaatgctgtagtcgccttcttttctgccttgctggcctttccaaaatagtacttatagatatctctggcaatctctgcagcattggctgaagtgtaaccatttggcactactacggtcatggtaatatccggattgtcatacggagcataagatatgaataatgcatggttcggtctctttttgttctcctgtgctgtaccggtcttgccagctactttcattccctgtttcttatacaggtacttgatagagctgtcctttccgttaaccacaccgatcatacctttctttatcaaatcaaatgtagatgagctgatcttcagtttttcttctgttttcttctcataagaagtcagtgtattcccctctgcatctgtggttttctctaaaagagacagatccagcagattcttgtggtttacaagggatgtcacatatcttgaaatctgacttggtgtataactgtgggtaccctgtcctattgctgaacgaatcgcatcttcatctgaaatatgcggctcatattctgtgatttccacaccggactttcgatttaagccatacattgatgcatacttctttaactttgttaaacctctctggctgttataggttccattcaccgtaccaagattatatcccatctgataaaagaagaagttacaggatacagcgattgctccacttacattaagtgagccatgcgcattcggataaatccagcacttcgctgccggagaaatcttatcaaaaatccctgtacactttacatatgtagaagctgtagctacgccttcctcaagaactgccgtagatgagattggtttaaatgttgaaccaggcgctgtccttgactgcgttgccctgtttaacatcggcgaagataaatctgtattaagagatgcatagtattctgaatcaattccattcgcaaggcgattattatcatagcttggataggaaaccatcgcccttacctctccggtatcagggtctgtaataataacagaaccggaacatggatctaaggcaagctgggctggtgtaatttctatattctttatctttttgtacatgaaattataagcagacattttgcctgtatacaaactattataatccttatctttctttttatcaagaactccctgatcatataaaagcagacaaactttccgtccgctcagcgttccacttttgatcatatactcatatagaattttatcaaagtcttcctcagatttcaatgcatcaacaatataatttattaattcgtcatagatttcatctgcatcataataatccgacttaatattaaaggagctgatattaatccactcattattgatcgcatattgaagaaactttcggaatgtgattttttcctctttccagtcaagataaacctgatcattctcatcaatagaagaagcaacaagaattccgtcattctctaacattttgtaaatataatttacataatcctgcttctcctcgctaagatatttacgaactgtcgttcctgttttcaaatcttttcgaagagtgtttaatacactttcctgtttcttcttataaatcctgtaaacatctttttcattacttttcgcatttttctttgctaatctggaaatatttataatattattatcaagaagcgcataatatacgtcctttatcggaactcgtttgtctgagccggcagtatctgctgttgttaaatgtgcaagcagaattcctgcaagacgtcgttctaaaatattataggcatacttctgcaaatccgcatcgatcgtcaaatacacattgttacctgcggaagcctttgttgtctttactgtcttaataatcttaccaagattatctactaaaacatctttctgtcccttctttccctgaagagtactttccatcgtcttttcgattccagtcttaccgacaacatcgtttgcctcatacttgccattgtccgcattcaattcttttaattcgctttcggaaatcactcccgtatatcccaaaatagaagaaaaatactttgcatcattatatttacgaagagagtctgccttaatggaaactcccggatattcctcctcatgttccgaaatagcagcaatacttttatcgctgatattcgctgccacagtaatcggcgttgtctgtgaataacgattcataaatacatcataccgcaccgacatgatctttaatgtatcctctgtagaataactgtccgagataccaaacatacttcccgttccctgtggaccaccttttccgcttctcagatattcatacacttcctccggtgtagaattcaaatatttctccgctttctttttttcatcaccggacaaattatcgatattagcaattccataaatatcttttttaaatcttgtaagcgctgagccagacactgtaaatttcagctttcccttgctgtttactgtcataggaaggctgtaatttatcgtatcaccattctgctctaaaaccttcaccagcttatagattacctcatttctaacttcattctctgttactttcggaccattctttccatttttagctgttctctcctgggcaatcttactcgttttttctgaattctccaacgtcactgtataagccagctgattataagccagtatctttcccttgcaatcgtatatatttcctcttgcaccactgatctcaatcgtcttctttatcttatagttaaaattcgccagatgtttatcaccctgtatgatctgtaatacgaaaagtcgatagattaaaacacaaaataatgccgtcaacagtactcccataatgataatacggttggaaagcagctctataatctgattctttgtttttgccttatccgtctcctgcttttttttgaatttaaacaaaatctgcaccccgcttttcattcttttccaaccagtcgtttattctcaataaaatctgataaaatacaagacctaccgctacggtataaactatttccggaagaataatatttttaagataatacacaatacgtaaatgattatgtaacaatccacaaagaatatacataatgactccatagaccagatcatttacaccgatcaggacaagtggaagaatattgtcatctgaataatagattcgatgaaaaaatccatctacaaaaccaaacatcatatataaaaaagcaaatccaccgattgttgagccataaaaaatatccatcaaaagcccactgaaaaatccaacgatcattcctggcttctggcctctcattactgctattgaggaaataaaaatcagtaatatattcggtgcgattcctgccagtttaatcaactcaaatacggaagtctgcaatataaaacaaataaataccagtactgctgtcactattcctcgtttcataataaatcccttcttacacaaatggcggaaagagaaatatctgtacgatacccttatttccgcctgatttatcctttaatctgcactttcactatctgcgggaacctcttttagctgtgtgataaccagcacatcttcaagatgctgaaaatctacaaacggtgtcactttggcagactgtgtcaaattagaggaatctgtagaaatactgctgactgttcctatcttaatgccttctaaatattttgaactgatatgtgaagtgatcagttcttccccttctttcatatctgcatctttactgatataggtcacatcaatcgttccatctttttgaacagattcactgtttccctgtacgacacaggtatctcctgtctgagatgacttggcacttacgctgctggtatcatttataattgaacatacctttgcataggtccgtccggtttccgttacaattccgaccagacctccatctgccagcacattcatatttaccttgattccatcttttgtacctttattaataataaaagtattataccagttgccgcttcccttgctgattactctcgctcccactttcttatactgggaatattctttatccatcttcagaagcttttgcagactattcaattcgttttcattggtacttaaagtttcgttttcctgcgttaactctttcaccttctgattaagctttgcattctcctttttcagttccttcatactcttaaatgagccaacatgctctcctacccagactccaaaagagttaattccatcctgcattggaataactaccgtttctgcgactgcagaaagaggtttcaccacatcttttaatactgtactgacagacagaagtaatatacaaagaactgtcagcaaaataagcatcgttttaggtgaaaactcaaaattatgacgatttttcatagtaccactccctgattaatggaaatcagaatcctgtaaattatgagccaatctttcataatccggattttccataatcattcctaatccttttactacagtaagttccggttcttccatcttcataatggaaagtcctgtctcctgctggataagaagatccagattcttaatatgagtagatgcacctgtcatacatattccatcatgcatgatatccatggataattccggtggtgtcttctctaaaatgaacttaatcgcatcaataatagatgaaagactctctgacattgcctcaaaaatgagatgatttgtaacagttaccctattaggaagacctgtgatcagattacggcccattacgtcatacgtaatctcttcctcttccttgataccgcttgccagctgcatcttcaggcgctctgcactcttcataccaattacaaggttatgctttttcttaacagtctgctgaatcgcctcatcaaacttggttcctccaatcttcaacagacggctctgtacaattccaccaagactgatcagactgatttctgttgtatctgcaccgatattaacaatcagacgaccagtcgcatccatgacatcaagacccgctccaagtgcatccgcgattggtttttcaacaatacgaatcttctttgtctttaaagaagagcttgcgatcaaatcaaaaaacgctcttttctctacttctgtgatatcagaaggtactgcaatgtaaaactctgcattgccgccggcagcaagtccttctgcaaacttctttccatgcattcctttaaagtataactgaatcatggtctgcatagcagtaaaatcagcaataacaccgttaacgatcggctgttttacttcgatgttcttcggagccttctcatacattgagtatgcttcatctcccaaagctaatggctcttttttcttcaccatagcgatcatgtttttctgatgtaaaattactcctgcagctttctggtaaatcttgatggaatttgttcccatatcaattccatatattttttcagacattggtatgtctcctttcgttagcatttatacatgaaacaaatgcggtgttgccgcatttatctttcctctttgtccgatatacctgacatcaggtacattgcattaagatcacgagattcaagaatatgtctataatctgtaatccatggtcacatctatgactcacatcatattctgttcccgcaaactggtatagcacttatcccctataatgatgtgatctgaaagcggaattcctaacagttctcccgcttcttttatctgtcttgtgataatgagatcttcccggctcggctccggatatcctgacggatgattatgaatcagtatcatatatactgcctcacaccgaagggcttccacaaaaatatttctaactggaacccaggaactgttcgccgttcccttcgaaagtaaaatctccttcatcagcctgtgtcgtccatccagaagtaaaagcatcaccttttctacggaaagatgtctcatatcttccatataataagctgcaatataatccggcgaactgaaatcactttcttctttaatagaagctctcgccagtctcttagacaactccagtacacataaaatctcaattgccttgacattgcctataccgggaatctctttcagcatctcgatatcaagatgatgcagtcctgccagtcctttataaaccgggtgtctgttcaaaagcgaaaatgcaagttccagagcagtacagcttcgtgttccacaacgaataatgactgctaacagctctccgtctgtaagactctctgcgcctgctctcagacacttctcatacggacgttctgtttccggtcgttctttcatcgttactttcgctggtgatgactgtattgatggctgtctttccatattggtccctcctgtattctctccaggcacgaacacactgattcgaaaaacattttaccataaaaacaaacttttgtatatagggtacaaggacagctttcgttaactttctgtgtcatttattaagatatctttaagttttcctgtctcatatattttttgtaaagacatcataattccatactttgcatgttcccaggtaagtcccccctgaaaataaactgcatacggctccttcattgggccatctgcactaagttcaatggaagaaccggaaacaaaagcgcctgccgccataattactttggcatcatatcccggcatatcccatggttccggacgaacaaagctgtctactggtgcagctgcctgaattccttcgcagaacgctaccatcagctcaggatcatggaactccacttcctgaatgatatcatgacgactttcctgactgtccggaatcactttaaatccaagtttctcataaatatttgctgcaaaaaccgcaccttttaacgcaccttttacaacggtaggagcaaggaaaagtccctgtgttaatgcaggtgtcacgcccaatgtagcacctacttcctttccaagtcccggtgaagtcagacgatatgccgctctgtcaatacatttttttgttccgcaaagatatccaccgatcggtgcaagtccaccacctggatttttaatcagcgaaccaacaataagatctgctccgacctgagatggttcactgatttctacgaattctccataacagttatcaaccatgcaaagtacatccggctttctttctttaataaaatgaatcaattctccgattctttttacagaaagtgttggacgagatgcatacccttttgaacgctgtattgtaacaagctttgtcttgtcatttaatgctttttctattccttcccagtcaaactctccatctggaagcagatctacctggcgataactaatgccatattctgcaagtgaaccattggatggacgaataccaattacttcttctaatgtatcatatggctttcctaccggtgataacagctcatctcccggacgaagctggctcatgagcgcaagggcaagagcatgtgttccacaggtaatctgtggtcgcaccaaagcatcctctgttccaaacacatccgcataaatcttctctagtgtttctcttccaatatcattgtaaccataaccggttgttggggcaaaacaggcttcacttaaatgattcttctgcatggcacgaagcaccttcatctggttacattctgctgtcttatctatcgataaaaagcgatcttttaattcttcttctactttcatgcaaaagtcatatactggctttgcaattcccatctgtgcataatactcttctagtattttatctctttgttccattcctgattcctttctcttctattatatttaaaacagaatcaagtaaatctttttcctgttcatattcttttttattcagccatattacctctttttctctacgaaaccaggtaagctgtctctttgcaaagtgtctggtatctttttttatcttatcgactgtatcctccaaagtcattctgccatcaaaataatcaaaaaactctttataaccgagtccctgcatagatactaaattctttgtataaccttcttttataagactttcaacttcaaaaagaaggccatcttccatcatgagatcgacacgccggttgatccggtcatatagttcttccctgtcatgatataaaacaaagtacgcaaagttatacggagattctttctgtctttgttcctcattatgttctgacaatttctttccggtttctttataatattctaatgcgcggatcactttctttacattgttacaatgtgtgatctttgcatattccggatcttttttcttaagtatttcgtaaagatattcttttcctttttcctttgcaagctgttctaattctttacggtaactttctttgtctttatgctgtgaaaaatcaatatcatacagtaacgcctggatataaaatcccgttccaccaacaataatcggtacatgtcctgccgcataaatctttttcatggcttcttttgatttttccacaaaagctactacattaaactcctccgatggatccaattcatcaatcagataatgtggtactccctgcatttcttccggacgaatctttgccgtacctatatccatcttcttatatacctgcatagaatctgcactgataatctccccaccgatacttttggccagttcgatagaaagacttgttttcccggcagctgtcggtccggttaatataataagaggtttcttttcctgttgtttcacgaccatccccctctactgcactctcttaaacttcttttccagttcatattttgtcattgaaataattgtcggacgaccatgtggacactggtatggattatccagcttcataagctgttccataagactgtccatttcctcataagacatcgttgtatttccttttaccgctgccttacatgccattgatgccagcttatccgtaatcatttccatattcatcttaccactgttttcttcaatctgatcaaaaatttcaataaacagctcctgtggatcaattccgagcagatttgccggaaccccacgaatacaatactcgtttccgccaaattcttcaataagaaatcccagttttttaaaagattcttcacacagttcaaatttttgctgttcttttatactaaaagtaagtataatcggcggcgcaaccatctgctggacaattgtattattttcgagatcttttttcaacttttcatacatcactttttcatgagcagcatgctgatccacaaaaaacaatttctcatcatattctaccagccagtatgtacgaaatacctgccctataatccggtgctttggacgggcttcttccgaaagaagcggaacatccgcaaaactcatctgtgtacctttcgcatagttatctgtttcttttacaagttcagcctttgttttttctacttgaaccggctgctgtgactgtggttgtcctgtattaatttctgtattgttttcagttttttcagaatctatactgtttttttccattgtctttggaatcactttatcaatttctttttgaatcgcagtattttctccgacatgcaaacgggcgattctctcttcaatcgaacttcttcgatttgatatttctgatacatcctcatcctgaataaatccctgtccattcggatttagtgcagcattttgtacgctgccctctgcttttgaaaatgagtcctttattttagattcattattttcttttttctttgcaatctgctttatttgttccgaagaaagagaagaaaaccgctcttcgatcgctctcctctttttttcaaatggttctggaatctttctcgcattttcctttactttttgctcattaccaagacccactttcggaatcagctcttttttcacaaaactactacgaactgcactcataacagaagaatacagttcttctgcatttcgaaaacgcatttccatctttgccgggtgaacattcgcatcaaatgaatgcggattcattgagatcatcaatgctgtaaatggaaatttatgcaccatggcatgtcctttatagccttcttcgattgctttgctgataatattatttttcagataacgtccatttacaaaatagttctcataatttcgatttccgcgggaaataaccggttttccaatataaccatcaactagtattccattttcattgcctttaaccggcaaaagattcattgccacatctcttccgaaaatattatagataacatcttttaaatttccatttcctgatgtggaaactttatttttattatcacagataaacttaaaagaaatcgctggatggcttaaggcaagccgctgaataaaagattccacgtaacctgcttctgtcatttttgactttaaaaactttcttcttgccggtgtattaaagaaaagatcacgaataataaatgttgttccttctggacatccaatctcatcgcagctcttttcttcgcctccttcaataacataacggattccggaaatcccttcatctgtttttgtgacaagttccaccttcgcaaccgccgcaatacttgataatgcctcgcctcgaaatcccagtgaagccaccgtctcaaggtcatctgctgatctgatcttacttgttgcatgaggaagaaaagccttacgaacctgttctttctcaatgccgcatccattatctgttattcgtataaaatcaatgccaccgcccttgatttccactgtgaccgctgttgaactggcatctactgcattctctacaagctcttttacaatagatgcaggacgttctactacttcaccggctgcaatctgattaatcgtatcctgatcaagaacttttatttctgccatgctttctcccttctgacatttcttctctcatgtccttttaaaatgatatgtacgaagtgattttatttacattttttctgcagttcataaagctgattcattgcctccatcggagtcatattactgatatctaacttcttcaatgtttcttccacttcacttttctttggctgttctgccaccattcccatcgtatcaaataatgaaatctgaactggctcggcttcttctgtacgtttctttccaatattttttgtattcgctgtaatatcagattcttctaattccgccgcaatttcttttgctctttctataacaacttccggcacaccggcaagctttgccacctgaatcccgtagcttctgtccgcactgcctttaataatctttcgcaggaaaataatactgtctcctttttcctgtactgcaatacagtaattatttacgcctggaagcttgccttctaattctgtcagctcgtgataatgggtcgcaaataatgtcttcgctccggctaaagaggaacccgctatatattccacaactgcccacgcaatagaaagaccgtcaaatgtgctcgttcctcttccgatttcatcaagaatcaacaggctgtctttcgttgcatgccgtaaaatattcgcaacttcactcatttccaccataaatgtactttgtccggaagccagatcatccgatgctcctactcttgtaaaaatacggtctaccagaccaatatttgcggactttgccggaacaaaagaaccaatctgtgccataagaacaatcaaggctgtctgtctcatatacgtagactttcctgccatatttggaccggtaataatatcaacacgattctttttatgatcaagcaatgtatcattcgcaacaaaaagttcaccggacatcattttttccacaactggatgacgcccatctttaatatcaatgacacctctttggttaagggtcggtcgtacatattgatttgcttccgctacaagtgcaagagaggcaaaaacatctgtccatgcgatcacactggctgttttctgaattctctccatctcagatgccagtttttcacgaattgccacatatgtttcatattccaaagcataaagtttatcctctgccccaagaattgttcttgccagttcagacagctcttctgtcgtataccgttcggcattcgcaagagtctgtcggcggatataataatccggcaccaggtctttataagaattcgttacttctatataatagccaaaaactttattaaaacgcactcgcagatttttaattcctgtcttttcccgctctctctcttctaattcagcaagccatgtctttccatccgttttcgccttctttaaatggtcgatttcttcatcaaaaccttctttgataattccaccttccttgatcggaatcggtgggtcctcctcaatagaagactctaataattcatgaagatcttctaatgtatcaaggctttctgccatttttgcaagaacgcctttactaaactgcgcgagaatatctttaatatatggcagatattgaatagaggtcttaaaagagatcaaatctcttgggtttgccgtacggtaacttaccttcattgtaagacgttccagatcataaatagaattcatatactcacgaagttcttcccttgccataaggttatcttttagcatttctaccgcatctaacctgtcctgaatcgcccctttatgaattaatggctgctcgatcatcttacgaagtgttctggcacccatcgcagtctttgttttatcaagcacccataaaagacttccctttttccctttttctcttaatgtctcacacagctctaaatttcttctggtagagctgtcaatgaccatataattttctgtcgaatatacttttaattccatcagatgagcaagagaattcttctgtgtttcatgaagatactgtaataatgccccactcgcaatcatgccaaatggataatctgagagtccgattccctctaaattcacaagagcatactgttctttaatcagcttctcgcaccgatccgtttcaaagtaatcactggaaaccggtgaaatcactgcgccaaccttatctctgatataatcaaaatccataccacaaatacaaaaggcatcgttacaaataatctcagacggctgaaacttattcatttcatcaaaaagtgcgtcctgatgttcaacctgtgttgtccgaaattctccggtagataaatcacacacaccaattccgaacaggtcatcttcacagaacacactcataatgaaattattctttgattcatcaaggctctgcgtcataacattcgttcccggtgtaacaacgcggataacatctctttttacgattcccttcgcagcctttggatcttccacctgctcacagatggcaacacgaaatcctttctccactaacttgttaatataaggctcacaggaatggaaaggcaccccacacataggcgccttttcttcctgaccacagtttttccctgtcagagtaatctctaattctcttgatgcagtcagtgcatcatcataaaacatctcatagaaatctcctaaacggtaaaacaaaatacagtctttatatttattctttatctggaaatactgttccatcatcggagtcagtttagccatggatgctcaacctccccagataataaaatcctttcgactcttccagcacaacaggaacaatcttaccaattaaagaagcatctcctttaaaatgtacaacactattatttgataatcgtcctgtaaccatagaagcatccttctcgtcaatctcttctactaaaacaagttctgtattcccagcaagcttgccattctgttctcttgctgtttcatttaccacttttaataagcggtcaaatctctcatgcaccacttcttctgaaacctggtccggcatttttgctgccggtgttcccgaacgcttagaataaataaaagtaaatgcgctgtcatactttgcttttcttacaacatcaagcgtctcctgaaaatcttcctctgtctctcccggaaaacctacaataatatctgttgtaatcgcaatatccggaacagcagtacgaatcttatctactaatgtaagataatgttcctttgtgtactttctgttcattaattttaaaatgcggctacttccagactgcaccggcaaatgaagatgtttacaaatcttcttagaatgtgccatcacttcaataagctcatctgataaatcctttggatgagaagtcataaaacgaatcctttcgattccttctacttcttctaccatagtaagaagcttggcaaaactaatcggattctcaagattctttccgtaagaatttacattctgtccaagaagcatcacctctacaacaccttctgatgccagcttctttacttctgctacaatatcctctggctttctgctccgctctcttcctcttacataaggaacgatacagtagctgcagaaattattacagccaaacataatattaactccagccttaaatccaaacttacggtcacttggcagatcttcgataatctgatctgttttctcccaaacatcaaataccctcttccttccggaaagacattcatataaaagttctgcaagcttaaaaatattatgtgtcccaaaaacaacatcaacaaacttaaatgttgtcttcaccttttcctgctcctccggttcctgcatcatgcatccacacatggcaatgaccatctccggattcttctttttataatttttcaatgctccaagtcttccataaacacgtacattcgcattctcacgtacagtacatgtattatagtaaacaaagtccgctttttccgtatccgccttcacgtaaccgatatcttcaagaatcccgttcagcttctccgaatctttaaaattcatctggcatccaaacgtctggtcataaaatgtaagcttacgtccaagctccatttctttttcctttatgatttctctacactttgcaataaaataccgctgtctctccggttccttttccggtgcaggcgcggttgtatcaattaattcatagtttatattcattataacctccaaggtgtgtaaaattgatttttacgcagataaaattattataggataactctttttatttttcaagaaaaaagtacttgatttttatttttgtctgtgttatattagtcaagtcgcaacgatatggtcgattggtcaagcggctaagacgtcgccctctcacggcgaaaacaggggttcgattcccctatcgactatttattaaaaataaaataaaaaagcacttgattttcactttagtatgtgatatactaatcaagtcgcaacgatatggtcgattggtcaagcggctaagacgtcgccctctcacggcgaaaacaggggttcgattcccctatcgactatttattttagaaaggtttgtctgtttagacagaccttttttgtttaataaaagaaaatgtctacttttgttgaataggatatttttcctagttatcttatgatacagattttttcctgtattatttctcagaaactattatttttatctcagtcgagaagactcccacctttttcaagtggtgagtggctgctcgacttgaatttcataaaggagggactcttctatggcttttttcgacactttaaaacaaaatcttatgactactggccaaactaccgtagacaaagccaagacaactgttgaaattttaaaattaaaagatcagattcgccaggataaacgagaaatccgctctgccacttataaaatcggggagatttaccgggagttacactcggaggactatgaagaagcttatgaggattgtttccaaaagattgagcgtttagagcaggcaatcgactggaaagaggatgccctaaaagatttagaataatagacgaaactattctttacaaaggatttttatttatgaaagaaagactgatttttcatgttgacgtaaatagtgcctttttaagctgggaagccgtttaccagcttaaaaatggtgccagtacagatatacgaacaatcccggcaatcattggcggagatacttccctacgaaaaggtgttgtccttgccaaatctcttcctgccaaacattttggcatccacacaggagaaccggttaccgatgcattaacaaaatgtccttccttgaaaagcttccgtccaaactttcctctctatcgtgaatactctactgcatttattactattttaaaaaaatacgcccctgtagtagaacaagtttctattgatgaagcttatcttgacatgagcggactacattacttttactctaccccacttgaagcagccgcaaaaatccagacagaaatccgggacaccctgggttttactgtaaatatcggcatttcctccaataagcttctggcaaaaatggcatctgattttgaaaaacccgataaaatccacacattgtttccacaggagatagcagaaaaaatgtggcatcttcccgttcgcactcttttcttcacaggaagagctgccgcacaaaaattaaaccaacttggtatttatacaattggtgaccttgcaggaagtgatccgaattttcttcaagcacatttaaattctcaaggtttcactttatggaactatgcaaacggccgcgacgattctcctgtaaaagaaactcccgatgctccaaaaggctatggaaactctatgactctaagcaaagatctgacttctttttctgaagccagacctgttcttttagaactttgcgaaacggttaccaaacgccttagagcagatcacgtttatgctcaggttatcgaagtagagctaaaagacaaaaacttccgtcgaaaatctcaccagaccgtccttgactactccacaaacactactgatgatttctaccaaatcagtataaaactttttcaggaattatgggacggaacacctatccgtcttctcggagtccgcggaggaaagctgaccactgataaaatcgaacagattcagctctttaccgagactgcttccagacaaaaaagtcgtgaaaaaatggcaaaattagatgccgcactcgactctattcagaaaaaatatggcaaagactctgtgaaacgaggaagcagatgctgagttgtagatttcgtgtagacgaaaaaagaaaaaatactatatcccatctgctctgtagtcgctgtgcttaagatgctcatctgcatcttaaacacgctcccaagccgcatctgggatatagtattttttcttttttctgactatctaaatccacagttggtaagagtgggaattctccagaaggttatggctttccggtaaatcaaagcctaaaggattgacgcatttcttccaaattttttcatttgaatagagattgtatatttctggacacttcccttgttttttaactgagttgtggggcgagatcagacagctgctataatagaacttcctgctgaattgtaaggaaactatggtaaagaaaagagaatttttataagtattgcattttgtgactttgcgctgtgaaattttgactctgaaaacttcggactcgtttttccgaagtttttgttttttgaggcaaaatgaagcgcttagcgcaacggaacaaaatcaaacttataaaaattttcttttcttagaaacctcaatgcaattcagtaataaaataaaatgtgatgtcggagcaaataaaaatgccggtcaggcattttctatgccgcgactatcttcacattttattctatatcaagtttctggttttcgtctctttagtccatcaaatcatgaaataccggtttcatcttctcaaatgtgcaaaattgtgtataccccagtttacgaagttcttctttcgcccagtcaatatacgcaccaagatgttcttttttatggctgtcacttccgatcgtgataattgtgccgccaagttcccggtaaagttttaatatatctcttgatggtgtcatatccgcaattccgtagcggtgattggaagtgtttacttctattccttttccatctgcaatgaccgtttttaaaatttctgtgataattggctttactttttcaaatgaatacggtccctgctcatcataacggactatcaaatccatatgtcctaatacactgtaattgtgatagttttgtacaacggaaagtaattctttataatacccttcattatattcctgctgtgttcgcgtactctggtattcgtttgtccaaaattcttcatcacctacctgatggatggataagataataaaatcaaatggataacttgcaaataacttctcatattccggaatggtatgtgtctgcacaccaaactccaacccggcttttattgaaatctgcttcttatatttttctttcagttcttcaattagtgaaaaatattttttatattctacattggtaagcgcaacccattccggttcgccttcctctcctgcacgatattcaatccctcttgggtcgtcccagtcacgatacggaccataatctacatgatctgtaaaacagatatcctccattcctaaagaaatcgcatctttaacaacatcttccatgggataaacagaatcattactaaacgctgtgtgtacatggtaatctgctaacattttttctcctttacctaaatatgtactataatttttgaaatattgcaacggtcttcgataagcatattttaaaaaatggcctttctcatatcctctatctctttttgcagttcctgatatcttcgctgtctttttacaatgttggctttgtcctttccagaaagttcttctacctcttctatatcttccatattctttatggactgtttcaggtctgctgctatttgttctttttttgcaatttctttctctaaatattcaattaagactgaatttttcgtttcgattaagtatctgccatactgttcgtaaatctcttccatttctgccttcgcaacggtctgattctccggtatatctgctatttctttcatatattcgtgaatagaaggctgtttgtgcttcattcgctgtggctgcgtccatcccggttctgccttgataataacataatatttgccatcttcttttaagaaccattccttttcgatctgataacgatattcttttaaaatctggcgaactttaaaccattctgactggggctgtaaaatcaattcctttccttctatcagaaattctggttttgcttttagtattttacatattaagtcaccacccataccggcaataactactgtatctgtttctcctggctctagtggagcaagtccatttccaagacgggttgctattttaccgctaagcttttctgcacgaatatgctccttggctttttcaagtggtcctttattcacatccatggcaataccacctggtgacaagttattctttacaagataaatcggcacataaccatgatccgttcctatgtccgccacacgatttcctggtgttaccgcttctgctactgtttttaatcgtattgaaagttccattttaaattgtctgcctcctaaattatattccttaacctatttcttgtttcgtatgtattacttatctattttctctgaatattatacgggatctctatcccttttttcaatgacaaaagcaggtatatttataagacttaaaatccatataaatatacctgtcctttattctctatttctttattctattctcccaaaaaatctctaagctttctacttctcgttggatgacgcagcttgcgcagggccttcgcctcaatctggcgaatacgttctcttgtcacttgaaagtctcttcccacttcctctagggtatgtggctttccatcttctaatccaaaacgaagtgctaaaaccttttgctcccggtcagacagggtatccataacttcttcaagctgttcacgaagtaatgtgtgggctgcttcttctgacggaacaggcacatgttcatcctgaataaagtctccaagatgactgtcttcttcctctccaattggtgtttctaaagaaactggttcctgtgaaatcttagaaacttcaagtatccgctctaccggaaggttcatcgtaaccgcgatttcttctggggttggttctcttccgtattcctgtaaaagcctcctgctcgttcgattaacccgattcattgtctctaccatatgcaccggaatccgaatcgtcctcgcctgatctgcgattgcccttgtaattgactgacgaatccaccatgtagcatatgtcgaaaatttataacctttacgataatcaaacttctctacggctttaattagaccaagatttccttcctgtatcagatcaagaaactgcattcctcttccggaatagcgtttggcaatgcttacggtgaggcgaagattcgcttcagacaatttcttttttgcttcctcgtctcccatttccatacgcttggcaagctcaatttcctcttcagaacttaacaaaggaattcttccgatttcttttaaatacatgcgaaccggatcttccgcacttcctctttcagagtgtaaaatctccggttcatcctctcttttttcttcgtattccttctccactccttctggaaacacatcactttgttctatctcatcagaatctatttcagacatggtcagtacatcgatttttctttcttcaagataagaaacaatcccttctaactgtgccggtgtcagcgaacccttctgaaagacttcttttatctcctgaagttccactacatttttctgcttctttgctctctcaagcagacaattcatctggctgccaaaaatctgttctttcctgcccaaaataaaccctccaaatcattatatatgtgctctcggaatcttcttataaaatcaagtgcataaaatcaagtgcaatgaatactccgcgaatacattatacctgtactcttagtataacccggtttatgaccggcttatactaaatttctgcattttatttttaagtgataaaagttcctgccagcgcacaatatcactggtatgaaccatttcatcctctatgcttgcaagcttcactttacgcactacatctgagagcgctttatcttcatcttcggaggaaagtccgtattttaaatgtgtattaaaaattgctgcgatttctttttgttcttctgcgtccgtaaaacgacttaagattgccgcaggatttattttctcttcgttgtctaactgttcaaacaacataatcgctactgaatgatataatggctcgataaaatcatcggctccgatataagcccggatatactgatacatttccggatgctctacaagccaggtaagaagaagtctttgcggctggtttttattacttttctttttctcctgccgccgttcttccgtttccggcggagtcttatactgctcatttaccttttcatactgatagccaagcccataacggttaaccagattttcaagatcattctttcttatcataaaacgattcgctgcggatgccagatatgtctgtctctctaacggctcttcaatctgcgccagtttctttgctatctcatgaataaactctgtccggctttccggatcctgctgattgtactgtccatataggacaagcagctcaaacatccggcctgactcagcttcctctattcttttctgataaccttcctgtccttctgccttgatcaattcatccggatctttatacggcttcattgacaacactcggccacgaagaccattttcccgcaaaatcggcaatgccctgagggccgctttcaccccggctccatcactgtcaaaggataaaataacctcattggtatacctttttaaaagcattgcctgattcggtgtaaatgctgttccaagaggtgcgaccgcatttgtaaatcctgcctgatgaagggaaatgacatccatatatccttcacacaaaataagtgacttacttcttgaacgtttcgcataatttaacccatataagtttcttcctttatcaaacaaaatagtttctctggaatttagatactttggttccccctctcccatcacacgaccaccaaatccaatcactctttggttaatgtccattatcggaaaaatgaccctgttaaaaaacttatcatagttacctttgaccgtatcaatattaacaagagaagattccttcatctgataatccgaaaatccctttgctttcaaatactgatacagatcatctcggtaaatatctgcataaccaaggccaaattgattgatcatctcatcactcaagcctcgatcctttagataagcaagcgcctgtgttcctctcttactttttaaaagataatgaaaatagaccgccgcttctttattcatatcccgcagcgttaacctggcatctgcctgctgtttttcctctgctgtctgttccctttctggaagttctactcctgctctttttgccagttcctgcaacgcctccacaaaggaaagacggttatattccataagaaatgtatagacattcccaccctgtccacagccaaaacaataatacatctgcttgtccctgctaacagagaaggatggggtcttttcattatggaaggggcaaagtcctacatagtttgaacctcgcttttttaatgaaacgtaagaggaaatcacatcgactatatcatttttctctctgacctcatcaatcagttcttcttcatatctcatcttttttcctctttttattataaatattataatacccacttatcgcatatgtggtacaattcctgagatttatctatctccggatagttacattatatgttgagaatcctaaattattatattatttatttcgattgatctaatactgcgatcgcatctaacgatactttcatcagttctcgcacttcttcttcagtaattcccattctttctgcaatttctgacggttttgcttctctttcatattctctggcaaatgctgtcgcaatatcattcatctcattaacgcggtttgccatcttcactgctgaacgggtggacgcattatattcttctaatgtttcttctaaatgcttacgaatcattttctcacaaaacatttgaaaatctctgtctatatccggttcaaattcattcaccgctaccatcaatccaatattactttcctgaatcagatcacttaaaagaagacctcttccttcatattctttcgcaatctgtactgccttggaaagattcgcttctataagaagatttctcgcattatcatctccgcttacaagctttcttgcaataaccatttcctgctctccggataattgttttgccttttccatctcttttaaataaaaagcaacaatctccgcatccatcggatcttctttattcggaagttcttcatctccgatttcttcttcctgtctctcaatacgatttgtaatataaatctgatgagattcaaaataattacagataaaatcaagctgtttctcttctagcttcatatcagaaaaatacgcattgatctcctccattgacaattgatttccattcgtttctccaagacgctctaattcctggattgcctgtaaaaattctgtctgacctgccatgacttttctcctcctcttttgcggtcttttttatatttattttttcttttccttcggtttcttatccgccggaaatactatatgcagttgttttcttgcctcatctaaaaccttcatggtctccaaagtaatctcttttgacttctcccatcccatacctgtttttatcatcttaataaattcctgtgtctcataattcaatatattatctgactgttcaaaatgtatcgattgcactacaccttttctcacaatgcgtaaatcctttacattttcgatttcctgtacgagcatagaagcatcttcaccctgaatctgacttggcattgctgagtctgtaatcttggaataaatcgcctctccaatcatatccggatattccatgagtattgttcctgccccatctacaccattatgcaacttaatcccagaagctttgattgccttaggcgctccaaaaagacgaatcatgcaagatacaacgtaaacaccaatatccatcaatgccccattcgataattctggcttaaatgcattctccacaattcctcttttgtaattatcatatcttgaagaatactgacagtactgcagcgtagcccttcgaatcgtcccaagtgtctccatatacggaatcatcttctgaaaagacggggcataaatagagcgcattccctctaaaagaatcagtttctgcttctccgcttctgcaaacatttcctgtgcttcttttaaattagatgccattggcttttcacaaagtacatgcttacccgcttttaacaaagtcataacctgctcataatgacaacagttcggactcgccacataaactgcatcaatacagtcactgtttgcaaaagcctctaaatcatcaaaatattgcagctgccccttctgaaaaccaaactgtcttgctctttccaatgttcttgaatatacagcggtaagttcaaaatcttttccataacggtttgcctgccagaacttctctgcaatctttcccgttccaatcattccaaatcgaatcatatccgtttcctttccttcttccgtccgtccttttaaacggtcataccatgtcagtttcgctggattctctccctgatttctaagataatcctctaactctgccaccgtccttattatatgatctgctccggcttctgttaattcctgctctgttccataaccataaagcactccgacagattctaatccacaagctttcccgccctctatatcatgccttctgtcaccaatcatgatggcttctttcgctctgattccacaggtttttagtatgtaagaaataacttctgccttttttgtacgtgaaccatccaattcacttcctcctacaaaagaaaaataatcctctataccaaaatgcttcagaactttccttgcaaaaacagttggttttgatgtcgctacaaggagagtaaaccctgcttctgttaaatgcgcaagcatctccggaataccctcataaacttcattttcaaatattcccttcggcgtataatattctctgtaatattgtattgccttctccgcatcctctttcgaaaacccataaaatttctgaaatgattctgcaagcggcggtccaataaacggaatcagctctttcagataccgtacatgaatcccaaacttctctaatgcatattgaacagaggaggtaattcccaccatcggatctgtcagcgttccgtccagatcaaataaaagatattgcttcaatacgttccctctcccttcttcattatcacctgtttttaattataaaagaaaaatggataaaacacaatatttattgagctaacttaacgaaaacgacaagcaagaagtcgttaaaagagggggattatttttacaccacgattgacaatacaacctttataaaatataataatacaaatatattttttaaaggagatgatgtcttggaccccagttccatacgccagattattattctgttaatactattactgctttctgcttttttttcttctgcagaaacagcccttactacggtaaacaaacaccggatgcgagcgcttgccaatcagggcaacaaaaaagctgccagagtgctttctatgatagagaaaccggagaagatgttaagtgccattttaattggtaataatattgtaaaccttactgcttcttctctgaccactacgctggcaatgagtcttgccacacaggcaggtcttggaaagagcagcagcactttcgttggtatcgcaacaggaattcttacctttcttattttaattttcggtgagattactccaaaaacaatcgcgactatgaagaatgaaagcatggcccttgtttattccggaattatttatacgattacaacgatccttactccggtaatctatgttgtcaatcttttcagtgggcttttatgcagattatttggaattaagcccggaagtggacagaccatgaccgagttagaactccggacaatcgtggatgtcagtcaggaaagtggcgtaattgaaaaagaagaaaaagaacttattaataatgtattcgattttggtgattctgtagcgaaggatatcatgcttccgcgtattgatgttgcctttgcctccgttgatatgtcctatgatgaactggttgaaatctttttagcagaacagtattccagactcccagtttatgaagaaagcaaggataatgttattggtatccttaatttaaaggatttatttttttacagggaaactcaccgaaatgaagtatttgacatatataaggtgttgagagaaccattctttacttatgaatatcaaaagacttctaccttaatggaagagatgcgtaataattctatcagttttgccattgttcttgatgaatatggctctactgccgggctcgtcaccttagaagaccttatcgaagagatcgtaggtgatattaaggatgaatttgatgatgcagaaacagatgctatccgctgtatcggtaccgatgaatacgaaatcgaaggaagtactaagcttgacgatttaaatgatgttctcggtacagagattgaatcggacgattacgattccattggaggtcatatgatcgaacttcttgatcatcttccaaaagagggggaaacggttaaagagggaaactatctctattcaatcaaaaaaatggataaaaaccgggtggaaattgtttatttaaagattgaacggcacacttctgaaagcgaagaaatgtcttctgaagtgtaagcagtatttaccaccctgacatccggataatctccacaaggaatattatccggattttctttataatttttagtttttctatcagaaaggacaacagctatgattacggacaaacaacgacagcgtgattatgagtacgaagcagattatcagtccaaaagccgctatacaactgaacaatggacaaatattttaaattcaggacagcttgatgagaacaatatctctcttctcaaacagatttactcttcttttaatcatgccgcaacacttcttcagctttcttttgaaagtaaccgcactcaggaagatcttctttcacagcttaatgctgccggacagcttcttggtgaggcaaacagtatgaatcctgaagtcgattatgaagggaatgaatattggtggtatctctttttctggggtaaaaatactgacgctaaaactttagagctgaaaatgcatccggaattaacagaagccatcggagcattatacccagaactagaagaggcatactatgcctttatgagcgatgtggaacggagcttacagatacgttacagtcaggaagatgctgtatggattgctgctgccgttcttctttacgaaaagtattactgcaatcccggcattaattctgatgatatcctgctgatgcagtacgaagtacaaacccgttcccagaaagtatacggacaggatgtcaatgcgaacactatcacacagatctgtaacgccgatgaacgtggacatcgctttaattatttaagagatatttataaatattatcgtgtatcttttcctggagagtttgaaggagagagggaacgtcctgaccctgaagaagtggattataatgcatacatctactccattcttggctatatgaagctcacaaagttaactgacttcatcgagcatgaatatgcacatcttgtcgatgaatcttatgtcgaactgaccaacgcaaatgggtttgttcgtatggctgcctatttatcaagacaaggagggactgtattttctccggatgatacttctgacaaagcgatttctcttcgtgcagatggtgaagatgccgctgaaacatttcacaaaataagcgaagctatcttaaaagaatatccaaattttatttatgcatcaaaagctgactggtatcttccggaatccggtgtaattgctggcatacttcaggattctttatatattccatcctatgccgggcacaatgcttttatcggcattcgtactgtattagatgaggataaactgaatattgaagtttccctgaatcttccttgtgtttctgatgaagaagttatgcttgatatccatgataaatgcaatatgcttactctcatgactgcggcaccgtttcaggtaacacttgttccggcagaaacctcggatcttgctcctttcggggacaagataaaggcatctgttctctatcattatgatgactttaaaaccatgtctgaggaagatatcgtaggactcttttctacttccttagagatttttgcttcctactataccgatatctgccagaactactaccctgccatcgaaaacagtgaggatatcacagcttccgcttcctcagaagatcctcttgctgccgcacttggttcaaagctaacctatcgtcctgcctccgatgttccaggaccacaagttatttataaagagggcggaacacctgcctccaccgattttatcaccaaagcaatacagggctacggaacaacctcttcttccgatgagagaacttacgagaacgaatccactcagggtatttcttctgacattagctctgatcacgaagatgaagtttcttctttcgtaaataaggccgctttggaagccgacgatgatgaagttcctgcaagaaaaaccggcaattactctactggcactgcctctgttacaggcgccggaaccaaccgaataactaacaatagaaacaataatgcctctgcatcttctacattttctggaagttctacgggtgccggaattcccattgctgcatctgtttctatcactcctgagtctgtctggccttatccggacaacgcgattgcttccacacatccggaccgaaaagaccaaagcttccgcctttatccaaaaaacaccttaattaagggtcctgtaaaaaccggaaagttccatcaggcaattatgactgctgtaggtatcattgagggaaaagatcctaatatgatgaatattgagcctgttcctgacgtactcgaacattatcagcaatatgttgatgaaggccgcattttacatatttcttatccagatatcaacagtgatggctatgatggcttcattgaacgaaaatgtggtccatttacagaagacggtatcttcaaaaaatttgctaaccagtgtgctgacggacgatatgttattatgatggaagaagtggacttaaactggatgcatcttttcagagaaactgccgttctcttacgcgaaaaccgccgggagggaaccagtagtgaaacagctgtaactttgcctctttccaaagaaaagtttcgtcttccttctaacctttacattgtagccacctgtgactctattgtatgtgaagatacaattaccggcgcaattgatcacgacttctttatccgtcctgtatcaccagaaccggaaattcttcatggcatgcgtattgaaggaatatcccttcagcgccttatgacaacacttaatatgcgtctttcctattttttaggcgcagactaccaattaggagaaggctttttccttcaatctccggataaagactcctttatctctctttgccggatatttagagaacagcttattcctcttttagaaaaatggtttgatggcgatattgaacgcattcgttatgtactaggcgataacggcaaatctcgcccggacactatattcttccaggaaattcctttccgggatggtttattcaaaggagatattcctgattcctttgataaggagcggcggatttatcgatgtaatgaagaagctttctacaatccaaaaagttacatagatatttacgaataattttatgatgtacaaaggggctgtcgcaccaaaaacagccctaccctatggcagggattcctgtatttgcaatggaatcgctgccatatttttatgaacaaacatgggacctatggcataatcgcagacgacttgcgttttgatactcaactttcgaacgtttatggaaacgccattcgccacgcccgatgccaaaagctgtttttgttttccctgtctgtgacaaagcataagtgcgctttttcagcagtacaagtactgtgactgtagacaaagcaagcagattttgctgaaaatgcgcaaaaaaaagtccgtcgcagttacggtcgttagaccgttactgtgacggaaccttctaatcagtttatgtatgaagattaaaatactcttcgaattgttacgatagaacggtaagctgcaccttttgtaatcttgataccatctcttggattacttgcatggacaactttattattacccatgtagattgctacatgaccactgtagcaaatgatatctcccggttttgctttacttaaacttcctactcttcttcctacacgtctctgtgcataagaagaatgtggaagagactttccaaaatgtctgtaaacactcataacgaatccagagcagtcagcaccacgagtaagacttgttccaccccatctgtatggattaccaacaaacttcagtgcataattaacaacactctctcccttagttactgtagtatctgaggcagttccaccattctttacagaaatgtatcttccctgtgtataaccaaccataccattcacttctactgcaacccacttggaattgttagaaagaagctttactctgtctcctttatgtaaaacagtaattcgttttgacttcatgctcttctttacacgaatatttaactttttagtatttacctttccctttttcacaaggcttgccgcctcaacctgtgtcacattattcactcccggtacagcagatatatttaaaagaaaaacagcggtaagtaaaccagctgcgacacgtttcatcttgttcagcatgttttgacctccatatttataatcacgcattactttaactgaggctcattataaacgctgaatgtgtctaaaatgtgacttttgcaatattttttaataaaaccgtaatatacaacaagaaaagaatatatttattattaaaatattcgcattttactgtacgtcaaaaaataaatcatgaccttttggacataatccaaacaaattaccctctcggattaagcattttatttttcaattcatcctcaagctgcataagtttactttctgcctctcttcttttttggcgtccctcctgctggatatgcattacctcgtcaatcgtactcataaggctttcattcgttgccacgagtgtttccatatcaacgatacctctctcactttccttagccgtctcaacagtagctactttcaacttctctgcattcttcttcaaaagatcattcgtaagatcagatactttacgctgtgcttctgctgccgctctagaatgttctactccaagtgcgataatcatctgactcttccagagaggaatcgtattcaccaaagtagactgtatcttttctgacatttccacatcacttgactgcaccatacgaatctgtggtgccatctgtaaagataccattcttgtaagctccagatcatgaatctttttgtcaaaacggttgcacaatgcttcgcggtcattaacctcctgtgcatcttcctgccttccacttaactctgctttttttcttaatgcaggaatgacctcattctcttcctcttcaagtttcttctttcctgcaagaatatacatcgtcaattcacgaaaatatactttatttaattcatataactgatcaagcattgcactatcttttaaaagctgcacctgatgcccttccagcttctcacagatctcatcaatattaccttctatcttactgtaacgaagtttcaatgtctgagccttggaaatctttttcttaaaaaatcccttaattcccttttcctcttcttcatcaaaacctttaagctctacaactactccgtttaacagttctccaacttctccaagatctttagaacgaactttttcaagcgttccttctgaaaatgctgacatttttttctgtgtacctgagccatactgtaaaatagcattcgaatcatctaagcgaatctgctttacaaaagactctacctgttttttctcgtcatcagtaagatactgttcctcctcatacaccttaggaatcggctttgcctcctccaccggaagttctggtgctatctccggctctaatgtaagagtagctccttcttttaacatttcttcaatactgctcatctccatgcccatatcctgctcctcctgccgctaaacataaacggcttttcctttctgaaaatttttaaaactttaacatcggttctgtcttatctgcatgcagttcatcttcagttaatccatcctgcttaagcattacttctaaaacctgaatatctgatgaaatatccattgctacattttgaaacatttcgtcaaataacttttccaaagcctgatttatcgtatctaaagattcttctatctctctttttgatttctgaatattctctccctgaatcggctgtttttccatatcttcatacacattaagaagcttcatcaccgatggaaaataatatttaaacaacttatctgtccgcgaaatgctttccggatgttcagaagcacagacaaaaatccttgccgcaagaacttccatatgcgaaatctttgctgctacatccagagattttatttgcgctttgatatctgccaattgctttaaataatcctgtccctctttctttattctataaatctctttttgctcaaaagaagcattctccatcgcctcttctaacgctctttttctttcctcttcctcttctctgactctcttcgcattcatagcattctcgtattggcttttcgattcatccgtaagcagcaaacaagtttccccttcatctaactgcgccccgataatcagatctttctttgtcagataatgaatatccttcattatcttctttctgttccagcgtaccttactctcaatatcatcaatcataacatactgctttcccatccagatttgagaatactgtttcactcttctggctctgctgctgctaaagataccttttccaaacagtaccgcacttattaccgcaaatggaacaaaaatcgctgccgaagcaatcgccagattcgtcgccatcgcacctacaaaggtcgtaactcccagcccaataccggctcctccaaaacctgcaagccctgccactcctatcgcaatctctgctggtccactataaagtcccggattcttcctgagctttcctgatatgactcttcttccatgccccacatctacatatgcctgttcattctgacctccataaaatctgtcaaactgtcttgctgcaccctcttttgctttatccatctgcctggatgcttcttcctttgccttatctacctgctttaaagcctcctcctttacattacctgcctgttttaaaacttctgcagttgccgtatcaattgttttttgaatcttacttcccagatcttcaaaatccgaaaaatcaaatttatcttcctgattactcataaatataatactcctactctgtatttcccttactataccataaattccttcttttttatagcgcagaattttttacagaggaatttttcggcttactcaggaatatattaaaagaaaaatggagaaatcatttggcaatcaaaatctatatcgatcaaggacataatccggagggaatcaatgcaggcgcagaaggttttggaatacgagaacaggatatcacctaccaggtggggcactttctctttgatattttatcagaagactatcgttttacagcccgcctttcccgtccaacaccacagaccaccttaggttacagcaatacaagcagcttaaaagaacgggtgacacaggcaaacacctggaaagcagattactttatcagtattcatgcaaatgccagcgaaaacccagatattaacggcaccgaagcttacgtttcttctgctaattctgccgcatggtatctcgctcaaaacattgtatccgaaattgtgcgaagaacaagcacaaaatataatggtgtattcaccagaccttctctctatgtcttaaaaaacacaaaaatgccggcggttcttgtggaactcggatacataactaactacgaagataatcagcgaatgattgataacccatatcaatttgcatatggaatctatgtaggaatcctcaattacctggaactcccacaaaaaaatactgatttgtagatttcgtgtagacgaaaaaagaaaaaaataagatatcccatctgctctgtagtcgctgtattttagatgctcgtccacatcttaaacacgctcccaagccgcatctgggatatcttatttttttcttttttctggctatctaaatctacaatttagtgagaatggagttctccagaaggttatggctttccggggaattaatttctaaagggttgacattcaaattgttggatatacttggaatttgaatgcaattcaacaggaattcgcttctttctggagattttatctgaataaaaaccgtagttttctggacaatcccttattttttaactgagttgcggggtgcggttagatatccactgtaatagagcttcccgctgaattgcaaggaaactacggtaaagaaaagagaatttttacaagtattgcattttgtgactttgtgctgtggaattttgactctgaaaacttcggactcattttccgaagttttcgttttttgaggcaaaatggagcgtttagcacaacggaacaaaatcaaacttataaaaattctcttttccttagaaacctcaatgcaattcagcaaaaaatactcccttctgggaaaaccccttattttttcactcaaaatcctgatttcatctggcgccaaagaacagaaaagcagaaactttatatagaataaaaatgtgatgtcggagcaagtaaaaatgccggtcaggcattttctatgccgcgactatcttcacattttattctatataaagtttctgcttttcgtttctttagttcatcaaattaggaattattacattaatgattgatataatgctttgatatcttctttacttgcatcctttggatttccaggagcacatgcatcattgtaagcagaatctacaaggaaatctaagtcttcttcttttacgatttcttttaagtcctgaggaatctttacatctttagaaagctgagctactgcatctactgctgcttttctgtattcttcctgtgtcatgtcttctacgccttctacacccatagcaatagcgatatctttatattttgttcctgttgcatctgcattatatgccataacagtaggaagaaggatagcattggcaacaccatgaggtgtatcatatacagcacctaatgcatgagccatagaatgaacgataccaagtcctacgttagagaatcccattccggcaatatactgtccaagagccatgtcttctcttcccttaggatcattttcacaggcagctcgaagacttcttgaaattacttcgattgctttaatatggaacatatctgtcatttcccatgcaccttttgtgatgtaaccttcaatcgcatgtgtcagagcatccatacctgttgatgctgtaagtccatatggcatactgctcatcatatcagggtcaacgatagcaacaacagggatatcttttggatctacgcaaacaaatttacgctgtttttcatcatctttgataacatagttaattgttacctctgctgctgttcctgctgttgttggtactgcaataatcggtactgttggttttgtagtaggggctactccttctaagcttcttacatcttcaaaatcagggttattaatgattactccaatggctttggctgtatccatggaagatccgccaccgattgcgataaagtaatctgctccggattctttaaatgcagctacacctgtctgcacattttcgattgttgggtttggtttaatattagaataaatttcatattctaattcagcagcttctaatacatctgttactttctttgttactccaaacttaattaaatccggatcagaacatacaaatgctttggtgagtccatgtgcctttacttcatctggtatagactggattgctcctgctccatgataagatgtctggttaagtgtaatacagtttgccatgattcccttctcctttactgagtgtgctttataatttttactgttatcattataatagttctccatttaacggaaaaaattcttttatgaaataatactgtaaatttccgttttctatttatttttttgtgaatttcaaacatatttttcagtactacgttcttgtttttattatatatactgatatttttttgtcgttttatagcagagctgccttctgattaaattctcaatattccttcaggatttaacagaccccatccctgccggctttttgccataccacaatcgagcgcactttgcatcaggcgtatttttacatctctgttagaaagccatggttcatttgataataaaagggctacggttcctgatacaatcggtgttgccatggaagtcccacttcttcttttataatttttcccatgattatcacagcttaaaatattaatcgccggagcaataatatccggcttgcaaacgcaggttcccggaactggtccctgtccggaataatctccccctgcttcttttcctgttcccacagtaattaccttacggcttgtgcccgggcttgtaatcgtatatggtgccggtccgtcatttcctgctgctacaacaacaacaagtcctgtgttccacaattgctctactttttttacaagttcctcttcttccggattttctatatttttcacaggcataccgacagaaatatttacgatccgaattccatatttttcatgatttaaaagaatccattccattccttttagcatattttttattttaccgctgccatctttttcaagtacttttaacatcactattccactttccggggctactcctattccgctcccatctccaagccttcctccggatgcgataatgccactgacatgagtcccatgtccgttatcatcaaaaggtccctttcgatttcttataaaatcctgaaaatatactattttgttccttggaataaagaaatccggatgtgcataaattcctgtatctaaaacagccgtagtaataccttttccggtaataccacggctgtaaatccttctcaactctaacaaatttcctacatttgtcattcccatagccatgattccttttttatcagtatatgattaaaaaaactatatgataaaaaagaacatgttattcaacccatgggttactatttcttagagctggttctttaattctttttaatacttcggggccctgcagcagcaaaaatgcttcagaagaagaagtcaattcctgtttttttaactctttcacgcagtccacacaaaattcttctatgatccattccatttctttgtaatctttttccagagataaaacagataatctctgcatcttatcatacgctgcctttccaagaaccggcaaagataacaatccccgatgtacccatttataatatggtctgtatgaatgattcaataaatacacgagagacatcgaaacggacataaattcactcagtgcaaggtgagaagctacatattcttttcgtttattacaacgaggaaaattatattgaccgctctgcgccattttcataaggcgggcagcaatcttctttaaccggatatcttccggatagcctttttgaagttcctcgcgaatctttgtaaactttccgtaatgatcaaagaaaacttctccattagttacggttgaaagtgcattctccggaatctgtctccaatgagaaagtgtttccggcactccttccgctgcaatgaattttctgtaaaaatcttcaatagaaaaaacaccgactctcccatctccatactggctttcgattcttgcaccaaagccctggaaagtttttggaagtgtattgagtctttgttttaaccgttctccataaatcggcatatcttcttgcggaatataaatctggaaagatggtccaaaatcatgatctcttgatatctcatcatcaaatccataacactctgaaccttctccaattagtcctgctgccatacgcggaaggaaatttgaaaattctttttctaaaagaggataacatacttgattaaaatactctctgcacaaatcaagtccctttacaaatcctttttccgtatctttatatattgtatggttccgttcttcagaacctttctcacagttcagattgctttctgatgcacaggcagcagaagtcataccctttaatgtttcctgtaaaatttcatgatttttctgcatctttttttcctgcagtttctcatgaatcatttccagatttttcacactggttttataggcatcacttgcctctccgagatgttttttcgtaatttccacactttcagtcatcacagcttttgccttctcatactgttccttttcacagtataaaattccaagagaattcagcgctgctgcataaagaaccgttccttcataatgctgctgtctgtaaatctctatttcttgttttaaagtctgttctgccttgaaaatctccccttctttcttgtaaatatcaacaagattatgcagggttgttgcataaggaatgatatactcctctttgccttctaaaatatgaaggctgtgttctaagcattcctttgctctttcaagatttcccatctcataataaagaagtcccaaattattcatcgttccggcataaataaaatgttcttctccaattgttattttatagagagccagcgcctggtaaaaaagagattcgctttcctgccactgtttcatcattcgaagtaaattggcaagattaacaagcgttgttgcataatccggatgctcttttccccgcacaatttttgcacagactactgcttttcgtaaaatatattctgccttttcataaagtccaagattccgaagatgtcctccataattattataaatttccagggtttttaaattatgctctccataaatctcttttgaaagctctaacgcttcctcataaagcggaaccatttcaagattctcttcggcatcctccatctgcacaagcttttttaaaagttcatttaagcgctctagtttcataggcattcactctatcttttcaaactgctgctgtcctacatgacagattggacaatgagaaagtgttgtaaatggtcttccttctctgttttcatcaaaaatatatccgcataccttacaacgatagattcctccaagtccatgatcttctacatgtggattacctcctgtcttttctaactcttcaattttttcttttaaacgcatcttatgcatttcttctaaaagagatcccatatctatacctcctgtaataactattcaaaacaaaaatccgtcataatctataatatttatttccttatgatctaaaaacgaactcacatcctaaagcttttacaaactctcttaaaattgccgtatttcctggccatgccggagaagtaataagattacagtccaccactgcctcatccggagcaacttcaatatagtttcctcctgctaatttcacctcagctgctaaagccggatagcaggtaagctttcttccacacacaacatctgctgcagtcagtacctgcgccgcatgacaaattgccgctaccggtttcccacttcttacaaaacatttcacaagagaaattactttatgattcatcctgatatattctggagaacgtccgccggtaataaataatccaacataatcatcaaaatctacttcatcgaatgttttcgtcaatttaaaaagatgtcccggcttttctgtataagtctggtctccttcaaaatcatgaattgctgttttgataaattcgccttcttttttatccgggcaaacagcatctacctgatatccgagcatagataatgcctgaaatggcaccatagtctcataatcttctgtaaaatctcctgccagtaacaatattttctgcatgtcaattctcccttcttatctcccggtatactgacacattgacacatacaattatcttcctatgtctgtgccggttacacccgtctgaaatcatgccattgccttctctgcttcttctaaagaagaatatccatatgcctgtaccatcttctgcattgtagcaagataacggttatattccggattatgttcgattgacaaaataaaaagtgccagtgtttttacagaatacgtataaagctcacactttaaataatttctaacacttactgttccgtctacaccgattccttctgccggtctgccatgccttctgatattcggatatttaatatctgcttctttctcccactccatgtaaatagaagtgattttttcagccatcaactgtttctcttctgaaatctccggaagcatccccttaatggacaggaaatagactggatctgtctcctccatcatataggcatatttctccatgataagatttctctcctgtgcttccgcctgctcaatgtcatcataataactttctaatacattcatatcccagccttcaaactggctaatacgcataatcagaaaagtagtccagtcatcctggcaggatgctctgccattcacgtcctgtaccttttgaaacatgagccattctttttcaataatctgtttctctagttctctacgttccatatgctcctcctttacatactatttcagtttcattttagcatttttgtattgttttttatgggagtatcacgttctttctatggaaatatactgttacccctttttgactttcataatttccaataattgttcccgtatcttccctgtaatttttcatacatctgctacaatgaatataataaaatgtactggagggaaaagagtatgcgtatcggaatttataaccatcagcatcttagaggcggctgtcctgtctgttctcagacttatgtaaaaggcatgattgccgatggtatgaaatgcatgaatcgtgcaaaaggtatttacggcgaagacaacgaatttgttaactatacggatcttggtgactatccatcagataatcttgaacgacctggctttaaacgcatgatgacagatgtagtagcagataatcttgatgtaatagttgtaattacattagataaaattacaacagatattgaccttttattagaaacttataaaacaatccgacaacataatatagaactgatcactgccaacgatggcaaaaaagcaatggaaatattagataaggcgttgataaaatggggaaaaaattaagcttaaacgaagaaaaatttaaagtggctttcatttttcttaatgaaggttgtaatccaaaaaaagaccgttctgttattgaatctaaaaaaatcattctgtactctgtaggttgtgcagattatagtcaggcagaaaccgtagcacaggagatgttagaaaaaggttgcgctgctattgatttatgcggtgctttcggaaatgaaggtgttgcccgtatctgcaaagccgttgatagaaaaataccagtaggtgctgtcaatttcgattttcatcctgttttccgagataagagcggtgatgatctgttccaaaaagacttctggtgcattggactttaatcatttatttgtagaaactatagaaattaaagggactgtcgtaaaaacagcccctgattctatggcagatgttcctgtatgttatacggaatccctgccatatttttatgaaattatcctgcttgcgaagtcaaaatttgtgaatttttatgaaatgctgacggtgtctgtccttcatattttttaaatattttgcaaaaatatcccgcttcactgtatccaagcaagaaagaaatatctgaaatattcatctcgcttgttgccatataatatttagcctgcaacaacttacgaaggtgaatataatctaccacactaatcttataatattttttaaaaatgcgacttagatatccactgctaattcctgcctcttctgctaattcagagagagaaatctcattgttcttattattctctatatactggaataccttattcatatgtgcatacttcattgtacaaagctgacgaaatacttctgttatgatctgaatcagccagtaatagcaaagcgtactctttgtcagaaccttgactgtaatctcatacttttgtaaataataatttttctgaatattatccattcctggtatcatataaaacaggctggatttcagcatggacagtttacttctacgctctcttctgtcacattcttcaaacaaacattctaccagttcctttgctgtatcatacgccttcttataatctttttgctctattgctgcaaacaaggcttcctgctgaacattttcctcttcattctgcccaagaccattctgtttctttactagttctaaaagcttcgttctggatataggcttatttaaatattcttccactcctgcatccattgaacggcgaatcatgcgaaaattacaataatttgataaaatatacgttacaatttccggaaagtgctctttaataagactgcagactgcaataccattctccataccaagaaccacatcacaaaatataacctgcggatgatagcggcttatgatttcaaatgcttctttactattttccgcaattccgacaagctgacaatcttccgtttccgtaatcatttttgaaaaagcctgttgaaataacggttcttgatcaatcaataaaatatttaccatggctacctccttactttattttctgaaatgggattttcaccgttactacattcggatctacagttatttcaaaatctttaccaaattcttttgcatatctctttctggtatccgcttcctgcatctgaacaaaattactatctgtaatatctgctccaaaatgtcccattgataaaccggaactttctaactgcaatacaatctggcaatactcttcttttttctccgcatcaatatatacagttcctctaaaatgtcctgaaaagacaccaaaatcaaccaattgttctacaaatgggaaaagtccgacaatcggaatcttttgcttttccacttcttcctgacaatacacacgatattctaaccgatcatcatattgttgtcttaaaacatccaaatataattcaatctgctttaactcttctgataatgaaataatctctgatgtattatccagataatatcgtaacactcctgccatttccgctataatattttccgttctatttgcattttcaatgatagaaaaactagaaatcgttgttaaaagattaagcataaactgtttcggcagctttccttttaatacctcatattcaagcctgttcaccttatcttctagcaatttattctttttacgaatatctgaaagatgtacttctttatgctctaatgcacctaatcgaattgctaccgtttccttttctcccatttctttaaataaaaggaataccatatccgcaattgctgcaatccgtttttctgtaaaagcaggaatactctgatattctttttgttcgcctagtttttctaaaaactgttttcgttctttctcgttatctcccaattcactctcttttaatgctttttcttcacatcgaatcggacctccaaccattgctccaatgtactggttgtttacaataatcggaattgccatatgtacaagtccatttggacaggtaaaaatatgtgtacagtttttaatcgcactcttcgctgcagcaaatgccctgctaatctgacattcactacacttttcatcttccttctttctttccttacaaaacttttcttccttttctccctttgtaactggctctcctttataatcaataataaaaaaagaaactcctgttgcttctgccagcttattctgcatttcttctagaaactgttttccaaataagccgatcagactaacttcctttttccctctgccactcttcttctctacttccatgttcacctccaaagggatatttaaattgtaaaaataaagacaaaaatttttactttctttacaccaaaccctactttatatatattttatcatttttacccaaaaaataaactgttttttttgtgctatttctcaatcataggaaaatatattgcatttacatgtaattttcttgattatttatttgtgatagcgagaacaaaattcaacaagtaattacccctcttgtaatatgagacagacgaaaaacgagaagtccgtatctaagagatacagatttctcgtttttctggttgtttatgcctcatagccaggccattaggataatttttgttgtggattttactttcctgtttttatcaaagacagaacccccgaagagaaccaataccctatatttgtggccttagagcgaggattgaatgtgagccgtatagcgaacattcaacccacagcgatagagtcacaaatatagggtattggttctcttcaggggttcgtctgtcttaacaaaacctcaaacgaatcagtctttatgaattaatgccataaatgctaaatctttgcatgatgatgcattctcgattgcgtgacactgtcctggaaggattgtacatacatctccagggcctacttttgtgcggcttccgtcatcgtccacaaagattccctctccctctaaaatataatatggctctgtctctccaacatgacgatgccagccaacactggaattcggttttaaaacaacctttgcatataactttccatgtccatataaatctttctctggaacaatctcatgcacctctgcacaaccttttccaccgccaagttcctgtttctgaatgatatttgcttttcttaccattttaaaaatcctccttctaaaattataatagtaatattcacaaccactttgcaagcctgcatccacatcataatgcttttacctgcatggttacttacttctatcatataattatattttaactattaattaccatttatgcaagatgaatatttcttcttcaaagcagctcgcatagaagtccctaatttaattcactcccggagccactacacaggtagtaagaacatagatatatagcatctgtgacttttggaacaagctcttaatgcggtctgagcattaagagtgcagtgatacggaacagatgctatatatctatgttcttactaccgtctgttgttcccaaaattaaatcagggggctgtcaccttgcgacagccccctttatgtggatcaagcttattgttatttcataatctatttgtgagagtgttgagaccgattatttcagaacaattatgcgcttgaatgaccccttagctatttcactattctaaagtctcagtcgctgaaaccatctgactttgaatagtttctataattattaaaaagtgtaatgattgttgtatttaatatttgttaacggtttttgtagatttcttctgccacacgggcaactgctttttcctgaagaatattcactttatctaaccgttcccacggaagatcaagatctgttcttccaaagtgtccgtatgctgcgactggtttatatttcaccttagtgagagataggctgtttataatacctgccacactgaaatcaaatacttcatttacggtgtcttcaataatttcctttggtatttcttctgtaccaaaggtatctatctttatagatactggctgtgggataccgattgcataggcaagattaatctcgcacttcttacaaaatccggcagcaaccacattctttgcggcatatcttgccatgtacgctgcggaacggtcaacctttgtcgggtcttttcctgagaatgctccgcctccatgtctggcaattccaccataagtatctacaataatctttcttccggtaagacctacatctccggcaggaccaccaactacgaatcgtcctgtaggattgatatgtatctttacatccggtaaaagcaattctttaggaattacttctcttataacatgctcctcaatatccattcgaagcttttgtacagaaacttctgcattatgctgtgcagaaattacaacatctgtaacaccaaggatttctccctgattattatatgctactgtaacctgtgactttccatctggatagaggtatggaaggattccttcttttcttacctgtgtaagtcgtttactaagtttatgtgccagtgaaatcgacagtggcataagttcctctgtatcatcacaagcatatccatacatcattccctgatctcccgctccaatagttccgttacactgtgtaactccctgagcgatatcaggtgactgtacaccaatattggtaataattagacattcttttccatctattcctttttctttactgtcatatcctatttcacagatgacttctcttgccttatttttaacatcaacctttgcgaaagaagcaacttcaccagcaatgaaaaccgtgtcttctgaagccattgtttccaatgccacatgggcagatgggtcttcctctaaataagcatccagtaaagcgtcggaaatcatatcgcatactttatccggatgtccctctgtaacagattcagaagttaataatgttatgtctttattcatcttgacctcctgtacctttcggtatgtataagggatacctcggactgcctgtatcgatttatcctccgattttacaggttaatccttctttttctactattgcttttaattcttccatgaattcattttccggcttctgtacatcggcaagttcatattccttgccgagcattccatacttgttacttccaagatcatgataaggtaaaagatgtaactcatttacattatgcagataggttgtaaactttgcaattgccgcaattacattcggacttgcattaaatcctggaataaccggaacacgaatgatcatcttctttgcaagactagaaatcagtaatgcatttttaagtatttgctcgttacttacaccagtatactctttatgtacttctgggtcaatatgcttaatatccatcatgaccacatcaagccacggaacaatctctttgattacttcctcagaagccataccagttgtttcaatcgcagtggtccagccgaatgacttacaagcctttaacagctctaaaagaaattcgtgctgtaccattgcttcacctccggagacggtaataccgcctccggactttctgtaaataacacggtctttgtaaagttctcccatcagttcctctactgtcatccacttaccggacatctcaagagccctatgatagcagacatcaatacattttccgcatgcaatacattttgtatgatcaatttttcctggaacgtttaaattagaagcaccagttggacacacaacctcacaatttccacagccgacacagttttgtgctttaaacatgacgactggttttaattcctgcgattcagggttacagcaccatttgcagcgaagaggacagccatttaaaaaggcaatcgttcttacacccggaccgtcatttacagagaatctctgtatattaaagacaagcccttttttacttgtatcgcaacttggttccatattactcataggtacttcctccagtttatttcaaaaatctactattttagaaatgctgttctgtacgagcaatgatatcatcctgtacttccttagcaagtactgtccagtgagcggagtaaccagctacacgtactactaagtctttgtagttttctggatgtgcctgagcatcaagtaatgtttctctatcaattacgttgaactgtacatgcatacccttcttatcgaagtagttacgaacaactgctgcgaagttcagaagtccctgatcacctgctactgcagaaggtaagaatttctggttgtataatgtaccattagagatatttaactggtcaagtttagctacggagttacctgcagctgtaggtcccttaacgtcatgaccctgacgaggggaaacaccatctgcaagaggtgcgttgctataacgtccatctggaagagcctgtacgtctttaccaaataatacattagcagatactgggtaacatcctgcctgatactggcctccacgtgggtttttgtatttctcaacttcgtgagagtaaacctgtgtagctttacgagcacacatatcaacttcatcaatatcgttaccgaagcaaggtgttgcgtcgaggatatgtctgattctgtcgtattcagctctctgagcatcgctgcagcttgtgcaagcttcagattttgtatctacgctcatacttaagttagatcctttttctgcaagaatcttctgaacaactgcgttgatgatagattccatgctatcttcagaagatacggaaacactttccatagctgctgctgcaggttctgcagaatctgtacttaatcttacgaatggtccatcgtaacatccagcaccaagctcagcaccgaagttgtgttccatagcatcgtaaatctgctgcattgttaagtctttgtcttcaaatacatgtttcttgatacaatagatagcatcacctgtatctacgttaccaaatgcctgaggtcctgtgaagttgtagatagctccaccttccataactgttttacctcttccgatacagtcatcaactaatgcggacataaatggtaatggtgctctttctttatgagcgatatcaacagcgttatctgcctcaactaatttagatacgaagtactcaatctgagtttcatatgcttcatataaatcatccatggatttccattctggcataggttttgtaacaggtcctaactgtttgccatcacggttcttaccaccatgaatagcgatatcaaataccttagcaacgttaaagaatgctgcgtcatgccatccgtctgtcttgtgtggacactgaggttctacacaaccgatgatacagtaattacgagcatctgcaagagttaatcctctgttacataatgcaggaatgattgcttcatcattgtacatagctggaacaccagtaccaagtcttgcaagctcacaagctcttaataagaactcatccggtgtctggttatgaatacgaacggagaatgatggtgcaggtaatctaacgtgagctgctgcatccatacacatataagaaactgggtttgtagcatcaaggccatcttctgtctgtccaccaacaccaaagttctggaatactgcgtatcctgcaaatgcctgatcagatacatcatcacgagttttgtttacatggtttaataatacgaagaggcagtcgagtaattcctgagcgaattctttagaaatgctcttgtctgcttctaagtatggccacatatactggtcaaaacgtcctggagaaatggaatgtccgttagcttcaatctgtactaatgcctgtacaaaccagaaagactgacaagcttcatagaagtttgtagctccgttttctggaacacgatcacagttcttggaaatctgaagtaattcagcttttctcactggatctgtacatgtagctgccatctcagctgcttttttgctgtatctctttgcaaaattgattgctgcattgtaagaaataataactgcttcatagaatgctctcttctgcagacattccggatcatttgcatcaagtttgttcattgcttcaacaacttctgcaataacgcccttgaaaccgatttttaatactttaccgtaatcaacacacacgtgtccgataccaccgaag

SEQ ID NO: 394 - DNA, 75556 bp, Eubacterium hallii
atcaatatgctttttttaatcatagcctttctcccattcttccataagctgttccgcttcatcaaactctaaattccgaacggatttctgtatcttttccaattgttttctttggtctgcatccttttctaaagataataatatttctatctgttcttctgcgtattttccctgatatcttccaatcgcacaaagaagctctttctttgcttctttatattttttctcaaaaccttcattgaaacaatcttcttcaacctgctttggactatcctttgcgctattttttaaaagaaacggttctgtatatttgataaaaaagcatatgccctgtaccaccctctcccactcaaaaaataaaagggggattgctttatttatgtagttcacatcttggagctttccttttttctccattgtaaaagataattcataaagttctattgcacctatagccctggcattactttttaaagtatggagcaatcctgtcatattttttatttcattttgcgtctgctgcaatctctcgaaactctgaattaactgttctttattgggcacatagtattccacaaacagttctgctaaccttctatattgcgaaatactcccacttagcaaacgtaatccttctgaaagttcaatatcccattgtttcatcttctgtttcaattctaaaatctgtttttcctctattttccattcttcccttacatccttttcccttgaaatcaaatttgcaggaatgaattgcagcaatatctcctctagtctatcccacataaccggttttgaaagataatccacaaaaccttctgaaagaaatttctgtcgaatacctgtagaaacatcagcagtaatagcgattatcggcacttcctgtccattttcctcctctctcaacttgtgaaatgtttccattccatccatctctggcatcatataatcaagaaaaatcaagtgatattttttgcttctaactttttcgatacattctaatccactgcctgctttatctaactgcatactcgttctttgcaaaagagatgcaagcacctgaagattctgctggctgtcatccacgatcaaaaccttcgctttcggtgcaaaaaatcgttttcggtcttccgatacctttttactttcttcgaaattccacttcccgattttctcttctcctgtactttttagcggcagacatactgtaaatcggcttcctttcccgtagatactctctgcataaatctgtcctcccatctgttcacaaagttcttttgctatcgtaagtcctaaaccgcttccctcaatatttctgtgccgcttcatatccacacgtgtaaacatatcaaatagtgtgtccatatcctcttttcgaatcccgattcctgtatcttttactgaaaaaatgatttggtctccgcttgcattaatttctaatgtaacccgtccttcttccgtatattttacagcattgcttattaaatttaagataacttgcttcgtatgtaacacatctcctgtcaaatacttcgcagttcttcttccgcttcaataacaaaatctattttttttgcctctgcctgcttcgtcccaatcatccatatttcctgtataagctgtcttaactcaaacttttcttctgtaatatccagctttcctgattcaattctggtaatatccaatatgttattgataagtgataataaatatcggcctgccttctccacactttctgcatactgaacaatttcttttgaggcagattcccttaaaatcatttcattcatcccaagcattacattgattggtgttcgaatctcatgactcatatttgcaagaaagatacttttcgcctggtttgcttccatcgcttcttcccttgcctgcgtaagaaaaatctgctgttttctataaatatgaaaatggaaatacattgcagcgcctaaagatacactcgctacaacaacaccagtcaatacatccgctacaatttctttttctgaatgaaaccagctaacacagacagggtaataataggcgattcccatcgtagcaatataaataaccagctccagtaaaacactgaaaaacatcagccagccttctaacataaaaacagtaaataaaactccgaaaatataaaaggacggcattcctcctttatatcccccactcttaaaaaacataaacggaaataaaatcataaaaattacaactatcgttataaaataacatctttgatatttcttcctgtaatatgcgtaaaaaagaagcatgagcgaaagaactgcaattcctgcatttataataagtatccgcttatctccattgtttaaatacgaaaaaactccattacaaaggctgatgatacacccaagcgatgccaagacattaaataacctcactcgaaagggcagatcagactgataaagtacttttccaatttcaaataatctttttctatccatagtctattccttttttatatttttatagttctatatctatccttataattatatgatgtcacgaattactacgtaaatctctgctttctcatatttcgcggaatccaacgtcaaacaccttatcgttcacgcacgaacggagctttgaccttttaaccctgatatcaatcatattttaccataaaaaatgtgtttgcactgataagattatggacagtcttggcatttctacaaaaaaagaaattcttataagcagcaaaatcaaacttataagaatttcctttctttatattctattctcctggatgacttgaaattacctttccggcattccataacattactgtctttttagcggcttctagtcgttcttcttccgagtggaagtcaatggtcacagaatggcatccacaatccagacacattacataatatccacagccactttcttcttctaacaatgatccaccatcacataatggacagtcatgaatctctaacatttcttcaatatccataattagcctctttctgttgttctttttattttttcaaacacattataacactgtttttttcagttgtcatgtgattcgcataatgaatttttttttaaacaaacagtatgtagatgaggtattagctttacgttatgcgtttgtcttatttatttgcactatctgcatctactacagactgaatctgtttcataagtgcatcatagttatcctgattatcaattcctccaaccattggctcacctacaacattcccttttctgtctacaagaattgttgtcggaaatgccataatctcagaggcatatttgcctgcatctgaattagcatccagtgcgaaattacgatattttgcaccttggctttcaagaattttcttcgcttcttttattgtagattcctttccgtcaaaagtatcggtattcactcctacaacttcccctcccattgacttgatcgcatcatttaattcattaagctttgacaattctgctacacaaggcttacatcctgtaaaccagaaattcataaccgttactgcatttttagaaaaaagactttcatcaacatcatttccatcaaaatcttttcctgaaatattattgaatgcgattatatcatcatcttcggattcggaagcacctgatgcatccagtttgttttcaacttccgttatctgttcttccattccccggattgtctctatatcttcttttaatgttttcagttcatcctccgtaaaagactttttgtttgcttccaccgtagaagcaagataatcggcatagtcacctgaaccggcatctgttttggacatcttgctaaatactttttcccagacatctttgtgtttttcaaaaatctggttttcctgttgatataaatcatccagttttgcctgcaggtcttctgtcttatctgtcccttctgacacagatgcagaatctgcttttcccaaatccccctttcctgtacatgcagtaaatgataatgctacacaaagtgtaaggatcataatgatagtttttcttgttttcatggtaaaaaacctcctttttatttgtcattaaattttataaactgatagtgaatcgcatctttaggacaagctttcatgcaggctccgcatcgtatacattccggatgatttggagtctttatgacgttaacatccattttgcatgcttttgtacattgatggcatccgacacatttctcatgctcaatcttaatgctaagaaaagatatcttattgaataaagaataaattgcgccaagcggacagatccatttacaaaatggtctgtaaaacagaatgctaagcatgattactgtgattaaaataatcaatttaaaagaaaacagttttccaagcgctgagcgaatggcagcatttccaagtgacagaggtatcgctccttctaaaactccctgaggacaaatatatttacagaagaacggatctcccattccaatagaatttgttacaactaccggaagaagtataacaaaaactaaaagaattatatatttaagataccttagaggcttgagcttttctgtagaaaactttttccccggaattttatgaagtaaatcctgaaaccacccaaatggacacaagaacccacatataaatctcccgaagactacaccaagtaaaatgaaaaatcctgttatatagtacgtaaatttaaactttgatgaacctacgactgcctgaaaagctccgattggacaggcacctgctgccgcaggacaggaataacaattcaatcctggcacacatactgtttttgcatttccctgatatattcttcccttaaatagattagggatatgtatattggtaagtaatgtggcagctgcctgtatccagccacgtaatctggctattttttttgatattacatttgtttttttatccaattcctacacactccagacataattttattgctttactaagcacaacagcagcttcgcctctaacagcaccgtagctcatcatgctcacaccggcgataagtaaaataaactgtgatattttcctgtatttcaagatcagtattactcctttcttttgctatgtagtattctatttgtctttgttgacctgctgacttttgtattatacaatagatgatgtaaaatttctgttaagcgaatggagagattattttgagattattaattgttgaggatgaaaaggaattatgtgataccatcgcaaaaactctgtaccaggcaggttatgaagtagatacctgctatgatggtgatgaggcacttgattatattttggcagaggactatgatctgatcgtgcttgatcttaatctgcccggcacagatggtatggatattctaaaagaactccgaaaggaaaacgaagaaacaaaggttctcattttatctgcaagaagccagattgtggataaggttgaaggcttagatgccggggctaatgattatatggaaaaaccttttcatttgcaggaattagaagcccgtatccgaagtctgacaagacgtaaatttatacaaaaagatatttgtctgcattgtggagagattaagtttgatacgaaaaaacgggaagcatatgcgaaggaaacgcttgtgtctttaaccagaaaggaaaatgggattttagaatatttactccttaatcaaggcagacctgtcagccaggaagaacttattgaacatgtctgggatgcatctgtagacagttttagtggatctatccgggtacatatgtcttctcttagaaaaaagtttaaagttgtgcttggttatgaccccatcgtaaataaaataggggaaggttataagctcgtggaggctgtatcatgaaaaaaatatcacttcagtggagactcactattataacaacgttactgattgcaataatatgtggatgccttactatatttatctacaaaaatggagtctactatatcgactccctgcaaaatactgtagatgccaaaagtgaaaataacaatgaaaataacagtagaaataattcagataaaatctatatccgtattccggatgaagactggaataatttcgcaaagaatttttcaatccaggtgtataacaacaaagcagactacaaaagaaatagccttatattttcaacattgctctcccttcttgggggtgttcttacatttttcattagcggtcatgcattgaaaccactatgtgatttttccaagaaaattgaagaagtacaggcacaaaacctgtcggattctcgaatagaagaaagtaaaattccagaactgaatcagctcagcacttcatataataagatgcttgaacgtttgtcggaggcatttgaaatgcaacggcaatttaccgccaatgctgcgcatgagcttcgtacaccacttgctgttatgcaacttcagattgatctttataattccacacagcatctggacaatgattcgtctgcacaacagactataaaaatgattaccgaacagacagagcggctcagcaaaatggtcaggacacttcttgatatgagtgaactacaaacaatagcacgagatgaagaaatcgaaatagatgcactgattgaagaagtccttgccgatttagaacctcttgctcaggaaaaagacataagactcactggaaaatgtgacaaagtgattttaataggaagcgatatacttatctaccgactggtctataatcttgtagaaaatgctataaaatataatatttccggtggtacggtcacagtaacagcaacacagcgagacaaacatatttatctcgctgttgaggacactggaaacggaattcccgaagaacttaaagaacgaatctttgaaccctttttccgtctggataaatccagaagccgggcacttggcggtgtaggtcttggtcttgcactcgtccatgaaattgtaagggtacatgacggtagcattttcgttaaagacaatgcgaactccggcacaacttttgaggtgattttttcataaatcattttcgaataaagtttcgaaaacacttgttttatatagtatctcatgatacaattattataaaaacatatgtttataaaggagagtgtattttgatgagctatggaaagataagtgcaaagcagaaagagatactggaatatataaagcaatccattttaagccatggttacccaccggcagttcgtgaaatctgtgaagcagttcatttaaagtctacttcttctgtacattctcacttagagactttagagaagaatggatatatcagacgtgatccatcgaaaccaagagcaattgagatcatagatgataattttaacctgacaagaagagaacttgtgaatgtacctattgtcggaacggtcacagcaggcgaaccaatccttgcaatcgagaatatccagggatacttcccaatcatgccggagtttgtaaacaacaagcagacatttatgcttaaggtaaagggcgaaagcatgattaatgcaggtatttttgacggagattttattttagtagaagaaacaccaactgcctcagataatgatattattgtggcattattagaagactctgttactgtaaagagattttataaagaggaagatcacatccgcctccagcctgagaatgatacgatggacccaatcattattccacaggatgccccaatctctattgtaggtaaggttatcggattatatcgcgtatttaagtaatactatgaatttcattacttcttcctcataatcacttatgttatatattgcataaaaattcacatagaatagaagaagtaaaaaagagttcccaggacatctactctgtagaagtatctgtcctgggaactctttttaattctactgtaaatcttctttactaatctgttttccatctctccagattctttccaaatcatagaaagcacgatcttctttactgaatacatgaacaatgatatccttgtaatccataagaatccagtttgcactctggtatccttcaatctgctttgcatcatatcctgctctgccaagtgcttcttctgcactgtcagccatagcctgtacctgattacggtttgaaccatctgcaatgataaagtaatcagcaagaacagatacttcgctgatatctataattgtaatatcttctgcttttttatcttctaatgcttctacagcaagaagagccatttttttagattcgttcatgattaattcctttctttatagtaatcatatgttttctgtgtcataggatcagtcacgcttttctttctggcaaggtaggcaatcgtatcttctaaaataagaagcaggcaggcatcaatatctttaaacgccagttctcttactttaggcagatcttctgctttatctctattagcctctatataatccgcaataaaaacaatcttatcgagcaaagacatatccggacagcctgttgtatgccaaatgattgcagaaagtatttctgaatcagtcacatcatatatttcatttgcaaaacatgctccaagctttgcatgaagtagttccggattctttcgttcgtagtctgaaacaggaattccatagctttcacacttggaaatcttatcttctgaagaaagatatttggcacaatcatgaagtaaacctgcaattcttgccttctcaatatctacaccataccgcatggcaagacaggtactggtatattccacaccaatggtatgttcatatctctttgaagatagtttcttttttaaattttcttttattttctgtattggcatcatagctttattgctcctttttttctgcgtcctgaccgtctggctgataaagaccatgttcataaatataatgctctactttatcaggaagaagatatcgaatactctcaccatctctcacccgtctacggatatcattcgatgagatttctaatacaggagagtttaaacggtgtatttctgaatcatatttattctcaatgtattcaatctgactatttaaagaactccctgttccggctctccctgctactacaattgtagccatttttaagatttgttccggttctttccacgattcaatatgataaagagaatctgcccccataataaaaaagtattcataatccggatggcgttcggtaaggtgagagagggtctcaaccgtatacgtgttaccctctctgttaagttcttctttagaaagccggaaatgcccgttatcttctatcgcaagttctgccattgctactctgtcctcttccgtaacagaattggaaatctttttatagtaaggatttttcgttggcataatcaaaatctcatccagctgaaattgatgaaatgctgtttctgccaacaataaatgtccaaaatgaatgggattaaatgttcctcccataatacctatttttttatgatctgccatgacttcatacctatatctttatggtaatacgattttactgttttccttcgctggtttatataagacaatctttttaccgataacctgtactacctcagaacgagttctttctgcaagaacttctgcaatttctcttggatcatcaaaacagttctttaaaacagatacttttactaattctcttttatcaattgcttcgcgaattccctcaattacttctggagtaagagatgcttttccaatctggaaaatagggtccattgtcatcgccaggctttttaaataagctctttgtttgcttgtcataatatttcctttctatagctatttctatttttctatttctatatttctacttcattttttctttttctaattggtatttatttataataatcaaaggcaaggttatataactgtacggtatccccttcttcgatccccagttcctctaaacgatctaaaataccgttttctttcataaacttctggaagaattcaaatcctttttcggattctaagttcgtatatccaagcatacgctctactttaggaccttctacactgtatacgcccggttcttccatcttaacaacgatagattcctgctcatcgtcttcctgaagttcaaagaagtattcctgatcgaactctatcggttcttccggtaattcttttaaaagatcattaacgtaccaaagaagttcttttacaccctgtccacttactgcggaaatcgggaaaatcttcatatctttgtctgcgaaagcttcttcaagcatttcaatgatcacttctctgtcctcttctggcatcgcatccattttattggctgcgattacctgtgggcgcttggcaagttccggattatacgcctctaattctttattgattgctatgatatcttcaatcggatctctgccttcaacagaggccgcatctacaagatgaatcattactttcgtacgttcaatatgacgtaagaactgatatccaagaccaacaccttctgaagcaccttcaatgataccaggaatatctgcgataacaaaaccatttccttctgctaagtctactacaccaaggtttggattaagtgtagtaaaatgataattggcaatctttggcttggcgtttgttacgcgagaaagaaacgtagactttccaacattcggaaatccaatcaatccaacgtctgcaatcactttaagttctaaatcaacccacagttcttttgctctttgtcctggctgtgcgtactttggtgcctgcattgttgctgtagcataatgctgattaccctttccaccacgaccaccttttaaaagtactactggttccgtacgatttgccatatcaagaatgactttgccagtttctgcatcttttacaaccgttcctgctggcacttttaaaatcatatcttctccgcttgctccggtacatttctttttcgagccttcttttccatcaccggcacaatattttcttttatgtctgtagtcaaccagtgtatttaatccagggtcaactacaaatattaaatctccgccttttccgccgtctccgccgtccggaccgccgtctggtacataaagttctcttcggaagctgacatgtccatctccgccttttccggagcggataaagatgcgcgcacgatctgcaaacattacatacacatcctttctatatatttttatctatattgttgtctatatattttctgttgttatattttgaaatattggtcagaaccagattataaatacatagttctgctaattgaaatttaatttatagtgaaataatgcagctaaatatgcagtacttccaacattctacatgcatgcccaaataaatttaagccgtcggaaaaatcacaaatagctacggatataatttaagagtatagaagaaaagcggcttcaaatcaaaacgctttgaagccgctgataaacaagatttaactatgccactggatgtacagagcactgttttttatctctgccttttctttcgaaacgtactacaccatctactaatgcaaataatgtatcatctccaccgcgtcctacattaacgcctggatgaatctttgtaccacgctgtctgtaaagaatattaccagcttttacaaattgtccgtctgctcttttcgcaccaagtctcttggactcagaatcacgtccgttctttgtggaaccaacacctttcttatgtgcgaagaattgaaggttcattttcatcatagtcgttacacctcccttgttataacttttaaccagatatcatactgttcttcaatagaatgaactccaagatcaaaggaattcatcaacaacaatgctttgtcgctgagaggattcttaaaagtaacctgaacaagtccaagttcttcctgttctgtcacctcaaactcatcatcagtaaacatatcaagactgtttaccagattaattgtcagtacagacacagaacagcagactaaatctgctccctcttctacactgtcagcatgaccaattacctgaaatcctttatattgattctcaggctttttgtagatagtaatctgaatcatatctctaccagtttttgtttaacaaactgtctcgtctgtttctgctcacttaaccttaattaagcattaattttttcaatcttaactttagtataaggctgtctgtgaccctgttttttgtggtagcctgtttttctcttgtacttgtaaacgataacttttttatctttaccgtcttcaactacagaagcttctactgttgcacctgcaacaacaggatctcccaccttagtctcttctccgcctacaactaaaacctggtcaaatgtataagcagatccagcttcaacaccaagcttttcaactttgattacgtcgccttcgcttactttatactgtttaccacctgttgcaataatagcgtacatatggcacctcctaataattactcgccagttttggtgttctgttatgaaacttataccgaactgtgcggcatacggctattataataacagccattcgatataatgtcaagtgtttttctataaaaactcttcaaaaaaactctttaaaattctttttaaaaattttttagtttttttgcattttcctgcaaacagttatttgttccaaaagaggccttctgactttactccgggtcatctctacaagatttaatgcagtcatatctacaacattacagtgtatcctgtcttttctacattcattctctaataaaagtagtaatttttctttctgtttttcgtttttcatattgataaaatcaatcataatgataccggaaatattcctcaggcggatctgtcttgcgatttctttcgcggcttcgcgatttatttgataaaataaagtatcttcctgacgttttttctttaatacacttccggtatttacatcaattacggtcattgcctctgtatgttcaattacaagacttgctccggattttagccatatatatttgccataagcttcttcataataatgagcaaaacgatacaggttataaagagaataggtatcttcataaaaagtaacagatatttcatcaaaagaagtatcctttttataatactcctgcaattcttcatatatttccttactgtctgtcaaaatctcatctaaggcttttgccggcagttctttcccaagagtaatataatacggcggttctttgtataaaagagtctttcccatagcaatcttcgcttttctcatcagctcctgatagcgttgctgtaatacttttaactcttctgtcagtatttcttctgcaatccctgctgcattcgtacgtacaatgatgccgtagtcttcatctgtatatttttttacaagagaatctaatctctctctttcctctttctttcgaattttttttgaaataccgatacgtttttctgtaagagtaaaaacaaaatatttaccatccagactaacgtttcctgtgcataccggcagttttgtcttaacagcatctttcgtaatctgcactaaaataacatctccaccgtaaagcttattttcatgcccaggagataactttatcggctgttctccagataaggaataataacatttctgtccttcgcctatttctaaaaaagctccctgaattccttccgcaatacgttctactctggctgcataaatatttccaagaagactttcctgttcctttggctcacaataaagttctgccggaataccatcctgaaaatatccataacagatgactccttctttttctgatatgactaacttattttttttcatttccatatatgataacctcaatttaatcttctggctgaaaaaagaccgatgaacttcttcaccggcctttttatataattatgttaaatatatactttaatctttcgatacttcacaccatgtgcagatgcctgacgatgactggaataatagacatcaatcctttttcctttgatcgctcctccagtatcttctgctgtatagataatcttaccaatcttaaccttcgttcctaaaggaattaatcgcttatctactgcaatcgtatgctttgctcttggtcttttcccactggcagtcatacagcctgcccactttcctgcacaacttctacagttacagtaaccggttgtgcggacacgcattgttatgtaattcttaacagtaacaacactttgtgcacaaatgtttgttccagcaatccttgctgtaataactgcagtacctttatcttttgctgtaacctgtccgttacgctttaccgttgcaactcttttcttactggaagtccagattatcttctttgagcggctgttagatatgttcactcttaacttaatcttatcgcccctctctacaacggaacctactttattcaatcgtatcgacgcctgtggctgaacacttaactgtgtattgttcgaattaatctgttgtgcagaaaccttctgcgggaaaaggcagagaaagcttaacataaaaatgaatgctgcgatgatgttatactgtttacacttcataatagacctccttttcgtctttcaatttctattacgaaatgtattataacatattcatcacattttgttaacccttttttaataaaaagagtaatctaattaatatttttgtaatatttactcttccggatgcttttcttcagcaatatcccagccgacagaacctaatggctgaagctctccatctttttttaaataggtttccagacggtgatactgaaatcccattggatcataatcatatccaagatatttacaaaaagcttccataacaagctgtggttttaaattctctgcactaccggtaaccagcttcataaagattccttcctgttttaatggaagccccggaataagcggttcagattcatattcacgaatatcaagaattaacggtgcaatatctacttctttttccgaacgcttcgttttctttataaccggaatcttctcctgaagataaaaaggctgggtacgttttaaaaatgcatctttataataatagccttcgcgaaatgttacaagataatctgccgcctctgttaccgccatacagtttttctctttttcatcaatttctttaaattcaaggacagaaatcccctcattcattaccgcattgatgcgtttcagcatttcctcactgctataagaccagtcaaaagaaatatccgcatattctccttcactggtcattccaagaccaagcggtgcagcaaaactcataatctgatgaggactcattccttttgaaaaagaaacaggaagctccgctcgcatcaatgccttttgaaaatatctttgtacatccagatgtcctataaatttcagaactcctgttttagtccattttactcttactttcatagcagacacctcctccaaatcttgccgctccacagccggaacatttctcacgacagtttggggtcaccttttctgccatcgcattattccattcacgttttaaaaattcttttgttacaccgatatcaatgaaatcccatgggaagacttcatcaagctctctctttcttgttgtatagaaatgataatcaagagcattttcctccatcgtttccatccaggtatcataatcaaaaaactctgtccatgcatcatagatacagccttttttataaacatcataaatcactttacaaatacggcggtcaccacgagcaagaattccttctaaaactgtagtcttagcatcatgccacttaaaagacaggctgcgatgattatgctgaatcttaaattcatcattgacgatatgtgctttctgcttatattcatcctcctcacacatcgatgcccactggaatggggtaaatggttttggaacaaagaacgaagcacttgcaccaacagaaatacggccatgacgatattccgcatccatactatagtaattcatggcgatcttttcagcaagatgagcgattcctttaatatcttcctctgtttctgttgggagtcccatcatgaaataaagttttactttactccatcctcctttaaatgcttccattgccccatgaagaatcacttcttctgtaagccctttattaatgacatcacgcattctctgtgttccggcttccggagcaaaagtaaggctgctctttcgtacatcctgcactttgctcataacatccaaagaaaatgcatcgattctaagagatggcaatgcgatattaatattttttgcacgataattatcaattaaataattacataattccggtaaatgactgtaatcacttgaacttagggaactcagagaaatctcgtcatttccagttcctttaatcccggttgaagcaagtttttcaagcattggaagagaacgttctcttaacggacgataaatcatacccgcctgacaaaaacggcagccccttgtacatccacgttgaatctcaagcacacaacgatcctgcgttactttaatatagggaacaatctgcttttccggataaaaagtattggataaatccatctgtacctgttttaagattgttcttgggacatcatcgtaaagaggttcaaaagaagcaatcgttccgtcttcattataagttgtctcataaagagaaggaacataaatacccggaatatgagaagctttccgaagaaattctttacggcttcctccattttgcttatgttctttatataaatccatcagatcataatatactgtttcactttccccgatataaaacatatcaaaaaagtctgcaagtggctccggattataagtacaaggtcctccaccaataacaaatggagcatcttcccttctatccttcgcataaataccaatctgactcagatcaagaacctgcaaaatatttgtatagcacatttcatactgaatcgtgattgccagaaaatcgaacataaatacagggtcctgactttctaatgcaaagagcggaatattttcctcacgcatcactttatcaagatctacccaaggagaaaatacacgttcacagtagatatcatccctgcggttcatctgatcatatataatcttcatccctaaatgagacatcccgatctcgtacacatctgggaagcacatcgcaaaccttattttcccttccgggtctttccttaccatatttacttcattcccaatataacgtactggtttctctatttttagcaatatttcatcggttaatgctaaattattcataaatttccctttcgttgttgtttatttttcacaaaacatatatttgcttaaattttaatatttaagtgatttttaatgtgaattcaaacaaatttatgcatcagtttttctataatatcaaaaaaattcactttttgcaaattccaaactttttgagggtcatatgaattataaaaatcaactggataaacgaacaagaatagttattttttattttctcttttttcttttgctccaaagatatcttactgttaaaaatatacttaccaccatcgcaaaggcatatccggcaaatccaagtgcaggaattcccagtattttaggtgtcatatctgtcgtacagattacactagatgcaataagcagcgctgcaacacagagcccaacaacaatatttcttattgctgcggaaattacattgataagatcttctgaagaatgtaaatctatattaacaacggactgtccttctaaatgctctttaagaatatctgtcactaaacctggaatctctacgcctttgtttacagagcgatacacaatccgtgcctgtttctgaaattcacttttccagtttatattttttaaaaaatcttcggtataacgattgactgctatctgcatcatattgatatccggacttatgactgcaagaacaccttgtatatgtgtcagtccacgacagagcatagaaacaccatgtggcagactaatacgattctgcttcatgatttccacaagtccagctattgctgctgcgacatccagacttcccatagaagttgtgccataatcagcaataaacttttttaaatcctgatataaacgttctctgtcaggctttccacgaaactctcctatttccagtacggaattctcaaccattgatatatcatgtaaagcgattccgcgaatgccttttatcatggtgtggcggtctttttccgaaagacgtcccatcatccccatgtcaatccaaacaattttaccgtctcgaatctttacattccccggatgtgggtctgcatgaaagaatccatcatccataacctgtttgatgaaattattaacaaatttcgttccaatctcatccatatcatacccggcattttggagtgactctacatcatcaagcgaatacccatcgatatattccattacaagaacatgacctgttgaatattcatgataaagttttggtgtagtaacatattgaacagaagcattatttcgtgaaaactcatccatattcgcagcttctttcagaaaatccatttcctcctgagctacagaccatagttcatcaagaaccatatctaggtctacaagattcttaaaatcaccgactggcggaattaactttacaagtctgtgcaaaagaccaatatctctggccatggtgtcataaattcccttacgctctacttttataatgacttcttcaccatttttcagtctggcacgatgcacttgtgcgatagaggcggatccgagaggagcttcttcaatgaattgaaaaagttctctccaatcctgaccgtaggagtgattaatgacatcctctacatcatcaaaaggcatgggggtcacatcagaattcagcttcagtaattcatcacagtacgctttcggaagaaaatccgaatgcaaagacataatctgtcctaatttaatataagttggacccagttcttccagtatcattcgtagtttttccggtgtgactccccgggttatctgatttttccgcaggacatccttgatttctcgaaagcgttctgaattctcttccttctgctgttttttatgactttttaactcactgtcttttgataccattcactcactctcctggctctgcttattcctcactgtttgtctcttctacctcttgtgccgcttcagtctcttctatttctacttcttctgcctcacagtcttcacaactatccgcttcgtccaactctgtttcctctgctacatcacctgctgtgccatctttatgatctagtgagtcgattacttttctaaccgctgtaatctgttcaacagaaagcttagaaacaaaatcaatcacatcttttgcagcttttgcagcttcatctactgcttctacagcagcctgatcgattgttttggctgtgttctcatctctcattgcatgcttttcttctgcttcttcctttaccttttgggccgcctccttcacaatctccttctggttcgttactgactcttttacattgtgtttaagttcagagttaataatcttgccctgatcaaccgtaatctctcccttttctacaagatgtccgagaatttcggaagttttctcataggtgatagctcccgctccaatagccgcaagtgtaagttttttgaatccatctgaaattgtcataatgttctcctccttataaatattctgtactcttagaatcctttttgcttgcttttatgggaaaactccgagagtacattatgagcaaaagtttattacattacagaccagctacatctaatagctttggtataaaaatcaagataccaatgactgccgcaaaaatagctacaatcaatactgcaccggctgcggcatccttcgccttttttgcgagcggtttccgttcctctgtaaacagatctactgttgcctctaccgcagtattgacaagttcgagtgcaagaataagtccaaataggataaaacaaatcatccattctgtctttgatatctgcagccagattccgaaaatcgtaaccaaaatagctgcagcacaatgtattttaatattcctctctgtacggattgtattgaaaatcccctgaaaggcatatccaaagcttttatataacgggtctttcttcataaacaatatctttcctttacacatttgtcttacttttctaattcacaaccaatatttgcacagagtctaagctgtcaaatacagatgtaaactaccaccttgtcttgagataattgtaaaatattttcactaaattgtatataggcaacccattcaatatatctgattaaactaccctgccttacttccgagcacattctccttcacttccccgcaagattcccagtccatgttctagatttggaagcaggaaatctaaagattctttcactgctttcggactgcccgggaggttaataattaatgttcttttgcggattcctgatacagcacgactaaacatggcacgaggggtaatcgtcatagaataattacgaattgcttcagcaattccatttgccatacgattgcaaacggcaatcgttgcttccggtgttctgtcgcgttcagaaaaacctgttccacccgttgtaaaaataacgttcacctgacgctggtcacttaaacgcatgagttctttttctaaaaggagttgttcatcagcaagaagaagcgtttcttttatatcatatcctgcagattttagcatttctacaatagctggcccgcttttatcttccctttctcctgctgctcctttatcacttaaagtaatcactgctgctgtatacggtctgtctgctttaggtaaaatacaggtaacttcctgaccgactttaatgtgtcctccctctactacttctgcaaacacgccttctcttggcataatgcagtcacccatttttttatagattacgcaatgattatgacattcttttccaatctgagtcatttctaaaacaacatcgccgataacaaaacgggtgccgaccggcatcgcactaaaatcaaagccctcaacaattaagttttcgccaaaagatcctggatggatatctgctccttttgccttaaatgcatcaactttttcttgggaaagaagactgatctgacgatgccatttgccgccatgggcatcaccttctattccccagtctgctataatatttgcttcttcgatgaaatgtttttgtacccctcttttctcactgatacaaatcccagtgatttttcccataatatcttctcctctcatccaccaatctgccccataaaatgtttttccgacacgctttttacatcttcaaaacagtgcatctgcggtttgttttttatgctttctattaatattttttgaatactttcctgccgtttttctttatgttccattcgcaatgcaggctttaatgcccaccgctgctcgtagcagaggcatggctttatatctcctgtcgaagtcattcggatacggttgcataaattacagaactttccatgtatcgcactgataaaaccgatatttcccttgaatccttcgatggaataataaacagccggtccatttccatatatccgaaaatcttctgttaaattgccgtaatacctcatgattttctcttttagttcttcattagaaatactttgtggtatagttccataaccaatcggcatcatttcaataaaacgtacacttaatggcagatttttcgcaagctgggtaagtggcagccactcttcctcattcattcctttttgtaaaacagcgttgatttttaccggaataccagactctactgccgttgtaatagacgcaagaacaactgataatttatcaaatcctgtaacctgtttatatttttctttgtctaatgtatctaagctgatatttactgcatcaagacctgcctgcatcaaactttctaattgttctcccagcaacagaccatttgttgttaatgtgacaacttctgtccctggaatctcttttatcatacgaattaatttagaacattctcttcttacaagcggttcccctcccgtaattttaaaacgggtaatccctagctttactgcctcctgacagactgccgtaatctcttcatacgtaagaatatccttcattggaatccagtcagccccgtccggcatgcagtagcagcagcgaagattacaacggtcagtaatagaaatccgcatataatttatctctctgccgtaactatctcttatccctgtttttatcattataaaaatacctttttatctatttttatcttgctttggcatatttttaaactcaagaaatgccatgataatagtgacaactgctgataaaaagtcggcaatcggtccacaataaatacagccttcaattcccataaatcgtggcagaatcaaaagcaatggtatgaagaaaataatctgtcttgtaagagacaggaaaataccctttgccggctttccgatggatgtaaagaacgtggatgtaattggctgcaaggcatctaaccagataaagaataagaagatacggaagaagcgtactccaaatgtaaaatattctggctctcctgttccaaaaagtccaagaatctgtctcgggaaaatctgaaacagtacaaaagaaaaaatagaaattattactcctgttaatgctgcaagtctatatgctttacgtacacgatcatactttttagcgccgtaattaaaactctccaccggctgacttccctgagaaagtccgattacaatagagaaaaatatctgatttactttaattacgattcccgcacatgccagaggaatcgcttctccataaatggaagatgccccataaaaagtcaatgaattattcatcacgatctgcacgagcatcatagcaatctgattaaaaaaagaagccatacctatctgtgcagttcttccaatatattttatctgtggataaaaatgctctttttttagcggaatcgttttaaaatgaagcagataatgaataacaataattgcagaaataatctgtccgataatcgtcgcccaggctgctccggccattccccatcgaaagaccataacaaataccgcatctaatattgtattaacaatcgcaccgaccagattacaaatcatcgccatctgtggacttccatccgcacgaatcagatgacatcctccagctgttaaaatcataaatggaaaaccgattgccgtaatacgtacatacgtctgtgcatagggaagtacgtcacccggagcaccaaatccttttaaaagcggtgttaaaaatatctctgcaattccaaacaagattacaccgctgccgatcagacatacaatagcatttccaacaaaatatactgctctttcactgcttccccttcccatatttaaattaaaacaggacgcaccaccgataccaaacattaaggcaagtgcaatgcaggatgttgttaacggaaacgcaacgttcgtcgctgcattgccaagtgtaccgactgcctgtccgataaataactgatcaacaatattatataaagcactgacaatcatcgcaataatacttggaacagcaaacttaaccattaaagaagcgacagaagcctcccccaatgggtttcccgcctgtatattctctttttgttcttcactcatattttctctcctcttttcgtactgcataaaatgcggctgtcttatctaaacagacagccacttttattatagcatcaattttacaaaataaacaaacaaatatttagattctaagaaattatttcttttaatctctcacagcgattcctccactgaaaaattcatatttttgatataactttccataaactttttattttctgccaaagatacatgtatacaattatttgcaatatttttagcccggacacgataagattgatccagcaaaaaggactgtaccccctgacctgctccgtttcctattgaaataatcttctccctggataccggtggcaaaagtccaatcgataacgcattatctatatcaatataattgccaaatgcacctgctaatacaagataatctatactttccagtgtgagacctgcctcttctaataaagccagacaaccagaacaaatcgagctttttgccatctgaatctgacggatatctttttgagaaatataaactggatgctccccttctgtaaaataaaacgccatattatattcttctgcttcatgcaaatatcttatccatggactatatgggttcattcttctgcattcatccgggtcaagcaaggttcccgcttcatcaatcaaaccagcttttctaagttctgctacggcatcaataattgccgaaccacataacccctgtggcgttccttctccgatcactttgtaagtaagctgattatttttgaaggaaactttctcaattgctccatttgttccacgcatgccacaggcaatatttccaccttctaacgccggaccacaagccgtagatgctgccaaaaactttggaaatgtccctaccgcaagttctccattcgtaccaagatcaaccattaaatatattttatccttcttcgttaacgtaagaagtacggatgttgtatctgcaccaacaaatccacccaataacggtaaaaactctactactgcatttggattacagcataatcccgtctctcttcctgttacaactacttcttcttttataatattggcaaaaggattcactccaagaaaatatggattcatcccataaaacaagtgctgcatcgtactgtttccacaaagaacgacatgataaatattctctttcaaatcttgatactcacttcttgcctcttcaagcagttcattcaacgtatctatgacacaatcccttaatctttgcagcatttcgggattatctcttacacaggaattccgcgtaatcacatccgctccataagctgtctgtttatttaaagcagactttgtcgcaattaattctcctgtattcagattataaatatatactgcagccgttgtcgttccgatatctgccgccacaccataacaatacggagtagtatctccttcttccactgcaataatctcatcattaaaatacacaaaggtacagccagtaaaatcaagcgaaacattcatcatcgaaaacttttgcataacagaaagaggtactttttcagtctgcgagaaaaacgtattcttttctcgcatcttttcgataatttcatctttgttcatatattttttagaaacagaaggatgaaattctatatttaaaggagctgcctttgttaatacgactgtctcctgcctataatctgactcctttaagcaaatctccatatcctctgtaatctctgtctggcaggcaagaacttctttaaagttctcatccgctttccctttgatacgcaccctgcattttccacatgtgccgttccccccacagacaagatttagtggaaaacctgctaattcacaagcagcagataatttccctccatccacagtaatctttttgttctgatttataaaataaatttgataactcatttatacaatgcctttcgttatatttttatataagaaactctttactcataatcctgtccatcgaagctttcatctcctgactggcggttaatgaactttggatgatatttggaatagacgataatctgctctttataaagtccatgatatccggaaagcatatagcttatggatattgcaattaaaatataaggaactccttcaaaaccaaacagctcaaatcctatgagcatagaagcgatcggacagtttgttacgccacagaacagggcaagcattcctgttgccgcacaaagagacggcgaaattccaaaaacatgtccaaacaggcatccaaatgtcgctcctgtaaaaaaggctggcacgatctcgccgcctttatatcctgctgcaagggtcagggcagttaataacatttttaaaagaaaagcataggcgggaacacttccttcaatcgctttggcaatcatttctgttcctgctccattataatcatatgtacctatcaataatgtcattccaatgacaaggaatccacctgccatagctcttatatatgcatttttaaaaaacttactgtaaaataaacctgctccttttaaaaacaggcaaaatacaacacttaatcctgcacaaaaaatgcccagtaatacaattttagcgctgtttaaaaaagtaagttctggtatgccatgaatcatgaatgcttccgggttgattcccatatttactgcaaaacgattggccacgattgaggaaaaaacacatggaactaatgctgcataatgcataatcccaacactaatcatttccataggaaaaatcgctgccgcaagaggtgttccaaatacagcagaaaaggctgcactcattccactcatcaccaaaagctttctgtctccctcttcaaacttaaaaagtctgccgattgtattaccgatacttgctcccatctgaagggctgccccttcacgcccggcagacccaccaaataaatgtgtgataatcgtagctgcaaaaataaggggagccatgtatgctggtacatcctggtctttcccatgtaccgctgtcataataatattcgttcccttatcctgtctcactccacaaaggtgatacaacaatacgattacaattccgccagcgggtaaaaaatataataaaaatggatactctccccgaagcatggttacttttttcagacaaaaagaaaacgcactgctaaatgcaccaacaccaactcccgtcagacctgccataaacaaccataatgcacaggtttttaaattataataaatcttttttaaatacctctcacctatttctcgcatattttattccttcctctttcttttaagaaagtgtactctatttgaatttatattgtcaagttctggcgaaaaaagaattgacatcctttttatttcgtgataaattaaatcctgtaaatgcgatgaagaggaatagtagaatgatgaaagcatccagagagctgctggttggtgcgaagcagtagtagacatgatttgaactcgcctctgagcagcctgttgaaccgcatgattgcagtaggcagcgccggaaacctgaccgttataacaggaggatataagacttttgagtccgtatctataatgagtgcataccttactttttaagtatcgtgtgaataagagtggtaccgcggaattattttctccgtctcttttcggcatctgccttttggtatttgccattaaagagacggagttttttattttacaggatatattttcctgtaatatgttgtttttaacttaaggaggattttctattatgaagtatgcagataagtataaaccaatgtatttcccagctccagccggatatactaaatggatggagaaagaccatatcgaacagccacctgtctggtgttctgttgacttacgtgatggcaatcaggctctgatcatccctatgagtttagaagaaaaaatcgaattctttaaattgttagttgatgttggttttaaagaaatcgaggttggtttcccagctgcttctgagacagaatatgaattctgccgtacattgatcgaacggaatctgattccggatgatgtaacgattcaggttctgactcaggcaagagaacatatcattaaaaagacatttgaagctattgagggtgctaaaaacgtaatcgttcatctgtacaactccacttctgttgcacagcgtgagcaagtatttaaaaaagataaagaacatattattcagattgctgtagaaggtgctgaattattacagaaactgatggaagaaaatggaggaaaatatcgttttgaatactctcctgaaagttttacaggaacagagatggattttgcattagaaatctgtaatgctgtattagatgtatggaaaccaaagaaagaattacctgctatcatcaatcttcctgctactgtttcccactctctgcctcatgtttacgcaagccagattgaatttatgagcgagaacttaaaatacagagataatgttgtattatctgttcatcctcataacgatcgtggaacaggtgttgccgatacagaattagctgttcttgcaggagctgatcgtgtggaaggaacattatttggtaatggagaacgtacaggtaatgtagatatcattacattagctttaaatatgtatgcgcatggtgtagagccaaacttagactttacagacttgccacatatcgtaaaagtatatgaaaaagtaacaagaatgcatgtatatgaaagacagccatatgccggaaagcttgtatttgctgccttctccggttctcatcaggatgctatcgcaaaaggtatgctgtggcgtgaaacacatgactgtgacaaatggactgtaccatatctgccaattgatccaaaagatcttggaagagaatacgaagcagatgttatccgtatcaacagccagtctggaaaaggcggtatcggattccttctggaaaaaacatatggtattcgtattccaactaaaatgcgtgaagaagttggttattctgtaaaagatgtttccgaccacacacataaagaattacagccaaaagaagtattaaaagtattcaacgaaaaatatgttaatatttgtgatccaatcgaattactcgaagtacacttcaaacaggagcatggtggaatttcaacagaaattatcctgaacaaatatggtgtacataaagtataccatggaaaaggaaatggtcgtcttgatgctgtaagtaacgcattaaaacgccactctaacttagactacacaatctccacttacgaagaacatgccctgaaaatgggatcaaactcccaggcatgtgcgtatgttgccatctacggaaacgatggaaatacatactggggcgtaggaattgatgacgatattatcaatgcatccgtaaaggcgttaatcagcgctgtaaaccgctacgaaaaatgtgaagatggaaaagaaaattaaatcctgacttgccaaaagagacgaagcaatcacttttgcttcgtctcttttactcatataatgtttatcttcttattacgctgatacatgttcccatacaatccatttcatccatacgatgtaaaataatatcttttccccttccattcagacattctaagcaataatcgtttcctttcatcttaaagtatcgaaaatacgctttcaatccatctgtaaagacagctctctcccctagttccggaaaacgattttcaagtaatatcctatcccccttacaatatgccggtgcaaaattattacttgtgatttctattgccagatatacttttttaatcatcgtatattcattctccacattacagctattataataaataccatctgacaccttaccaacaggaacaagacatggtattctatgtttcattttatgtatattcattcgttcattctgtgctgctttactttcaaaacgcgccacaatacgaataactgcccggccatgatttccacattctctataatttttaattagttcctcctcttcctgttcacattctaaatatttattttcacctaataaatattcaactgtaacacccagtgcctgtgcaagctgaaaggcagtagacacctttgggtcctttactttttgataatagatgttacgtaatgtttcaaaaggaacaccggaggtatctgctaatttctgcaaagatatatcttgttctatcattaagtcacgaatcttcttactaaacatactatctcctacgggtcattactgacatgaatttttttaaacatttatgaatattatgttattcctaatattttattatgtcaatatccatattaaaatgtaacataaataattcagagaggagatttattatatgtctgacatttctattacttatgcaggaatttttcatgttaaagatgacctttggcgatttattaacacaatggaagatcatcaaaaggtacttgtttttacaattaatggtgaaaacaacattaaaagtatttttcgtattgaaacttccggaattcaaaaacttctaatgcagattggaattcctgccaacctgctaggtttttcttacatagtgaccgcattagaattgattgctcttaaccccgaatatttaaacaatattacaaaaggattatatgctgatgtttccgaaaagtgttcaagtacacccgttcgtgtagaacgtaatatccggcatgcgattgaaattggatttttaaaagggaatttagagataattaaaaagatctttacctcttctagctactcagataaaggggcaccgactaattctaactttttagccgcgatctattattatatggtgaataatgaattatagatgtaatcaaaaaacaaaaaccggaagtatattatgtgaaacttttttatcacttgcaacatttacaattaatctctgttgtttccagtgatatttccataatatacttccggatttttatttattattttatctcagtcgagaagactcccacctctttcaggtggtgagtgacagctcggcttgaattactactgaacggaattatgtttgacagaagcagtaagcgttcctccctgttcgtcaatgataatcgtatcttgtggatacacttctcctgaaagaatcatccttgctgcaagcgtatcaacatgttttgtaagatatctctttaatggacgggcaccatatgccggttcatatccatgatcaattacataattctttgcagcatctgtcaagcggattaccagttctttatcctcaagacgtttattaacatcagcaagaagtaattcaataattccgccaatattactcttcgtaagaggtttaaacataataatctcatccagacggttcaggaattccggacggaaatgtgcacgaaggtcattcataaccatgttttctgcatcggtcttaatattaccttcctcatcaattccctcgagcagatactgggaaccgatattggaggtcataattaatatcgtgttcttaaagtctaccgttctgccctgggaatcggtgatgtgtccgtcatcaagtacctgtaacagcacattaaatacatcaggatgtgccttttctatctcatcaaaaagaacaaccgagtatggttttcttctgacggcttcggtaagctgaccgccctcttcatatcctacgtatcctggaggcgctccaatcagacgagatacagaatatttctccatatactcactcatatcaatacgaaccatgttctgttcattgtcaaacaggcttgcagcaagtgcctttgcaagttctgttttacctacaccagtaggtccaaggaacataaaggaaccgattggcttacttggatctttaattcctgctttagaacgaatgatcgcttcggtaaccttttccacaccctcatcctgaccgactactctcttatgaagctctttatcaagatttaatgttttatttctttcactttccgtaagttttgctactggaatacctgtccagcggctgatgatcgttgctatttcatcatccgtaacagattcatgtaccatagaagactctctcttctttgcactttcttctgcttcttctaattgtttttgaagttccggaagtttaccatattgaagttctgctgctttatttaaatcatagttacgctgtgcgatctgaatctcattattcaaactctcaatttcttcttttaactttgaaacacgctccactgcagatttctcctgatcccaggatgcctttcttgacttaaagtcctcacgcagctctgctaattccttctgaagattctccagacgttctacactgagccggtccgtctctttcttcaaggcagcttcctcaatctctaactgcataatctttctctgtacttcatcaagatctgccggaagagaatccagttccgtcttaatcatcgcacacgcctcatccacaaggtcgattgccttatccggaaggaaacgatctgtgatataacggttggataacacagcagcactaactaacgcactgtctgcaatctttacaccatgatatacttcataacggtcttttaaacctcttaagatagaaatcgtatcttccacagttggttcatcaaccataaccggctggaaacgacgctccaatgcggcatctttttcaatatactgacggtactcattcagtgttgtagcaccgatacagtgaagttcacctctggcaagcataggctttaataagttacctgcatccatcgcaccgtctgtcttaccggcaccaacaattgtatgcagctcatcaataaataaaagaatctgtccatcactcgctttgatttcttcaagaaccgcttttaaacgttcctcaaattcaccacgatactttgctccggcaactaatgaacccatatcaagggcaaataatttcttatcctttaaagaatctggcacatcacctttcacgattcgttgtgcaagaccttcaacaacggctgttttaccaacaccaggttcaccgatcaataccggattattctttgtctttcttgaaaggatacgaaccacgttacgaatctcgctgtcacgaccaatcaccggatcaagcttctgttgttttgctcgttctacaagatcataaccatatttttcaagtgtctcataagttgcttctggattgtcactgacaaccttctggtttcctcttaccgtagataatacctgaagaaagcgctctcttgtaattccatatgcctgaaacaatttcttaatctctgtattcggatacttcattaaagaaaggaaaagatgttctacagaaacatactcatctcccattgccttagcttcatcctccgcactcacaagtacctgattcaaagacttactaatataagtctgtccaccggaaacttttggcttcttctcaactgcctgctgtacctgtgacagaaatgcttctttattcacttccatcttctcaatcagctttaaaatcagactatcctcaatggtaagtaagctgtataaaaaatgctcctgatcaatctccggactgccatactgataagccagtttctcacaactattcacagcctctaatgacttttgcgtaaatttatttatattcatataagttcctcctaacccgaagatgcttatttgttctacacttcgtataacatatatatagcaccttctattagccacgtcaatagtcgagtgctaattatttgtgaaaattttgtgaacactgcgagccatgcaaatttacgctacctcatacattaggcgagcttcctggatataaatttaaactcacatctatatcaggatttctttaattcttccatataaagttccgctatatatgcgggaccattgcaccacaactttgttttttcatcatacagtgctttgcccgtcctggaacacagaaaatctgtcaacacctcttttctgtcctttcccatctcttctgcaatttcttccgtcaccatagtaataagaagatcaattgtataattcattttctcttttggaatttttacttcagccatatcttctcaccgttctgtccctcttcaattgttccggttgcaattgctttgactattgaagttctcagaaaactttctgcctgctcctttgaggatgttaaataaaatccctgcccaaaatcttttctctttgcacatttggcaagatttggctcttttacttcacaataacttccatgatagagaacaaatccatcttttaactcaagcactaatctctatcccctttccttccagaaaatccataatatcttcaagtacagcttcatcgccttcgcaatgaaaaatcccatagcatttttctatatatccaagaacatcggcttttttaaacaagcagatgatctgctcaacaggtaaatgccactcttctgaagcaagccggattaatcttgtctgcatgaaagtaatctccgttttttcgctcattatgaatcctcctcaatttttaatcaatagaattctgatttataatgtaccgtataatcataatatcacaagaagaaggaatgaaaaaggatattttcttatgataaaaacgacatctgatatcagagagattccggtatttgcatctctgtggaatatggatggactgattctgatcggattttgtgaagctgattatgaaagccttagaaatctgatataattgattagcgcaaatttatattttaatatctgctcctgtctgctatcacccaagtgccacatccagaatcatcattaagctaaacccaactgcaaagaaaaccgtaccaatatttgagtgctgtccctgcgacatttctgggattagttcttcaaccacgacataaagcatagcccctgctgcaaagctcagcaaatatggtaatgccgggattatcagctgtgcagcaataattgtcaatactgcgccaatcggttcgaccacccctgaaagtacaccacctaaaaatgcctttcccttactttctccctctgccctaagcggcatggatataattgctccttccggaaaattctgaatagcaattccaagtgataacgcaagtgcacctgttgatgtaatctgtgcatttccagcaagaaatcctgcatacattacaccgactgccataccttcagggatgttatgtaatgtgaccgccaacaccatcatcgtagtacgaccaagcctgcttttcggtccctctgcctgatcacttccaacatgaagatgtggaatcaaatgatcgagtgtgagtaaaaataatataccaatccagaacccagcaactgccggaacaaatgataagtctcccatattctcagattgtttaatggccggaatcagaagactccagattgaagcagcaaccattacacctgctgcaaatcctgtaagtgcacgttgcactgattttcctagcgtttttttcataaaaaacacacacgctgcacccagcgttgttccaataaatggaattaatatgccaaaaaaagtattcattagctttgcatattcctttctttaaaatcagaaaaactactattttgtagtctttcatactattttaatattagttgtaactaacttgtctgtataaaagaaaccgtgcgaaagtaaaactgtaatttcacacggtttttttctgtctttttagtatatcacttacggaatgatataacaacaaaattcttttaacaatgtttctaattttttctggtcaatcacagtcaatctctaatagatggtgattgaatttttcttttttactaaatgacagattgttatcatcactttttcaacatctaaaggcttcgccagatgagcattcatccctacggcaatgcacttttcagtatcttcctgaaatgcattcgctgtcatagctataatcggtattgtttttgcatctgaacgttctaacgacctgattttcttcgtagctgtatatccatccataacaggcatcatcagatccatcagaattgcatcaaatgttcctgccggtttctctttaaataattccactgcctgctgtccatcctccactctggtaaccaacgctccgtcatcttcgagaactgtcttcgttatttccgcattcagctcattatcctctacaaggagaattcttgttccttttatcgtgtgaattgcgggtggcttcatggtattctgattttcatacacctcttctttcgatgctatgtcaaaagaaaaatctaccgtaaattttgttccaatgccctgtctgctttctacctgaatacttccacccattagttctatcatgcatttgataatagaaagtcccagcccggttccctgcaccttattttctgtagtggtatgttctctggaaaattcttcatagacatgcggaagatattcttcactcataccaatgcctgtatcttcacatgagaaaatataatgtatctttgaaggattctctgatgcggcctcatgtatttctacatggattgaatgtccctctggagtatactttatagcattgctgataatattcagcatgatctcctgtaactttgtctgattacagacaacataatgatgtcttatatctaaatcggcatgatactgcaaattcttctttctgatatcctcttcaaacactgtatttaccctgtgaaataatgcatccatatcctcagcttttaattgcaataccgctgtaccgctttcaatccgggccatttccaaaatctgattgatgatcatcaacagaagattactggaagactgtatcttttccagatattcttttgcctttttttcattctgcagattcttctctaacaaaccggaaaaccccacaattgcattcatcggagttcggatatcgtggctcatattgaataaaaatcttgtttttgcctcactggcatttttcgcctgttcagcagattttttcagttctgcttcatattgtctttccctgtgttttttgctgaatatcaaataaaatactgtagcaaccaataatgagtatacataagaaacgacaatacacataatccagtaagaacgtggaatccatccctttgaagggataatgtcaaaataccatgtgttattgggaactgtacattctactgtcagaatgttgtccggcatatcatcctgactttctgccagaataatcctgtcgttgccgtctctatcatatgtccagattctgtagcagaaatctgcatcacttaaataatcaagatttatttcatcaatgaaacgattccagtcaatcaccagaatcacaaatccccagaactcccttttgtctgaattattatcctgataaactggattaaaaagcagtgctcctgttcctccctgctttaactggtatggtccccaaaaagaaaaaagatggctaacgacaaccatcttctctctgttctatattataatgataagaaaaaaacagtgctttacttcacacactccataattatcgcttcacatctgtcatatccaagctgtgaactgttcaggcacaacgtgtaattgctggcttttccccatttttgatccgtataaaagttataatttgtcatacgtcttttatctgtgtctgccatcattttgacagcttccttctcttctacattatgtaagtccatgatacgttgtattttttccggcatatccccatgaataaatacattcaatacatcgttccaatctcttaggataaaatctgcatttcgtccaataattacacaagactctttttctgccaattccaatataacctttctctgtgcctcatataccatatcctcaacggattttcctgtaatatcacgtccggcaagtgcataggcaaataatccttttttgggagatagctctgcgctttcctgaatatattctggtgataaaccagacttttctgcaatctcactaatgatatttttatcatagtaagtaattccaagtttttttgcaacttcttccccgataaaacgtccaccgcttccaaattctctgctgattgtaataattctttttgccatttccagttcctccttaatttaaaacatcgaccttattttttctgattttctttaaaaatacatatcctgccagacatgcaatgacttcggtaatcggaaacgcccaccagatcagggagactcccatctgaccatttctgacaaataaagaaaagactcctgccagtggcagaatgataataagctgtcttagaagtgaaataaccaatgattccataccaccatccagcgcctgataaattccctgataagcaacattaattcccgcaaacagaaaactaatagaaatcactctcatcgcactgataaaatattctcttgactgtcctgcattaaacagcgttgcaaaagctccagggaaaatctctgtaattgcaattcccaaaaccattaatacaatcgtatagagaagcccatatttgattccatcctgaattctttttttacttctcattccataagcaaatgcaatgattggagtaatcgcatctcgcagaccaaacgcaaggaagagaacaaactgctgaactttataaaataacccataggctgtctgcgctgacggattgaacttcaaaatcagattcattacataaaccataatagacatcagagcctgagcaataattgccggaagtccaattgcataaatttcttttataataccagtatccggcttcatatatttcgcatcatgttcaaattctttattcaatttcatatgaaaaatgaacagtaacactgcggatgctagctgaccaattaccgttgcataagctgcaccttttacacccatttccggaaccggaccgataccatagatcataattggatcaagaataatatttacaactgcaccaaccacctgtccgattgtagaataaagagaacgacctgttgcctgcaataacttttcaaataatgaaaagaagataataccaaaagaaatcacgcagcatatcctcaaatagctgactcccatctcaagcacttctatatctactgtctgcgatgaaatatatgcttttaccccaaagataccaaacaagaaacaaaccacataaataatcacaccaagaaacaagctatttcctgctacctttgcagcttttttgctgtttccctgtccaagtgtccttgcaagaagtgcattggttcctacacctgttccgattcccaccgcaaccataagcatctgcaccgggaatacgagcgtcagtgcatttaatgccgcttcactgcctactctcatatttcctacaaatgcactgtctacaatgttatagaccgcctgcaatgccatagataggatcattggaattcccatctggatcatcagcttattcactgacatatctttcatcttgttacttcctgccattttgttttagctcctctctttttgcacaaaaaaagtgtgtgccttgtcatataagctggacttacgctgacaggctacacacttttttacgcaatattagttttaacaaaaaacgagcagctggtaaactggatttacgcttacttgctactcgtttgttataattatatttcctgttttttaaaaagtcaaataaaatttttcttattcttcaagtacctttattgtaaatgtccttatcggcatcgcaatatttcattcgagttgatagttattcagcatacagcttccttaccattctttttggaatcacaaaaccattatcagtgttcctgctccaattaaaatgcatccgatcaatgactttgtcgtaaatgtttcatgtaaaaatacaaacgccaatatcaacgtaataaccacactcaatttatcaatgggaacaaccttagatgcctcgccgatctgtaatgccttataataacataaccaggaagcacctgttgctaaccccgataaaatcaaaaacaaccagctttttctgctgattccagaaagaccattttgcgcattcgtcagaaaaactattccccatgccataataacaacaacaactgttctgattgccgttgccagatttgaattaactccattgattcctactttcgccaaaatggaagttagggcagcaaagactgccgataataatgcaaatataaaccacatatgttcccctcctgccatatctgctttttatacttttttaataatacatcattttttattcattttcaaactatatagtgaagaacagtatcttttttgttttcccttatgctataatactcaaaaaatatatacaggaaagtgagacaaacatgaataaactctacaaagcaatcgaagaaaaaataaaggaatctggttacccaaaagaaatctccgggagagatgtctataatgatatttgtgaccagattgaagacaaagaaaacggaacctatctacttctatcaaaatttgaagaagatgtcatttttgaataccatattaccattcaagacgacggatttaatcttggactcttaacaatacgcactcctgagggaatttatcagacagattttgattcttaaaagtacagaaaagcattctctttttgttcattctttctctaatgctagacatttatcactgccttgtccaatttttggatattgtcatttattttgtccattgttcataaaaatgatatgaaataaaatagtgttaaatcgcttccggctaaaaaatacggaacataaggaggaagttaagatgaatgcagcaaatactttaaaaaaacttggaattgagcagacctttaactatatttacaaagatccggacaaaaatatgaataagataatggactgggctgataaattttctcaaggtcaattcccttctcagagggaaatgattcgcgaagcgatagagaatccggaacatccctattactcatatatccgaaaactctttaaagatgttgatcctcacgtgacaaaaacactggcagttaattttttcatcaacgcagctttaacaggctggccaaaagaagaaaaattacgccaaaaatataattgtaatattccttgggcaattcttcttgatccaacttctgcctgtaatctgcactgtacaggatgctgggccgctgaatatgggcataaattaaatctgacttatgatgagattgatgatattatatgccagggcaaagaactaggggtatatatgtacatttataccggtggtgaacctcttgtccgaaagaaagatttaattaaattatgcgaaaaacattcagactgtgttttcctgtgcttcacgaatgctactttaatcgatgaagattttgcaaatgaaatgcttcgtgtaggcaatttagtccctgctatttcgctagaaggatttgaagaagcaacagatgaccggcgtggaaatggcgtatatctgaaagtaatccacgcaatggaacttctccgaaagaaaaagcttatttatggaatatcctgctgttatacgagtgcaaactataactcgatcacttcggaggaattctatgattctctgattgacctcggtgcatatttcgtatggtactttcactatatgcctgttggaaacgatgccgcaccgcagcttcttcctacgccagagcagcgtattggtgtttatgaaaaaatccgtaaatatcgtgccacaaaaccattatttgcaatggattttcaaaatgatgcggagtatgtcgggggatgtattgccggtggccgccgctatttacatattaatgccaacggagacattgacccttgtgtatttatccattattcagattctaatattcgtgaaaaaacactactacaggcactccgctctcctatgttaatggcatatcatgcaaatcagccatttaatgaaaatatgctccgtccttgtccaatgcttgaaaaccctcaaaaacttcgggcaatggtaaatgagtctggcgcacattccactgatctacaatcaccggaaagtgcagagcatctttgtgctaaatgcgataactatgcaaagcattggaaagtttccgcagataaactctggcaggaaaataaaaaaagaaaaacgtcatctatttccttaaattagagagcatcctataggcatcctcataaaattttcctaaatcgaaggtcgcatccctttctaaccattcgaggaggctgccaacaaagaaacacttataacattgtataagtgtttctttgtcctgctctgaaatatttcttttttccttcatctcattcgcataagtacagatgatgtgatatgctatctcgttcatattggataaaagtttttctttttcaacagaacgaaataaatgaagcattgccttttttctttttgtacactcctgtgccatataggaaagacaattcactgatttctctgatattgcatattcttttataatcccatccgcccatttttcaatagaattaatcatcaaggatgggatatcctgaaaatgataatagaaggtatttctattcacatcacatcgacttacgatatcatttaccgtaatcttgctataggccttctcctctaaaagttcccaaaatgtatctgtaagtaattcttttgtgcgcttcatcttgtctccttattatattttaaaaatcttcctcttttcttttatttaaagtgtaatttataaaaatcgaaccggctgataccagcactctacacaataataccacaaaaaatccaatagaaaacggatgacttattttttctcctaaaatcgttgttgttacaatactcaacaaagaacctgcaatacctgcaatcaaataaatatcatatcttgtattacaggctccaaaatacaaactgacaatatctcctggcaaaacacctactattcttgtaatgaaacaggcaaaaaaagtattttccctttgatattccataattttttgtgtcttaggatacttttcctggattctctgcacaacttttttcccactaaaatatccaatcagatatggaatcgtaagtgtaatagcaagaccacaagtactaacaaacagtgccatgaacggcgaaaacaaaataccacttgccagataaagtgctgacagtggtaagattactgtaagactttttaaagcaaaaaatagaaaaagtaccgccaccgcaagacatatattttccggtgtatatttcaaaactgtttttacagatattggtccctctgtatttctcataaccacaataagtataactataattataccaatggcaaaagccggtatcaacatttttatatattctttcttttccataataacccctttcctttttcatagcagaacttctttctcctctagtatgaacaaataatggctatctttcttttaaaatacaaattagaactcattttgtttccatattttttaatgctaacaaatatttgtatcacagaaaagagtcaattattctataaatatccagtttttatgcacacttctcattttgtctaattttataaaagataaaaaaataaaaatttttatagcgattttttgaatttcctactataatggaatctgaatattactaaaaagctaagaaacggtattatttatactacattaataccgtatcggaaatggaggcagcatggaaatcgtttgtttagacttagaaggtgtattagtaccagaaatctggatcgcatttgcagaagaaaccggaatccctgaattaaaaagaacaacacgagacgaaccggattatgataaattaatgaagtatcgtcttaacattttaaaagaacatggacttggtttaaaagaaattcaggaaacaatagcaaagattgacccaatcccgggagcgaaagaattcttagataaattaaaagagctgacacaggttattatcctcagcgatactttctcccagtttgcaggaccactcatgaagaaactcggttaccctactatcttttgcaactctcttgttgtagcagataacggagaaatcgttgatttcaaaatgcgttgtgaaaaatccaagtatactactgttaaagctcttcagtctatcggttatgacacgatcgccagcggagacagtcacaatgaccttggtatgattcaggcaagcaaggcaggattcttatttaagagtactgatgccatcaaggcagaatatcctgaaatccctgcttatgaaacatatgatgaactttatgatgcaatcaaaaaggtgattactatttaattcattaggggaaacagacgaaaaaagaaataataccatatcccatctgctctgtagtcgctgtgtttgagatgctcatccgcatcttaaacacgctccgaagccgcatctgggatatgggattatttcttttttctgttttttggcaggataaggggggagaagtcagaagtcttctacttgctcggaagatatatcgtccagacgattattttctttctataacgagtagaaaagaaaaagagcttatcattttacaaaaaataaagtaatcacctttagagttatcttgctacgagatgtgcatcatgcaacgtatgcatgcattgataaaaacaatatattgcgacaatataatgataaatgtatcatgtacagcgatagcttgcagtatcatcttatcatcagtgaaacttaaaaaagtcagcatagtggagagaccatcgcaactgtataatgtgagagcgagtaattcaagtcgagcaactgcgagacttgacgcgtgattctggtcaacgtaagctgacatattctttacagaatcactgcgcatcctcgcggagcgtttatctcagtcggagattggactcccactgagacaaatttgctgtcactcaccactgaaagaggtgggagtcttctcgactgagataaaattccatgacagagatatattccgaacaatcggtagacttctaccctcttccccttatctcccccaaaggctattgaattcattccttctgcagccagcaagcagaaaataaaaagaatagaccataacaaatgtaatgtgagagcaagtaaaaatgccgaacaggcatttcctacgcagtgatatctttacatttgttatggtctattctttttattttcgtctgctttccctaatgaattaaatagtaaagcccatttttattgcattttctaagaattctttatggtcttcgagatcatcttctccggcaaggccaggacaaagaagtgttcctcctttatcaaaatgcagtaactcacaaagctgttcataagcatgaacaacatcattaaacattgctggatctggattggctgatgccgcaatcagatataattctttgatatgtaacgtttctctaccttttggaaaactgaactgataaaaacggtcaatagctctctttatctgtgatgtaaatccactccagtaaatcggagataccaatacaagaacatctgcctgacgcatgagttcattcatttgtaccccatcgtctttctgaccgcaataaccacgttgttcacagctcttgtccccggaacaaccatgtaaatttgcagtagcagcatcaaaaacttctacttcattccctgctgctacagctccgcttgcaaatgcagttgccaaagcgtttgtgttacccttttgtcttggacttcccgtaataatcaatacttttttacccatttaaatccctcctttataatagtattataacactataaaacgatggaagcaaattacaacttaacacaatattaaacttcctccattttgaatgatttttgttctccaatcaatatctaattcttcatcggataaaatgcctgtataatctactgtatcagcatactttacaaaactcctttttcccattttcgaatgatcaactaaaagataattctcgtctgaattctcaagtacacatttttttacggctgcttcaatttcttctgctgcagatgcaccaaatatcggatcatagctgtttgaaccaaaaaaagctttattataatgaaaacgggacaaatattctgcagttgcataatcaagtggccctcctacagaacgatacaaacctggtgccatgtagagatcaatgttttcatctcggtaaacagtttccattacaggtactgaattagtaatgattttcactcgaaatgctggcatataagtaagaatctcaagtacagttgtactggtatccataaaaagtacatccccttcttttataaaggatgccgcttttcttgcgatttttcttttattttctgattctttaccctttctcaaagaaaagctctgacagcctatattttgtctatctaaaagtgctgccccgccataatgaatggtcgcatatccctgttcttctaacaaatgcaaatctcttcggattgtcatttcggatacaccaaattgttcagataagatttttacggtaacttctccatgttcccgaagttcattgataattcgttctcttctctttactccagataattcttttttatattccatctgttatttattcctttcaaatataaatatcatttccgaaattatgtattttgttaaagtatatttccttgtattgatttaatattgctgtttaaatgtctttttttattatatctccactaaaatgttttatcaaacattttttgttatgttttcaaacaaataaaacatattcaaacgtttacttatgtttcttttaatgatattctagtctcgtcagaaagacatggctaattttattaaaggagacaccacatatgagaacatataaagctgtttttagcgacattgacggaacactgttaacatcggaacatatcgtatctaccgctaccattgaagcgattgcttctcttcagaagaaaaatattccttttgttattatttcttcccgaagtgcttcctgcatttatcccattttaaaaaaacatcatttccaatgtccgatcgtggcatgtggaggtgcatggattgaggatatgaacggccggattctttcaaatgaaggtatgagcagacagacagcagctactgttatcgaatttatgacagaaaagaatttcgatctcgcatggggcatctattccggaaagaactggattacaagtgacagaaccgatgctcgtattctccatgaagaaagtgttgtggaagtagaaagcgtagaaggaactgtcgctttattgccggatgatgcggtcgttaataaaattctctgtatgtgcaaccctgcgtgcattcttcagattgaagaagatttaaaagaggcatttccaactctatccattgtaaaatcctcaagttacctgttagaaattatgccagccggaatgaataaagccaaaggtatccgcaagttctgcgaaatttttggcattgctaccgaagattccgtagcatttggcgataattacaatgatttagaaatgctttacgcagccggttgcggtgttttaatgggaaatgctccagcagctatacgggagacattccctggaaaagttactcttgataataatcatgatggaattccggttgctctcaaagatttaggaatgatttaattcgttgagataaactgacgaaattctatgatacactaaagtgtatttaaaaacatttttttaataaagcacaaggagatttacactatgaaacttgcatttatcggaacaggaaaaatcattgcagatgcattatttgcaatcgaaccaataaaagaaattgaaaaaacggctatctttgccagacctcacagtaaagaaaaagcagaggcttttgcaaagcagtataatatcgctgaagtttataccgattatgaaaagttacttactgaaactgcagcagatacggtttatatcggactaatcaacagtgcacattattcttatgcaaaggaggctcttcttcacagaaaaaatgttatccttgaaaagccttttactggattttataaagaagcacaggaattacaacaaattgcagaagagaataaattgtttatttttgaggctgtaacggtacttcacaatgaagtattttatgagatgaagaaaaatgttgaaaaacttggtactgttcgtatggctctttgcaattattcccaatattccagtcggtatgatgcatatttggaaggagatatcacacactcttttgaccctgcatattatggcggtgcactttatgatattaatgtttacaatattcattattgtgttggattgttcggtgaaccgaaagatgtcacttactatccaaacatcggtccaaatggtatcgatacttctggaactttggttcttgtatatgatggtttcagtgctgtatgtaccggaagcaaagattctgacagcccaggatatgtttccattcaaggcgaacaaggctttatgaaaatagacagcaaaccaaatattgcctccgaacttactaccacttacgttgatgaaaatgtaaaagaacgggttcgtgatgctgctggtgctatggttcgtgctacaatcacagaccactttattgcaacagaacagcaccaccgtatgactcaggaatttttagattttgcaaaaatcattgatgaaaaagattatgaggctgcatatgagctattaacagaatcagtgactgtagtaagcattcttgaaaaagcccgaagcaaagctggaatcaaattctgatttgtagatttggtgtagacgaaaaaagaaagaataccatatcccatctgctctgtagtcgctgtgtttaggatgcggatgagcatcttaaacacagcgactacagagcagatgggatatagtattttttcttttttcgtctataccaaatctacaaatcagaattcttcgtacattcttcgcaaagtccatgaagtaaatccccactacattgtaactgaaaatgatgctctgccataatatgttttcttaattcatccataaatccgcagtctaaatgcattacttttccgcattttatacacttcaaatgcagatgttcccggcaattcccctgttctcctgcatattgataaactgctttatcagaatttacatccgaatactttataataatattttccgcacagagcttatcaagaaaacgatatatggtcgttgtatttacactgatttctttttcctcaaggtgcctttttatatctgctgcacttattgtagaggaacagttttttttaagataatcaagaatttctgatctgtttttcgttgtgtaaggttttctttctttcataatatatatatacttccttttttgttcttacaatgatatctatatcgtttatagtcatgatttcatctttattttactcatgtttttctttttagtcaatgttcaccagaagaattcaagatgaattaaattgacaatcttctatattatgcataaaataaggttaagttttctgaccgactgttgaatcaacaaaaatgaaatcaaacgaactatttgaaaaacaaacagtttgtctattcaagaaagaaagaaagagagattttaatatggtgttacgtcaaatttatgcattatattttagtcccacagggagcacagaaaaaatagtatcttcaatcgctgatactttatccagatcattggaacttccggtacatttggttgactttacatatttagaaaatagacaaaaagaatatcattttccaaatgactctcttgtcattatcggtactcctgtctatgctggaagaattccgaataagattcttcctgatttcaagaaatgtatcgtaggtgcaggacacactccggtgattcctgtctgtgtttatgggaatcgtaactatgatgaagcattgcgtgaattgttgctcctatcagaagagaatggatgtattcctgtggctgcggctgcaatgataagccagcatgctttttctgacactcttgcaaaaggaagacctgatattcaagattttaaaaaactaaattccttttctaaaaatatcgcacaacttttgaaagacgattccactgctgtggcaatagattatgaccgcgcaactcctcttgccccttactatacaccgcttaaagcagatttgacaccggcacgttttttaaaagccaaaccacttacagaccttcaaaaatgctctcactgtggtctctgtgtcagaaaatgtcctatgaacagcatttcggaagaagatgtttcaaaggtaaccggcgtatgcataaaatgtcaggcctgcattaaaatctgcccggctcatgcaaagtatttcgtagacgaagcgtttctttctcatgtggaaatgttagaaaacacatacactgaacgaaaagaaccaacctttataattacaaactaatttctcaaaaaatactagataaaacaaatactaataggagcaattcacatggaaaaatcagttttagatataatatatgcttcgttagacagcttttttgaatccgaaaaaaagattggcattccggcggtatccggtacaatctgggaaacacaaatcggctatacttataatatgacagcagatgatgttaaagttatttcttacactatccctttaccagtatgttgaccgaaaaacaacaacaggatataataagataaaaagggcggaggttacttatgaataaatatttaaaacgtactctggttgtttccacgatcatgattattatctttgtcataattatggtctggccacttcctcttcgtaaggttcttagaaaagaagcagatacaacagctatgacagtcagcctgtctgaacatgacacaaatgtatcttccttttctctgtctgcgaactctgtagaatatcgaaaaattatagagattcttgaagattacacatatcactgcacctggtacagttttattccccatgaatcttttaccggacatggagagaatctgattatttatacaggggacagcggaattattgttgatgttgataagggacgagtcttcgttgacaaaggaaccgcagaacatacctatcgaattgattattttggacataatgatgcagcacagcttgcagcacaaataaaaaaagtattaaaaatctaatctatcgtttacaaaaacgaaataaaataatcctcttacagcatttattttggatggttatacttatggatactatttgtattataaatccacaccagaattatctgctataaggggatttttttaatattttttcagaacaatttgtaactttgtcttttgaataaatttcaacagattctgtatactatggttatcaaaaatttaaaaggagaaaccaaatgcagacagattctacaaaacttacagataccgcaaaacttttaaaagaatgcgatgccggaactaaaatggcgatttcatctattaatgaaattttagagaaagtagaggatccaaaactaaatgaaatcctcacccacagcaggaatgcacatgaacaattagaatcagagattcattctcttctcaattatcatgaagaagaccaaaaagaaccagatccaattgcaaagggtatgtcttttattaaaacaaattttaaaatgggtatgaatgaaagtgatactactgttgctgagcttattactgatggctgtaatatgggaattaaatctttaaataaatatttgaatcaatataagatggccgatgaaatatccaaaaaggttacagaaaagctcatccgccttgaagaagatcttcgcaaagacttaagaatctatctttaaattcattcaccacagaaaaaatgaaaatgaaagacccgccggaaatgaaacacaaaagaataaactcacttccgacgggcatatgcaaaatgcaaagtactattgtattatatattttttcttatctattttcaatactaataacatgaaatgtcgatttcatgtcatgaacaaccatttattattcattatatacttgcaaactaccaaaaatattatataatataaactatatttataaagaaaagaatactatataatataaaatagattttagggggggaaaaattattttatgatttcaattgcaatttgtgacgataatgaaattactactcaggaaattgccaaaaaggtggaacaatactgtcctgtcgaaactgaattttctatttttcatcatcctaaggatctcctagattctatgtatgccaaagagaaagcttatgatattattttaatggacactgaatttgagtccgcttcgggtattgaggctgtaaaacagattaatgcctggcatccggattcccaaattatatatattacgaatcatgttacttatttttcttctgtttatgaaacctctcacatcttttatattttaaaaaaagatatagataaatatcttcaagctgcattgaaaaaggcaatccgtcatctaaaaaagataaatcaactttatttaatcatccatacaaaacagaatgatattcgtcttccacaaagcaagatattatatttggaacgaatcatgcgcacaacaaatatttatacagcagatggagtctatcaaacgccggaaagattagattctatcagtgagcgcctttgtccatggttttgtctctcccaccgcagttatcttataaatggacggcatattataaatttagaccggcatcacgcaatcttatcaaatgaaatttccatccctgtgagcagaacctgctatgaaaatgtaaagaaaacctttgccggatgtgtctggtcagaagaattttacactacataaataagatttttcttgacaatatattatttaagtgataacatatagaagttggttatgcagttttaataactgttaacatctgccgctgtggcggaattggcagacgcatacgactcaaaatcgtacgggaaaccatatgggttcgagtcccatcagcggcatcatttttttttagtatatagtatcatatagtacaaaagtatttgcagagttttttagataaccgtatgttttatctaaaaggctttttttattttatgaaattatattcttttaaaacaaaccgctccgcaagaatgtgtacttctaaacatagtttaaagataaaagctgccgcaatagcgacagcctcttttaaaaatactttttgttcccccacagtcctgctttctttaattcaatatactgctggtaggcatcttctaatatctgccgttcgttaggaaatcgaagcaaatgatacgcttcatggtacttatagtagccggaatcttcaaaatattcttctttttgaggcttggagtaatagctgtcagccatcatcaaataccaatgcacctgttttacaacaacatcatgtgccgtattaaaagtatactggctctttcctacatactttattgcagaagcctttactcctgtctcttcatgaacctctcttaaggcagtttctttatattcttctcctgcctccactgttccttttggaagaacccatccgtcatatctgttcttataattcttatataacagaagtatctttccccgaaatattacaacaccaccgcagcttgtcgccttaatcattgctctatcctcctgtgctgacaattctggtgtgttctacacttatattaagtataccaaatcgacagaaggtttgcaagaacagcctttttatacagatcttattcatctgactgtgcagtattctttttttctccgtagtactctttcatattattattataataggagttaaatatctttttcgcaatgggaactgcatatttacttcctgcacctgtattttccacaagcacacaaactacaagatccggatcttctacattagagtaccctacaaaccatgcgtgagcatatttcccttcattttctgcggttcctgtctttccggcagcggtatacaggtcggtgtcaaggctgtatcctgttccatctgtaactacttcacgaagcattttctgaagctttttagcatcctttttagacataaggtctgcatagatttcagggatattttctttgacagttgtattatctgcaccttctatatgatctataacatatggtttcataagtactccatcgttggcaactgcacacattaacagtgcattatgaaacggtgtcattagcgtatttccctgtccgattactgtttgtggaatttctcctttatcggaatgttcatttaactcaaaacgacttttctttacagacagatcaaacggtatgttctgattaaaaaggcactttttattcaaagctgcaaactgctttatatctaatttacttccaagtgtaacaaaggcagtattacaagattttgcaaatgctctatccaagtcaacttctccatgttcttcgttttcatagcagctgatccgtacactatttataatcgtttccccctcacaatcataactgaactttttataggtggctggacgctcttccatatactctaaagccgtcaatattttataagtggatcctggaggatataatccctgtgttgccctatttaaaagacagctttgtgaagaatcagacgtaatcttattccacatatcatctaatttattagggtcaaagtccggcttagaaaccagcgcccttactttccctgttttcggctcgatcgccaccactgctcctctatgatcatctaatgcctcatatgctgccttttgaaggcgggtatctaatgttgttatgacattatccccaatatttttctggcttgctacaccgttactaagctgtttcattaacttttcatgagaagtcagcaactctttattacagaccgcttcaagacccgcttttccataactggtatatccaataatatgcgcaaacatattttcataaggataatgccgaatctcatctcctgcttcattgttctctgaaaatgcaagaatcttatcattggcactgatgatcttgcctctctttgtctgctctgacaaagaagaattccttttattataagaactctccgaaacttttacactatcttttaaagtaaatcttactacatatccagccagacctaaaaataaagcaactacaatcacactggtctgaagcatataccggtttgtttttaacttttttcctcttcttggagtaaaaatttcttttataccagaaaaaccttctctcttttgattatgtttacgagactttccggctgctactctattttggctggttactctcgtttttcttgtttgattgctcttcttcatcttcatcatcctctttataggcaatgataaatatgccctgcattactgcaaaaattattaaagtactcgctaccgaacttcctccatagctgatcagtggcagtgttactcctgtagacggaataaactttgtcacaccaccgattgttaaaaacacctggaaaataaaacaaatagaaaaaccgtaagctagaagcttgtagaaacgccctcttacatccattgctattttcaaaaaatgtacaaacacccctaaataaatcaaaataagacagattgcaaaaagaattccaaactcctctgtgattgctgaaaaaataaaatcactttccacaactggtatatcatttggtcttccctgtgtaagaccctttccaagccagccaccagcagcaatcgcaaataaagactgtgtaacctgataaccgcttccttctattactgaccatggatctttccatgcaataaaacggactcgcacatgtgcaaaaagcatatatgcaagattagccgctaccgctccggcaccaagtcctccaaataaataaattcctcttcccgtagcaacatagcaaaggaaaacatatacaacaaaataaataagtgctccacctaaatccttctcagcgatcaatatcatgacatgacaggctgaaaatattgttgtgataagcattgttttaaaatctggtgcttttgtcaacattgccgcaataaaaaacacgaacgatatctttacaaattctgatggctgcaacgcaataccatgccctagtgaaatccagtttgtcgcaccattttgtgatgtaccgattacaaatacactcgctaagaacaaaagacctaaaatcccatatacccatttcagacgtttaagccctgccgctttttgcataaaatatggaataaataatacgataactgaagttcctgctgcaatggcaaactgttttaccgccttatcaaaggataagcgagtcagcataacaaaaccgatcagtaataaaaagcatgtgtggttcattaaaattctggagcaatctacatatactctggaataaatgaatataagcagtttaaaaaaagcaacctgtactgcatacaaaaaaatcaacttcgtatctaatgtttttacgaacaaaactccataacaaataaaatggaacaaaaacataaaaagttcctgcctgtccatcctttttgcctgtaccttctcagaagacggaagaaaaacggtaaaacaggaaattgcatagatgacacccatgatgataataatataattggatcctgttgaaattaaattcaccatactttctttcccacctttctattctataccgtagttccagtgatgttctgtatcatccttttgaagatcacacataaaatgattctcctgccagatcagatacctgtctttcatctctttgatttccttttctgacatatggaataaatcaaatctatgccttgtaacataaggaatacttcccgtaaggtcttcaccgataagatcatatggtttatcctgccagatcagattataacattccctgcaatgtgttgtaactggaagctttcttccttttttatcttcaagccatatttcttccgaagttttattacaatgtccggttgtctttttcagacactgtgttgactgcattacaggaattcttccatgaataagaacttcaaatgcttctttcttctgtatatcttttatatttcttatatgttcagccagtcctaaacacttctcataacagtgttccagcatcgcattaacttctctgccggacaattctattggtatctccctcactgtcatctctggatacagtgccgctgtttcagatactgcactggaattccagtgatacagagaagctgctgcgataatcttcgctgtgcggcctttcagttcatgcaaaaattctgcttcatttatagtatatgcatatattccattccaaatagaggatacacatactttttctaaattcaaattagttctgaacacacgtggtaaagctaaataaacgttcttacctgcatctgatactacctgaccaaattgcagtaattcttcctctgagaaaaattctgaagtaagacagatcccctcaaaaaaggaatctttgcaacatatcatacactgttccccattataaactgttgcaattctttcatcgatagatatttttcctgtgaaattctctgtaaaatcttctttcaagccttctttctctaaacatacgatcttatttattttattattttccttatccttttcattattttccaatacgcttcttctcttcgtattcttcaatctttcttctaacaaagaaaagcctttttgccgtacagtttttaatacagacataggaaggaaacaatcttcctccatattcacctcaaaattctctaattcaaacggaactgttcctgttttatgcatctgccttaaaatatcttcttttgtaacaggtctcttcttggataattctacaacaggcccttctacaaacgcatattcttcacgacaaaacagctggagcatcagcggttctccaacttttaaagtaatatctccgcttaccggatattttatcactttatttaaaatattttttccgatatgctctgcaagctcaatattcttccttcgatataccaacgttccctctttcagtccctgtgtccttggaatatttaatgtaatctgtccctttttctttccatcttcctgacatttagatggtaccgtaagaacaagttcctcctgcctatccaaagataccggtataactagaatatccttcggatgtagtctgtcttcataggaaatcctcactttatttttagaaacagaacatacttcgccaattcgcctgcccgtattcttaggagaaagtactgacatcatattctgcccattatgctgtttccagtaaccggttgtaaagcttcctctgcaatataattcttccagcgcatgaatatctgattcttctggtttaaaatgttctctctcttcccagttagcaaaaatttgatcgagatactttctataaatagaagtaaccccagctacatattctacattcttcattcgtccttctatcttcagggaatccaccggaagctccattaatgaaggcaatagagaaagggaacataaatcctttgggctaagtaaataattcccctgttttgatgtatgcagattattgccattatgatcttttactttatatggcagtctgcatggctgtgcacatctgcctcgattaccgcttctgtctccatacacactacttaaaagacactgtcctgaataacagtagcataatgctccatgaacaaaaacttctatatccagtcctgtcttttcttttattgcctttatctcctctaaagatagttctcttgcaggcacaactctggtcattcccattctttttgccgcaacagctccatgaatatctgttactgtcatctgtgtgcttccatgtatctctatctcaggaaaatgttcacgaataaaacgagcagctcccatatcctgaacaattactccatctaatccattctcatagtaagggaaaagaaactctcctaattcttcaaaaagttcctcttccttcatcaaggtgttcacagtaagatataactttcgttcatgaaaatgcgcaatttgcaatgcctctatcatatcttctctggaaaaattctgtgcgtaggctctggcaccaaatttctctccgcccatatagatcgcatcagctcctgcggataccgctgcctttaaatgttccaaagaacctgccggagcaagtaattccggcaggttccctctcttaacgaaactcatggtttgtctccagtccaatcatacgtttttgtaactcattgacctttgtcttataatcttctaccagcttattcgctgtatcaatctgcagctttttatctacgacttcctgctttaattcataaagctcctgttccctgtctctgctatcctgattaaatacttcaatctcctttttcagcttgaacacttcttcggcaatagtaagtgccagtaaaatatctctatactctgtagaaagcttattatatcctgcctgtgtttttaactcgcttatcttgccatcgacataagaggcaagtttctgaagataactatcacttccaccggacagtcgatatactttaccatcaattactactgataattctctttttccttccatattcatcattcatcctcctgtgatgcaaaatcagatcttctctttaaaatacttcctccggtaccggatagccaagatgttcataggctaaaactgttaatgcccgtcctctaggtgtacgtttaatcagtcctctctgaatcagaaatggttcatacacgtcttctatcgttccagaatcctctccaatcgctgctgccaatgtatctagaccgactggtcttcccataaacttttcaatcattgtctctaacagattgcggtctgtggcatctaatcccatagagtctacttctaataaatcaagcgctgtctgcgctacttcataagtaatcatcccatcatatcttacctgagcaaaatcccggactctttttagcagtctgtttgcaagtcttggtgttccccggcttctcttaccaagttccatcgctcctgcctcatcaatcttcacaccaagaagttctgctgaacgttctacgattactttcaactcctcatctgtatagaactccagacgattcaccacaccaaaacgatcacgtaatggtgccgtaagcattcctgctcttgtggttgctcccactaatgtaaaatgtggcagatccagacgaattgacttagccgaagctcctttaccaatcataatatctatcgagaagtcttccatcgccggataaagcacttcctcaacctgacggtttaaacgatgaatctcatcaataaacaaaacatctccatctgaaagtccattcagtaccgctgcaatctctccaggtttttcaatcgccggtccggatgtaatctttaagttactgtccatctcattcgcgataatacctgccaacgttgtctttccaagaccgggaggtccgtataataatacatgatccagtgcttctccacgcatcttcgcagcctctataaatacgctaagattcttcttcactttctcctgtcctatatattctgttaaattctgtggtcgaagactgccttctaccgcaatgtcttcttccataagctctgtgctaatcattctgtccatgacatcaccttacgaaaatgttaatataatttttaatgcttcttttaataactgctctgcatccattgtatctgcatcagatacacctcgcactgcacgataggcctccccattagaataccccagtgcagttaatgcctgcaccgtatctgaaatactgtctccatctcctgcctgtaagcttgctcccgtctcttctttcatggaaactgattccaaatcttctaaattcaacttatcttttaactcgatgatcatccgcttcgcaccctttggaccaatccccggagtttttgcgatactctttgcatcttcactgaataccgcataatataagtcttccactgtcatcgtagaaagtacagataatgctgccttaggtccaatacctgatataccaagcaaaatctgaaaagtatctaattcctgcatagaagagaaaccaaacaatgccaaaacatcttctctcacatacaaatacgtgtgaagcatgacattctctccgctctccatactgtcaagaactctggatggcactttaatctggtaacctattccatgattctcaatgacaatgtaatcatttcctttaaacgcaaccgttcctttaatatatgaaatcaaatgaaattcctgccttcttttcaaattgttaccagaacttatattctgacttctgacatgataccatagtttccatgatattacaactcttttactttaacgacatttaccttgaaaccttctgtaaaatctttcagaaatccgtttgacatataaaacgttctctgctatggttagtaagaaatttatacgacagcactttgcagcactggaggcatcatgttaacaatcaacaaagtattcccggaaaaaacaataccggaaaaaacagattcttttttattcttcgatatagaaactactggtttttcaaaagataatacgatcttatatttaatcggttgtggatattttattgaaaatggatttcaatttattcagtggtttaatgacgatggaacaagcgaagaagaaattcttcttgcttttcatgacattttaaaacaaaaagactggcagcttgttactttcaatggcaatagctttgacattccctatctaaagcgccattacgaattaaatgagttaccttgtgatatagaaagtttcccttctcttgacttttatcaatttttaaaaccatttcaaagtttatttcaaatgacacatggaaaacaaaaagattgggaacattttcttgaattatatagagaagatatttatgatgggggacagcttattgctgtatacaaagaatatctcatgaacaaggatgaggctttactccataatcttcttctccataatgaagaggatcttctcggaatgaagtatctccttccacttttttcttatcgtatgttactttcaaaggatctctctctcataaaggtttctccaggagaaagcctctttgagaaaggaacaggcagcattgcgatatcttgtaaacttccgcttgctttaccgaaaccattaaatttttctacttcgatcggcagtatctctaccgataaaaatgattcttctattttaatcatttctcttccttatatagaagaaacattaaaacacttttttaaagactatcgcaattattattatctcccggaagaagacagagccgttcataaaagtgtcggatgttatgtagaaagaaagtaccgccgggcagcgaaagcgtccacttgctatataaagaaggaaggaattttccttcctatccccaaaacacaaaaacattatggaattcagattaaaagatatccttatcaagattcttttcctctttataaaagagaattcaaaagtcctcgttcttttgcagaattcgataatctcttttctgataaaaatgaaagcctctctatctatcttagagatgtcataaaagaactttttatcattcatatacaagaaattaatgatttaatttagaaaaaaacagccaaaaacaagaatttccagccatagcaacatagctatataacggttggaaattcttgttttatgtttattgatgctgcatagcctgaatgtatttcagaaaaattgttctttaaacccacatttcttcttcaatccagtcaagtgcctcttcataatcttttcttgcttcttcaatctttaacggatcctggcgatcaagaatcctctcaaattgctgggttaccatctcaagctgttcacgaagttcacctgtcgtttcttcgtaaagtcgttctccccgcaaaagcagaactttattcttttcctgctctcttggtggaattttaaggtaagaaagttctttcatacgagctttcatctcttcttctgtcatactgttttcctgattctttataaggcgggttatcgtttctcctgtagagacaattttagcttcaacttcaagtaacgcattaatatcataagtataagtaatgtcaatctgttcctttccagcctcattatccggaacagtaagttttaatgttccaagagaaacattgtttgaggcaaatcggctttcgccctgtaatatgtgtatttccacctgtgtctgatgatcataaaccgtaaagaattgctgcgttctgcttgctggtattaccgtatttctctcaatgatcggacagaaatgatttccctctatatgatcattctccgctttaacagaaacttcggttccaagagtaaacgggcagacatctgtaagaatcacttcttttactgcttcttttcgttctttcatcgctgcctggattgctgccccaagtgcaactgcctcatctggattaatgcttgtatccggtactctgccaaataactttccaacaaatttacgaacaagcggcatcttcgttgttcctccaactaatacaacttcgtcaatttctccaggtttcacaccggcatccgaaaggcttcttcttaccggagttttaatacggtctaaaagctggctgctcattttttcaaatgcccctcttggtataagggtttctaccttttcaccacttaccgatgcctgcatacgataaaaagaatctgctgtattacatttacacttttctgcctgattacggtaatatgctttttcctttgcagaaagactctcttcatttattccatgttctttataaaattcttcaacaatcaaatttgtaaagtcttcgccaccaagataattatccccggcaaccgcccttacctcaagaatatcgtcaaacaactcaagaatggaaacatcaaaagttcctccaccaaggtcaaaaacaagaaaacgcgtattatcatttttctggtaaagtccataggcaattgctgccgcagttggctcgctgataattcgttccactttaagtcctgctaattcacctgcctgttttactgcttttctttttacttcattaaagtatgctggaacactgataaccgcttccgttacttcttctccaagatagacttccgcatcttcttttaaagaacgaagaaccattgcggaaagttccgttgctgtaaatgttttattaccaagtttaaattcttttcggcttcccatacttctcttaaagagatctgctgtctggcccggatacactgccattcgttctcgcgccgttttacctacataaacctgatcattttcatcaatactgactactgacggtgtcagtctttctcctaatcgatttggaataatttcaggtccatgttctgtatagtacgccgcaagtgaatttgtcgttcctaaatcaattccaataatcactgtatttcctcctgtaacatttttaaaatctgcgtttttcgatacgagatttctgtccattcttcctcatccatctcggactgtaaagaccatccttttttctcaagtctttcaagaatggcatacgccttttctaaatcttcccggttttttgctcttattgcaatatatcttgctcgaagaagttccagttcatcactgtttacttctcttttctctgccacatccaggatatcttttacgctgtcaagctcaccaaatatcagatacattcgaattaaagtacaatatggttttgcatgatatggatataatgtggttgctctttgatagtcattgactacttcctgatatcttccaagatacagacaagcttcctgtctcaaaagatatgccgggtagtactgcggatctatagcaagcatcttatcacaaatatcaaacattttagcatattctttttttctgcgccagatatctgctgccgtatggtaataacttactttttgtgaaacatctttttccgctgctaccgccttttctatgtcattcattacctcagaaagactgccttcttttccgtcaagaatcatatctgccttagcagaagcaatcgtataataagcatagccaagacgagccatctgccttgtcgttttcttcgttccatccggacgaagcttctgtatggcatgaagccacaaaaccagatgttctaatgccttttcatcttcatttactgtgagataaattcttccctttaaattatgatagtcaagggtatggctctcatccggaacaaaacgatccaataacgcaataccatcctcaaatctcgaattctgataatagcaccatgcaagttccatcagactatcctgatttaaatgattctccttatagtctggctctaactctgctataacatacacattcgctttgttaagatctgccactaaacgctcatctaccggactttcttcgagcagatcaagaattgcctctcttgcttcccgatatcttccttcctgaagtactgcttccatcctgccggttcttgcaagaaaagactgcggatgtgcttctaatactttatcatacagctctatcattccatcccattgattcttttcctggcaataccttccataacagcacacaatacgctcttcctgtggatatttttcagcaagctgtcgaaagatagttcctccttcttcctgcttcacttcctctttttcactgtaaagaagccttgccttctctaactttgtatatggatgataaatcgtatatttttcttccatgagctcatactcttgccaggcttctttttgcataccaagatccgcatactggcgaagtttatgataatgctctatgtaatcatcaatatcctgactgacttcaccttcaaataattcataatttaacgcaccgttatagcggacaacctgtaacaaaaaatcaacataaggctccggaaaaagttctagaagttcctttcgattacctgtaatagaaaaagtacgatcaatcttcttccatactgctgccggcaaacggaaatgttccatcaaaaatactaaaaatctctgccgtacttcttcaccgctttctaaactgatacagatatcttctgaaaaaagactctcccactcctgctcatcaattctccgataaaaatcattataaagctgttcacagcgaaaaataaaatcttcaactggtgacagccttttcttcttctcgtcttccttttgtctggcgtattttaatgcttcctcgtaagcttcccgaagaatcttaaatccatttggatcatcttccggatttacagtatgaagcttctctctatatgcttttttaatttctttttcttcttttgtcgcttctattcctaatgtgttaaaaaaatcattcatctttataactgcttaaatacttctcctatcttatcattaattattaaatctgcctgagaatctctctctgtctttgacttattaattaaaatgagatgacttcccttaaaataatcaatcagcccagctgccggataaacaacaagagaggttcctccaataatcagcacatctgcctgactgatatactgtaccgtttttgaaatgactctctgatcaagtccttcctcatataaaacaacatctggctttatcagtcctccacattcatcacactttggctgaccctcgctgttttttacataagcagcatcaaaaaacttcccgcaactcatgcagtaatttctgtggatacttccatggagctctaatacatttttgctgcctgccatctgatgaagtccatcaatattctgcgtaataaccgcacgacattttccctgtttttcccattctgcaagcttgtaatgtgccgcattcggcttagcatctaaagccatcattttatctttataaaactcataaaattccttattacgtctcataaaaaaggtgtgacttacgattgtttccggtggataatcatatttcatgctataaagtccatcggtacttctaaaatcaggaataccactttctgtagaaactcccgctcctccgaaaaataccagattatctgttccatcaataatttcttttaactgtctgatcttctcgttcataataaacctcctatactgtgctgattaatacgataataaaccagtatcttaccatatccatacaccgggcatctatgcgtgaaaataagtttggagcaaaataccttttgtccctcatatcataacatcagattataaaaataatcacattaataagtcctaatataagaccaataactgcaccaagatttacaatagcaccaagttctttattcataatcgaaagaaccagttcttcgacctcttctacctgcatcgcattaattctttcttcaactactaaagaaagtttcaaagatgaaagcaatgctggtagcttatcttcaataacttttttataaagtccccataaaaattccggatcataaattcccttctcttcaagaaaggctgtcacttccggcattggcttttcctgcagttctttcgattctttcacaactgcttttccaacatattctctggcattctcctgtatatatgtatcaattccatcttgtacctgtccggcaatcttttcaagaaaagaaccgccaagcatcattccaaacatagattccgaaagcttattctgtgcttcctgcatcactttatctacaataagctttcccggttccattgcaataatcttttccgaaagaaagtctgacagactttcttctgccgaagcgataaaattattaagtctgtcctcttcaactatatttgatatagaagaataaagcgtatcttcagatgctttctgactgcctatccagctttgcatatggcttttaaactcttcttctgattcttttgaaagaagcttctctcccaaatattccggggttaaaagctgtgtctccacaacatttccaaccgctcttgccagtcgtccctgtccccttgggataactcctggtgtaaagggaagtctcttcccaaatacacgaatctcttttcttggacggaataacatctttaccgcaatccagtttgttacatacccaatgacagccccaatcaaaggggttgctatatatttccacatactctttactccttttcttacaatatatcatatcttatcacaaatgcaagaatcaactcatgattcccttcttcttcgttcttcccaaaagtcctttaaaactttcccgtaattttgtctgttcactccataataactgtcccattcttctggaaaaagcttttgattttctctttctaaaaaacgttcatccatcaaaagaatcgtacctgtatcttgtgctgtccgaatcacccttccagcggcctgcaatactttgttcattcccggataccgatacgcataatcatatccctttttttgctgtctgtcaaaatattccctgattacttcccgttcattgcaaatctgaggcagcccagttcccacaatcactactccaattaaactttctcccgtaagatcaatcccttctgaaaaaatacttccaagaacacaaaaaccaatctgtggttttccttctttcctgcgaaacttttccagaaaatcttctctgcttttttcttccataaaaggttcctgcacaacaagttcagatactaacgcaagattactatctcttgctatctcatatactgctgaaagcatttcataggatgggaaaaagatcatataatttcctgtctgcttttctagagaaagctccagataacctaccatcttcctgtattcccattctcctcttcttgtatagcggctcgtcacatcttctgtaattgctaaaagacgcttttccttttgaaagggagaagcaatttgatacgcttcaaaacgattgcctccgagaagctgtctgtaatattgtaccggcaaaagagttgcagaaaagaaaatactagaacgactgttttcaatatattcctctatctgctctgaaggatccacacaaaaaagccgtaaaaaaaagtctcttcctcttttttcactataaatttcataaccgctgtccatgttatctaaaatcatataaaaatgactgattttaaaataaaactctacaatctcttctctttcctgaaaattatcgtgttctgtcagatactcttctaacggacctatcagatgaaaaattgggaagtacatcgcatccgcatttctatgcaagtgaaatcgtttctcttcatgaaattctttttccagctttcgaagtgcaataatacaattattcaattttttaaataaaaaacgattcctatctttaaaatactttttcggcaccttaaaatcactttttgcaatatccgcgctgtacatatctctggctctgtcaagaagattatgtgcctcatcaataagataaatattttgccgcaaacttccttctatcagactttttcgattgacatgtggatcaaatacataattataatcacaaatgatacagtccgaccatactgctgcttcaaaagacagctcatacggacacacgttatacctttccgcatataaaagaagattttctctgctgatgtcacaagcagaatccagtaaagcataaagtgcttcattaattctgtcaaaatgtcctttggctctctcacagctttccggattacactgcacttctttttgaatacaaattttttctttggctgtaatcgttactgctgatacagataatccctgtttttttaaaagctttatcgtatcttccgccaccgttcttgtaattgtctttgctgtaagataaaaaatattttctgccttttcttctcctaattctttcaaggctggataaattgtagagattgtctttcccacacctgttggtgcctgtaaaaaaatatgctttttgctttccatcgcttgataggcaatcgctgtcatcttcttttgacccggtctaaaatcaaaaggaaactttaattgttttatgctttcattccgctgttttcttgccgccacataatacgatgcccacattcggtaagaatctaatagatctgcaaaccataaggaaagctcttccatgctgtatacggaaaaaattctttttatttcttctgtttccaaatgacaatatgtgatctgtataccaattttttctaaaccgtgtttatgtccgtacatataagcataacactttgcctgtgcaagatgcaaaaaatctgcttcttctatttcttctatatttctgtaaacacacttaatttcatctacataaataacattttcctcttctaagttcatacggtcaattccatctgcccgtccctctaatacaagaatatacccttcttcctgccactccatttttaatggaacctcactctgataagttgcattctgggtccgttggattttacgatgcagccttcccccttcaagcattgcttctggattcgcactcagtgcggaacctgttgtgatacttccggttcgtaataaaaattctaccagatggcgcactgatgtttttacaatccccttctgataggacaacataatacagtcctccttttttttcgatgccttctaatacttttttgcattgtttcttatcttgaaaaatttcttttattattttccttaatatttttacgttttgtctttgtttttctttcaaatgaaatattatcgtaattattttattttttaattgttctttccttattcttccctataatttcaccttgaaattccatgtatctgacctttagagagatttaatgatatatctacataaaagaaaatgcccacaatgaggggcaaaactcattgtggacattctctgtataatactaacctttaacttaggggattactttaattataatacaacacttttctaaaaatttcatgccttcgtagtggaatattttgttcaatttcaaagaaattattgatattcgtattcatataacaacattctttcatttgaaacaaaaaaatagtcctttattcactccattttcaaatttttctgattcgtttccctaaaaaagattatctgtttatgataactgtccaagaattgcaggaattaactgcttctttctggatactacacctggaagttctgcagaactgctttctacagttgtctcaaatgcattctctattacttctttgcacatatcacctaccattaataattctgtggactcattaatgatatctgtcatcataaagaagaccatatctaaaccataagatgttcttacttcctccatataaggaaggagcttatctttacaagcagataattcttgtttattcattgaactgatctgtcctacaccaaagttaatgttagaatcattaaactttttaaaatcctgataaaaaatttcttttgcagacttctctcttaagttacttcctgcatcaaacatatctcttgcatacttttcaatctcaatatgtgcgatagctgcaagcttttctgcaatgatatggtcaattgctgtacaggttggagaacggaacattaatgtatcagaaagaattgcagaacataaaagacccgcaatcttttccggaatctcgataccattttccatgtacatctgtgtaataattgttgcagtacatcctaccggctgatttctgaaatagaccggagagtttgtctcaatatttccaagacgatgatgatcaataatttctaaaatttctgcttcttcaaaaccatctactgcctgcgctttttcattatggtcaacaaggatgagcttctttcgatctaaatctaataagtttcgtctagaaatcattcctatataattaccctgattatctgtaatagggaaatcgcggaatcttctctttgccatagtttcctgaatatcatctacataatctgttgtatggaatgtaatcaaattctccgttgtcatgaaataacgaactggcatactgtggttgatcagtctagccacagtgtaagtatcatatggacttacaatgattcgacagccatgttccttggccatcttacgaattgtctttgaaaccgttgctcccatacatacaacaatacactgtgcatccatctcaatcgcacaaagctgggattcataacggttacctaaaataaccatatcctgcggttcaatatatccttccatcatgtccggattagctgcggcaatcaaaacatgaccctcctcgaattcaccatcaagatcaccaacaatcatctctccgtcaatagtctcaacaatattcttatagcttgttccggctttagataagatcatattgtcatatacatccatatcagaataggcgatatcactgacagtgatgattcctgcaagtttatcctcttcaaggataggaagggaaacaatacgtgctccccgcatgatatcccacgcttttttaagagataaaccagcatccacaccttttgttttacgaatctcaatatctgtaacctgtggacggatatcattcacaaataaaggggcttcctgttcaaaataacgcaggacatactgtgtctcttcattaatatgaccggctcttgtagggatatacttacattcttcttcctgcttctgacttaattcattcttcagatatgcataagaaattgcagaacagatactatctgtatctggattcttatgaccaattacataaatattattcttcttactcaaaattcctgtatcctttctattatcttttatttatggtaatccatttataataaagagcttactctcttccaccatctataattgtaaacaaattctttctttttttcaattgtttctgatgagataatcgtttatattcctctctggaatatcccttgtattcaaaaaccgggacactttcaaacaactgacccactgcctgtcttgtctcttcttccaattctttattcttaaaaggcagcccacttaatctttcctgtagtttatcataactacatccgttcttaatcataatcaataaagttcttagcagaaccgttgcacgataataatttagtcccatcttatcaatgaataaattaccaagttcactaactcctgaccatctattatcgatcccggctgcatcgctgacataaattaaatcctcaattttaactggcttatatggtaattcctcatgctctctgatatatgtaagcaataaatcagcattctctacactcaaatactgaaagtattcattcttccctgtaaaatctttaagaatcaccccaaatgcccacatagaactacgacatttaatgaataaaataaactcttcataagaaactacttttttagaaacttttaaaaataaagaatataatgttctcgtctctatgaaaccataataatacatatatccagtaataatcttttcccattcctcataaacagacaatgctttttgactttttctgctttttaacaggaaataaaaacggtctttcatctcatctacaacgagaatctgatttggttcatctgaaatagaattgcccattcgatatgctaaaaatccaaatatctttaaatattcaacataattccatctttcttctgacatctcaacgacaggattctcccagacttccatcagaaaatcaagcatcattttgggcaacataaggagaacccacttgggttcagaacaaaattcttctttaaaagcagcaatatatgcttctttgggcagtccctcttcatattctattccaatccgtccaagaattgacgtcactgttgatacaggagtacttttcataacggtttctgcttccagactactgatatttaccttcgcctcgtctgctatatatctgtcctgcatattctctccaatcctctttgctgcctgttatgttttgatctatattttatagcattgacatgaaaacagcaccctgcaaacacaggatgccgcacacaaggcatactatgccttatagtaattcgtaattaattattacgtccacaacacttcttatacttcttaccacttccacatggacatggatcattacgtccaatcttaggtggcttaacaactgttgtagaacttctctgttccttatataactccttacgtctctcagaagttaaaagatcactccactgctctaaaccatataaccagtctgccttagcagcaaccatattgtaatagagtttctctttatcgtagtctaaagatactactgtattcgcatccatatcctcgataggatttggattctttaaactatcattaattccatctaagaaacctacaaaatatgtaagctccatattatatttctgtgccagttctgcaactgttccacttactggttcttctggtgtagcaagaatctgctcatatacagccttttcctgattaaaatatccaatccagaattcctgtccttctctggttctatcgtcatgactataggcaaattctctccaatctgttaataaagacatctttcttttcctttctttttaaacgattcccataaaatcactgtgcatatcctttatggtatcatatattacaacagtataccaaaatccccaaagaaattcaatatatatttttatttgcagggttaaaagaaacaataaacaaaaaaataaaaagaaaaaagaatctaattccttttgctctattgttgttgcagtaaaaatacttattcgtatttaaacatactcccaaacttgcaagccggatagattcttttttgtaatttaaatcctgtaaatcagcaaaaagaattaaaataaaaatacttttcctgaattattatcgttgattacatagtaagcggatgcatcttctggttttaagtaaatttttaaagacttgatatcgctttctttatggtcttcttcaacatactgctttttaattcttgctgtaatcgcagctaaatctgattcgttaccctgatactgtacatatacttctggttctgctactgctgctttcacctctgctactttttcttttacagtcttctcaactttttttgtaacttcttttgctttatctacaactttagcgccagtatcttttactgtctcttttgctgcagctgctacttctttaatatcagcatctacaactttttctttcttttcttctacttcttttaccactgcttcttttacttcctctacaactgcttctgctgctgtagttttagctgcaggtgcttttgttgctgcttttttctttgctgctcttgctgttgttcttgccatagttaattcctcctaatttgaataaggttttcttaatacatacgttgctattatacatcggaaatattattttgaaaagccgttttataaactttttactaagtttttctaatatactgatgtatcatattgtaaaataaaaccattatttagttaaaatgatgtttctttttatatagtaaatttttattatataaaaaaaacagcgctaccaggattcgaacctggaaatgctggaatcagaatccagtgccttaccatttggcgatagcgctatactataaatattattcaattataaaagcacgagacgggattcgaacccgcgaccctcgccttggcaaggcgatactccaccactgagccactcgtgcacatgatatgtaccttcaaaactacacacaaatcatcttttctaattgcaaatcttattgactaaagccggtcatctcgatccggctttctacgcttggtcaagctttcgaccgattagtaacagtcaactccacacatcactgtgcttccatctctgctctatctacctcatcgtctctaaggggtctctcactctttcgagtctggatatctcatcttgaggggggcttcacgcttagatgccttcagcgtttatcccttcccgtcttggctacccggccgtgcc

SEQ ID NO: 395 - DNA, 73119 bp, Eubacterium hallii
  modified_base (5455)..(5552): a, c, t, g, unknown or other
  misc_feature (5455)..(5552): n is a, c, g, or t
  modified_base (29519)..(29617): a, c, t, g, unknown or other
  misc_feature (29519)..(29617): n is a, c, g, or t
tcccttgtcgtcattcccttcgcatacatagaaagtacctgatcttcaatgtttgagatatctgtctgattctttttcacaatctgcggttcaaaatctccctttcgatctcgtggtatatccagattgatcgttcccattgaagaggtgactgttttaggactataaccattacggctatcgtctgtctctttgttcttgtagtcatacttggaatatccaaggtgatcatccatttcagcttctaacataccttgcagtgtttcgcctaacaaatccttgagcatgtcctgaatatcctgagcatcctttggttgatagtgttctaataagttgttgatgaacgctttgcgttctggatccatttttcttcttcgtgccataaaaaatcctcctgaattgatatttattttaacatcaacccaagaggatatatagctcttttagagtttacacagaattaattacagtctcgacgatacatctttcgggtaaggaggagacttctgatttctcccccttatccatctcaaaggctattgaatttattccatgtggaacccaaacacagaaaaaagaaacaataccataccccagatgcggctttggagcgtgtctaagatgcgaatgagcatcttaaacacagcgactacagagcagatgggatatggtattgtttcttttttcgtctgttttctctcaatgaatcaaatagtaagaatttttttggcattctccactcgttcttttgttggtgggtcaattccctccagtggatactctagtccaagttctttccatttataaatccccatcgtatgataaggtagtatttccactttttctacattattaagggagtgaatgaaatcggctaatctcgttaaatattcatctttatcgcttcgttccggtacaaggacatggcgaatccaaatcggttttttgatatcggaaagatagcgaatcatatcaagaatattttcgttactgcggccagttaaaactttgtggcattcggtatcgatgtgtttgatatctactaataacaagtcagtgtatttcatcagttcctgaaatttagaaaagaaaggttcttctcttgtaaatggtcctccggctgtatcaatagtagtatgaattcctttttcttttgcctttttaaaaaattctaacaaaaaatcaatctgtaataaaggttcaccgccacttattgtaataccgcccccgtttttccagtaaggacgataacggagagcctgatttaatagttcatctgcacttttccagacagcgccggtttcttctgttatcttccatgtatctggattgtggcagaattggcaacgtaaaggacaaccctgtaaaaaaataataaaacgaactcccggcccatcgacagaaccaaaactctccgtagaatgaacaagagccatcgcatttttatcactcataaacaacacctcataatattttcgttataatttctatttctattacagtgtaaaaataaattatcaaggagaaagcaggtagcagcacatggacaggtgcatatcaaatattaaaatatcctaatgaagaaaaaagagaatacttttatcattccgtactatggaattttgaccgtagctgcttcgaactactttcttcgaagcggatgttttatcgggcaaaatggaatgttcagtacggtgcataaaagtatctcttttttcttcatcaggataggagttaactaggctatgcaccgttcaggctcctcatcctgctttcagtataaattatttttactacattctatcgtggcatgttcttgcaatgacatccaactgctgttcttttgtcagtgagatgaatttaacagcatagccggaaacacgaattgtgaagtttgcatattcttctttttctggatgttccatggcatcaatcagtttctcaacaccaaatacgtttacatttaagtggtgagcaccctgtgcgaagtagccatccataacatttactaagttaccaatacgttcttcttcggaatgtccaagtgcatctgggttgattgtctgtgtattggaaataccatctaatgcccattcgtaaggaagttttgctacagagtttaaggaggctaagagaccattttgttctgcgccataacttgggtttgctcctggggaaagtggttcaccggcttttcttccatctggaagggaacctgttgccttaccatatactacgttagatgtgatagtaaggatagaagttgtaggttcagaatcacgataagtatggaatttctccagtttcttcatgaatgtctgaagtaaccatacagcgatatcatctgcgcggtcatcatcatttccgtatttagggaagtcaccagttgtctcataatcaacaacaagaccttcttcattgcggactgtttttactttggcatatttgatcgcacttaaggagtctactacatgtgagaatcctgcaataccggtagcaaaagtacgacgtacatttgtatcgattaaggccatcagtgcatattcatagtaatatttgtcatgcatatactggatgagattcaatgtatttacatacaaacctgctaaccagtccatcatgatatcatatttgtgcattacttcatcatagtcaagatattcggaagtaatcggtttatattccggtccaacctgctggccggtcttttcatccacaccaccattgatcgcgtaaagaagacatttggcaaggttagcacgagcgccgaagaactgcatttccttaccagtctgtgtagcagaaacacagcagcagatggagtaatcatcgccccataccggacgcattacatcatcattttcatactggatagaacttgttgtaatagaaatatgagctgcgtaatctctaaatgcttttggaagacgctcagagtaaagtacggtgaggtttggctctggggatggtcccatattttctaatgtgtggaggaaacggtagtcagtttttgtaaccatagaacggccgtcctgtccaagtccgccaacttcaagtgttgcccatacagggtcaccggagaagagctggttgtaagctgggatacgtccgaacttaaccatacggaacttcatagtcatatggtcgattaattcctgcgcttctttctctgtaaggattcccttatccatatcacgtttgatataaatgtcaaggaaagtagcgatacgtccgatactcatagcagcaccgttctgtgtcttgattgctgcaaggtatccaaaatatgtccactgaacagcttcctttgcgttagaagcaggttcggaaatatcatagccatagctttcagccataactttcatatcttttaatgctttgatctgcatggagatttcttctcttaagcggataacatcatctgtcatcgttccgtcaccgcagtttgcgaaatccttctgcttgtcagcaactaacaggtcaataccgtaaagagctacacgacggtagtcaccaacgatacgtccacgtccgtaagtatcaggaagaccagtaatgatcttattgtgacgagctttcttcatttcaggagtataagaatcaaatactgcctggttatgtgtcttatgataatctgtaaaaatcttgtggaattctggatttggtgtgtaaccataagttgtacaggcttcttccgcagtacggataccaccaaatggcataaaggcacgttttaaaggcttatctgtctgaagacctacaatctgttctttttcttttaaagcttcagaaatatagcctggtttgtgtgaagtaaggcttgatacaatctcggtatccatatcaagaacgccacctttgtcacgctcagccttctgcaatttctgcagttcgtcccacagcgtattcgtagcttctgtaggtccctccaggaaagaagcatctccatcatatggagtgtagttatcctggataaactctcttaaattaacttcttctctccagatacgtccgttaaatccctgccattgttctttttgtaacatcttaattgacctccctgtttgtaaaaaaattcttaagtcaaggctttgaaatatgtttgctaaaaaatcaaaaaaagtgtcagatgattttaaataattagttaaaacttattatagttataatcatctaacaacattattagcatgatttttgataatcgtcaaacaaatttttgatattatgtgttcttttttctgaacatatacactaaaaatgttcttagagcccttaaaatcaagggatttaagctgttgataaaaaaatatcaaatcgtacaaatgtacggatataaatacaatatcaacaagaaaatagcaaaaatttcacctggcttaatcatgatttaaagttatttcttttcggggatatcggatagaatatttatcctgtcagagtaaaataaaaaaagccgatatccagacaagaattgcccagacggtcggctaaataagaatctcatacttcatgtggttcattccacttacttccgtcagtcgtataagtaacctaactataaccaaaagccaatcaaatgtcaaggggtaactatttaattcatttgggaaaaacagacgaaaataaaaagaatagacgataacaaatgtaaagatatcgctgcgtagaaaatgcctgttcggcatttttacttgctctcacattacatttgttatggtctattctttttattttctgtgttttggctccagaaggaatgaatgcaatagtctttggaggagataaagggggagaggtcagaagtctactgcttgtttggaaggtatagtgtccagaagattattttctctttttaatgagtagtaaaaataaaggagattgtcattttccagaatattaaagaaatcgcctttatatttatcgtatacaatggtagttggcgatatcattgtatcatcattgacagtatcagaataagctacaaccttctgtccccttccccatttctttcccaaaaattattgcattcattccttctggagccaaaacacagaaaaaagaaatactgctatatcccagatgtggcttcggagcacgtttaagatgcggatgagcatattaaacacagcgactacagagcagatgggatatggcagtatttcttttttcgtctgttttcccctaatgaattaaagagtacacccttcttgccatatcgtggaatatccatatgaggctcattccgatggcaagtcctaatgcacattggacggttttagaaccatacattgcggcatactgccattgcctttgaacagcatagctcatcgtgtagtagagagaaccgccgggaatcaaaacaacaacagagatgataagaaaaagtgtggtgggagcttttcttatttttgcaatgacttcggagtaaattgcagcaaaggcgctggcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcatcgtgtagtagagagaaccgccgggaatcaaaacaacaacagagatgataagaaaaagtgtggtgggagcttttcttatttttgcaatgacttcggagtaaattgcagcaaaggcgctggcaaatagtgaggaaataaaaacatcgaacccccaggtattagcaataacataaataacccaggtcagtacgccacctaaagctgcaggaaaaatgtgtttaaactgcaaatgaaacaggaatccgaatccggcagctccgataaaagccgcaaagaactgaagtatcataatacacctcccacaaaccagatagcgcacatgaatccacaggcaagagcgccggcccatagaagagattctacgagtcgcattataccggaaatcgtatctccgattaaaatatcccgtatagaattggtcataagaataccgggaatcaacagcataatatctccgatcataactttatctacatgaattaccggaaaaaagaaggcagtgatgcaaatgccggtaccgataaagagggagcagaaaaactgaagaataaaggtattactgcatatagaatttaaatgcctttgtaaaaaacaaaggaaaaaagcaaagataacagcaatagctccatctaagatcgttccgccgaaaaagacagagaacccgccggcaccaagcatacttcccagataaatagtataaggtgcaggttttatttttgaaattttgtttatttcatctttcaaatctgttaaagaaaagggagtggcacagcattgtctgcttaatgcatttgcctgttctaatttaaaaaaatctgtgccggcaggggtggtaatcctgcgagtttgtgtatattcttctccctcaggaaataccattgtaacaacaatgcttgatgtaattgcaaaaacattcatctggctggcaccgtaggcatgtcccattcgattaagcgtttcctccacacgactgacttcggcgccattggtcagcataatttcagccagatttaataattcatgtaaaatagcattcggtgagctcaatgaaattctcctttcaacaaaatatgatatagtatatcacaaatttagggtactattggaatctttttaatcagagaactatttcgctcttttttcgtctatacgaaatctataaattagtatttgaaaagcttttcaattgtttcagatggattttctgttgggtcataagaaaattcttggcagaagtttttctgttcaggtgataattcagtgttactaaagtcaagtgtcagtaattgctccaggtctttcaaatacatagatggataaaatttctttataaaatcaccaaatatttttggaagatattccaaataataaataggctttttggtgattgagaagtttccggcatgtttgctgctgtttgtaatcaacatatcggaaaggtacatcatatcattaagcgaaattttatttttaatataaccaaatttggaagaatattggtatgataactggtaggatagttctacaagatcccagttatttgtaattacaaaccagtcatcgtctatataatccatgattttttttaagttaaaattatcaaaaaggtttacaggttctgaaccatcttcgggttcgggtttttgtccgactaaaagtatggatagtatttttttaccttttgcttgcggaaaatagaattccaattgtttttttacagtagttcttttctcttcctgaagaatatcccaggaaataggtagaggaatatcatttaaaaaggtaacattatcttcccattcataaaaagagtggaaaagtttagctgtaaatggagagccgggcattacatgtgtacagcgtatgaatgtctgtttctttggttggtcaggattatcatggtatttcataaaaatattaaattgataatcaaaaggtgttgctaagagcaaacggcgctctctttcggaagcactaggtattttaattggaatagaaggatccatacaaatgatattttgggcttcagtacaaaaagttcggcgtgcgtcttccattttagtattgattagaggaatctttgtagctgttttattgagatagtattcaaattccacttctggaagagcagccatgagattatctttcacaagctgcagatcagtgtttagtccacgtccacgggtacttacaaatgaaatagtttttttactcattttactttccctccatgtatgaattaatcaggtttgcaattctttcacaactatgtccatcgcaggcagacatatatttttcaacaaaagaattcatcttatttgtaagaatatgtttttcaggatgtgttaaatagtctgtcagttcttcttgatttgtatatacatctccaggcaggtcttctggataattaagataaaatcctcggtcataggttggcagatcataacagaagaatgcgataggtttgcgaagtagtgcatattcaaatataacagaagaataatcagtgattagcatatctgaaataagcatataatcatttgttgaaaaatctctcattacgcgtatgtttttgtatttttttggaagaatatcgttcttcattaccggatgcgggcagattaaaagtacttgattaggaagtaaatcttttgaaagacgatcaaaatcaagttcaggatggaattcacttctatcacatccaacatcccggaaagtaggtgcataaacaagaacagattttccaattaaacttggatgccggaaatagattttccgttttgttttgttgatcagatgtttgttaaagtaatcatctgttcgtggacagcctaatgcttttaccttattataatttacatcaaatgcatccgcatagatagaacgtaaattttctccacttacacatacaagattatactgtgcatgtgtagatctgtcttcaggcaaagaaagatttgttccgcgctgtccaaactttttaaatgcaccgcaagcatgccatagctgaataactcgctgttccgggcgtaaagggaaatatcttaaatattttacatagtcatctgttacgattaccttactgataaggatttcctcagtcatttcaagggctgtttgaggattatgtggtaaacgttttgcacagattgtctttttacttttgataaagggatatagagcctttgcatttccttcaagatgcccatctgcacggggagaaacaaataaaacctgatttttcagtggctttttctggaaagaagctgcctttttattccatgcttgttcttcttcagtttcatcagagagaagacggaatttcatgccagattctgccggagagtagagtatttcagcgctatttaatgtaattggtttatcttttaagtattctttaataaaagatagagttttatctgttgcaatgtaatcaataaaagtttcttttttattattgtaaagaagcaaaccatctaagcggtatgcgtaactgccttttgtataacataattttatcaattctggaagctcttcgctaaaatctaaatggagacttcttacaaaatcaacacagaagaatttgttagctaatgtagcatccatagaaagagaagaattgtatttttttccatcttttaaagatgtagaggcaattttactgaaaagcaatggctgtggattatcatattctttatgataaattccctcactgatgaaatcatactgctgcttcataagctgccgataagccaggcggaaagaaccaacggcataagtgatttcagcatcacaaaaagtaatatatggtgtctgagcattattcaaagcagtagcaaataattcttttttagaattactatcttcaaagaaaagattatcttgtaacaacccttctttttcgatatcagctttcatagaaacaggtacaactattttcataaatatgagattctgttttattagtgaatctaaagacttcataaagttgtctttatttgttttatcaccatagagtactgcagtaaaaaatgcgtttttaagaacgtcctctttagatgacttaatatcatataaagaaaattctgggaaagagagactgagggtagaaattaccttcatatccagaatctttaatttgttatttatttcatccacaagtaactgaattgtgtttgaatctaaggaccagaactgaatataaaactggttcagcataatctgtagctgcttttgaataattgtattcaagtagttatgaatatctggattctgttctcgtgcatcatcaatagaactgtacttaggataatcccttaaaaagctttcttctgcagaatgaagaatcatctgatgagcagtaatgtaatctttgattttacttggtgagatagaggccgtaatagaatccatatcatcatatcttcgataatggaagataatataatccaatccaacaatttttgagcagcgatataaaaactgagtaagaaaagcaccatcttctgagtaagaaattgatggtaagcgaagatgatgtttttcaataatacttcttctgaaaagtttattagacagagaaaaagtccataaaatatcggtgttatatttatcaatttcttctaattcaattaaatcatcgagattatggatttctatagttgtatgccgattaaaaatatcgtattttccaattaataaatcagagtgtttttcaaaaattgtattatacatggtagataaagcatcaggttctaaaagatcgtccgcatcaaaaaagaaaacatattctccctgtgcaatatctagtcctacatttcttgcggaagaaggaccgccattttctttatcaataataattaaattagagtaattttttttataagaatttaatatagacaaggtgctgtcagaagaaccgtcattaattacgataacttcatattcggaattatccattgtctgtaaaaaaatgctgtccattgtttcagacaggtattcttctgcattatatgcagcaataataactgatatttttttcatatctattcatcctttttcctaataagtggttgtgtaattgtaaaaaatatatatttacaaaacatgaatatatttttttattatatactatttattatattatgacaatattgtggagaaatttagtaatgatatgtttggaatatcgtaagttaagagatggttttttacgttgataaacgatatatttagtgataatatatgtaaagcaacttttagaaagagagggaaatatgctatttaaagaaaaaaatttataaagtttactgtaataatagttacattatgtatgttgtttttaggagagacagtatctgtaaatgcaaaagtagataaaagaaaggatttatcagaaataaaaacaataaaaatagtaaataagaaaaaagttttgtatacaaatacatggtataccttaaaagtaaaaacgaataagaaaaaaatttctaagaatataatctggaagtcaagtaatccttctgttgcaaaaatttctacaaaaggaaaaataactgcaagaaaaacaggaactaccagaataactgcaatagaagaaaaaagtaatattcatacttcatacactgttcaggtgaaaaaatccaaaggattaaaaaaaattaagataatttccaaaaagaaaaagctattagaaggagagtctgtaaagctgcgtttgaaaagaattcctgcaaatacaacttataaagacgtaaaatggatatccagtaataaaaatattgcaacagtatctgaaaaaggtgttgtacaggctaagaaagcaggagttgtcactatcagagcaaaagaaccttttacgaagaaaacatcaaagattaaattaaagattaaagaacagcatattccagtgacaggaatttggtggaagtccaaaataacgtctatggaagttggagaaaagattaaattaaatgcacagatagaaccatggaatgcaacaaataaaaagattatttattcctcgagtgataaaacaaaagtatcaattgatacaaacaggggggtgcttacagctcttcgtccaacggaatacgtagaagtaagagcaactagtgttgatggaaagtatagagcaacatatcaattgaagattacaaaaagtaaaggttatcttacaaaacaaagtcttgataagttaaatcttacgaatgtaacaaagcttatgattgttgcacatccagacgatgaaactttatggggaggatctcatctgattgattcagattatcttgtagtttgtatgtcaaatggatggtataagaaaagaagttctgattttgagcgggtaatgagtcagacaggtgatccacatattattttagattatccagatgtaagaaaagattgggttacagatggtaaatatggctatgaaatggatctgtactctacctgtaaaaatgcgatgcaggaggacatagaatttttattaaattataagaagtgggatgaagttgttacacataatccaaatggtgaatatggaaagtttcatcaccaacaggtaagtaagatggttacagcagcattccaaaagactcttgtgggtaaatcaaaactgtattattttggtcgttattataataagggagaagaaaatccaggcgacaaaattagtgaggaaaatcttcaaataaaagaaagactgattaatgaatatcagccaacagcaaaaggagcaatagaggcatttggacatatgataccttatgaaaactgggtattagcagaggattggaagtaatatgaatacaaaaggaataaattttaaagatatagctaaatatgcaatatgttttgtaacgatgtttgcattgagctggctgttcccctatacaggtgatgactgggcatggggaagtcagattggactggatagactgcatacatggtttgataattacagtggaagatatgttggaaatttgattgttctggcattgactcgttctaatctgttgaaatcactagcaatggctgttgctataactggaattatacttttactggaaagactaattaaagaaagatggtctttttatgtaagtattgttttattaatatgtttacccaaggcaattttgagacaggcagtggtatggacagcaggattttctaattatgtgacctcgatcttttttacgctgatttatattgtttatatttattggatatttgatgaaaaaccaaatcgaaataagctgcgccaaagaatattgccatgtattccactgtttgctctgggaatgattaatacgttaattgtggaaaacgttactctctataacgtagtactggggatagccgtgataatatatgtattacttcgatatcgtaaggtattgattcagcatgtatgttactttgcaggaactatttgtggaacagtgtatatgttttcaaactcagtataccattcaatctctacaaattcagatggatatcgaagtgtagcagagggagggattattgctcaggcgttaaagaattattttgatgttatttataaagaatattttatgaataatattgcgttaaatttatttattttaggtttatgttatattatttatataaattataaaaaagagaatatagaaaataagaacatactggataaattaccagcagtttgtttaggaatactgaccggttatgatgtctggagtttattctcttatattggtttgagtacagtaacaaaacagaatattttaattgctatagaaggaagtctaacagcagtagcgggtgcagcattaattatttttgctttaattatggcggttcattatatgaatttttggagaattttatttactgcatgtagtgtactctgtgtggcagcaccattatttgctgtaaatccaattggaagtcgctgcttctttccatcctatgtattatttgttttatttacagaagaattatgtagagttgtggcagataactttacaataatagtgaatgagaagattcttaagcgtatagcggtagttgtggcaggggtaggaatggtattttatttatgtatctttgcattggtatatcgagcagatcatcaaagactctcttacataagagataaagtgtcagacggtgaaaaaaagattgaaatattacaccttccatatgaatcttatatatggactcctacaccaaataaaggggaaatatgggaggaaagatacaaattattttatgatattccacaggatgttacgttaaaggctgtttgggaatatacaaaataagaaaggggagagaaattgagaaaaattaaaaaaatatatttacaaatattttcaattatattgttagtaacatttttttggatttttcttgtggagtcatatattatcgggcagcaacatctaataagtgtaggattgatggtgttttttgcttttttgatatttgtgtttggaaaaaaatgttataacaggattacagaacaaaaagtagtaattatttattggattttatggggaatttcatgtttgcttatgctatatatagcatggagtctaaggatgagtatttatcatacatgggattatggtcgattattacaggatgcaatacaattagctcaaacagatgaatttaaaagctatatatactatagtcaatatccgaataatttgtttatgctctttttgcttaaaatgctctttaaaactgtgttaatagtgtttccagatatttcgatagggggattgcaggcttgttcaattatagtaagttgcattctggttcaaatttcaattgttttggtttacatgacagcaaaagaagtatgggggaagaagaaagctgcggtaacaggtatttttttattgctggcatcaccgttatatttatatgctacatttgcttatacagatactttttctttacctttagtagtaggacaaatatatttctatgttaaatttcagaaagaagaaacaaagaaaaaatggtactatttagtgggaatggctatattgggggctatgggatttaaattgaaaatgacgattgcctttgtacttattgccagtataattaatttgtttattaggcaagaattaaaacaatttttaaaatatgttggaattatttttgtagtgagtggaataacatgcattatcataaataaaacattatcttttcaatttaacattacaccagaattatcaaatcgttatcaatttccctatgcccattgggtaatgatgacgttgaatgattcaggaggatattcccaggaagatgtagattatacatgttcatttgaaacatatgacgaaaaaaataaagcagatattaaagaaattaagcatcgtctgaaacaacgaggaatagtaggtacactgcaacatatttttgtaaaaaagataattagaacatggggaaatgcaagtatggctggtgatacatatatttccagtgttgctggcaaaatgcttactaaaacaaagttacattcattattttgtttagatgggaagtaccatgatatttatatgatatattcacaggtgtatcatttaattatgttattttggatcttttattgtgcgataataaatgtttggaagagaaaaatggaaaatggaatggaaaatgttctgatgactacggtttgggggcttgctgttttccttagtatatgggaatgtaattctagatatttatttcaaatgcttcctataatggttttacttatgatgagtggaatgtataaaagccagtggatatataataaaaagtttgagatataattaaaaagtgagactgaacaaaagtaagtggtagatacgctcttgttgagatagcagatgaattgaagggaagacaaaaaatatattaaaaataaaactgcaaaataagataaatgcaaggagagttgaaaatgcttatcaatttaagaaataatgctgaaaagttagtagtaaaagatatattagatattgattttgatatgtctgttgaagaaaaaaataatagatatattataaatgtgaatcgtcaatatagttgtgctgaagaatatgataatgaaaaagatgcagaatcaaggatgttacaaattgcagaaatgcgtaatgatttagaaacggagttaagaaattgttaatttgaatcaaattcaacttttctttccccatccttgcatactcttaaattttttagagaaaatagaggaagcattcctatttaactcaatgcttcctctggaatttttatacggtttgttgtgtgttacttacaaatcttggtaatggaatagactgaaaatctgttcaaaaggattctgtgcaatatcataagcaaactcctgacaaaatcgtgcctcttcctcagataaatccgtttgtccatagtcaagtgttgccaattcttctgctgtttctagatatagatctggataatattgtttcatatatcttccaaaatgtttttttccgtaatttagataatacactggttttttttctgaggcaaaggtacaagcatgcttactgctgtttgtgactaacatatctgagaaataaagcagattatcaaaaccgaatacacccttcatatatccaaaatattttgcatacgaaaaaggaagttttccagacatttcaagaagattgatattgttggtaagtaaaaaccagttatctccgatttcattcagaaatttctttaagtctaaatcggaaaagagttctgtcattttctctggagcggtttgatttactgtaaggatagtcagtatctttttcccttttgcttcaggataaaggtattctaagttgtttcgtacattttcttttgattctttagatgtgatatcccaggcaagagggagacacatatcgtctaaaaaagtagcattttcaaattcataaaattctttcagtaaattagcaaagaacggagatccagccagtacatgagtacatcggatgaaagtttttttgtgttccagttcaggattttctataaattttaaatattcattaaaaagataatcataagggactaaagttaaaagtcgccgttcttccggtaaagcaggagaaagtttcactggaatagaaggatccatacagataatatttctggtgttatcacagaaggagagacgggccttttctaactgtttgttggcggcaggaactttcgtagcagtgtttttcagatagtattcaaaagttacgtcagaaaggttcaatgccagatagtcctgtattaattttaaatcgatattcattgctctgccacgtgtactgagaaatgaaatggtagctttactcatactagttctcctccatataagaattaattaacgctgcaattcgttcacagctatgcccatcacaggcagacatatattttttcacaaaagcagtatatttgtctgtcagaacttgcttttcaggatttctgagatattctgtaagctcttcctgtgttttgaatacatctcctggcagatcatctggatactttagataaaaatctctgtcatatcttaaaaggtcatagcagaagaatgcgattggtttacctagtaaagcatactcaaaaatgacagaagaatagtctgtaatcagcatatcagaaatcaacatataatcgtttgtagaaaaatctcttacttccaatatattatgatatttgtgtggcaaaataggagcatccattaccgggtgagggcaaattaataaaacttgattcggaagcagagactttgaaagtaagtcaaaatcaatttcaggatgaaattcatttcggttaccgtcggtgtccctgaatgtaggggcatagacgagtacagatttaaaaagcaacttcggatgctttaaataaatctgtcgttttttcttcgaaatcagttttttattaaaataatgatctgttcttggtacacctagagcctgcactttctgataattaacatcaaaggcatccgcataaatggaacgtatttgttcaccactgacagatacaagattatactgtgcatgggtagcaatatctgtaggaacagggatattagttccacgctgaccaaacttcttaaatgcgccgcaggcatgccagagctgaatgacacgttgttctggacgaagaggaaagtaccttaggtacttgacataatcgtcagttacaattactttgcttgtaagaattgcttcggacattgcaagagcagcgtcattatcgtgtggtaacttatgtgcacagatttctttttcacctttgatataagggtaaagagcaagtgcatttccctcaagttcgccatcggagcgaacagagacaaaggcaactttattttgtagttttttcttttttagtttttccacttcttttgtccatggctgttccgcttccgtttctggaattggacgaaacttttctccggactctaaaggattataaagtaattcagggctatttaaagtcacagattttgctttaaaatattcttttaacagagaaagagatttttctgtttctgtatagttcaggaaagattcctctgtgccattgtaaatgacaagttcatcaaaattataaaggtaatatccagtatggtaacatttgtccagaaagtctataatatcaaggttgaaattgatattctgatttcttaaaaatgaaacagagaagaacttattagctaaagttgcttccattccaagacataatgtatcatattgattagaagccaagaagtctgcggtaatatgactgtagattaatggctgcaaactgccataatttttgtgatagatagcttctgtaacaaagtccatatataatctgctgaataatttgttcacgcggcggaacgcacctgtagaatatacgattttctcatcacaaaaaacaatgtgagaagttgttgcttcatctaacgctttattaaaaaggttctttttggaattacaatctgtgaaaataatatttttctgtaataatttcctagtctgaataacagctttcatagaagaaggaacaacaatcttgataaataccatattctgttccgttaaagatttcagacaggataggaagttctccttcgtgctgccatcaccatagagaacggctgtcaggctggcgcattttaatacttcttcagaatcggcacttaaagcagttaatggcaattctggaagagcggctcttagttcacagaagctcttcatatctaataagtttaatttatcattaatctgggcaagaaggaactgggcagtagaagaatctaaagtccagaacttggcataaaaacgatttaataaaataagcagttctttatgaatgattgtgtttaaataatcgctgatttcctcattatctgccatagcatcctcgattgttgtatacacagggaagtctcgcaaaaaactttcctttgcacaatcaagaatcatttcatgtgcagtaagatagtccctgatttttgatttagaaacggaagctgtaatggattgtgcgtcttcttcattatatcttctgtaatggaagattacctgattaagaccggtaattttagaagagcgatataaaaactgaacaagaaaagctccatcctctgaataagaaatatccggaaaacgtaacgtatatttctcaattaattcccgtttgaataacttgtttgataaagaaaaggtccatagaatgtcggtattatatttatcaatatcatcaagagtaactagattatcaagtgtgtgaacagcagaaagcttgtaagtgttcaacacatcataggttccgataactaagtctgcgcttttagtcactgctctggtaaacatagcctcaagagcattattgataagaagatcatctgcgtcaaaaaaataaatatattcgccttttgcaacagtaagtccggcattacgggcagaagcaggtccaccattctcttgattgataacagttatatttgaatgtgattttttgtatttctgtaaaatgtctgctgtgtgatcggaagaaccatcattcacaataataatttcataatcggagttaggcattgtttggaaaactacgctgtctaatgtttctgtaagatgcttttccgcgttatatgcaggtataattacagatatttttaaatcttttttcatagtatacttccttttaaataaattgttgtagagtcttccttgactatagcatagtttaattgtggtgacaagaaaaggaacagcgaagtattatataactatagaatggattgattagaacgtgattgaaaaaaatataagattgtatatgacatggaaaacgaagaacaaatccaaaattataaatcaagatatatataagaattgacagaagaaggctatagagttaaaatttaaaaatggaaaaatttaataaaaggatagagaagaaaatacgaggaggttttttgttgaaaaaatacgattatttaattgtcggcgcaggactttttggagcagtttttgcacatgagatgacaaaaacaggaaagaaatgtcttgttatagataagagagaacatattgcaggtaatatttattgcgagaacgtagagggcattaatgtacataagtatggtgcgcatatttttcatacatcgaataaagaagtatgggattatgtgaatcagttcgcagagtttaataattatattaactccccggtagcgagatataaagatgaattgtataatctgccatttaatatgaatacattcagtaagatgttcaatattgtgactccggctgaagccaaagcaaagattcaggcagagattgaggagttagggattacagaacctaagaacttagaagaacaggcactttctctggttggacgttctgtatatgaaaagctggtaaaggggtataccgagaaacagtggggaagagactgtaaggaacttccggcatttattatcaagcgtcttcctcttcgttttatttatgataataattattttaatgaccgctttcagggaattcctatgggcggctatacagctattgtagagaaaatgttggaaggttcagatatttttctgaatacagattattatgagttcagaaaagagaagccagatattgctacaaagacagtatatacaggaatgcttgatcaatattttggttacaaatatggcgtattagaatatagaagtgttcgatttgaaacagaaaagctggatatggagaactatcagggtaacgcagtagtaaattatacagagcgtgaaattccatatacccgtattattgaacataagcattttgaatatggcacacagccagtaactgtaatttccagagaatatccaagtgaatggaagttaggtgaagaaccatattatccagtaaataatgagaagaatgaggaaatagcagagaaataccgtgcgttggcagcggcagaaaaagatgtgattttcggtggccgtttgggtgaatatcgttattatgatatggataaggtaatcgaagcagcattaaaggcagttaaagaagaaactgggatataattcaattgtaaaaggagaacaaatatgaataatgtaccgaatgagggaaaagtggatttttctaaaccaatattgtggatagtaatcccatgttacaatgaaaaagatgtacttccaattacagcacctatgtttttagaacagattcagacgatgatttcaaaggagaaaatcagtgcaaacagcaggattttatttgtaaatgatggatcgaaggactcaacatgggatattatctgtaagttggcacaggaggatgaacattatattggaattagccagagcagaaacagaggtcatcagaatgctgtacttgcagggttaatggaagcgaaagatgtttgtgatattacaatttctattgactgtgatggacaggatgatattacggcgatggaacgaatggtggatgaatatctggcaggcgcagaagtcgtttatggtgtcagaagtaagagagatacagatacatttttcaaaagatttacagccgaaagtttttataaattgcttgataagatgggcgtagaaacggtatataatcatgcagattacagattaatcagtgcgcgggtattacaggaatttgcagattttcatgaagtaaatatatttttaagaggaatggttccacttgtaggatataaaaatgcaacagtgtattatgaaaggcatgaaagaattgcgggagaaagtcactatccgttgagtaaaatgttggcacttgcttttgatggaataaccagtttatccgtcagacctatttctattataacaggaacaggctgtatagttagtcttattggatttataggtattatctgggcgattataacagccattatgggaaatacagttgccggatgggcatctattgtttgtattgtttgtttccttggaggaattcaattactttcacttggagttattggggaatatattgggaagatatatctggaatcaaagcatcgcccaagatatataatcagtgataaaacctgggagccatatgagagacattacaaagggctgtagggaattgtgaatgatgaataattatttttcgaaagaagatacaaaggttataaaaggaattactattattttaatgatgatgcatcatctctgggcttttcctggtagaatatcaggaggagagttaaaatatttttttgaaatattgggacagagttctatatcgtacctgggaatgttttccaagatatgcgtttcaatatttttctttttaggtggatatggaatatataaaagtagtcaaaatagaaaatttgatttggtgaaaaaaattaaaaatttatatatttcttattggaaggtatttattatttttattccgattgcttttttgtttttttcaaagcaaccattatattgcgaggtgcaagatatttgtaataaatatgagacattttctgtagatgagttattaaaaaatttttttgctttaagtagctcatataatggagaatggtggtttttaaaaagctatatttgtgcagttataacatacccatttgtagaaaagattattaaaaatttttcgatatcaattaatattgcccttattattataggtggtctattagtaggcaatatatttcctctagcaggacaaatcagtttgttgaaaggattaaatgataattatttatatagtacattcttttgtcagacctctccgtatataatgagtttttggatgggaatagtagtggcgaaagatgatgtattgttaaaattaaaaaatagcttgaaggaaaataatttattaaatcctttttttgatattattttttttgttgtaataatttacttaagaaatacaggaacaggaagttacttggatattatatatgttccaataattattgtgtgttctttggattttatccagaaaatgaaaatagtaaaaaaaatatttatggagttaggaaagaaatcaacgaatatgtggttgattcatacctttttttgttattatttctataaagttgtaaaaattatagttgcccccaaatatgcagtagtttgtttggggttattacttcttttttcatatgtagcagcgttgctggttgattttttttggaaaattataaataccatagtttgtaaaataatgggaaacattaaatattattttttgcttagaggaaagtaaattacattattgatttttcctatattttaaatatatcagagtgtgttagaaaattaaaaatcagagactgttttttgtaattgaaatgttattgcaatcagtcgaaaggaaaaaacaaaagagaagaggaaaacaaaaaatgaaaaaaatgtataaaaatatttttgtaatattacttgctttggggatggcagttggtagtatctcgccgagccttttagtgcaggcagaagatagtatttcaaaacaagagatgatccctgaatctagtaaagatgcattaaagaaatatagtaaaatttcagatatagacagtactactattttgggagcagattttacctattatcagcagtgcctgacatggggaaaacagtataaaaactatatgagccagcctgtagataatctttttacttatgtaaaaagtcaggggattaatactatttcagtgaaggcagcagtgaatccagttggagagaatacatatctgtcattggataatgcgataaaaacattaaaagcagcaaaagcagcggggttacagactaatttggttttactgtattctgacaagatgacctatgcgggaacacaggaacttccgaaagcctggcaggaggatgaagaagcagataaagtaacagataaagcaaaagaatatacaaagcaggttgtagagcaactaaagcaggcaaatgcaataccaacaatcgttacaatgggtaatgaagtagactggaattttcttggaattactgagggaggaggctggaacggctgggttgcaatgggagatatttctgcttatttaaaagaaaatggaattaaaaatgcaatcagtattgcggctccaaaagaagcttctgctgttaaagaaataattgatggaaaattaaaatggacaaatgcggattatgattatataggagtgaatctttatccagatgataatacgaatacttacgttgaggaattaagaaatgctgtggaagagtgttcagaaaaaaagcagctcattgtttccagtgtaaagtatgcccgcgtaaatgaagaagacaccgttaatgtatatacacaggcagaaggaatttatgatttactgtctgcgacaattgataagaataatgcaggcggaatgatttatgatgaagcggtgtatacaggaaactggacttcattatttgatgatgatggagatgcgcagatttcccttgctatttttgcttatgcacagggaaaacagacagataccagccgtgatccttataaatatggggatgatactggattgaagtcgcagaaggtaacaatccgtaaagtaagtaagatgacagattcaactattcgtggaatggatatatcttcttatattgcattaaagaatgctggagtaaaatactatgacaataacgggaaggaagcctctttattaaaggttctcagtgataatggggtgaattatcttcgtattcgtatctggaatgacccatataatgaaaagggagagacctatggcggtggagccagtgatgtagaaaatggtttaaaaattgcaaaagaagcagcaaagtataatatgaagttattattatgctttcattattcggatttctgggcagagccatccgtacaaaagcttccaaaagcatggaaaaaggatgcaaataaccaggaaaaattacgagcagatgtctataattttacaaaagaaacgatagagaagtttaaagcagttggtgccgatattggtatggtgcaggtgggaaatgaaatctctcagggaatgatggatgttatgagagatgaaaataattccgaacttagtgtatggtcagatcaagcaaagagtaaagtaattgacagttatataaatgaaggaacaaaggcagttagagaatatgcgcctaatgcactgatagcattacatttgaatactttatatacggggatatataaagatgctatggatgcgtgggaaagagataatgtagattatgatgtttttggtgcatcatgttatgctttctgggtgggagacaatgtggtaaatgatattaaaagagcaggaaattatgttgcttctcgaggaaagttatttacaatattagaaacttcctggttcaattcgacagaggatgcagatggtacaggtaatatggagtccagcacaaatctaaagtcttataaagttggaccacagggtcaggttgatgtactggcagacatgtacgatgccgtattaaccaacgataacggtctcggtattttctactgggaaggagcttggattcctgtaaaagccggatggacaaactggaagtacaataaagagatggcagataagtacggaacaggctgggcatcccaaggagctgtaggatacttccctaactggaaaatgtactataatggtcagccggcatggggtggagattcctgggataatcagacattatttgatacaaagggatatcctttagattctcttcgtttttacaaggatgcagtttcatcgaaagaaaaacagcagattgcaattattgagttatgcagtcaaagcggaggaattatcggttataaatatgttaaagtttctgtaggaaagtctataacctatacattgccagtagtcactggttataaagcggtaaaaaccaagattcagattaaaggagaaaaagaaggaatcaaacgggtacaggccacatataaaatgcttccaaagaagcaaaatattcgcctgaagaagtcttcatataaattgccatatgcttcaaactataattttaagaagcaagtcattgccaatggaaaactgacttttaaatccagcaattctaaggtgatatatattaataaacgaaccggcaaaatgacaataaagaaaccgggaaaagtaacaattacaattaatgttggatcaacagctttttataaagcagcaaagaaacgtgtaactgtatatgctgttccaaagaaacagacattgcagcgagttagaaagtctggaagaacaataaaggttactgtgaaaaaagatgtgaaggcaacaggctatcaagttgttacatctacaaataaaaagtttaaacgcaataaaaagtcagttgtttcaaagaataaccgaaggcttagtctgacattaagacagaatgctaagggaacctattatgtcagggcgcgttcttatatcaagattggtaagaagtcttattatgcatcatggagtaaagtaaaaaagattgtattaaaataattacttcctcttgatttcctaaccattttaagtataataagtagtataaagaagtaattaatatcacaggggttatcaaagaaggtatatttgtttgtaacaagtatgccttctttttcttttttggaattagaatataatcagaaggggtaattaaagaggtgatttttactttttatatgcgatttatatgagatgaagtggtatgagggattagtacatagagaggtgagatgtatgaatactttacagacaaatgactggctgattttgaattctattatttatgagatttatacaacggcggatttcgatcagatgagaaggaagtttttagagcagatgaagatgcttgtggattttgacagtgcagatttttatctggcgtcttccggggaggaataccatcttaaggctccggttacatatcattgcgatgaggatttatcggaggtttatgacagtattgattacagcagagggattatgtacagtgggaagagtatcgtatatcgtgagacagatattatttctgatgatatgagagtgaaaacggagtattatcagaaggtatataagccgaataactggcattattcgttgcagatgatcatggcaaaagagaagaagtttcttggagtggtaacgatgtaccgcaatattgggaagaatgattttagtcatgatgaagtatttttggtggatacgttgaaggatcatatggcgtacagattatggcagcagaaacaaagtcgtatgcagtttggtgagaagcttacggtgtcggcagcgacggagaagtttgggcttacaaagcaggaacataatattttgcatctgttaatggaaggaaaggataacagttttatctgcgattatttatctattagtatcaatacgttaaagaagcatattttaaatatctatcggaagctgggaatccgtaacagggtacagttgtttaagaagataagggaaaaggaataaaagtaaatttattacgttatttgtgagtatgtatttaaaaaataattaaaaagtagtaagaaaatggttaaatgggtgacttgtattaaatatcttaatgggggatagtcacaagtatcaaaagcaagggagctgtaagtgatagatacagcttcctttttttatagttttttttaattgtttttttattatgggacaaataaaggaggatatagcatatgaaggaattagttatgattattcgaccggagaagttagaagatattaagcatattttggataaaaatgcttcgcatcactgcgcttttaatgctcgcttgtaacgcttacattatgagcttgctttaaggcgcatttttatataatggtctttgttgattcctgtctttggtaaagtgaaggggatttggtcggaaggtttctgcttgctctgaaagttgtgtttgatgcgataaaaaatgaaaacctttattctgacaaagagatgtgttataactatctttggaatttttttagttaatatgaaaatatatatgggcttctgaaactctaaaatctgtgataaaaacatagtggttaattaatgttgcatctataagggcttagggagacatatataaggaaaggaatgaagaaaaagcatgttaatgaagaaatgtaagattgttctgacggtgctgctgacctgccttctgctgggcaatacatttggcagtgtggcggtaaatgctgcagaagcttctgacactcaagcagaacagacagcaggaaatacagatgagtacaaggcattttggttttcctactatgattatactgcttacagagcaaagtataaaaagagaaatgccacaacatttaaaaagtattttacacaggcagtaaaaaagggaaaaagccttggaatgaactgtataatcgtccatgtccgcccatttggggatgcgatgtataagtcgaaatattttccatggtcaaagtgtatttccggtaaacagggaaagaatccaggatacgatccattaaaaattatgacacaggtagcacatgcaaacgggatgaagattgaagcgtggattaatccgtatcgtgtagcatctggttccacgaattataagaagctttctacaaaaaatccagcaagaaagtggcataataagaaaaagacacgccgtaatgttttagcttataaaggaagcctgtattacaatccagcgaaggcccaggtaagaaacctgatcgtaaacggagtaaaagaaatcgtagagaattacgatgttgatggaatacatatggatgattatttttatccggctttcagctcatcaaatgtaaactctgcctttgatgcaaaagaatacagagcttctacaatggcaaaaggaaagcaaaatatcgtaagctttagaagagaacaggtaaatatgctggtaaaggcgattcacagggcggtaaaatctattgatccaagtgtgacatttggaatcagcccggcaggaaatattgataatctcacaagcagatattcatattatgttgacatcaacaagtggctcaattcttccgattacgtagattatatctgcccacagatttactggggattcaagcatccgtatgcgaagtttgatagagtaacgaatcgatggatgaatgcagcaaaaagtaaaaaagtaaaggtatatataggaattgccgtataccgcgcaggccataataccggcgcaagttcaagcgaacgccgggagtggagaaccgatgccaatatacttaaaaaacaggtacagtatgcgagaaagaaaggctgcgatggatttgctttctttgattatcaggatctgaaaagtaagaaaagcgccaaggcagtaaaacaactgaagaaagtactgaaatattaaattgaaatattaatctaactctatggcagtgattcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcactgccatatttttatatcagatgtgagatgactcccacctcgcagcaagaatgccggggcatttttgaaaaaagtttggctattgagaaaaaatctcaaataaattattgacttctaatgaatattagagcatactaactagataagagtgtataaaataaaagtaaggtttaacaaacgtacaaaagaaagaggttattatgttaccattaacgatggcaagtcagggagaactggtgacaattaaaaagattggtggaaaacaggagacaaaaaaattcttagagacattaggatttgttgttggtggaacaattacagttgtttctgagattaatggcaatatgatcgtgaatgtgaaggattctagagttgccattggaaaagatatggcgaataaaattatggtctagattctatctgatttaaaacctgaataagataataatacagtgcttattgagaataaataatgccaggcgagggtaagtgagaaaaaatctcatttgtgaatattttacttgtaatttctcctcggttggcttattattgcgtgaaaagaaaagtaatgctacataagattacattgtcaggaggtcatagatatgtttgaatgtttaactaaaattaactggaaaaaagtaggtttatttgcatcaggtactttatttggaacagcaggtattaaagctttagcaagtgatgatgctaagaagctttacactaactgtacagcagctgttttaagagcaaaagaaacggttatgaatacagttacaactgttcaggaaaatgcagaagatatttacgaaggtgcaaagcagattaacgaagagcgtgcagaagcaaaagctgcagcagaatttgcagaagaagcagaagcggaagaagaaacagaagaagaaacaacagaagaagttggggcagaagcagtagaggaagctgcagaatagttttaacaatttggatgaagagttagataaagagactgcagaatagaggcggtctctttttttaacagttgatgtgataaacagacaaacagataaatgaagaggtgaatattttgaagtttcagataaaacatgagataaaaggaagaatacgttttcatgtagttcagaagaaacagatgacctgtgagcaggcagatattctgttatattatctggaaaatatggaaggcgtggaatctgtaaaagtttatgacagaacagcagatgcagttgtttgttataaagcggatgcggatggccttgtacgaaaaaatattattaaaggaatacaaaaatttgtttatgaaaaggttgaagtaccggatggcattattgaaaactccggaagaaatctgaatcgtgaatttcaggaaaaaatgatcggacagattatggcacattatgcaagaaagattttattaccggcaccgtttcgtgcagtgtatacaggggtaaaatctattggatatatatggaaaggaattcggacccttacacagcgtaagttagaagtaccggtacttgatgcgacagcaatcggagtatctattcttcgaggcaattatgatacagcaagctccgtcatgttccttcttggaattggagagctgctagaagactggacacataagaaatccgtaggtgatcttgcgagaattatgtcactgaatgtagaaaaggtatggctaaagacagaggatggagaagttctcgtaccatattcacagattaaacagggtgacagcattgtcgtacacatgggaaatgttattccatttgatggcattgtaagtgccggggaggcaatggttaaccaggcttctctcaccggggaatccatgccggtaagaaaggcagatcaggcatctgtttatgccggaacagttgtagaagaaggagaaatcactgttgaagtaaaagcagtcggtggaagtggacgctacgacaagatcgttacaatgatcgaagattcacagaaattaaaatcaggtcttgagggcaaggcagaacatttggcagataaactcgtaccatatactttagcaggaactggacttgtatatttggctacgagaaatgcaacaaaagcaatcgccgttctcatggttgatttctcctgtgcgttaaaacttgccatgccaatctctgtattgtccgcgatacgtgaagcaagccagcataacgtaactgtaaaaggcggtaaatatatggaagccgttgcagaggcagatacgatcgtattcgataagacgggaacgttaacaaaagcagagccaacagtggcagaagttgtcccatttggaggaaataatgcagatgaaatgcttcgtatggcagcatgtatggaagaacattttccacattccatggcaaaagcagttgtagatgcggcattaaagaaagaccttgatcatgaagaaatgcactcaaaagtgcagtatgttgtagcgcatggaatttccacaacaatcgaaggaaaaacagccataatcggaagctatcattttgtatttgaagatgaaaactgcaagattccagcaggagaagaagcaaaatttgaagctcttccagaagagtattcccacctttatcttgcattagaaggcacacttgctgccgtcatctgtatcgaagaccctcttcgtgaggaagcagcagatgtcattaaaaagctgaaaaaagcaggaatcacaaaagttgttatgatgaccggagacagcgagagaaccgccgccgccatcgcaaaacgagttggcgttgatgaatattattcagaagtacttccagaagataaggcaaactttattacgaaagaaaaagaaaaaggaagaaaggtcatgatgattggagatggaatcaacgattccccggctctttctgccgcaagcgtaggaattgctgtcagtgatggtgctgaaatcgcaaaagaaatcgcagacatcacgatcagcgcagaaagcttatatgaagttgtcgccttaaaacagctcagtaatgcgttattaagacgaattcacacaaactatcgttctatcgtagcaatcaactccagcctgatcgtattaggagtcgcaggagtattagcaccagcaacatccgcactgtgccacaacgtatcaacactgttaattagcttaaaaagcatgaagaatttgcttccttaatttaggggaaacagacgaaacgaaaaaaatctaatgattgcatctgtaaagatagtcgcggcgagaagaatgctaaatcgcatccttctcttgctccgacattacatctgcaatcattagatttttttcgtttctgtgttttgctaaattgaagtaaaaattaaacatgcaaagaaagaatggggaataggtcggaagtctatgttattaaaattcagaaaaagcttcagtatggtagtatattagaattttccaaagactcctgtcttatgctccttgtcttgcccaatattgctcgacttgaatattcatatggagccaataaacagaaaataaaaaaatagacccttgcaactgtaatgtgagagcaaataaaaatgccgggaaggcattttctatgcagcgatatctttacagatgcaagggtctaatttttttattttcgtttgttcatctaaattttttattttcgttagtttaatgcatgaaataaatagttatagagaaaagtatatcaataaagctattgacttatgagtggaagttaggtattataaatgcaagttagtaataactaacgaaacaaaaaacaaggaggcaccatgagacaggaagtatttgagattgtacagaaaatggataaagataatatcagaacacagatggccctgcagtgtgcgccgctgattaccggacttaaggtggcgaatcttttgattataccatcaaagaacgagaaatatgttggagcaattcttgatggaacggatatttcttatataagattggcaaagtcagaatgtaagacaacattttttctgtacagagaagaaaggctgactgcctggcttatgcgggcagagaacagagttcttcttacggaggcgggatacagaggaattatcttatcagatattcttcaaacaattcagatgcgatatgaagcttacgtgcagaaagggaaagcttttccccatgagattggtgttctgttaggttatcctgcagaagatgtcaaaggatttgtggtgaatgaggggaaaaattatctctattctggttactggaaagtttatggagacctgtcagaagcaaagcaattgttttacaaatttgaccgggcgaaggaagcgttaattgaactggtatcaaaaggtatcggaataagaaatgtaatcgagagctgcagcagtaatttactgctggatggcgcggcttaaagttccttgtaagaccctttcaatgatggaaacatcgtggtgaatcacagtaataattttcaggaggaagcagcaatgagcaagataagtgtagtgtactggtctcagacaggtaacacacaggctatggcagaagctgtcggagccggaattacaaaagctggtaaagaagcggatgtagtagaagtctcaggcgcatctatggaagacttaaaagcagcaaaagtatttgctcttggatgtcctgcaatgggtgctgaagtactagaagagatggagatggaaccgtttgtggaagaagtagaaggcttcgcacagggaaaaaccatcgcactttttggttcctatggctggggcgacggtcagtggatgagagactgggaagaaagaatgacagcagcaggtgcaaccgtattaaatggggaaggccttatctgccaggaaactccagatgatgacgcgatcaaacagtgtgaagaactgggagaacagctggctcagaacgcataagaaagcgtatcattcaaagaaatactcgtagtaactcatagtaaaaaatagtaacaagcaattatagtaatcgcatagtaacgcatataaaaaaactcataataacgcagtaaagtaatttatattaaaaagtaacgtatatcaataagtaattacacatttaaaaaatacctctaatttaatgaaataccctttctaaaatttattagatatcagggttaaaaggtcaaaagtcgtcttgcaagcaagcttgtatcggctttctgatcttttgaccctgatattatttatctcagtcgagaagactcccacctctttcaggtggctcgacttgaatgtagtagaaaagacaaataagataaaaagccgaaaactgtgaaaattccggcttttttgttttgtaattattttttgagaagagcttttttataaataatataagatatgatcgctgtaatcgcttcggtaatccagaaggaatgccatacaccggatacaccagagaattggcttagtacaaatgcgagcggcacgatgattatgagatagcgaagtaaggaaacggcaagagattcatttcctttaccaagtccctccaaagctccacttgatacaacagatacggaagaaacgataaaaccgcaggaaataattcgaagagcggaggcaccggctgtgatcgtagaaggctgtgtggtgaacattttcataaaggtttcaggagtgaacatgaaaagtgcggttccgacagccatgattccaaaggcaatcatgagcgccagattgtaaatcttatttactcgtttatattcttttgcgccgtaattatatccgataattggacgcatcccctgaatcattccattgacagataaatataaaaaggtctgtaatttataatagattcccaagattgtaacgcctgtttctgatatagatgccaaaatggcattaagagcagaaatgagcagggatggcagtgccatatttaatgctgcaggaattcctactccatagaggcgggcacatattttcttttctgggcgaatcaggtttctatgtatttttacaggtggcttttttataatataaaataaaaggtaaatcagcagggtggaacattgtccgattccggttgcgatagcagctccttcaattccaagtcgagggaaaggaccaagaccgaaaatgagaatcggatcaaggataatatttagaatacatccgcagagcatactgagcatgctgacaaccatcatccccatcgcctgaaagtatttttcgaaagtgatttccgcatggataataattgaaaaaagaagaacgatattggaataacgtaaccctaacgataaaatattttcattgtgagtaaatagttttaaaaatgaaggcataatgaggatgcctgtgatacttaaaaggattccgtgaacaatggagaggaagaatccctgtgaagcagctttgtgcgcatgaagctggtctccggcaccgagacaaaaagcaatcataacattgattccgatgccgaaaccgaccgcaacagagttgacaaaattttgtattggaaatacaagagaaagtgcggtcatggcatcttcgctgatctgtgcaacgaaaatactgtcgataatgttgtaaagagaatttaccagcatggataaaatcattggtgctgccatagaaagtaaaagcggcagaatcggtttttctttcataaaagtctggtccataaaatatcttttcctttctgtattatttattattaattttttaccgagtacacattgatgctgttagatttgtggattttatttatcaagttgcttttgccagttttctattttactatatagattttctgtacaaatgctggtaaatattttttatgacaaaaactgtgcctgtatattctgtaaaaaggggtagtttatcgcaataaaaaaggctacaggattctgtactgtttaaatcagaaacagaaaaacctatagccttgtttagacgatatattattttagccacattattataagtgatttgaaaaggaaatgtcaagcactcttttttagaaaatcgagaggaattcccgataattgaattataatttttgcgggtaaatgtttaaaaatattttttagatatatttttcaaacacgttccagtgagattttgcagatgaactcataaggaggtaaaaagtgtggttctggatagataaataagtatagaaatataaaaaagattaaatttatattacaaatgatatattgtaattaacaggaagaaaggactatgttataatcaataacaaagataatgtttgatatggagaagcttcgtacattgaataaaggctggcgacacctgttttgtttgctgtgaggacttctgtcataatcttgcattgaataaaggctggtttttacagcccaaagagagaaaaaggagatgtttatgaaaaaaattcatgcattagttatgtctcttatcatgctttttactgtgttggcaccagcgcagaatgtggaagcagcaggcaaaagcctgaaagtttctgagaaagcatttttcaaagagatgaaagaatttgactacaaaggaatgaaccgatatgtgaaggactggggagaaggtggacagtttgtgtcggcattttacatggttccgagtggtaaaaagtattttgctaaatgtgccagcaagatgagttaccgtatcatttccacaaagaaaaagggcaataaggcagatgtgaaagtgaaattccgctatgtgaattgcgaggattttacatttaatttctgtatgaatgcattttattatatggcagatggaaagcttgataatttatcttccatgtcagaaaagcaggttataaaactggtaaatggaattattgacaaatcgcagaaagatacaaagtttaatcgttttaagactaaaacagttacaattcgttttgtgaaagcaaagaattgctggaaggttcagaaagtttctgataagttagctgatgttatgatggcgaactttgcatcaaatcttcagaatttggcaacattttctatttcggcagcttgtggagaaaagagtgcatacgttatacctgagacgtcggtgtataggacagtgcagaaaaaagtactggttaaagtgttaaaaaatatttatggaagaaagccggagttgtctgcataaagctcatttatacatttactgaaatatttatgaagtttattgcattaaaaattgtgcttgctatttcttaattcctagtatattattaggaattaggaggtggagaggtatgatggtttcatcgaaaggtcgttatgcacttcgggtaatgctttatttagctcagaatgacagagaagaattagttccgttgaaggagattgcggagagtcagaatatatctatgaagtatcttgaaatgatcgtaagccttcttcataaaggaggcatgcttataagtggtcgtggcaagaaaggcgggtatcgtctggcgagaaagtcttcagagtatacgataggctctattttaaagttgacagagaagactttggcaccggtgaattgtctcgaaggaggcaaggtgacctgcgagaaagcaggatattgtattacgctcccaatgtggcagaagctggatggtattattgatgactatttagagacagtgactttggaagatttactggagggtcgggtataatccgattcttcagtattttttatttagcagtatttttttggtatacactttcgtgtataaaataaaaaacatgaatagaaatatcttttttgtaaaatcctattgacaggataggaatttaaagatataatccctataaaacagataggatttagaaagaagagggtgaatttatgtatatttatgcagataatgcaggaactacaaagatgagtcctgttgcgatagatgcaatgacaaagtgcatgaatgaggtttttggaaacccatccagcctgcattctacgggacagcgtgcagctgaagtacttcagaaagcaagagaggacgttgcagaagctttaggagcagattttaatgagatttattttacttccggcggaagtgaagcagataaccaggcaatccgttcagcagctctttttggagcgaagaagggaaagaagcatcttatctccacgaagattgaacatcatgcggttcttcatactcttaagaagttagagagagaaggatttgaagtcacattattagatgttggagcagatggaatcgttgaccctgcagatgtggagaaagcaattcgtgaagatacggcattagttactattatgtatgcgaacaatgagattggtacattacagccaattgatgaaatcgcaaagatttgtaaagagaaaaaagtaacattccatacagatgcagtacaggcggttggacacgttccagtgaacgtacatgcacagaatattgatatgttgtctttatccggacataagttccatggcccaaagggaatcggtgttctttatgtcagaaaaggtgttccactgtttaacttgatcgaaggtggcgcacaggaaagaggacgaagagccggtacagagaatattccagctatcgttggtatggcagcagcattaaaagaagctgttgcaaatatggatgagaatatgattaagatagcagcaatgagagaccgtctgattgagggactttctactattgaacattctcgtttaaatggtgatgcgaagaaaagacttccgggtaacgtaaacttctgttttgaaggaattgagggagaatctcttttattattactcgatgaaaaaggaatcgaggcatcttcaggaagtgcctgcacatcaggttctcttgatccaagccacgtattattagcaatcggactgcctcatgaagtggcacatggttcacttcgtcttacattatgtgaagagaatacaccggaacagatcgaatatatcattaaagaagtaccaggaatcgtttcttatttaagagacatttcaccaatctgggaagagcttgagaagggagagaagaaacatgttatatagtgaaaaagtaatggatcatttccgcaatccaagaaacttaggaaagatggacgatgcagatggcatcggagaagtaggtaatgcaaagtgtggtgacatcatgaagatgtacattaaagtaaaagacggaattattgaagatgtaaagtttaacacatttggatgtggttctgctatcgccagcagttctatggcaacagaaatgattaaaggaaaatctattgatgatgccctagaattatctaataaagcagtagttgaggcgcttgatggactgccaacacataagattcactgttctgtattagcagaagaagctgtaaaagcagcagtaaaagactactatgataagaacggaattgcgtacgataaagaaaaatttgcaccaggctcctgtccaacatgtggagagtaattgatttagtggtttattggtagtttaatagaaagaaaaagacttatagctatatttgtgattttcgtcgtgacggtttggatatctgcttatgcacttgcatacaaaccttgcttcgaggtcataaatatgcttataagtcttttttatttcagggctgtttttcattcgtctcgccattgtcgcaataaatcccaaggacgagggaattctcccataaaataaattgacatatcactgaactatttgtataataacaagtgtgttaacttattttattcttattatttatgaaacttataataaaatggaggaggaatgaaagaagtttttcctgatagcatgatcgtgtaagatatcaggagagcgaatgacatgggttatttgcaaagttacagcaaagcaggagaacattaagcaataaggaggaagccatgaataaattagaacttcagaaagtggcaaatgaagtgagaaaaggaattatcacaggtgttcatgcagcaaaagcaggacatccaggtggttctttatccgcagcagatctttttacatatttatactttgaggagatgaatgtagatccgaagaatcctcaggatccagacagagaccgtttcgtattatcaaaaggccacacagcgccaggtttatacgcagcattagctaataagggatattttccagtagaagacttacttacattaagacatatcggttcccatcttcagggacatccatgtatgcagcacactccaggacttgatatgtccagtggttctctcggacagggaatctccgctgcagttggaatggctctttcagcgaagttaagagagaaatcttatcgtgtttacacacttcttggagacggtgagatccaggaaggacaggtttgggaagctgcaatgtttgcaggagcaagacatcttgataacttagtagtgatcgtagataacaacggattacagattgatggtaaagttgaagatgtatgttctccatatccgatcgataagaagtttgaagcatttaacttccacgtaattaatgtagcagatggtaacgattttgatcagttagatgcagcatttaaagaagcaagagaagtaaagggaatgcctgtagcaatcattatgaagactgtaaaaggtaaaggagtttcctttatggagaatcaggcatcctggcatggtactgcaccaaacgatgaacagtatgctgtagccatggaagatttaaagaaagtggaggaagcattatgtcagaagtaaagaagatcgctaccagagaaagctatggaaatgcgttaattgaattaggaaaagaacacgagaatcttgtagttttagatgcagaccttgcagctgctacaaagacaggaatgtttaaaaaagttttcccggaacgtcatattgactgcggtatcgcagaatgtaatatggtaggaatcgcagcaggtcttgcaacaacaggaatggttcctttcgcaagtacatttgccatgttcgcagcaggacgtgcatttgagcagattcgtaactctgttggatatccacatctcaacgtaaagattggcgcaacgcatgccggtatttccgtaggtgaagacggagcaacacatcagtgtaatgaagatatcgcattaatgcgtacaatccctggaatgacaatcattaatccttccgatgatgtagaagcaaaggcagcagtacgtgccgcttatgaattagacggacctgtatacttaagatttggtcgtcttgctgtaccagtaatcaacgacaacgatgattataaatttgagatcggtaaaggagttgtattaagagaaggtaaagatgttacaatcgtagcaacaggtctttgcgtaagctctgcattagaagcagcagacatgcttgctgaagatggcgttgaagcaaaagtaatcaacatccatacgatcaaaccaatcgatgcagatctccttgtagaagcagccaaagaaacaggtaaggttgttacagtagaagaacattccgtaatcggtggacttggcggagcagtatgtgaagtactttccgaaaaatgtccggtacctgttaagagaattggcgtgaacgatgtttatggagaatccggtcctgcagtgaagcttattgagaaatacggcttagacggcaagggcgtatatgcttccgtaaaagaatttgttaaataactatttgattctttgagaggaaacagacgaaaataaaaagaatagaccatcgcaactgtaaagatatcactgcgtagaaaatgcctgttcggcatttttacttgctctcacattacagttgcgatggtctattctttttattttctgtgtgttggctccagaaggaatgaatgcaatagtatttggggagataaagggggagaggtcagaagtctactacttgctcggaagatatctctgtcatggaattttatttatctgttctcgcatttcttttgcgatggtctattctttttattttctgcttgttggctccagaaggaatgaatgaaatagtatttggagagagatggggaaggggatagaaggttgtggcgtattctgatactgtttccgcgatgctgtcaatgatgataaaatgatattgccagctatcattggatatgataaatgcaccattatattgtagcaatatatttagatttcctgctcgttaaagagagagaaaataatcttctggatgatatatcttctgagcaagcagtagtcttctgatttctcccccttctcctccaaaaactattgcgttcattccttctggagccaaaacacagaaaaaagaaatactgccctatcccaagccacatctgggatagggcagtatttcttttttcgtctgtttccctcttaatgaatagcaaattaatctaataaatgtccttcctggtaagaacattcaatatagctcgggttctgataatataaatctgtattaaagttagagatttcgtcgcttataaaagaagaaaaaatacgaataagttcgtcaacttcttttccttcttcggcacaatcttctatcatgatactgtataatttgccaatatccataaagtttggaactgtatatttacaggtagatatagtatcaaaatcaccttctggaatattataaaattcgataagctcatcacttacctggtcaaaacttaaacagtgatttacttcagcatcatataattgtttttcaattccttttttgccgagcaaattaacaatagttcctcgtttgttttttgttttgcgagcgatatattctattaaagagcatacataaaagtaatcattttgttcctttggtgtcataaataacttcactcctttcgaaagttagacagtctaaagcagaaagcgtgtggaaacttatttgatgtgtaggatatttgaattccgctaatacccaaaactgcttacgtgtgattcttccagacaaataatcatttacatagttccagatggtgtcatttgccatgggaccttctacgatatcaaaagaatgagtttttccatttctgcattttgctataaaatctaaccagtcatctgataattcagggaattttaaaatgtttaaattttcatttggttcataattataataatttattataggttctcctggacctcgattggcccatcgaattgcctgctttaaattattagtacaataaaatccccaggaaaagtctttcgtatatcgtgcttttcgaatttcaggaaactgtacgatttctttactagcgtgatataatatcatataaaacagtcctttctaaaagaatttacatttagtttatcataaaagacaatgcagaggaagtaatcaatgactacatgatcaaaattagagaaggacctctactaatagaaggaattcctgacttttttcaagcttcactgatgataagatgatactgcaagctatcgctgtacatgatgcacatctcgtagcaagagccttctgacctctccccttctccctcccaaagactattgcattcattccttctggagccaaaacacagaaaaaagaaatactgccctatcccagatgcggcttgggagcgtgtttaagatgcggatgagcatcttaaacacaacgactacagagcagatgggatagggcagtatttcttttttcgtttgtttccccctaatgaatcaaatagtaatcacttatccattttgtcaaattaaaaaaagttgctgaaattcggtgcttttttactgctattttatacatattatatggaagtatttttgtgtctatgtttaactggcgaaaaaaatggaaaaaatcaaaaataagagaaaaaaattagttgacatagcttgacagatgtgctatgataataaactgattcacaatgggtctgtatgcctattggaaagtaaccagaagattttacattatgattattcaaggggtgaaaacatcgatggaaaagaatagactgcgtccaacgcgaattccgggaagcaaaaacatcagaatgagctatgccagacaaaaagatgttctcgatatgccgaatcttatagaagtccagaaagattcctacaagtggttccttacagatggattgaaagaggtttttgaggacatttcgcctatcacggattacagcggacagctcagcctggagtttgtggactttcagctttgtagagaggatagaaagtattcaatcgaggagtgtaaagaacgtgatgcaacatatgcagctcctttaaaagtgaaagttcgtctccataataaggaaacagatgattttaaacagcacgacatttttatgggtgatctgccattgatgacggaaacaggtactttcgtaattaatggtgcggaacgtgttatcgtcagtcagttagttcgttctccaggtatttactatgcgatcagccacgacaagattggtaagaagttatattcttgtaccgtaattcctaaccgtggtgcatggctggaatacgagacagactccaacgatgtattttatgttcgtgttgaccgtacaagaaaggttcctgttactgtacttgtcagagctcttggcattggaaccaatgccgaaattaaggaattattcggagaagagcctaagattttaaaaactcttgagaaggatacagcaacaaactatcaggaaggtcttaagaagttatacgagaagattcgtccgggcgaacctttatctgttgacagtgcagagagtctgatcaacagtatgttcttcgatgcaagacgttatgatcttgcgaaggtaggacgttataaatttaataagaagttaatgttccgcaaccgtattgcaggacatagactggcacaggatgttcttgatccttctacaggcgagatcatttttgaggcaggtgtaagacttacaaaagaacaggctgacacgatccagaacgcagcagttccatatgtatatgtagagacagaagagaaagaagtaaaagtcctttccagcatgatggtagatatcacaagttttgttgatgttgatcctcaggaagtgggcgttactgaacttgtatattacccggcccttgaaaaaatcttagaagaatatgatgatatagatgaaattaaagcacagattcgcaagaatattaatgagttgattccaaagcatatcacaagagaggatattttagcttctattaactacaatatccatctggaatatggtgttggtaatgacgatgatattgaccacttaggtaaccgtcgtatccgtgctgttggtgagttgttacagaaccagtacagaatcggtttatcccgtctggaaagagttgtcagagagcgtatgacaacacaggatattgagtccatttctccacagacattaattaatatcaagccggttactgctgctgtaaaggaattctttggaagttctcagttatctcagttcatggatcagcataacccattatctgagcttacacataagagacgtctttccgcattaggtcctggtggtctttccagagatcgtgccggattcgaggttcgagatgtacactattcccactacggaagaatgtgtcctgtagagactcccgaaggtcctaacatcggtctgatcaactctcttgcaacttatgcaagaattaatgaatatggttttgtagaagctccttaccgtaaggtagataagagtgatccacagaatcctgtagtaacagatgaagttgtatatcttactgctgatgaagaagataactacacagtagcacaggccaacgaaccgttagatgaagaaggtcatttcattcatacaaacgtttccggtcgttacagagaggaaacatctgaatttagaaagtcaagaattgacttgatggacgtatctccgaagatggtattctccgtagctacatccatgattcctttccttgagaacgatgatgcgaaccgagctctgatgggatcaaacatgcagcgtcaggccgtacctctgttaaagacagaagttcctgttgttggtactggtatggaagcaaaggctgcacgtgactcaggtgtatgtattatcgcacatcatgcaggtacggttgagtattctacaagtaaagagattattgtaaagagagaagacggaattcgtgatacgtatcacgtaatcaagttctcccgaagcaaccagggtaactgtatgaatcagagaccaatcgtaaataagggagaccatgttgaggcaggagatatccttgcagatggtgcttctacatgtggcggcgagatggctcttggtaagaaccctctgatcggatttatgacctgggaaggttataactacgaggatgccgtactgttaagtgaacgtcttgtacagaatgatgtatatacatctgttcatatcgaagaatatgaggcagaggcaagagatacaaagcttggtcaggaagagattacaagagatcttgcaggactgagtgaagatgtattaaaagatctggatgagaatggtatcatccgtatcggtgcagaagttcatgccggagatattctggtaggtaaggttactcctaagggagagacagaacttactgcagaagaaagacttcttcgtgctattttcggtgaaaaagcaagagaagttcgtgacacttcccttcgtgttccacatggcgcttacggtgttgttatggacacaaaggtatttacaagagagaatggcgatgagcttcctccgacagttaacaagtctgtgcgtgtttacattgcacagaagcgtaagatttctgttggtgataagatggccggtcgtcatggtaacaagggtgtagtttcccgtgtacttccagtagaggatatgccattccttccgaatggtcgtccacttgatatcgtactgaacccattaggtgtaccttcccgaatgaacatcggacaggtcttagagcttcatttaagtcttgcatctaaggtgcttggatttaatgtagcaacaccagtatttaatggtgcagacgagaacgatattatggatactcttgagatggctaatgattatgccaataagacatgggaagaatttgaagaacgctggggtgacaaggttaacgatgatattatgaaatatctctgggataaccgtgaccacagagaagaatggaagggtgttccaatcgaccgtaccggtaaggttcagcttcgtgacggacgtactggacaggaatttgattcaccagtttccatcggattcatgcattatctgaagctgcatcacttagtagatgataagattcatgcacgttctacaggtccttactcactggtaacacagcagccactgggtggtaaagcgcagtttggtggacagcgtttcggagagatggaggtttgggctcttgaggcttatggtgcttcctatactcttcaggaaatcttaactgtgaagtctgatgatgtaataggtcgtgttaagacatatgaagcgattatcaaaggtgagaatattcctgaacctggtattccggaatcctttaaggtacttcttaaagagttccagtccctcgctcttgacgttcgtgtcttaaaagaagatatgacagagattgagcttcaggaaggcagtgaaacaattaatgaatcccttacttcagtgattgagagcagtccggatgataataattataaggatgagagcaatcttggagagtatggctacaaagaaagtactctggaagaagaaaccggacaggtggatgcacagccagagtttgcaggaatgcctttcggtgattccgatttgtaagatagtttggaaggagtaacctatgtctgatatgaataaccaaacagttgaacagccggttaattttgacgccattaagatcggacttgcgtctccggaactgattcgtcagtggtctcatggtgaggtaaaaaagccggaaaccattaactaccgtactttaaagccggaaaaagatggtctgttctgcgaaagaattttcggaccaagcaaggactgggaatgtcactgtggtaaatataaaaagattcgctataaaggcgttgtctgtgataaatgtggagtagaagttacaaaggccagtgtaagaagagagagaatgggacatatcgagcttgcagctccggtatcccatatctggtacttcaagggaatccctagccgtatgggattaatccttgatatgtctccaaaggcacttgaaaaagtattatactttgcttcctttgtagttcttgatccaggaacaacaaacttaagcaagaaggatgttatctctgatgcagagtaccgtcgtgttacagaggagtacagagattctgaagaaggtcttggaagcttccgcgtaggaatgggtgctgaggcaatcaaagaacttcttggagagattgatcttgaagcagaagcagaagaacttaagaaaagtcttaagaacgccagtggacagaaaaaagctagaaatattaagagattagaagttgtagaagcattccgtctgtccggaaactctccggaatggatggtacttgacgctgttccggttatccctccggatatccgtccaatggttcagttagatggtggacgttttgcaacatctgatttaaatgatttatatagaagaatcatcaaccgtaataatcgtcttaagagactgttagaacttggcgctccggatatcattatccgtaatgaaaagcgtatgctccaggaagcggtagatgcgttaattgataacggccgtcgtggccgtcctgtaacaggaccaggaaacagagcattaaaatctctttccgatatgttaaagggtaaacagggccgtttccgtcagaaccttcttggtaagcgtgttgactactcaggacgttctgtaatcgtagtaggaccggaactgaagatttatcagtgtggtcttccaaaagagatggcgatcgagctgtttaagccatttgttatgaaagaacttgtagcaaacggtcttgctcacaatattaagtctgctaagaagatggtagagaagttacagcctgaagtttgggatgtacttgaagatgttattaaagaacatccggttatgttaaaccgtgcccctaccttacatcgtcttggtattcaggcattcgaaccaacattagtagaaggtaaagcaatcaagctgcatccattagtatgtacagccttcaatgccgacttcgatggtgaccagatggctgtccatctgccactttctcaggaagcgcaggcagagtgtcgtttccttttactttctcctaataacctgctgaaaccatcagatggtgcgccagtagctgttccttcacaggatatggtccttggtatttactacctgactatggaaaaagaaggagcaaaaggcgaaggtaagtgctttaaatctgaaaatgaagcatatcttgcttatgagaacaaggtaatcactcttcactccagaattaaagtaaagagaagaggaatgagaccggacggaacaatgggaagccgtattgtagattgtacaatgggacgtcttcttttcaacgaaatcattcttcaggatttaggttttgttgatcgttctgatccagataacttcttaaagttagaagttgatttccagtgtggtaagaaacagttaaaacagatccttgaccgttgtatcagtgtacatggtacaactaagacagcagaggttcttgataatattaaagctcttggatataaatattctacaatcggtgcgttgagtgtatctatttcagatatgacagtaccaaaagaaaaagcagatatccttgcagcagctcagaaacaggttgagtacattacaaaacagtacagacgtggtttcatgacagaagaagaacgttacaaagcagtagtacagacatggttcgctgccgataacgaacttacagataaactgatcagtggtcttgacaagtacaataacatcttcatgatggctgactccggtgcccgtggttctaaccagcagatcaagcagcttgcaggtatgcgtggattgatggccgatacatccggacgtacgatcgagctccctatcaagtcgaacttccgtgaaggtcttgacgtattggagtacttcatttctgcacatggtgccagaaagggactttctgatacagcgcttcgtacagccgattccggttacctgacaagacgtcttgtagacgtatcacaggaactgatcatccgcgagcaggattgctgtgaaggaacaaacaagattccaagcatgtatgtagaagcaatcatggatggaaaagaaacaatcgaaacattagaagaccgtatcagcggacgttatgcagcagaagattataaagatgcagaaggtaaccttatcgttgaagctaactgcatgattactccaaagcgtgcaaaagcgatcgttaatgctggatatgaaaaggttaagatcagaacaatgttaacttgtaagtcccataacggtgcatgttctaaatgttacggtgccaaccttgcaactggtcaggcagtacaggttggagaggcagtcgggatcattgctgcccagtccatcggtgaacctggtacacagcttaccatgcgtacattccatgccggtggtgtagccggtgatgatatcacacagggtcttcctcgtgtcgaggagctttttgaagcacgtaagccaaagggtcttgcaattatcagtgagattgctggtcgtgcagatgtaaaagaaacaaaagaaaaacgtgagatcactattgtgaatgaagatagtggagaaacaagaagctatatcattccatatggttcccgtattaaagttctcgacggcacttacttagaggccggtgctgaactgacagaaggttctgtaaatcctcacgatatcttaagaatcaaaggcgcagaagcagtacaggattacatgatgagagaagtacagcgtgtataccgtctgcagggtgtagatatcaacgataaacatatcgagatcattgttcgccagatgcttaagaaagttcgtattgaagatgctggagatagccagtatcttccaggagcactcatcgacattcttgaattagaagatgagaatgagagacttcttgcagaaggaaaagaaattgcaacagcagagcagacacttcttggtatcacaaaagcgtctcttgcaacaaactccttcttatcagccgcatccttccaggaaacaacaaaggttcttaccgatgcagctatcaaaggaaagatcgatccactgatcggtctgaaggagaatgtacttttaggaaagcttatcccagcaggaacaggcttaaagaagtatcgtaaccttcacctcaatacaggaaaagtagtgaatgaaatcgaagaagtagatgaatttgactacgatgcggattacccttccatggatgaagaagtgcaagatcagaagtcagatgatgtagcaatgagtttagattccagaggagaggaactgtaattcagttcttttagaagataaaaataaagaatgtgccacataattactgtgtggcacatttttttttgctattatgctattatatatcagatgtgagatgcctcccatttctactgtacatttcgtagcaagaatacatcggcattcttaaatttttaagaaaatgttgttggtaaagttaataaaatccttacttcaaaagtttgattttcataatttacattcataataccattgtatttttctgcgattagctgggcagagtaaagaccctgaccagttccttcatgttttgtcgaataaaagacattattttttattttgatgttaccatagtaaggattgcgaatctgcaaagcaagagtggcaggattcgttcgggcaaattttaaagaaatatgtcgttcatcttttggaagtacccggcaggcagcaatagaattatcaagaagattaccaagtaatacacaaaaatcagtctccttaaaagtattttccggaatatcaagccggatagaaaaatgtgttttgatgaataaatccttacattgtgtttcataatgatttaatatcgaatttactccaacaaaagaacaatatcgttttggcgtagcaggtatcgctgaagagaattccttcaaatattcttttgcctctgcatatttattttcctcaagcatttgatttaaagtggcaagatgatggcggtaatcgtgacgtaatctgctagtatcattaataaaagcctgtaattttcgtgtttgctcagcctctatctgaaggtagagatttttttccgtcactttttgtttttcaattacaatgtgagcaatttgaaaaaagagcagatatacaatcataataagagaaacactcatagcaatagctaataaatatatttctaaagttttatcaacgtatattttatcgctgttttccggaacaagatattgagaaaaaaacacaaaaagggcaggtggaatccatatgatcttccatattttttcttcatgaaaagagttgaccagccagccaagatatctttttgcaggataagctaaaagaaaaaccaaaatccattcgaaaaactgctcgatcataagtactgttaaaggactgtaaggaagaacagtgctgtggggatataaaaggatatctattatatagtagaaaaggtaagcgaaggaacctaaaagacaggcactcataaatataaaccataaatgtgaacgtggtaaggcaacggttctttcgtaaaaataaaaaaagataaaaatgcatagaaatgcattcacagtgttggaaatccagaaaggaagaagcagaaaaaaaataaacataacaatctctactaaaaatgtaactagaacaaccttttttatgagtgaaagaagagaaactgtaatttgagaatatacagggataaagcagaaaacaataagtggaaaaatcatgatagtttcccgggtaagaaacagtgcggtatgtatactgttcaattagattacctcctcgtttaactttttaaattggtaatcctgatattttttcaggagttcattgcaatcctttctacggagtggaagatgttttccatcctgcatgataaaaacttcattattagcctgacaaacataattcatatttaaaataatacctctgttgcagaaaagaaaaggttccttttcatggagctgttctgcaatagaagaaaaagtaatacggcattggagctgtttgttatcagaaaaggtaaaaaccgtatatttatctttggaaaaaagatactgcagctgtgaaaaattcagggaaaaattcttttttcctacaatgaaatccagagttccatcatatttatgcagtctttttaaggcagaatcaagaacatcgttaatgttttgttctgtaacagaagtctttaacaaataatcaaaacaggcatgcgtcttaattgcccgccacatatcgtcctggctggaagtaaaaaagattataagacagtctttatttgaagagtggattgtatgtgcaatttcaacaccatcaattccttccatatatatatcaacaaaaataatagaatactcggtgtaaatagaatttttaaaaaaaagttctcctgatgaaaacgtatctatagaaaaaggaaaaggatggttctgtccatagttttttatataggttgttaaatattctcggtcattttggtcatcatctataatagcaatcttcatgtgcatactccataacatatttaaaatagaaatcataaataatatataataaaaaaaacagaaagtccagtttaggaaattaaaaattacctcttgacaaaaagtttttttaaagatataattcgtaattgtgtgcagatgtataactatgcccacaagagggtataatcaagatgatttgtcatattggtttagcccagagaagaaactattagcaaccacattagaaaatatgcatggaggtgaatttcagaatgcctacttttaaccagttagttagaaaaggaagacagtctgtagcaaagaaatccacggcacctgctcttcagaaaggatttaactccttaaagaaaagaccaacagatgccagctcaccacagaaacgtggagtatgtacagccgttaagacagcaactcctaagaagcctaactcagcgcttcgtaagattgccagagtacgtctttccaacggtatcgaagtaacaagctatatcccaggtgaaggacataaccttcaggaacatagtgttgttcttatccgtggaggaagagtaaaggatttaccaggtacaagatatcatatcgtacgtggtactcttgatacagcaggcgtagcaaacagacgccaggctcgttccaaatacggtgctaagagacctaagaaataaatatcagtgagaatgccggaatagcaatattttctctgttggttgcaggcaatatattgacttgtccgagcatgaacaacggaaacagaagtttccatgagtaccgatgatttaatatttcatttcctcatggaaatgaagaaatgaaaatcacatttaattaaggagggaagaaccgtgccacgtaaaggacatatcgcaaaaagggatgtattaccagatcctatttacaataacaaagtggtaacaaagcttatcaataacatcatgttagatggtaagaaaggtgttgcacagaaaatcgtttacggtgctttcgaccgcattgcggaagaaacaggaaaagatgccttagaagtatttacagaggctatgaacaacattatgccagctctggaagtaaaggctagacgtatcggtggtgctacttatcaggtacctatcgacgtaagaccagacagacgtcaggcattagctcttcgttggatcactctttactctcgtaagagaagtgaaaagactatggaagagcgtcttgcaaaagaacttatggatgcagcaaacaacactggtgcatctgtaaagaaaaaagaagatatgcacaaaatggcagaagcaaacaaagctttcgcacattacagattctaataagttatttacacaggatgtgctgcataggttatgcagccgtccggatacattttataggaggaaaaaaccttggctggaagagaatatccacttgagagaaccagaaatattggtattatggcccacattgatgctggtaagacaacattaacagagcgtatcctttattatactggtgtaaattacaagattggtgatactcatgaaggtactgctaccatggactggatggaacaggagcaggaaagaggtatcacaatcacttccgctgccacaacatgtcactggactctggaagagaattgtaaacctaaaaaaggtgctttagagcatcgtatcaatattattgataccccaggacacgttgactttacagtagaggtagaaagatctcttcgtgtattggacagcgctgttggtgtcttctgtgcaaagggcggtgttgaaccacagtccgaaaatgtatggcgtcaggcagacacctataatgtaccacgtatggcattcatcaataagatggatatcatgggtgctgatttctacggtgcagtagatcagatcaaaacaagattaggtaaaaacgcgattcctattcagcttcccatcggtaaggaagatgacttcaagggaattatcgacttaatggaaatgaaagcctacatctataacgatgagaagggtgaagacatcgatattatcgatatcccagaagatatgaaggatgatgctgaattatatcacacagatatggttgaaaaaatctgtgaagcagatgatgatttaatgatggcttatcttgatggtgaagagccaagcgttgaagacttaaagagagttcttcgtgaaggaacatgtaactgtacaatggttcctgtttgctgtggtacagcttacagaaacaaaggtgttcagaagcttcttgacgctatcatcgaatatctgccagctcctacagatgtagaagctatcaaaggtcaggacttagaaggtaatgaagtagaagttcctgcttctgatgatgctccatttgcagctttagcattcaagatcatgacagacccattcgttggaaagcttgctttcttccgcgtatatgcaggaacaatgaattccggttcttacattttaaatgctacaaagggcaaaaaagagcgtgttggacgtatccttcagatgcatgccaacaaacgtcaggaattagataaagtatactcaggagatatcgcagcagcagttggatttaagtttactactactggtgacacaatctgtgatgaacagcatccagtaattcttgagtctatggaattcccagatccagttatcgagctcgctatcgagcctaagacaaaagctggacagggcaagatggcagaagcccttgcaaaacttgcagaagaagatcctactttccgcgctcatacagatcaggaaacaggacagacaatcatcgctggtatgggtgagcttcaccttgagatcatcgttgaccgtctccttcgtgagttcaaagtagaagctaacgttggtgctccacaggtagcatacaaagaatccttcacaaaagcagttgatatcgattctaagtacgcaaaacagtccggtggacgtggtcagtacggacactgtaaagttcgtttcgagcctatggacgttaacggagaagaaacattcaaattcgattccgaagttgttggtggtgctattcctaaagaatacatccctgcagttggtgctggtatcgaagaagcatccaaagctggtattcttggtggattccctgttgttggtgtacacgctacagtatacgacggatcttaccatgaagtcgattcttctgaaatggcattcaaggtagctggttccttagcattcaaggatgctatgaagaaagcagatcctgcattacttgagcctatcatgaaggttgacgtaacaatgcctgaagaatacatgggtgacgttatcggtgatatcaactcccgtcgtggacgtattgaaggtatggaagatgtaggtggcggacgtatcgttcatggtttcgtaccattatctgaaatgttcggatattctacagacttacgttccagaactcagggacgtggtaactactccatgttctttgatcactatgaaaaagttcctaagaacgtacaggaaaagattctagatgctcatttagcagctcagaacaaataatttcatagataaagattatctgcaaagttttacttgcaaataatgttaaaatgaaatataattacagcaggtgcggctttatagtcgcagtctggctgtaatttggaatcgtctggtcgattctttgccggacgagaatatttaaaattataaagacagcctatcaggcgtaattttaaggaggaaattcaaatggctaaagctaagtttgagagaactaaaccacattgtaatattggtaccatcggacacgttgaccatggtaaaacaactttaacagcagctattactaaagtattagctgaaagagtagaaggaaacgaaaaagtagatttcgaaaacatcgataaagctccagaagaaagagaacgtggtatcacaatctctacagctcacgttgagtacgaaacagagaagagacattacgcacacgttgactgtccaggtcatgccgattatgtaaagaacatgatcactggtgctgctcagatggatggagctatccttgtagtagctgccactgatggtgttatggctcagactaaagagcacatcttattatcccgtcaggtaggtgtaccttacatcgtagtattcatgaacaaatgtgatatggtagacgatgaagagttacttgagttagtagacatggaaatccgtgaattattaaacgagtacgacttcccaggagatgacactccaatcatccagggttccgctcttatggctcttgaagatcctaacggagaatggggagataagatcatggaacttatggacgctgttgatacatggattcctaacccagaacgtgacacagataagcctttcttaatgcctatcgaggacatcttctctatcacaggtcgtggtactgttgcaactggtagagtagagcgtggtgtattacacgtatctgatgaagtagaaattgttggtatctcagacgaaacacgtaaagttgttgtaactggtgttgagatgttccgtaaattacttgacgaagctcaggctggtgacaacatcggagctcttcttcgtggtgttcagagagacgaaatccagcgtggacaggtattagctcagccaggtagcgtaacatgccatcataagttcacagctcaggtttacgttttaacaaaagatgaaggtggacgtcatactcctttcttcaacaactacagacctcagttctacttccgtacaactgacgtaacaggtgttatcactcttccagaaggaacagagatgtgcatgcctggtgataacgtagaaatgacaatcgacatgatccatccagtagctatggaacagggtcttacattcgctatccgtgaaggtggacgtactgtaggatcaggacgtgttgcttctatcatcgagtaatcacgaacttatataattgtaactgaataatactagattttatatatatcgtaccgcaaggtacttgtgttcaagcgtaagattcaccccagaaacattggtttctggggtttttctgttacctggaaaaataggaatttgatgggctgtccgtttactccctcggcaaattcctatttgaagttataattgctgtatgataaaattattgtaaaagacatatttctaagaggagaaaatataagaaggagaaacactatgttatttgatggatttgatgtgctatttaacatcgtcttcgcactaatattttgtagcgtttttattatattagcatatggcattatcacaagtattaccacatggaataaaaataatcactctccaaggctcaatgtatcagccagggtagttgccaaacgaacagaggtctctcatcatcaacatcctaataatggggacatgagtggctctcatggatatagcactacctcatccacttcctattatgtaactttcgaggtggacagcggtgacagaatagaattttctatgagtggttctgagtatggaatgctaatagaaggagatgctggaacattaaattttcaagggacaagatatcttggatttgagcgcaaatagagacataagagctattaaaaataagcagtttctaacagaattatttaataccatgtatagcgaatggacagttccaaaattcaataagaaaaataaatgaaggaaaatgatgtttttaatcatcggctcaattatactttttattcatgcagtaatagtctttaacacaggaggagataaaaaaataatatgaaaacgaagacagattacaagtctattttgatagaaataaatatccttaccatcgcaattgctattatagctgttgctgtttactttttcctggttccgagtcatacgtcgattagtagtatgtcaggtctgggtattgttctgtcgaattttgttccgctgccattatcagcgattacgatgattcttaatgtagttttattaattattggattttttacctgtggaaaggaattcgggcttaaaacagtttacacgagtgttatgctgccggtgtttctgggtatatttgagaatatttttcccaacaccggttctataacgaatagtcaggagctggatgttctttgctacattctggtggtgagtgtgggcctgagtattttattcaaccggaatgcttcttctgggggattagatattgtagctaagattataaataaatattttcatatggagctggggaaagcgatgtctttgtcagggatgtgtgtggcactttcggcggcgctggtttatgataagaagactgtagtactcagtgtattaggaacttattttaatggtattgttttggatcattttatttttgatcataatatcaaacgacgggtttgtatcattacaaaaaaggaagaggaattgcggcagtttattgttcgtgatctgcacagtggggcaactatttacgaagcaactggtgcttacaatatggaaaaaagaaatgagatcattaccattgtagacaaaggggaatatcagaaattgatgaagtatatcaatcaggaagatccagaggcatttattacagtatatacagtatcggatatgaggtatttgcctaagaagtagaagaattgagcattgagggaaaagggtgttgttgtagtaatctacggatatatgaggaggtgatttttgatgaaacttacatggagtgatgcgagtgtttttgcatttgtgtgggcttgtgcattagggtatattgttgcaagccgcatactggagtggaattttgaacgatttttgccaagtaactggtattttgtggtgaaaaaaagattggcacaaccggaagcgaagtctttgagaacggagaaagtaccgaaaaagatatcgaatgttctggaggagctgcttactttgatgcaaaccggtaatttgcaaaagagtacggtaagaatggatcggatttttcaggaaaaagtagtgcatgaaataaagctgcttgaaggaagaggtttatcaaggcagctacattttacgaatgtgaagttatcagaagggaatgccaaaaagagagacttccggcattggagtgattcaggacgtgaatggagggaagttatcgtagaagccgctgtttctgataaatatttacatagagacagtggtaaggtaattcatgaatcgatttatccgcatgggtcgatattgcttcggcagtcccgtcatattcgtcacaatgaagtgggagagaaagacaggcagaaggagcagagattttactcaaagtattcggaaatattttgtccaagctgtggggcacagatacagttaaaaggtgatgagacaaactgtccttattgtggagggtttattcagagtaatttctatgactggcaaatcgaagattttatgatttatcagacaccagatccgaatatggataatctaaagtataccagtgcaacgattttactctcgtttttaccgacatttccttgtgtttatttgatcacgaatatgtatattgcaattggtgttgcgatgacacttacaattatactgagtctgagtcttctttggatcagagcaaggaaaattgatgagctggagaatcttgagaaagagatcgttcgttacgatgaaggctggttgataagtaatatcaatgaagcgttgtacaaaacacttcttaccccagagctgctttcttacagtgttgataatataaagctaaaaggtgtggaaaatacgtctgacaagacgacgatttctgtggaagcgatgttgaagcagaccgttcttcaaaataataagcatattgtgacgaaaagtgaaaagcataactggaagctttgccgatctcgttatccgaatcgaattaagtccaaaggccaggccgttgtgatggaaaaggaatgtccaagctgtggggctaactatattccggataataacggttgttgttcctattgtggttatagtctgcaagttgataatgccaaatggaaattgctgtaataagtttttgtatatatgcaaatttctgttcagatccacctgtgccccttttttattcaccctggcaacgaactatttgatttattagaggaaaacagacgaaaaaagaaatattgccatatcccatctgctctgtagtcgctgtgcttaagatgcttatccgcatcttagacacgctccgaagccgcatctgggatatggtattatttcttttttctgtgttttggcttcggaaggaatgaaagcaatagtctttgggagggagatgagggagaaatcagaagactactgcttgctcggaagatgtatcgttagaagattattttctcgctcttaacgagcagtaaagagaaaggacattgccattttccaaaaaattggaggagtcccctttagattcattgtatactctaattcaagaatacctcggtattcttgctacgagatgtgcatcatgtaacgcatgacatacgtcgagacaaacgatatatcgcgacaatataatgataaatttatcatgtatagtgatagagcttgcggtattattttatcatcattgacagcatcgcggagacaatatcagaataagccacgaccttctgacctctcccccttaattcctcccaaaaactattgaattcattcacgtggagccaaaatacagaaaataaaaagaatagaccatagtaaatgtaatgtgagagcaagtaaaaatgccgaacaggcattttctacgcagtgatatctttacatttactatggtctattctttttattttcgtctgttccctaatgaattaaatagtaatagcagcaatcgctgcaccaattgctccggcatagcgaccgtcagtatcggttaatacatctgtttttaaagattctccgagcgatttcttaagataagagtaatcgcataatccaccggtaagacaaatgcactcttcctgtccgtttgtaagtcttgctgcctgtgatacaactttttgtacgatagagtcgataacggcaaaggcaatgttttctcttgattctccacgtccgatcaaactgattacctcagattcagcgaacacagtacacatggagctgatagaagttccgctaccttttgcagcaagctcacacagatcttgtggggttagagataatgtatttgccatgacttcaaggaatcggcctgttccggcggaacatttatcgttcatgaggaagtcggtgaccataccgttttcaatgcggataattttcgtatcctgtcccccgatgtcaatgaggagcatattttcatttttatgaatatagcaggctccttttgcatggcaggtaatttctgtgacgcattttgcagtataagggacggatacacgtccatatccggttgcgacaacaacggattcttctggcaggattcccttttccatgagcgtttcctgtatttgctttgcagtatctacactgctccagccagttggctgtaaaaaacggtggagaatctctttttcatgattcatgacaactgttttagcgcaggtagaaccaatatcaataccaataaaatatttgttcataataagtatcctgaatattttttcttttaaatgctaataaattaaatttctaaaatatgtgtagaagcccactcgattccttcttttgtgagtgcttctattaaaatagtttcatcttctggagcggctttccaggcaaagccacagccggcggtaatttcgcgtggaacaggaattaatcgtccgggaagaccattttttgcacagagtttatcggttgccattgcctgtgtggttgcgtcaaatgcgatgatgaatgcaggctttttctttctaagcataggcaaactcctttatttaaggctgcacgattaagtcggcttgtgtcattttttcagcgataacgtacatgtttgttatctcaccgacctgaagcttatcagtaagtccatagaagtttaaacaggttccgcaggtgaggatttcaacaccctgggcttctaaagattttaaatcttcaatagaggcagattcttcgcaagtgatatatgcaccactattatagaaaaggatagtagaaggaagagtatcttgctggcttaaggcatagataaatccctttaataaagcttttccaagttcctcttcgccgtttcccatctgatttgagcggataactacgaccgtattttttttatttaacggagtaatcggacagttctcttcttctattgttgccacagcactattcgcggcaatctgtgccgcttctgcatttatagtcattgtaactttaaattcattatcagcaactttttcagaatgtacatcgtatcctttctggtttgccatctttgtaagattctgtacggcaatttcattatcaacaagtgtctccactgtccctccaccctgtaattcgcggatggcattcttagtttttactactgggattgggcaggcatcgcccattgcatttactttaatcatgattgttcctccatttgtatatcagatgtgagatgactcccacctttgtaggtggcgagcaataaatcagtatcagtgggggagtcaatccccccatctgatatagcctccggcaggattgcagagatgcgcagaagaagtatgtcatgcattgcatgacgcgcatctcgcagcaagaatgccggggcattcttgaattaatttgtgactaaaatttccggttctgtttttgctaaaacttctccgacaatctcagcaggaagaccggaagcttttaacttgtcaagaagagcaggcgcgtcttcttttgcaagagaaatgagcagaccaccggaggtctgtgggtcaaaaagaatttcttccatagcaaatggaatatcttcaaattgaacaaatggaccggtaaagttccggttccgctgtccggcagcagttaaaaggaattcatcggcgtgtcgtaaggcctcttcaaagacaggaacctgttttgcgtgaatatgacaggaaagctgtccatccatcatttcatgaaggtgacctagaaaactaaaaccagtaacatctgtgcaggcatggatttcgaaattcctgcaacattctgcggcatacttgttcaaggttgtcatggagtctgttacggcttccattgcctcagaagaggcctcgccaactcggttagctgtacagatgatgccaacaccaagacgtttagtaaggatgagggcatcgccaggttttgcgccattattggtatagattttatttggattcacaagaccagtaaccgataagccgtattttacatcggaatcagcgatagaatggccgccagccagtgttcctcctgcttcaataaccttttcagcaccaccacgcataatttctcctaaaatgttcaaatccattttttcaggaaaacagacaatatttaaggcggtctttacttcaccgcccattgcgtaaatatcacttaatgcatttgtagcagcgattttcccaaatgtgtaagggtcatcaaccatcggtggaaagaaatcgagagtttgtacaaaagcaataccatcggaaactttatacacagcggcatcgtctttactatcgtatccaacgagaagattcgcatcttccggtccctgcggcagcttcgataatacacgacttaaaataccggcaccaagtttagcggtacatcctcctcccttgcaaaatagtttttctttttccataataggcagcctccttttatgtgggatgtactctcagtgctttttatgtatgtgcttgttaccactgaaaaatacttttgttcctcttcaatgtaatttcagaacttttcatacatttacttttgtaaccgattttgcgagtacactttgggtaaaatttcccaacataatgtaatttattctaaaattagtttaatagatattgtacagaaagtaaagttcattatttcgataatatagatatgattattgataaaaacgatagatatggtaaaatgtatttattctggagtgttttcgaccagagtattttaaacttaccggaaaggaaagtgagaaaatggatatacatcaattgcagatttttgcaaatgttgcagaatgtaaaggttttttggcagcatcgaaaaaaatgcatctctcgcaatctacagtcagtacacatgtatcagccttagagcatgagcttgggaaaaagctgattcgacgtacagcaagaaattttgaattgacagaagatggggtaaaactttataagtatgcagtagacattttacttttacatcggaaagcaataatggaagttggggggaatggaagtgagtttcttcggattggtacatcttctgttccggcacagtggtttgttcctacaatattgagtggatttttaaagaaaaatgtaaatacgcaggtggagatgacgagtgcggatagtttagatattattcgtcgggtaaaagagggaagtctcgatattggatttgttgggacaaaggtagaaaagcagtgcaagtacattccactgataaaagaccatttggttttggcagcaccaaatacaaaggagtatcagaagatttttgccggagaaagtgattctggggagagcgatttaagacagattttagaagtaccatttttagcaagaagacaatactctggaacaatgaaagaggcactcggcagcttgaaatattttggaatagaagaagaagacttaaatattattgcaacctttgatagtgcagagatgctaagagattgtgtggaagctggaatgggaatttcgattttgtcatatcaaatgataagagaattacatgaatctggaaagatattgatttatagattgccggaaaaggaattttgcagggaattatatcttatctataaaaatgaatcttttcttccggaaatagtgaaaaggtttattcattatacagagaagtattttaaaaaagaattttaaggagatatatgtaacttattaacggttcaacaaagtcggtataatcaagaatttttgttgaacatgcactaaaaggaatagagaagaaaaatgtaccgaattttaattgtcgaagatgattctacgattgcttcaaatgtggcggcacatctggagcggtgggattatgagaccaaacaaatagaagattttaaatgtgtgatggaagcatttcagcagtttgatccgcagcttgttattttagatattggtttgccgttctataacggattttactggtgtcaggaaatccggaaaatatcgagtgttccaattctgtttttatcctctatgaatgataatatgaacatagtgatggcaatgaatatgggcggcgatgaattcatcgagaagccatttgctctaaatgtactaacagccaaggtacaggcattactacgccgggcctactcctttcaaggaaatgtcaatgtgttagagcgtgaaggcatgctccttaatttaaatgacgcttctctttcttataagggggagaaaatatctcttacaaaaaatgaatttcgtattttgcagatgcttatggagaatgccggaaagattgttgcaagaaatgatattatcgcaaggctgtgggagagtgacgaatttattgatgataatacacttacagtaaatgtagcaagacttcgtaaaaagttagagaatgcgggtatggaaggaagaattaagacgaaaaaaggaattgggtattatttggatagatagaggaaagaaagagaaatgatcaaagaaagtattttttcatttttgaaaatccgcaaagtgctaattattatatttacaggaatcgttgcgatatttggaatactattttatttatatgatattccttttgatgcgattatctatggatgcgaattgtcttttgtgtggagtgcagtatgtctgtttattgatttttacaaatattataaacggcataagttattacatatcaacagggagcagttctttgacgatgcagaacaactcccagagcatatggatattattgaatatgattatcaggaacttgcaaaggaattatatcaggcaaagcaggagcttatttctaagaatcgaattgcaaaaaaagagctacttgattattatggcatgtgggttcatcagatcaaaacaccgattgctgcattggatattttattgcaaaatacggagcaatttttatatgaagaagatatagtgaacagccggataaataaacggttagaaattattcaggaatcaatacctgtttctgatatgaaaatggaactgttcaagatagagcagtatgtggagatggcattaaattatctaagagttgaagacatatcttcagatttatcttttaaacagtatgcggtagatgatatggtgcggcaggtgatacgaaagtatgcaaagatttttatatctaaaaagataaaaatgaactttaagccgacaggaagatatatagtaacagatgacaaatggtttgtttttgtacttgaacagctcatatcgaatgctttgaaatatacaaagaagggacagatttctatttatatgaaagaaaaatctcttgtaatcgaagatacaggaatcggaattccggcagaagatctgcctcgaatttttgaaaaaggctttaccggatataatggcagagagaacaagaagtctaccggaatcggtctgtatttatgtaaaaatattatggataaattgcaatggaacattacagtagattcagaggtgggaagcggaacaaagatatatcttacaaaaatgtaaggtaagaacagaaagtgttaggtacttcgatggaagtagctgcactttctttttataataaacctgtaagcttagagcatttttcaaacacgctctagagaagaagaaaggcagggaattataatggcattattagatgtaaaaaatgttcgtaaagtatatacaacacgttttggcggaaatcaggtggaagcattaaaagatgtaaacttttctgtggaacagggcgaatatgtagcaattatgggggaatctggttcaggaaaaagtacacttcttaatattttagcggcacttgataagccgaccgaaggaaaagtatttttaaaagaaaaagatttaagcaaagtaaaagaaaaagagatggcggcatttcgccggaataatctgggattcgtatttcaggactttaaccttctggataccttttctttaaaagataatatttttcttccgcttgtactttccggaacatcgtatagagaaatggaaagaagacttcttccacttgcagataaacttggtatcaaaaacttgctggagaagtatccttatgaagtttcgggaggacaaaagcaaagagttgccgttgcaagagcagttatcacacagccgcagcttctgctggcggatgaaccgaccggagcactggattctaaggcagcaaaagaacttctgcgtttatttacccatttaaatcaggatggacaaaccatccttatggtaacacatagtgtaaaggcagcaagcacagcagggcgagttttatttattaaagacggcaaagtatttcatcagatttataaaggcagcctcagtgaggcacagatgtatcagaagatttctgatacaatgactgcaatcacagcgggaggtgaggatgatgaatagtaaaatttatggaaagcttgcagtaacgaatttaaaaaataataggaaaagttatattccatatattttagcctctgcattttctgtgatgatgtattttattatggataatctgtaccgcaatcgttctctagtagaaaaagggagtccgcttgctattatgttatcttatgctgatgcggtacttcttattttttcgattatctttttgttttatatcaatagttttttaattaaacgccggaaaaaggaactgggaatatataatattctgggaatgggaaaaggacatcttggcaaaatgctttttcttgaatctgtaataacaacggtggcaagtatcattggtggtattttagcaggcattcttttgagcaaactcgtgtatcttatattattgaaaatactgcatatgggtggaaagatagagtatagaatctcactggcatctactggaatgacaacgattctttttggcgcaatttttattttaatttttctgtataaccttttacagatgaagctttcaaatccaatcgaactgctgcgcggaggaaatacgggagaacgagagccaaagacaaaatggatcatgacgataatcggaatcctctgtttagcaggaggttattctatcgcacttataacaaaagaaccacttcaggcattaggtcagttctttattgcagtacttttagttgttgtaggaacctatgcattatttatggcaggaagtatcaccttattaaaaatactccgaaggaaaaaaagctattattataaaacacgacattttacagccgtatcaggcatgatttatcgaatgaaacagaacgcagtaggtcttgcaaacatctgcatattaagcacaatggttcttgtgatggtttctatgacagtatccttatatggtggaatgaatgatgtgattacgacccgttttccatatgaggcgcaaatcacaagttcaggaatcaatcaaaaagaagaaggacagatagaagaaattataaagaatatgacaaagaaaaatcacacagtgccaacttcacagatacgttttcatgtagggcgatttacaacagtatataataacaaaacgaagaagcttgatatgatggcagcgggggagtataccaattcaaatactgtagatttagtcatgattccactttctgattacaatcaaaccgaagggaagaatgtaaacctgaaagaaaatgaagttcttctttatcatagaaatcataaaagaactcataaaaaaagtgatacagaagccctaaaaaataagaaagtcattcagttaaatagcatctcatataaagtagtcgatgaattagacagactagcaatagcaaaagctgatacaactagtttcatagatggatggtatgtagtagtcaaagacagcagtatcatcacatcctatttaaaagatatttacgagaatagtaatatatatgatgaactgaaagaatattatgggaaaatacagtacagttacagttttaatttaaacggaagcagagcaaatcgtgcaaaaacagaaaaaagtattcagaaacagcttcagaaaaaatttgcgaattgttccattgaaagtagagaattaagcagagaaagtttttatgaactttacggtgggtttctcttcatcggtatcttcctcggaatcatattcctgatggcaacgacacttatcatctactacaaacagatatccgaaggttatgatgacagagaacgctaccagattatgcagaaagtcggaatgagcaaaaaagaagtcagacagtccataagaagccaggtactactcgtcttcttcctgccactgattatggcagtcattcatctggcatttgcttttaaaattattacaaagctgctcagcgtgttaaaccttacgaatgtatcattatttttcatgtatacagtaggaactgtagcgatatttgcagtaatctatgcgattatttacagtataacagcaaaggaatattacaaaatactagtttgatggactaaagagacgaaaaccagaaatttaagatagaagaaaatgtgaagatagtcgcggcgcagaaaatgcctgttcggcatttttactggctccgacatcacattttcttctatcttaaatttctggtttttgtttctttagcccctcaaataaattagtatttaattccccattctcaccaattgtggatttagatagtcagaaaaaagaaaaaatatcctatcccagatgcggcttcggagcgtgtttaggatgcgaacgagcattttaaacacagcgactacagagcagatgggatagggtattttttcttttttcgtctctttaatctatcaaatcaagtatttttgtgttattattcttctatgatttttttggaaaggataagcagatggatattacgataaatgaattagagcagttgatgccggatagttatagattacttgatatgcgaggcgatgtggaagtcggacatggaatgattccgggggcgattcacatgagtaaggatgctattttggagaaatatcaggggggacttgtaaaagcagaggagcaagcggcacaggcaagagaggatttagcggataagaagctggttatttattgtgcgagagggcgtatcagccaggagcttgccgaggaacttcgtgacagaggatatgatgcgtttagtttaaagggtggttatacggcatggctgttagagcagatgaagaatcagcaggcggatgaagtgtgtgcccaggtggagaagagtatccgtaagaagtttcgtaagaatatctggtgtaagtttacgaaggcgattaaccagtatgaacttgtaaaagagggggattgtattgcagtttgcatttccggtggaaaggattcgatgttgatggcgaagctttttcaggagctgaagcttcataataagtttccgtttgaagtaaagtttgtggtgatggaccctggatatagtccggaaaacaggaaggtgatcgaggagaatgcgagaaagttaaaggttcctgttcatatttttgagtcggatatttttgagtcggtatatcatattgagaagtcgccttgttatctttgtgcgagaatgagaagaggatatctttataattttgcgaaagaattaggatgtaataagattg

SEQ ID NO: 396 - DNA, 72258 bp, Eubacterium hallii
cacaaccaccgcctcttgaatattcgcctttacggtattcttctgtcctgagggtattcagtgactgtttctttgcataacgtgcttcttcactgtcctcagaatcaaagtatccattcgcatttactcttgtcatatcatacatggtagaagcaacggttgcttttattcttgtatccagcgcagctgcgttaagagccattccaccccagccgcagattccaatgattcctattttatccggatccacatcttcctgaacagaaaggaaatcaacagcagccataaaatcttctgtattaatatctggagaagccataaatcttggatagcctccactttcccccgtaaaagaagggtcaaatgcaattgttaaatatcctctttcagccattgtctgtgcatataatccggaacactgttctttgactgccccaaatggtccgcttacggcaatcgcaggatatttcccagatgcatttttcggtttatacaaatctgcggcaagtgtgattccataacgatttacaaatgtcactttcttatggtctactttttcactctgtggaaaagttttatcccattcagataccagctgtaatttttctgtttttaacatatttaacatcctccatatgcaaaatttcttgtaattacactaacaatagtatatgatataaatatcttacaacctaaagttaactttaggtcaagcataaatttgaaagaaggttttttatgtatacaatcggtcaggtctctgcaatgtttaatcttcctgtttctacattaaggtattatgacaaggaaggctttttccctaatctggaacgcaagggaaatatccgttatttcagcgataatgaattagaagcacttcgtatcattgaatgtctgaagaaatccggtcttgagataaaagatataaagcaattttttatctgggtatctgaaggcagctccagctatgaaaaaacgtatagattatttccatacgctctatctcacatttcatattagactttgaattctacaaacttgaattgacataactcacttagattgcttatgccaaacatataagtagatagcaaggaacactctcgcaaagcagctaatgattatgcctgcaatcaaagcaggataataacttgtaatcaatcctgtatctgctgttacgatgaagataataccaataacgaatgctataacatagataatgggcataaattttttcataaaatcacctcctcgtcaactccagatttgttactcacatgacatttcattgaaatgataacggacaacatagacttgttatggatatcttatcttaacaaacagtttcaattttccgtaaaacctcttatctacttttacttttttgtatgtcgtcttttcggtgtttctttgctagagtttcttgtggttatcgctttttcttacatattctataaactgagcttctggcattggtcgtgcataataaaatccctgtatctcatcgcacttgatttttcgtaatacatccagttgttctgttgtttcaacaccttcagcaagtaccctcatatttagggcttttgataattttattatatgatccacaagaattttcactctcgtctcacatacgtgatcgatcagacacttatctatcttgagaacactaaatggcagtctgcttatgctttccattgaagaatacccggatccaaaacagtgtagcaagcatatcgtatgtagaatcctgatccgaagtaatacaaaaatacgcacacttttgttcagcaatattaaaaaagtttaagatttcaatggagcagatcccattaaaacattttacgttaaaaaagcaactgttgtatatcctgttattctatttttctctctgacaaaaaaggtaccggaaaccaccatcaggaggttttcagtacctttttataatccatctgtttatttgagcaatcagacctgtttttgtttatgtacagtaccgaaatgtttcatctgtcagtatccttgcaaatatcagtcccagcggcaatgcggcaataatcagtatcgctgatgcaaaccaggacgctgccggacctagagacatgattcccagattataaaaccctctgtaaagatacatacccggaaccattatcacaatagatggaactgtcagggaaattcttggatatcctactttacttttaatcagcgatgccaggattcctgctgtcagtgcacctacaaaagcagctcctgcaggcggtatggcagtcatatcaaccatctccagtcgaagagtatttgcaatggcacctattcctgctgctgttgcagccagccggaccgggctgttaaacataattgaaaatccaaataccccacaaaaacttgtaataagacgaagtaaaatccaggctccaactggtaaagatattttcaggaaatcaactggctgcaaatgaaggattaatgccataagccaggccgccatggttgctaccaaaatcacaatcaatgcatacatcagtcgctctgtcccggaccgcatatccaatttggcaaggtcaattccgctggtaataaatagaaaacccaggataataaacaacatcgcacagatataccctgcctcgtgctggatggaaatcccaaacagcatctcaccaattttgagaagtcccgcataaacaagacatgcaagtgatacagaagacacaatacacaaaaataaagtaaaatgatgtttactcagtttacaacgaagaaaatttccaattcctggataaaatgctccagccgatttaattttgatgtatttactcctgtattggtcagacaaagagattgggaaaagccatcctgaccatcaaaacaggtatactctatggacatcagacctatatctgctgtacaggtaattcccataatttcagcaagtgtattcatagaacttctgacccgccaggcaccagttccacaggaaagtaacataatcccaactcgtccaataatggatgccttttctgtaagacttgcctgcgtaacaggaacattggcgccatcttcatctgtatattcatgccaagatatatccatatggttttttcttattaattgctgcattttattcacaccccggctgttttgtttttaggatcatttttcagagcctttatttctgccaggattgcctcacgacatccaagaccgataccgttggcaagttcaactgttttttccatttcatgttcaaaatggcagaacggaagaaaaattccaagtttgctggtgtttttttcaactccgttctcatcacgtcttccataatacattaatgcccggggcagctgttcctgtaatttcatcagatatttccatataatggcataagatctctcttcgttaatctccagtgtaacagattccggaaattcaaaaagcataagaattcctgtgtgttctgaaattctgaatgtctcaatctcccccttctcattataaccatgtttttcccgaaatccgtccgccatgtacatatgataatccggtatctcatcctgctgttcatacagcttatgaaacattttgtattttttcgcacaggcatgctgatgtgacccagacaacagatctccattttcgtccgtaagaaatatgggattttccacacccttatcattaaaacgtatcgaaattagaaacgaatttcgcagaagatcaaatacactgctgttgcagactgccatcataaatgcagacagatctttattttcgtatgcagtaaatagagctgccgcaaaaacagttcccggaatgtctgttcctgcaccttcactttcttccgctgatggaattgcttcaaaaaacgtatcttttaaacgttcgcatgcatgagggtttttgagaatctcatcaaatatctgttctgctttttcttcccttggaaaaatcgtgctcataataaagcatccttttgtgccctattataaaagcatcgttataaaatgtaaatttcatctcttgtatattaaatataacaaaagcttatgccagatcccggttcactgactgatgcacatgttttcttacgaagcagaagcacactgcctgcatgaggatcgtaaggatccaggataccggataggaaataaacaggaaactcaaagacctgtgtgcagggaaaagtccgaagatccacacaatcctggttcctacggtaccgataatcgaaagaatcataggtactccggaatatcccattccccggagggctcccgggagcagatccataataccacaacagaaatatggtactgtagtaaaggcaaggacttccacgccacagcggattacatctgcatcactggtgtagatcttcagaagttccggtccaaagaaatacgctccacagccaagggtcagtgccacaccgacagaaaggatcatacagtccagaagtactctgtccattcttttcagtttctttactccatagttctgactggtgaaactcatacaggactgggtgactgcattgacagacatatagagaaagccaaaaatattattggcagcagtatatcctgccattgccacagaaccaaaagagtttacagaagactgcaaaagggcattggacaggttgatcactgtactctggatacctgccggtattcctacctggaagatctgcttcagatactgtgttttgattcctaattttgaaaaatacagccggtaactggtattggaagtgtagagacagcgaagcaccagaatactggagatcagctgagacacaatagttcctatggctacacctgccactcccatatgaaacacaataaccagtacaaggttcagaactgcattggtcatacctgagatcaccaggaaaaacaatggtcttttggtatcccctactgcccttaatatggcagctccatagttataaagcataaagaaaggcattcccagaaaataaatcctcatataaagaacagactggtcaattacatcattcggagttcccataagattcagtgcgaatcttgcaagcaatactcctgccagtgccataacaagtccactgatcagtgccagggtaatagatgtatgtactgtctctgacatttctttctctttgccagaagcataaaaacgtgctgccagaacgttcgcacccagagagatcccaataaacagattggtaaaaatattgatcagcgctgtggtagaaccaactgctgccaatgcctgacttccggtaaatcttcccaccacaatgatgtctactgcattaaatagaagctgcaggattccagacaacattaatggcaatgaaaaggatatcagtttgtccatcaacgttccattgcacatatcaatttcgtatttattatttttcattttcctcactccattaaatcttatccatctattttagtataacacctttttttataattcaaaatacaaatttctctcagaacatgttatacttataaaaaatcaaactacatttaataaaaaataggatttattattatgagatacaaagatgaattaagaattgccggggttaccgcactgttttgttgtgccatgcttatgatcaccgctgtagttcccaaggataccactgtagccaaagcacgaaagactttcaaagaagctccggagactgctgctgatgctgaagcacaggctcagagcgaagccgaagatgctggcttcactgtctatacagaagacagcaattatgactatgaagataacagttacgatgattccggctctgatgataccagtacagatacttctgactctgattcttcaggcgatactacttacgatccttcttatgacgacagcacaactgataatacagagaataatgtgatcgaagatgattcttccagcgattacgatacttcggatacagataccagcgacagtgacgatggaacggaagatgatacagagtttgattatcctacagaggaagaaacattcccgtcggattatgctgacaccggtgactataccggcacagacgtttatacagataacaactggcagtgattttgacgccaacaaaggggctgtcgggaaatagatagttccaaagcagggagggtatgactcacaacgagtcataccctccctgaatttatctgaaaaaagaaaaaaagatggctaacgacaaccatctttctctccgttacatgttataatgtaactatgctaacaactaattattataacgatttttttgagtttgggcaacagaaaattaactttagtttcttcgaattgagtttacctgacgacgatccagtctataccctgaaaaaagtgatggaggaattagatttttctggcttgttagccaattgttcagataagggaagaaccgggtacaacccaattatgatgtatgctgtagttacctatgtataggctgtcagaacgtaattttggaatggcggataatctatactctgttcctctttatgcggcaggatgcttgttctttactttatagtttgactcccagaattcactttgaagacccccattagtatttctagggacttgtatcacttttaaaatgacatgtcactataagtttcactataaatgtcgctctattaattaccgaaatgcttacaacaaacaaataccttcaaacacttgcagaacatgcaaaaaaagaaaacccggaggctggctttatcagccattctccggatcaaaatggtatgcggataacaggactataactgtataccctttatttatgcggtttctgagcatttgacaccaaaatgacaccaactatttcagcattttccccaacaaatgatcaattatcataataatatatcccataacaataaagccggcaagcaaggcaagtatccaggtaatcatccctgttatccccacccgctctggattcaggaagaaataaggatagatgatcgggtctttttcatttcttttatccagaatcagatttaacaatttcagatggttctttccataatcaccacgtcaaatccgttccattccatttctttcccggagactgcaaagccctgtttctcccagaagtcaatggcttccgtattctctttgggtactcccacagtcagaaaatcaaatccctggctatgcatggcagcgcgcacgtcggcgacaggttctccagctgccataatcttattatatccatttgaaacacatttgttaacgaaactgaacgcgttcataacagtgtggttttttcctcataatcattggatttcttcccatttgcttccttaaagcaggtgtatcattaaaatatatgattatatggggggagtgtgatttttctatgttgataaaagacaaaataaaggtcggcagctttgagttaagaaatcgtatggttaaggcgcccatccacagtgagacttgcgtggacgggaaagtaacaccggaaacagaacagcattatgaagagcgtaccaaaggcggccgttttggcctggtagtagttgagcacagctttgtcagaaaagatggaatggccagtccgacgcagctttcttcctccagagattccgatattgacggactgaaaagaatctgtgatatcatccataaaaacggaagcactgctatcctgcagatcagtcatgcaggctgtggagcaagcagagatttcaccggggagcagccggtcagttcatccaatatcagtgtgacctgcggatggcccaacgcaaaacccaatcccgagaagccgagaccgctgacagttaacgagattcacgatctggaagaggcttatttcagggctgcagagagagccatgaaagccggttatgacggaatcaacctgcattcagcccatgcctacctccttgaccagttcttctctccgctgatcaacaagagaaccgatgcgtataacggatatacactggaaggacggacccggatccacatggaactgatcaagggtatccgtcaggtgatcggcgacaaatccctctttgctctcaggctgggcggatgcgattataccgtgggaggtaccacgattgaagatgcagtctgggcttgcaggcgttttgaagaggcaggcgtagatcttctggatatatccggaggaacctgctgttatgcccgtaaaggtcataactatcccggctatttcggagacatttcagaggcagtgaaaaaagaggttcacattcctgttctcctaactggcggagtccgaactgttcaggatgctgaaatgcttctgaaagaggaaaaagcagatatgatcggagtaggccggatcataacagccaagccggactggggtatggaattgatataatcagggagggagaatatgccgagaattactgtaaaaacaaatgtgtttctcaatcgtgagaaaaaatatcgtatgactttagaatttaaggaagcaatagaactgatcccttgtgagaagggctcttttgtaatggctgattttgaagatgaggcttttatgctgtttggagatgaagcagcatcagatccctgtgcagcaatagaagtggcagttatccaggatgccattgataaatatgataaggagatttttgtgcaagtccttgcaaggatgacagaaactgtgatgaagtacacccagataccggaggatcggatctttgcctattaccgaaattcacctctgtggacttataaaaggcaggatatcatcggaaccctggttcatgtctgaccacctgtcaaaagcatagtcaataatatcattaacaaataataacaccatccgaaagtttaatggcgttacagcagcctgaaaacaaccggatggtgttttttgaatcctgatataaattctcaggcaggcaggatgcccaccagagctcttttgtacatatctctggtaaccgcaggaagatcaaaccttccccgttccgctacccaggtaaatatgattcccttcacgatcatgcacagatcgatggaaatctcgtggacacttcgtccttcagggagtatatatcctttttgaattgcctccgtaatgaactgatctgtgaccatcatgatatgattgttattgctgtgaatatccatttcttcgcttctggaatctcccctttggtcttcctttcccgtaatgcttgtctctgctatagtttcttctcttttattttcttgcatcttatcttcaggtaggttctgctccatctgttcttcagggacagtctcttttgcaccttctttatggacagccgtaaagttcatcacataaataatgtccagcttaccctgtcctctttttttcttctcgatcagtccaacttcggaaagctgtttcattgctttgctgattgtacgatcactgcgtcccagtttttctaccagttgtttcagattgtatgtgatatataaacgaccagtatctttttcaatccagctattttttctggataatgccagcctagataataatactccatataatatcttcgcagtatcactaatccctctgtactcctcttcttccaaaagcaacgctggaatctgataaaagcggaagttttctccctctgtattgtaaaaatagtccaatctcatcattttttctcctctcttctcttttccaatgtaaaggggaatatcctggaaagggatcccccttacatgaaagtatatgctgcacacaaatagtgtgcgaattctgcctgtgcttttgcagctacggcatagtcttctccatccggcaggcagaatgtatgtaatactgatcttttatacggactgtccttcttcgtttacgcagtcctttagccatttttcaatcaattccggacaccgcaagatttcttcagtaagaaaatggctaatataactggaaacctcttttatatctaaagaattcatatattcttgacgggttaagcctgctgtttcttcccttccttcttccactaactcatccatcgggacagaaacttcccttccttccctgtccagcttttcggcaggctctttgcagtctgtatcttctgtttctatttctggtaccatatctctttgttcttccctcctttctacaagctctggctcttctttttcttcttttgggcagtactggtcaagcagggtcacataccgttcccatgtaatggatctctctgagatactgatgtttttatccgagcaggagatcctgatctccccttgtgatatttcatatgatgtactcccatatctccctcttaagaactttacaagtgcttttctggagacagtagacctgtcatattcatctatacccaacagccggtacgatacccgtatctctaccgcacccggttctaaattcttctgtttatattcttctatatccacattttttgtaatcccctgttcgatcacttccttctgcatcttttccggcagcctcgccagagtgagtgcggcagatttttctatctctccttccttaaatttttccattgcctctggaagtaaatttctggagatctgctggtactcctgtaccgtagcccttgcaatccccattttttttgataagcgttctaccattctacctttctgtaaagaagtggggaattcttctggatgttcccgcaaaagtctctccatctctgtaatctcatgcatcagctcatatggctttttcgtatgatagccattggaagccagtacacggaaactttcctgtactacgctaacattatttacaatgcatgggagaaattcaaactgtttcagtcctctctcttctacaagtaacctgcatgcctcacatcttttatgtccggcaataatccggtattcatccgtatctgatttacttacggacagattttcaatgacttctcccgcagcttcgatcagatctgcaagggattctatctcttccttatctcttgcaggacaatactgatctggatttgttttcagtttagagtaatggatccatttgatcgttcttcgtggatgctgctcttctttttttatctcttccttattaaatatattcccaagctttgccataaccgataccccctaatcctcaagaagttcttccaccagatctacaaaatcctgtgctacattactcataacacgatgctttgccactggcttataaagggataacgcattatcaacaatcgctgtacggctgatacatgactgtaaaaacggataatcatgcttagtgatcagatcctctgaagataatttctgtgctttggtgttcgacaccatgtttgcgaatatcttccattccagatctggattgttttccaaaatctcatgataagcatcttccaccattgtaagattatcccggcagaagttatcaaatttcactggggtaaggaacacatccgcagcatacaatgcattcattgtcagcatatcaaatacagggcgggtatcaatcaggcagacatcatagtctttctttaaatatcctaacgcttctttcagtctccatggagttttttgctctgtgatcttaacagagcctttcacaatatctatatcctggtattttgtgcgatagactgcactatttatccctttaggattctcaagaacatctcttaccgttttactgtatccgtttacctttgcaaaaaatcttgtacagttacattgtggatccaggtcaataactaatactcttccacccatttccgaaaatgtataagctacgtttactgttgtggtggtttttccaacgccaccttttaaatttgctactacatatactttcataatcaatctctccttaattttatcttttcagagttaaattttatataatatgtaaatagatttaactctaggtttttatgttttctaaatttaatgttatcctgttcataataaacctcctcatataatgaaaataaaaaaaggaacaaaccctgataattagggtttattcccaaacatgaaacgagggaaagcaatgttgctttccctcgcagaactttatatatagacttttacttcaatatcttcaaatctgttcgcttttgtatactctgaacgttcagccataaaggcctgcacatctgctttagttaccattagcgtacagaggtaaatatatgattgtctattcctatttcctcttttccgcaatcgctgcctgtgctgctgctaatcttgcgataggtacacggaatggtgaacaggaaacgtaatctaatccaattctatgacagaattctacggatgatggatctccaccatgttctccacagataccacagtgtaattcaggtctctgaccttttcctaatttaactgccatatccattaacttaccaacaccattctggtcaagtttagcaaatggatcgttctcgaaaatcttagcatcatagtaagcgtctaagaacttaccagcatcatctcgtgagaaaccgaatgtcatctgtgttaagtcgtttgtaccgaagcagaagaactcagcttctttagcgatttcgtcagctaataatgctgcacgaggaatctcaatcatagtaccaacttcgtatttcatgtcagaaccagcagctttgatttcttcgtctgctgtcttaacaacgatcttcttaacgtattttaattctttttcttcacctactaatggaatcatgatttctggaacgattgtccagtcagcatgtttagcctgtacagctaatgctgcacggataactgcttttgtctgcataacagcgatttctggatatgttactgtcagacggcatccacgatgtcccatcatagggttgaactctttcagactttcaataatagccttaatagtttctaccgatttaccctgtgcatctgcaagttttttaatgtcttcttctgtctgaggtacgaactcatgcagtggtggatctaagaaacgaattgttacaggattaccttccatagcttcaaataactgctcaaagtctccctgctgatatggaagaatcttatcgagtgcagcttctctttcttctactgtatcagaacagatcatttcacggaatgcatcgattctgttaccttcaaagaacatatgctcagtacggcaaagaccaataccttctgctccaagctcacgagccttcttagcatctgaaggtgtatcagcgtttgtacgaacccccattgttctgtatttatctgcccaagccataatacggccaaattcaccagcaattgtagcatctactgtagggataattccatcgtagatattacctgtagaaccatcaagagaaatagcatctccttcatggaattcttttcctgctaatgtgaatttcttatttgcttcatccattacgatgtcaccacatccggatacacagcaagtacccataccacgagcaactactgctgcgtgagatgtcataccaccacgaactgtcaggataccctgagcgctcttcataccttcgatatcttctggggatgtctcaagacgaacaagaacaactttttcccctctctctgcccaagctttggcatcttcagcagtgaagacaatcttaccacaagcagctccaggagaagctccaagtgctttacccattggtgttgcagcctttaatgcagcagcatcaaactgtggatgtaataatgtatcaaggttacgagggtcgatcattgcaacagcttcttcttctgttctcattccctcatctactaaatcacaagcaatctttaaagcagcctgtgctgttctcttaccattacgtgtctgaagcatgtataacttcttgttctcaacagtaaactccatatcctgcatatctctataatgatcttcaagagtctggcaaacctgtttgaactgttcaaatgcttctgggaatttttcttccatctgagcgattggcattggtgtacgaacaccagcaactacgtcctcaccctgtgcatttgtaaggaattctcccataagcttcttctcacctgtagcagggtcacgagtaaatgcaacaccagtaccacagtcatctcccatgttaccaaatgccatactctgtacgttaacagcagtaccccaactataagggatatcgttgtcacgacggtaaacattagcacgtgggttatcccatgaacggaatacggctttgatagctcccattaactgtttcttaggatcatctgggaaatcttcaccgattttctctttatattcagccttaaactgagatgccagctcttttaaatcttctgctgtaagatcaacgtcctgacttacaccttttttagctttcatctcatcgattaattcttcaaaatactttttaccaacttccataactacatcagaatacatctgaataaatcttctgtagcaatcccaagcccaacgtggatttccggatttagcggcaatagtctctactactgtctcattaagacctaagttaaggatagtatccatcatacctggcatggaagcacgagcacctgaacgaactgatacaagaagaggattctctttatcaccaaatttctttcctgtaatctcttccatcttctcaatgtactcattaatctgtccctgaatctcatcattgatctcacgaccatcttcataatactgagtacaagcctctgttgtaattgtgaatccctgtggtacaggtaatccaatatttgtcatctcagccagattggctcctttaccaccaagaagatttctcattgtggcatcgccttctgtaaacagatatacccattttgccattgttgtgttcctccttcaattaactatcaacattactttatgcgctttcctcacgcgcaatatgagtatagcacaaacgaataaaaaatgctataattttccgtcatttttttgcaaaaatttatcatggactatatttttttgcaacattcacgataattttaatttttttatacaaaagagactatttgatggggtgtttgccgtttaattcgttgggtggacagacagatagacgaaattagaatacagaatatatgtttttaagtagatgggaaactgcttgataaattgccatctctaaaatcaacagaaagtattgtttaaaagaggcttacgctatataataaaaaaatatcaaaaaggaaaatagtaggtattatatgaatgcgggggcaatcttatgatagaaaaatgttattattatgatgaagatggaaatcgttgcgaaggcgaagtgggaccaagctttgaagattttccaggtatggcaagggttgttagtccgataccgctgtgtgatgcttgtaaaaagtctgatttcgatgaaaatgatgatttgacggtgtgcaaagcatacgggaaaataccaaagaagtatttgaatgcaaaagattataattgtcctcattttgataatgaaaataatggatggtatcagttaattaaagataaggtagaaagacaacagaagaaagaaaaataataaatttgaattttagagcatgtttgaaaaataaaagttgcacaaaacatatattcccacaccctttttcatgataaaataaagaaaaaagaggagtttattatgttgagacgatataaattaacagatgaagaatggaatcaaattgtttctctactgccacctgaaaattctggcaaataaggacgaccatccaagtgtaaccgtaccattcttaacggaattgtctggattgcccgcagtggagcaccttggcgtgaccttccagaacgctatggcccttggcaaactgtctattctcgctttcgtaagtggattgaagacggtatccttgataatatctttcatgttttaagccttgatgcagaattaagcgaattatcaatagatgcctccattgtccaggctcatcaacatagtgcaggtgcaaaaaatagggggccatccaacgaaatcggacacagtcgcggtggagcaagtacaaaaattcacgccattgtagatgcttatggttatcctgtttatgttatgctcagtaagggacagcgtaatgatattaattacgccatccctttgctagaacaagttgacataaaggaaagtgatatactggctgaccgcggatatgatagcaataaattaatggactatatctatgcccatggtggtgagctaaccataccttccagaaaaggggctaaatttgaccgttactgtgactggcatctttacaaagaaagacatttagtggaaaactattttctcaagttaaaagcattccgtcgaatagccacgcgttatgataattagcatccacttttgcagcatttatatgcatcacctcaatattaatttggttaaaatgaacaacttaaaatgtttttcaaacacgctctagcacgctcgatatatcggacgtgttatttttatgctctttttgaaaaagaaaaattaaagaagatgcttattataagaacgacatgcttaaaattaatatacaaaggcaaagcagtcaaatagcactgccatcataaaatgtttgtagaatttttcatcaatatatttgttattttgtaaggaattgtaattgttatctctgcgaagagacgatgtaacaacaacgagaactgcagtgcggattacctatttcaatccacgcctccgcgaagaaggcgacgtaaatcaaaaaacgtataaaagcatgaagacaaatttcaatccacgcctccgtgaaggaggcgaccgcaacatattgtgatacatcagctatcatgtacatatctagtctcaacaacttttttgtccactatttttagctttatatcgcaatatgttgtactattctttcttttttaagtgcgaatgccctacgttttttgcgtagcttatgattcgcactgtgtttaatttttaatattttctatattttatttcaaggtattcctttttaacggagataacaagaaacttttctttctacatttgactatatctaaatttagaaagatttttgaaaaagggattttgtcgcagatgcgattgtttatgcggctgatcttattctgtgtgacagcatatcccctgtcatttaagtatccagcaaattctgttatatagtcaaaaatcattttttaccacctctaaaaagaattcgattctgcaagacactattaatgcaaatctttgatattcggcagaatacctgcatcccgtaccctcatctggtcttctttgttcttgcacaacatgcacagggaatctgcaatattaaaatctttatcatccatcagtttctgcagatagctagcccatgtgatgccttctgaaatagacggaatctgtttcaggcacaggctctgcaactggtaaagacaggatgccaccccttcgatgattgttggagatgcttctgctttcattttcaaaatctccataatctcttcttttgtttcttggaagatacagataattgcatcttcgctttagtgcatcggataagtccctgtagttgttcgatgttagtacgacaacgagctccatcccttcttttgcctttacggtgccatattggggaatgctcaaagagaaatcatctaaaaactccaataacgtgtattctaattcttctgatgctttgtctacctcatcaaagagcaggacataccgttgctctccccagatagactccagtaccgggcgacggattagaaaatcctttccataaaaatcaatcgtttttgctacatccatcgcttcgttaatcgtcttcccatctaaatttttcgctaaagtactctgtattgcctggatggaaagtagctgtctttggtagttgtaatcgtacagtatcttgtccgcagtcaatccctcataaaactgaacacgcaacacagaaagcccaaaggcttgtcccattgctaaagcaagacttgtctttccctgccccgggtcagactcgaccaataatgggacacctatattcaaattgtaatatatatcctttatagccacaatatgtcatttaaattcccgcaacttatattaaaatattttatcaacaaaaatacacagaaatttttatatacaaaactcatataattcatttgctctttcacatactgcctgctataatcatttacatatattttaaacgaaggagtataaactttgatattttatattgacgaatccggatctattaataatcatctctctcataataagcattttgtaattgctttagttagagttcttaataaaaaatctttaaaaagatcttacaagcgatttgtttcttctaattatgatagacttcttgaattagataaagataagtatcatcccaaaacgggaaaactcataaaagaaggcggcaaaatgttctctaatgaaacttttaaagaacttaaaggttcccagtttgacaaagaaatgaaaaaaagttttgttgatttcttttctcgtaaaccatcatttgaattatatatcattaaaataaaaaattcagaattaactgatcaattttgccagaatactgcgagagtgtttaattacactataaaattagctatggaatactttatccataagggatatatcccaaaagaagattgttcacttcaacttgatgagcgaaatgaaaaaactgaatcaagattttttctcgaaaattatcttaatactgaactatccatgaatggaaccactgacaagaaatttgatgttacatattatgattcatctgataataaccttattcaaattgctgatgtttttgcaaatctatattactctcatttacaaacaggtggttataaaaatgaattaaaaaaattagaagaagcaggtatcctaaaatttgtttttacttttcctaaacaataatgatttttttttgaatattgacagtttttcttgcatatgataagataaagctaccaacagtaagtcctatatcagtgccattatcgaggtaagtgtcatgtgttggcatcgctgctaggctattggtaacttagtataattagatcaatctcttgattggtctttttattttaccaaaaaaagagcccacacccttacaggcatgagtcctttcaaatttaacattcttggtctaactattaagtcactcatattaatccttcctttcgttttatctattaacacataatagtatgtaaaaataataaacaaaaagcatcaatatggcttaaacaggcgcttgtagacttcgacagtgttaaaagtctacattacgaagttgtgtagacttctcgtagacttgacaacattcgctgtaagatttttctttttaagaataatatttaggaaataaaaaaaaggacttccacataaaatggaagtcctaaaacccgcttaaatagggagttttttattagaatctacctgccttagcagcctcttctacgctaactgcaacggctacagtagctccaaccatagggttgttacccattccgataagacccatcatctctacatgagctggtacagaagaagatcctgcaaactgtgcatcagagtgcatacgtcccattgtatctgtcataccataggaagctggacctgctgccatgttatctgggtgaagtgtacgtcctgtaccaccaccggaagctacggagaagtatttctttcctgcttctaatctttctttcttatatgttcctgctactggatgctgaaaacgagttgggtttgtggagttacctgtgatagaaacgtcaacattttctttccacatgattgcaacaccttcgcaaacatcgtttgcaccataacagttaacttttgcacgtaatccatcagagtaagatttacggaatacttctttaactgtgtttgtgtatggatcgtattctgtctcaacaaatgtgaatccgttgatacgggaaatgatctgtgcagcgtcttttccaagaccgtttaagataacacgtaaaggtttctgacgaactttgttagccttttctgcgataccgatagcaccttctgctgctgcgaaagattcatgtcctgctaagaaagcaaaacattctgtatcttcttcaaggagcatttttccaaggttaccatgtccaagacctacttttctgttctctgctacagaaccagggatacagaaagcctgaagtccttcgccgattgctgctgctgcttcagaagctttttttgcaccttttttaattgcgattgctgcacctactgtatatgcccagcaagcgttttcaaagcagataggctgaatgccttttaccatgccgtatacatcaagtcctgcatcttttgtgattttctctgcttcttctaaggaagcgattccatagctgcttaatacggaattaattttatcaattcttctttcatatgattcaaataaagccattcttctctacctccttaattagtcaattaccttgtctgttctagggtcgataatcttagcggcatcatcaacacgtccgtactgacctacagattttgcccatgctgtgttaggatcatcaccttttttgatgaagtctgtcatttttccaagatttacaaactggtaaccgataattaagtcgtcttcgtccagagcgattcctgttacatagccttctgccatttcaaggtaacgaggtcctttctggagagttccgtacattgtacctacctgtgaacgaagtcctttaccaaggtcctcaagtcctgctccaacctgaagtccgtcttcagagaatgcagactgggaacgtccgtaaacgatctgtaagaaaagttcacgcatagctgtattaatagcatcacatacaaggtcagtatttaatgcttccataactgtcagtcctggtaaaatttcagaagccatagctgctgaatgtgtcataccggaacatccgattgtctcaactaatgcttcctgaatgataccttctttaacatttaaagttaatttgcaggcaccctgctgtggagcacaccatccaataccgtgtgtaaaaccagagatatcttttacctcttttgctttgacccactttgcctcttctggaattggagctgctccgtgatgtacgccctgagccactgggcacatgttctgtacttcttgtgagataatcatgttagtactcctttcggtataaattgagtttttctaaaataacttacattccgtaagtaatccctaagtcaagacgattgcttgtcttcacagtttattattttctcacaaaaattgcttttcgtccatacctttttttaattttcgacattttttttgatatttctttcacaattctttgcgttttctcgaataaactacttttttatacattagaactattcaaaaacaggcaggtattatataaattttactttaaataagaatcatacgaagctttacaggaaaaaattattggtctgttccttcactttctatctcatcacgatgagcagatgagacatctgtttcagaagaacctgttgtttgttctgtagagggatctgtagaattttcattttttttctgttcgattttctcagctttttgttttgcgttcgcttctttaaatatatttttcattttgatgaccgcttctttttctgcatgataccagacagttttaccattcatatttgttattgtaaaatattcatcatagatgacaagtttcatcgtattgccatgatgataaaatgtatattcctttccgttacccattttctttgctgcctgtttaccccattttttctttgctctagcttcatttgacttctttttattcatctggtcaatatagtttgcaacagagaatgcaacttcattttcataacattttccatcagtatttgtgattaaaggggtatctgccattcggtggaacagctttgagtttggatatccattcttaaagtgcaaaaatgcatctccgatcgcggatgcattatatgcataatatacattattaggcaaatcggtaaatacgatatagttcccgccaaatatcattatttcataaacagcattatcttcatcatataaaatatattcatatcccggaccatatttttctttcacttcttccggtgtatattttgttgttttgtctgctcttaatgcgattgatgttgcaagagaaaagacagcttcgtcttctacaaactcacttccattcatattgtcagcatagcctacttcaagttttacgagatgatctcttgatattttttccagataatcgcttgccctttgttcatcctcagtcatatcattttcagcatctacctttgattttaaggatttattttctttttttaactttttgttttcctttttcagttccttataataacttgaagaaagtacctttttcttagaagccttacagccagtaagagagagtactaacacaatacttaaaataaaaactgcatatatttttcttctctctgctttcatcatatcttttagtattcttctttcttcactatttcgtttttatttttataaatggaatgatctgcaacatatcctcttacactggataacggataaatgttactgcgtcgtcctacaattgttcctggatttaaaatggaaccacatccaacctccacataatctccaaggattgctcctatttttttcatatgtgtttcaatctttgtatcgtcgaaatgaatttctactaactttttatcagacttcacattagaagtgatagaaccagctcccatatgtgatttataaccaaggatagaatcaccaacataattgtaatgaggaacctgtactttatcaaataaaataacatttttaagctccgtagaattaccgacaactgccccttctcctacgatagcattgcctctgatgaaagcacaatgacgaacttctgcttctggtccaataattgcaggaccgttaatgtatgcagtcggcgcaacggttgctgtttttgctacccagacatgctccttgatctcgtcatactcgtcttttggaagaagcatccccacttccatgataaaatcatgaatcttcggaagtatctcccaaggatatgtgttctcctcaaataatactgttgcaattgttctgttaaaatcctgaaataataccttattctctaatcgtttcatttcttttcctggctgtatcagccttctcctttctaaattaatcctctccatgtaaaataaataaatctaaacaactacataataacaaatgcagtaaatcaaatcaatcccacatgaaatttacttttataaatttatgatggagggtttgtatctataaattctaatttccagttatatcttttcgttttttcatccttttcataataaaaataagcggaaaatttattccctcttttacttacacagccacgaaatcctactttcccatgttctaataaaatttttaccatttcataggatacttttttaccaagagaggtgataaagcgatcatctttccaaatggcaaatttacagccttttttccaggcagaacatccaaatgctctggccgtttctattaccggcgcaccacactccggacaaataccaacgggttctgtatgaagaggttctagtataacaggacctccaaagacagtatcattttttattttatcgacagattctataacgaactgctttatcatcgaaagaaagtcgtcttttgtgaacttctttttttcgatatctgacaatgttttttccagtcgtcctgtgtattctagatcaaaaagttctcttgccggaaaagtttctactaacatttttcctaaatctgtacaagtcagactctttccttttgccttaatatagccggcatctttcaactttttaattgtctccgcgcgtgttgccggggttccaatactgaatccacttaaaattgccatcatcatctgttcttcttctttttcttcatatttttttccacaggtttccatgactttaagcaatgttttttccgtatgtagcttcggtggttttctttcgacttcattaatttcagactttattaacggtaaaatgtttcctttttgaactggtggcagaattgtttctttcgcatcaattccttcaattaatttccatccgggttctaattgtactttgccttttgcaacgaattctccgggtatatcgatctcctgcatcttaatatgcaaaacagtgtcttctgctaccgcaattggcataaactgcgctaaaaatcgattttttactgcttcatatacaattctttctgattcagttagttttcctggctgcatatatgtaggaataatagcagaatggctctctactttcttgctgtcaaaaatacgctttgtacttttaaactgtatcatttcttcatacggacaatttttcttatgaatatttaatactttagctgttttttcttttaaactctcatcaagaacaacactggccgttcttggataagtaataaactttttctcatatagctgctgcgcggtttttaggaccttatctgaagtccatcctttatattttgatgtcacatacccctgtaatccagatagattaaaaagatagggaggatattcatttttctttgttatctttttagagacaacttctccatttctgccatgaattttttcctgaatttcctttaattcttctggattatcaaacttctcatttccttttacataataaatgctatcaaaatctttcttttcttctgtctgaaagattccttttaatttgtagtactttgtgactttaaaatcggcaatttctttatctctatcataaataattttcaaggtcggcattaagactcttccaacatttagaagacggatattttgtttgtttcgatatttcaaagtggcaacggatgtcagattaattccaataagccaatccgcaatctgcctgccaaatcctgcatcctgcaaggacttcatttcctcattcgattttagattattcagtcctctgtttacctcttccgccgtccattcatttaataaaattcgttctactggtttttgtggagaaatgtaattgataatttcatctgcaataatctgtccttccctgtcatcatccgtcgcagaaataattccctctacatctttccgttccataagattttttattgtattcatctgctgaacaacaccgctgtccggtttttctttattctttccgtctgattttattttatataaaaacttctccggaatatatggaaacttttcaatcttccaactgcgcatttccgggtcataatctctggcatcataaagctgtaaaagatgaccaaatgcccaggtaattacataatattcaccttcaaaatatccatttttccgggaagaagcggtggcatctgcaatattttttgccacagacggtttctccgctattattaactttttcatctgattccctctttctggattaaaaatacaacggaaactactatatcataatttttttattctgtgaaccttagagaattatcctcttttctccttttttaaaaaatgctatactattattaatgatcttaccctatgatcaagtacattaaattaggaggaatgactatgacaccaaaacagaaagcttgggcaatacaggcagaacatgtgataaaacagatggaacgtagacactttaatgcttactattgttctacaaaggaagaggctttatcaaaggcactctccatcattgaaaaagggtctgtaattgccagcggcggttccgctacaatagaagaagtaggactgcttaattacataaaaacccattcagaagaatatacttttattgaccgcagtattgcaaaaaatgaggaagaaaaaagacagattcacgcaaaagcaattctgtctgattattatcttatgagtacaaatgcattcaccatggatggacagcttgtcaatattgatggaaacggcaatcgcgtcagcgcactttgctatggaccaaaacatgtagtaattattactggtatgaacaaactgacaccatctgtagaagatgcatataaacgaatccgtcaggatgcctgtcctccaaactgtgtacgtcttggacttccaactccatgcagtaaaactggtgtttgtggcgactgtatgtctgcttcttctatctgcgacttatttgtcactacaagaatgtcacgctatcctgacagaatccatatcattatggttggagaagaattaggttattaaaattcttttttctttgaaaagttttttgcgagggtgtgaatcagtttgtcaaaatcaagcggttttgcaatatattcattcattccggcttttttagctgcaatcacatcctcattaaatacatttgccgttatcgcaatgatcgggacggtttttgcatcttttctttttaattttcgaatctcctgcgttgccgtaagcccatccataaccgacatcatcacatccattaataccgcatcaaaataattttccgaagactgtttaaagcattccaacgcttctaaaccattttttgcaacagaaacttttccacctgcatcctctaaaatatactgtgccacctcaagattcagcttgttatcttctaccagaagaattctcattccttcgatcgtaacttcttctgtatcttctttttctatacaaacggtatctaacttcacaggaagagtaataataaaggtcgttccctctccctttactgtatgaagagtaatacttcctttcatcttacttataagatttttaacaatggacataccaagccctgtccctcgatagctggaacgattttcagcatcttcctgcgcaaatggttcaaaaatatgctctgcaaactctttactcataccgattccggtatctgaaataataaattcaaaatgcacatcttcttcatcacaggatacttcttttacggaaaaagtaatgattccccctgcatctgtatattttattgcattacttataatattaactaaaatggaacgcacataatttggacttccgcatacataagggtgaataatctcattatctacatgctgttctaattttacgcccttttcagaagcaataattcgctgaacagccaatgtactatctactaagcttgcaatatcaaatggctcttctataagctgaatatcaccggtttcaagcttggacatatctaatatatcattcgtaatcgataaaagctgatccgctgctcctctcattttagaaaaacataaatcaatcttttccggatcttcaagatgtgactgtgcaatatctaacatacccatcattccattaataggtgttcgaatatcatgagacatccttgataaaaactctgactttgcccggactgccatttccgcatcctctgtctttttcctaagaagacgttcctgattatgaatgaacataagtaaaattgtgatcgttaatgccgcattagcccatggtagattatcaaaaaaacattgcaggatacttccgataaaaaatggaacaatatagtaaatagattcccataaaatctttcttttttctaaatccttctcagtgcaaagtctccatccacttaatatgatagaaactacattatagacattcgccagtattaaaatcacagaaaagctatatatctctcttttccaataagatataattaaaagtatcgccagcaaatcaatcggtatatgtagcaaaaacagagaacaccgatttttaaacacatccgaaccatacatattctcactgtaataaaaaagaaaaaaggaaataaaggctattgaaataagaaaaaccgcatctaacacatacaaaatctctggtccggcaatatattttaacaacatcccaaaagcatctgaaagatcacagacacaaactgcaagcagtaaacgaaaaatccacctctcggcctttccaaaccctggtgttctgctaagcacatataccagaatattattgatcagcatcattaaaaaaactgtgtatatatagtttattttaaatacttccatttcgattacctcattttgaaaaacacttttttacaatttataataacatataataatacaaatttctatataaaatatttttttactttctcttataatttatttaaatactaatttgtagatttcgtatagacgaaaaaagaaacaataccatatcccatctgctctgtagtcgttgtgtttaaaatgctcgttcgcatcttaaacacactccgaagccgcatctgggatatggtattgtttcttttttctgactatctaaatctacagttggcgagaataggggattctccagaaagatatggctttccaggaaatcaaattccaagaaactgacatttatataaggagttttattttttctgtcggtatcccttactattttcttatggcgaaaccattctctgattaaaaaccatagacttctgggcaatcccctctccattcaaaattaaaatattaatttccatctggagccaaagaacagaaaaccagaaatagaatatagaagaaaatgtgatgtcggagcaagtaaaaatgccgaacaggcattttctgcgccgcgactatcttcacattttcttctatattctatttctggttttcgtttctttagtccatcaaattagtattttatactctcataaattgggtatttctctgtaagagacttaacgattgcttctgcttcctcaagtttacggtcaataatagtaagcttgattgcttctgctatctgtaccatatcttcttcttttaatcctctagatgtaacagcaggtgttccaagacgaagaccacttgttacaaatggagactgtggatcattcggtactgtatttttattacatgtaatgtgtacagaatctaataatttttccatgtcttttcctgtaaggcccatcttacgaaggtctacaagcatcagatggttatctgttccgccagatacaatatcaaatcctctttcgattaatgcatctgccaatacagaagcattctttacgatctgtttctgatattctttaaattctggtgttaatgcttcttttaagcatacagctttagctgcgattacatgcattaaaggaccaccctggattcctgggaagatagctttattgaagttgtattttttatttacctcatcactggataaaatcataccacctcttggcccacgaagtgtcttatgagttgttgttgttgtaacatgtgcgtatgggattgggctctcatgaagacctgcagctactaaacctgcgatatgagccatatctaccattaatactgctccaacttcatctgcaatttcacgcattctcttaaaatcaatctttcttgcataggcgcttgcaccagcaataatcatctttggatgacactctaaagcgatttctcttactttatcgtaatcgattactccttcatcattcacaccataaggtacacaatgatagttcttaccagacatatttacagggcttccatgtgttaaatgtccgccatgatcaaggttcattcccatgtaagtatctcccagattcattactgcaaagaatactgccatgttggcctgtgcgccggaatgaggctggatattaacatactcacatccaaacaattcttttgctctctcgattgccagattctctacaacatcaacatactgacatccaccataataacgttttccaggatatccttctgcatatttatttgtaagatgacttcccattgctgccataactgcttcggatactaagttctctgaagcgatcaactccaaattatttctctgtcttccgagttcatcttccatcgcttttgcaacttccggatcaaaatccttcacatagtcaaaactaaacatattttcttcctccgtattctatactgaattttctaaaatagatttgcatatcgagattatagcatactgataaaatacaagcaatcattaaatactgtaatattacagcacttgaatgacttcccgtacatttgatacaccaatcacctgtatcttcttacaaatattgttactgagtacttctgcatttgtctttggcatgatgcatcttgtaaatcccattttgacggcttcagccagtctttgttcaacatgactgacaccgcgtacttctccggtaagccctacttccccaaaaattaatgttccttcatgaactgggagattccgataactcgatacaactgcacagataattccaagatcgattgccggttcaccaagcttcattcctccagcaaggtttacgtaggcatcacagccaccaagctgcataccagccttcttttcaagaacagccaataaaagattcactctattaaagtcaattcctacggtagtacgtcttggcatattaaaacttgtaggggaaactaacgcctgaatttcaataagtaatggtcttgtcccttccatcgaacatacaacaacggatccggaagcatccgttggtcttccgtcaagcattacttttgatggattctccacttccacaagcccctgttccttcatttcaaatacaccaatttcatttgttgagccaaatcgattcttcactcctcgaagaattcggtaaattgcagtctggtctccctcaaaatacaataccgtatctaccatatgctctaatgtttttggtcctgctactacgccttctttggtcacgtgacctactaaaaatacagcaatcccttctacttttgcaagctgcattaatacagaggtaacctctcttacctgactgacactgcccgctgcggaagtaatctcctcgctgtacattgtctgaacagagtccactacaaccatatctggttttgcctctcttacagcttctgcggctgcattgatatctgtttcgcaaagtagaaaaacattctctttaaagccaccaagacgctgtgccctcattttaatctgttttaaagattcttcgccggatacataaacaactttttttccactgttcgcctgataacgacaaatttgtaatagtaatgttgactttccaataccgggatctcctccaactaatgtaagggaaccttttacaattccaccaccaagaacccggtcaagttccggaataccagagcttgacctgtcttcttcttccatggaaacttcaaataaaccggtaagctgctgatgtggcagattatttcctctttttccaactccccttgatacaggattaatcttctcctccgtcattgtattccactgatgacagccgggacactgtcccatccatttcggcgtttcataaccacattccttgcaaaaaaatacggtctttgcctttgcttttgccataagtaatccctttctgtactacaagatcaaaaatttttaaatgtctttattcatcagatatcttctcgataaaattcaagtcgagcagccatcactcaccacctgaaagaggtgggagtcttctcgactgagataaataaaataagctcgaaaaaacaatattattatataaagcatcttcgcacaacacgaagatgctttatattatgattatactttttcgaacttttatactttttcaatatgtattataacttcactacctgaactttcgcagtttctcctgcatctagttcaatactaaaactaatctttccaccaagacttgatttcagcttaccaatatttgtgtcattaacaaataccttatattccttttctggttctacttcaagtgtaatctgaagatcatctgctgcttctgtctcaaatgcaatctgacgttctgtttctttatatccatgcactgcagaacctggtacagattcgtacacaacaccaccattcttttctaaacgagtgatttcctgaaatgtttttactttatatacatcgccttcgaatgaaaattcgtcaagctttgtcttctgtgtaagactgtaatctccaaagcttaagcttccattctcctctgcttttaatagttcttttacattagccattattatatcctccgtatttgtatctataaagctaccattattatacaagaaagtaggtaatttttctaccaaaaacacataattattaaaaacttttttattctgtctttttcttctttcgctctttctgaataactggcttatctttttcaatatcaagaaggattttatcattatttttgatatgtccttcgaggtattcatctgcaaggaaatcttctaattcattctgaattgctcgtcgtaatggtcttgcaccatattgtggatcatagcctttttcaagaacataatctgcaactttatcagaaaaattcaatacaaaaccaggattctttgaaagtctgtcggaaagttcttttaaaagtaactttacaatttctttttgctgtggtttttccaatgtatggaagaccataataccatccacacgattaataaattctggtttaaataactgttttacttcttccatcacctgagacttcattcgctcgtgatcttccttagcacttctttctgtaataaatccaagatttttcggtgccatgattcgttgtgcacctgcattagaggtcataatgatcactgtatttttgaagtctacttttctgccgtttgaatcggtaatctgtccatcatcaagtacctgcagaaggatattaaatacatctccatgtgctttttcaatctcatcaaacaaaagaacgctgtacggacggcgtcgtacctgttcggaaagctgtccaccttcttcgtatcctacatatcctggaggagaaccaattaatttagatacactgtgtttctccatatactcagacatatctacacgaatcattgcattttcatcaccaaagagtgcttctgcaagtgccttagacaattctgttttacctactccagtaggtcctaagaacataaaggaaccgatcggtctctttggatcctttaaaccgacacgacctcgcttaattgcctttgcaagcattgttacagcctcatcctgcccaatgactctttttttcaaagtatcttccaaccctaaaaggcgctgggattcactctggctaatccgcgtcaccggaatctttgtccaggaagaaacaactgctgccacatcattctctgtaacagtgatacggcttacggacttcttttcttcccataattctcgttcttttgccagttttgtttcaatagttttctgctttgtattattcgtctttgctttacgcagatttccctctgcgagtgcctcctcctttctcttaccatatttatcaaattgttcttctaatgtcctcatctcatcagacattgtatagagaccaactttcttctttgaagcagcttcatccataacatcgattgctttatctggaagaaaacggtcactgatatatcgctcggataattctactgctgcttgaattgctcctgctgtataatgtacctgatgatgctgttcatatctgtcttttaaaccatttaagatagcaattgcttcttcctcagatggttcttccaccgtaaccggctgaaagcgccgctcaaaggcagcatccttttcaatatatttgcggtattcttcacgagtagttgcaccaattaactgaatctctcctctggcaagaaatggtttcataatattggaagcatcaatcgcaccttctgctccacctgctccaatcattgtatgaatctcatctacaaaaagtaagatgtctcctctggagattacttcttgaagaagttttttaattctctcttcaaattcacctcgatattttgatcccgcgatcatacccggaagatctaaagtcattactttcttttcccagagcatttccggcacttctccccggatgatccactgtgcgagtccctctacaattgccgttttaccaacgcctggctcaccaacaagacaggggctgttctttgtccgtctgcttaagatctgtatgattcgctcgatttcctgtcttcttcctacgatagggtctaatcttccatctttcactttctgcgttaaatctacacagtatgaagaaatcatcgagttcttacgcttattcttcttaggagctgtcagagattggtattctttctgtgcccttgtcatatctattccagttgctgttaatacatcaatataaatcttcttgacattgatattcattcccttcatcagacgaagagcaatacaatctctttctttaattaacgccagtaaaatatgttcggttcctatctgctttgcatgaaggcgaagtgcctcctcctcactggcagatagaacatgctctgccttaggactatatccaagaaatgtctgactagtattatctccaagtgctgccgactcaccaagaactgcttctaaaaagttttcatatgtaaggccattctcataaagtactcgcccggaaagagattccggctctgataaaagtcctaaaacaagatgctcggtccctatatatttttgatggcatgaagtagcatcctgtgccgctctttctaatacctgggaagcatagttattatattctgttctcattctatcctcgctttctattcttcctcttctattacaagaaatgtatcatacatttcttcgattaactgtttcatctcatcctttgtaatctccttacagattgcctgtgctacaatcatctgcatatattcattcacctttgtcatttcttctgctttattactaatctgtacagaaatgactgctccgcgtcttctgtcaagcttcagatagccttcctgccgaagcatagcatatgccttattcaccgtatgcatattcacaccaagttctcctgccagacaacgtacagaaggaagggaatctccatcccttaactgttcctgtgcaatttgcataacgatttggttgcgaagctgtatgtagattgcttcagggctgttaaaatcaagttctattctcatatttatcatcccattcttttaaagatatcttctgtgttatatagactatatcatgtggctcaaaaaatcaagtctataaagaaaaaaacgtataaaatgtattcttatcttacggtaaacacactttatacgtttcttttattaatgctcatcagcaagaagctggcaatacaaaatatccagtgcttcttttactgcactgtaacggacaccctgacgatctcctccgtaaaaacaacgctttacaatcgtacatccctttacataacaaccgatataaaccaatcctaccggtttttcttctgttccccctccgggtccggcaatccccgtcgtaacaatagcggcatctgcatttgccgctttcgcagcaccttctgccatttctaatgccgtctgccttgatactgcaccatacattttgagcgtttcttcttttacgccaagcaatttatgtttggcttcattagaatacgtaatgtagctctccttaaaaacttctgaaattccatcggcatttacaagggtacctgccacaagaccacccgtacaagattcagcagctgttactgtcatcttcttgtgaagcaaaatacgtgtaatctttttttcaattggttcttctgccataatccgattggaactcattatttttcattgcctccctctttcagtacatcgatattctttgccagataatctacgagagaaacaatcgtaagaattaatgcaatgtatacaagaatctgttcaacaatatgtataccaccagcataggctgggaaattctcaccaagattcagcatgagcaaaatgatagcaaacatctgaaaatttgtcttaaactttccccaataacttgcagcaataacaacaccgctgtcacttgctactaaacggaaaccactaatgacaaactctctagcaataattacgataacgatccatgcggcaatcttattttgtgcaactaaacagataaatgcagaagaaacaagcattttatctgctaatggatccatgaactttccaaaattcgttacaagattatactttcttgcaatatgtccatctaaaaagtctgtaagacttgctgcgcaaaaaagaacagttgcaatccactttgaaccagccacaaaatctgttaataaaaagaatacaaagaatggaatcataatgattctcacaattgtaagcttattcggtaaattcatcggcataaataacatctcccatcaaatcatattcattagctcctgtaatccgaacaggaactatgtcaccggaaattaattcttcctctgcacgaacaaatacatttccgtctacctttggcgcatccatataggttcttccaatataaatgtcgtcctcatataagtagccttctattaaaacggacatctcctgaccgattcgacgttcttctttttcagcagaaatctcctgctgcaatgccataatctcatctcttcggctttcttttatatcttccggaatctgcccatccatctcggcagcctttgttccttcttctgcggaataagggaatacacccagacggtcaaattccatcttgtctacaaaatctaccatattattaaattcttcctctgtttcaccagggaaaccggtaattaatgtagtacggagaacaatgtccggaatttcttttcttaacttctccacaagagaaattaattctgctcgattcgttcttctgcccatacgctttaatatcgtatcttcactatgctgaattggaatatccagataatgacaaacttttttttcttttttcatgacagcgataagctcgtctgtaatttcttccggataacagtataaaatacgaatccattcaataccttcaatctcgcaaagctttgtaagcagttccggcaacgcctttcttccatagcagtccatgccgtatactgttgtttcctgtgcgatgagaatcagctctttgacaccgtttgacgcaagattctttgcttcctgtaataaatcttccatagggaaactacgatactgtcctcgaatgtatggaataatacaataggtacagcgtttattacacccttctgcaatctttaaatatgctgtataacctccggttgttactactcttttatctgcaagagaatcagggagcagatcaatagaaggacagcaatttatgaaagatttttcttgtgttactgcttcttctggagatacctcctgtaaactttctgttctatcaagaatttcatctaaaatagaaacaatttctgtatagccagtggttccgatcaccgcatcaacttcaggaatctcctgttgaatctcatcctgataacgctgcgccatacaaccagtaacgatcaaagccctgaggtcacccttctttttccattcagccatctcaaggattgtttctatactctcttcctttgcatcatgaataaagcaacaggtattcactacaatcgcatctgcctccgattcttcctgagcaacgcgatatcccgcttcattcaaaagtccaagcattttttcactgtctacaagatttttgtcacatcctaatgatacaaataatacatttttcatcggttattcatccttaatgctgcttctacacagttattcattaacatggcgatcgtcattggccctaccccacctggaactggtgtgattgcagaaactttatctgccactttatcataatcaacatcaccacaaagtttattttctgcatttctgtggattcccacatcaataacaactgctccatcttttacatagctctcatcaaaaaactttggttttccaatagctgctactaaaatatctgctctctggcatacttcttttaaattctttgtatgagaatggcaaatcgttacggttccattttctcttaaaagaagcatcgccatcggttttccaacaatgttgcttcgtccaacaactacacagtcttttccgtcaatagaaattccggaacgctttaataactgaataattccggcaggagtacaggatacaaagcccggttctcctgttgataaagctcctacactctgtggatggaatccatcaacatcctttgcaggagagattgcctgaataatttctttttcatccatatgagctgggacaggcagctggacaagaataccattgacatgatcatccttattcagtctgtcaattaaagcaagcagttcttcctgtgttgtttcttctggaagttcatatgcctgtgattcaattccaatataagcgcaagctttctttttattattcacatatacgcttgaagccggatcatttcctacttgaattacagctaaacatacagaaatgccttcctcttttaactgctttacctgctcttttaattcctctttaatatcagaagatatcttttttccatcaattcttaaagacatggtatttcctctttcttattcaatatttttaatatgtgtatttcagaacgcatcagcattcctgctttaaacagccataagatattttataatacaacactttttccatttcgtaaagtcctgaccgataagtctttatatatctttataaatattcctcaaaatatgcctctaattgttctgaagacatcagaactttacgtggctttgttccttcttccggtcctacgattccagcatctgcaagctgatcaacaatccttgctgccctgttaaatcccaccttaaacatcctctgaatcataccaatagaagccttatctttttcaataacaaaacgggctgctgcctcaaaatattcatctttttcctgtgaaatagctgcactgtttaatttactttcgattttttcagtaacttctgtatcatacactgcaacatcttcgttctcttttaagaactctactacatcactgatttcactatctgaaataaatgccccctgtacacgcactggtttagaatatccagctggataaaataacatgtctccttttccaagaagcttctctgcaccgttcatatcaatgatggtacggctgtctacaccagatgaaacagaaaaggcgattcttgacggtacatttgccttgatcagaccggtaataacattaacagatggtctttgcgttgcaatcaccagatgaattcctgctgcccttgcaagctgtgataaacgtacaatcgcatcttccacctcaccaggcgcaaccatcataaggtcagcaagctcgtcaataataataacgatctgtggcattttcttaattgtttctgggtcaatctcccctgatttctgaagttcttttacctttttattatatccttcaatatttctaacaccggtttctgtaaactttttataacggttcgtcatctctgctaccgcccagttcagtgcaccagatgcttttttcggatctgtcacgactggaatcaaaagatgtggaataccattatagatactaagttccaccatcttaggatcaaccatgatcagttttacctcttctggagaagccttgtacaaaatactcatgatcaaagtattaatacagaccgacttaccggaaccggttgctccggcaatcaataaatgcggcatctttgcaagatctgtaacaacggtttttccaccgatatcttttcctacagcaaatgcaagtctggacttaaaatttttaaaagtactgctttctatcagatcacgaaaatgtactgtctgattgtgcttgtttggaatttcaattcctatcgctgcctttccgggaattggtgcttcaattcgaatatctgaagcagccagattcagcttgatatcatccgtaagtgaaagaatcttgcttaccttcgttccctgctcaggaaacatctcataccttgttacagacgggccacagctaatgtctgtaatcgttacattaaccccaaagctttccaaagtctgctgaagcttcaatgcagtttcttttaaatactgttcatatccggaagattgtgtctgctgttcttttataagaagagtaaccggtggaaaaatgtaatcctttccttttgccttttttctatcagggacagcagcttcttttgctttaatttttttaactactgtttcattagatataatctcgttatccttagcttcactttctatcacttcattatctgaaatatttgaaatttcactggcattttcttcattatctgccgcttcattatttatctctacaacttcattggtcatagcttctacattggctgtctcactatctataagcttatattccgttgtttccttatctttttctttatctttttcctcatcattgattctttcagcctctatcgttgattgcgagaaatcagggagatttactgaaatatcttcttctaaaatcgcatctgcttctgatacaatattctcaacaggttctttgacagaagtttttaatccacttatcttgatttcttcaggcaaagaggtatgaaaacctccctttgctttatgaggtgcttcatatactgtctcttctttttctttttgattcgtttcttcttcaaaggaggatgcagattcttttatttcgtcagggaatgtaaatgcactgaaatccagcttaccctgaaacggttctgtttttccatcttcttctgtaaaaggatagattcttggatgaagttcttttacacaatcttttcgtttcacttcatcagaagacgtaaataatggaacatttacttttaaatcctgtaagttcttttttggttctgtcttatctattttttcccgggcactttctttctgcaatctacgttcttctaattcctttactttttcctcgcattgttccgttctgcgcttctccgttgttttctttttaccatttttcatctttaaaaatgactttgttctatctggagtttcttcttcatcaagattgatcagaatatcttctgtagcagcggcttccctctccagttgtttttgctgagcagcttttttccattcttctcttgatgttttcatatcttttacaatctttttgaaaaaagacacaaaagaacgctgtgtgagcaaaatacaggataacaggaaaatgcaaaagagaattaccatagctcctgccgtcccaaagcctccttttaacaatagggcgattccaccaccgataattcctcctgtcacatgattattgatcgccagtgaaaataaatcatgtactgttatggaagcacctttatataacaactgggaaagtgctgacacttccatcaaaatgataaaacctgcgccacactttttcatcgccagtgtactataatcatttgcaattaaaatggttacgccaaggaaaaagaataccggcataacaaactgtgcacagccaaaaataccaaaaaagaaacttgcaagccactttccgatcatcccacaatgaccaaaattactaaacatcatcagaacaactaatccgaatgaaacaacaagcgttatctcattgctcataggaatgccctcatctctttgcgtatagtttctttgtgcgctgtttttttgtgtcgttcctttttttcttgttgttgtgctgcccttcgcggtacttttccttgtcacattactgcccggtgctgttttctttgtcgtttttcgttttgttttattctcgtttgttttactatttgccatatataacacctttatattctaagtttgatacttctatcatcatatcacaaatacccgaagaaaaaaagatgcgttcttaaaataaataacactgtttttatcttattaatttttataatttcttcttttccttcttctttctatctcctgatgcagccagaaaagtgcttcggagataccgccaacctcgtgaatcaatccctcttttactgccatttctcctacaagaattgttcccagatcttttaccatcatcccctgccgtagcatcattctttccagcctgctttttgtaactccggtatgtgcttctacaaatttaagaatcctgtcctgaattaatttaaaatattcaaaagtctgaggtgcaccaattatcgttccatttaaacgtaccggatgaaggatcattgtcgctgtcggtgcaataaatgttcgatctgctgctacagataatggcacaccaatagaatgactgtcaccaataattagagaaacggttggtttctttatagaagcaatcatctctgctacagcaagaccacaagaacaatctcctcctacggtatttataaggaagaaaatcccctctatttcttcactatcctgtgcttttgccaaaataggaagtaaatgttcatactttgtcgtctttattcgctctgatgacagattatgtccttcgatttcaccaataattgataaaaataaaatgtgatgtcctgatatcccatcttccagtacgatttctccaacttctaataaattatttaactgttgattcatgagctgcctcctgtatttttttctagcatacccatttcaagcaaaaaaacaccagagaactccattacatttcactctccagtgttttctttttatttagaaactttataaaacttgtgattattctgaaactgactactcaccttcaaacaattccagttttttgaagcgtccatatgtgcatcataatattctttatctaaaatcaatgcctgggaatatcccttctctatatctcctatcgcttcctctacatgcgaaaacgtgattgcccgtcctttgtatttatttgcaagatattttgcaaatctttcttcaccggctccagccggtgctgcaattattttatttttgagacttcgcatatcaagtaatctgctttctttcggaaccaatacacaaatatctgatgtgtaaaattcacttccagaaagaacttccttttctccggtttttacgactgtactgccaataaagccatcaacagattgttctgaaagactttgttctgaagcagaaatatccatcggaacaaacatataagtaaacgactgttcttttgaaagcttatctaaaaatgtcacatacaaacctttttctgtgccatcagcatctttataataatatggcgcattgttatcaactacaccaatataataatctactttcttctccgttttctttttttgattgccaaattgacatcctgcaagaatacataaaagtaacaacgttatgattcccagtgtaaattgctttcttttttgcattcggaccctcctgttaattttaatgcactctcaaagccttcactacacttgcttttgtgagaagattataagaatacattttatagtcccagctcatgtctgtaaatctgtattcttttttctatttcatctaattccttattgatttcctgaatacgtgcctttccctgttctacatcaattgctgtatcctgcataatttttgtaatataacgtggcagatttaaattataatcattttcctgaatcgttgttttagatacacacgaacataatccaggaatcgtttttcgctccatccagagtgtctgtaaattttttatctgttctttattaaattcttctacttcagaacaatcaaaaaacatcacatcatctttacttcgattcaactgtaaaaacaaaaagacttctgcctgcccatttgaatgaaatatagtatctggaagtaacatcaccgtatcaagacaatttaattcatctacaagatacttgcgaatctgtgcttctcttccttcacgatataacattgctcccggaaagatggcagctagagagccctctttcttcaggcaggacaatgctgttaacaaaaacggaaattctccctttgttccagaataaaactgctctttgccaaccgaaattcttggtggcgatacgtattcacctgcctctacaccttctggcataaaaattaaaatatagtcagcaccttccggaagttcctgtcttgccttccaatctctcttcatgaaaaaatgtaaatcatctaagggaattcctttcatataacaaagaatagtgaaaatatcaatgtattcttcttcctttgcatatccgtaaatatctgcctcttctccagcatttataatataggaagccaaaattccatactgaaattccggcaaaagaaacttctttttttctgacacactctgcacattgttattaaaaaaaatattatataattcgcacagttcttctgatatatacgtatccttctttaatcttgcaaattccgtaactaaaagaataaataaattgggatactgactcaacaattcttcttttggattccaaccattgattttttttaaaaacttacgaaaaaatctggcataacttttttgtttttccaaagaatgtactttttcaagttttttataaaaagaaaagtctgtcaattgaaattctttattaagcatgtgaagaaaggaagaggctgattccataaattttaaaaaagaagctacctgaagcttccctcgtattgccatttttactaattcacctggtttgtatacatcttctaataagtcatcatattttaaacaaagatactgataaaataagaggaacacacaactatctctgtattcctcaaatgtcagacccggatgactttcacttaaaattgacaaaaattcattatgtatctgttctctgtccatccgattcccctttttatattttttctaaatagtgcatcatttcttctgtcaaaattgcctcttctaaacgcattttttccatgagcaatacttcttttctcttctgataataatacagcttaccaatggacatctgcgttgacaaattcgggcactcgatcatcagctgacgaatcatatgaactgacaatactttgacagaagaatttccctgaatagcaatcattctctgtctttttatttcaggatgctcattaaaataccacgcaaaataataaggatccataattccattctgaaactctatagagacaaaatttgatggaataattttcccttcatgctgcttttctaatacagcagcgcggtggaaggaggtcagccctattacaatactgtgttcttttgccagattcagattcttagtcttttttctatcaaccaaagcagttggtacttcatagtcccatactccattttcctcatctatcagctgactgatcgtaagaatgggatattcctctccctcacttaatatctttggctttattctgtttaataccacaccatgtgtaatctgactgatctgctctaaaaggagttccacccttcactgcctccccgtaacaataatttatttgatgatctcacgaagtgcaagattaattcttcccatcttatcaatttcaagaacttttacttttactttatcaccaatattaacaacgtcttctaccttctctactctttctttagaaagcttggagatatgaatcagaccatctttattaggagctaactgcacaaatgcaccaaagttcataatgcggactacttctccttcataaattttacctgcttctactggttctacaataagacgaataatttccatcgctctgtcgatcatagcctgatctactccacagatgtctactcttccttcatcattaatatcaatctttacaccagtttcatcaataattgcattgattgttttaccctgttttccaataatctcactgatcttatctggatctacatgcatctgcatgatctttggagcatattctccaacatgatctcttggtgtagaaatcactggttccataacattagtaaggatatgttcacgagcttcttttgtacgtgaaattgcttcgcggataatgtccggtgtcaatccatgaatcttaatatccatctggattgctgtaataccatcatgtgtacctgcaaccttaaagtccatatctccgaagaagtcttctaatccctgaatatctgtcagtacaatgtaatcatcatcactgtctcctgttacaagacctgtagaaatacctgcaactggtttcttgatcggaacaccggctgccatcaaagataaagtagaagcacagatacttgcctgagaagtagaaccattagattctaatgtctcagaaacagtacgaatagcatatgggaattcatcttcactaggaagtactggaactaatgctctttctgctaacgcaccatgtccgatttcacgacgtcccggaccacgactaggctttgtttcacctacagagtagctagggaaattataatgatgcatatatctctttgatgttacatttgcatcaagaccgtcaatcttctgtgcttcagataatggtgctaatgttgtaattgtcataatctgtgtctgtccgcgggtaaacatacctgaaccatgtactctaggtaaaagatcaatctccgcagcaagtggacggatttcattgattgcacgaccatctggacgcttatgatcctttaagatcatctttcgaacggtcttcttctggaacttataaacggcatcatcaattaatggaagccagtcctcgtgttcctctgcataacgctcttccagtttttctttaatctgtcggatattctcttctcgaacctgttttacatcggtaaatactgcttcttccatcgcttctggtgtaataaaggataccatatcatcccataaatcttccggtgtatctacatgttcgtattcatgcttttctttaccacattcttctacaatgcggtcaataaacttaataacttctttatttacttcatgtgccttgaagatagcttcaatcatcttatcttccggaacctcattcgcaccagcttcgatcataataaccttctcggctgtagaagcaacagtaagtgcaagatcagaaactaactgctgatccgctgtcggattcacgataaactcaccgtcaataagaccaattcttgttccagcgatcggaccatcaaatggaatatctgaaatagatgttgcaacagaagcgccaagcattgctgttacttctggtgaacagtcaggatccactgccataaccagattattcaatgttacatcatttctgtaatctttagggaataacggacgcattggacggtcaattacacgagaagtaagaactgcatgttcggatgcctttccttctctcttattaaatcctcccggaatcttacctaccgcatacatcttctcctcaaactccacactcagagggaagaagtcaattccttctcttggcttttctgaagctgttgctgtagataaaaccactgtatcaccataacgcataagagcagcaccattcgcctgcgctgccacttttccaatctcaactgttaatgttcttccggccagttccatagaaaactgttttaccatcatttaaacctcctaaaaatatatattaaatacagggaaggtttccgaaacaactgaaaaaggcactgtatatgcaatgcccttttcagaagtctcgggcacatccttcccatagtcataaattatgacctaatctttaccattctatcacaggataaaaaaaactgcaatagttgaggttactatttaattcattaagagaaaacagacgaaaaaagaaatactaccatatcccatctgctctgtagtcgctgtgtttaagatgcttatccgcatcttaaacacgctccgaagccgcatctgggatatggtagtatttcttttttctgtgttttggctccagaaggaatgaatgcaatagtctttggggaaaaagatggggaaggggacagaaaggttcctgcttgctcggaagaattcttccatagcagcaggttgttgaaatttcgtaagcaagtaatctttggataccgttctttaaaagtcccttccggatttttaaatcgcttatacatgtccataataatgtttacaaatcacgagacatttttgcaatagcactttgcaatttttatacaatataacatgattttttcctcccggatacttttctcatttgttttcttattggtgatttttcacgttcttttttgatatatttaaggaaaattataacatattttctctaatttcaccacaaaaacacgcagtctcagataatctttatctaagattgcgtgttatattttttatagagacctctaagagattcttagctatctattttagaacttccttagagtctttttacatctattctggaaccccctgacctacattttgtaatccccttcatggatatttttatctataatcccctgacacctctatataactccgcttcccacgaatataatcctcatatgctatttccgggtctttgcccttgaataccgtacaaagtccacacatatcgcaatcggcaatgcagggaaatgtttttttgatgtattgtcgtctttcttcttctgtggaagattctatttctggtggtcgcataattatcttcacctgccttgctatcttactagtccagtatgacttcggtattcttcgtttaattgacggagttctttttcaccgttgatatatggttcataaaaagcatctaccagaccaccgcctagattgtcacagccattgcagaagtcacaggctccaccacactggctgagtccttcctgtacgatacggattcgttcttcttttgttgtgtcctttattaatatgcttttgatttccatgtgacatcttcctttcttgctgctacttgacttttggctaaatcatattcattcttagagttatcccattcttttttaaattctttattatcaagctgtttgttaagatattttccgaaatcactcatagaacttattcccaccttttatttttgttttgcattaattctttgtctttattatatgtgatataatccacattatcaagttggattaatgcacacatacgtcgcattatctggaagtaactgtgattttttataatatttatccttttccaacaagaatactcccacctctagagcatgtttaaaaaatgctttctgtaagatgtacgttacaatttgtggagatgaattgtatccattccccacttgatagtgtatcctaatcatagtataatatattcagttaaataatgaaaaacaaaaccaagagaacaaaacttaccaaaattaggaaagcgcttatctctacaggtgagtgagaatgtcacgctaggattactatagttaattttataacaaataaccattttaatatagaggtattttcagatgaaggaaccacaattactacagacaaaagcttatgattatttaattaatctaatcaaaaagggtgaattagaaacagataaaatttattctttaaatcagcttgctaaagaggcaggattttcaaaaactccatttcgtgatgctgtattgcgtcttgaacaggaacgttatatcgacattcttccaagccgaggctttactctccataaaatgtccaaagaagatattattgaaacatatcagatgaggaatgctattgaaatatactgttctaaacaacttgctctccacttagatactcctcgcggacaggaatattttaataagctttctactaaaatagaacttcaaaaagagatacgaaacacaacacattctgaagaagacttcggtcggaaagattatgagtttcatcgaagtattgtgcaatatgtagataatgaatccatgttagaaatctatcgccgttttatgtaccgtatattctggctgacagttacttccttttctcaaaaaggccgaatggatgagacaatcaatgaacacatttccttattaaatatgatacaggcacaggacttaaccgcacttgaaaaacttatcatgcatcaccttgatgtgcctcaaaaaattacattaagtttaattcaataacaagcacaaagggtctttatattccatttactctataaacgttgcttttaaaatgttcaatcgcatcttaaaacatcttaacgccgcattcggaatatatataatttcatgccacccgaaggcttattatgatactattcttcttccttatttaaaattgaataataaattgcaaccatcaccaaagacagcccgtaagaaataatataccccctatatgtggcctcggagcaagtgttggacacgagcctaaagcgagtatccaacacgatgcgactaaagtcacatatagggggtatattatttcttacgggcgtctattctatcttaaattacttattcaatctccgcaatacatactacctgactggagtctaatcctttgataagtaatggagcattgaaaaatctcttaatttttgctccctttggtatgtctgccaaatgcatgtcttctacacctgtaacgaacttacctgtataatatccaagcatatgtctatgacaatctggtggtaattctccttctggacatttggatgaagcagaaccgattgctaagaagtccattccaacaccttttaaattagggaaattctctgtcaagtaatctcctgcacttggagcaatgtaggaaccttcattctgatatgtattctgatctgtctctctatatttttccattcctgtacggattaatgcaaaagaaactttagataaaatatctgcaaatggttctaaatcttctttataaataccttctgccggtccttttggaatctccaaaagtgcaacttctgtatggcagaaataatcaatagaaagatcattgatactaagtccgtcttttacaaaatgtcttggtgcatccatatgtgttccacaatggtttggcagttcagatacaaaactgcagaatggacagtcatcggaaacatctgtacactgtgttgtctttacaacaggctctcctggccatgcataaccttctggatctaatgggtgcgataaaaacataaacatatataactcctcctcatacatatattatttttaaattttactttctcaactactttttatttcctattacttttttaaccagtctactttgttttcattaaaatctctacagcttcttttaaagtagtatctccacctacattaccagggaaaataacatatggtgttaatggaaacttactttctgtacctgtctgccacactggaatacccggtcgaatctgacctaaaacattcgctcttgtaacagcaagtgcctttgttcctacatcggatgaagtaattcccccctttgcaataacaaagcttggtgttacagtaagtcttcccactaaagactgtactgcatcagaaattcgtacagaaagtctcaaatcatcttctttgtctccggtatctgctgtgattaacgctcttgtagtataaacacaaactgacttaccagatgaaatatattcttcttctaatgcaagacatctttctacttcttcagcaaatgctgcttcatcatttacaagtgttgcattaagttcaacaaaagcaatgtctttattctctcttagtttttccatctgtctggttgttttgtcggtatgagaacctactacgataattccaccgtgatccgtctcttttacaaccatctgctctcttgtcaataacggctgatcactgacaccacccattacctttacaattgcagcagcagtacggaacataaagttctttccctttttcatagctctaaaaagtgctacgcagaaaatctttacatcgacataatcaatcgcattcacgataactttattaaaatcttctaccgctaaaagctgttcttctatcttatcataattcagttcacgaatattctccaaagaaatcgctgtaacattctcctttttatatgctccctgcgtcttctcctcaacatattcctttaaattagagacggtatatccaaaagttttatcttttgcaaattctgtctcagctgctggtacaagcgtgtcatcatactgtacataatgcacgtcatcaatcgtaaaacgtcccccctctttaaaaaatgggcataacacttcaccatctatctttttaccagtgttcttttcatattcatcttttaaaatagttgtttctaacggataatgtcctcttaatgtagaatcacttctactgataaaaaggtattcctttcccgtttcttttgctacctgatctactacttctgcaatctccttatgtgctttttctgtctgtgcagctgtaaatcctctggaattcgttaatatgtaaaaaagtttattctcctcagcaaatccctgttcaatgcttgccttctcccaattcgtataaacagaaatatcatgaacggtctgtacacctgtagggtcatcatccaatacaacgattttcttctcgttatcacgaatctcttctgccagcaccttatctacttccgcttcctgcactggcggataggaacttaacacatcaattgataacgccatcttcttctcctttctcaagtgtatttaaaaatatttttgatttttcaaacatgccttaagcatttttaatccttctttttaacctgtacatctgcaagtgcttcgaaatactgtacaattccgccatgatcatcattcatatgtccatgaatcttcaatgtctgtaaaatctcataaagctgtgcagaatatggaatcggcacatcaatcgcatgtgctgtgttcacaacatttttaatatctttatgattaatagaaatctttcctcctggtacaaagttacgctctacaatcataggaatctttgcatcaagtactgcacttcctgcaagaccaccacgaattgcttcatatacctttactggatcagcccctgccttcgttgccattacgaatgcttccgacactatggcaatcgtattatttacaataatctggtttgccagcttagtaacagaaccacttccgctatctccaattagtaccgcagaacttcccataatattataatatggcatcagtttatcaaaatcttcctgtcttccccctgccataaatgcaagtgttccatttactgctcccggttctccaccagatacaggagaatctacaaatccaactccaatcttctcaagacctgcaaaacattcttttgattctactggagttactgaactcatatcacagacaactttacctgctgttaaagtctgtgccacaccgccttcatcaaatagtacattttttgaaatatcaccatttggtaaaataagaaaaacaatatcgcacttctcaccaatctcacgataggatgatgcctgtgcaccacattctacgacttctttcaccgcctgctcattaagatcacagaccattaaatcaattcctgcttttaacaaattcttagccattggcttacccataataccaagaccaataaaaccaactctactcatataggaacctctcctttctttttatccgctttcgatatgctgatatatcggtttgcatatattatatgatataccggtatatcagtcaagggtattatttattttttacactttgcataaatcttttgccaagaattcagcaatttgtataaaataattttgacttgctgaaggctgtctttggcagttgaaaaaacttcagaatttatttttagagagatttgagaaaggttttagacggttgtggttagtcaaaaaacagcttgccaaagcacagctatctgaaaataaaaaaatctatatttgtggcctcggagcaagtgttggatacgagcagtaaagcgagcattcaacacgcaacgactaaagtcacaaatatagattcttttatttttagatggcgtctcttttgcctacagcaatcagaatttaaagcacctgttttgctgctccgtaaattccagcatcgtttccaagtgttgcaagtaaaatcttagttttctgatttccataaaatgcatggtcgtagaaatactttcttacgatatctaaaagaatatcccctgcttttgatacacctccaccgataacaaatactgccgggtcaactgttgcagctaaatttactaatgcctgcccaagataagcaccaaattcttgcgtaatttctaatgctgcttcatcccctgcttttgccgcatcaaatacttcttttgctgtaatttcttttttatttaagatactgttttttgcatttttctcaaaatatctttttgtaagtcgaacgaggcctgtcgcagaagcgtactgttcaaggcatccttttcttccgcatccgcatgtttctgtctcatcatttcttactgtgatatgtccgatttctcctccggctccatgagcaccgactactggatgaccatcaataataattccgccgccaactcctgttccaagcgtaaccataatcagatctttttctccttctccggcacccttccacatttcaccaagtgcagctacattcgcatcgtttccgataacgcatggataaccggtaagttcttctaattctttctttatttcttttgccttccagcctacatttgctgcacgttcaattgctccatttttatcaacaggtgccggaacacccacaccgattccacaaatttcgtctgctgcgagttttttttctgcgatcttttccttaattgcttttgtaacatctggcagaatacgttctccttcattttctgtgtaagtcttaatctcccatttatcaagaagttctccttccactgtgaaaagaccaagttttacagttgttcctcctacatctacgccaaaacaatatttcatgatgctcccctttcttcttccacttattgcaattataaatttataattgtaaacaaaattctctctttttcaagaatgcctcggcattcttgctgcgagatgcgcgtcatgcaatgcatgacatacttcttctgcgcatctctgcaatcctgccggaggctatatcagatgggggattgactcccctactgatactgatttgctgctcgccacctacagaggtgggagtcatctcacatctgatataatatcacgaatttgccctgtttgctttcattataatattaattactgatacatttctatcatttttcaaatgttctttaccaatatagcttttatcatattaacattagcaaccaatattaatcatcaagtagctggatgatctaaccgatataatcgcctctgtcctcaaccagttcgtatccggcagaacgcactcgggcagatagacagtttttgcattttgctgcttcatctccagtacatattttattatcataaagttcatactgttttcgattctccacaggagacaggttcggcatcactacatttgcccctgcacacagtcctttttcccggccaaggggatctagcgttccgagtgccgttgttgctggaagcagtaccttaggaagcagcagacgaatgacagacaataactttaatgtcaattctacacttcctgctttttcattcgcaaacctggtatcatgatgcggaataaacggaccgattccgaccatctgtggctgtaattcctgtaaaaaaaccaaatcttccgccagatgctcccatgtctgtcctggtgaaccgaccataaaaccggctcctacctgatagccaagctcttttaattcatataaacatttttttcgattagaaagatgcatactatccggatgcagcatatgataatgttcttcattcgccgtttcatgacgaagcaggtagcgatctgctccggcttccttccatgtctgatatgtttctttagacttttcccccacagataatgtaattgcacaatctggatgtgctttttttatctttctaacaatatctgcaattcgttcttctgtataccatgggtcttctccaccttgtagcacaaatgtacgaaatccaagtttctctccattggcacagcagtcaagaatttctttttcagtgagacgatatcgttctatattccgattatctcttctgattccacaataataacaattatttttgcaataatttgtaaattcaatcagccctcttgtaaataccttcgttccatagtattttttgcgaatctttactgcttcttcttttatatactccatactttctggaacatcaaacaaagaaaacagttctaaacattcttttttactcagagagtgtgtttctacaagtttttttgaaatatccatttttttcctctggtaattaataatagttcggttcatctggcataattaaagcggctacgatataaaataatataccagatcctccggctaatgtaaaaagaacaacaagcagacgaattaatgttacatcaattccgaaaaattctgcaaaacctccgcatacgccacaaatttttttgtctaatgatgatttataaagtttgttttccataaaatactcctttctttttcttacctattcttgtctactctgttaaatactaattttcatttttgtctgaatcgttctttttctgattctgagtagttgtctgtgacagttcttcctgtatttctttttgttctgcaagagaatccgcccattttttattaaatgtagtataagacattgctggcagggtaattgttccatcctctccggaaatctggcgaacttctgccttctgtgtctgtgtatgttctgcaagataattcatctggtaatcggcaagtttatcggcaatcaaaagtgcctgtcctcttgtgataagctgattaccagctttacaggaatcatccaccgctaatgttcctgatacgaaagaagcatacgcttctcttgtttcttcactcatattctctattccggtacaagctgacaatgcttcttctatcttatcatctgcaatcgtcaccggatataatttctgaattaactgtgcaaaccgcactgtgctgaccgttccatttgcattttctgtaataaaagcgattaatgctgcattatctttaagggagtctatcgcacctaacatcgtaccaagctgacttcttgtaatcgctttatttgggtcaaaaagtccgtccttttgtaccggatagcaatgcaatgaagaatattcactgtaaacatctccatattttttagaacttctcacatcataattacttggtgttaaagtaattttcccctttttataactcttaaatgcataatcaaataaacttctgatcgaggcaaatgtactttccttgctcacatttccaaaatatgcacagatcagttcatgtccttcatcatctgttgctgttgcgataaatacatgaccggcagcattggttgtaccagattttgaaccgataactttataagcatcatggtcataatatgccattccttttaaaaaccagtttgttgtattaatatccataccgcctttttgcgtatgataatgcgccttagctacagtgcttcgaattaatggcattgccattgcataacgacaaacttccgccatttcttttgcgctggcatacgtttcgttaaatcctgccccaatatcagaaccaaccggattatcaaaatgtgttttctttaacccaagttccttacatttctcattcatcgcctctacgcaggctttttttgaaccaaatacaccaaccgccaaagaatctgtcgcatctgcagcagaagacataagactcatatgtaataaatctttgaaagtgtattttacaccggctccgattcccagactgtatgtacccggtgttgtgcgatatactacatcagactttgttttaataacagaatttacatttcccttctctacacaaacaattgccgtcataagcttagcagtacttgccggataaatctttttgttagctttttgtccaaaaagaacttctcctgaacctgcatccatcactgcatatgcatggcactgttttttcggtgcttttacttttgcctgtccctgtaacggcattgcaaaaaacaataaaagcaatacgattcctgttaatttctttttcatatcattcccctttatcttatgtttatttcctatctcatttcattttcatgaatgtcctgacattcttggctgtgagatgtccgtcatgcagtgcataacatatttttctatgaaaagtctctagacaatctcttttccttgcaaaaagaagtatccatactatgtaaagcattataaagctttgttatcatctccacacatagatcctgacttccataataaagttcccataaatgctggcaggtttccttatcacccggatgaatttctcttggaataaaatgatgatgtatctctaattccggacatacatatccaccaatcatcattgcgattgctcttttgactccaaatccagaacgaaatatgtgattaattaccagcttcatatgaaaaaggcttacccgtatttgtttcgcagattttttaaaatacggagcgattaccattgcaatctccttcctgttttttacatgacaggctcttttgtaatgatctaaatcctctccagctttctgtaaaacctgaaaatcccaatctgtttcgatttctgtatgactgattccggtttcttttatccgctttcttacataaggatgacaggtactatccaaaataaaatgtgtcataaagccagcaagatatgcgcaggcagcccttttatttttctgaacctgaaatactttaaaagctcttttaaagaactctcttgcgggttcatgatgcacttttattccatattgatttacattgtttttatgataagaatgataataaaataatatatccggaccatgtactcctatattataataatccatataaggttctatacttttttgtatctgttccggaagtttattaaaaacatcctgcccatatgcataatgtgtatatgttgtcggcatactatctcttcctttcttatttccttattttacggcactccgtataataacgtttatcctgtgcgtgtcccatagaaaatgtctttcttggaagtgctccgtcatgaatcactgtaggaaaaagttcttcttttcccatatccggcaaaataaatccgatactgtttttttctttagcaaggccttctaccacatcctctccatgaatataatcaatctttccaccattttgtgccagataactatcaagaaatctctgaaggcttcctactgtcaattttgatgtcgggcgatctatcacacatttctttttctttcctttatagatcgtataaaaagtctgtccttttccttcttttttaatatgcaaagcgacactcattttacttaataaatcttctacatcaacgtccgtaacgatacggtgaattgcctcaaactgcaatgccgggctgtgaagattcacaatctctacaagcgcatatcttgcaggatgatcagaaaaatcctcatctggatatgctgctttcagctgctcataatactcttttgcagctgcaagagaatgatttccgtctcctaccgcaaataataataccgggcggttttttacatgatatttatctccaaaacatttcgcatccgcaagaaaagaaagagctttctggattctttcctgttctttttctccaagaagatatcctctaagatgaccgcctcctaacataagatcaaaatcatacagaagagggaggctttccttttcaaatgcacaaggttctattacgtgttttccggcatcgtctactaaaagcataacatgcggaagttctactactgcatttttacgaatttccactcttgccggaattctttctgctaccgttgcttccgttgctcttataaaagaagtactttttttgcgataatcatattgctccaaatcaatctttcctacaattccagaacgcacctttccgctgctgtctgttcgttccacataaatcatagcatctttgtattctgcaaaaacctgttcatgcaaatacgtattcatggaagattcaatcgttttaagctgtttttcgtgatcatcatgccctaaatatacttccggcaaaatcatatctaaagtagacggatgttctgctacatttgccttcactttctcccaatattccggttcgcttgtaaactggtcacaggcaattacggaccacttttccatatctattgttttttctggcagtaaaatatctgccgcttgaaataccgtatccattacccttgttctccttattctctcttttctttcttttgctcttcaattctttcagcaagatcatttaaatatacccaccgttccattttatcagaaagtttggcttccgtcttctctttttcctgcataaattcattcaattttatgaaatctgttgcacatttactgatctgcccatcaagttctgctattttttcctctaacttttcaatatcttcatctatcgtttcaaattctttttgttctttataggtaaattttaatagcttttctttgtttttagatgcaagccatttttctcttccttcttttttcttctcattattctttttaatatgaagacccgcaccagaatcaacactttcaattgcatccgtttctatcttccctgatttctcctgatattctgtataatccccttcataaatcactattctttcctcttcgaaagcagcaatccgatctaccgtacgatcaaggaaataacggtcatgtgatactgttatcacaattcctgcaaattcgtcaaggaactcttcaagaactcgtaaagtagcaatatcaagatcattggtaggctcatcaagaattaaaacattaggagactgcatcaagactttcaacaaatataatcttcgtctttccccaccggaaatctttgcaattggtgtatattgcatatctgaactaaataaaaacctttccagcatttttgatgcactgactaacccttctgatgttcgtacatactctgctgcatctttaatataatcaatcacccgttgcctttcatccattatttcgcattcctgcgcaaaataaccgattcttatcgtttcaccccattcgacacttccggaatccacagattctaaatttgataaaatcttcattaaagtagacttaccacatccgttatgaccaacaaatccaattctttcaaagcgtttaaatatataagaaaaatgttcaaaaagcactttatctccatatgcctttgaaatatcgtaaacctctattgtcttctttccaagtctggttcctaccgaacccatttccacctgttttgccgttttaggagaatccattgcttttaactgctcaaaacgttcaagacgtgctttttgttttgtagatctcgctctggcgcctcgcattacccactttacttcgttacgaagaatactttgccgctttctttcagaagctaactgcctctcttcccgctctgcttttctttccagatacccggaataattctcatcataataataaacttttccaccatcaacttcccatatatgattcgttactttatcaagaaaataccggtcgtgtgttaccattaaaagaacacctcgaaaacttctcaaataattttcaagccagtcagacatcttattatctaaatggttcgttggctcatctagaatcaaaatatccggtttctgcagcaacactttacaaagtgcagctcttttcttttgtccacctgaaagattctttatcttttcatcaaactgctcaagctctaatactgtaagcattgccttagcatcactctcatatccataatcttcttcgatcttttttccttcacaaacatattttaaaatactgctgtcttcatcgaattccggattctgccccagccaaccaatagtcagaccattagaaaatataattttcccttcatcagcttcttcctctcctgcgataatccgaagaagcgtagactttccagtaccattaattccaataatcccaattttatctccctcatctacactacaggaaagatcttcaagaaccagcttatctccatatagctttgaaatatgttctacatttattacactcatgacaaactcccattttctaaaactttataataacaaaaaaagctgaaaaccgcaaaggtcctcagcttcttccaacaatgcagttgatgggacttgaacccatacccagttagcccggactagatccttagtctagcgcgtatgccaattccgccacaactgcttatcagcgaatgtctttcactcaccaacgaaaactattataacataatgtattttagaatgcaagtattttttttaaatactaatttactggggacacagacgccgctttggtagaagatattgagctgaattgtagtaagtcttctaaagaaaaaaagaattgtgataagtttgaatttgttccgttgcgctaagcattccattctgcccagaaaaacaggaacttgggaaaaacgagtcccaagttcctatggtcagaattccacagcgcaaagtcacaaaatgcaatacttatcacaattcttttttctttatcataattttcttacaattcagtataaaattttgtttcagcggctgtctggttttgataacaaataacaaattagtattttaatctgagagagaaataagggggttgctcagaattctatgattttcgtcagaatgaaaatctccggaaggtcatatccttctggcacattccatgttgttaaactgtagatttggatagtcagaaaaaagaaaacataccctatccaagatgcggcttcggagcgggtttaagatgcgaacaagcattttaaacacagcgactacagagcagatgggatagggtatgttttcttttttcgtctatacgaaatctacaactcagtatttatttaaaatattctactccactttcgaatatcttctgatcctgttttgcatagatattctttgcgatattgtctccgatacgttcggaatgtgccatcttaccaaggacacgaccatctggactggtaataccctcaatagcataataagaaccatttggattgaaacggtcatccattgtaggttcgccatttaagttaacatactgtgttgcaacctgaccattcttaaataatttctcaatccattcctgactggcaacaaaacgtccttcaccatgagatgcagggattgcataaacctgatcaagtactgctttgcgaagccatggggacttattcgttactacttttgtatataccatagtagacacatgacggccaatctcattcattgtaagcgttggtgaatctgctgtctggtttacgatttctccataaggaacaagtcccagtttgatcaatgcctggaaaccgttacaaataccaagtgcaagaccatctctttcattaagaagtttcataacagcttctttaatcttttcatttctgaatacagtagcaaagaacttcgctgaaccttctggttcatcacctgcactaaatccacctgggaacataatgatctgagcctggctgattgctttttcaaatgcatctacagaatcaaggatatcagattctgactgattcttaaatacgagtgtctctacttctgctcctgcacgacggaaggcttttgcagagtcatattcgcagtttgttccaggaaatactggaataaatacttttggtacagcaactttattcttgcatacataaatatcatttgtgcgatataatggctgtgatacattatgtttgccttcatttgtttttgtagggaatacagattctaacggtgcctgccatgtatcacacatctcttttaatgaaatctcttcttcaccaacctggaagaatggatcatctgtaactcgtcctacgaatgcatttggaagagcggacatttcatccatccagtctgtaggaatctctacaagaatagaaccataatatttctttgtaaggtcttcaagtttaaagtctttcataaacttcacaccatacatatttccaaagctcatcttgcttattgcttcaattaatccgcctgaaccaagtgcatatgctgatgcgataacatctctacgcattaatttatgaattgtatcataaatctctcctgcttttttataatcaggaataccatattcatcaaaaggaatatcgatacgtaacagattattgcctgctttcttcaattcaggagttacaacatgagaagcctttgtgtaatcaaccgcaaaggatactaatgttggtggtacatcaatatcttcaaaggaacctgacatactgtcttttcctccgatcgaaggaattccaaatcctttctgtgcattataagaaccaagtaatgcagcaaatggtttaccccatctctttggatctgtgccaagtttctcaaaatattcctggaatgtaagacgaatcttacggaagtctcctccggctgctacaatcttcgcaacagattcaagaacagcatacactgctccatgatatggactccagcttgacagatatgggtcaaatccataagacatcattgttgtaaactctgttttgccttctaaaacaggcagttttgctgtcattgtctgaattggagtaagctgtgtctttccaccaaatggcatcgtaactgttccagctccgatagaactgtcaaacatttctacaagacctttcttggaacatatattaagatcagaaagagtttcttcccacatttcttttacatttttaagttcagcctgctttttatagtagcattctttctcgtcaggcatctctacttcaaccgtagtctcctgatgtgcaccattcgtatctaagaaagcacgtgaaagatttacgatttctttgcctctccaggacattacaagacgtttctcttctgttacttctgcaacaactgttgcttcaaggttctcttctgctgcataggaaaggaactgctctacatcttttttatcaagtacaactgccatacgttcctgagattccgaaattgcaagctctgttccatcaagacctgcatactttttcggcactttatcaagatcaatgcgaagtccgtctgcaagctcaccgattgctacagatacaccaccagcaccaaagtcattacacttcttaataagagaacttacctctccacgacggaataatctctgaatcttacgttctgtaggggcattacctttctgtacttctgcaccgcaggtatcaatagactttgttgtatgtgccttagaagaacctgttgctccaccacaaccatcacgaccggtacgtccacctaaaagtacaatgatatctcccggatcagaagtttctctgataacattctttcttggagctgcaccgataactgcgccaatctccatacgctttgcaacataacctggatgatatacttcgtctactaatcctgtggcaagtccgatctggttaccataggaactatatcctttcgctgcacctgtagtcaactttctctgtggcagcttgcccttcatggtgtctgccatcggaacagtagggtctgcacaacctgtgacacgcattgcctgatatacataggaacgtcctgataatggatcacggattgctcctccaagacaggtagcagcaccaccaaatggttcaatttctgttggatggttatgggtctcattcttaaaactgataagccattcttctgtcttatcttcaaattctacaggaacaacaatgctacaggcattgatctcttcactttcttccatgttatcaagaagtccgtcctgttttaacttcttcattcccataagtgcgagatccatcagacagataaacttatcttttctgtctccatatacttccgtacggtcagcaagatattcattatatgttttttcaaagagaggcttgtaatatccatcaccaaaagcaacatcttttaattctgttgaaaatgttgtatgacgacagtgatcagaccagtaagtgtctaatacacgaatctctgtcatagaaggatttctgctttcttctccctgataataattctggatataacggaaatcttcaaatgtcattgcaagacctaaagaatcataaagcttcttcaattcttcttccggcatatctttaaatccatcaaaaatcgcaacatcagccgggtcttcataatccataactaatgtttccggtttcttctcgtctgcttctctggaatctactggattgatacagtattctttaatcttctccaattcttcgtcactgatattaccagagaaaacgtaggttgttgcagaacgaatgattggttcttccttctcatcaagaagctgaagacactgtactgctgaatctgctctctgatcaaactgtccaggaagaaattctacgctaaatactttatctccatctttcttagggaaatcttcctcatataaatcatctacaggcggttctgagaatacggtaactgccgcttttttcatagtttctgctgagacattctgcacatcatagcgaattaactctctaacatcactgacatcctctatggaaagatatgcctttaattcttctgcaagttcttttgcctttaccgcatatgacgatttcttttccacatataatctctttacctgactcattacatcctccaagtatgtttaattaaattgtggggacaatttattaatcagccccatattttctgtttaaaatatcatatcacttttttattctatttcctatggttttatatcagtttctacaaaaccatgaattctgacaaaaatcgacgacaaaatttcaaaaaatttttagattttttacagatgaattctcttgattatctgaaataccaaaagatttgaatagacaaccggccttgtttctgcgtaaaaaatgataccgtctgttggtgctgtaacttccgaaataatttctccgctatccgccttcatgatctgcgctaaaacatccccccggcttacttcctgaccgcactctgcctttcttataaagatacctgccgcctctgtcataattggctccagatcactttcctttaaaacacttgcgatatatccgctatgagaataataacgaataatacccattcttgtaaggaaacgcagaatagaagaaacggcctgtgtcgcaagctcatcgtcaattttccctgtcattcctgtgtataaagaaaatgcttctgttccatttctttgccagttgttatgtaatgttgttctgtcaaacggtctgctttttgcttcaataacatagggaagtccaaacagattggcaagactggtgcttccatgttctgggtcaagaagacggatatgtggcataaaagttcctccaagataaaaagaaggtaaatgaattccataccggtaccctcttgttgtttccataatcgcatatgccacacgacttcctgattcacctgacggattccccggaaacaacctgtttaagtccgtatcatcagaaatccagaaacgtttaccaaaatccatcgacatattgtttacggaaggaatcactaaaataccattctctcctaccatatctccatgcttttctatcttttttaatacatcgatcagttttgaacaaatatataattgctgatattcatttcccctcaaagctcccacaatgcaagcagagcgttctttcccttcattttttccgaaataatatccttttacattaatttcctgctgaaaaggagattccatcgaatacaatattttttcttccattatgcccagtcctccttttgctattcatattttccggcaggtctttctgccttgcagattcttgccagaagttctccctcacaaaccgccggatattctctcaaactaaaaatcattccgtcacaggaagactttacctcctcaagctctgccccaagaatcggccgcacgatacagccaagtacctgattttctcttacaaaacttccaatctgtattttaggaataaaaattccactcgtattacagtgaataacttccacatcatttttctttactgtcactgtttttttcgtaggagaaacttctccttcaaaaacttccagttccttcatcatccgaaaaataccatctattacctttttacagtactcataatcaattttaagtgcaatccccgactcaatcaccaggttcgggataccttttctccgaaggctgtacgcaagacttccttcccaaacagaagaagaattactgttcatccataaaactggaattcctgacttttgcgcaagctctgtcacttttttccctgcattctccggcactcgtatctggggaagttcccgaataaaaatatcacttgaatggatatcaatacaaaaatctgaaccttttaaatcctcaattacttctgctgccatatattctatcgtatgtccatgatgacttcccggaaacatcgcattcatatcaagagctcctggagcattacgctttcttatttccagtgccataggagccacacatggatatacatctacaattcctttcagattctctctttcctctttaatccgccgaatcagttcataacaaatatactgtccttgcagttcatcaccatgaacacctgcaacaatacttaatctcggcatattttcctgtatcgtatccggctctaacctgttcttctttatttttatcggaagtcctaccggcatctgtgccgtcattactgtctctatcatatatagtctcccctctgtcaatcaaaaaaatttctgttgtttcttatattgacctttttaattttgtaagctatcattagcttcgtatagaatatactataaaattatgttttgcaaattttatataaggaggaaccatatcatggataaaatagcaagttttaccgtaaatcatttagatttaatcccgggagtatacgtttcaagaaaggattatgtaggaaaagaagttctcaccacctttgaccttcgtatgaccgctccaaacagagaacccgttatgaacacagcagaacttcacacaattgaacatcttgccgcaacgtatttaagaaataatgacgaatggaaagaaaaagtcatttactttggaccaatgggctgtcgtaccggatgttatcttatccttgcaggtgactatgaatctaaagacgttgttggtcttgtacgcgatacttttgcttttatcgctgattacgaaggtgaaattcctggagccgctgcaaaagactgcggaaattatcttgatcagaatcttccaatggccaattatcttgcaaaaaaatatttaaaagaagcgttaaacaatccttctgaaaaaaatctgatttatcctgaataatattttaactttttcacatactacctccgtacctgataaatgtactctcgaaattattttggtactgacagaatttaattacaaaagtaagtgcaagaaagactccgagagtacattcttgaaaaaaggaggatttatcatgaaaagttcaaagaaaacctatcaggaagtcgcagaagcatgcagcaaatatgaaccggtatctgaggaatccgcatttaaaaattcttcctgcgaatgtagtactccaagctgcttaaactgtacacatttcacgaagcaggagcactgcgatttagacttatatgatcagattgtagaacgaattaaataagggtttgtaggattctgaggtgcgcaggtaagaggagacgcacccaaagagaaaagcaccgctatatttgtgactctatcactgtgggttgaatgttcgcttatccgctcgcattcaatcctcgctctaaggccacaaatatagcggtgcttctctctttgggcgctgttctttggctagagcaggctcaggattctaccactttctcatgtcatcatccccaaatcttttcacctgatttgggaaaggagacacaagagacagggtatcaatgaaaccaaagttataaaaatactgtaatatgtaacaataaatttcgtatcggtttttaatattttatttttggaaaatccacaactttctagaaaatctccaagattaaattctgaatttgcaggtataactgaacagctcctaaagagagcagatcccctatatttgtgaccttagagcgaggattgaatgtgagcgtgaagggcgaacattcaacccacagtgatagcgtcacaaatataggggatctgctgtttgttttgctacgcaactcaagattgatctggcttgccaaatcagaatccaatgttgtataatacccttagtggtaatttttttcaatatacagggggtttttattatgcagttacttaaagtttattatgcgtattttagtccgggaaatactacagaaaaagttctttcccgaattgcgtcatcttttgaaaactatccagtggaatctatcaatcttacaagttatgatgaacgccagcaagaacatcattttaaagaaaatgaacttcttatcatcggtgtacctgcctacggtggcagagttcccgttccagttgtcgatgcattaagccgcttttccggtttaaatacacctgtcgtccttgttgcaacatatggaaatcgtgacattgatgatacgttgatggaattaaagaaaaatgtaacagataaaggatttatcccagttggtgcagcttcttttgtatgccagcataccttcttaaaggaatgtgccgaaggcagaccagatgaagaagatttaaaaatggccaaagaatttggtgataaattaaaagaacgccttcgtcttctcgttacatatgatgcctctaacttagaagttcctggttctttcccatacacaaagccacctatgggtgaatttccattcaaagttgaaacaaacgactactgtatctactgtatgctctgcgcagatgtatgcccggtaaaagcaatcagtgacagcaatccaaaagacattgataacagcaaatgtctccgctgtggctcctgccttagaatctgcccaacacaggcaaagtcctttacagaagagccatttaaagcgttacagcagaagttagcaccactttgtggaataagaaaagaaaactggtatacgatttgttaactatgatggtgccaactacgatctggctttatgggctgcttattataacttcctgcggtcatataatttaaatctgccagccgaaggctctaactgttcttagattccaaaccagaggtaataaaccagccaccgcattagcggctatacccttgatgacacataaaagaactgctacactgctgtaaacgacggaaaaatcactaactattcttgaattcttcgccgtcggtgaatcacctacaatagttcttttgtgtgctgtcaagggtggggcagtctacctctgactaaaatatctgcaattttcaaggttccagtactcttttcaaacttataattcctttccaagttcatatgctttctttattacatctacatggcttgcagctgtatttgcagcatcaattccactgccaccgaccatgccttttaaggaagccttttcaaaacagtctacccagccttgcagaccattgtaggctttttcaaatgcactttccagtcttctgacaggatagacaaccgatacaatatttgatatcttttcctttcaaagaaagaagttccaatcatgcccggcttcttttgctccctttgcacactcctttgcgagcatatcagaattgctgcctcctcgaagacttgtagatatgatcaatactttttttgccataattaaatttctcctttttcagtgtcttttttaaccttccgtataactttcgcaggcactcctgccgcaaccatattggccggaacatcttttgttacaactgctccggctgcaatgatcgaaccttcaccaattgtaacccctggaagaaccgtcacattcgctccaagccacacatttttttcaatgtgaatcggctgaaatatcatacctgctcttttttcgggatcttccatatgattgattgttgccaatactgcattatgtccaatcaggactccatcctctatataaataccaccctgatcctgaaacttacatcctgcattaataaaaacatttttacctatatggatatttcgtccgcagtctg

SEQ ID NO: 397 - DNA, 68454 bp, Eubacterium hallii
  modified_base (16620)..(16719): a, c, t, g, unknown or other
  misc_feature (16620)..(16719): n is a, c, g, or t
agtagtagctgtaggtcctggaacagacgatgttaagatggaagtaaccgttggacagaaagtaatttattctaaatatgcaggaacgaatgttaaaatggaagaggaagaatatatcattgtaaaacagagtgatattcttgcaatcgtagaataataggtaacatatatttattttgatttatatcagataatcattcataatttttggttaatatattttatataacaggaggaatctttattatggctaaagagattaaatatggcgtagaagccagaaaagcattagaagcaggcgtaaaccagttagcagatactgtaagagtaacacttggaccaaaaggacgtaacgtagttcttgataagagctttggtgctcctttaattacaaatgatggtgttacgatcgcaaaagatattgaattagaagatgcatttgaaaatatgggtgctcagattgtaaaagaagttgcaacaaagacaaatgatgttgcaggtgacggtactacaacagctactgttttagcacaggcaatgatcaatgcaggcatgaagaacttagcagcaggtgcaaatcctattatcttaagaaaaggtatgaagaaagcaacaaatgtagcagtagaagctatcgaaaagatgagcgagcaggttggaggcaaagaacagattgccaaagttgcatcaatctctgccgctgatgaagaagttggccagttagtagcagacgctatggagaaagtttctcaggatggcgttattacgatcgaagagtctaagacaatgaaaacagagcttgaccttgtagaaggtatgcagttcgatcgtggatatatttcagcttatatggcaacagacatggagaaaatggttgcagaattagatgatccatatattctgatcacagataagaagattgctaatattcaggaaatccttccgttattagagcagatcgtacagagcggttctaaattattaattattgctgaggatatcgaaggagaagcattaacaacattaatcgttaacaaattaagaggaacattctctgttgttggtgtgaaagctcctggatatggtgacagaagaaaagcaatgcttgaagatatcgctatcttaacaggtggtacagttgtttctgaagaagttggtattgaactgaaagatgcaacgatcgatatgcttggtcgtgcaaaatctgttaaagttgaaaaagagaatacagtaattgttgatggtgctggcgataaagatgcgatcaaagcaagagtaggtcagattaagtcccagattgaagagacaacatctgagtttgataaagaaaaattacaggaaagattagctaaattatctggtggtgttgcagttattcgtgttggtgccgcaacagaaacagaaatgaaagaagcaaaactccgtctggaagatgctttagcagcaacaagagcagcagtagaagaaggtatcatcgcaggtggtggatctgcttacatccatgcagcaaaagcagtgaaagaaatggctaaagaactttccggtgatgaaaagacaggtgccgaaatcgtgctgaaagcgttagaagctcctttatatcacattgtagcgaatgcaggtcttgaaggttctgttatcattaacaaagtagcagaaagcgaagtaggaatgggatttgatgcattaacagaaacatatgtaaatatggttgaatctggaatcattgatcctgcaaaggtaacaagaagtgcattacagaacgcaacaagcgtagcttctactttactgacaacagaatctgtagtagcagacattaaagaagataccccagctccagcaatgccagcaggcggaatgggaatgatgtaatcaatatcttttgattctcaaacatcttgatagttgattaatagttgattaatataagaaattgaaaagtacagtatcgtatatgtaaagattgtcatgtgtgagaatgtttaaacacattttatttactatgacattacagttgcgatgctgtactttttttgattcccacggttattcaaatcaaaatgttatttttaggggttttgtgctataatagattttactaatgtgtccttggaatcttcttataaatctttttaatataagtaagtgcagggaagactctgagagtatatactacatacatggaggatttttttgaaaaaatggttggcataatagtattacagattgtattgatcatattgaatgcgattttttcaagtgcagagatttcggttatttctatgaatgaaacaaagataaagcagatggcagaagaaggtgaccgacgggctgagaaggctgttctgctccttgagaagccggcaaagtttcttgaggcgatacaggcagctgtaacattcgcaggattgctaagcggtgcttttgtggcagtgtattttgcagagcttgcaaaaagtgcagtgatggaagtttttgcaggaaagatgattgcttcagaacaggtcatctatggagtgtcggttatcgtagttacacttattcttacgtatgtgaatctgctgtttggtgagatattgccaaaaagggcagcgatgagtaagaccgaggatgatgcctttaaaatggtagggatattatttcttgttgcgaaactatttgcaccgcttgcaggattacttcatatttcttctaatatctttttgcggatgatcggtattaatccggaagaagaacgggaagtagttacagaagaggaaatccgcatgatgcttgcagaaggaaaggagcagggtacgattcagaaggaagagagtaaactgatccagaatgtatttgagttcaatgatacgacagcagaacaggtcagtacaagacgacgagatctggtttgtttaaatcttgaggacgatgcgcaggaatgggaaaagacgatcagagaatgtcgtttttcacattttccgattattgattcaaatcaggaagacgttgtagggattcttgatacgaaagattattttcgttcggaagataagtcaaaggaatacgtaatgaagaatgcggtggatgatccgtattttgtaccggagaatatgaaggccaacatattgtttgcacatatgaagaaggttaggatttattttgcagttgtacttgatgagtacggaggaatgagtggaatcgtaacgcttcatgatctggtagaagctttagttggtgagttagaagaagaagagatgccggcaaaaccagaagatattaaaaaaatcaaagaagatgtctggcggattcagggctgtgcacagcttgacgaggtatcggaggctcttggtgtagagtttccggaagtgtttgatactttcagtggttttgtgtgggatgcaatcggaagagttccggcagaaggagagaagttttctctggaagtgaatgatttaaagatagatgtaaaaaatattgagaatcatatggtggactatgcaattgtgcgaaaagttaagaaaagaggaagcgatgaagcggatatttgatttattaaaaaagcaaagtccaagcaggattattgcactgggttttggcgcagtaatcctgacgggagcaatactattgatgatgcctttttctgtgaaaaaaggagtacatctttcttttcttaatgcattgtttacctcaacgagcgctgtttgcgttaccggtcttgtagtagtagatactgcagacagttttactgcgatagggcagatggtcattgctatgttgatacagattggtggtctgggaattgcttctgtcggtgtcggactgattatcgcagcaggtaaaagagtaagcattaaaagccgtctgctggtaaaagaggcattaaatgttgacacctatggcggaatggtgcgtctggtgcgggtcgttcttgcgattacccttggatttgaggcagtaggagcgtttatcagttttattgtatttaggaaagattattcgccattacatgcaatagggataagtatttttcattctattgctgcatttaataatgctggctttgataatcttggaggaatgcataatctgattccctacaaagataatattttactaaatataacaacagatattttagtaattgccggcggtcttggatttcttgttcttgtagatattgtcaagcaaaaacattttaaaaaactttgtctgcattcaaaggttgttgtttctatgacagcagtacttctgcttggaggtatgtttattttaaaggcaacagaaaaaaatatcacatggatgggtgcattttttcagagtatgacaacgagaacagcaggattttctacgtatgatattggaaatttttcaacagcaggtttatttgcaatgtgtattcttatgttcatcggtgcctctccgggctcaacgggaggtggtgcaaagacaacgaccatttttgtgatgatacaggctttaaaatgtttgggaaggaaaaagtctgcacatgctttccggcgcagcatatctgatgagaatatttcaaaggcatttatgattacagtattatatgtcggcattttatgcactgctacatttttgatatgtgtatttgagccggaatatgattttatacagcttatatttgaagtgacatctgcattcagtaccgcaggactttctacaggaattactccggaacttggcatagctgcaagaatacttcttattctgttaatgtttacgggacgtgttggtgcatttacacttctttctgtatggagtaaagatactacaccgaatgcaagatattctgaagaaatgatttcgattggatagaagaaaggatataaagatgaaaaagaagcgtggaacagcttatggagtgattggacttggacgttttggaacagcacttgctatcgccctttcacaggcaggaaaagaagtaatcgcagttgatagaagtgaagaaaaaattaaaaatatccgtcgttatacagattatgcgtttgtagcagagaatctgggaattgatgcgttaagggaaataggaatccagaactgcgatgttgcaattatctgtattggagaaaaagtcgatgtcagtattttaacaacaatgtctgcactagaacttggagtgccgcatgttattgccaaagcgacaagtgaagagcagggagcagtattaaagaagcttggagcagaggtagtctatccggaacgtgatatggcacttcgccttgggaaaaaattaatatcggacaatttccttgattttgtttctttaagtaacaatatagaaatccgtcagattccagttgggaaaaatctgatcggcaaaagtgtgcaggaatcagaaatccgtcgaaagtatcaattaaatattatcgctttagaaaataattcggaaacgaatattgaaattatgccggattatcgctttaaacataatgatattattgtagtaattggaaaaaccgaaaatatggataaattcgaagaagaaaattagtctggatattttaagaaggatgttttaaagttaaagaagaataggtcatgcattatatgacacacacctcgcagtaagaatgccttggtattcttgaacaaagtatttatgaaaaagaacaaaagtatcgaaagcaaaagaaaggtagaaaagaatgacaaaagaacagtttatgatggaattagaacagtctctgcaaggagaggtatctgcgtatgaattgtccgattctttaacatattacaggcagtattttgaggatgagatccgtaatggaaaaagtgaggaagatgtaatccgagagttaggaagtccacgtcttatcgcacgttcaatcattgacgctcatgggaatgagggagccgcttccggtaatgcaggttatgaagacagcgattacagggaaggctcgtacagtaattatggaagttcgtatgattctgaaagaggcgatattgaaaacagcggacagcggggaggcggaacgctgcagaatgctggaagaatgatcatgacaatcattatatcagcacttatattttttgttgtgttattcttgcttcgagcattgttaccggtcgcagttgtaattattgcaatcgtgttcattgttcgtttgattcgtggatagagtaagagcatataaaaaggaggaaaatatgatacgggaagaattattagagaaagtatccgggaagagagaagagtttatttcctggtatcatgaattccatcagataccggaattgggttttgaggaagagaaaacaacagaattaatctgtgagaagcttactgcgatgggaattcatccacttcgtttagatccaacaggagtaactgcatatattggaccacatgatgcctatacagtagcacttagagcagatattgatggtctgagagtttcagaagatacggatctgccatttcagtcaaaacatccgggaaagatgcatgcttgtggacacgatggacatattgcagggcttttaggtgcagcctccatattaaaagaaatggaatcagaacttacagtacgtgtcaaactgatttttcagccatctgaagagaatacaaaaggtgcaaaacatattatttcacagggaatcttagaagatgttgatgagatatttggcctgcatctgttttccgatataaaggccggcgagatttcggtagaaccgggagcaagaatggcacagacagaccgtttttctattacttttatcggcaaaggcggccatgcagcaaaaccacatcaatgtgtggatgctacagttatggcagcggattttgtgatgaatatacagacaattgtagcaagagaattagacccgatcgaaggagcggttgtcacagtcggttccttaaaatcaggaacacagtataatatcatttcaggaaaggcagtattagaagggacttgtcgaagttattctgaaatagtagcacagcatctacaggatgccatccgaagaagagcggaagcagtcgctgacagctacggtgggaatgtaaagattgcttatgagcagggttcccatccaccggtacttaacgacgaagcactttcccgccggatcgcagacgaagcggaacagctattagagaatagaaagctggtccatatcgcaccattgatgcttggagaagacttctcctggtaccagaaagaagttccgggcgtatttgctttcgcaggctgtggcacaccgggaagaaagtgttatccgaatcatcatccgaagtttgaaatcgaagaatctgcacttgctgatggagtgctgcttcatttggcggcggtagtttcagcgatgcatcgggaggaggaaaagtagagtatataattttgggattggattttccagtttgttagtatagagtaaaggatgtaatttataaaaaatgtatttataaatggaagtcataccgtatgggtatgtgagtagaaattatttggttgaatattattctagagaaagtttcttgcagaaaaatgcaaggaacttttttaattggaattataattaatattcaactaaataaagaaaaagttgaaataaaaaaataactgtgctatcatgaatgtacaaaaataaatacaatattgcttttgagagggtattatatggagaaaaagtatattgcgcatattaatgaagaattaaaaacagaacaaacagtaaaggaacatagtgaaaatgttgcgatgttagcagaagaatatgctgttgaaagatttaagaagatagcatatgtaacagggttattacacgactgtgggaagtatcaggaatcttttcaaaaaagaatatcaggaagtgatatacgggtagaacattcaacttgtggagcaattattgtaaaagatatgtcggagaataaatccagatatccattagggattttgtcaagaatgatggaatattgtatagccgggcatcattcaggaataccagatggtggaactacaaatgattatgagacggatccgacattaactggaagattaaaaagggaatttgaagatttttctacatataaagaagaattggaaataccggaactagatgagaaagattttctgcaatttctgttatcagattgtgacaatagtgaggagaaagtactagataagattgcgtttttgacaagatatttattttcatgtcttgtggatgcggattcagaagatacggcgaatttttgtagagttggtgaaagaccaagagaattaaaaggggattttggagtagcgttagataatgtaaatcaaagattagaaagttttcaggttgaaacagagcttcaaaaagccagagcattgttacaaagccaggcatttgaaaatgcaaaaacaactgcggaaatttatctgttgaatatgccaacgggaagtggaaaaaccttggcgagtgtcaagattgcgttagaacgagtgattttacaaaagaaaaaaagaatcatttatgtaataccttataatagtatcattgatcagactgcagaagtttttaatgagctgtttcaaaataatttagagatattaaggcatcaatctacatttgattatgaaaatatagatgaaatagatgaagattataaagaagcggctaagatagcaatagaaaactgggggaatacgaagtttattattactacaacggtacaattttttgagtcagtttattcaaacaagcgtggaaagttacgcaagatacataatatggctgatagtattttaatatttgatgaagcacatatgatgccggagaaatatttacagccatgtctgcaggcagttacgtatattaccaaatatttgcaaagtgaagcggtttttctaacagcaacaatgccggattatttaagcttgataagaaaatatgcagtgacagacagtaaaattgtaaacttaattgaagataagtcattatttaaaaagtttcaaaaatgtaattataattatttaggagagataggagaagatgaacttcttgccaagagttcattatgcccatcctcattaatcatcgtaaatacaagaaaagcagcaaggaaactatataaaaagatttcggggaaaaagtatcatttatctacatatatgacagcgttagacagggcaattgtattaaagaatatcagaaaagacttgaagtacctggaaaaagatttcccagattttaaaaatgtatcggaggagagacagattactattgtttctacatcgttaatagaagctggggtagatttggatgtttacacagtttttagggaattaaaaggattggataatattttacaggcaggaggacgatgcaatagagagggaaaaagggaaaaagcagatgtgtttgtgtttgaaatgcttgattcaaaaaagaaggcgatatcagtagaaatggatataacaagagatttattaaaaaaatatgaagatatttctgattcggcctgtatagaagagtattatgaaagaattttttcgcttaaggaagatagtatatctcaaaatacgatgcattgtatttgtgataattttagatatattccatttaagaaatatgcagagaattttgaattgattgacagtagaacggtttcgctagtagttccaagagatgagaaaagcagacaaatggtagcagatttaaagtataagcaaacagtggatgagagaaaattacagaattatacttgttctttatataaaaatgaattagaggatttaatggaccaaaaggtagtagatgattttggaacaggcatttattgtcttactaatttggattattatgatgaagaattaggactcttatttgaagcaagtgattattttttataatgaaagagaggggagaaggatgagttatggatttaaagtattagtagagggggattatgcctgctttaccagaccggagcttaaagttgaaagggtaagttatgatgttcccactccgggagctttggaaggaatgctaaaaagtgtgtactggaagcctgctgtccgatatgtaattgataagatcattgtattccatccaattgattttattaatatacgaagaaatgaagtaaaagaaaaagtgaaatttaaagcagttaaaaatcaaatgaaagggaaagcggaaagtccatgtatctatacctcgaaaatcaggagtcagagagcctctatggtattaaaaaatgtgaaatatggtatagaatttcattttgaactgacaggtctgaaaaatgaagaagaacaggatgcggaaaaaaagcactataatattattaaacgacgtttagaaaagggacaatgttttaggacaccgtgtttgggatgtagtgaattcccggtaaagagtatttctttactggagaaatttgatgaaaatatgatcagtgagagaattattgcaatgggagatgttgatttgggatttatgagttataaagtacagtttgaagatggtggaaagccagttaatggagactgggataatcctaaattttcagataaagcatctacgctctactatcgcccacatatgataaatggggttattgatgtagaaaaatacagggagggacttaaatgctaattcaggcactatgtgattattatgatattttatcggcagaaggaaaagttcttccagaaggatattctaaagtaaagattcattacctcatttctttgacggaagaaggaacgatagataatataataaatgtgcagagagaaattgcggaatctaaaaaagggaaggtggtaaaaagactagttcctaaagaagtaaaaatgccagaaaggacagaaaaatctggaattgaagcaaatatttcagaacatagacctttgtacatttttggattaaatagagataaaaaaacaggtgaattatctacggaagataggacaggaaaggcaaaaaaatctcataaagcatttgtagagaaaaatttagaatttatcgaagatttaaagtctcctataatagatgcctatcgacaatttctattaaattggaatccagaagaggaattagaaaataaatttctgttagggttaggaaaagattatgagacctctgggttttcctttgctttatcaggaaaatcagatacgacattattatacgaggatattgagttaaagaaaaaatgggatgctgtatataaaactgatagagaaatggaaaacgaaaaaacatttgcacagtgtgccattacaggagaagaagaaccgatagcaagaatacatgggaaaataaagggagtatatggtggcctggcaacaggaagcgtgttgattggattcaataataattcagaaagctcttatggaaatgaacaatcttataatagtaatatttcagaaaaagttatgaaaaagtatacggaggctttgaatgttttattaagcagcaaacacaaaatattgttagacggtatgacgattgttttctgggctatggataaaggagaagaatatgaagatttattcctaaagatgctttctcaaacaacagataaaataaaagcaaaagaactttccaatatacttcaaaaacttatgagagatggacaaaaaggaaaagtgttaaaagaacattttttagaattggataaaatagatgaaaatgtagatttttacatattgggattgaaaccaaattcttcaaggctgtctgtgaaatttattttcagaaaaaaatatgcagatatattatggaacatttcaaaatttcagcaggaattaaaaatagtaggtggacttgatattgtatcgattcatcgtatttattttgaattgacttctccggagtatagaatgaaagatgataaaaataataaaataaatccggcattgtcggcaaaaatatttgagtctattatttatgacacaccttatccaaatgctttattagagacagtagttcgaagagttagagtggatagtggaagtgaaaagttaaatggtgtaagagcaggaatgataaaagcatatattaacagaaattataaaaaggaggaattaaaaatggcattggataaagaaaataaggggcaggcatatttgtctggaagactttttgccgtcttagaaaagttgcagcaggaggcacatcagaatgcccttaatcgaacaattaaggattcttatttttcatcagcatctatgaatcctcaaatggtttttcctaaattgcttcgtttaggacaggcacacttgaagaaagtttcatatcctgttttttataataaattaataggtgagattatagattcattgaatggaggttttcctaaactgctttcattaaaagaacagggagaatttatagtgggatattatcagcaatatcagagcttttttgaaaaaaatgaaaagaatgcaagtaaagaagaggaggaaaaataatatggcactgaataatagatatgattttgttatgatttttgatgtggagaatggaaatcctaatggggatccagatgctggaaatgctcctagaatggatgtagagtcggggttgggatatgtgacagatgtatgcctgaagcgtaagataagaaattatgtggaacttgtaaaggagggagttccgggatataacatactgataaaaccagacaagccattaaacgaaaaatttgcggaagcatatagaactgaaaatttagaaactgggaaaaaaggaaaaaatgtagatgatgtaaaaaaagcaagagaatatatttgcaaaaattattttgatgtaagagcttttggagcggtaatgtcaacgggagatgacccttgcggaatagtaagaggaccagtgcagattaattttgccagaagtatttctccaataaatgcattagatattactattacccgtcaggcaaaaacatctgaagtgcgtaatcaaaaaagtggtgatacggagatgggaagaaaaagtattattccatatgcattatacagggcagagggttatgtgtcagccgctcttgctaataaatcaacaggattgacagaagaggatgtagagcttttatggacatcaattataaatatgtttgaaaatgatcatagtgctgcaagaggaaaaatgtgcatgagaaagttgtatgtttttaaacatgataatgttctgggaagttgtccatctcatattttatttgataagataacaattcaggaaaaagagggaaggattcctcggtcattagaagattatgttattcaggttgataacaatatgccgcagggagtggagatgatagaaaaattatgagtagtgtagaaattacaattcgctctatccaacattatttatactgcccacatcgatggggacttttggaaattgataaagcatgggaagaaaatatctttgtcacaaaagcaaatttgatgcataaaagagtacatgatccaaagaaaaattatatttctagagggaaaaaagtttttacatcagttccgatatataatgatttggaaccttataatttatatggaatgaccgattgtatggagttgcacgaaaataaaaacgggatatccattaatggaagtgaggagaagtatcagatagttgttgtcgaatataaaccgacaaaaccaaaaaaacaagaatatcgggaagatgacttaatgcaggtatttgcacaaaaattatgtatagattttgtatttggaggtcattgtaagggggttatttattatggagatgtgaagaagaggattaccttacctttagaagaacattttcaacagtacgatgatttcttgagaaaaactttagaagaaatgagagattatttaaaaagaggggaaattcctcctattagaaaaaatcaaaagtgtagtggatgttcaatgaaggatttatgtatgccatcaatgaaaaagattaatgacgttcgaaacgagatagaaaaaattgaaagggcatcaatatgagaaaacttttaaatacagtttatatattgcaagaacaggcatatttgacattagacggagaaaatctggtatgtaaaatagatggagaaacaaaacttcgtattccgttcgaaaatgtagaaaatatagtttgtttcaattatctgggttgctctccagcattaatgggaaagtgtgttagtaaaacaatacctattaactttatttcaccgcaggggaaatttttggcaaaggtatgtggtgaaacaaaaggaaatgtttttctgagagtacagcagatagacaagtttagagctgaaggtttattattaacacaaaatactatggcagcaaaatttagtaattgcagacagttaatacgtagaacattgcatgataatgcggagttaagggaagatgaaaatatacaaaaagtattagaagttttgaaggaagggattgataaagtttacgaggcagagtccatcgaagaaatagtgggaattgaaggattttgtgcaaagaattatttttccatatttaacaaacttattacaaataaaaaggttgattttgaatttcaattaagaacaaaacatccgccactagatccagtgaatgcattattatcatttatttatacgttagcgacaaatgaggtggccgcagcattagagacagttggattagatagctatataggatattgtcatacattaagaagtgggcgaagttcattagcttgtgatttggtggaggaaataagatgtattgtggagagatttgtaattactctcttgaatttaaaaatagtgggagagaaagattttgaacaaaaaatttctggagctgtttggttgaatgaagacgggagaagaaaggttctttctaaatggcaggagaaaaaacgttctacaatgacacatccatatttgaaacagaaaattcctcgtggtttgttgccatatgtacaaagtaatttgttggcgaagtatgtgcgaggagaaataagtacatatccttcatttttgcttaagtaatatattaaaaacgaggaagtgaataataatgatggttttgataagttatgatgtaagtacgacatcaccggcggggaaaaaacggttacgaaaagttgcaaaagaatgtcagaatcatgcccagagagttcaaaattctgtttttgaggcagatttagattattcttcatttttaaaattaaaagaaaaacttatggatttaatagataaggaagaggatagtcttcgattttattatttggggaataattgggagagaagagtagaacatataggtgcaaagaagacatataatccagaaggggttataatcatttgatttttaaatgaaacaggcgaactactggtgattaaaaaaatctaggaggttcgcttgaaaaaaatccgttttaacggtaaaattaatataattctaaatgaattataggtccatcctgtaatatatgggaataatgtgattgaaatatactatatatagcggtcacatcccacacgggatgtgtgagtagaaattccttccttatttgcctcgatatgacacgtaccgtgtcacatcccacacgggatgtgtgagtagaaatataaatctctgaccgcatttgtgcgagaaactctgtcacatcccacacgggatgtgtgagtagaaattttgaattatccgcagcataaccttaccggaaaatgtcacatcccacacgggatgtgtgagtagaaatactgccatcattccacattagctggtataaaaaggtcacatcccacacgggatgtgtgagtagaaattatgaaatcatgaatcacattcacaatttcttcgtcacatcccacacgggatgtgtgagtagaaattagaaaatgcagaggtatccaaagtgtgttttatgtcacatcccacacgggatgtgtgagtagaaataggactggacaaaatgaaataaatttacgtaatgtcacatcccacacgggatgtgtgagtagaaattatcaatgaataggacaagaccaaagcagatagtgtcacatcccacacgggatgtgtgagtagaaatttatccgagaagcaagagctggtatcgacagtaggtcacatcccacacgggatgtgtgagtagaaatacagcagatgatattgtaggtttgcaagtagattagtcacatcccacacgggatgtgtgagtagaaatcatatgtccaaactgagtgggtagaacaaggtgcgtcacatcccacacgggatgtgtgagtagaaattgtcattgtcgcctgatctgcacagtcaacatagtcacatcccacacgggatgtgtgagtagaaatacacagaatagtggtagagataccacaaaatcagtcacatcccacacgggatgtgtgagtagaaatctgcagcgcagtagtatcttcctttagcttaccagtcacatcccacacgggatgtgtgagtagaaattggggctaatatctccatacccgccggtggaacgtcacatcccacacgggatgtgtgagtagaaatgtaggcagccagaagcgagaggatggcactacagtcacatcccacacgggatgtgtgagtagaaatctcaatgactctgtaaattgtgtcagcatcggcgtcacatcccacacgggatgtgtgagtagaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccagaagcgagaggatggcactacagtcacatcccacacgggatgtgtgagtagaaatctcaatgactctgtaaattgtgtcagcatcggcgtcacatcccacacgggatgtgtgagtagaaatatatttgtttacctttgcgccgcctaaatcttcgtcacatcccacacgggatgtgtgagtagaaattccagttgtcatgtacatctgcgccgctacgcttatgtcacatcccacacgggatgtgtgagtagaaatttaataataaacggcggaacgattgccccgccgctgtcacatcccacacgggatgtgtgagtagaaatcggaagacttcccccagtaatatcgcttgcttccgtcacatcccacacgggatgtgtgagtagaaatctgatgattacacgggtaaagacattacatttggtcacatcccacacgggatgtgtgagtagaaatgaaaagtattgcaacgagcataaatattgccgaagtcacatcccacacgggatgtgtgagtagaaatacctagttcgttcctacgatagaaacaatacccgtcacatcccacacgggatgtgtgagtagaaatactatgctgcaattccaaactgcttcaatctcttgtcacatcccacacgggatgtgtgagtagaaatctgcacctcaaaacggagcatctggcatcacctacgtcacatcccacacgggatgtgtgagtagaaattcgtcatttcgataaacatatcgccgttaccagttcgtcacatcccacacgggatgtgtgagtagaaatactgtatgtcaaggctaagattttagacgatacagtcacatcccacacgggatgtgtgagtagaaattaattactaatatttcgctccaatctgtatatctgtcacatcccacacgggatgtgtgagtagaaatgattttagtaattttgatacttcaaatgtaactaagtcacatcccacatgggatgtgtgaatagaaatgaaataaaagtattgaaaaggtaaacattatttgttcagtggtggggctgattctccatttgacaatcatctggaagaattgtcaagatgtgcagtagaagtatatcatgtgttacatttttgaaaaaataaaaaaagtcttgacacatttcaaagcttatagtataataaatttcgttgatgacgtgggatcttagctcagctgggagagcatctgccttacaagcagagggtcacaggttcaagtcctgtaggtcccacttatttttatcaatatttatggcgggatagctcagttggctagagcacgcggttcatacccgcggtgtcgctggttcaaatccagttcccgctattttttattgtatttaagccggacatatgtggtttgatgtatggttttggtcagtggaaacggatagatacttataatttaatagaggaacggacaaggtcattatgcaaagctgcctcgtattctacacaacttgtgttgatatatgaattctttactcaaagggcgcagttactgtataatggcttttttatgttgctcatgtaaatttttgtgaagaaaaacttttctcccgctattggatgtggtaaactgaaaaaggaaaaataaaaagtagaataagaattcgcatagtgcggagtttggaggacctatgagaattggaaatggttatgacgtacatcgtcttgtagaaaatagaaagttgatccttggtggtgtggagattccttatgaaaaaggactgcttggacattcggatgcggatgtattattacatgccgtaatggatgcacttcttggagcagcggctcttggagatattggaaagcattttccagataatgatccggcatacgagggagcagacagtatgaaacttcttgaagaggttgggaagctgttacaggagaaagcatattttattgaaaatattgatgcgacagtgattgcgcaaagaccaaagcttgcatcgtatattccacagatgaagaaaaatattgcgaatgtacttggaattcaggaaggccaggttaatgtgaaggctactacggaagaaggtcttggatttaccggagaaggtcttggtattgcggcatcttctgtgtgtcttctttcagaaattcagaattatgttggggcagatgttctcatggaagacagaaactgtgccggctgtggaggctgcgccagatttggaggaacgagagaatgattgtctgggatgacggaacaaaaaagcagagaatttatgaaatgtggcaggacaattttcatgatccggtctcatacgcagatttttattttaaggaagtatatggaaagaatgaagtcttaataaatcaggaagaagatgttgcaaagggtatgttacatttgaatccttatctgcttcatgtacatgaacagccggttagggcaaagtatattgttggggtagcgaccgataaggaatacagaagacagggagtgatgaaggagcttttaatagaaagttttcagacacttcgcagcaggggagaatgctttacgtatctgatgccggcagatgagaattattacctgccgtttgatttccgatttggaatgacacagatagaacaggaggtagagtatctgccagatctgtatataccagaagaaagagaagcggaaaagtatacatttaaagcggagatttctgaagcagaacttgagaagattacagcacaggaaaatgcggttaaagatacggtatttgatatttatacagacatttctccagactatatccgaagaatggaaaaagaagtggaaagtgattttgggcaggttctttatgtttttgaaggagaaaagtatattggaagaactgcggtaggtgcagaagacagctattttgtcctgtctcaggtcttttgtgcagacgatgcgaaaagagaaagctttttagaacagaccatgctgtattgtgaaaagaagtatcactataatcgttatcagcttattcttgatgcatcatggaaggatgccacagataaaatcggattacagggatgttttcggtatatgcctgctaaacgggtaaagaagattatgttccgcttgttagatttagagaagcttagtgtatttttaaagtgtaacgtgccagggacacagggatacagtacattggaagagaagacagctgatggtgaagaaactatttgtgaagcagatatttatatagaagataactatctggaagaacagagtggggtatatcattttctgctgaaaaatggaaaagttttaattcaaaaaacaggggatacaaaaggagactgtaaagaaagtatttctgttgcagcatttacagaatatctttttggcgctgaagaagagtgcgtagatgattgtactacgttatcaggagagacaaagaatttgttaaaaaatatttgtccactttcaaaaaactgtatcatggagatcgtttaaaagttttttggcatatgattagagttttgtttctgttatcaggtattttctttgatttctttattgacaaaagtgaggaaattgaatagactaaaaagtacgtaaataaagacggcggaaggcttcgtctcagggaggcggagctttttcattgataaaggaggatgactatgaaactgtataatacacttaccaaacaaaaggaagaatttgttccggtacacgaagggaaggttggtatgtatgtttgtggacctaccgtatataattatatccacatcggtaatgcaagaccaatgatcgtgtttgatacagtaagaagatattttgaatataaaggatacgatgtaaattacgtttctaactttacagatgtagatgataagattatcaagaaggcgaatgaagagggcgtaccagcttcagagatttcagagcgttttatcgcagaatgtaagaaggacatggaagggcttaatattgagcctgcaacacataatccaaaggcaactgaggaaattgacggaatgattgccatgatttctacattaattgaaaaaggctatgcttatgagaagaatggtacggtatatttccgtacccgtaagtttaagaattatggtcagctttctaagaagaatcttgatgatatgagagcaggaatccgtatcgcggtaagtgatgaaaaagaagatgcgatggacttcgtattatggaagccaaagaaggaaggcgaaccagcatgggtatctccttggggagaaggccgtccgggctggcatatcgaatgttccgagatgtctaagaagtatatcggggacacgattgatattcacgcaggtggagaggatctggtattccctcatcatgagaatgagattgcacagagtgaggcctgcaatgatgagaagtttgcaaattactggatgcataacgcatttttaaatattgacaataaaaagatgtctaaatcagcagggaacttctttacggtaagagaaatcagcgagaagtatcctttacaggtaattcgtttctttatgctcagtgcccactacagaagtccgttaaacttcagcgatactttagtggaagcgtctaagaacggccttgagcgaattcttactgctgttgatcatttaagagaggttcttacagctgctccagaaggtgagcttacagcagaggatcagaagcatatggaagaagtaacttcattaaaagaaaaatatgaagcggctatggaagatgacttcaatacagcagatgctattgctgcaatctttgagcttgtaaaacttgctaatattacagcggagagtggaagtaaggcatatgtacagcatctttttgatacgattgtacagttgtgtgatatccttggtattatcacagagaaaaaagaagaacttcttgatgctgatatcgaagcattgatcgaagaaagacaggcagcaagaaaggcaaagaactttgcacgtgcagatgaaattcgtgatatgttagcagataagggaatcattcttgaagatacaagagcaggtgttaaatggaaacgtgcttaaaagggatcgcagaacattttcctttgacggaaaaagagcttcggggctattcttccctggggcttgcctatatcggagattgtatctttgagttgtttgtccgtacaatggttgtgacaaaggggaatgataaggcgaatcactatcatcaaaagacgattggttacgttaatgcagcagcacagacagagatgatggagataataaagcctctgcttaccgatgaagaaaaagcagtttttcgtcgtggaaagaatgcaaagtctttatctccagctaaaaatcagtccagtcacgattatcatatcgcaacaggttttgaggcattaatggggtatttatatctttccggccagatggagcggttagaagaattaatccgtatttgtctgtccgaaaaagcaaatagaaatgaggaataacatggcatacgaagaatgtactgtcgttgggcgtaatgcagttttagaagcatatcgttccggtaaaacgattgataaattatttattttagatggctgtcaggacggaccggtcaggtcaatccttcgtgaggccagaaaaagggacacattaattaagtttgtctctaaagagaagcttgactctttatcttctcacgaaaagcatcagggtgttgttgcgattgcagccgcttatgaatatgcaacggtagaagatttatttaaaaaagcagaggaaaagggcgaagcaccattctttattctttgcgatgagattgaagatccacataacttaggagcaatcattcgtaccgcaaatcttgcgggcgcacatggcgttattattccaaagagacgtgcggtaggacttaccagtacggtagctaaagtatctgccggcgcactgaattatacaccagtagctcgtgtgacaaatctttcaagaacaattgatgaactgaaagacaaaggtatgtggtttgtctgtggtgatatgggtggagaactcatgtatgatctgaaccttaccggttcgattggtcttatcattggaaatgaaggcaacggtgtgagccgtcttgtaaaagaaaagtgcgattatgttgcttctatcccaatgaagggagatatagattctctgaatgcttctgtagcaacaggagtactcgcatttgaaatcgtaagacagagaatggggaaatagttctgagtagttctggtttaattcggtgacagacagacaccctcgaagaaaaaagataccctatatttgtagctttagtcgcagaggtttgaatgcccgctttatgcgctcgaatccaaaccttgctttaagaccacaaatatagggtattttttctctttgggagtgtctgttttgcctacggcaaattacgattatctatcgaaaattagtctttttaaagtcattgacatctctttctttacggaattcctgttttttcaccattgcaaccaactctggctcctttttaagggaataggtaagagcatgataatgctttaatatatttttttgaaacataggtgtgatctcggcataatttgcaaattgtgcgagagtttgtttgttaagagccttatgctcctgaaaatgacattcagcctctttggcaaaggcgtgatacaattctttttgttccggtgtttctaaagcagcgataatcatctcatttttcatgtcacaggaaaatgcctgtaacttctttaatgagatgcggtggcgcatcagggtgagcttcaaatagcggtaccacgtattacggaacttgatatagtattcgcttacgcctccatcgtaaacgtcaagacctttacagaagttaaagtttctcttcatgtaagtgtaatcaaagagaatgttctgtataaggtaactgataaagtaacctgcccgataaagtggagaggtgtacttatcataataaagataatcatcaaaatcgacatgcagctttttgattctccgaaacttgatgtaatgatgaatacggtaagtaacatatatgataatgataataccgataaatgcggcgcggtaaaggttacgatgtacgccggtcataaaaacagatcgtgaaagaccatagatagcggcagcgcatgcggctacaatggtagcaaacatttcaaacataacacacattcctttcttaattgtttatctcagtcgcgaagactcccacctctttcaggtggtgggtgacagcaaatttgtctcagtgtgagtccaatctccgactgagataaacgctccgcgaggatgcgcagtgattctgtaaagaatatgtcagcttacgctgaccagaatcacgcgccaagtctcgcggctgctcgacttgaatatcatatcgtatttttgtgaaaaaaacaattgctttatatgatgtgttcctgtaaaaatttaataaaaatacacagtgaataaaaacaaaatatggcaagtgatgataagagaagggcaaaaggctattgacctttctgtaaaaatacgatatgataataaacaaacatacgtttgttagataggagggcacatatgagaaagataaaagtgattttaatgtcagtacttctggctctttttatagcaggatgtagttcaggtacttcggctgagttttttgaaagtggcagccagatttccgggaagacggagcagtcagattccggtatggaagtacattttattgatgtagggcagggagatgctactttgataaaagctggggatcatgcgatgctgatcgatgcgggtgataatagtgagggaacagcggtgcagtcttatttgaacagtcagggtatagagaagcttgattatgtcatcggtacccatccggatgcggatcacatcggaggtcttgatgttgtagtttataagtttgattgtaagaagatttttatgccgggagtgacttcggatacgaaaacatatgatgatgttatgcaggcattgaagtctaagaatcagaaggcacaggcgccaaagcttggagaaacatatacattaggagatgcgtcttttacagtgattgctccggtgaagggctatggagatgagacgaataactggtcgattggaatggtacttcaatacggagagaatcgttttctgtttacaggtgatgcagagaaagaagcagaggaagatatgttagcgaagggggaagatatttccgcagatgtatataaggcatctcatcatggaagtaagacgggttcctgtgatgattttcttgataaggtacatccttcttatgcggtaatcagttgtggtgaggggaataagtacgggcatccttctgcccagacattaactaatttccgaagcagagggattaagacattccgtaccgataatcagggaacgattgtggcatatagcgatggaaagaatattacatggaatgtttctccggatacaacctggacaccgggagagccaaagggttcttcgtctaactggaattcctcatcgaagaatatttctaagggaaagtcaggggatagttcaaaaaatacttccaaaacacaggtgtcttatgttataaatgaagacacaggtaagttccatctgccatcctgtcgttttgtaaagcagatgaatgaggagaatcgtattacatcttcaaaaagcaggaatactttgataaaggaagggtatgaagcctgtaaagtatgcgaaccgtagatgaggatttgcagatttacagatatggaatgaaagagaataaagatatgataaaggagaacgattgagtattatgatgaaagacggaaaaagtattgttttgatcggtatgcccggtgtagggaagagtacgatcggtgttattttggcaaaggagatcggttatcagtttctagatgcggatcttttgattcaggaacaggaaggaatgttgttgaaggatattatcgcaacgaaggggcatgatggttttcttgcagtagagaatcaggtgaatcgtgatgtggatgcgaagcattctgttatagcaacaggtggaagcgcagtctattgtgaagaagcgatgttacattataaagatacatgccagatcgtgtaccttcgctgcccatatgagattttgtcaaagcgtcttggcgatttaaaaggaagaggtgtggcattaaaagaagggcagacattgcttgatctatacgaagagagaagtgttctctatgagaaatatgcggatattatcattgatgaagataacaaaggaattgaagaaacactggaattactgaaagaaaagttttgttagcacattcataggctgatactaaccggcatgtcagtgtgtgaaacgagattaaaaagtcgttatgaaaagctactttatattaccatctaatatgagaatatatattatcagatggttgggaggtagttgttgcataatggcttttttcgatttgtgactttgggtgacgttgcttcgtttgccagatttcacagccagggaaatttggcatactaatccttttcacagtcagggaaaccaggtgtattaatccttttcacaagcagggaaatcagacagataattgattttcagaaagctcgaaaaaggacgtattaaaaaagcaggtaattcttactataatggcgttgtaaacaaaaagtgcttgaaacacttacgaaaaacacttacaaagccataggcaaaaattaaaagcagatttaaaaaaggaggattacatgatgaatggaaattggctgggattagacggacaggttgttatcgtaacaggtggtgcttccggaatcggaaaacacgtagtagacacacttgtaaaggttggagcaaaggcagttgcagtcgatcttaatgtaaagacaggagatgagcttgacggagcatattgtgtgcagtgtaatgttactgatccggaaagtgtaaaccagatggtacaggctgttcttgcaaagtatggcaagattgatgcattagtaaataatgcaggaattaatcttccaagactgcttgttgatgtaaagggagaaaaaccagagtacgaattaaacgaagattctttcggaaaaatgtttgcagttaatgtaaagggcgtattcctctgtgcacaggcagttgcaagagaactcgtaaaacagggacatggagttattcttaatatgtccagcgagtctggaaaagaaggttctcagggtcagtcagcatactctgctacaaagggagcggtagacagctttactcgttcctgggcaaaggaacttggaaagtacaatgtacgagttgttgcatgtgctcctggtatcatggaagcaacaggacttcgtaccgctgcttacaatgaagctttagcttatacaagaggggtaaaaccagaagatttatctacagactacagtaaagtaattccaattggaagagatggaaagcttgatgaggtaggaagccttgtagcataccttgtatccgatcaggcaagctacatcacaggaacaacagttaacatttccggaggaaagtccagaggataattacttcaggataattacttcataggaatggaaaatggagagaagaaggaggtacgctatgataaagatggcgttggtgattggacttgcatttgtgatccaatttgtgttaagcagttttcagatgaagaatttcaataatgaatttgtcagaatgagacggaagggcaaggtggcaatcggcagaaagtccggaggattccatgcaggagcaattgtaatgttccgcatagatgatgaggggattattcaggaatccaaaaagatagaaggaacaacatttctggcgagagtgaaaaattttccgggatttgaaggacgatacattggagaattatctgtagatgatgtagaaaaaggacatcgaaatctgagaaaagcagtagaggacgcagcgctgacttataaaaaatatatagcaggagaagaaatagcacagcctccttccaatttccagaaagcaggaaatatcgtaacaaatctatttaatcgacgcgcaggagcgtaaagagggaggtaactatgaatattttagttaaattagcgtcaggatttatgaatctttttacattaggcggagagcagtttgtaagctgggttacaggaatcattccaactgtcctgatgctgttattattaatgaatgcaatcatcgcattagcaggaaatgaatctgtaaataaacttgcaaaagtatgtacaaagaatccggttctccgttatctggtacttccatttgtatctgcatttatgttaggtaacccaatggctctttccatgggtaagttcatgccagaattttataagccagcatattatgcatctgcaacatatcactgccatacaaacaacggtatttttccacacatcaatgcttcagagctttttgtatggcttggaatcgcaaatggtatctctgcattaaatcttgatacaacaccattagccgtacgttatcttttagttggtcttgtagcaaactttatttcaggatgggtgacagaatttactacaagatatgtagagaagcagcagggtgtaaaacttagccgcacattaaaggcataggaagattagaaggaacgataagggaggaacgaaaatgtcagaattaagagcaatcagaatagaaagaggcccacagggatttggcggaccgttaattatccgtccaacagaacagaaaaataaagttatgtatattaccggtggtggaactgcaccggaatgtctgaagaaaatcgtagaacttagtggaatgacaccagtagatggtttccatggttcagcaccagaagaagaacttgctatggttatcgtagactgtggaggaacattacgctgtggtatttatccacagaaaagaattccaacagtaaacgttatgccggtaggtaaatccggaccacttgcaaactttatcacagaagatatctatgtatctgctgttacatccaaacagatttctcttgcagatgaagcagatgtagaagaagccgcaaaggctgtagagacttccgagaagaaggaagaaaaaacagtgaagtttaatgcagatcagaaagtatcagaaacacttgctgcacaggaaaacaaatctatcatcacaaaagtaggtttaggtgttggtaagtttgtaaatacattttatcaggcaggtcgtgatgcgattcagacatgtatcacaacacttcttccgttcatggcatttgtatctttgttagtaggtatcattaacggttctggttttggtaatgcatttgcaaaattactgactccattagcaggaaatgtttttggactggttgctcttggtgtaatttgttctattcctggattatctgcattacttggacctggagcggttatcgcacagattgttggtacattgatcggaacagaaatcggaaaaggaaacattgctcctcagcttgcacttccagcactttttgcaatcaactgccagggtgcatgtgactttattccagtaggtcttggacttgctgaagcagagcctgaaacaattgaagttggtgtactttccgttatgtattccagatttttaacaggctggattcgtgtattaattgcatatgcagcaagttttggattatacgcataagtaaaccaagaataagaaaagtaaacagaaaagtaaatagaggatgtcagagaatggaaacattccggcatcctgaatttttattaaaatattaaaattagctcttacatgtattggagaatgtgttacaattaaaaggagcaaactgtagaaaggatagaagaatcatggctataatttatgagaacaaagtaaaagaacttggaaaagatattatgatgatgaatggaggagacttcattattatttttggagacagtgctccggcagaattaagagattattgttactctgttgatgtgaatccgattaatggagaaatcaaggcaggacagacattaaaaattgatgaaaatgaatataagattacctgtgtcggagaagaggcaccggtaacactcgcaggtctgggtcattgtacgatccgctttaatggtatgacagaagcagaacttccgggaactctttatgtagaggaaaaaccagttccggaaatcaagatcggtacaacaatccagattatagaataagtagtaattcagaattattgatgattcgttttggtgaatggattctgaataattacagaaaatattaatacgaaaccaaaacataaccagaaaatctgaaaaggataacggacaaggtatgaaaaatttatttggtgacaacagacaggctaacatcctgtctgttttgcgaaaaagttctacattaaatattgagacactggcagaacgatttggcgtaagtgagcgtacagttcggaatgatataaaagacattaacaaagaattaaaaaacagtggcctgatagaaattaatcagggaaagtgcggtcttagagtgtttgatacgagagactttcaaaatgcgtatgcccgtattatagaaacagatgatttgatgaattcttcccacaagagacaggagtatgtttttgcgaagcttatgagagcgatggagccggtacttacagatgaccttgcttatgagatgaatatagggcgaagtacattgatcagtgacttaaaaaagcttcgccagacaatggaagactacgagcttgagattgttggaaagaccagtaagggattagctcttgccggttcggaacttaatattcgaaagtttgttatggagaatctttttgactctatttatcagaattatccccaggatgaattgatgctaaaggggatcagagaagcgctggctgaacagaattttgaagaatcaacacagaaaatgtttgagaactatatgacattaatgtttgatcgttttcttacgggacatatcattacccgtatgccggaaaagtattataatttagtatcaagaaacagtttttcatttgtgaatcagttaattgataatctttcaaaagaattttacattgaaattccaatagaagaaaaaatatttgtttttttgccgatcattggtatgcgtacacctgcagacagtaaaaatatgtacagcatagaactcgatgagaagattcatccattactgaaaaagattgtagaggggattcgtctggaattaaatatttcaattgatcctcatgaatttgcagagaagtttatgtatcatattatgtttatgataaacaggcttcgttataatgtacacattgataatccgatgtttgaagacattcattacaaatatccgcttgcatttaaaatggcagaaatagcggcgagagtaatcggtgaggaagcggaagttgcagtgacacaggcagaacttgggtatctggcagcttattttggggtgttccttgaagtaaatactttgaatcaaaagcagcaaaagattgcagtgatcagcgataagggaagagttacagcacagttatttgctgtgcagattcgtaaagtagttgacagcagcagtcagcttgatatactggcaccgtctgaagcagtcagtgatattcttgatcagtatgatattgtaatctgtacaacggagcacatgatagaatgtgaatgtccggttatttatattcatgagatttttgatgagaatgaactgaaaaacaagcttcgccaggcgaagttttgtaaaggaacagatgcggtgattcttgatgataattggtatgtaatggctaatattttaaaagaagataccttttttaatctttcagaacaaaaagattatatttctgctttagaccatatgatggatgttctttgtcaaaatggctatgttgatgaggatttcaaagaacgggtatgggaaaaagaatcgaaatccagcatgattattgataatattgcgattcctcatgctatacaaaaggcaggagatgccattgtattatctgtgggagtatttcgtgagccgatgccatataaaaatgacaatattcaagttgtgtttttgctggcgctcccggaagaaattcgagatgaaaatcttttgatctgtgtctatgatgagattatgtcacttgtaaaaaatgatgaacttattgaaaaaattacgcattcagggaattatattgattttatgaaggtattatataaaagaaattaattgtctgcttaggggaatattataaaaagagccatgtactataacagggattccctaatagtacatggtatacataatgaaaaagagaattatccaacaatattcattggataactctctttttctttttcagcatagatataagctgatgacgagacttgaactcgagacctccgccttaccaaggcgacgctctaccgactgagctacatcagcaattcagatatacaaacctgacaaaaaggattctatcatgccctattcggtttgtcaacggaattttattaaatttttaaaaaatatgtactattggcacaatataatgatgttagagtcaaaaggttaaaatacggagtaattcgtgacatcaaatcagggaaaaaataccttttatgataccaaggtcaaaaaatcaaaaatgcatattttttgtcttcttgtcatatattattagaaatcgcgatagcgaaataataagacaggagaaaaatatgaatagaaaaaaacatgggaattacaggtgtattttactggtgttggtgttgtggtttttttggtttcagaatgtcagtgcatcacagatgctttttccatttgtagcggacgactggatttcttttgaagggcgtacttttttacagcttcagcaagagaaaaaacagacagaaataaaaaagcagaggaatcataaaaaaagtaatgagaaaagtaataaaataagtaataagaaaaaagtaaaagagacgatggcggttccggtaaaatatgataatgaaatcagtgccggtgaccgccagattctttataaagtggtttccatggaatgtgatacagggtacgaaggttcgttagcggtgattagctgtatgttaaatcgtttagaatctgacaaatatccggatgatttaatggatgtagtgagggaaaaggcacaatttagtgcatattatgataaaaaaactgagacatatccatatatagacagaaatccatctcaagaatgtatacaggcggtagacgatgcgcttgccggcaaaaaaagaaatctgccatcatatatcatgtattttcgtgcttcttcgtataaaaagctgaaaggttataagaaatatgggcagattggagacaatacttatttctataaagaagaagaccgttgattttcacttgtacaggaaaaataagtatgatatgatagaacgcagttaaagggaatcgaagcctttatagaattacaggaggatgagaatggaagaaaaagaaaaagtatcgaaaaattttatagagatggcgattgataaagatttagaagagggtgtgtatgatcatgtcatgaccagattccctccggagccaaacggatatcttcatattggacatgcaaagtctattttattaaactatgggctggcacagaagtatcatggcaagtttaatctgcgttttgatgatacgaaccctacaaaagaaagaatggaattcgtagaatctattaagaaagatgtacagtggttaggggcagattatgaagacagactgttttttgcatccaactactttgatcagatgtatgaggcagccgtttctttgattaagaaaggaaaagcatatgtctgtgatctgtctgcagaagaaattcgtgaatacagaggaacattaaaagaacctggcaaagaaagcccatatcgtaaccgctctgtagaagagaatcttgaactttttgaaaagatgaagaatggtgaatttgcagatggagagaaagtacttcgagcaaagattgatatggctgccggtaatattaacatgagagatccgattctctaccgcgttgcacatatgacacatcataatacaggagataaatggtgtatttatccaatgtatgattttgcacatccaattgaagatgcaatcgagggtgtaacacattctatctgtacgctggaatttgaagaccacagacctctttacgactgggttgtaaaagaagttggtttcgaacagcctccaagacagattgaatttgcaaaaatgtatttgaccaatgtaattaccggaaagcgctacattaaaaagttagtagaagatggtgtcgtagatggatgggatgatccacgtcttgtatccattgcagctcttagaagaagaggttttaccccggatgctatccgtacttttattgagcttgcaggtgtttctaaagcacagagttctgtagattatgcaatgttagaattttgtattcgtgatgatttaaaacttaagaagtctcgtgtgatggcggttcttgatcctgtaaaggttgttattacgaactatccggaaggacagattgagtacctggatgtagagaataataaagagaatgaggagttgggaagtcgtaaagttgcctttggtcgtgaactttatatcgaaagagatgattttatgattgaccctccaaagaaatatttccgtatgtatccgggaaatgaagttcgtcttatgaatgcttattttgtaaaatgtacagattacattacagatgagaacggcaaagtgacagaaatccactgtacgtatgatccggaaacaaagagtggaagcggatttaccggacgtaaagtaaaaggaacgattcactgggtatgtgcagatgaatgtgtagatgcagaagttcgtttatatgagaacattgtagatgaagagaaaggtgtttacaatgaggatggaagtcttaatttaaatccaaattctctgacgattcttccggaatgtaagttagaagctggtctgaaagacagcaaggcttatgatagtttccagtttgtaagacagggatatttctgctgtgatgcaaaagacagtacagaggatcatttggtatttaaccgcattgtttctctgaagagttcttataaaccgaaaaaataaggtgtaagctctcgggagttgttatgaacttatcgttatatttatgacaggatagaatcgtgaaagccgcagaaatacttactttttgcggtttttacttgagtttttttcttgttcatgtaataataaaggcgcgctaaaatttagttacttagattggcgagattatgagtgaggtgtaaccgtatgtacaaaatcgtaaaaaaagaaacgcttaacagcgttgtagaactgatggaaatccatgctcctttcgtagcacgtaaatgtgagcctggacagttcatcattcttcgtgtggatgaagatggtgagagagtaccacttactatcgcagattatgacagagaaaaagagactgttactattatctatcagatcttaggatattcaacaactcttttaagccagaaaaaagaaggcgaatatctggcagactttgtaggtcctcttggagtacctgcatcccttgaaaagagagagaacaaagtcatcggtgttgccggtggtgttggagctgcccctctgtatccacagcttcgtaagttagctgagaatggaacaaaagtagatgttatcatcggtggtaagagcaaagagtacgttttatgggctgataagttccgcgaattctgtgagaatgtttatatagcaacagatgacggaagcgaaggaacaaagggatttgttacaacggttcttcaggatcttttagataaaggggaagtttatgatgagtgtatcgctatcggaccactgatcatgatgaagaatgttgtgaatgttacaaaacctgctgatcttcatacaatggtatctttgaaccctatcatgattgacggaacaggaatgtgcggtggatgtcgtgttacgatcggcggagagacaaagtttgcctgtgtagacggaccggactttgacggattccttgtagactttgatgaatgtatgaagcgtcagggaatgtttaaagaagaagaacacgaatgtaagatgatggcactgggaggagaagcataagatggcaaagaaaaatatgagtctgacaaaggttccaatgccggaacaggcaccagacgtaagaaataaaaactttgatgaggttgctcttggttatactgctgagatggcgatggaagaagcaacaagatgtttaaattgtaagaataaaccttgtgtaggcggatgtccggtaaatgtaccaattccaggatttatcgagaaagtagcagaaggagactttgaagctgcttatgagatcatcacaagtgaaaacgcacttcctgcaatctgtggacgtgtatgcccacaggagaaccagtgtgaaggtaaatgtgtgcgtggtatcaagggacagccggtagccatcggacgtatggagcgtttcgttgcagattatcatatggaacatgctgcaccagtaaaggcagagattaaaaagaacggtaagaaggtcgctgtagtaggttctggtccatctggaatcacctgtgcaggcgagctgattaagaaaggttacgatgtaacagtatttgaagctttacataaagccggtggtgttttaagctatggtattcctgaattccgtctgcctaaagccttagttgcaagagaaatcaagagcgtagaagatcttggtgtagatatcgagacaaacgtaatcgttggacgttctgtgacaatcgatgaactgatggaagacggctacgaagcagtattcgtaggaagcggtgcaggtctgccaagattcttaaatattccgggagagaacttacttggagtatattccgccaatgagttcctcactcgtgtaaaccttatgaaaggttacaagttcccagaagttccaacaccagtaaaggttggaaagagagttgccgtagtaggtgccggtaacgtagctatggatgcagcaagaacagcaaaacgtcttggtgcagaagaagtttatatcgtataccgtcgtagcgaagaagaagctcctgcccgtttagaagagcttcatcacgcaaaagaagaaggaatcatctttaagttcttaaataaccctgctgcgatcgttggcgatgacaacggctgggtaaaaggaatggagatcatcaaacaggaactcggcgagccagatgcatctggaagaagacgccctgtaccggttgaaggctctaactacatccttgatgttgagacagtaatcattgcgattggccagagccctaacccattaatccgccacacaacaccaggtcttgagtgccagaagtggggtggaatcatcgtaaacgaagagactatggaatcttccaaagagaacgtttacgctggtggagacactgtaacaggagctgctacagtaatccttgctatgggagctggaaagaaagctgccgctgcaattgatgagaaactgtcaagtaaataaattagggctaccgcagacaaggtagacgccctctggaaataaaagaatccctatttgtgactttagtcgcggcgtgttgaatgttcgcttaaagcgctctcatccaacgcttgctccgaggtcacaaatagggatttttttattttcagaaggctgtctttgtctactgtagaatcggaattatttacttgatgggatggattgggggatttttcagaagaaggcaaactatctgcaaacgatttctattcgtaaaaccaaataatataaaagaacgagaagccttattttgcaggtttgagaataaacagaaccacagaatcctgtaatatataaaaatgcgcctttgagcaaggccaagctgcggttgagcagtttggatgcagtgaaacgaagcatttttatatattacaggatttggtggttcgtctatttttttaaatttaaaaagtcagatttttcgtctattttagaaaaaatatgttagaaaataacaatatgaaaagttgaaaaaataatatggttattttaaactgaaaaacttgacgtttgatggattgtattgtatgatagtgcttagtgtctcggacgatacaaagtgatttctttgtattattgaacaatgtgaggaggctttgaaagagagacattgttaattttaaacattaaattggaggagaaggatgagaagaaaaagtagtaagcagttgttttctgtattgatggcagctaccatggtcatgtcgggtatcagtatcccggttaatgcatcgcaggttgatgatgcggtggtgcgttctgtattgacaaaaacagaagcagaggcatctgaaagtagggaaatcaatttcaacgaaggttggaagttccactatggagatgtagagaatgcagagaaaaaggattttgacgattctgatttagccaaatggggaaatctaaagcttcctcatgatttcagtattacacaggagccttctaattcaaacgaagcagagtccggatttatgccaggaggtacaggatggtatcgcaagaactttactttaccatctgattatgaaggaaagagcattgttctgaattttgacggatcctataaccacacttatgtatatgtgaatggtacaaaagttggggaaaatcactatggatataatgactttgcttttgatatttcaaagcatcttatctgtgatggtaaaacagaaaatgtgattagtgtaaaagtggtgcatcagacaccatctagtcgctggtattctggatctggtatttatcgtgatgtagaactgattgttacggatgctgtacatgtttccagaaatggtgtttatgtaacaacaccagaactggcaacagagaaaggcggaaatgttacagtaaaagttcaaacaaaagtacagaatgatggcgatgcacaagtagcagcgaagattcgtacaacagttttagatgcagaaggtaaggcagtttctgaggcaagcacaacggatgtgacattgacagagaatggcacagaagaaaaagaacagaatttgaaagtaaacaaccctgcactctggagtacagagaaaccaaatctctactatgtacaaacggaagttttggttggcgacgaagtaaaagacattaataaagaaacatttggtttccgttatattgactttaattccaatactggatttagcttgaatggaaagaatgtaaaattgaaaggtgtatgtatgcatcatgatcagggtgcacttggatcagcatccgaacatgatgctgtataccgtcaggtaagtaaactgaaagagatgggttgtaatgcgattcgtactgctcataacacaccttcttccgtacttcttaaagcatgtaacgaattaggtatgatggtaatggatgagacgtttgacggatgggcattcccaaagaacggaaacagtcaggactttagcacacactataacaagacgattagtgaggataataaattactcggtgcgactgcaggcgatacctggtataaatttgtactggaatccaacattgaacgtgataagaatgatccgtctgttgtaatttgggatatcggaaatgagctgaactttggtgttactgatcctagcaagtatgaacagtatgcaaaaaatatgaagagttacatcgaggcgattgataagacaagaccaatcacagttggtgataataatccatacgggttacgatataacacatacggggatttccgtaataaagttactgcggttctggcaaataagggagaaggattagcgggagcaaactattctatggcagctatgagtggtattcatagtgctcatccggattggaaaattattgctacggagactgcttcaccaagtaacagccgaggtatctacacaacattgtcacagtatggtaagtctggtgattatcagtgtacagcgtacgatactaatgcggtaagctggggaaatacagcacgtgaatcctggtggtatacgattaaagatgactttgtatccggtgaatttatctggacaggatttgactatattggtgagccaacaccttggaatggaacaggtaaaggaagtgttagtggtgacaaattggctgtaccaaactcctcttactttggagtaatcgatacggcaggatttgagaaggattccttctatttctatactagccagtggagagaagataaacagacacttcatatcgtaccacagagttggaataaaaaagatctcagtatttcaggaggtaacgtaccagtttatgtttactccaatgcagcaaaagtagagctgtatctgaatggaaaactgatcggtacttccacaagaaatccaatcaagacggctgccggtcatgaatgggctacatacagtaatgaatctaatgatgaagaacagtgtgttgcagtcaacgagagtccggagtggaaagctcaggcaattcagtttaaggtaaaatatgcggagggtacacttagtgcgaaagcatatgatgaagatggcaaagaaattacagatacgctgggatcacagagcgtgacaacaaacagtgatgctggaagtaagttatcagttaaagcagagaagagtgaaattacagcagatggaagcagtctgagttatatagcagtagatgtaaatgacaaagatggacgttttgtaagttctgcagacaatagtattcgttttactttaacaggtaatggaacaattgttggtgtagataatggaaatccatctaccgttaataaattccagcagaaatctgtattaacaagcagtaagacagctaagattaaagcatttagcggaaaagcacttgtgattgtacgcagtacaaaggatgcaggtgggtttgcattgaaggcagaatctgcaggtcttactggagagactgtatttgtaaatactgtaggtgaaaagaatggtgaagtattcctgaaagactatacgataaaaccagagtacactgttatgatgggtacaaagcctaaattagagacaaccgtaacaggtactatgagcgatggatctaagcaggaaggtacgattgcttggaaactgacagaagatatgtacaatcatcctggtgagtacgttctggatggaacaatgaagtttggtaaagaagaagtagctgtatctgcaaaccttcatgtaaaaccgattatcgtagcggtacagaactatacaagagcaactgtaaaaggacttgttccaaccttaccttcaacattagcaggaattctcccagatggtacatcttacggtgcatatccggttacatgggatagcattaaagagtctgatttggaaaatgttggagatatcgtaaaggtaaaaggtaaagttgacgtagaaggtaaagaaatgacagcaactgcaacgatacgtgtggcagaaggtgaagtaaaagaagcggtcaatatagctccaaaatataaaactttaaaagaaagctgtggcgaaccggcagataatctgctttctattgtagatggtgttaataatgtgttgaataagccaaatatgcgttggacaaactggaatgaccatttattaaactcttcgccaactatcacatttacctgggatgaggtctatgagttggcaagtatcaatgcatggttctttggtgatgcgaatgtaggtgcaccagaaagcgtaactattgcagtatctaaagatggagagaattttaaagaagttgaatttacacatgatgattatcaggtaaatcagaagagtgaactggtatttaatgaggttcagaaagcaaaagcattgagatttaccatgaaacaggtaggaacaggatatgttggtctgactgagttagaaatcttgacaagtgcaaaggggtatacttcaaacaagacagcagagttagaagggctgaaagtggatggaacagcagtggaaggttttgcagctgataaatacgagtatactgtagttgtagacaaagtagaccaagctgttgtggatgcaactgcaaaagataatgcatcagtaatggtagtaccatttaataaagaaaatgttgtaaagataatcgttacttctgaagatagcaagacaaccaatacctataaaatcaagttgattgcaaaggatcagattgcagataaagcatttatggaaaaggtagagggcgagatcaagcaggcagaagctttgaaaaaggatgattatacggatagttcctatgcggaatatgaaaaagcattgaaggaagtaaaagcagtcatcgcaaaagaaatagtgacaaaagatgaagtaaatgcggcacttgaaaaattacagacagcaagaggcaatcttgtaaaagtgacaaaaccggcaccagatataaataagaatccagaaaaaccatctgcgaataaaccagaaacaggggttccttctgttggaatgttaatcaagtacaaaaaagctatctataaggtaagagaagttaacgcaacaggtggtacggtaatgcttgttaaacgaaatagcaagaaagcaaaatttgttattccagcaactattaagagtggaaattatacctttaaagtaacatcgattgcaaataaagcgttcaagggtgataagaaactcaagaaagttgtaattgataagaatgttcaggtaatcggcaaacgtgcatttgagaaagctaaaaatctgagaagtattacaattaagtccgtttctctgaagaaagttggaagaagcgcatttaagggtatccatgcgaaggcaaagattaaagtgcctgctaagaaaatgaaagcttataagagacttttaaagaaaaaaggacagaaatcaagcgtaaagattataaaataattagtataatctgaaagtatagctaacagattaccgccccggcagattttcttctgccaggggcggttttgcttataaaagaaatttacaggatatagatattcgttctgtttatccattcaattttataagtaggatttttcgtctattttttgcaatacgtgaaattgtataacatttaagccggaattttataaaaaactgttttatttgccacgttgacaaaagtggatttatttgctaacataatttactaatattagctatattttttaatcaattattcaaggatggaaaggaagaaaacaatgggaaaaatcattaaagaagcgattacatttgatgatgtattattagttccaggatattcagaagttattccgaatgaagttaatctggagacaaagcttacaaacaagattaagttaaacattccatttatgagtgccagcatggatacagttacagagcatcagatggcaattgctatggcacgtcagggaggaattggtattattcataagaatatgtccattgaagcccaggcagaagaagtagataaggtaaagcgttcagagaacggtgttattacagatcctttctatctatccccggaacatactttacagcaggcagaagacctgatggcgaagttccgtatctcaggtgttccgattacagagaacggcaagttagtcggaattattacaaatcgtgacttaaagtttgagacaaactttaataagaagattaaagagtctatgacttccgaaggtttagttaccgcaaaagaaggaattacattagaagaagcaaaacagattctcggtaaagcaagaaaagagaagttacctattgtagatgataactttaacttaaaaggcttgatcacgattaaggatattgagaagcagattcgttatccatattccgctaaagacagcaacggacgtcttctttgtggtgcggcagtaggatgtacaccagatatcttaaaccgtgtagatgagcttgtgaagtctcatgtagatgttatcgttattgatacagcacatggacattcagctaacgtattaaagacatttgctttagtaaaagagaagtatcctgacttacaggttattgcaggtaacatcgcaacagcagagggaacaaaggccatgatcgaatgtggtgttgatgccgttaaggtaggaatcggacctggttctatctgtacaacacgtgttgttgctggtatcggtgttcctcaggttactgctgttatggattgctatgagatggcagataagtataatattccaatcattgcagatggtggaattaagttctctggtgatgttacaaaggcgattgcagcaggagcgaacgttgttatgcttggtggacttcttgcaggatgtgatgagagtccgggagagtttgaattatatcagggaagaaaatataaagtatatcgtggaatgggctcactggcagctatggagaacggaagtaaagaccgttacttccaggctaatgcgaagaagttagtaccggaaggtgtagaaggccgtgtagcttataaaggtaaagtggaagataccatcttccagcttgttggaggattacgttccggtatgggatattgcggagcaaagacgattcaggaattaaaagaaaagggacagtttgtaaagattacagcagcttccttaaaagaaagtcatcctcatgatattcatatcacaaaagaggcaccaaactatagtgtagaataataagaacgcaaagggctgcgcagatgggggaatcttcatctgcgcagtttttttattttataggaaagtttgatttttactttagaaagaggtgatcggatgtttttttccagagaccggaaacaggtctggaagaataataaagtgaagaaaaggaaaaagtctgggaaaaaacgcagaggaaagaaaaagacatcaaatagaaagatatcaactagaaagacgtcaaataaaaagcaattgatcattacagtttttcttttggcattatttatttctgttctacataatagcttactttggatgccggcgaaagtagcaggaacatcacaggagcaggaaaagggagaagcatccggtaatcgagtgcttcctgcagaggatggaccttgtgggagaccggagatcacagaagactttttagatatgaatccatacagcagaagtggagtcgcccttaaaaaagtaaaaggtgtagtgattcattatgttgcgaatccaggtagtacggcaaaggagaatcgggattattttaataatctccaaaatacgcatattacaaaggcaagcagccattatattgttggcttagatggagagattattcagtgtattccacaaaatgagatttcttatgcatcgaataacagaaataaagatacgatttctattgagtgctgtcacccagggaaagatggaaagtttaatgagaaaacttatgattctgtcgtgcgtctgacagcatggatttgcaagatgtatggattatcttcccaaaatgtgattcgccattatgacgttacaggaaaaatgtgtcctaaatattatgtaaaacatgagcaggcatggagagaattttgcaataaagtacaggaatgtctggaaaaaagattgattataatagaaaaatgagatatgataaagaaacgtgagtatctatacccataagtatttgaattattaatttgcaggaaatgatgcgtcttaattcataaagggtataaagatagaagaaaaaggaaagggatgaaacgatgagttataaagtaggtgtaatccgaggagacggaattggtccggaaatcgtggcagaagcacttaaggtgctcgataaagtggcagagaaatataatgagaagttcgattatacagatattcttcttggtggtgcatctattgatgcaacgggaaagcctcttacagaagaagctttagaaacagcaaaaagctgtgatgctgtgctgatggggtctatcggtggcaacacaacaacttctccatggtataagcttccagcggatttaagacccgaagcaggactccttgcaatccgtaaaggacttggattatttgccaatatgagaccggcctatctttatgaggaattaaaagatgcctgtccgttaagagaagatattatcggagatggatttgatctcgttgttatgagagaacttacaggtggtctttactttggagaaagaaagacatttgaagaagatggtgtgacaaaggctgtagatacacttacatacagtgaagaagagattcgccgtattgctgtccgcggttttgatatcgctatgaagagaagaaagaaagtaacaagcgtagataaagcgaacgtattggattcttcccgtttatggagaaaagttgttaatgaggtggctcaggactatccggaagtagagttagagcatatgttagttgataactgtgctatgcagttagtaagagatccaaagcagtttgatgttattcttacagagaatatgtttggagatattttatcggatgaggcgagtatggtaaccggttctatcggaatgttatcttctgctagtttaaaagaaggaagctttggattatatgaaccaagtcatggctccgcaccggatatcgcagggcagaacattgctaatccaatcgcaaccattctttctgcttccatgcttcttcgttattccttcaatatggatgaggcagcagatgctgtagatcatgcggtaaaacaggtattaaaggatggataccgtaccgttgatatcatgtctgagggaatgacaaaggttggatgtaaagaaatgggaactcttatcgcagaacgcatttaaaaaacttggaggttaattatgaatagtgatcatgtaaaaaaaggaatgcagcaggcaccacatcgttccctgtttaatgcattaggatatacaaaagaagaaatggaaagacctttggtaggtatcgttagttcttataacgagattgttccagggcatatgaatcttgacaagattacgcaggcagtaaagatgggcgttgctatggctggtggtacaccggtcgtatttccggcaattgctgtctgtgatggtattgcaatgggtcatacaggaatgaagtattccttagtaacaagagaattgattgcagattctacggaatgtatggcaaaggcacatcagtttgatgcattagttatgattcctaactgtgataaaaatgtaccaggactgttaatggcagccgcacgtattaatgtgccaactgtttttgtaagcggcggtccgatgttagccggacatgttgatggaagaaagagaagtctttcctctatgtttgaggcggtaggcgcatatgaagccggaaaaatgacagcagaaaaagtagaagagtatgttaataaagtatgtcctacctgcggttcctgctccggtatgtatactgcgaactccatgaactgtatgacagaggttcttggtatgggacttcagggtaacggtacgattccggcagtatattctgagagaatccgccttgcaaaacatgccggtatgaaggttatggaattattaaagaataatgtacgtccaagtgatatcatgacaaagaaagcattcttaaattgcttgactgtagatatggctcttggatgttctaccaatacaatgcttcaccttccggcaatcgcacatgaggcaggtgtagaactgaacatggatattgctaatgagatcagtgcaaagacaccaaacctttgtcatcttgcaccggcaggtcctacttatatggaagacttaaatgaagccggtggtgtatatgctgtcatgaatgaacttagtaaaaaaggccttctttacgaagatcagattacagtaacaggaaagacagtaggagagaatatcaaagatgtgcgtaacttaaatccagaagttatccgtccgattgacaacccatatatggcacagggtggaattgctgttctgaaaggaaatatcgcaccggataccggtatagtaaaacagtctgctgttgttcctgaaatgatggtacatgaaggaccggcaagagtatttgactgcgaggaagatgcgattaaagcaatcaagggtggagatattgttcctggagatgttgttgttattcgctatgaaggaccaaagggcggtcctggaatgagagagatgttaaatcctacctctgcaatcgcaggaatgggacttggtgattctgttgctttaattacagacggacgtttctctggtgcatccagaggagcttccatcggacatgtatctccggaagcagccgttggtggaccaatcgcattaattgaagaaggagatatcattaagatcgatattccgaataacagcttgaatgtagatgttacagatgaggaattagcaaagagaaaagaaaaatggcagccaagagaaccaaagattacagatggttatcttcgtcgttatgccgcacttgttacttccggaaacagaggagcagttttggatgttgaccagttaaaataattggaaagggtaatttataatgaagcaggttcttaatggttcagaaatcgtattagaatgtttaaaggagcagggggtggacaccgttttcggttatccgggtggtgctattttaaatatttacgatgaattatataaacaaagtgataaaatccatcacgttcttacttctcatgagcagggagcttctcatgcagcagacggttatgccagagcaacaggaaaagtaggagtatgtatggctacatccggtccgggggccacaaatcttgtgaccggactggcaactgcttacatggattctattccggttgtggcgattacagcgaatgttggtgtcagtcttcttggaaaggactctttccaggagattgatatcaaaggagtgacaatgcctgttacaaagcataattatattgtaaaggatgttgaaaagcttgcggatacgattcgtgaggctttccagattgcacaatccggaagaaaaggtccggttttagtcgatatcacaaaagatgttacagcagcaaaaacttactttgaatcaatgactccgccagtgattcatccagtttgtgagacgatcaaagaaaagagtgtaaaagaagcaatcgagatgattgaggcggcaaaacagccatatgttcttcttggtggtggatgtattttatccgatgccagcgagcaggttcgggagtttgttagaaagattgatgcaccggtttgtgatacgcttatgggaaagggtacttttccgggagaagatccagcgtatacaggaatgcttggtatgcatggaacaaagacatcaaatattggagtatcaaaagcagacgtattgattgcgattggtacacgtttcagtgaccgtgtctatggtaatgccaaaacatttgccagtcatgcaaagattatccagattgatattgatccggcagaagtgaataaaaatattttaattgataccgcgatcatcggtgatgtaaaagcagtactttctattttaaatagaagaattaatcagcagcatcatgaagaatggatgaaagagattcaggatatgaaagcaaaatatccgatgacttatcatcaggaacgtctttctggtccgggacttattgagaagatttatgagcttactaaaggagatgcgatcattacaacagaagttggacagcatcagatgtgggcggcacagtattataaatataaatctcctcgtcagttccttacttccggtggtcttggaacaatgggatatggactcggcgctgcaatcggtgcaaagtgcggatgcccggataaagtagtagtaaatattgctggagatggctgcttccgaatgaatatgaatgagattgcaacagcaacccgttctgagattccggtaatagaagtagtcgttaataaccatgtactcggtatggttcgccagtggcagaatcttttttatgaacagcgctattcttctacaactctttatgataaagtagattttgtaaaggttgcagaagcaatgggagcaaaggcaaagcgtgtagagacgattgaagaatttgagactgcttttaaagaagcagttgattctaatgaaccgtatttacttgactgtatcattgacagtgatgataaagtatggccaatggtagcaccgggcggttcgattagcgatgctttcaatgaagaagatttagaaaagaaaaagagtgaattaaaataaattaaaaataagaaaggaagatatataatgtttcagtataaatgcttaaatccgatttctgcatgcggaacttctctttttacagaagaatataaacaggtagaagaattacaggaggccgatgccgtattagtaagaagtgctgctatgcatgatatgcaggacgtgccgaatcttttagctgttgcaagagcaggtgcaggagtaaataatattcctatcgcagattattctgataaaggaattgttgtatttaacacaccgggagcgaatgcaaacggagtaaaagaaatggttatcgcaggaatgttattggcatcacgtgatttgatcggtggtaacaaatgggtggaagagaataaagaagacccaaatatcacaaaggcaatggaaaaagcaaaaaaagcatttgccggaagagaaattcagaataaaaagattggtgttatcggtcttggagcaatcggtgttctcgtagcgaatgcagcacacaacttaaatatggaagtttatggatatgatccatttttatctgtaaagtctgcatggaatttatcaagagcggtacatcatgtatcttctatcgatgagatttttgaaaactgtgattttatcacaatccatgttccactgttagacagtacaaagaacatgattagtgcagaaggcattgcaaagatgaaaaaagatgcggttatcttaaactttgcacgtaatggtcttgtagatgaagatgctttagtagctgcattagagaatggcaagctggcacattatgtaacagacttccctacaccaaaggtagctggagtagatggagtgattgccttccctcatcttggagcttcaacagaagaatctgaagataactgtgcagagatggcagtagaacagcttatggattatctggaaaatggtaatatcacaaactctgtaaactatccaaatacacagcttggtgtatgccagacacagggacgtatttctattttgcatagaaatattccaaacatgctgactcgttttacaggggcatttgcaaaagataacattaatattacagaaatgagtaataagacaaaaggtgattatgcatacgcaatttttgatgtggattctcagattacagaagaatctgtacagcatatcacagatatcgaaggcgtgctcaaagtaagagttattaaataaatagcaggtaaataaacatagataatttatagaaaggtgacataggaaaatggatcagaaattaaaagtaggtatccttggcggtacaggaatggtaggacagagatttatctctcttttagagaatcacccatggtttgaagtagtagcaattgcagcaagtccacgttctgcaggtaaaacatatgaagaagcagtaggcggaagatggaaaatgcacaaagcaatgccggaagcagtaaagaacattgtagtaatgaatgtaaacgaagtagaaaaagtggcttctgaagtagatttcgtattcagtgctgtagatatgagcaaagaagagattcgtgcgattgaagatgcatatgcaaagacagaaacaccagttgtttctaacaacagtgcacacagatggacaccggatgtaccgatggttgtaccagaaatcaatccagaacattttgaagtaatcgaagcgcagaaaaagcgtcttggaacaaagagaggatttgtagcagtaaaaccgaactgttctattcagagctatgcgcctgcgctttttgccttaaaagagtttggccctaaagaagtagttgcaacaacatatcaggcaatttccggagcaggaaagacatttaaagactggccggaaatggtagagaatattatcccatttatcggaggagaagaagaaaaatccgagcaggaaccattaagattatttggtaaagttgtagatggtaagattgaaaaggcagccgctccattaattacaacacagtgcattcgtgtacctgtacttgatggacatactgctgctgtattcgtgaactttgaaaagaaaccaacaaaagaagaaatcattgatcgttgggaaaactttaagggacttccacaggagctggaacttccaagtgcaccaaaacagtttattcgttacatggaagaagataatcgcccacaggttaaattagacattgattttgaaaatggaatgggaatttccatgggacgtttaagagaagatacaatgtttgattataaatttgtaggattatctcataatacagtacgtggcgcagccggcggagctgtactttgtgcagaattattaacagcacagggatatatcacagcaaaataaattcggatttgtagatttgatatagacgaaaattcaagtcgagccgtcactcaccacctgaaagaggtgggagtcttctcgactgagataaaaaaatgatatatcccatctgctttacagccgctatgtttaagatgctttcccgtattttaaacacgctctaaagcgatatctgggatatatcatttttctttttttaggaggtttttatgttgttagaagcaacttcattgaagtcttttgctcactcacttatctatgaataccttggtaaaacaggagtgaaactggcagatttttgtggtgacattatcggggcactgctgattttatttatcggttttaaaatcgtatcttatgtggtaaaaatggcacataagatttttgagcgttcgattatggacacaacgctgcagaccttcctgctttcttttattaagattggcggtaaggtacttgttatttttatggcggtaacaaagattggcgtagcagcctcatctattgtggcattacttggttctgccggtcttgctcttggtctttctttacagggttcactgtcgaatattgccggtggtgttattttgttattattaaaaccatttcaggttggggattatattattgagggaaactctgggaaagaaggaactgtacaggcaattggaattatgtatacaaagcttttaagtgtagataataaagcaatcatgataccaaatggaaatttatcaaatgcgagtattacgaatgtaacttatcaggaaaaacgacgtgttgatctgaatgtcggtattgaatatagtgaagatatcaaaaaagtcagaaaagtattaaatgctttaatagaaaaagaaccggcaagaattacagatgagccagttaaaatttacgtaaatgaatttcaggcaagttctatagatatagggattcgttactgggtaaaaacagaggattattgggaatcacgttggagagtattggaagaaattaaagaagaatttgacaataacaatattgctattccatttgaacagcttgatgtaaatttgattccgcaggaaaaagaataagagaagaataagagggagaaaatttacaatggagaagaacttaacgacgggcagtgttttgaagagtattttatatttttctctgccctatttattatcctattttttacagacgctttacggtatggccgacttgtttattatcggacagtttgaagatatttcgagtataacggcagtatctatcggcagccaggtaatgcatatgattacggtaatgatcgttggtcttgctatgggagcaacggttaatatcggacaggcgattggggcaggcaataagaaaaaagcagccaaagatatcgggaatacagtcaccctttttatgatgctggcaattgcaggagcagcaggtcttttattttttatcaaacccattgtcggcatgatgtcaacaccgcaggaagcagttcctgaaacagttatttatcttaccatctgttttctgggaattccttttattactgcctataatattatcagttctatttttagaggaataggagattctaaaagcccgatgtactttattgcagcagcctgtgctataaatattattttagattatctttttattggcggactgcatatgggggcagcgggagcagcattaggaacgacttgctcacagacaatcagtgtactgattgctcttgtcgttattatgaaaaaaaagacaggaatttctctttccaaaaatgattttaagatagacaggaaaacaataaaacgattattaaaaattggtattcctgtcgcgctgcaggatggatttatccagattgcttttataattatcactattattgcaaacaggcggggactcgatactgctgcggcggtaggaattgtagaaaaaattatcagtttcctctttctggtaccatcttctatgctttctactgtatctgcacttggagcgcagaatatcggtgctggcaagagagaaagagcacagaggatactttattatgcagtgataattactgtaggatttggtgtaatgatatcaattatcatacagtttatttcagaaccggttgttggcttgtttacagaaaatgcaagagtaatagtacttggttcccagtatatcaggggctatatatttgactgtatatttgcgggtgtccatttcagtttcagtggttacttttgtgcctgtggacattcagaaatttcctttatccataacattatagcgattcttcttgtaagaataccgggagtatatattacagctaaagtattttccagtctttttccgatgggattggctacagtaggaggttcccttctttctgtaataatctgtgtgattgcctatgtatggatgaagaaaaaacaaatatgtattgactgattttgttgtttctgttcgttaacctgtgttatcatgatataagaataaaaagatgtctcataagatgaaatacaagagattatgagaatacataaaaattatacagggggttcctatggaagaaaataaagaattagaaaaaccacataaaagacgagtgcgttataaaggaacgcatccaagaaagtttgaagagaaatataaagaactgcagccggaaaagtataaagatacgattgagaaagtaatccgtaaaggaagtactccggcgggaatgcatatatctatttgtgtgcaggagattttggattttttacagattcagccgggacaaaaaggattagactgtacacttggatacggaggacatacaagaaggatgttagaatgtctccagggcgaaggacatatctatggattagatgtggatccgattgaaatcgtaaaaacaaaggatcgtttaaggaaagcaggatatggggaagacattttaacgatcatacagcagaatttccgtaacattgatcttgtagcggaagaatatggattatttgattttgtattagctgatcttggggtatcctccatgcagattgataatccggaacgaggcttttcttataaagtagaagggcctttggatcttcgtttgaatccggataagggaatttctgcagcagaacggttaagagaattaaccagagatgaaatagaaggtatgctgcgtgagaatgcagatgagccttatgcagaacagattgcaaaagagattatgaagacatttcgtcaaggagaacgaatcgatacgacaggacagctaaaagaagttattgaaagagcgcttgtatttctgccagatgataaagaaaaaaaggataccatcaagaagacttgccagagaacctttcaggcacttcgcattgatgtaaacagcgaatttgaagtactagaagaattcttagaaaagttaccacatatacttgcaccgggcggacgtgtagcgattctcacgttccattccggagaggacagattagtaaagaaaatctggaaaagacagcagaaggaagggttatggagtgaggtggcaaagaatgtcatccgcccttcaaaagaagaatgccatcgaaacggcagagcaagatctacaaaaatgagatgggcaataaaataataataaaaaccggggaagtatatgatttccccggtttttgtctgtattaagtttacatagaaataattcctaatacattcgcgatagaactgcacaaaataataatcaggcagattggtgcgaaatatttaaggaagacagtgtataacttctttctgcggaaagaagaagactgttcgatttcttctgagattttcttaaatccaacaaccctgaggattaagaagcaggttgctaaagcagcaagcggcatcattacagagtttgtaaggaaatcaaagaaatcaaggaatgccattccgaagatctgaatgaaatcaagggcaccgtatcccatagaagatgcggaaccaagaacaatcataacaacagccatgaatacacaacattttttacggctccagtgaaattcatctgcaaaagtagatacacaggtttccattaaagatactgcacttgtaagagctgccaacagcacgagtacaaagaacaggataccagctgcggtaccgattcccatactggcaaatacttttggtaaagtaataaacatgagggatggtccggcctgtaagttttcaggatttccactagagaaagagaaaacagcaggaatgatcattaatccggcaagtattgcaatccctgtatcaaagatttcaatctgtgttgtggatcgttcaagatccatatctttatctgtataagaaccgtaggtgtaaaggattcccatagcaatggaaagagaataaaacatctgacccattgcagtaacaattgtcataaaagaaaaattcttcatgttaggaattaagaaatactttactccggctaatgcgcccggacgtgtaacggaataaattgttacaacgattgctaaaagtacaagaattggcatcatgattttagacattcgttctactccatttcttacaccgccaaggatgataataaagattaatgctgcaaaaacaaggaaccacagttctgtttgaaaagaatctgtgatgaatccggtaaagtagccatcctgtgcaacttcctgcacatttccttttaaatattcagcaagatatttgataacccatccgccgatcgtactataataaggaacgatcaggataggaataaccgcattgagccagcctccaagtttaaaaggaaagctattaccaaaagaagcaaatgcacctaccggactttttttcgtcatacgcccaagagctgtttcggacataataagaacatatccaaaagatacagttaaaaggagataaactaaaagaaagattcctcctccatattttgcagcaaggtatggaaaacgccagatgtttccaagacctacagcagaaccggcaacggccagcacatagccgatacggccggaaaaacttcctcgtccctctttatgtgacttttttgaatgtttcatagttattctccctgtttactcttcgtgttcttcaatccattttttattgatcgcgatgacctgttccattgcttttggacctggggcaccgatagtattcctcttgtcaacacaagtatgaacatcaattgcctcgtaaatgtcattttcaaatacaggactgattgctttatattcttcaagactcatatcatcaagagcaattcctttggcgatacaatacagtacaagacgtcccacgattccatgagcatcgcggaatggaaccccatgatttacaagataatctgctgcatcagtagcatttgtaaagccatgtttggcactttgctccatgatgtctttatggaaagtaattgtctttaacataccgttaaagagagcaaggcagccctttacagtgtcatatgcatcaaaagtgagttctttatcctcctgcatatctttgttatatgccagagggattcctttcatagtagttaaaatagatgttaaagctgcataaacacgaccagtttttccgcggattaattctgcaatatccgggttctttttctgtggcataatactgcttccggtactgtaagcatcatcaatctcaatgaaacggtactcgttagaattccagagaatgatttcttcacaaaaacggcttaaatgcatcataattgtagaaagtgcacttaacagttcgataacataatctctgtcagatacagaatccatgctgtttaaagtagggccataaaagtcaagaagttctgccgtcatttctctgtctaatggataagtagttcctgctaatgcaccggaacctaacggacagtaattcatgcggtcataaatgtcacttaagcgggaataatctcttttaaacatttccatgtaggcaccgacatggtgagagagtgttaacggctgtgccttttgtaaatgagtaaatccaggcataacggtgtgaatattttcttccattaaagtctggcatgtcttgatcagttcaagaacaagctctctgatagaaagaagctcctgtcttgtatataacttcatatcaagagcaacctgatcatttcggcttcttcccgtatgaagcttctttccgacatcaccaatacgctctgtaagtacagcctctacaaaactgtggatatcttcatattcttccgtaataataagagaaccattctctacatcacgaagaataccttcgataccggtaatgatctgatctctttcttcttctgtgaggataccaacactagcaagcatctttacgtgagcaatacttccttccatatcctgtttataaaacttcttatcaaaattgatggacgcattaaaattgtaaaccagtttatcggtttcttttgtaaatcgtccgccccataattgagccataaaacttcctcctgattatataatttctaaaagtgttctaaatgaatattctacatgaaaatatgataactggcaaggaaaaaggcagaaaaatcttgtctctgatataagattggagtataatccgttctatctttgctatttgcagaagaatttgagaggaaaagaggttgatggaagatgaaagcacaaatgaaagcgcaagtgaagacacataaattacgaaatacattttttctgtttctgacagccatgatctggggtgcggcttttgtggcacaaagtgtaagtatggattatatcgggccatttacatttatttgcctgcgctctgtaatcggtggtttgtttttgatcccggttattatagtacttgacggtatccggaaaaaaagtcagaatgaaagtgcagatgtagtgaattctgagaatattcttcatatagagacggaggagaaacaaagactaagttggaaaaacaaacagcttatagaaggcggcattgtctgtggtatttttctgttttttgccaactgttttcagcagacaggaattcagtatacgacagtaggaaaagctggatttatcacaacattttatatcattattgtaccgcttatcggtttgttctttaagaaatattgcggaattcttacatggatcggtgtagtcattgcattagcaggattatattttttatgtattacacagaaattgacgatacaaagaggagatgcacttattttatgctgttcggtcttgtatgcaggccagattcttgcaatcgatcattataatccatttgtagatggtgtaaaaatgtcctgtatccagttccttaccggtgggatacttggtgctgtgttcatgcttctatttgaaaatccgagcatagcaatgattttaagtgcggcaggaccgattctttatacaggtattatgtcaaccggagtaggttatactttgcagattgtaggacagaaggggttgaatccaacagtagcagcacttattttaagtttggaatctgtattttccgccttttcaggatatttgttccttcatcaggttcttacaacaagagaattgatcggctgtgcacttatgtttattgcgattgtattagcgcagcttccggatatccgaagaaaagtataaaaatgcatagtacatgttcattttattaattcaaagtaagtttgatgaatatttattcaaagaatatgcaggaagcacttgtgtttttattcggtttgtggtattttttatatttagaagaaagctttgcatggctttcttacaatacgcaaatttttttagaaaaacttgtaatgaaatgaaacaaaggagagagaaaaatgaagatgaaaaaattagcagccgttgcgcttgcagttgttatgtctgtatctatgttagctggatgcggtagcagcaacgacaaaaagtcagcagaatccagtacttctgctaatggaacagctacagtaaagacagcaaaagatggtgtattaacaatggcaacgaatgcgacattcccaccatatgaatcttatgagggtaatgatattgttggtattgatgctgacatcgcaaaagcgatcgcagataagctgggacttaagttagagattcaggatatggaatttaactctatcatcacagccgtacagtcaggtaaagcagatttaggtcttgcaggtatgactgtaacagatgagagaaagcagtctgttgacttcactgacagctatgcaacaggtattcagtccgttatcgtaaaagaaggttcttccattaagtctattgatgacttaaaaggtaaaaagattggtgtacagttagcaacaactggtgacatctatgcaaaagatgactttggcgaagaaaacgtagaagaatacaacaaaggtgcagacgcagtgatggctcttacaagcggtaagattgatgcagtaattattgataaccagccagctaaagcttttgtaaagacaacagatggtttacagattcttgatacagattatgttcaggaagattatgcagcagcaattcagaaaggcaatactgatttacttaacgcagtgaacggagcattaaaagagctgaaagaagatggaactatccagaagattcttgacaaatacatcaaataattatacatagttatggagattgtagctatgatatgaaaaagcaggaagcagtgtataccgctttccatacccggggcagttgtcccgggtactcttttgttttataaagtaacaggtaaatacgaatgaatatttaagaaagagaaggttgagattttgagtgagtggttttcaggcataaaagcaaagtttatattggactttattgcagatcagcgttggaagtacattacagatggtcttaaagtaacattggaagtaacgttccttgcattgattctgggattagttcttggagcagtcattgcggtaatccgtacaacacacgatcagctgaaagaagatcagagtaaaggttttggaagttttcttattaagctggcagatttgatctgtcgagtgtatctgacagttattcgtggtacgccaacgatggtacagttattgatcatgttctttattgttttagcatcttctaacaataaagttatggtagcggttatcacgtttggtgtgaattccggggcgtatgttgcagaaattttccgttcaggtatcatgtctgttgatgaaggacagatggaagcaggacgttccttaggacttggctatacagataccatgttacagattatcatgccacaggcaatcaaaaactgtctgccggcattggtaaatgaaatgatcacattattaaaagaaacatccatctgtggttatattggtcttaacgaattaaccagaggtggggatattatacgtggtataacttatgatgcaatgctgccgttattaattgtagcggttatttatcttgtaattgttatgttctttacatggcttatgggcaaactggaaaggagactgagagaaagtgatatccgttaaaaatttatataaatcttttggaagtcatcaggtattgaatgatattaatgaacatattgctcctggtgaaaaaatagttatcattggaccatccggttccggtaagtctacatttttacgctgtatgaacctcttagagcgtccaacatccggacagattatctttgatggcattgatattacagatccaaaaacagacattaataaagtgcgtcagcatatgggaatggtatttcagcatttcaaccttttcccacataagacgatcatggaaaatattacacttgcaccggtacgtctgaagttaatgaagccggaagaagcaaaagaagaagctcttagacttcttaaattagttaacttagaagaaaaagcagatgcttatccgggacagttatccggtggacagaaacagagaattgccatcgttcgttctcttgcgatgaagccgaaaatgatgctctttgatgaaccaacatccgcccttgacccggaaatggtaggagaagttttagaagtaatgaaaaaccttgccgatcagggaatgacaatggcagtagtaacccacgagatgggatttgcaaaagaagttggaacccgcgttatgttcatggatgagggaagaattcttgaacagggaacaccggaggatatctttgataatccgaaagaagcaagaacacaggaatttctttccaaagtactataatcctaatttgtaggggttgaaacagacgccgctgaagggagattacttaactgaattggattgagatttctaaagaaaagagaatttttataagtttgattttgttccgttgcgctaaacgtttcattttgcctcgaaaaacgaaaacttcggaaaaacaagtccgaagttttcagagtcaaaattccacagcgcaaagtcacaaaatgcaatacttataaaaattctcttttctttaccataatttccttacaattcagtaggaagttttattgcagcggctgtctaatcaattctagaaatgagttaaaaaataaggagcacagtccatgttgctaactgtggatttaaattagacagaaaaaagaacaaatactatatcccagatgcggatgagcatcttaaatacagcgactacagagcagatgggatatagtatttgttcttttttcgtatagaaaattccactctgccaatactattcacattcaagtcgagcagccgcgagacttggcgcgtgattctggtcagcgtaagctgacatattctttacagaattactgcgtgtcctcgcggagcgtttatctcagtcggatattggactcctattgagacaaatttgctgtcattcaccacctgaaagaggtgggagtcttctcgactgagataaaaattgtgttttaggagcggcagagaatgagacattttgtggtaacaaaaatagtgcagccattatttcttattagttttggtgggatgggatattttaattttgagattctataccggggttattctcatatatctatgattatttgtggtggattatctttctatacaattggcttattaaatgaaggcaaaaaatggcatccctcttttcttttgcaaatgatactgggaagtcttattattatttcttatgaatatttaactggtgtcattgtgaatatttatttgaaacttcatgtatgggattactcaaaagtgccttttaattaccgggggcagatttgtattccatttcttattatatggttttttgtcactccgttatgtatttggatggatgatgtcataagagaggtagtttttaaatcctgatttgatgaactaaagaaacgaaaagcagaaatttaatatagaataaattgtgaagatagtcgcggcgtagaaaatgcctgaccggcatttttacttgctccgacatcacattttattctatattaaatttctgcttttctgttctttggcgccagatgaaatcaagattttgtgtagaaaaaataagggggtttccccagaagaattcgtcaatcctttagactttaatttcctggaaagtcatatccttctggtacattccacgttgttcaactgtggatttagcatagtcagaaaaaagaaaccataccatatcccagatgcggcttgggagcatatttaagatgcggatgagtatcttaaatacagcgactacagagcagatgggatatggtatggtttcttttttcgtctacaccaaatctacaggtcaggattgtctggtaatacaaaagttgtaaaagcaaagaagaaaggaaaggctgtgattactgtgcagtctggaagtaagacagttaaatgtaaagtgacagtaaaataataattatttaagaagttaaaaagtatctattggggcatctcatttgctatgcaaattaggattcaactgatagtagagtgcgatattcctataaatgtgttaggatatttatatcgaaaacaggtttctaaatataaatttggaaataaatactatcattttatgggagcgtgaaaatatggttgagccaataaaagtaggaaggttcatagcacaaaatcgaaagaatctaaatttgacacaaaaagaactggcagaaaaattaggagtaacagaccgggcagtttcaaagtgggaaaatggacgatctataccagatgtaggaattatagaatctctttgcaaagaattgaatataagtattggcgaattctttgcgggagaaaaaatacaggaaaaagaatataaaaaagaaacagaaaaaatgttacttgcttcccttgatgaaaaacagctttatggagtacagacaataatctatattctcgaatttgtgagcttggaattgctcatgctaccatttcaattatctgaaaaatggccttctattaatagaataaatataatttactggatcttggcagcagtagtttttttctgtatgtgttatcttgataaaaaaatgccagaaagaaggttgcgtaattcaaataaatggatacagggaatagaagcggctgtaggattcttgtgggtggtatttccaatagcatcaaaggaaagaatgaatatatttcaaggtatgagcattggagaaagtattgcaataggtctggaaataattattggatttatcatagtagttggtgtggcaattatacagtcaaaaatgaggaaggaagaatgggaagaagaaaacaatagcaaaaaatctgattgagcaacatcgttgtgccatagctttcctaagccatcacgtcgcgatgttgttcaatcaggatttagatttgagttgttgcaatgtattattacttatattacaataaatataacagatagaagggagggatatttatgatgtatccttttatgacactgaatgatgatacggaaatcactcattctgagatgaaggcagatggtagtgtaaaagtgtatattgaaactccagatgaagtaggtggattccataatgcaacatgttggttgccagcctataaatgggaaaatattgaaggatatagtgatacagaaatatcctattttaaacagttgattcgtaaaaatgctcatcttattatagagttttcgcaagaagggggcgtttaaatgccgcaacttcttagaattggaccatacagtatttattttttatctcactccacatatttcccagattttgtgtgaatctgtatctatattagattacctgctgttttataataaataataattattttttttcttataaatggatggggtggaatgaaaatgaaaaagagaataggtatttatcattatcaatactatagaggggcctgcaaactatgttacagacattttattcaggagatggtagaatcctatgaaaaatgccatgaagtagcggaagaaatctatggaaaagagaattgtgagttccttcattatacagattttggacaatatgattcagaaaatacagacagaccaagtttccgccgtattatggaagcgatagagaaaaaagagttagatgtagtgatgtgttatgggctgaataacattacgatcaatgaagagcttttaattaagttctataaatatgttcgctcacagggaatggaatttttaacagctgatcatggaagagatgcgatgaaatatatagatatctacatcgagaaaaataacttgtgaggttgcaagacagacgaactcctaaagataaataaagcatatttgtgactttagtcgctgcaggttgaatgttcgcttaaccgctcgtatccaacctttgcccctaggccacaaatatgctttattaaaatgctttctatcaataatttaagcggcaagcttcagaactttagttttttggaaagccacaacctgctggcgaatcctcaaatcctccaacattaattctgattttgtttctgcagttacagccaaagacagctccccaaaagaaataataacctatatttgtggccttagagcgaggattgaatgtgagcctataagcgaacattcaacccacagtgatagagtcaccaatataggttattatttcttttagggagcgtctaccctgcctgcagcaactcagaattatttactatggttcttctccaattcctgcattctcattgcacgaacttttaatggaagtccgaataatgtgatgaatccttcagcatcgtgatgatcgtactgatcgcctgttgtaaaggatgcaagtgtttcgctgtaaaggctgtatggagaagttgttccggctttgatgatgttacctttataaagcttgaatttaacttcaccagttacatatttctgtgtggattctacgaatgcctggattgcctcacgaagtggtgtgaaccattttccttcgtatacaacctgagcaagcttattacccatatctttctttactgccatagtgtctcggtcaagtacgagttcttctaactgtctgtgtgcttccataaggattgttccgcctggagtttcataaacaccacgtgacttcataccaacaacgcggttctctacgatatcaacgataccgataccatgctttccacctaattcgtttaacttacgaatgatatcagcaactttcatttcttcgccattgattgttttaggaacgccggcttcaaaagtcattgtaagatattctggttcatctggagctttttctggagaaacgcctaatactaataagtgatcatagtttggttcgcaggcaggatcttcaagttcaaggccttcgtggctgatatgccataagttacggtcgcggctgtagctgttatctacagagaatggaaggtgaatgtcatgtgccttacagtattcaatctctgcatcacgagaatccatctgccacttgtcatcacgccatggagcgatgatctttaaatcaggagctaaagctttgataccaagttcaaaacgaatctggtcattacctttaccggtagcaccatgacagattgcaacggcattctctttacgtgcaatctcaactaatttcgctgcaattccaggacgtgccatagaagtaccgagaaggtatttgttctcatatactgcatctgcctgtacgcatggcataatgtagttttcgcagaaatcgtctgtaatatcttctatatataacttagaagcaccggagtagagagcacgttcttctaatccgtcaagttcttcgccctgtccacagtcaacacagcagcaaattacatcataattatatgtttcttttaaccaagggataattgcggtagtatcaagaccaccggaataggctaaaactactttttctttactcattctatgtatcctcctaaatttttcatcagatgattaaattgtcttatatactatacgtcattataaaggaaaatgcaagagctttttttgcatattattaataaaaattaattaatacttgcataaatcgctttttagctgtataattatgaataatttcgaataaatatgcaaataaacatgcaaaaatgaagcctcttgttttttggaaaactttgtgggataatagaaaactgaaattgatttgcggttttcatatatagattatgtatattcaagaatgtcttggcattcttgctacgagatgcgcatcatctcacatctgatataaaagatgactacaaagagtaaaaagaatgataaggatgctaagaataaaatgtactcacaaaatcaagtgaaagaaagactctgagagtacattaaagagaaaggatgataaagaatgataagagctggtattattggttcgacaggatatgcaggacaggagcttgtccgcattttacttggacataaagatgtagagattaagtggtatggttctagaagttatatagatcaggcatatgcgagtgtatttcagaatatgttccagctggtgccggatatttgtaaaggagaagatttagagcagctttgtgaggaagttgatgttgtatttacagctactccgcaggggctttgttcttctttagtaagtgagaatgtattatctaaggtaaagattattgatctgagcgctgatttccgtattaaagatgtagacacatatgagaagtggtatggaatcaaacatcagagtccacagtttattgaagaagctgtttatgggctttgtgaagtgaacagagataagattaagaatgccagattga

SEQ ID NO: 398 - DNA, 67226 bp, Eubacterium hallii
tactaaataaacaacaggctgaatagcaaagtatgccattcagcccattacattatatttttgtattctataaacctatgattttatcatcaatctgagaggtttacacagaataatttacactaccgtatcgtcagtaaattattttcttgctcttaacgagcagtaaaaattatgttattttactcttacttttttaactttactccaagtaccaaagtatttcttattaccaattactttataagaacgtgcttttacatagtaaatctttctagaatttaactttgttattgtatatgttatctgtttgttacctttctttgttaacactttcttacctttattaaatttagaatttttggcaacaacaatctgataccctgtcgcttttgtatctttctttaaaacaacctttacttttctcttaccagcagaaatcttttttattgtttgtttctttggaactgcataaatagtaattgttttgcttgctcctttataattttctgttgcacttgcttttattttgattgttacttttcctggtttctttacggtaagctttccacttttccttccaacagaaataatctttttattacttgaagtaaatgtcaaatctccagctgcttttacttcctttttaagattgtatgtcgttccataagaaattttatatgaagctttctttacagtaattatctgattctctatatttttattataaattgctgatacctgagacaattgactgttcgttcctgaaatttcaatcgtattttttgcttttgtatatcctttaatgtctggcaatgtataagttatactctttcctggaacaacctttactactctatattcaagtacattattattcttatcacataaagcaaccactactcgtgaatattttgtattggaagatatcgcatctctataaaaacgaagtgaatctaacacatatcctctatcatcaaaaaatccttgattgtcccaacttgaacctccccatgcaggtttaccattataatacattttatatttagaaaaatatccatctgccccagcagaagcccatccagttccatatttatctgctatttttttattatattcccagtttgtccatccagctcttacaggaatccatgcaccttcccaataaaaagcaccaagtccattatcttgagaaagtactgtcttgtataaatctgttaacatatccacctgaccctgtggtcccacttcatatgcagaagtatcagctgacttaccgatagaattcggggttccatctgcatcttctaaagagtttgtccatgcagtttctgtaacaacaaaaagttttcctcttaaagctacataatcttgaactttctttaatgaagctggtgtattggctttccaactcgtagaccagaatggataatacgaagaacccagtacatcataatctacaccatctctttcccatgtatccataatatacttatattttgacaattctggtgtttctaactgaagcgcaatcaatgtttctggagcaacttccctaaccgctctgcttcctgcacttagatacctatttattgtctgtgatttattcgtatttttccagatttctgcccagtttcctcctctatcacgatcagcgagaattcctagcataccgtttgtaatttcatttccaatctgaaccatgcccacattagctccttcttttaggaacttattcactgtatctttagtaaattcatagacatgatcacacattttttctggattatctttgtctgctttccatgcttttggtataatctgctgtgccggatctgcccagaagtcagaataatgaaaatcaagcaagattttcatcccatattccttcgcttcccttgcaatttttaatccagtttctacatcatttccaccaccaccataagtttctcctttttcattataaggatcgttccagatacgaatacgaatgtaatttacaccattatcactaagaatttttaataatgaagcttccttaccatctttatcatagaatttaacaccagcattctttaacgcattataggaagaaatatccattccctgaatagttgagtctgtcatattttccactttattaatcgttacttgctgctgttttaaaccagtatcatctccatatttataaggatctctgcttgtatctgtctcatgcccctgtgcatatgcaaagatagccatggatacctgtgcatctccttcttcatcaaagaatgacttccagcttccggcatatactgcctcatcgtaaattaatccaccagcattcttctcatcaattgtagcttctaacaagttgtaaatattgtcagcctgcgtatatacattttctgtattagactcatttatacgttcatattttacattagaaacaatcagctgtttgccagatacacaactttctacttctttttttaaacttttaatataactattcgtattattatctggataaatatttacaccaatataatcataatctacagacgcataacccagtttctgaacaatatattttacagaatctgcttgggatggagcagctatactaacagaactctttactccttctgttttcaacaatgctgaaatatcacccatcgctttccatccttcccatccttctccatcagtaatccctaggaagttccaattcacttcattaccaatcgttataatatcagggagaacattcgcctgttttaactttgcaattgtctcttttgtataagtctttgcactttctacggcatctgccttagtccatgctgccggaagcttctgttcatctgcataagttatttcgtctgaataaagtaagacaagattcgtcttaagatttgttttagactctcttaattcccttaatgtttttatcgcattatccagagaaagatatttattttctcctatcggatttacagcaacttttaaagatatggtattgactccctgactttttacataggcaaaaatattgtctacagactggctcatataatttttatatgattttccccactccagacattgttgatagtatgtaaaatcagctcctaaaatagtatcttctcctattccagaaatcttttcatactttttaaaagcatccttacttgtttctggaacttcaattttgttttccgaagaaatcactacatcattatcaccagaaaatgcatttacttcttgagccttaactggctgtatagctaagctaaatcctgttgttgcaaacaacatcgaagccattgctactgccgcacattttttaatactctttcttccaaatctttcaagttttttcattctcattagtaagttacgattgtttttcataagtttcccctttcttattaaatcatgtactataaatgaataattttataatttttctcatttataatagtatatagctattctagcataacatcatttttttcaactatacacatattgaaattggtaaattttgatactattccttttatgttgaatagcctttcgggcaagcagaaatcttctgacctctcccccttatcctttccaaagactattgaattcattccttctggagccaaaacacagaaaaaagaaatactgccatatcccagatgcggcttcggagcgtgtttaagatgcggacaagcatcttaaacacagcgaatacagagcagatgggatatggcagtatttcttttttcgtctgttttcctctaatgaatcaaatagttattttatgcttttccgaattcagagagtactagtccttcgtttctttctaaggtcattcctacactccagctattaataaacagtaacaatgggcgtccctttaagtctttaatcttcttcatatccgatgttccgcgaaggttttcaaggtcaatctctgtgttttcaatccagcggatatactcatatggaagtttttcaaggcggatttctacattgtattcatgctgcagacgataatttaatacatcaaactgcagtgttcctactacacctacgataacttcttccattccagtattaaattcctggaaaatctggatggcaccttcctgtgcaatttcattgattcccttaatgaactgtttacgcttcattgtgtttacctggcgcactcttgcgaaatgttccggtgcaaaggttgggattccttcataggcaaacttctttggtgatgttgtgatggtatctccgatagagaaaatgcctgggtcaaagattccaataatatctccggcatatgctttgtcaatcatctttctctcacttgccatcatctgctgcggctgggaaagacgtacttttttatcaccctgcacatggaaagcatccattcctgcttcgaattctccggaacagattctcataaaagcgattctgtcacggtgtgatttattcatgtttgcctgaatcttaaatacaaaggcagagaaatccttttcttcaattggatcaataactccctgatctgaagttcttggcaatggggaggaagtcattttcaggaaatagtttaagaaattttccacaccaaagttcatgagggcagaaccaaaaaataccggtgagagttctcctgcatcgactaattcctgatcaaattctgcactggccccatctaataattcaatctcttcttctaaaactgcttttgcttcatctgtaacatagttgctgatttccgggtcatcaagggcgatttctttcatcgttcccatctttgtacctttcatcgtatcctcaaataagtcgattttctggcttgttctgtcatagactcctacaaactgcttaccggaaccgattggccagtttaccggacaagttggaattccaagttctttttcgatttcatctaagagatcaaaaatatctcttgcttcacgatccattttattaataaaagtaaataccggaatatgacgcatagcacaaactttaaaaagctttcttgtctgtgcctccacacctttcgatgcatcaattaccataacagcggaatcggctgccattaatgtacggtaagtatcttcagagaaatcctgatgtcccggtgtatccaaaatattgatgcagcatccgccatactcaaactgtaatacggaagaagttacggaaatacctctttctttctcaatatccatccagtcagataccgcatgttttgcggttgcttttcccttaacggaacctgcttggttaattgctcctccatataaaaggaatttctctgttaatgtggtcttaccagcatccgggtgcgaaataatcgcaaaggtacgtcgtttttttatttcatctattctactcatgttgttctccttacattttttcaacagattttatcacctgcactacagtaattacctgtagcttttatagtcaaacagtacctattatcgtataaaatcgtcattttcgcaagtacatcttttatttttgttacatatttcagattacatccttctatgtcttgtaaattttctattttaagcaaaaaagcgagtataaatacccgcttcaaaatcaacttgctctatcaaattctttcatatattttatcacaacaaatatgcatatcactgctgccactaccgctatcacgccaccaaccattccgatataggaaatggacaaatgtgtgcagatacttcctccaatccatgttccgcttccgattcccagattatagattcctgaatagattgccattgctacagaagaagccgctgccggtgcataagtaataatttctgactgaaaggttacattaaatgccataacagccataccccagaatgcacataataaaacaaccgccatatgtgcttttgataccggatacaataaaagtaaggctgctgctacactgatcatgaccagccttataaaaagatatttattcttgtcatagtaatgggaaaataaaaaacttcccaaaagacctgctgctccgaatatagtaagtgttgtcgtaacccagttagcagaaagacctgccaccttctgtaagaacggttcaatataactgtatcccgtataatatgatgtagcaaataaaaatgtgacaagaaaaatccccatcaatgttttatttttcagtatttccggcatttgtttaatagagaatgactcgcctcccggcacctttgggaacacaaaaatcatatatgctgttgtgataaatgcaattactccaacacagaaaaatgccatattccatcccatatgaagtcctatgatccttcctaacggaagtccaagaatcatcgcaattgaggttccagttactaccatactaagtgcaagtgagcgaaacttttctgatacaacactgactgccgccggtgatgcaatcgaccagaatacagaatgcgtacacgctacacccatacgtgataccattaacattccatacgaagcagaaaaagcagacagcatctggaagattccaaagagtgcaattgttcctaacaaaagtcttttaaaatcaattttattcaacaaaagcatcaacggcagagacagtaacataacaatccatgaatatactgtgatcagtacccctgcatgtgcttctgtaatatgaaagctgtcggcaatatctgtcaacaaaccaatcggcataaactctgatgtgttaaatataaatgcagaaacagtaatcccaaaaagcggaagccattccttaagtgacattttactttgcataatttttaatcccttctaaataataattttatataaaaaccacgactattaaatcacatggtgacttatgtgtcaatcctgaatataatttactccaacagcaaagataatcctctgaaagataaataaagcatatttgtgacctcggagcaaggtttgaacattcgcgcgtccaagcgaatattcaaaccacagcgactaaagtcacaaatatgctttatttatctttcagaggatgtctccccttgcctgtagcaaatattatttattctgcaaagctttcgtaactaatgcagcaatctcatctaccttccatgctggctgggtagatgcagaaatcttattgcctctctcccagattccctgagcagatgcagattcttttggtttatactcctcactgtcatctttccatgctggctgggtagagcttgatactgttgttggctttggtaatggtttgttatagaattccaggttctctgttaattcttttcttactaaagctgcgattgcatccaggttccatactttctttgtctcagaagaaagtccacctggtgtatctgttgtatcccatgctccctgtgttcctgctgctggtttacgaggagcttcttcctctttcttccatgctggctgtgtagaacttgagattgttgttggcgccggaattggtttattagagaatgcaacctttacattattagactctaatgcctttgttacaagtgctgcgatttcctgcacgttccacttttcctttgctaaggaagaaacaccgccaggtgtattcgtgctgtcccatgctccctgtgttgctgcggaagcttttggcgctaaatctttagaccatgatgcagaagttgctgtagaagcttttgttggctttggacgggcaacgttagaaaatgccagctgattctctttaagaatctccattacctggctgtgaatcagctcctgtctcttgttatctatcatgtcttttctacccctttcccaatatgtatactttggttttctggttataataaactgtaactgttcagaatagccacgtacctcgcaaataaaattctgcaagttgtttctgaatagtcatattttctttattatagcactaattcaaagaggggatatatgaaaattgctgtcctattactgaaatatattgactcttcacacaggaaattaaaatctaaaggattgacacattccttctgggacattccacgttgccaaactgtggatttagaataagcagaaaaaagaaaaaatgatatatcccagatgtggcttgagagtatgtttaagatgcggacgagcattttaaacacagcgactaccgagcagatgggatatatcattttttcttttttcgtctataccaaatctacaaatcaagatttacttttttttcacaaagtattataattataacatacattttaattaaggaggaaagttactatgaaacacttagtaaagaaactgtcaactttatttatcgttgctgtattagctgttaccatgctgctgccagcaactgcaaatgcgcaagaacgaacaataaaatataaacaaaatttagttctttctaaagaaaatacatttgctagcaatctcttatttcctgaaaaagtaaaaagttgtacttctactaataaaaatattttgaatcctgatatggtagcattaggcgaaaaaagtgttgccttttacacaaataaagctggaaaaacagagctttcatttgtaggaaaaagtggtaagatctatactataaatcttacagttgtaaaatattctaatcctgtatccaaattcaaaatcaattcaaaaaattacgcatctaagtttaaaaaatcttcaatgcctgccttaacttcatcaggaaagcaaaaaatatctattaaagcaaaaaaaggatggaaggtagttgatttacattatactttctataattatagtggaaaaattaaaacgaaaaagtttaaaaacaaccgctctgtaaatatttcaaaaaaatattcaggttttattgatgcaaccttaaaaaacaaaaaaacaaatgcaattacaattttaactctttgtactggtccacaattttaattattaaaatacaagaacaaaagaaacagaaaacaagaaccccatactatagcaaatgtaatgtcgaagcaagcaaaaatgcattcaagcaattttgcgtagtgactacctttacagttgctatagtatagggttcttgttttcgtctgtttattttatttcactctttgaagatatgcgacactttaaactgtgttttcgttgagcaaccaaatactctttccttctaaaccttcataacactctggaaatggttaatttctctctctgaaacaatcctgccatctgatcaatagacaaccacactgtatcaccatcaaaagtagtttcgactttcgtcagaccatcctctgtcgtatattataatttttctttctatatctggaactttttgcaatgttttctgataaacctgtatttgacttgctaaattgttcttttcctttgaacagttttttaactgaacaactatggattctgacttatcctcacaacggagttcatttaagaagttatatactctgttccagatatgattcatcatctttgctcctccttctgctccatattatttccagttatacaataaatatcctataacagcacctatatcaaacaccccaattacctcttttgtagaaggagaaagatgtggaataaatactgcagataatatatttttgttatctatgcttcctaaatttgtcatactgacaccatttccgtcagaaaatccaaacatggaaaatcctacaaattgagctgctttactcttaaattctcccaatgtagcaattgctgcagcatctattaaatttgcgtccatatccaggtagcaggctaataccaacaaccattccctcttattatttctatatttttccataagttgatggatttccatcatactctggctaatttctgaatttctatttttgtatgtaatcccaacagcggaagaataattgccaatagcaccaggatgatagcaagttatatcttggcgggcatctactccgattactatcttatttgtactggacacctgaaaaagagccgctaataaataatcattcacagatactctattgtcatgacataatttttttatttccaataatctttttacggacatactgcttcttgcgtatccataaggatttttttcatgaattgctttgcaaacatttcgtattctgtataagaaaccatctgtttttccttacgccataaacgatttactctttttacaagtaccttactaataccagataacttgcttttttctggaagatctaacattgaagaaatcaattgttctttcacatacataggaattttattttctatatagcaatctgaaaattcaacaaccaactgcagtaatgccctcccatcgcataagagatggtgtgctataaatagaattttgctgtcttgactgattttatcagtatctatgagtgtctacaactcttccagaaactgttttgaagtgatcggcaataccttttcttcgttatagcatggaataatgataaataacgttggcttcttcatctactcaccctcttttctttcttttgttgataaacacaaatcccatgaatatacaaaccgaagtcgctgatactaaacttcccacacggaaaccaggagtatgataagtgaaaactatctgatgttcaccagccggaatctttaaggccatcattccaccagaattaataatcttcgtctcaaatccatccacttttgcaatccatccattgctccacggaaccgtgaaatacagtaaacgattttgatcatagcttgccgtacacgtaaaaccatgactatccctatgaaattcagaaactctgtttgcaacagctttcgccactaactcatctacacttgcctcatagtcaaggcttccttctcccgcatgaataactgcatcatttaaatcgccgaaatcatcttcatcaacaatagctgcttgcataagagtcaaagctttttgttcttgaggagttgccgtaaactcttcttctgttagcgcaaaatccacagcaaaacctatagggcaagcattcttttctgtcacatagaatgttttctcacgccctacaactgtatccaatatttttttatctcctggctccctcgttatttcatattttcctgcaagaagctcagaaaggccaggtacatcatatttgttttgcgtacgattactggaataatgaccaaacagggcatcaaattttcttgaagaattctctacagtagtacagaatactcctattccagcagcatccccattaatcatcaattcattatttacagaattatagcgatattgtgcatctatcgtttttaattgcaatccagcctcaaagttttctttatatccttccaccgaattgctccatgcacttcggtaaaaatgcaaagttaatgcagtggtaagaatgcagccacacattgtaagtaccaatatatttttatatgaattccagttcagctttttcaacacgtaaaaaagtagtggcccagccaatgcaataaaataaaacaaagtgaatcttttcacatcaaaaactatactgtctccattggcattccattttacaaatcgaattgtaaaataaaatattgataacatcgccacatatagcattgaagatttcatcactggataatcttcaatattttccaaaacttttgtagtcgccaaggctaataccaagacaaacatataccaccaacgttgattggattcgctaaacaaaagaaaaattgattccgacagcggaaacaatgaaattatccctaatatccacagcagattagaaagccattccttctttttccctcttacataagcgattaccaatgatattccaaaaaaaggaagatatgccgaagtagaaccccatgtctgtcgtattacggcgctgaattctcgcatagattcgcccggaaaaagaatacccttgatgatatgaagtagccctgctgaatcataagttaaattttcaagatggagtttattctgccctctggaatttcctaacacataaagaatgttgggaaagaacagaattgctgccatcccgactcctaaaactccgcataatatacatgtcaagattccagaaataaactgtcgtacaggcagttttctgtatctaaccagataataaattgcaagaaaaataacctctccgacgaaaaagaaataattcagcaaacaattgatgaagattgtcaatacaaagacaggacgatattttttgtctttcattgccatctcaagtccccataacaataatggaaatatggctacaacatcatggaaatgaaagaattccaaatttgttgtctgatagcctgaaaacgcatataaaagtgctcctatcactgcccattgacgtttatcaacaaaaagcctgagataaagatatgcagttgttgccgccgttacatatttgacgatatacaaaaatcctgcaagatatgggaacacacctcttggagccagtagacttatccaaataaacggactccctaaatcataaaaactgaacgtattaataaaagaggagcctaagtctatattccagcaccattctcctgcatcacctgagtggatcatattccacactgccgttgcaaacggcaattgctgagaattaaaatcatcaacaaccgtaaaaaaacctctacttttaaaaataaaatatccgaatataatacttgcagatattagagaaaaaagtagagtttgaataaggtaaacatcttttcttccctttttcatctgtctcccccctatatattttgattttctgggtatcaaaaatgtgtacttttctgtaaatcgccaatgccgaaagtacctgtcccattctaccacaaaagtacgtctgttccaacataaaacgacacttttaaaggcgaaatttcacgcctgggtttattatggttctgcatacctttgggtggaatctcaaatggaatccacatattcactgtctgatttccgaaggcggctacaatgatgatggtttttggcgtcatgtaaaatatctaaacagtgtcatcatctttttatgcctgcctttgcgcagttttttgtcattcatgcgttcaataaagatcgaactttcctataaagtaaaaaataggaacacccgcttttaacaagtatccctataatctatcaattatttgatagctctctattcattttcatattcagaattctttgtgttccccgtaccgagttctaatgcaacaacaacggttactttcttcacaaggctcttttctttgtgattttcgcctattcttttgaaactgaaaaactccacaaagtgcgtaaattcaaggatttctacatattcttcctttgtagcaacaccacactttccacatgaacagaatgactaaactgatctacgacggctactttctctaaagtgtatttttccgcacatagtatctttaaatctcttgccaatgttgccggatcacagctcacatacacgatacgttccggtgtcatatctaacatcgtatttaaaagggcagcatcgcagccttttcgcggtggatctactacaataacatctggatggattcctgttttttcatactgggcaggaacaatttcttctgcctttccgacgaaaaattcaacattatccatatgattcaatgtggcgttacgccttgcatcatcaatcgcttcttttatgatttcgacaccatagacctgtttggctttttgtgcaaggaatagggagattgttccgattccgcagtataagtcccagactagttcttggccttttaagtccgcatactctaatgcttttgaataaagtactttcgtctgctgtggattcacttgataaaaagaaagtggtccgatctgatatttaatatcgccgatataatcttcaatataatcctgaccccagactgtttcacagtgtaatcctaaaattttatttgtcttatctgtatttgtatttacgataatacttgtcataccctcgatttcttttagtttatcgacaagtttattgatattctttaactgttttgcggttccattcacgataaggcataccatgatctctcctgtggtaaatcctactcgtgttaaaatatgacggatcaatccgctatgattcttttcatcataggcagagatcttattccccctcatatatgcaagtactttttcaacgattggatgggttacttttgcctgaatcgcacaattagtatttgctacaatggaatgggttcttcctgcataaaatccagcgacaagattcccttctttatcatatcctacaggaaactgtgccttattgcggtaatgccaaggttctttcatcccatataccggctccatcttctgttctatatcttctttttcaaaaccgcctatacgggtaagacagccttccacaagccctttcttaaagtggagctgtttatcataagaaatctgttgtaatttacaaccgccgcactgtcttgcaacagggcacagaggggtcactctgtcttctgatggctttataatctccacaagacgggcatatccgtaattcttttttaactttgttatggaaactttcacttcgtcaccgattaccgtatccttaacaaagaggggaaagccctggtacttcccaagaccttccccttcctttgtaaaatcttcgattgtaagtgaaacttcctgattctttttcaagttcaaattcttctctgatttcactttcttattcaatccttttctcctaaatgacttgtcggtctgatattcgtttcaaataatttattgtagcctttccattcgccactctgacggctttcttcggcaagtgcttcaataaatgtctccatcttcgcatcggtattatctgcaaagttaagagccagcgcctcgattaaggcaggttttttcggggaaccgtattctaattcaccatgatgtgcaagaatacagtgctttaattcattcgccagctttggtgggaatccatgaatttctctgatcttttcatcgagcatcatcgttcccataacaatatgtccaactaactgtccaacatctgtataatcattctccgggaaattagaaagctcatcaatctttccaatatcatgacagattgctgctgtaataagtaaatctttattcaggatcggatattgggtacagtagaaatcacacagcttcgttacactcagtgtatgctctaataatccacccataaatccatgatgcactctcttggctgctgaatgtgctttgaacttcgcagcaaactctttatctccaaaaaaggcaactaagagctgtcttaaataaatattctgtacatgattcacataattagataattctttaaacatgccatcgatactcttgctagagcaaggaatataatcttccatggcaaactcgccttctctggctttacggagtcttcttacattcaactgaaggctaccctgaaaacttgtgatattcccctcaacacgaatgtaatccatctgctcaaaattatcaattccattattcaaatcccagatctttgtatctattacaccggttttatcctgtaagatcatggaataataagtctttcctgcttttgtttttgcaatattctttactttacaaaggtatacatcagagacattatctccttctctgagttcattaatataacgcatatacgtttcctttctagctttctcattaattacttcacatattatagcgtaaatttcatatgctgacaaccaagaaaatcgtctattttgcagaattttccgcttttttaaaagctttctctccatcttgattgacaaatcgaatgtttcgtgtcacaattacttttacattatttttttatcttaaatttactaaattaaagaaaggaatagtccggcacattatcggactgtagggatgcactatgatcagaaaacatattattgcacatggtcgcgtacaaggcgttggtcttcgatttacagtaaccggtttcgcaaaaaagtacaatgtaactggatgggttcgcaatctttatgacggtacggtagagatggaagtgcagggacttgaacaccgcgtggacctctttttacaggagttatcctctgatcggccaggtgggaatggttttatccgcattgacagactggacatttcagatattccttccgtaaatgcagcaaaagaaacccgattccgggcacgctattaataatctcatatacgatactgtatcaacagataatgaatatatgaaaatcttaacatgtactctcggaatctttttttgcttgattttgtaagagtacatttaacttatctgagaggattttatttatgaatacaaaggcacttatcacattagaatatgataaaataattaaaaagctggaaacttttgcttcttccacaatgggaaagaagctttgcaaagatttgcttccctcttctgactacgaagaaatcttatccgcacagacagaaacaaaggatgcattaacccggctttataagacgggttatctttcttttcagggactttccgatatccgcccacatttaaggctactagaaattgattccacactcaatcaaaaggaacttcttgagattgcccgtcttctttctattactgcacaggcagtcgaatacggagataccgaagatgaagtgctggcttatgactctttaaacagttattttggagaacttgacccgctcgaattcctgtatcagcgaattacccagtgcatcctatcagaagatgaaatcagtgatgatgcttcttctgcattaaaagatatccgacgggaaattaagcagacgaatatttccattcataataagctgacttccgttatcaactcacaaaataataaaactatgcttcaggatgcattgattactgtccgtaacggccgttactgtgttcctgtaaaaacagaataccgcaatgcatttcctggtatgattcatgatcagtcctcatccggttccacacttttcatcgaaccgatggctgtcgtacagttaaataaccatttaaaagaattagatattaaagaaaaaatggaaatcgaaaagattctgcagtctttaagcgcccaggccgcttcctgcagccgggaattagaagagaatcagaagattctcacaaagcttgactttatttttgccaaagcaaaatatgcaaaagaatatcagggaacagaaccgatctttaataccgacggcattgtagatatcaaacagggcagacatcctctgcttgatccgaaaaaagtagttccgattcatatttatattggagaagatttcaatatgctccttcttaccggaccaaacaccggtggtaaaacggtttctttaaaaacagttggtcttttccagctcatgggacaggccggtcttcatattccggcatttcagggttcccgccttgctgtattttccgatatttttgctgatattggcgatgaacagagtattgagatgaacttatccacattttcttctcatatgacgaaccttgtccacattttaaacgaagctgaccccaattctctcgtcttactcgatgagttatgtggtggaaccgacccgacagaaggtgcagcacttgcgattgccatcttagacgatcttcatacaggcaagatccgtactgttgcaacaacgcattatgcggagcttaaaatgtacgcaatggatacagaaggagttgaaaatgcctgttgtgaattcgaccttgaaactctttctccaacctaccgtctcttaatcggtattcccggaaaaagtaatgcattttccatcagtgaacgcctcggtcttccggactatatcatcgagcaggctcgctcccagattgatgctactgctatcgactttgaaaatatgctctctgaattagagaaaaataaagcggaaatcgaaaaagagcagtctgaactttacaagacaaaacaggaaatcgaaaacttaaaaaacagcctgaaagaaaaacaggatgatatcaaagaaaaacgagacaaaatgctccgggacgctcgtgaggaagctcgaaatattctcgaagaagccaaggaagttgccgatgaatccatccgcaaataccacgcatggggacagcatccaaagcagaacaacatgaagaaaatggaagcacaaagaagtgaccttcgaggccgcatgagtaagcttgataaaaagcttgcctacaaagccaagaagtcctctactatctccgacccttctgactttaaagtaggcgattccgtatttgtaactacactttctctaaacggaaccgtaaaagaagccgccaataaagatggggaccttataatccagatgggcttcctaagttcggtagtaaactataaaaacttagaactcctcgcccctgaaaaagcaccaaaaccacaacatcagccaaaagaccgctacagcattaataaagcggcaaccatcaatccagaaattaaccttctcggaaatactgttgacgaggccatcgcccgcctcgaaaaataccttgatgatgctatgatcgccggccttacttccgtccgcgttgttcatggaaagggaaccggtgctttacgaaaaggaatccacgaatatctccgtaagctcaaatttgtcaaatcctataaactcgcagaattcggcgaaggagatgcgggggtaacgatcgtaacctttaagtaaatactaatttgctggagacaccgatgccgctttagtagaagatattgagctgaattgtagttagccttttaaagaaaaaagaatggttataagtttgattttgttccgttgcgctaagcattccattctacccagaaaaacaggaacttgggaaaaacgagtcccaagttcctatggtcagaattccatagcgcaaagtcacaaaatacaatacttataaccattcttttttctttatcatagtcttcttacaattcagcataaaattttatttcagcggctaactgctcttaatgaggaattagtattttagtctgagggaaaaagaggagattgtccagaagtctatggttttcactagaataaaaatctccagaggagaatattttcccactggatttgtagtctatcttctaaagcaaaaggaattgtaagacattattatatggaaagaaatcggattaatcggaaggctttgaccttcactactattttcttatgcggaacagtttttttgattaaaaatcatagccttctgggtaatcccccattctcaccaactgtgagttttgtatagtcagaaaaaagaaataataccatatcccagatgcggcttcggagcgtgtttaagatgcgaacgagcatcttaaatacagcgactacagagcagatgggatatggtattatttcttttttcgtctatacgaaatctacaaattcgtatttaccattcgtatttgtggagttgcccttcgagttcaagttctttgaatccctgctgtcttaatgcttcatacagaacaattgctacagagtttccaagattcagtgaacggatatgatcgagcattgggatacgaactgctgtctctttatgttcaagaagaatttcttccgggattccggcactttcttttccgaacatgatgtagcagccgtcttcgtattctacatctgtgtatgtctgttttgactttgtggttgccatgtaaatttttgctccgggatttttcgcaagaaagtcttcaaagtttacataggttcggacatctaatttatcccagtaatcaagtccggcccgtttgagcattttgtcgttgattttgaagccaagtggctcgatcaggtgaagaacgcttcctgttgctacgcaggttcttccgatatttccggtgtttgccggcatttccggctcatgtaatacaatgtttaccataattattcctcgatatttctttatttactactattacaggtttttctctttacgtagtctttcaacaaagtttgctaaacgtcctaatgcttcttttaattcttcgatggaatacgcataagagattctaaggaacccttctccgcagtcaccaaaggcggttcctggaatgactgctacttcttcttcgtgtaagaaacggtttgcaaattcatcggagctcattccaaattctttgatgcatgggaatagataaaatgcgccttccggttcaaaacattttagtcccatttcggagaaaagttctaatacaaatcgacggcgttgattatatgcattccgcataatctgtacgtcttcttctccgtttgtcattgcctcgattgcagcatactgacttgttgtcggtgctgccatgatcgcaaactgatgaatttttaatatttgcggcatgatcagttccggacctgtggcaaatcccattctccatccggtcatagcaaatgacttactgaatccattgatgataatcgttctgtctctcattcccggaagtgaagcgatagaacagtgatcttgtccgtaggtaagttctgcataaatctcatcggaaatgacatacagatctttttcttttataatttcggcgattggctctaagtcttcgcgagtcataattgcacctgttggattattcggataagataaaattaaaatctttgttttatctgtaatcgcggcaagtaattcttccggctgtaatttaaattgattctcttcttttaaattaatcgtgaccggaactccatctgccagcttaatgcaaggaagataggatacgaacgccggctccggtaaaataacttcatctcccggattaatcattgcgcggagtgcaaggtcaattccttcacttccgccaactgttactacgatttcatgtacaggatcatattctaaatcatatttacgatacatgtagtgtgcgattgcttttcgaagttctaacagtccggcattcgatgtataaaaagtgcgtcctttttccaaagaatagataccttcctcacgaatatgccatggtgtgtcaaaatccggttcacctacgccaagagaaatcgcattaggcatttcttgtaccagatcgaaaaatttgcggattcccgatggtttcatttccactactttatcagataagggatttctcatggtgtcaccttcattctgttagctggctctttatcaataagaatcattccatgatctttatactttttcagaacaaaatgtgttgctgtaccggcaactgcctctaatgttgaaagcttcgttgatacaaacatggatacttcttttaatgtttttccttctaaaaagattgcaaaatcaaatgctccggacataagatatattgactttacttccggatagttcgtaattctttctgcaagtttttcaaaaccctgtcctctttgtggggtaacacgaacttcgataaatgcggttactttttctgtatctgttttatcccagttaatcagtgtaggataaccgcagataatgccctcattctccattttttcgatttcttctaacaccatactctcatcggttccaagcatgattgccagatcatgcaagtctattctgctgttattttccagcattcttaaaatctcattacgcatctactactctcctttatattttgtcactatcaatatgatatcgttactattacatcgttggcaatgcctatttatattacaataattatactttataatattcatccattttcgggggctctaaaaaacgagcctcttcatcgtagtgtatcaggcggtcatttcctgatgttgtctgaccgatcactgccgattctatgccggctttctgaaactgttctactaatctagctccatttgcacaggcaagaagcaaggttccaccggaccgaatcatatatggatttaaattaaaatattcacatacttcgattgtatgttgtctgatcggtatattttttaaatcaacagaaagaccaacgttctttgcggctgccatttcccacagtgcggcaaaaataccaccttctcttacatcatgaatagaaataacttctctttcctgtaaaatgtcagatactgcggacatcgaaccgtcatcaaataaatgctttgccgtttcaatataagacggcgcatatcttttttctaaacgatccgcatgctccgttgcgatcattgctgctccctctcttccgatagttcctgcaataaccagatctaaatttgtatattctgcctgagcttcctcttctttcttttgaattcccattgctgtcacagataaaataagagtgcttacaaaaggagacactgctgtatgtcctgaaattaccagaatgtcttcctgtgtacaaagtgcatcgatctccttcattaaaaattttaactgtttttcctctgtatcttgtggcataagaacgctaagtgaaattgccctgatttttgctccggctgccagcatactatttacagcgccataaacagctctctttgccgcaaatgtccagccttctatcggattcaccgataatgctaccccggcatcctctgaaaattccggcataaaaagaaccccggcatcctcaccggatgccggagagccttcttcactgtgattatgcaactgtcttagtaccgagcgttttaaaatactctcttttacttttcctatccgcataatatctcccgcacagagcaggcatacacctgctctgttttatctatttttcattcattactcttcattaattaccgtttggcttctccacatcggctttggctttatcctctgcctttgttgttttctttccagtttctgtcgttggctttggaacttcttttttctttgttccaacacgaacaaccgatggcgttgacatgtaagaactggaattcacctgtgttctctttgtctctttgccgtctatgtatacaaccttccacagccttgctgtataaccggtacgtccattagattccacaacacgctttccttcttccatcgtattatctttaatcactttttcggaaggacctcttacagaaagggtctgtgatacatattctactttacggtttgaagcacgatattccttaccataaatagtaaatgtaatactgcttccacctgcggttccctgaatatagatcggatgatccaaattattagtaaactttaaatccttatctgttccggaaattgccgcatcggcagataaaggaacgtaatgaaccgtcatagaatgatttaaacgctctgttacatttaactctgctctaagaactgcattataaagagtcgttgaaacctgacagattccaccaccataggtctgaactgtctgcccatttgaataagaacctgcaagatgatatccattagccgctgtaaatggcgcaactttagaatatacagagaaggattctcccggatataatacggttccattgatgagacttgctccattctctacattcgcacatcttccagaagcagatccggcataggatgttgtatatgtaccaagtacatccttaattgcagaaagctccttctttgtgtgctttgccttatctaaagtataatccatcggaaatacaacagacttatgatcccagttcttattatcaaaaacttctgcaagcttctctgcattcgcatcaaaatcgatagcaataccatgtacatgttttgtaataacaaacttaccatctacacgcttaattgtcgcatccttcttctttgcaagaaacttctttgccttctttgcgacaaccttctttgtttcttctttatcgacagaaaatgtaagtggaaagtcggttcctttcttctcaagctccctgacttccatcactctcttaaaaacattacctgtcttcccaagattatatgcttcctctaccacatccatgtttgtacacttcaagccaatatctgaaagagggaatgcggtctccttcttccttacctgtaatgtcactgtttcctgtgatacttgatctacgtactcctgtacctttgcctccgcttcttcctgcgtcattccgccaacagacatcccctgaatcgttactcccggataaatcgcgtcaatattaatatacttagaatagtaataataaaatcccgctccggcgcctgctaaaagaagaagaagcaatacaagaacaacaacccctattcttttcttcatctcacaccttttcactttctttctaaaacttatctattgtattctcacatctgatataaacaaaacagctttacaactgcatcaaaattctggtcatatccctgccaaaatacacattgcctacatcatcatcggcgctactgtagtaattaccattgcgattactactattgctactacaatcgtagcaattctctgtcttctctttgtaccatttgacttcataatatattcctctcttctaaatcatatttctgtacttttctataaagtaaaaaatatcttcaatgtcgaatagttacattctaagccatttctgtcttacattcaagtatgtattttattagattttacccttttggggcgaaacattccattccacagtccttgcagcacgatttaacggatttcttttattataatcaaacaaacaacatactctcttttctacaatcgttccattctcctcaaactgctttatatcaatttcaaatagttcaatatgactctgattcgctgctttttttgaatcatatgtaccggcctgtacttcttctgggaaaagtttttctccctgttctctatacagcatcttccattctttcttgtactttgcagtatcttttgcccataccggtcttccttttacattttctcgaagatacatatcatacagcataatctcatctaaaatattccatctgacttcctgcatatgttctcttaagaattcacgaagaatattatatttttccagacgattatgattcaatttatggtaaccttttttccgataagatgccgagaacatttcataaaaacggaacggactttcaaaaaatggtacagcatacttcaatgtcaacgcatactgcccgctattataataaagctctaccagttcctccacaccttttaataaaataatctcatcataagaaagccattttgtaccaagcacttcatacggagactgattcctatagataatatcgtattttttaacttcctcttccatcactgtccccttcaggactttaaggaaccctagctgaagctgatctggttcatgtgcatacagatcattaaaagactttccaaagctctcataatcttcatagggaagccccgcgatcaaatccaaatgctggtgaatatttcccagtttatgtactctgtccacataatgaaaaagcttatctaaatccatatgccgatgaatcgcatcaaccgtctccccattcgtagactgcactccgatttcaagctggatcagacccggccgcatctttgcaaaaagttccagctcttcctctccaagcagatccgaagaaatctcaaaatgaaaattcgtgattccattatcatgttccaccaaataactccaaatatcaatcgctctttgccgattacagttaaatgtcctgtcaacaaacttcacctgcggaacctttgcctcaagaaatgcatccagctcctttttcacaagctccaatgaacggaaccgcaccgtcttatccacagaagaaagacagtaactgcaacgaaacggacatcccctgcttgtctcgtaatataaaatcttatgctcaaaaagatgaaaatcttcatacacaaaaggaatcgtatccatattcatcaaagtagcaaaacctgtattgatgattttcgatttactctccatactactctcgccattttccaaagctgatttttcggaaaaatcccgaacggcgattccctgtaacttctgaagttttgtcatatctatatgattcgttgagttggtattctcttctcctgcgaaatatttatctcctagcgcaaaacgaatcagttcagaaaaaacttcttctccctctccctgcataataagatcaaatgctgaattctgctctaaaaatttattcgccgcataagaaacttccggaccaccagcccatatttttacagcagggcttaccttcttaagctctgctgctaactctcttacaaaagaaatattccagatataacaggagaaaataaccacatcggccttcgtctcatataaatcctgtaaaatatcctctacataattattaatcgtatattcttttaaaataatctccgctcccggaatcttcttcctgtctgcatatgctttcaggctgaagattgccagatttgagtggatatacttcgcattaattccgcataataaaaagcgcattacatactccttccaacaaaattcaagtcgagcaggttcttttattcaatatgggattcaaacagaacttcctagctctatttgagtaaaaaacctacggaaatgtactccgcaggctgattttaattcgaacattcccagtataccatgagatgagcatttttaacaggggaatgttgtttaaatggctaaactgacgccccttatcctctgtaatatacaaactcccaatctggcaagtctgttaaaaacttagaaaagtgaattaatgaactttagttttctataaagctataatcttctgaacaatttcaaaaaaaaaccttgcattttcaaaaaaactgtgctagaataaatcttgttgtgagacagcacatcacatgcgggtgtagttcaatggtagaacactagccttccaagctagatacgtgggttcgattcccatcacccgcttttatttttcaaagttgttaaaacatttcaaatagttcttgacaattagaaaatatatgatatacttaatacagttgaataatttatttaagttttatgcacgagtggctcagtggtggagtatcgccttgccaaggcgagggtcgcgggttcgaatcccgtctcgtgctttttttgttgtctttttactcaactaatttatattagaattaaatttggagatgttgcattataataatatactgcaacatctccgttttttctacttaatagtaattagccatcctatgaacgaaatgataaatttttaatccatataaaataagaacctgccaacaggatacttgataagaaccacgttataccaaagaaactatatttaacatttgaccacagcatatacgcagcaaacaatactatcgcaatataaaacaaaatacttacaatcttccatatcagcgaatcatcggacgaataacaaatttttcttatatcaacatattcattagtttgatatatcaaggtgatgatgatcaatacgatagaactaataatttttataatagctgctccataattccacattataggaaagattaacaacactattgtattactaactttagaagcatccgccgtatccatcataatttttacatattcacaagatagtaagtaattaagccatgttaaaaataaaataaatactaaaaatgtcttctttttcattgcctcgcccctttaatctagtgtattatttaacagcttctattgattgcgttgaagcttcttcggcagcttcctgttgatcttcttcacctgctttatcataccatttttgtgcctcttctccttctaacgtagtgaatgtaccatctccattaggaatatcaactcttatgacctgtcctccctgatcaacagaaacagactcatcaaccatattacttgtttctgactggcctgtaaaagtacaagcatttaatgacaatgctattgtcactgccataatcagtcctactatttttttcatgatagacctcttttcgttttacttttttactttctttagggcattattacttttttataatacatctatttatccagtttttcaaaacaaaccacttccggttaatgattatttttttctaataaaaaagcagaaaggatacgcctttctgcttttctacatctaacatactttaagttttaatgatttattactatattttctattaaccatccttcataatgctctgatgcattatacataatctccatatttttaagtgcatctttccgcaatcaattgacataatgcagctctctgatattctcttgtaagttcctttactttattatgccatttttttataaatggactatatgtaaatgctattgcacctaccaacatcactactggaacataataattacttgcaagttttaaagcacatattattggtaaaaaatgaacagactggataaaatcgtatttaaaaatttttcgtttgtaattatcaatatctgcgtcttcccacatttttgtacccattagctcgtttttccaaaactcccagtctagatctggcatttgtggacaataaatttggaaaattgcctcaatctcaggtgtatactctatgacatgatacactttttcgaatttactatctgactcgggtttatttgaaaagtacaataatttttcatttctatcatctgcattttcattttttttataacaaattccacaataagggaattcattccatttatgttttttacaaaaaataactcttcgaactgtaatgctctcatctgatagaatataatcatcatcccaaaccagaaaaatcagaaggatactgaatactacatttagtgcaaattcgctccaacatataccagttctcgaaaaattttctgctactgtttcccttgtaagtccatactgacaagcaaacataaatactgtaaataagattactgccccttgaatttttctagaatatattacttgaaactccatttcatcctctcttaaaatatacactcttaaattaaagatttaatttaaatacatgtcaatatcaataactgcatccaaataatttacaatatttaaaaatcttttctcaaaataaattgccggcaagttatctttctcaaaaattggaactatctcaaaacaaacttctccattattttctttacatatctctttaattatttccaattttccttccaacttccttaacaaatcatcaattaccggttttatatctaattcttcaaatgtgtctgtaaccaatgaccagtatccctctaaatgctcatttttattaaatggtgacattctagtttcattttttcttttacaatctgaaggttttatatttaatatcctttcaattttatatacatcaaaattattatcaaaaaataaattcatttctatatatatacccattttttataataatcctttctttatacacgatatattacttagtataatacaaaaatcattctgtttctttctcgtgtttccacaatcaatcgacataattcagttctctaatattcttttatcatatatttccttcatatttacaatcatacgttatgaatccttcctgccagcatttttcatttaaattgtgctcttcatattcaaaatattgatttttttttattttatattttgatttgtatttcttaataaattttttaaattcttttttatttctaactatttttattaccgacaattcttcctcctctccatctttataaatataagtaaagataacatatactgttctttgcttagccacatctaatcctacaacttcaaattcttcaatacaaaatccactgggataatccttaaatcctaccagttcactactatatttccccttcacatccaacgctttatcataagatgtaaaaacccctattattttataatccttagtttcatcttcaaatacatgtatgtgatacatcaaatagcatttcattttttctctctattctttttaatttcatgttcaataaaaattcttcatttcactggctttgttgaatcctaaatttcttcattttgcttatgatcctcatacaaaagcatcatcttacaaaaaatgtcagggtattatttccccatttttcctgatagatcagtccatccagcgtaacatattcatgctttacaccatttatagttttactgtctctaatgccgtctacatcatatgtaaatgttatattttttccatcagcagatgccgaagaaagctctcttcccttctcccatgtgaatttccatttcttaaataaagatgatttgtttgatgacgaggctggtgtagaaggtttttatatcttctaaaccggtgtcgttctatctgtatgccctcctctgtgcgggctattttcgttcaatgattcgccaaaaatcgaactttcctataaagtaaaaaaagaaggcagctatataaccgacttcttctagagcgtatttgaaaaatgctttctgcaagatgtgcgtcgcaatttgcgggagatttcgcctgaatgaaggcggcgtagcgggctacggcaactgaatgaaggcaaaatataccgtaaattaaggcgtgcaggttgtaggaatgatttttcaaacacgctctaaactatgcaaaaaattctctggtcaaaattgattcaacctatctcttacaatgactttctaaactcttcttcaatccctataattgtttcgatcaaatcatctgcactttgatacttatatcttccaaacataattccccagtctatcatgagcgacagtaccgttgcattacgtttggcatctttgttctcaatcacatcaaaatccggatatggtatatcacttacagagcggaaccagttcaccatgctggcatatcccggcatgtccaccataacttcctgcaaaatgctttgtaacagtccctgctgtccgcggtatctttccttcacacttctttcccagcataaagtaaatgtcttcatatatgtttcgattaatgactgaatcgttgctaacagatatgccttaaactgctttctgttctgctcggacgagaatcgtttaaagcaggctgcacagtactgggaaatgaggttgccaaccagataaccgaggtcgtaaccaaatggtcccatgaaggcgaactccatatcaatgaccttcatctcatctcgtgaagctaaaatattcgatgtatgtaaatctgcatgaatcaatccgtctgcatggctcataaacttacggcggagcttataaagctctgtgcggtatctggaatctttactgaactgacttgcaaaatctgcaaagttatttcctaacgaataatcaacatcacagccaaaacaatctaaaaacatctggtcttccataatctttcgaagttctgtattctcaaaatgcttctgcagtccacgatacttctcacgagacagataatactctgatgtacagaattcggtcttcgccataaactcaccgcactgacggccaagctccggaaacatcttgttcttatttaactgaaaacggacaaccttcaaatccgaaacatcttccatcacaaaaacattattctctctgtcctgaaacttaagatacggcacatactccggtgtgatcgcataaaaaatacgcatactgttgtactctaaccgattacggtacgttgcgatctcctgctggcttactctgctgatatccgttccctgcttcaataccagagattccttcggtgtctgcactctgtaaatgtaattcacatagccatctccgtcttcttcttctgtcccctctccaaccatactgatattcacagggagagaatcatcaaaatccggcaaatgctcttttaaatatggaataatattttccttcgtaatcttaatcatacaattcccccaataatcttctatccgaatctatatttatctacattttttctgattatcatttaactctatagacaaactctctcataattattatagcctaatattatgaataaaaaaagcaaaatgtttgtctgtgaggtgggaaaaaatgtggcattggagacagacgaaaacctgaaaatcctcatatatcacaaatgcttcgtatcactgcgtccaaactgctcaaccgcaatttgaacttgctctaaggcgcatttgtgatatatgaggattttcagattttctgtgtattgaacattccatgtttgccacttcacaagctagatgctgtgaagattaaccccaattgctgtgactcatattatgaataatattaaatttgattccttctggcattctttattgcctgtcttagaaaaaacagaagctcgataatagatgatatttcaagaatgccccggcattcttgaaatatcatctattatcgagcttcgtttattttctcaaaaaaggcaataaaaaaatgcccagaaccggaatcgaaccagtgacacgaggattttcagtcctctgctctaccaactgagctatctgggcattcgttgtattgctacaacgtctaatattctactttataaagtaaattttgtcaatacaaaatgcataaaaaactctaaaaaaattcaaaattcttattctccgtactccgcgatccactccgcaaccgtagagaatatttctttattcaggctgtaatatgtccacttgccattctttcgagcctttaccgctcctgcctgcaataaaattctcatatgatgtgacaaagtagactgtccaaagtccatctcatctaaaagttcgctggcattatattccctttcacgaagtaattcaagaatccgcagtcggttttcatccgacatagcttttagtactcttgcgtgaacaacaaactttttattcatattatatatgatactcctttcactccgcaccgcctatagaagtgaacgttttctaatctacagtcacttctataagcgaataccataaacatctgcgatgctaaaactccggcgagctttgcttaaatctcccagattccttccttgttctccgttgtctgaagctcaatcttcttatcagaatctttaatcttgatttctggattctttacgattacctttgtatgtgccggaacagacttcgttacaaacgctccacctgctacgataacaccctcaccgatttctgtctctccaccaagaatactagctccagaatataccgtaacattatctttaatcgtcggatgtctcttcttaccctttaacttctgtccacttcttgtagaaagcgcacctaaagttactccctgatataacttcacattattaccaatctctgttgtctcaccaattacaacaccagttccatggtcaataaagaagtattctccaatctgtgcgccagagttaatatcgattccagtacggctatgtgcatattccgtcataattcgaggaaggaatggcacatcctgtgtatacaactcatgagcgattctataaacaaaaatagcaaacaaccccggataagaaatcacaacatcctctctgctctttgcagcagggtcaccgtcaaatccagcctgcacatcttttaaaagcatctgctgtacatatggaagcctcttaaaaaattcctcacagacttcttctgcccgctcactgatttcttcctctgtatacttttcataatctctataatacaaagaaatctcaatctgcggttttaacttaccataaatatctgtcagacggtcaccgataaaatactgcggagaaatcaacgcaatattctcctctccaaaataaccagggaacattattctctttaaatcctttaaaatacgaataatacaagaacgatcaggaagacatcgttccccccttgatacgataaaatctgttttatggcaactttccgtcatctgaacggatgcattcaaaataatgtctttcattgtctctttcataatttaagtctcccaacaaattttcagaagcatctactcctcacttgcaatataaagggcatacttctgaggtatattgatatacctatatttatgctaaattataacaaacaactacagaaaatacaattcccaaatactaatttgatggactaaagagacgaaaagcagaaatttgatatagaagaaaatgtgaagatagtcgcggcgtagaaaatgcctgaccggcatttttactggctccgacatcacattttcttctatatcaaatttttgcttttctgctatttggctccagaaggaaattagtatttaaagattggatgggaataaggggatttcctagaagttaccactcttgatagttggctatcggtattttccaacaccgccgaccaaagcgtgttattctgttttaatgatttctaagacatctactccaagaatcttggcaagccttccagctgtttctggcttaatgttcttacctgttataacattagtgagcgttccgaccggaaatcctactactataatttctttctgccccatgcaggctctagctttagcaagttctaatttttttctgttgattttcatttgttttaccacctctcaaattcaacaaaattggttttttcttgtattttaaatcaaaataattgtttttctatttacaaacacatatctttgttatattattaaatcaaagaaatcaagaggcggtgcatatatggaaaataatagtttttcggaaaccttttctaaaaatcttgcagagttattaaaaaataataatataaatcaaaaagaattagcaaaaaaaataggggttagtccctctacagtttccatgtgggcaactgggaatagttcacctagaatggatttattagaaaaaatagcggaagtatttaatattaccccatctgttttattaacagatttgtctttagattcatcgcaaaattatataatccacgccgctctacattcaaaacataaatcgaatataatatatcaattaggaaaagctgaaattgattttttaagcaaaaagggcgagttatttaataatttcatgtccttaaacagagatgggcagacaaaactatatgattattcctgtgatttattagaaattccaaaatatagagctgattccgctcctgatcaaggcaacactgccgccccggatgaacttatggcagcacatcgaagaactgacatagagtcaactaaagaaggaatacagcacgacttggatataatgaataatccttctacccgggaataagtacccttgtttctagttgaagtttttctgtacttttgcgccggcacaatttccaaagaataaaattactttcctggaaatatatagaactatacaaatttgtacaaaagacaagccatacttaacttgtaaggctcacacataagagataataactaatttatttgtaaaatagtacccctatttctaggagttctataacctcgacaatataacatacttaaccaaggaaccgataagggtgcaaatgccaaccgccggacattctgaaaggggttggtgcttatggtaacttatgaatcactattctcatttgtaaccatgatttgctctgtaataacacttgttatttacatatcacgcaaaaaatagcgccctcggtctggtaaactaaggcgctactttttgtagtcaattatttgccggcggctaggcttcatctagtcatcggttcctttgttaagtatattatattctatgccgctcccattgtcaaatagaacacaaaactaatttgatggactaaagagacgaaaagcagaaatttgatataaaagaaaatgtgaagatagtcgcggcgtagaaaatgcctgttcggcatttttactagctccgacatcacattttcttttatatcaaatttctgcttttctgttttttggctccagaaggaaattagtatttggatttgaggaagaataaggggattgtccagaaggctatgatttttaatcagagaacggtttcgccataagaaaatattcttcatctggagcctttattgtcaatcctttagaatttaattttccggaagaccatagccttctggcacattccatgttgttaaaccatagatttagatagtcagaaaaaagaaataataccatatcccagatgcggcttcggagcgtgtttaagatgcgaatgagcattttaaacacagcgactacagagcagatgggatatggtattatttcttttttcgtctacacgaaatctacaaattagtattttagaagccgcctccagaaacatcgagctttccatcgtcatctgctgctgttccgtttgaaccacaccagttacacacaactttatcggagccgtcatagcagcttacttttccgcagtttccgcagacaaaacacttctttgctccacagtaagggcagcctgggtattcttcgtctgtgtaaaagcttccggtaaagttgattttatcgaagccttctttttctgcagtttcttcttttaatttaaaggcccatgtacgaacccagtcattatctcttttttcaattcgaattccgtaaagcttatcctgtgcacattttgccagaattacgcttgcctctttcttcattgcgctgtctctccttcctgataaacgaaagcaatggaaatatcgtctccgctgccttctctcgttctcttttcaaaattccgttttaaactctttttcattttttcggtatcatgaaacatatgagaaagtaatccatgatattttaaaaagtcttcttcgcttgcaaatgatttaaacagtccatctgtggatacaaataatgcctttactttttctgttgtataccagtgttcaaaaaaatgtatcgcatcggtattacagagagaagatgtatagtttgcgtgggaatttttatcctcgatcgggataaataattcgtcattctctccgagtacgacaaaacctccatcaccgagaatcattccgtaagaaaagtcttttgtcaaaaccgttgccagtacggtacttccgtaaataacagctgttcttagtctgccttttgccttttcgggaatcttgctttcttcttcctttgtgagtgggttttctaaatgatattcctctaccgcttctctccacttcattaaaatctgtttttccatctgggccagaataaattccggatgtttgaaaaactgttctttaaaatcagaacggttcatataattttttaataactttgtcgtaatctttacagcaatcctcgaacccacatcactgcggaaatgcttggcactgccatgtccatctgctactacggctatggcaaactgatcggtaactacggttcccgaactgtcctgacagacaatgccctttctaatatggctgtctccgattactgtagaatgtactccctgaaacattctaccatccctcatcaaattcaatatccatatcgccaagatcggtaagatcgtctactcccatgatatcctgtttcatttcctgtacagcttctatcatctgttccttctttgctcctgctacttctgcaagggaacgctcaccggtcgcatcggtaagtgtcatgctcgtgcttccgatcttagaagaagtaaccgcgatttcacgaacaagctttttcagcatttctgcaccgcatgcctgaagtactaattcttcatcatccgtaaattctcggagtacatcaagatcgacattagaaccaattgccagtgcaatctttaagccatactggaaccagcggtttttctttaacatttcaaaaccttttttgtagttatctgtcggatatccatcggtcatcaggaagataaccggtgcataggaaagggaaggtgctcttaagaaactgtttcttgaaagcttctgacaaagctcttcacaggcatctcccagatcggttactccatctgcagaaagattctcccatctctgatattcttcaatcaataccggttccggtgtaatccattcacaaccggaagaaaacgacattacagcaacttttacatcggttcctgcctcaccgacaccgatcaattccggtaaaatatctcccataacacgatttaaagattccagctttgaaccttccatactttttgaagtatctaccaggaaaaaaatgaccatactttttttggcaggcggcatagtctctaacggatcaattgcctctatactctgttcttcaaactgtctgctcatcctcatcttcctttctctcctccgtctgctgtaccagacgaagattccattcttcacctaattcaaatcggacagacattccattccagataggaattccctgtccatttggaatatcttttaatttcccgtcaggataaaatcctctccagacaccctgacttacatttttaataccatacaggccttttttctggcgattctccacgatcagacctgtgaccgtatctttatccatcggattccgaccggtctgacactcataaagtttctccccttctgcaagaagaatccggtctaatccgttcgttaatggataataaatctttccacacttcggacaggccaatgttccgttctccttttgcagcaatctataagaaaatccatgaaatccgcaatggcaggacttataatccatcgccattcttacaagaagctgcttccagtccacctctgtcggtcgaagttctcttagtcttccgccatcaagaaatgccttctggaacatcttttgtaaaatctctggatattcattccagtattgaatcaatttatcctgaattcccttaaccggaatattctcctcctcacccggttccatgcaaaaacgtccttcttttgcccggaacagttccttttcctctggagaaaggaaacagcggttcaccatctttttcccttcaaatggggaacctgtatgaaagaaatattcaaataaatataccgccatgaaataacggtctgtctcaaaagaataacattctctgaatgtttcaacatcctcagaaccttcctgttcttctggtccttctgcaaggaattctactaactcaggagcaaggaactccgtaaaatctgtcttttcgacatcaggagcctgcacataggcttcgccaagaagctcttccccttcaaaatgaaatgctccacttttcagattaaaataaaatgcttccggagaaatactacaataaaccttaccgttttgatgcagctcttcaaaaaaacgggcaaattgatatgctccttctatcatcgcattcattgaagaaaaatatgccgctcttaaaaccttttttccggtttctacgtctgttacaagctgtctttcgtcacatatttctgcaagagaaacccagccatttttattaaatgcactcatcctatcctcctacctacaggagaatctttgcaatcagattatctccaaaatcaatctctaagcccgaccagattggtacgcccttgcccggtgcaacttctctgatggaattatccggaaactttgccttccagacatcatccgacatatttttaataccgaacagccccttctttaaacgattctcaattaccattcctgttaccgattcaaagtcatcactattcttcgttgtcagacatttatagagctttgcaccaagattcaatggaagttcataatcttttacccccattgtataaatagtacttccacaattacgacaacgcagtgtatgctcccctgtcttttcaaatgaagaagaaaacgccgtctttccacagctacagtgaataatatcaagctttaactgaatgagcatctgaatccagctcttttcaataattctggcattcggctcctgaattccatacgtaaaagataatgtaaatgcctctctgataaagtcagggtaaatcttccataacttgattacgttatcatggacaccgtttaccggacgattcgatgcattgcccggatcataaataaataccggatcttttccgtaatggatcagatcattctcctctgtcataacaacgcactgcaatactttgcttccttctaacgggtctccgcggaaaaataatttaaataaaacgactgccagtgagtatctatctgtcagcacatctggctttgcaataccacgcacaacttccggtgccataaagccaggcattcctccgattccaaagttatctccatctgccgctacgttatcgcagtcgcaaactaaaacatcccctgtttttgtatcaataaaaaatccgccatcatttagatcctggtaactcttacccgcaagatgcagtgcccggaatgccttaacgatgttgatcgctgctgtgagcatcacatcaagagaagcaaacttcaccttgatctttcttgccggctgtccttttacccgaggcttttcccagcgatatccattataaatatccgtaaaagactcgtagcctgatggtgcaagacgcatcagataaccaaaagctccgttcttcttcgtttctgtcaggaataacggccagataaactgctttccgccttccggcgcaccatcttcaatgttcttacgaagattattacgaaatgcctccgggttctttatccgactgataaaataccatttaagcgcatattctctgccattataacgcacaagataaacaataccctgcccgcctcgtccaagctctcttgagacaacggcctcgccgcctgcctctattggaattctctctccaatctttaactctctcatctatgttctaccatccttcatcgtaattcacagcaccaagatccactgcttcaccaagaatatcctttgctcctgtacgaatctcttccacaagaacctgctgcttcgcctgtgccacagcctcctctgccgactgtcttccattcgaatcaactaaagcaagactgcggcttccaatctgagaagaagtgaccgctaaaagcttaatcaattccctaagctgatctgcattctttgcctggacagcaagctcatcgttcccggtaaatgcacgaagtacatccatatttaccttagaaccgataccaagcgcaatctttagcccatgctgaaaccatttattctgttttaatgtatcaagccctttcttccagtcatcattcggagaaccgtcggataacaagaatataaccggcgcaaaagaaagggaaggagaacttaaaaatgtactgcgcgaaagcttcttagaaagctccaaaaatgcatctcccataaacgtaagaccgtctgcctccagacgattccagtactgatattcctcaatcttcaccggctccggtgtcacccactctacatctgtagaaaacttcatgatcgcgatcttcacatctgtagaagcctcgccaacaccaatcaatgaaggtaataattcctccatcgtactgttcaaagaaccaatcttcgttcccttcatactgcctgacacatcaatcataaaaaagattgtcatactcttcttcgccggttccatcgtatcaaggaaatcctcctcagccgcatctgccacttctgatacttccggtgtgtcaagaacaagacttctgctcattcgattctttttcaaaagaatctcatcatcatccacttcatttaaatcaagccactttggcataaaagtaccccctttggaattatcttttcacgtgctatgacaagaccagaatttctcttctagtctttaacgccatcctgtcaccattatataacaatttacctattttacaaactgctttatctagttctttgagataaattcttgcacgaaaatttgtaaggttgaagaaataaacagacgaacccgcatctcctgtaatctataaaatgcttcgtttcactgcgtccaagctgctcacccgcaacttgaacttgctctaaggcgcatttttatagattacaggagatgtgggttctgtgtatttcaatcctacaaattaattcattcaagaatgcccctatttcatttcatggaaaactatactcttatgaataatatccaaatcctacaacatgaattctgattttgcttctccagccaaagcacagccatctggaaataaaagaatctatatttgtggcctcggagcaagtgttggatacgagcggttagagtgagtattcaacacgctgcgactaaagtcacaaatatagattcttttatttccagatggcgtctactttgcctgcggcaaattacaattcacaattattcactgttcttgggaatggtatcgcatctctgatattagaaattccggtcagatacataacacatctttcaaatccaagtccgaatccagaatgatgtgtggagccatacttacgaagatctaagtagaactgatagttctcctcatctaatccaacttcttccatacgttttctaagcagatcataatcatcttctctctggcttcctccaatgatttctccaatacccggtacaagacaatccattgccgctaccgtcttgccatcctgattcagcttcatataaaatgccttgatttcctttggataatcggtcacaaagacaggacgtttaaacacctcttctgtaaggtatctctcatgctctgtctgaagatcggttccccatgatactttatattcaaattcatcgttatgtttctcaagaatctctacagcctctgtataggttacatgtccaaattctgcgttcagcacatgattcagtctgtcttttaatcctttgtcaacaaactggttcaggaaatccatctcttctggagcattctccataacataggaaataacatatttaagcattgcttccgctacttccatatcatcttttaaatctgcaaatgccatttccggctcaatcatccaaaattctgccgcatgacgcgcagtattagaattctctgcacgaaatgtaggtccaaaagtatacgtattacggaatgcctgtgcaaatgtttctgcgttaagctgtccgcttactgtcagattcgttggtttgccaaaaaagtcctgtgtaaaatcaaccttttcttctttatcctttggaatattattcaggtcaagtgttgtcacctggaacatctctcctgcaccctcacagtcacttgctgttataagtggtgtatgcacataaacaaatcctctctcctggaaaaactggtgaatcgcataagccgccatagaacggatgcgaaatactgcctggaacgtattcgttcttggacgaagatgggaaattgttcttaaatattctaagctgtgacgctttttctgaagtggataatctggtgcagaagcaccctctaaagtaacagatgttgcctgaatctcaaacggctgctttgcctgcggtgtaggaacaagaattccttctacgatcactgcagctcctacattcattttagaaatttcctgaaagttggcaagtttttcttcatacacaacctgaatcggcttgaaaaatgttccatcatgaagtactaaaaatccaaaatgttttgaaccacgaatgcttcgaatccatccgccaagcttcacctctttatttaaaaattgttcactgttcttataaatctctcgaattgtcatgatatagcaatcctttcttataattatttttaattatttttggatatgtattctaattacttttaattagaaaatcccgcttctattttatcgcaaacctcgctgaattgctactgttttttgactctgttttcatcatttttatatccatctttttactttgtatatattacaggactgattggttaatgtattagatatgtacataatataaacccttcggccagaaacaatctttatcccttccggttctctgtaagaaagtctttttgccccgcgaatcactactcttctgctggctcctgaatcaaaatcatatctccgaatccttgtcggatgatataccgcagaacagttatgttcccgattatatgctttcaaaaaagaccttcttggacttccgtctattgtataaacggaactttcatacagatcaaatccctgaaaatccccataagtagcgtcaatgctaaatctctttacagggcctctcggattaataaacttcccgtcaatcagattataaatctgaaaatactgtctgttattatatgtataacgtactgccatctgtgtattatcttcactaattgccggataaacatttgtcatatacttgccaattcttatatccggaatcttatatcggattgctccatgttttcgaagtgttgtgtttttccgatacggaaatcctgagattgctctagatacgtcacttccctttttacagtcacttcctgtccataaccaggttcttccattcaccgtagaacaatccagattcgttgcatgtccgaatctttttaaatccatatgatctctcgtatagcgacccagtcctctgtatttcaccctggtaatccgcagattcccacagtagggctttgtcatctgtatgtaataataatatttcgaatccatcgtaaatgactggatccatctttttgatgcaagctttgtaacctttcgcactacctgaaggtcactagatgacggttctcttggcgtcacatcccgctttactacctttgcctctgcttttacgcaatgactctgaaatgcagtacaaaaagcaaatgcaaaaaacatcatccacagtatctttcttttttttgttctcataagtctttcctttcttttaatctaatttattattcaaaaatgcctcgtcattcctgctacaagatgcgcgtcatgcaacgtagcagcttactggtcatttttaactttttacatagttaaactgtaatttttttataaaatgtagtatagtatagttactatatatgtgtagcaaagaggaggtatactatgaaaaaaacggacgaacaggaaaggaatatagcctcccggctgtataacctcgataaaaaagtttatgaaacgaccggcagtactttaggtcgtgtttttccttccagtccatcgttcgctttagagaaaatcattgattcccttaagattaaccgggaatattttcttaaaaacgaaatgaccctaatcgccaatatgatcggtacaatcaaagatgaggagaaatctgccccactcaaacaggaatatgacgaattagagaaggatattctcgcctataaccctgctattattttaccacatagtatcgataataacgatgccgttgcttcccgtcgtttttcttctgataataatctcatcatatgtatcagcagacagttcggtactggaggccacaccatcgggtttgaacttgctcaacgtcttggcatcgcttactacgataaagagattatacacttagcttgtgaccgaatggggttaaattcaaaagaaattgtagattatggcattgatagttccggaagcagtcgcggaatactgagtaatcttggaaaagcttctaaaaagttcttctccatacagtctgatatgctctttttcacccaaagtaatcttatctgcgaaatggccgcacaggaaagctgtattatcatgggacgatgtgctgatgtcgttctcaccaataataacatccctcatctttccattttcttatctgctccatttaaagaaagagtaaaatacgaaatgggtattgctgcctgcgactataaaaccgcttctgctaaagtaaaaacaatggatcaggaacgaaagaattattatcagtattacacaggccgtcagtggggatacgccggcaattatgatctatgtgtaaatacattcttttacggacacaatgagacaattcaggtgctttacgatatggccgaattatcctgcaagaaaaattaatcggaggacactatgaaatttcacagagttttactatttacttctatccagatggatatcacaccggtaggcgatgatctccacgtgctacttacctgtggtggtgaaaaccgccttggatgtaccgcattttccacaccgcttccagacactgaccccgtcgaatgcgaaacatctgtcattacagatgtagaaaatccagaagatctcttctgcccatacattgcagaaaacctctgcaaaaagaccggtcaacgcgtgctatgtaccggcggcatctttgttgaggaaccagatgcgcatcagatcgataaactttatgaaaatattgatgaaatgataatggactgggtacattttttagattaatttagaggaatagacgaaaaaagaaatactaccatatcccatctgctctgtagtcgctgtgcttaagatgctcatccgcatcttaagcccgctccgaagccgcatctgggatatggtagtatttcttttttctgtgttttggctccagaaggagcggctacattagtctttgggagggatgaaggaggagagaggtcagaaggctgatgcttactcaaaaagtatattgtccagaagattattttctctctttaacgagcagaaaaataaagggggattgtctttaggattcgcgaaacagtatcagaataaaccacgaccttctgccctcttctccttatcctccctaaatactattgcattcattccttctagagccaacaaacagaaaataaaaagaatagaccatagcaaatgtaatgtgagagcaagtaaaaatgccggacaggcattttatacgtagcgatatctttacatttgctatggtctattctttttattttcgtctgtcctctcctaatgaatagtaatcgatccattcatctaaggttcgtggtatatagtctgaatacatgcaaaaacagttgaacatattacagggaatcggcataggttcttcatcgtatttcccctgtttttttgtctgtcttgtaatctggcagaactgccgcacaagctgttcatcgagtgtatcatgtacgtgaccgtagagcatgtaggtgagtggttcgccttttttatttctgcgatactgtccgttgtaacagaaaattgggtaatgggataagactacttttcggcggttatcatgcatctccgcataaggttttatccagacaaagcgttctttattgaactcgctttcttttaaatatctgtcatgatttccttttatcatataaagtctgccgttaagctgatttaaaatctcatttgtctgctctgcttttcctacggaaaaatcgccaagaatcaccacctcatctctggttcgcactctactgttccactgttttatcatataagcattcatttgtgctgcatccttaaatccacgacagtccatttgtgtatttagactttcgtgaaaaaaatgcagatctgaaatataatatcgcatactcttcttactcctctctaaaaagttctgtctaatttaattcataaataaaatcctttcgtttgccataggcggaaacccactacctttaggtggtgggaggagccttgttaactgttacccaatatgctacaatagccgtagcagttcttaaagagaaaaccgttagatgtgctgctcattaaagacactcttttgtacattgacaagatatgaggttgcaatacgaaattcgtgtattgcgtaaaatcttaaccgtaaaagatttttttactgtatagcatgggaagtttagtacctgatacagttacagatgagcatgtcttgtctgtaaagggtgttgtcagccgccctatgatgtaacgccactttagatagcaatatctatcggggattaaaggtcggaggtgtaagccgttagtacgactgggcagttacaagcccatgacctttaggtcgtgggtagttgactaggtgaatgggcatgccgacaagctctggttttaaatgaataaaatctgactcgtttacaaatatgatttataattttaaccccgctaaagcaagctcccgaagcaagaagataccctatatctgtggctttagaatgaggattgaatgtaaagcttttaagaaaacattcacctcgcagtgatagaatcacagatatagggtatcttcttttttaagaattgtctagagcgtgtttgaaaaaggctttttcaaacacgctctagtgtaattaaattaccagatcatccacagaaatattctttccggtaagtccgataaaggctccttcttccccactttcttcatgagcgataagccatttattcttggcaaaaagtaacttttcttctggcaatttttctttctctgcttctgctccaagtgttacacctagtggaaaattggttccaaatggtaaaacaactcccatcttaaatgcgtagtcattctcttttgttccgatcggtacataatggagtgttgttgcatacagttctactgcggttcctgccggaacgaaaaatgcttctaactgtgctgtatcatatgtaaagtcttctgtaatatctgactgatgacctagtaataaaataatatctgttactgcaacattcgcctcagaagaacgatgatattctaatgcattcagcatcttattatgtccactgcaatatccgatttctacggaaagttcaccgtaaagtgtgttagataatttctggcggaattctggttcttctaacggtccgaaagatgctgcatattccacatcttctggataatccatttcttccaatacattataaatctctgagaaatcaatgcctgttaaaatctttccatactttctaaaagaagtgtctgttacctgtttcaccttcattataaagtccccctgtctttatatgcggctatctcttattggaacgccgccatatctttcttttttcggcttccttaatcagttcatctctgaaatccggatgggcaatggaaataagcccctctgctctctcccatgttgaacgcccttccatattgatcactccatattccgttgcaagaaaatatacctgactccgcggagatgtaataatatccccattaaactgcggcaatactcttgaaaaaagctgtccgcttttatctttatacgtagagcccatacagataaatgccttaccccctctggctgaagatgctccgattaaaaagtcaagctgtcctccggtaccactgatctgccttgcaccaaagctctcggatgatacctgtccatacagatctacagaaacacagctattgatggacaccatattgtcaatctgggcaattacatccggtctgttcacatattccagtggatatgctgctacaccatgattatcatctaaccattcatacagttctgctgaaccaatagctacaccaaatacacccttacccttatcgattgtcttctttttattggtaagcttccctgctttatataaatgcaggtacgcatctgagcaaagttcagtatgcatgccaagatccttaagatctgattccgcaaacagttcaccaactgcattcggcatacttccaattccaagctgcaaggttgatccatcacaaatatacggtagaatattctgtacaatctttcgatcagtctcagtcggtgcatagcgcctgactgtcgtaataggttcatgtcttccttctacgatataatccacttctgacacatgaatacattccccatatccaccatggatcttcggcatatgctcgttaacctctacaataacaatatctgcattctgcacgataggtccggctactccggtatttaccgaataattgaaatatccatgcttgtccatcggtgaaacgctgaccattactacattgacattcagaaaatacttataataggctgcattattgtgaaataccatcggaatatagtaacatagtcctctgtcacaaagctttctctcataagcagaacaatgccatgtatgatagacaaaatgttcctgactttcatcacattctgccacttcaatcggtccctccataagattccctcgaatctttacatcaaaaagttcatctcttcttttagcaagagcccgatctaaaagaaccggctttccaagtgagctggtataatcaacccagtctccactctttactacttctaccgcctcttccggtgtacaaagcttttgtctgtactcagttgtaaaatcctttaacaccgttgtctcctctctgtatttctctcttctttgccagttatactggcatttctcccaattctttcactgttattttaccaaaatttgtgctaaataacaagaggtagattgagaatagacgaaaaacagaaatgttagattatctccactgtgaagatagtcacggcatagaaaatgcctgaccggcatttttatttgctccgacatcacattggagataatctaacatttctgtttttctgtctactctaaagtgtaatggtttgatagggagacagatattgctgaaacgagattataggtctgaattatatataagattctaaagaaaagagaatttttataagtttgattttgttccgttgcgctaaacgcttcattttgcctcaaaaaacgaaaacttcgaaaaaacaagcccgaagttttcagagtcaaaattccacagcacaaagtcacaaaatgcaatacttataaaaattctcttttcttcactatagttttcttacaattcagcgtaaagttttacttatagaaccctttcttcataagataaaaatagttagacagatttatttctggagatttttatttgaatgaaaattgtagacctttggacaatccccctctttccctcaaaataaaattcctgtcactatataggaaaagtaaaaaatgaagtatgtattattttgaaaagaatgattcgcaacatattaaatttaattttttctttgggattaacagtgcgattacaaaaataatttcaagaatatcaaaagattttaaaccttcatttttttgtgtagaaaatattataaaatatcctgcgctacatatagcgaaagaagaaagtattagaatattgaatccattccttctggagccaaaacacagaaaaaagaaacaataccatatcccagatgcggcttcggagcgtgcttaagatgcggacaagcatcttaagcacagcgactacagagcagatgggatatggtattgtttcttttttcgtctattcagctttacaaataagaattatttattcagttttttagctgcgatcattgtctctactacagctcttactacagcttctaatccttcttcgtctacagtttcttcttctggaacgcttaatgcagctgttacgatagacatactgtaaacttcttctgcgttacatccgcggcttaagtcgttgattggagcgttaagtccctgtaatacagggcctactgctgtgtatccgcctaaacgggaagcaatcttatatccaatgttggctgcgttgatgtctgggaagataaaggtgttagcctgtccagctactggtgaaccaggacattttacttctgctacttctggtgatacagaagcatcgaactgaatctcaccttctactgctaattcaggagcagcttctttgatcttctttgttgcgttagcaacctttgttacagaaggtcctttacctgatccaagtgttgagtaggataacatagctaccttaggatcaataccgaaaatcttagctgtcttagcggattcgatagcgatctctactaagtcgtcttcagatggatcaatgttgatcgcacagtcacccatagcaatcttctcgtctcctcttacaaggatgaagcaggagcttacgatgttattgcctggttttgttttgatgagctgaagagctggacgaactgtgtctgctgttgaataagtagctccgcctaacagacagtcagcgccacccattttaacgagcatggttccaaaatagttgctcttagaaagagctgctcttacctgttcatctgtcatcttacctttacgaagcttaaccatctctgctaccatagcatcgattccttcgtagttttcagggtcaatgatctggcaggcatcaatattaaagttgcctgcttttgctgcagccttaacttcttctggcttaccaagaaggacaacgccgagaattccttcctgtgtcagacgatgggctgactcaagaatccttttatctgtaccctctgtgtatacgatagtacgaggattcttctttaatgtttcaatcatttttgttaacataagatacctcccaaatatatctttgtctgaaaagtagtatcaataatagtacaaaatacgctacttatatagtaagccctgtgcacatttttttcaacaacacattgatataattttttgactacatcatataaaagaaagcacaaaaatgcatcggaatttgtataaaaatcccgatgcacctttcattttttgatattgtaattatactttcttgtaaatttgggaaagtcctatcacatctgatataatttattccaatgctgctttttgctgctcttctgcatcttccggattctcatggaaaatagaataggcaatgttagtggaatggtcggcgattctctcaagaccgattaccatatccgtaaagataagaccaatttcaacaccgcagatacctttagaaagacgttttacctgctggttctgataatcaatctgcatctgatctacgtcattttccatatcaataatctggtcaatgttatcttttttatttgtaacgaacatttccatactcttatcaaaaagctcaagtacttctttgtacatggttgtaagctcttctttacctgctccggtaaacttctcgttaagcttacttctcttctctgcattctcaagaatattgatcgcatggtcaccgatacgttcaaggtcgataacaacatggaacaatgcaccaattcttctggaatcggcaagtggaagctcatagcggtttacttctacaaggtagtccgtaatctcgctgcttaagtaatcaataatcttttctctggcattgatttcctttgccttatcaagattcttatctgctaatgcctccatagaagcaacaaggttttctctggcaagacctgccattctctcgatttcctgaataatttctactacggctgtagatggcacaaacttgcttgatgcctttctgatatattcaagatgtaatccgttatcctcttcctcaccttctttatttccaggaataagaagcttcgtaagttttacaaactgtgatgcaaatggaaggaaaataattgtctggaatactttaaatgctgtatctgcattcgcaacgaaacgtttcgcattatctgctccaccgagaacagaaatcgcatccacgatctggtttcttgcaaagaacagaattgttccgataatgatcatacctaatgcgttaaataagaaatgtaccaacgctgtacgctttgcattcttattggcattcattgctgccataactgctggtgtacaggaaccgatatttgcaccaagaataaaatacagacaacttccaagtcctacaagatgggaatctgctaataaaactaatacactgaccgttacagaggaactctgtactgctactgtaaaaatcaatccgacaagtaatgcgataaatggattcttcagataagagaaccaatgcatgatcaccggatattccggaattctgctcaacgcacctgtcatactgttaattcctaagaataatgcaccaaatccaaagattacctctgaaatctttcttgttatcggcttattgccaaacatcatcaggcaggcacctacaaagatgatatacggtgcaatggcagtcagtttcaaagaaacaagctgtgcagtaattgtcgtaccaatattggcaccaaatgtaataccaacggactgttccaatgtaagaagtcctgcattaacaaagctgacctccataaccgtagttgccccggacgactgaataatcgcagtaaatatcgcaccaaagaaaactgcaacgaatcgattcttggtcacacgatccaaaatgacacgcatcttgtcacccgcagccttctgcagcccctcgctcatgaacttcataccaaataaaaacaaggcaagtccactcagcagttctgtaagcataactaacatgatattatcctctcttttgttttctacataattttgtaatgatttcttcaggtttctacttaaatcttacccaaatttttacttaaccattacattttttttacatgccattatgtattctaatatattttatcctaaaagaaaagtcaaatcttttggcatttccgactcgattctcattactttttgacaaaacggatgtatgtatgtcagtctatgcgcatgcaatgctgttcgggaaatccccatttctggaccatccccgtaaaaagaatcccctaaaagcggacagccaatcgaagacatatgaaaacgaatctgatgtgttcttccggtttcaatcacaagagatacaagactgaacttttcaaaacgcttcacaacccgaaaaaatgtctttgctgtttttgcattttcacccagtcctgctttcatttttaacttatctccatccttagaatccctcatctcttccattggaatttcaagaacaccattctctggaaggttcccttttacaaaagcaagatactcttttactaaaacgcccgtcttcctttgtctaatcagtctttctgctgtcacgctgttctttgcaattcctaaaatacccgaagtttctttatctaaacgcccaatcaaatgtatattacttctcttattattgaagcttcccttctcctcaaaatatgcctgtaccccattaatcagactatcgcatgtatgccctttcgatggatgtgacacaattccagtcggcttatccacaaaaagtaaatcttcatcttcatacaaaatatggagattcatctttaccggtgcaattttactctgcttttcctgcgaatcttccaacatcacttttaagagctgtccttcttttccccttgctcttactgtcactctttcctcatctagcaaaattccccgctcttcgtgctttacagagcggaccttttttgttgtaagccccagcactttttgcatcagaaaaagaacctctttcccatcgtcagcaggacccagccgatattgtaaaaaatgtgccatccttacctccagaaaaaatatatgaaacttttttgtcagttttgcacaaacttttaagtcccttaaaaaatacattaataaacttcaaatactgtcatgaaaaattatctcaaaaaaagcaactgaaaaaacattaagactacatcaattcatccccgaatgtctcgacattcttaatgtaaccttataccctatataacctgaaattactcccacaacagctccacctaaaacatctgttggataatgaacatataaatacattctggaaaatgcaataaaacaggttaaaataagcgcgatcttccacagtcttttctcccccgctaaataaagcgccactacagatgtaacagatgcggcagtatgccctgatggaaaagaataatcctgtggctttgcaataatcaactgaatcgctgtattcacatcaaatggtcgtattcttgcgacaagtggcttcaaaattacattacataatatcagatccacaattaatgctgccgccagaatcactccgctttttctcgtttttggaatcactaacaagattattgtcaaaagaatccatataaaacctacattcccaagctttgtaacattactcatgaaaacatccagaaatgtagttcgtatttcctgtatcaaattcaaaaattgtaattcaatccccataaaaccatttcctcctattcaagaattcccataaagtaaaaaaggcataaacttcaaaaaagtttatgccttatctgctttcttataatgccggcgatcggaatcgaaccgatacgggagtataagtcccgcaggattttaagtcctgtgcgtctgccagttccgccacgccggcaaagaaaaaaccggacaatccggtacttcttatgcctgatattgctcagacgaatgggcggaggtggattcgaaccaccgaagcaatttgcagcagatttacagtctgtcccctttggccactcgggaatccacccattcaagtcgcattactgcgcctgacaatatcgtattatatactattttgtttcaaaaatcaagaggttttttattaaattttgattcacctaccaaaacagacgcgcccaaagaaagacaatatcctatatctgtgactctatcacttgtgggttgagtgttcgcttaatggctcacattcaatcctcgttctaaggtcacagatataggatattgtctttctttagcagctgtctatggctacagaaccgaaattaaaatttaatattgaagtaacttaagaaattgccggaaggttatggctacttaagggactggataatcaacgagtgacaaagcaaagatttaatagtattgacattttcttactttataattataatataattatgaatgatatcaaatttcaatgggacgacaataagaataaaattaatcagaaaaaacataagatatcattcgaagaagcacaaagcgtattttttgatgaggaggctttaatcattgacgacccagaacattcattagaggaggagcgcttcataattttaggtcttagtaaaaaggctaatcttctggttgtctgtcattgctatagaaaatccgatacaattatacgcattatatctgcaagaaaagctactgtaagagaaactatatcttataataagaatctattttaatggaggaatgtattatgaaagatgaatatgattttacaaaagccagaaagaatccatatgctaagcagttaaaacaacagattactattaacattgatgtagataccatagattattttaaggaacaatcgaagcaatcagggattccctatcagactttaattaatttatatcttgctgattgcgtagcacaaaaaaagcaattacaaatgacatggaaatagtaatttgtagatttcgtatagacgaaaaaagaaataataccctatcccatctgctccgtagtcgctgtgtttaaaatgctcgttcgcatcttaaacacgctccgaatccgcatctgggatagggtattatttcttttttctgactatctaaatctacggtttaacaacatggaatgtgccagaaggctatggttttcattagaatgaatatctctagaagaagaagatactttcttactcgattgtataaaaattatatttacctactcctacctcatggagaatttttctctggttagctcacataatcttctggagaatccccttctcttttcaacagaaatcactaatttattatcaaaaccagacagccgctgaaacaaaattttctgctgaattgtaaggaaactatgataaagaaaaaagaatggttataagtattgcattttgtgactctgcgctatggaattctgaccataggaacttgggattcgtttttcccaagttcctgtttttctgggcagaatggaatgcttagcgcaacggaacaaaatcaaacttatcacaattcttttttctttagaagactccatacaattcagctcaatatcttctattaaagcggcgtctgtgtccccggtaaattaggatttttttatggtttttaataggatggaggatacccttggaagggtgatatccagtactcctgacgttaccggatgcaccttcttctccatcgtatagccttcctcattactcatgataacttccaccatatcctcgttatctgtaacgccgacttcccatacagaaattttaactcttgcttcatcaaagccagcattaatcaatacgatcattttttcagtgtcggtaaaacgcccatagcaaattaccttgaaaccgccatggagatacttgagtgagcctcgcatcagtgcggtttctgttttatgaatcgcaataatatctctgtgatactggatgagttcctgatcttctctaccccatggataggttctcctgttatccgggtcagtccagccgcatagtccggcttcatctccgtaatagagggttggtgcgcctggccaggtcatctgtatcattactgccgcccgcatgattcctttattaatgttttggttggcagcttctggtccaaggcttgcggtacgtcctactgtctgatttgttcttgtcaggaaacgggaatggtcatgattggacagctcattcatggataccataagtgacggatactgaaatcttgacatatgatataccattgcatcaacaaatgcctgtgtgttgccaagaagatctcctcttctctcatcgctgtgcttttccattccggttaagaaccaggtaaccggctccatgaatgcactgtagttcatgatagtgtcccactgatctcccatcagccaggagcctgcatcatcataatgttctgccagaatgatggcttccggattggcttcttttactgctgttcggaagtctctccagaactgatgattgaattcttcactctgccctaaatcggctgccacatcaaggcgccatccatctgcattatatggaggggaaacccattttcttccgatatgcaaaatgtaatcataaagctgtcttgattcttcataatttaattttggcaaagttttgtgaccccaccagccgtcataatcatcgttatacggccatgcattctggttataaaatttaaagaaatgacgatatggactgtttgcatcaacaaatgcacctttttcatagccatactgattctcgtaaatccgctctgcatccatccatttattgaaggagccgcaatgattaaatacaccatcgaggataacgcgcattccttttttatgcacttcttctacaaaatgtacaaagaattcgttacttgcctcaagattacgcttatctgtaacacgagaaatatatttgctcgcattcatgttattattttcccagtcaggtaatgtatttccctcatctacgacaatctttccatagtgtggatcaatgtaatcataatcttgaatatcatatttatgattagaaggagagacgaaaatcgggttgagataaatgacatccacgcccagttcttttaaatagtcaagatgatcaagcacaccctgcagatctccgccatagaagttccgcacatccatctgttccggataacaataccagtcatcgattttcttcgatggctcctttatataaatatattctctgtttaagacatcatttgacgggtcaccatttgcaaatcgatctacatagatctgatagaaaactgctccttttgcccagtccggtgtcgaaaagcctggtgttactttataattaaagaacggctctaagtctcttgccggacccttcttattgaaatagcagcagatacctccggaatgaatctcaaaatagtaatccgctatttctgttcccataaggaagctgctctcataaaagtcaaacctctctgttttggatgcgatgtgcatttcctttttctcaccattgacccataaatatacatgttctgcattctctcttgcagtccggaagcgaaccgttacttcatcccctgtctttggttcgagtggattcatatagttgctgcttccatctgtaaataacgcctgaaaattcaataccggttttgtatgatagctgtgaaattgcagtttttctgctacagaaagattccgtattagattttgaaccatctccataataaactacccctctgctgtttcttttctgtctacttataatctattcgtaattactttacaccttgcaaataaagcttttctttcttacttaccttcttactttctatttgcaggttctacgttaacggatttacctttaatctttacatttttcattgcttctaatacatcagaagcaacttctcttggtacttctacaaaagtatacttgtcgtacatatcaatcgttcctacaagattacctgaaattccagattctcctgcaatcgcacctaaaatatttcccggacggattccctgtttctttccgatattgataaagagacgaaccattccttcttctgcaccagtatcaccgaagtcttctttattgccagcatctctgccatctgcagttccaagaatttctgcaaggaaagctgctgctacatccattgctgtatagtctttttcatttacgaaatcttctaccatggaaatgtatttatttaagttctgatcttcgatatagttgtcgatacggtcaaaaatcttctctactcttgtttctgttacatcattgattgatggaattggctgtgccttgatctttgccttgcagtaacggcggatatcttttaacttataaacttctcttcctacaacaaaactgaacgccataccggttcttcccgcacgaccggttcttccgatacgatgtacataatattcctcatcctgtggaaggtcgtagttaaatactgcatctacatcatctacgtcaatacctctggcagccacatctgtcgctacaagaatatcggtcttaccgcttctgaaacggtgcataacacgatcacgcatcgtctgcttcatatctccatgaagtccttctgcaaagtaacctcttcccttaaggtcagctactaattcatctacgcccttctttgtattacagaatacaacagacagctttggatcataaatatcaagaagtcttgataatacctcgctcttattcttaggacgcacttcataataatattgtgtgatattcggaacggtcagttcctttctgatcactttaattgtctccggctctgtctggtaagctttggcaagctccataatcggctttggcattgtcgcagagaaaagcatcgtctgtctttcctcaggcactccgtttaagattgtctcgatatcttcacgaaatcccatatcaagcatctcatctgcctcatctaaaacaaccgtatggatattgtcaaacttcactgtttttcttctcatgtgatccatcatacgtcccggtgttccgataatgatctgtacacctgactttaacgaacgaatctgtttggaaatctcctgccctccataaattggaagaatctttacagatgccatatattttgcaagcttacgaatctcatccgcaacctgaatcgcaagctctcttgtcggacaaagaacgattgcctgtggttttttaagcttcggatcgaccttctgtaaaataggaataccaaacgctgccgtcttacctgttcctgtctgcgcctgtccgatcacgtctcttccggaaagctctaccggaatcgcctttgcctgaatcggggacatcgcctcaaatcccatattggcaaccgcttttaaaatctccggtcttatatcaagttctgtaaattttactgtctccatgtaatgtctctctttctatattaaggatgcaatagctattctctatcgcaaaaaaaaagctctatcatccaacaggaaatagagctaagttaacggcactcttgtctttaactgttatctacattttcttcttaaatatcatagcacaggtaaaaatagccgtcaaatagaaaattccttcctttttcccgctaaaatacagcacttttccacatttttttctaaagcattgagtttttccacattttaatgtaaagttcttctcttctgtcatttttcataggaaatgttttacgcatttctttgatgactcccggattgatatctccaataagaagacattcctcttctcgaatggttgttatcacctctccatccggtgaataaatcgcagaatgtccgttataatgcagtccatccccatctcctgtccggttcaccccaaccatatatacctggttttcaatcgctcttgctttaagaagtgtatcccactgatcaatccttgaccttggccagttcgctatcacaaatataatctcacttttttctgaactgatctgaaaaatctccggaaaacgtaaatcgtagcatataaatgcccccagcgttgtatctttccattctaccgactttaactttctgcctccctgataataatccccttcaaatccgtaagaaaatgggtgaatcttcgcatagtttaactttaactctccattctctgcaatcccaagacgattataataatggttccaatccggatgttctttcaagcgctcctccggtactggctctgtatatccaaaaacagtcagcatcttgtactttctgctcatctcctcaaaaaaatgaacctgtttctctgctttttctcctgtttcttctacattcattgaaaacccggtcagtgtcatttccggaaatacgatacaatccacctgattctccactgccttctgaaaaaactcttctactttctttttattatcttcaatattctcccagcttatatccatctgggccattccaattcgcatatacgtctttttctccttttttctgttaaaaactaagttattctctttatttctcttatttatatttttttctgaaaaactgctcttgaattctcaaaccttctgtgctaatatccataataacagtacatggtttttaaaactacatcatacaatacttatatgaattctatattcattttacgacaggaggttatcattatgaacaaaacaagcaaaaagtttaaagatcccggcagtgccattacgcatttaatcgctatgatcggtgcagttatctgtgccttcccactgattggcaaagcagtacacacgaataattctattgtcgtttttgccatgagcgtatttatcagcagcatgattctcctctatggggcaagcaccctttatcattctttagatatttccaagaaggtaaatctcttctttagaagaatcgatcattctatgatcttcgtactgatcgccggttcctacacacctgtctgcttactggcacttgataaaaagcagggaattccactgctcattctcgtatggtctactgcgatcgtcggcattattataaagatattctttattaactgcccacactgggtaagctccatcatctatatcggaatgggctggacatgtgtacttgtcttcaagccactccttgccaatctgccagccagtgcatttgcatggctccttgccggaggcatcatctacactgtcggcggtattatctacggattaaagcttccgatttttgataagcttccaaaagacttcggcagccacgaaatcttccacctctttgttatgggcggaagtatctgccatttcatctttatgtatgcctatctaatgtaaggcttatactgcctgggcattcttgaattatccggcataacgagcaattctgtatctgccttacttaatattctatagataacttataacacactttatatccttaaatcaacaaagattaaaaaaagccctctcttatcctttattatcagagtatatttaaaaaatactctgacaacatcgaataagagcgagctttttttctctgggaagctgcttaatcgcatactcccttttcatcgcttcctgttttgtatcatactcctcaaaatataccagctccaccgggcggcggttcttcgtatacttagcaccttttccactgttatgtgccctcaacctcttctcaagatcattcgtccagcctgtataaagagtctcatcgctacattttacaatgtatgtataattcacctgagatgtattgggtattctatcatctgctctttctattctgctctcttccatctgttaccttctaaattattaccttctaactgctatcttctaaatactatcctctaattgttctcttttcattgctatcttccaatggtttctttccaacatacttatactttagtataacatattttctcttatctgtattttctttttgggaagcccacatcaatggactcccctattttcatcagccggaacgatcggtaaatcagacgatatggcaaatgactggctgtcacctgtaaaatatagaaaacaaataagaaggatacacatgttgacagattccggctgtatttttattcctgtatgcaactactatatgcaaaataaattcggacgttcctctaggaacgcaaatacttcaccggattcaccgcttttcctttatatgtcatcttaaaaaatacatttggtccctctaaaacaaatgatctggtaggctctgccactgttccgatcacatcgccttcctgaatgtcatccccaatctcatagtcaacattctcaagttgtccacaatatgccttatagtaattcccaagtaagatcgtcaccattttcccataacgatctgtatcttctatattaacaatccgtccatttcccggagaaacaacttcctctcctacttttgccccaacaataattccgtcattgcaggcatactggtcaagtgttgtgtaatacaccgtcgcatccatactataaggaaggataatatttcccatcaccggccatgtcaacttctttcttccattatagttgtacacagcatcactgctttctattccacttccacttcgtccacgatctgtcgtttgttcacctttttgttcatcagaatcttctttctctgtaactgctctgtcatttgtctccgtcttatcattcgtttcttcgccccattctgcatccatatcattattctctgtagaatctgatgcggaacctgctgctgaatccgtatcacttccagacaccggacctatcacatcattacttttttctgtattctctgtttttgttttgttatcagactttctcccatcggcattcccgatcttaatattgtaagcagtaagcactgataaaattaaaaaagctgcaatcaccaaacttgaaatatattttttttggaataagttatttggtcttttcatatcatcacctctggctatagtctttaccagaaaaatgaaatttatacaccaaaaattaatctaaaattttcgttccgggataataataggataatatcgttgtcgcagaaagctgcttctttgccaatgtatttgccccgtaaaggctcattcccatatcgtgtccttttccgacagtgaccatgcggagttttccattatagttttctaagtaaaaattggtggagtttaggtcaaagattttcttccattcttctcctgtccatttattgtcttgtgccataatttcctgcacaaatccattgtccgtatgttttgtgattttcaagctgctttttaatatttttatattctgttttttatcgattttttccagcccgcccttcttatccgctttaataagcttctgtagtacttcatcataaggaagaatcttcacatccatgtaatcggacgattccacatcctgactactatccacgctgattaaatacggtacagctacggaatagatttcttccgaggaaaccgttttcccaatactgacttcatgataaagtgcatccgcatatttattctcataagtaagcacctgtccaaaagttgcatcagaagcatcctcgagttttttctttatttctaaatacgctttcctcccattattttcctctaattctttcatggaaacataatcaagattcagatttttttgctttatattttttattattcctatgtttgctacatctgctacattaccttcattctgtgtagctgatgcatttttgctgctattttcaccggaagctgccttcacaaaatttgttctgcaaacaatcatccacgctttcaatgcttcctcctcttttatgtaggataactcggaagcagccatgccgatgacaaattgttctccgtccatcttttctccatttttcatctcaacagtgattcccatcttcttgtctacgatacccatgttaccggagataagtattgttccgattgttggaatgaagagaccaccgaagatgaaaaggaggtataacgctaatttcttcattgtacaatatatgcgggaaataactatttcattcattaggggaaacagacgaaaaaagaaatactaccatatcccatctgctctgtagtcgctgtatttaagatgcttgtccgcatcctaaacacgctccgaaaccgcatctgggatatggtagtatttcttttttctgtgttttggctccggaaggaatgaatgtaatagtttttgagagggaaggggggaggacagaacagattggctatttcaataacttggctgttatgtaatttaagaattcctcgggattttatgaattttttaataatccattgattcttcgagcataatataataaaataaaggtactaaaaaccgtactttttttggtacagaaaggagatatatatgatagcaacaaagcaaatggatcttagggcaaatattaaaaaatattttgatttagcatttaacggtgaaaccattgtcgtatcaagaaaagaaaataaaaatgtagttgttatttcggaacaggaatataatgaacttcaaagagcaaagcgtaatgcagaatatttagcaaaactagatagaagtttcgcacaattaaaacaaggggaagttgtcataaagtctatggaagaactggagcgcatggcagatgaatgatttcacttttacaaaggaagcatttgaggattatctttattggcagattcaggacaagaaaacaatgaaaagaattaatactcttttaaaagatatacgatcaaatggagccatgaagggaactggaaaaccagaaaaattaaaatatcgtcctggatattcaagaagaattgatgaggcaaatcgcttagtttatgaaattgacgaacttcaaaatattaaaattttatcctgtcggggacattatgaatactagaatgtgtttaaaaaacactccgaataataactatttaattcattaagaagaaaacaaacgaaaaaagaaatactgccatatcccagatgctctgtagtcgctgtgtttaagatgcttatttgcatcttagacacgctccgaagccgcatctgggatatggcagtatttcttttttctgtgttttggctccagaaggaatgaatgcaatagtctttggagagagatggggaaggtgacagaaggttgtggcttattctgatactgtctccgcg

SEQ ID NO: 399 - DNA, 65476 bp, Eubacterium hallii
tcctgataaagatttgtggctctggttcggcggaacatgtgacagtgaaccgaatccggaagactaacccctttttcactgaccagagctgcatatttttttataatccgctggacatttccaacagacatcctgtctgttacaccttttattgttgtggaaaataagtatgcttctttggaagaattactgtgatatacacgtatatattccctaaggtgtccgactgctttagctgttaattgtatggttctttctttattacctttgccggttatgaaaatatttggatattttgattccattgcgatatcacataggcgaatattaagcagctcactgattcttacagctgtatcgtagagaagaatcaaaatagcacggtctcgtacaccgaatttcgtattcggcggtgcagacagtattgcagcaagtgcatcatcggacagaataggtttttcctttttaatggttttgcatggtgagatctgactgatcgccagggcaactgactggactgatatgtccatatccgaggcatagttcagataggcacggatagccgcgactcttacatttacagttgatggctggctgccatttgcaagcagatattctctgaaattataaatacattctttggtacaatcagaaaactgaaaggtgcttatggatttacctaattcacctacaaggtagtttttaaatattgtaagggaatctctgtaggattctgctgtagcctgactgcgtccaacctgctttaccaaataaacatttagaaagttccatgtgtgagaaaagaacagctggtcagtcgatatctttgctgatttattcttcatagggaatcacctccggaatgacctttccagacactgaatctttctctcggatagtatcaaatgccttttctacaagatgatagtaataatacgtttcatcaggacttttgtgtccaaggtatctgcttaaatatgggagcatagtgtttgtatcaattccctgatgcatccactcattaaatctctctactacaaaagcatggcgtaaacagtggggtgtcggatgtttatcaactgtcctggcaaccggaagcatggcccaatggcggttaaaactcgattctactccagagcacgaaacaggcttatgtggatcttttcccggaaaagcccagtcaattccggggaaaagcatttcctgacgttctttatagtttttaagtaccggaaggctatcctgcggaagatatacaaggcgatctttgttaccctttgagccaaggacagtaaggattcctttatccaggtctatgtgctcccattttagcaatcgcccttctgacagacgcagaccgcagcaaaaatataggagaaaaagaatcttgcactctctatcgagtctaaattgctctgaattatgagacgtgcggatatccattttctgtagcagttccttaacttcctcttttgatggaatgtaaagaaccggacggtaagccttgcagaaaaaattaggaatgtatgcttcctgaccaagggaaaggatatattcactcagcaccttcaccatcgacatacggcgattatgataggcatctccttcgcccggtctggcttctgaccatttggctgccatttcataggtgactgttgtcagttccggataattctgtacgcaaaaggtatcaaagcgttttaatagcttttcttcggaattataggcatatccatcagctcgtttttgctgtataagtccttcgatatgatgtgccagaccgctctcaaaaatgtatgtcaagataaaacacctccaaattccagagggcagagcctcattttatcttcgtcacgttcaagatatacctccgctgtttcctgacgtgcatgtccgagagcattggaaatatcgtcaagtttgttgtctgcccgaagcattcttgtggcaaatgtttttcgtgtcatatgaaagccctgaccagcagataattcaaatccatattcagcaagtattctttttaaagctccacggcacgccgttgtaactttaagcggaatatatggtgcctgatggctgataaatatataaccgttgcctgtgacagccgattccggacgtccattcatgatgtatttatatactgaattacctacatccgttgggactggaagcgttattgctttgcttgttttctgctgaatgaaggaaacagttttgtttttccagtcaaaatcatttacctgaagctttaggatgtctgctcccctgatacccattcgaagtccaagcatgaccatggctgtgtccctgagctccatgggagtagaagctttctcacgatattcatatatattctcgaccatagcatcgctcagaacatcaactatgctgcgatgaggcgcacagcttgcagatactgcaaaagaaagtgttggtgaaatcagatcctggtcagccatgtaccgtagaagctgacgaagcttggttccatatgcatttttactttccggggtcgagtggacatcatggttatgaaatgctttaaccacatcgggtgttatggagactggattatctattccattatcttcaagatatttgaagaaactgcatccggctgccctgcacatggtaagtgtcttatcggtcattccatcccgcctgcggctttctatgaaaccatcaaggatgcttttgctccatgatggaagatgatcagatgcacgcatcggctcagcgattatattggattccattatgccctggagatacttttcaaacattctgatagtgtgtgaacgacgagctgatccggaactgctggctttgatctgattcgggcaatccgggagtatatctatccatgatgtcacagtttctgccgagtgttccagatggttaagttccaggaacatgaaataccatgtgaaatcattgcgataaacagcttttgatgattccatgtatttccaatcgtccaaagcgtcaagatattcatcagctttaagagcgagaggtatactcggatgaaatgcggtacctattttagaaagtctcatctcaagcagtatttcaacgttctcaccaaaaagaacccgctggtaacactctggcacatcacctctgcggtgaagatatttcataagtgctgtcatggcacatacggcgttctgacgtctggcaagagatttacaggatttgcagtaagtattccagtattcgataagagtatctatggttattgcttccggctctgtaactcccagggaagtagcaagcctgaagaactccttgatggcaacagaatacgtatggtaatagcagggattctgtgtggtcgcatagtattcttccagctcatatgtcaggcgaaaaaaggattccgatattccgctccggcagaaaaaactgtcttctgagcggcagaaagaacttttgatatctccaaagagcaggtaatgctcgaggcggaacagggcatttctatattgagaacacgtctcataggaaatttcccgttttttaatctcaagccagtccagtgcggcatccattgaaaaaggaatgcccttatccatcaggtacttgaagagtgtagtataacaggttctgtgcatgtctatatttttacatgcactgtctggctgtttcatcatattgagaactgatgaaatagcatctaaatagtttatttgcatatcaaatgcgctcctttccggcttcccattcgaggggaaaacctgataatagcatatctgataatgctcatcttttttacaagaaagtgaggatttatggaaaataatttaaaagatcaacattataaaaacatgggtataatgcttcaaatggaaacattaacatttgaagctgaaagtatcgcctatattgtctgcaaccactttggtctggatacttcagaatactcgtttacctatattgccagctggtgtgagagcaaggatatgaaagcactccgggcatctatggataccatccggaaaacgtctgcggaagtcattgagaatattgagacacagatgcacgagctggaaatggaaagaccagtgcgggatactcttcataaggaagatttaattctgcatctttcgggcagcatgggggttgagtttagctatgacctgattgaaaatatgagcagggaacagttagaacagaatgtaggagaatacgtcagccttctggaaagtggtgagatagaggaaaatgagaaaccactggaaagttttctggaagaaaaaggtgctgccgtcacaccactctatgacagcagtggacacggagagaactacccgcttgattttttcgatgtggaatatgacgctgacacaggcgttacttatttttctgatctttttccgagaaatcaggcagagatgtttgtacgaaaagcagagtttccgagacatattttttcagaagaagaaaagacatttgtaagtgaatatgcagaaaccttccccggacaggtggagagactgaatgacctggtatgggacatgagagaatcttacgatgaagccggttcaaagctggtgtatgaagtgattcaggcagcaagggcaaacttcccagcgaaggaaccggagattatagaagaaacagccatgcagtatgcccatcgtctgattgaaacggcagaagctgccaatacgggagattttacagattcccagagaaatcttattgtgaattttgcatataagatggatgacaaagacgaagtgcttggactggtgaaccgtatgatgaccgcaatccgcagaccgggaagtgaatatacgagaagccttatgaatgaaacacaggcagagatcgacaatttcccggacgggatgattggttttaccgaaatgcacgaggcaggaatccagttagaccatatgctaccgcttacgaaagaccgggcatatgaattataccgtggaggggcagaaatttacgtcttatatggaaatccagagaatccacaacaggcagaacaggtgcttgtgaagacggaaaatgagattttgggatatgacggtatctttggaatcacagaaacagaatgggaagtccagaaagaaagagaagtctctgccacaaaacaggaagcactggaacagcagagtgcagaaaagattgatgagacacttcttctgcatggagaaagcggaaggtttgccatttatcagatggatagtggagatgagcatacctatcagtttatgggaatggaatccgcaaagagtctgggctataccattgacggaaaggattaccggatggtttatgcagcaccatggatgccaacgatcacgttagacaatatttttgaacgctttaacattgaccgaccggaagatttccgtggtcattccttatcggtaagtgatgtaatcgtgataaacaggggtgcagagatcacagcctattatgtagattcttttggatttcaggaacttccggagtttgtccagcagagaatgaacatgctggaacataattccgtcagggcatatccgccagtttataaaggaacattggaacaggcaatgggagaacgggatgtggatgcttatctggattccagaaagttaaacttggactgtaagaaagcaatcgaagaagccatccgggagaattttgacggactgcacttaaagcaggatgcggcaaaagaagtcgtggaacgcttcggggaagaacgcatgagttttgttatggcaaataccatccgtgaactttcccatgatggaagattttccagacagaacaaagactgggcggagcatatcgaagtcccggaaaatatcagccggggcagaaatctgaacctggattatgtgatcgaaagccacccggcagttttagatgggtttattgacatggcaagagctgagatccggatgcagaggatagaacaggcgataggagaaaacgaagtgacgatcacggcagagacaagagggtatgaaacagaaggacataacgggacatggcatacggttgaggaaaaggaatatgccggggagaaattcttcttaatggaacacgatgaatttggctccgatgtggcaggcattatcgtagcagaaaatggacagcttgtagcggaggacttatggaacgggtttgatgcaggagcattggaagctgtttcagaatatttgcaggaaaatggaacaacactttatgacctgacggaattcccgaaagattctgttgtaaccctgcggagtggacagacacttacaatcgaagaaatgcaggcagtacagaaagacacctgggaagaaacgatagtaggaaaaaatgaatcgggaacagatgtccggtttaattttcatgcagtcagtgaggtgcagctgccggaaggcataaagttaaaaatgccagagattcattacattgataatttttatgtgatggaagatgtaaatgcagagggtatagtaaaagtaaaccggtatgaatcactggatgaagcgatgcaggaatatttacgtctgccaaatcatcagaaaaaaatgcttggtatccagaatacggaaacgatgcaggaaagcatggattttatccgatgtgaaaacgggatagatcggctgagccatgcgtatgaacagatcggagggtggctgaatccagaaatatatgaagcggtaaataaaatggaaaacatgctggactggaatgaggtacagattgcatatcagattggaaaacaatactttacaatccagaccgcagaagatggctatgactatacattttacaatgaagattatcaggaggatgatggaggaatctatgacaatccgacaatctatgtagatgaagctgccagtgatattttagaagataaagggtactcactggaagatgcaaaagtagtggattatgaagaactgatggcagatgtggaagaagttcaggaagaacagatgcagcggatacaattagaaaagaactgcccggcaagtatttttgaaggatttcgcagggaagaagcaatgcaaacctatgaaggaatcgcaatgcagtttaccaggagtaaagggtatctgaccatacaggcaacagaagaaggatattcgtttattttttatgactctgacctgcatgaaatccagggtggtgattacgataatccagatgtatctattcagaaagctgcttatgaaatccttaaaagtgagagaatggatgacatggaatgtgtcaaagtggattataaagaatttgaagaaatgacaatccagcactctaaggatttattgcaggagggggaacttcgtgcgacttctgagattggaagaaatgaactggcattaaatagtctgagcagggcagaagtagaaagaggtgtcctgtatcatgcacaggcagtattagaagatatgggaatggaacaggatgtagaactgcttgctgcaagagtgtatggttccagaagcagacaagacctttaccgggaagaatctgaccttgatgtggtgctttcctataaaggtgatattcgagaagatagctttttcaatgctttaaatgaatccggtatagcaatggcaggaattaaggtggacattaacccgattgcagaggagcgaatcactctggcagagtatataaaagaatctgaaaaatatcttgaccagcaggagattaaaaagcttgctgcggacctggatgattttgcttatgaatatgatacttacgagtataaagatacggttgaaagcagggaggagcaggtggaaaagctcacggaggatattcagaataagaaaacagacagtatcaaagactggctgcttgaagtatctgaagaatccgatatagacagcgatgttataactgcccgttccttactttcccgtctggaagatacagagcgactttctatctttgacaaacagccagagcaggaacagccagaagccacgatcagtttttatgtcgcagagtgcatggagtttccggtcatgggagagtaccataacaaccttactttagaagaagccattaaaatatatgagagcatcccgtcagaacggttgcatggaatcaaaggaatcggatttgatctgcaagatggcgatgaagattattccggggaatatggactcatgagtggagacaggatagacagggatctgattgatatgattccacattataaggagagttcattggtacagaaagcaatcaacgatatggaaaaatatctgaatgagaaacatggaaaggtgcaggaagcagaacagaccgtggaagtaaaacaggaagtttcagaaacaccagtcaagaaagaatccatatcagtggaaccgaaccgggaacaaaataaagagcctgcaaagggtgaaaaaggggaactgaaaaaatctgtgctgcagtcgttaaaagagtttcaggcaagagcaaaagcacaggagcagaaagaaatgacaactggaaaatccaaagcacgtaagaaaggggatgtagaaatatgatggatctggcaatgaactttgatacagacgaatgtttagtgaccgcaatgtttgataaaggtaacagaaatgatacgatggaagccatcgacaatatcattccatttctgaaaggggatgcggatatgatcgggctggtctgcaatactataagaaagctgttctgcatgagtgatgaaggctatgagatttttcttatggatctggaagattataaagcggaattggaagaggaggacgaggaatgagaacaagtcagtgtgcagtatatcaggtaaaagaaacaccagagtatcgtgatgttcgtttccgttcttatgaaaagctgagaagcgaaggaaagagcgtcagcattgagaactatcagcaggtgtacattggaagaatccagccgggggaaactccggtggatataaaaatacgcctgcagaaacagcgaccgaagaacttcaaaggtcattccatcggatgtagcgatgttctggtaatcacggatgagggaaaaaccacagcctactatattaatagagatggattcattatcgttccagaatttctcacaatcaaaagttcctctgataccagactttctattgatacaacaggatatgaaatcgaaggaaagaaaggaacatggcttgcccaggattatattttgatgaatgagaagaaatggttcctgatggaacatgaagagtatggaacaagagctgcctatgtgattctcagtgaagatggagcagtagtcatgaatgactgttacaatggctttgatgaagaagccagacggaacattcagaactttatgcagcaacaggcagcaaaagaacaggaacagcaaagacaacagcaggtgcaatcacaaaagcaaccgaatcagacgcagcagtcactagaacagcagaaaaagaaaccagagctggcaaactggcagaaggtcatggataacggagaatatcttcgcagtgcggagatggcagaagaagccaattacaacatgattgatggactgatgaacaatgttcgtaagaaaaaagataaagataaaccaagagaatccgtacttgccaggctccggctcaatcagaagaaagttgcaaaacaagggaagaaacagacacagcagaaagcgatggcggaggatatggagaggaagaagaaatagtatgtgacaaaagtggtcttgctacacatgtggcagggccatttttgttgaaaaaagtaatagatgaattataatataattggaacctaaaattgaaaatacagtgttgcagtaatgaggataaaatatggatttgaataatttatataattttaaaaatgcagtgagacattttatagatattgattctttggagtaccctgatgatgttgagaatttcgataccagagagttatgctggacaatgccaatttcatttaatgtacaaaaagggaatggaaagtatagaactttgaaaattcctaatattcttaactttgtgcgagcatatcattattactcagggttaccttattttgatgatgttcaggagattaatccagcacatagcagaatgacggttaattttgatacaggtgattttgtggcaggagaatatgatgcacaattaaatgatgattttatgaatctgtgcttgtatgataatttgattaagcttgatattaaagatttttatggaaagctgtattcgcattatcttcctaaaggtgaattgcaggacaatgtttttaccagtttaaataatggaagaactggtggaataataatgggcaattacttgtcactttattttgcagaaaatgctctgaaaaaaatatcggatgattttgaaagggcattagaagaggcgtcggttaattgtcattttgaatatttttcagatgatttctatattttctgcaatagatatgacaatgaaaaaataagggaaattttcagtcaggtattagcagaaaacgattatgaaggaaatgagcagaagatagaaatagaggattatgaatcatataatatagaaaatctattgaccagatattggaaagctattatgagacattggaatgtagaagtcattaaggacttggagaggcaaggacagaccggagcaagaatacaacataaattatcttttttgaatcagttgatatataaattggcaggtgtaaaaaaggaaagaaataaacagtcgttaataagaaattttttcaaaaccaagcattttcgagaaacagattttgaagaatatgatattgaagagtatgactatcatcagttatgcttcttattaaaaacatcaccagagtcattgctatatacatcagatatttttaataatatgagtgggtttgataatcaaaaaattaaagtatttttgaaagccagatataaagaggcgttaatttcagcattttatgatctgcagctgtattactattacgcaatcaagtgttatcatcttgaggcatgtttagaagatacaacggaaatggtacttaaatctcagaatcaaattttgatttcgtattatttaaaggatggattattttcagaagaccagagcaatagcttgaaatccttagataacgaaaaattttggtttcagaattatcatttgattttatatacgccgaaattactgtcagacttggatgaaagtattacaaaatatctgattccgcaaagggcaagtacagaacggagaaaagaaagatacaaaaaattttataaggataatttgacacttgggaaagctattatcaatgaaatttcagtcgttaccgagaacattgtagattatttagagaagaggcatcaggaacttatagaggaataattgttttatatattagaagtcgagaggaaaagcaattgataacgatatatgatgaactaaaaagagcatatggaaatcattttgaggatttgttttctgaattaatgaaacaaaaatatggtcttagataccaagtaataagcacttctggaagaactggtgacatgagtgttgatggtgtattggattatagtgttgcctttgctgtgtatgcaccagaagtttataaagaaaaaaatgcaatttgtaaacttaaatcagattttaatggttttatggagaagagaaaaaatgggcagtggggaagtattaaaacatattattttgttattaaaagagacaggacaggaattactccgttagtagagaatttgattatttctttcaatagacactttccagtgagggtaatgacaatggaagatttgaagggaatgtcagaaggctatttacccttttcagaagatggatatttactggaaaactttaaaaccgatgtaactaatataatggaatacataatagatacggatttttcggctgaaccatttgatgctaaattggtagatgggatttcttttatattagagaaatggaaaaagaaaaaatactcttttaaaaatcaagatttggaaatgttaaaaaaggagatttatatgaacttaatggaattggtacagtatttttctccgatttatatgcacaatatagaaaacgggatgttgatatttaataacgattcaatagaagcaggcaataggctaagggagacgttaagacctgaaacatttcggatacggaatgaactatggaaattgttagagaatctatattcacacaaacagctataaaattatagcagaaaagtaattgacatattcgtggtggcaagttaatataatattaataacaggcaacatgagtgtctgtcaagcgttgaagtaaggtgttgtgccagggggcagtgccttaccagctttataagggtttagcatttaccacaatctggctagggagcaaaagctctcaaaagaaaatgctgggaggctctgccaagtgcagggcctttcttaattttattatgaaataaagggagttgcggaaaatatagatgagaacagttgttgattgtgtatcatcatttattcctctcttatcaacagagtatgaaattgttctgggaagaaaaaatgttgcggttaaacttataataacgtttgataagaaggactgttttcatttgatgggattacaatatcttacggatagaccagagttaagacgtgatagaggaaaaatatttgatgaaattcagaaaggtattataaaaaaagaaaatatagagtcttcggatttttatcacaaaatacaagacagagtacattttcttccgctgcttgagaaaatgcttgatagtaatgatacgatttttaagtataataaaaagtcgaatgtctattctatgatagaagcggattatctgatgaaaaatcatatggaagggaaaaatttatttttgtttttatctaatgcaagagatgatagttatttttgtcgttcttttttctcagaggagaaaatggattatacaaagaatcaagcttcatggactcttttatataagaaaaaaagaaatcttattgatgggtcagaacatatattatacgacagattgaaaaaagatgttaaatagcagattgcctgatggaaaatatttattccatcaggcaatcttatgtaaacatttctttagttttgattattctgcagcttcttcagaaacagaatttttcttttttatggattttccagaaatcattttatgaccagagtagatagccataatcatacagagaagagaactgcaagcaaaatatttgtgagccgttttcatgtttttatagccggtgtaaaaggttccgatcatggctgccaatgcaccaagtgaccaatatttatgtgctttcatttgaatatacctcctgcgtttttttatataatacctctttttggaaagcatgaaaacaggaaatttataaattctgttctttctcaatctgttgttcctcctcgtgactcttcccaaggattatatcaatattagcggaaatggtacgaagctcccgttcataatcccggcggttagaaaaattttctcgttgtgtatctcgcaattcaataagccggcctttttcagcatagagggttttcatggaaggcagtttatttccggcagatttttctttcagtgtccggagagctgtatcataaagagaaagctctgcccggtgttcttcgtagaatttatccttattgcggctcttacgatagtcggcatatacgtttttgtatgcaaggtactgtccggtaaaatgaatctgttcattcacatctttaagttgctgctctgtatcttttaaagattttctggcggcactggcctgatcggatgcctggtcaagtgcagtatgaaaatcttcaagagagtcatatccatgttcctgaatataggcaaccgtctgagccatctgtttcagattggagagtttgactttttgagcataggcttcattctgctgtgctttgatacaggtttgcaaatctatcacaagtcggagatctgattttatgaaaatgaacggtacaggaatatcggaagcatcaggagaaagtgctgtctgcaaatctttcacagtgcttggaacttgtggttcttcagttttcattttcctatcagagagtgattttgcattttccttaaatgtctgtaatagaaaatcctcttcatatcgtgttccgagatttcgtccagtgatatatttttttctgcctggatgaagatagctgtatcggtttctgctgatcttgaagatgatatgatattttttatcgaggatttgtgcaaactcttctggtgacttggcggtgcttgcagcatcatcaatagcatcccggagaaactgtttctctgtttgatagcgagtctcttttggtgtaataccctcttcaagcattttctggttgagcttatcaagtttttcctgtccacgacgctgtgcccagtattctttttctgtaatttttctttcagcaggagagagcagatcaacttgatgcagaccttctttctggcacatatccatgacatcttgctttaagtgagcaaggtaggcggtgcttaggtggtgtttatatccggcttttgattcgcagtcaaattccatatagggttcttgaggcacatcatatttccgaaggctgttgattacaatatgtacatggatattgccactttcgttgtgaccatctgtatgtgtgcagactaaagcctgatgaccgggaaagttcttctttgcaaaagtcagtccaagctgttgtgcccgttcaccagtcagtccacattcctctttgtcttttgggtcaaagctgataatgtaatgatgagacttgatctcattgaaatttttatttttatggtagtagctgtttagttcctgacattcagatgcaaaagtaaacggatcacagttcagaccatccaggtaatattcatctcttaatatcatatgcccctcatcatcgaggattggcttttgggtgtattcattatgctgaaagatgagataccgttcggattctccatagtcagcatttttgcttgcgatatgtttaatcactgccacggaaatcacctgccattctcatcacttcatatttcatttcataaatatcccggagagatttttttatttctgttctcatttctgaggagataattccaccttgattaaaatatcgggcaatctgattgaggttacttcctatcttacccaattcaccaatcagtctttttatttctggaacatctgcagtgatttcatatttgataataacattctgactgttcaaggcatttcggataaaatcagaaacagtcatgtttgttgcagtggctctttccagaagaatctcatattccgtttcattcatacgcaggtgaacatctttagttttggtaagtgcttcatctttttttggtcttgtcattcaatgctcctttctgcataaaggttccgcataggaaagagaaaattttacagcttgttgtgaaaacaagtgatgaagaatcatcacgctgtgaccatggcaatgggaaccaatacgcatatctttgattgcggtcgagggtatggggaaacgaaatccccatcaagttgcaagtggccagtaaccccggaaggggttattgtgctacattgcgaaacttgctctaagagagaatcctttcccataatcatgcgtgggagacatccaaaagacaggtaaaaatgtaaaaaaataaaaaaagtgaaaattcatctgacattttgccctctgccagctgtgattagtagaaaaagagagatcacaggaggtagccagatgaaaaatatagaaatgcctacactggaagaattgcaggaaatggcagcagtggacatccgtaccgtagataaaagtacgttagtagagctggatgatgtggagattcatgaagaattaccgcaggcagaaaggattgcagattatatcaagcagattaaaaatccgtattgctataaatcacatggggtagttgtgaagatcagctttgcaggaaaatgctcgctggaagaaagcctgagcagatgtatctccatgtaaaagaaaatcgtccagaaaaaataatcgaaaaaagaaagaaaaaggtatggtagtaatccagaagttatgttaatatggatgtgggtcaaaatttaaaagcattcaaggagccgtgaatttcttggtttacaccgccacagagcgagtaaagtaggaggttgatggctttatgtatttcaatcaaaagtctattttagcagcggattatctccggttatccagagaggatggagacaaactggagagtgacagcatccgcaatcaaagaagtctcattaacgattttgtaaaacagcacaaagagatccagctggtcgaggaatatatcgacgatggatacagtggaacgaactttgaccgtccggcattccaaaggatgcttgaggatgtgaaaaggaagaagatcaactgtatcatcgtaaaagatttatccagattgggaagaaactacattgaaacaggaaggtatctggaaaaggtctttccatttatgggtgtacggttcatcgcaatcacagaccactatgacagtgctgcaggatcggatgatgcagatcagatcattgttccgtttaagaatcttatcaatgatgcttattgcagggacatctcaattaaaatccgaagtcagttagatgtaaaaagaaaaaacgggcagtttattggcaactttgcagcctatggatacttaaaagatccagaagacaagaaccatcttattgttgatgaatatgcggcagatattgtacggcttatttttaatctgaaaatagatgggtacagttcacaaagaatagcagcccagttaaatgaaatgggagttttgccgccattggaatataagagaagccgagggatgaattataacagcggattccgatccggttctgatcccaaatgggcagtcacttctatcaaccgtattttgcagaatgaactttacataggcacaatggttcagggcaaaaaccgaaagatcaattataaggtgaagaaaagttctcctatcgcaagagaaaactggattcgtgtagaaaatacacatgaagcaattattccagaagagagttttcaatatgtacaaagtctgttggaaatagatacccggatcgctccgaaaagaaaatctgtttatttgttttctggatttgtacgttgtggggactgtggtgagaacatggtcaagagaagcacaacgaagaaaggaaaaaaatactgttattatcattgctccacttataagaacaaagagggatgcagctcccatctgatcagtgaaaaaatgctttatgaagttgtcctggattctgtaaaaaagcagagcgcattattgaccgaagcagaagagatcatcaagaaaaatggaatggatgcttacaagaaagtggagaaccggtctttagaacagcagttaatggcactttatgaggaagtggaaagatataaagacttaaaggcgagattgtatcaggatatggtagacggtattgtcagcagagaagagtaccatgaatataatcagagattcacagagaagatgcagaaagcagaaaaggcaaaacaggaaacggaagagaagaaagaaaagttatctgcggaagaaaaacagatacatccatggatagaggatttcaaaaaatataaaaatatccaaagccttgaccggaaagcagttgttacattgatagagcagatcattgtgtacagtaaggagcagattgaaattcagttcaagtatagtgacgagatgcaggaaatgatagaagcagtgcagatcatacgtgagagacaggaacggaaaggagaatttgtatgcggtgcgtaagttataccagaacgacttcctgtaaagaggacggaaagattccggcagatattataaaacagcaggaccagcatatacaggaatacttgaaaaaacagggatggacattatctgcaaagtattgtgacaggaaaaaagatacagaagagaacacagcttttgaagaactgacaaaagatgggatcaaccgcaaatttgatatggtagttgtagacagcattgacagatgtggcaggacaatatcctgtgcagatgatgtcttagtaaaaacatttgtcccagcaggaatacattttgcagttgtacaggatgaatttatcagcattggaaaaacgaaagaagaattatatgaatatataaagaaagcaaggtatgaagcagttcagttaaaaggcatgagagagtatgcggtcagagaacagctggaggggctttataccgtgcatgatgaaaagtatggatacattctttctgatgaccgcagggaattgcttattgatgaagaagcggcagttgttgtgcgggagatctttcggatggtattagatggtatgctgattgcaaatatcgtgaaaattttaaatgacagtggaatagaatctccgatggtgcataatgcacgggtcggtcataaggtatggccggcatatgacaataaatggttattctgctctgtaaagagaatccttagatgcacagcgtatgctggttactggcaaaagacgatcaacaaaaaaatctgtacacttcctatagctcctattttggaagaaggcatgtttgaaaaagtgcaggagattctcgataagagaaagaagccaagaaaaacaagaccaggtaaaaatggattatttgtaaaaaagatatttgatgccgagacaggaagaaaaatatcacagagaaattttaaaacgggggaaacagtttttctttttgcaagtgggacgaatcagcttccaaaagatgaaagcacctacatttcttttgaaaccgtgattgctgaagtaagaaaagtcatacaaagagaaatggaactggcggaacagataaaaaagaaactgtcagccagagaagcagaatcagaaaaatataaatggttgaagcagtattcacaaagagcgtggacgatctttgaagagatggagcaagtggaaaaagagcgtattccattatatcagaactaccagacaggaaaaatcaatgaagaagaatatctggcgggaaaagaagaaatacgggatcagcttcgtatgtatgatggagatttcagtgaacttatggaagaggtatccgttatagaaaaagcatatagcaataaaaatgaatggttagagatttttaaaaaggagaatcttccgaaagaactacagccagagcatatcaataaatggattgagaaagtattgataagagattttaaagaagtacaggtatgtttatccaaacaggaatggaaaaaatactttcctgcagaatggatggaggaatagggatggcaagaaagagcagaaaaaacagaaacgtagaatctaatatacaaacgattgtcaaaaaagaaaacttgctggatacggctgcgtatattcgcctgtctgttgaaaacggaggaaatgaaacggatgaaacattagttgtgcagcagatgcttgtagaaagatttatagaagagcatccggatctgagactggaagaggtatacattgataatggatttacaggcaccaattttgaacgtcccggatttatgagattaatggaagatgttcgttctggaaaggtgcaatgtatcgttgtaaaagatttatccagattcggcagagactatctggaaacaggatattacctggagactatattgccgaagttaaatgttcgctttattgcgattacggatgattatgatagctccagaaaagaggacagggaaaatataagtgttcccatcaaaaacatggtaaatgccatgtatgcaaaggatatgtctaaaaaaattctggcggcaaaagaagcacaaaagcggaacggaaatatcacgttatctaaggttgcatttggctatgtccgttctgaggataaaacaagacaggtcgtagatgaaacggttgcccctgttgtgcgtatgatattccaatggacattgctgggagtcagtaaaagagaaattgctgacaggctgaacctgttgggagttgcgacacctggacagaaagaaaatagaaagatagcaagagtgccacttgaggagacaaagtggaatggaggaactgtcagaaaaatattagaaaatccaacctatacaggagatattgtcacaggaaaactgaaacaatctttgtacaaaggagtgaaacagtatcgtacagtaccagaagagtgggatgtgcagaaagatatgcatacttcgctggttgcgagggatgattatgaggaattgcaggaaagcagagaagagattcataaggtaacgaagaaacgccagtccagatgtatgaaggacagagaaaagtatcaggatagttttccgggaatggtccgatgtggcgagtgtggaaacgttatgtatttcagacgatatactcataattatacaaccaatgaaaaaatgggaagcgattactattgtgggaatgaagagtgttccagaaatttgatagaaggaaacttactcaagatccttgtgatggatcagatccagattttgatcaagagtatgtgtgacagaaaattgcttttgcagaaaatgaaaagtgcaacaaaagaaaacaatattttttataaagcagcggcaaaggtaaggatattggagcgtaagatcgcacagacggaagaacgcaatacaagactatatgaagattatgtagaaggtattgtggataaagatgattttgatatgatgaaggaacgctatataggggaactccaaaatctccgggaagagcttcaggaacaagaacagaatcaaaggatcttggaaaagaaagcaaaccgatatatggatatggtaaatcatatggaaaaatatctggataaaagagaatataatgaggcacttgtacaagaactggtggaatatatagaagtatatgcaaatgggagtatccatgtgtgctttaaatgtaaggatgaattccagcagatagcagaagaaatggaaggtgttcagattggctaatggattgtatttaagactctctatagcagatggagatttagggaaagaaaataaagatgaaagcaacagcattgacaaccagagatcgcttcttgtcaattttatcactgacagagaggacatgagtgatgaatacatagaatatgtggatgatggatattccggaacgaattttgaacgtccggcatttaagaaaatgatagaagatgcgaaggcaggaaaaatagataccgtcattgtaaaagacttttcacgatttggcagagattatattggagttggagactatctggagcaagtgttcccactcctgggaatccgctttatttcattaaacaataattatgacagtaaagagtacataggaaaaacgatgggattagatatggcaatcaataatcttgtcaacaatctttacagcaaggatatatccaaaaaattaaagagtgccttgaaagtgaaatggaaaaatggaaaatggacaggctcgaaacctccatttggttatttaaaagatgaagagcatggatgttggaaaatagatccggtagcaggtaaatatgtccgtatgatatttgataaagcgatggagggctgcaatacttctcagatctgctattacatgaacgagcagaaggtgccgacacctggaaaatataatcagatgaacggattgctgcggcaggggaattataaaatgccagataaggaagttgtttgggataccgggatgatccgtacaattcttggaaggtttgagtacacaggtgctttagttatgggaaggcggcatacggtagcggttggaagtaaagtaacaagaaagacagcagaacgagatgtcgttattcggaagaatatcaatccggcaatcattacggaagaagagtatgaagtggcaagtgcatctattatgtttatgacaaagccagaatatcgtggtgcgaaagacttccttctgaaaggaaaagtgcggtgtggaaactgccacaggtcattagcttatacagatggcggtattcatccaaaaatatattgtccccataaagttcaggcaggaaggtattctcattgtcctgaagatgcatatccggtatctgtgatagaggggcatatctggtattccttaaaaaggatactaaggatattggattcagtgcaaagagaatccgaagaaaaatatacggataatagtcttacagggaaaaaacaacaaagggtgttggaatcggaactagaaaaattaaaaaatgaacgtatccatcagtatgaagcttatgcagaaggtgtacttagcagagaaaaatatataacagtgaagaaacagctgacagaaaaaatcgaaaagatacaatccgaacaaaaagcacttgccagagtgatcattgaagaagaacgatacagaagccggataagaacagcagtccaacagttggaggtacagatagaaagaggaaagctgacgaaagagattatagatacaatgattgataccgtgtatgtgtatgataaaaaacggattgaagtaattttaagatttgatgatgttttacaaaaggtgatctcagaatatatggaaggggcgaaaggtgcatgacatttaaaaattttatgtataaaggggtattgatgataactgtgctggcattgatcggatggcttggaaagtatctgtatctggtagatggagaaattgactggttccggctgatgctggtatatggtgttccggtaggaatcccatatatgtttttcatcattcctgcaaggtgggatttatctggaacaataggaatggtagctttgtgtgcgataatcggagctgtatttggttttattattacgattggaattgcaatcagagcagtatggtatgtaatcgcatttccaataagctgtttgctgcgaaaggagaaaagcaggatatgagtacaggtgaaaatattaaaagaatccggaagtttagaggaatgacacagaaagaacttggaattgcgattggaatcggagaagaaagtgcaagtccaagaatggcacaatatgaaactgacaatagaacaccgagaaaagaaatgctgaataaaatggcagcagtgcttgatgtagattcgagaaacatttccattccgacaggatatagggaagaagatatgatatataggcttcttgtgctggaagattactttccggaaatgaaactggaaagaaatttacagactggagatgtagcaatcaactttcataataaaaagcttaatgagtttctgtttacgtggggagtgatacgaggaaaaagggccaaaggacttatttcagaggaagaatatcgggagtggaaatataaattgcaaaaatagttgttaaggtaggtttttgaacaaataaaaatggttctaccatgataagtcttgtgataaaatgaaaatatcaaatcaaaattcttaagttaaattttatatggagataaaggagtttcaaccgattatgaataaggctgaacaaataagatatagtaagagaaaaaaattaattggaaaactttttgttattgctgtaggcattaatgattataggctcaaaggtgacaatctaaataattgttgcacagatgcggaagttatttttcatacacttaaatctaaagaatattttagaatggatgataatagtgtattgataacatctgatacatgtaatacagaaaaacaaaatatattggaaagcataaaggcttgcgatggatttatagatgaaaaaacaaatattattttttattatagtgggcatggttgcaatatagacgatacttttcacttttgggtttcggattcggaatcatctgttaagaatgttatatctattaatgaggttactgatattttatctggcatgaataaaggcagatataaaagtatcactatattgatagatgcatgtcaacagcaaattagtcacagtaaaggattagaaaagcaatctcctaaatttcttgatgaatatattgatgatgcgaaaggattagggattatttattcatgcagtaaaggggagtattcgttagatgaatttaatggacatagtattagtgtgtttacatatttgattgtgcaagcattgaatgggcatattgatgctgtaaatgcaaattttttgacttttaataaaatatatgaatttttacagctgaattccagaaaaattagtagagaaaatatacaaataaatcagcatccagagtattctttttcaggaaaagatattgtatatgcgtatataccaaatgattttttacaagataaagatatagaaatagaaatacctacatatgatgatacgtttatgaatatcatgtttgatttacaaaatgttacagcattactttactatgaaaagtgtttgattgtagaaagtagcgatggtgcgaatgaggagaatccttcagaaaagtttataagagaagtgtgtgaagaactatctcgaaatgaaatattacaagaatatcagtattccgaaatactttcaaaagcatttacctacctgaatttgatacacttaaattcaacagaaagtcttccggcttcattaaaaattcagatgattgatgatgtaatgatgctatataatgagctggatactatatatgaaagatgtgttgatagaaagtcctagtattctagcatggtatttaatatataatagaacagaatgaaaagaaaaccgcaggaattttcacctgcggtttttctctgccctttcatatacagaaataccgccatagaaatattgttatactatgacggtattacaaatctttttcatctttaaaagcgaacacatcattgggtgtacagttaagaatattgcacagtttttcaacggtaaggattgtgatgttctgatttttccggagctgatcgagggtgtgcttgtcaattcctttgttaatcagggcatattgggaaatgtggcgttttttcatggtttcccataatggactataatcaatcaaggtatccccgcctttctttgctttttggcataaaataccattaattttaattataattgtcgaataaaataaaaaatatggtggacatcttcaccataagagatataatttgatcgagggatatgtaaaataaaggaaaataaagtcgggtaatgtaagaattgattgatgggtgcatgtgggaggagagttatataagtgaatattgaaaagttttactacgatgaacagacagaaatgtatgagcagatgaagaaggaacaggatgagcatgaacagtcactttcggtagaggaaagggaaaaagaacatcaaaaattattccaggaagcaagaacgattatggaaaaagcagagcgtaaaaagaaagaagaatatcagatcatcaatcctgtaaaatatcagagatttatatatctgtcagaacgggcaatacagttttcaaaaatctcaggatgtaatattaagattcagacatttccagacatgtctgcacttattaaaatgcagacgagatatatctggttgctgagtgatggtgaatcagcactagaagataaggaaacaatgaagaatctgttaaatgaagcggactgggtaggtattggcagcaaaaaacatggagaaaaagatgtagttgaattggagttttggtttgaactggcagaaaagttaaaaaagtaaatgaagatgaaatgactattccacatatatcattactgtgataaaatgtgagaaaatatatatcaacatataaaaaacggaggcgagaaagttatgttcgataccattcatcatattgcaatcattggaagtgattatgaaaaatcaaaacatttttatgtggatctgcttggatttaaggtgatcagagaaaattatcgaaaagaacgtgatgattacaagattgatctggcatgtgggccgcaggaaatagaactttttatcataaaaaatgctccagctcgtgtaaattatccggaagcattgggattacgccatctggcatttaaagttgagagtgtagatgatacagtaaaagaattgaatgggaaaggaattgaaacagagccggtacgcctggatgattataccagaaagaaaatgacatttttccatgatccggatggacttccattggaaattcatgagtagaaaatagcataggatagaaagagacagatgcaggtaatgaaatattcccacatctgtcttttttgtgcaaagatttatttatcggaatgtcgcagacagctttttataaaggcagcagcttttatcatttgttctttttcttcatcagagcagtcagaggataattcaaaccaggtctgatcagcagaagaaagagaaagtgcaggtttaccggaatctgcagataaagcaggactgtcagtatggatactgctattgtcatctaataatctgttctggatttctgatagagctttttcacgatattgagcatccatgtcctggatactttcaacagaagcatggtaattgcctaatatgtgattgatgtatccatttttaaaatgaagaaaaagagcatcttcagatagatccgctaaatcctttgaggttgcaatttctaaatctgcctgtccctccattttaaacagaatagaaaacagatcggatacagactgaatttcaaaatccataaagagatttacactgatacctaacgcatctgcaatttttgaaagttgttcgtatttcggattacgttcattggcttcgtacttgcggagtgtactgaaactgatctcagcgtcctgtgcaagttgttcctgtgtcatgttacgagccagacgaaaatacttgattatttctcctgtattcataggcaaagtcctccaatagcaaaagtataccatattttttaataaaagtgccacaaaagttttgagaaaaatattgacaggtacaaatgtaacatatataataatgacagatacaaaagtaacacataacttacacaacagacacaaaagtacaagtaaacttatacataactgtcataagaaatatgaaaaaagatgcagaaagtcaaacggtttgaagttaagtaacagttaagtataagatgatcaggaaaggatggaataggatatgacagaaattattatgggaattgatcatggaaacggaaatatgaaaggggtacatgtaaactttccatgtggtctggtaagatatacttctgaaccaggacgatttatgaatgaggatattctggaatataacggtgtatattatacgttatcagaaacaaggatgccatttaaagcggataagacagtggatgaagattactttatattgaccttattttcactcgctctggaagcaaaggaaagaggaatcactttatccggcaaagatattgtactgggagttggactgccaccagcagacttcggacagcaggctccgggattcaaaaaatactttatggaacattcaaaacatggaatttctttccgattcaatggaaagccagtaaattgttacctgaaagatgttttggtaagtccccagaattttgcggcagtcatgtgctataaagcaagcctgttccgtcagtaccggacggtcaactgcattgatattggagacggaaccgtagatttactggtaatccgaaaaggacagccggatttgtcagttcgtgtcagtgacagatcaggaatggcaattttacgctcagagatttctaattccattcagcagaattacggtattcatctggagtcctcagacgtagagcaggtattaatgcaggaagcaacgattctggatgaagaagtggtaagagagattcagaaaatggcaggggactggatgcagaggattatcaataaactccatgcgtatgtaccagacttccgaactaacccagcagtatttcttggtggaggcagcttgcttctgaaacagcagattgaaaaatcttctgattttaaatatatagagtttatcgaggacatccgggcaaatgccgtaggatatgagaaaatgacagcattacacatccagaaaagacagggggtgtaatgtgtgggagagatacgggttgtactgatatttaatgaagataatgaacggcagagagagatcggaaggtatctgaaatcacagaaaaggtgcaaaacagcactgattacagaattggtttatgcgtggctgcataaagaaaatgcacccgtttcttcctataataatgcaaatgtcagtgtggaggaattaaaacagcagttgttgcaggatacggattttatacagcagataaaaaagaatgtagttgttgaagaagatgccgggaaagtgatagaagaagaacagagcgatggactggatatggatgaagggatgctgatggcagggttgtcgatgtttgagagtatggaataatgccgattataatttcttttagaaaagatattgtgatagaagtagtgatattgtatgggattcgggaatatacagtatcactatttttatgttaagatataagaaacaaataatctggaggtttaattgtatggaaagacaagatattaataaacagatagagcagattgtttcaatgagtgaaaaagggattataaaaaataggataaataggataacactaaaacagtttagaggatttgaaaaggaatcagaaataaattttaaatttccgctttcagttgtagtgggaaaaaacggaagtggtaagactacagttttacggatgattcaattattaggaaaaggtaacattccacaaaatgagttctttgaaatagattttgacagtggaaatttaagaggggcagaaatagagtattatattgatggacaatatgaaaagctgtgttatttaggaaaaaatcggtggagggctgataatgaaatagagcaaataaacgtaaaaaccattcgtcctaaagctatagtaggagcaattgataaaagttttttatatgataacataggacggaaggttaacaaatcaaatcaagttaaatatttaataaagcaatcacggaaaatacaacaaagccctgaaaatacagcaaagaaacagagaaagtttttaagctcaaaggaagtatcggagataaattacatattacaatcagattatgaacaaattaatttaattagacatagattttttggtggcacatgggcaactaccgtgttgtttaagaagaaatcggatggacaggtattttgtgaatataatgctggtagtggagaatttcttgtagttaatattgttgaccaattattgaatgtacaggatggaagcgttgtattaattgatgaaccggaagtatcattgcatccaggggcacaaaggcgtctattgaaatttattttaacttctataattagaaagaagattcaagtagttatatctacacattcgagagagatggttgcatatttaccgtctgaagcaattatttgtatagaaaaacaatataatggcatttcaagagtggcgaataatattttaccagaacaggcatttcttgaaattgaaatagaaccaaatgcaaaacagattattgttgaagatgatatggcatgttcaattttgcaagaaattttaaaagcagaaaaaatggatgacctattgaaagtagtgtatattcctggtggagcatcaaacttgaaaaaatatataataccagcattttctaagacaaatgtaaatgaccaatttatatggtttgatggagatcagtataaacaggaaataccggattttgcggctgtaccagaaaaagacaaagatgagcagtattttaaagatatatttaaaaaatgtgttggcattgataccaaaaacatagattggtgtccagatggcaacgtaaaggcagggagaataaataaagatcaagaaaaacaaatgattgaacagtatcttgattattataagaaaaatgttttctttcttccgaaaatgataccggaagatattgtatatgacgaaaatcgtataaaaatattattgatgacagatgcaattcctgatagtgtaatgcaagctcaaaattctaaagcaaagataaaaatgtggtcggatgaacgtggaatgccattatctgatatagagaaatatttggtctatacattcgtgcaaatgaaaaatgatatatataaagaaatagtatcgatacttcgtaggattataggtgaataatatgaaaataatagaacttccaaagaggactgtgaaagaaaggaaaaagatccgacataaaaatattgaaaagaataaacatgcatatgctcagctaaaaaatcaattagtaccaaaagagatgaaattatatcagttcagaagatggtatcatccaacattatcaacaaaagaaaaggatgcgttattggaattaggtattgatccatggtcgatagaaggtattaaatatgttggcgattgcagacgttataatttgcaacttggtgagagaattccatttgatgaagaagatgaagataattagttaattaaaagaaatgtcgttaaacatgaaaaagttgtgtttagcgacatttttgctttcaagaccgcaacaccgcaagaccgcaatgttgcaaaataaaactgccggattcatcagttccgacagttatttatcatgtgcatcatctgtgaaagttaaaatgtcatttggggtacaagataagatccggcaaagtttttcgatagtagatgcggtaatattctggttattccggagttgctgcatagttcggtagtcgatgccattgttgacgagataatattgagatatatttcgtttttccattgtaatccataacggactataatcaatcacattgtccccgcccttctaatttatttcctgattgtttaattataagtaggggaaaatgcaaaaatatagtgaataaattcactagataatatataattggaaacataaaaagagaaagcagtatttatggattaaaaatattataaagcattgttaagtggaaattcgtctggttctcgaaagaggaaccgcagttccccaaacgagaactataaattgatagaatatactaaaatactgtaaaatcaaaaattttcatagtgcatagaaaggtaagatgcacatgatggaatcattaggaaatagattaaagcaattaagacaaaacaatcgcttgcggcaagatcaggtagcaagcttggttggagtaaataaaaatacaatgtgttcctatgaaaatgatgtcagacagccttcttatgaaattttggtcagattagctacaatttatagagtgagtaccgactatctgctggggtgtgaaagtaaaagaacggttgacgtatctggtcttacaccaaaagaaatacaaacaattacagaactggttgcagatatgacggagaaaaataaaaagctggaagggttatagatggctcaaaatgaaaaggaacaaaatgattatagaattacatattataatgcagtgtcatcaaaagaagttgattggttatggtatccgtatattccctatggaaagataacgatattgcaaggagatccaggagaaggcaaatcgaccatgatgatgcagcttgcggcacttattacaactggaaaagctatgccggatggaagcggagataaaataccgggaaacgtaatttatcaggcggcagaagatggaattgaagatacaatcaagccacgattggaagcggcaggtgcagattgtagtagaattgcatttttggaacagccggatgaagaaccaatattactaaatgacacaagattggcacaagcgattgaaggtacacaggcgaaattattggttattgatccacttcaagcctacttgagaatggatagtgaaatacaacgtacaaattcggtgcgttctgttcttacaaatcttgcaaaagttgcagaacggactggatgtgcagttgtgctgattggacacatgaataaaagcaatcggacaaaaggcatatatcgaggacttggaagtatagatatagctgcagtagcaaggagtattttattagtaggaagggatagaaatattccgcattatcgtgtaatgcttcagataaaaaataatctggcaccagaaggaaaggcatatgtatttgaactacatccggattcaggatttcgctggatagggcaggaggaatatgaagtagaagatcttttgtctcataaatcaaaaacagatagtaaattggacaaagcaaaggattatctgcaattactgctaagtggaacagatatggcatgtgcagatatatttgataaaatgcgtgcaaatggtattggtaaacgtactgtggagcaggcgaaaaaagatatggggattgtatcctataagtcgggagataaatggtattggcagttaaatgggagtgatgcatcaggtgagcggatatgaaaaagaaataaagagacaggaagaacaaaagaataagattcgtgaaagatataaaggtattgaccgaaatgaattggaattcattccggcaaaaccaagagaaaagttgtttgaggatacagcagagaaaagggtttgtgcctattgccgtgtttctactgatgatgttaatcagacttcttcttatgagctgcagaagaatcattatgaagatatgattaaagaacatcagggatgggagctggtaggaatttatgctgacgaaggaatatccggtacatctttacagcatagagacgagttcaatcggatgatagaagattgtaaagctggaaaaatagatctgattgttaccaaaagtgtctccagatttgccagaaatatagtggattgtattgcaaaggttcgtgaacttgggaatatgcgaccaaaagtgggtgtattttttgaaacagaacatatttacacattggataataccagtgaaatgatgctggcagtattatccgcagctgcacaggaagagtctcatacgaaaagtgagattatgaatatttccatagaacaacgtttttccaggggcatatttcttacaccaaaattattgggatatgatgtggatgaggatggtaatctggtaattaataaagaagaggcagaaacagtgcgtttatgctattatttgtttcttaacggttttccaactgcggaaattgcagaaatactaatgcaattaaagcggaaaacgaaacttggaaacaccaaatggtcaagtggtacggtggggaatttattgagaaatgagaggtattgtggagatgtactttccagaaagacatttacgcctaattatcttgatcataaatcaaaaaagaatcgtcatgatcggaaccagtaccgacaaacagatcaccatgaggctattgttgacagggatatttataatgcggcacagaagatgttgacagtaacaaagtatgcgaaaaaaggctttccatttcctaatctcaaggtagtagatggtggagcgttaaaaggttttgtgtcggttaatcggtcttggacaggatttacagtagaagattataaaaaagcaagtcagagtgtgtattctgataaaaatagtatacaagatagtgaagaatcaagagaagaaaagaaagagggaggatttgatttatctggatacgagattgttcgggcacagttcttttctacaaggttgaatccagccatgacaatctcagaaggacgtattagctttaatactgcctgtttgaagaaatttgaagatgtggaatatgtagaaattctttttaattcaatagaaagatgtatcgccgtaagaccatgcgataaggataacatcaatgccgtaaaatggggaacgatacgaaatggtaaatgggcagtcctgcctaaaagctgccggggattctcagaaccactatttgaattaatggactggaataatgagtgtaaatatcgttttagaggtcaatattcaaaggaagataacgaacagatcttattgtttgacctggaagaaccagaagtgattaaacatgagataattcaagaggatttaccgaacacaaatacgactgaagcggaagagaataccgtagaaacatctgaaaataaaacaaagaagattgtcagaacacttttcccgaagcagtggcagaatcattttggtgatagcccggaagatgttgttcttttacatagagttaagtattgtggaaattgggatgtgctgcgtcaagctaaaatagtagaaggtttggaacctatatcagaaaatttattggataagctgaatgaagaagcacagaacatgatagaaaagatgaggtgtgcagtatgagtgaaataatgataaatcagactattgagaatacagaaaacatagatcagaaagcactggaactggcacaagattttagttatgatggttaccaggttgtaagaagggaactttttgcacatttacgggagccagccgttgtaatccgaagagatagtgtgacatttaatactgcctgcattgccggtttagaggatgcagtttacatacagattcttgttaaccaggataataagcgaatggtagtgcggaaatgcgaagaaaacgacaaagatgctttgagatggtgtattgaaaaacctgataagagaaaaagtagaaaaatgtcaaataaattattttcagcaatgatgtatgacatgatgggatggaatacagactgccgatataagattttggggcataaaataacacatgaagatgaaactatgtatatttttgatctgctggaaacagagatattcatggatacaaaaagaaagaaaaaagcaaatccggattcgttggagaaaaaggaagaattagttactgcagaaacagatcagacaccggagcagaatcaggaagagatagcagcaaaagtggcgagaaagttgaatagaataccattttatccaaaaaattggaaggattcctttggcttatcagtagaagaacataaaaaagcactggaaactaatataacagacggctatatagaattttcagcaacaaggtgataggagaaagtgcgctcatttggaagggaggagtgcagatgccgaaaaccacagcaaatatcacaggggtatctctgtgtcaaaaaaaaggaataatacgaatatttcgatcaacgataaaagaattgggtgatccgaggtatattcgcttcttatttaatccgaagaaaagaactttagcagttcagtctgtcagccgaaaagaagcggagtgttttcgtgtgcctaaatataatcctaaagactgggattttaaaatttgcagtattcaaatgctgaggataatctggagagtttgtgagtggaatgaaaatgacacgtatcgaatagcaggaacgcattatccagaatataatctggtggaatttaatttgaatcaggctaggatagtgcaatttggagaaatagagtagagatagaatcgaagagtttgggacttctgagaaatcaggggttctttttttgtgcttattttgagggtaagttgataatactgtgctttatgagatatttttgaaaaaaagttgttcctgagttgacataaggaggcgatatgtccttagtcggtacccgcccgccaacagtagatgaatgggataaatacgaacttcatcaccgcgcccgcctcgcaaccaagccgggacttaccggaatgtggcaggtaagcggacgaagcaacatcacagacttgtaaaatggcaggaagaccaaaaaagaaaccagaatataatccagaacttcaatttaatagttttcttcaagagttaagagatgcttatgaagaagcagattccctaagatcactggcagatgagttaaatattagtctgcttaaactccgtaagctacttattactgcagatgtattcacatcagatatatgtacagaaattaatgctctgcaccagtcaggaaaaaagattccagagattatgaaactcacaggtctttccagagcatcggtacattcctatttgccctacacaaagggaatttataatgcagtagcttaatagagaattctgaagctaagaaaagcttatctttctgatgtcgaagcggaggaattggatagaagattcggttcttgtagtgcatccgaactgattgacgcagcaagctttttgatagaagcattgagaaaaaatggaaactatacggcttatatggactctacgattggcagtctcagagtacagaataaaaagttggcgaatgtggcgaatgcacttgcaattcttgaggcaaatgaacacactatttatgatcctcctgccgtatttgattctaacaaatcagagattcttctttcgacggaaaacaaactgaaagagatttacgaagcttttccgaacgaggggaaagttgtgcttggttattcgtatctggtttcgtggaattatgttacttggcttgattttccgagaccgatcgatgaagaattaatccctttgttcaaaaagtggataagaaagttcccggaaaataaacttgaattgatggagtattactctttcatattgtttgagaaatggctttatatggacagccttgataatataagcgaggcaaacaaaatatattatgaaataaaagcaattgccgatgaattgtcaaaagattatgcggataatcaggtgactcaaatgttgtccatggggattgtgagaaaattgtagtttgaagatcacaatgcctgtggaaataaagaagatataaaatttataaaaaagtatagaaatggcaatgacaggggaccataaagttccgtaaactttattaaaaaagtgcaaatggatggaagattttacagcttgtatatatatgacgtaagtggtagatagttaatgtataattagagaagaattatccacttgattcacccttcagatgtctttttggtgaaataaaaatacattttgtatgtatttttttgtttcgctgtgatatattatatatagagaaggaggaatattaaaatggcggacatatatttaattaagtattctgttaaaggtataaaagcaatcgatcaattggtttctttatctttctataagaagataattcctaagaatgcagatacacaggcatataatataaaaggaatttatggaatgaatggatcaggtaaatcaggaattataacatctgttgaaatattgaaaaatttacttattgattcagattatttaaataaccccattgttcagaaaaatttagatgcaattattaataaaaaaacatcagagttatttatagaagccgactatataactaagataggggaagaagtaaccgggttttatcggtataatgtaaccttattaaaaggagtaacaggaagatatgtaatttctcatgaagctttatttactaagaaggccacttcaagaagtgatgctatgcatacaatatttgaagtagataacggagaaataataatgcttatagaagaagatggtcgaaaaaaatttcatgtagattttattaataagactaaaaatcttttattaacatcatctgcttgttctttgttttatgaaaaatttttgccttctgcaatagttggatataataacgagtattcttttgtttgtgtaactctgattgaccttcttgtttttggaatgaagttacatgtatatttggatcaatccgataatcatagggagtatgttgctaaaaatgcattacaatgttctgaaggagcaggaagaaataaaaatgaaattaattatataataagtaatcttttgagagtggataacgattggctggacgtgatttcaatcacacataattgtataccaaaggaatgttataaagcttttgaaaaaatggttaataagttatatgaatttctaaaaatttttaaatcagatttgcagggaatagaaattgataaaaaagagaatcgtgacaaatgggtttgtgatttagtgatggtttatgattcgtataagattcatgccgaatatgagagtactggtattaaaaagcttattcagctatttgcttatttaaatgaaatggttgaaggtggaatcgtattcattgatgaattcgattcgaatattcatgatgtatatttatgtgcattgttggaatatttaatggaatatggaaagggtcagctttgttttactacacataatgtcggtcctatggatgttttaaaacatcataaaaaatcaattgactttttatctgaagatcatgagatttattcatggacaacaagtggaaattattcgccatctaaattatatcgcaatgggatgatcgaaggttccccatttaatatagattcgattgattttattggcatatttggttcgggagaggaggacgaatagtgggagttcagttaatattcgttgttgaagcaaataagtcatgtaagtcagattggatatatattaagagtacgatagattatttttatgaatataatcggacaggattgaagcttagcccggtgtatatggatggaaagggaaaatataagcaaaaagagaaggaagtaaaaagcttgatttctcaatatagtaaagtgtctaaaggtaataaatctaaggtgatatattgtttggattgtgatgaatgtgacagtaaaagcgaagatttaacttttctaaagacagttaagaagtactgcgatgatagaggatatgattttatatggttttgtaaagatgtggaacaggtatatataggaaagagggtagataagagtcaaaaaaagaatgagtcaacgaaatttaagaaaaataatttgattacgaaagttgatgtacataggctttctggaagagattacaggataaagacaagtaatattatgacagttttagatagttatcaggaattaaaaagaaaataatttttgttattatttaagtctatagggctaatgtacataaatttattatttgtaggaattttgaaaaagaattgttgggatatatgaaaagaaaaaattaatactctgattcttgattatacacagagctaaccatagaggaatagagaaaatagaaaccgcaggaattttcacctgcggtttttcctactgatttattgatccgtcacttgcagcacgcaggcacaatagccgggttcgggctgatagcagtggatgataagattcttgtctatctcgggactgtaatcatggagtgtgtgctttgtaccgtttaacgctacatctgcatacgatacaagccactttttatcaccattaggaaacaccttgtaaaaagagcggttaagcatttcttctacgggaaccccttccacagttgccatttccgcattgcagtagcgaaaaatgaaatccacaccacaaccgtccgacatggtataaacgccatcgttgctgatatttacaatgtggctgcggcatacgacaattcccttgctgatactcaaaaaattcttctccggcaaagtagatagaacactatgtaccggtacgaatagtgcaaattctgcaccgtctgtgcgttggatgacagttttgcggtctttgcggtaaatgtataggatgttttacgcacaaaatattgatttttaaacacgagcgatatatgataagtatgtcaatcggattgatacttgtgaaagggaacttgccacaggcatccagtagcccacctggcatatgcctcttcttctggcgtttatggaacgaactgaaaagttccatatgcggtggaagaccaggtggacaaaccagtcagtctgtatgctgttgctaaaaagagcgatgagttgatgactcatgcctattccaaactatgatattgtggtgggcatccgccatgtgatatcagcaatatcaaaaagtatcagaaaacggtaaagtggattttagtctgctttaccgtttttttgttcccaattgtgaaattttcaaaacggtattgcctgtagattttcaagtaaagttggaatttgttctgatgccaacaaaaaataaaaaacagagaattaatgtgtttccatagaaatcttactgtgataaacttataagaaaaacgatggaggataaatcaatgtttgatacaattcatcatattgcaattataggaagcgattatgagaaatctaaacatttttatgttgatttactgggatttgaaataatccgggaaaattatcgaaaggaacgagatgattataaaatagatttagcctgtggagagcaggagattgagctatttattataaaggatgctccggcacgtgtgaattatccggaggcacttggtttgagacatctggcatttaaggtaaaaagtgttgacgatacggttaaagagcttaatgcaaaaggaatagcaacagaaccggtacgcttagatgattacactggaaagaaaatgacatttttccatgatccggataatcttccattagaaatccatgaataatcaactgttatgattgctgtttgggttgctagatggtaaaatcaaagtacaataggcatggtgtaccatgctatccaagaaaggagcgtgatacgcatgggaatgtttgttaatccagacaattccgcgttccaagttgctttgaattctgaaatctatgtagataaaactggaatcattaaatatacaaatagggtgttaaatacgttgcaaggatatatttgcaacagccgtcctagaagatttggaaagtctattacagcgaatatgctcacagcttattacagcaggggttgcgattcagaagcaatgttcgctgatttggaaatcagcaagaacgcagattttaagaagcatttaaaccagtatgacgtcattcatcttgatattcaatggtgcctggaaccagctgggggagcagaacaggtagtgccctatatttccgagaggactattgcagagcttaaggagtactatccagatgctctttcagaagaaacaaaatccttgccagaagctttatcgcagatcaacaccttgacagggaaaaagttcattgttgttattgacgaatgggatgttcttattcgtgacgaagcctctaatatgaaggcacaggaagactacatcaatttccttagagggatgttcaaaggaacagaaccgacaaagtatatccagcttgcgtacctgacgggcattcttccgataaaaaaggagaaaacgcagtcagcactgaataattttaaggactattcgatgctgaaagctggatcattggcttcatatgttggctttacagaaaaagaagttcatactctgtgtgaaaggtatgggcaagattttgaggaagtaaggcgatggtatgatggatatcagcttggaaaatatcatgtttacaatccgaatgcagttgtgaatttgatgtttgatggtgattttcagagctattggtcaggaacagcgtcttatgaagcaatcgtcccccttatcaatatggattttgatggacttaaaggcgcaattattgagatgctttctggcgacagagttcctgttgatgtgacatctttccaaaatgatacaaacagctttgcgaataaggatgatgttatcacttatttaatccatttaggttatcttggttatgatcagaaattgaagactgcttttgttccgaatgaggaaattaggcaggaacttattcgagcaactaaaagaaaaaagtggaatgagcttgttatgttccagcaggagtcggaacagcttctcaatcgtacgctgacaatggatggagatgcggtcgcaaagggaattaaaaaaattcacatggactatgcctcttccattcaatataacaatgagaattcgttaagtagtgttctctcgattgcctatttgagtgcaatgcagtattattttaagccaattcgtgaaatgcctgctggaaatggttttgcagattttgttttcataccaaaacccgaatatagctcgttttatcctgcgttggttgtcgaattgaaatggaacaaagatgtaacaacagctttgcagcagataaaggataagcggtatccggagtcgatactgaactacactggtgatatcttgcttgtgggaatcaactataataaaggtaccaaagagcatcagtgtttaattgaaaaatacgagaaggattgattatcaatgactccgactcacaggtaaaaagtgttgacgatacggttaaagaacttatttgcagatttaatttcataaatgtgatgaaatgcagatgaatgcagcgacaagttttgtcgctgcattttttatatttttatatttttacttctgcgaattcccgttcattgcctcatgctctttagcaagttcatcgtgtaatgtgacagaatcccaattcacattgtgctctgtaagcattgcctttagattgacccttggaatcttctgcttatacatggcatttaaaaactgattaagttttgtcccagtaaaaccggcaaatacaagcattggatcatcaaaagaagcattgctttcagattcctctgaacgaagaaaagatgccatctcttccttttttccacaggcaagtattccaatcggaacatcatactgctgcttttccacaacgcggatatgaataccggattgaatacataaaaacttgattttattgcggatagcagcggaatcaaaattataaagtaagatagtctctttcataaaaaatcctttcatttattatgtgctttcattcattatgcattttcattcaagtctaactgctctgttcatctcgttaaaatgcacagaacatatcaactgttattatatgcgataatccccgaaaatcaaacagataatttttatcctaaataggaaacaaaatgataaagcaatatctctaattttatgtaaaaaaactctggtatttttccaaaaatgagatacaataatgtagggaaaacacctagcgtaccgacttgcggcacactagaacgatcgcatatatgcaaggaggatattaaattatggaagaaaaaaattataagatttatgacagtttatataacgtaattggtgtagcgccatacgaagaggtacatacaaaaggacttttacatcaggtagtacacttctggttagcagaaaaaaaggagaatcagctctggttttatttacaaaaaagagccgataatgatattgtatacaaaggagcatacgacatccttacatccggtcacattgatccggaagaaacacacgaagaagcaatgcttcatcagattaaagaacagttaggagtttctctccagaaagaacagcttacatatatcggacatatccatcagcagattaaaaaaggtacatactttgataacgcatttgtacaaagttatctctacgtaacagatcatgcagaaaaagactttgccggagcagataacgttgtgaaagtcaaatttgaagaacttgttgcatttgtaggtgatttagataaaaaggtagcggtatacacaaccgaagggaagttaatcgaagaaacaacacatgatcagtggtggttaagagacgaagaattcgaaaaagtagtagaaccttatatcaaagaacatttaaacaactactaatttactggactaaagagacgaaaagtagaaatttgatataaaagaaaatgtgaagatagtcgcttcgtagaaaatgcctgaccggcatttttactagctccgacatcacattttcttttatatcaaatttctgcttttctgtttttgggctccaaaaggaaattagtatttggttttgagaaagaataaggggattgtccagaagtctatggtttttaatcagagaacggtttcgccataagaaaatattcttcatctggagcctttatctggatgaaaaccatagatctctgggcaatcccccattcttataattcagcgggatgccctgtagaagcgaacgtatctcgcatttgatgtaactaaatttcaagtatacataacaatttgaatgtcaatcctttagaatttaactttccggaagtccatatccttctggcacattccatgttgctaaactgtggatttagatagtcagaaaaaagaaatactgccctatcccagatgcgacttcggagcgtgtttaagatgcggacgagcatcttaaatacagcgactacagagcagatgggatagggcagtatttcttttttcgtctacacgaaatctacaatccagaattcacttgttgtattcttcgatttgtactataataaaaaaatgtagtgtaaaatgtactctcggagttttaatgaaaaagatttcgagagtacattaagattataggaggttaataatgaaggcgaagttaacaaaggttctttcccttgttcttgtagtgatcatggctatgggtcttatgacaggctgttctacatcaagcagcggaaagggaacaaaaacacaggatggaaataaagttttattcagttatgacggaacagatgtaacattgaaggaagcgtggctgtatgctaagatgcttggggcacagtatgagaagacttacagtagctattacggaagtgacttctggagtatgtctatgggtcaggatgatgacgggaaggaccagacatttgaagagtatgtaaagaaacaggttatttcccagatgaaacagaatatcattcttaataagaaagcggataaatacgactgcaagttaacacatgaggagaagcagcagtgtagtgattctgctctttcctattatcaggataaggctggtaagaaggcaatgaaggaatgtggagctactcgtgaggatgttgagaagatttacagagacagtacattagcatcgaaagttcaggaaaagattgaaagtaaagaaaaagttactgtaacggaagatgaggcaagaaagtctacaatctacagagttgtatttgccacaacgaagacagataaagagggcaagacaacacagatgagtgcgaaggaaaagaaagctgtaaaggctaaggcagaagcagcacttaaagagattcagagtggtaagaagacgattaaaaaagttgccaaagagcagaattattctaatacggatgagtcttatgcagcaggcgaatctgaagaaggtgaagcatttgaaggtgtcatgaaaggcatgaaagacggcgacatcgcagataaagttttagaatgtaataatggttatgttattgctaagcttgtcgcttatacagataaagaagagactgaaagtaataaaaagtctttaaaagagcagaaacagtctgaagctttccagaagaaatatgacaactggacgaagaagcttgagaagaagtgggattacaacaaggatgtagaccagaaactctgggcacagttatctttaaagagtgcggattccacatctacagaaaaggcagaagagacaacagctgctaagtagtaattgataggataaatgggataaaagagagaaaaaccagaaattttattataaagtttctggtttttttgtttttgatttaattaggtttaatataaaaattaaagttttatcttgaaggaaaagagtgagaatttattttcttgagatttttttagcttaaaattatatacatcttgatttttactaaaaattgcggtaaacttttactagaaaccgtttatttacaaagtttttaagaggagtttttgggatgaatattttattagcagggggagctggctatattggttcccatacagcagtggaattattagtagcaggccatgatgtagttattgtagatgattattgtaatagctgtgcggaagcggtgaatcgtgtagaggaagtttccggcaaaaaggtagtttcttatgaggcagatgttaaagataaagcagctatgactacgatttttaaagagaataagattgactgtgtcattcattttgcaggtcttaaggcagttggcgagtctgttcagaaaccaattgaatattatagaaataatatcgataccactcttacattattagagtgtatgagagaagctggagtgaagaagtttgtattctcttcttctgctacagtttatggtgaggagaatgatattccttatattgagacgatgaagagaggaagctgttctaatccatatggttggacaaaggttatgatggaagagattcttgaagatgcggcaaaagcagatgaagatctgacagttgttctgcttcgttactttaatccaatcggagcacatgagtccggaagaatgggtgaagatccacagggtattcctaataacctgatgccatatatcgcacaggtagcagtaggaagaagagatcatcttactgtttacggaggagattatcctacaaaagatggaacatgccgtcgtgattatattcatgtaatggatttggcgaatggtcatttaaaggcagtagaatatgctgcagatcataaaggtgtagaagtatttaacttaggaacaggtacaccttatagtgtattggagattatccatgcgtttgaatctgctaacgatattaagattaagtatgaaatcggtgagagaagagcaggtgaccttccagaattctgggcgaattcagagaaggcagagaaggttcttggatggaagacaaagagaacattagaggatatgtgccgtgatacatggaactggcagaagaataatcctcaaggctataaataaatactaatttgtagattttgtatagacgaaaaaagaaaaaacgaatacatcccatctgctctgtagtcgctgtatttaagatgctcgttcgcatcttaaacacgctccgaagccgcatctgggatgtattcgttttttcttttttctgactatccaaatctacagttggtgagaatggggattgcccagaaggctatggttttcattagaatgaatatctctagaagaagatactttcttactcgattgtataaaaattatatttatctactcctacctcatggagaattttttctctggttaactctcataatcttctggagaatccccttctcttttcaacaaaaatcactagtttgctatttgttatcaaaaccagacagccgctgaatcaaaattttatgctgaattgtaagaaaactatgataaagaaaaaagaatggttataagtattgcattttgtgactttgcgctatggaattctgaccataggaacttgggactcgtttttcccaagttcctgtttttctgggcagaatggaatgcttagcgcaacggaacaaaatcaaacttataaccattctttttttctttaaaaggctaactacaattcagctcaacatcttctacgaaagcggcgtctgtgtccccagcaaattagtatttaatttaatgtttttgattttagaaagtagcggtctacgatgatcagaatagagatggcaatgatggagagaaggttctcgactgcagtagtatgctcgatgatcatatgtcgtgcgattacgaacatgagaacttctaacattgtatcttttcgtggtttgcataagagtttgaaaaattcgatgccgataacgatatcgaatacgcttgccatgtattcaaggaaggaaccggattccgtacgggtatgcaggaattctttaaatggttcccataaggaagcaatagcgattacgatggcgatgagaacgattgcggccatgatatgttctaaccattcgcttaagtttgtgtaaccctgcttcagtttctctagtttttctgtcataatgttcctccaatgtacattatccaaaaaaataacctccattcgatgtaaatgtactctcgaagtctttctcacaaaatcaagcacaaaaagattccgagaatacatgtaaaataactgaaaacttttatagtaataatcccaaaaaatatcataacataagtttatttgtgggtcacttaaaaatgcaagaaaaaaataaaaaaattcatttttcacttgcattttggaaggaaaaggaatagaatatttaatctgggaacaattcatgaaaagaaggcgttaaatggagtgaatcttcatctcgatgatggcgattttattacaattattggtggaaatggcgcagaaagtattttttctaaacagagaaacggagatacacaagagtgaaagaattaataaatttacagttgatgatgtttgccctgattattattgggttgattttgaaaaagaccaaagtgattggcaaggaaggacagaaaagcatgacgaatcttgttattgaccttattttgccatgtaatattatcttttcttttatgataaagttttcatcgaaaattgcacaggactttatggtaattttgatcatttctatattaattcaagtattttgtgttatcttaggcagtgtattatataataaatgttctgtaaaaagaaagaaatgtctgcgttatgcaaccatttgctcgaatgcaggttttcttggcaatccgatcgcacagggtgtatacggaatgatgggtcttacactggcttccatctatctgattccgcagagaatcatgatgtggtcagaaggtgtttctgtatttacggaagcaccgacgaaaaaggaaatgttaaaaaagatatttagtcatccatgtatcattgcctgcgagattggagtagttttaatgttgaccggatggcggccgccacatttcttacaggaaacgattacttcgataagtaactgtaatacggcaatgtccatgcttgtaatcggaatgatacttgccgatgcggatccaagaactctggtggataaagatgtgcttttttatagtgtgattcgtttgatctttattccgttctgtgtatttattccatgctggatgtttcatatagacagtcttgttaaaggtgtcagtgtacttcttgcagcaatgccggctggagcgaccacaacgatacttgcttctaaatatgactgtgaagaagaattttctgtaaaactcgttgtattttccacagctgcttcactgctcacaactccaatatggagcctgatattaatgaaaatttgattgtagatttcgtgtagacgaaaaaagaaaaaataccatatcccatctgctctgtagtcgctgtgtttaaaatgcttgtccgcatcttaaacacactccgaagccgcatctgggatatggtattttttcttttttctgactatctaaatccacaattggtgagaatggggaattaaatacgaatttatttgaggggctaaagaaacgaaaagcagaaatttgatataaaagaaaatgtgaagatagtcgcttcgtaaaaaatgcctgttcagcatttttactggctccgacatcactttttcttttatatcaaatttttgcttttctgttttttggctccagatgaaaactagtatttaaatcttgaatgggaataaggggattgcccagaagtctatgatttttaatcagaggactgtttatccataagaaaataacagtgacagccaatgccttctacttgatccgttttctttcactataatgtccttacaattctgtaagaagagatttctcttctggagattttcattccaaataaaaatcataatcttctggttttcgtttctttaatccattaaattatttaaacagtggagctaatgcagcagctaattcatctttgattgcctgcgcttctgcaagatcctttccaagggtggtgaagtaggtcttgatcttaggttctgtaccagatggacgaacaacaacagttgcgccgttatcgagtccatatgtcagtacgttagcagatggaagaccggtagtttcagtgttcttgtaatctgttacactgacaacctttctttctccgattgctgcaggtgggttatcacgaagttcctgcatgatgccagccatcttatccatacctgtaagtccagggaattcgaagctgtctacaacatttaagtaacggccgtattccgtataaatctcttccagtctctgttttaaagagcttccgatacttctgtagtaagcagccatctcacagatgagcatggagctgattacagcatctttatcacgaacgtaaggtcctgctaagtaaccataactctcttcaaatccaaagatgaatcggtctacttctccggcagcttctaaggaagcaatctggtcaccgatccacttaaatcctgtaagtacatttctcatctctacgtcataatgagaagcaacggcttctgcaagtggtgtggaaacgattgacttcactgcaacagccttttcagggagtgtacctaattctttacgtcctgcacatatgtaatcaagaagcagaacacccatctcattacctgatacaagttcataagagccgtccggacacttcatagcaatgccgacacgatcagcatcaggatcggtagcgagcatcaggtctgcaccggattccttcgcaagttcaagaccgagttttaaggcttcaaaaatctccggattaggatagctgcatgttgtaaaatatccgttaggatattcctgttcaggaacgatagtgatatctgtgataccaatgtcatttaaaactcttgttacaggaacaagaccggaaccgttcagtgggctgtataccagcttaagaccggcagtcttacaaagacccggacgaacctgacgtgcttcgatagcttcatagaatgcgttcttacaatcatctcctacaaagcggatgagtccctgctcaacaccttctgcaaaagaaatgtattttgccccgttaagaacatcagtcttctgaatctcttcgtatacgatagcagccgcatcatcagtcatctggcatccgtcaggaccataagccttataaccgttatacttagctgggttatgagatgcagtaaccatgatacctgcattacactcataatagcgtgtagcaaaagaaagtgcaggaactggcatcagtgcatcatagatacgaactttaattccgttagcggcgagaacggcagcagcagttttggcaaaaacatcacttttaatacggctgtcgtagctgatggcaactgtctggttaccaccctgtgtctttacccagttggcgagaccctgtgtagcctgacgtactacatagatgttcatacggttagttccggctccaagaacacctcgaaggccggcagttccaaacttcagtgcaactgcaaaacggtctttaatctcgtcatcatttccctcgataccggcaagctcaggatgaagatcactatcttcaaggtcagcagcaagccagcgtttgtactcgtctaaatacatgttgtaactccttccaatgttaaatgttagtgctttataaaagcttattttatgtatctaattttaccataacaggtactatttatcaagacgaaattatgtatacttttggaaaagaaaacgaaacatgacaggtaagaaagagaaaatacatctcttattttaattaccattaaaattaaaaaatagttcacaaagataagtatttctgtggtattatataaaatacgtggcatttgtggtatcacaggagtcataattaagaaaagaaagggagaagccttcttaatttaaatttataggatagaattctacaagctgataagataagcgaagaagagagacataaagacagacattaatatagacataatatatatagaagaatgtcgaggcattcttgaatttatcctatgcaattatagaatgtaattatagaaggcagattaactatggcagaaaaaattattgcagtttccgcaggaagagaaatcacagaaacagaatttaacgaatttttaagcaagcttccagaacagcagcaggcttatgtagcaacagaagaaggaagaaagcaggcattaactcagtatgcaaactacttcttatttgagaagcttggatatgacaagaagtataatcaggatgaagcttttattgctacaatggaagcagtgaagagagaacttttaggtcagtatgctttaactcaggagatcaaagatatccaggcaacacaggaagagtgtgaggcatattataacgagcataaagcaatgttcgtaaaagaagcaaaggctacggcaaagcacattcttacagaaacagaagaagaaagtaagaaagtattagaagagatcgaaagtggtgctaagacatttgaagatgctgcgaaggaatattccaaatgcccatcaaaagcacagggtggaagtcttggaacatttggacgcggacagatggtaaaagagtttgatgaagcggtatttactgcagaagttggtaagattatcggaccagtaaagacagacttcggttatcatttaatctgtgtagatgagctgacaggtggagaacagtctgaatttgcagaagtttacccacagattatgcagcagcttacaacagaggcacagaacaagaagtatatggaagtacgccaggcaatgattgaaaaatacggtcttgaattcaaatgatgttagggttataataagttcgtataacttagggcgatgcgaccatacatcgacaactgcgtaagcagatatttatatttatggaggttaataattatggcattagtatcagcaaaagagatgcttcagaaagcaaaagcaggacattatgcagtaggacagttcaatatcaataaccttgagtggacaaaggcaatcctgttaacagcagaagaatgtaaatccccagttattttaggtgtatccgaaggtgcgggcaaatacatggcaggatacaaaactgttgtaggtatggtaaacggaatgttagaagagttaaacattacagtaccagtagcacttcatcttgaccacggttcatatgaaggagctaagaagtgtatcgaagctggattctccagcatcatgtttgatggttctcatcttccattcgaagagaacgttgaaaagacaaaagaattagtagcaatctgtaacgaaaaaggaatgtctatcgaagcagaagttggttctatcggtggagaagaagatggcgttgtaggaatgggcgaatgtgcagatcctcaggaatgtaaagccatcgctgatcttggtgtaacaatgttagcagcaggtatcggtaacatccacggaaaatacccagaaaactgggctggattacagttcgacgtattagatgacatccagaaattaactggagaaatgcctctcgtattacacggtggtacaggaatcccagaagatatgattaaaaaagctatttcccttggcgtttctaagattaacgtaaacacagaatgccagatttctttcgcagaagctacacgtaaatatatcgaagcaggcaaagacttagaaggaaaaggatttgaccctcgtaagttattagctcctggtgcagaagcaatcaaagctactgtaaaagaaaagatggaaatcttcggttctatcggaaaagctgaataattatagaatgtaattgagctactatagaaattatggtagtaactatacttcaaaagaaaaaggactctaccgatggcgtggtatcgtttttggaagatatacggatatatctttctttattctactacgtttgtgaggtagagttcttttttgtttagaatatttcattaagaataaattataagtattgttgaatatgggacaatatggaaatataatgtttatggtatcttcattctcgtcagggaaaataataaattgatattagaaaagttctttattatttaaaaggagttaactattaaaattgacagctctttaagaaatatatactgtattatttatgaggagagataaagatgtggcaatggcttttcatgtagagtatagtgaaaataagattgattaaagacaaattctgtacaaggagaattgctggttaaaaaacttggaagtctttgagcagtataaaatgtattacggagaattttctgatagaatagaagaaaggtaagaaatgactaatttaaataatgattttatggaatcttataaacatctggataaaatatgtaaagaaatttttaatagtgagaaaggtgttactacatatatagatacgatgaaagaagtaaatgatggaaatagatatgtccctttatggaataaaacgctatataagttaaaacattatagacatattagaaataattatgtacatgaggttggaacatcacaatatgatatttgtacaagagacgatatagagtggttaaataatttttataaagaaattatgaaaactacagaccctttggctcggtacaggagagaaaagagttcatataaagctgtcgaggatgttaaatatatcagatatacggaaggaggagaaggggagcaactacaatatcagaatgtaaactctaagagcgatgatggtgaaggtttacgacttttaaacattattttaaagtttcttataataatgggaatcaatttagctgtggttttgtttataatgcttatgataagttaatggaagataaaactaaatttgattcttcaatttagcaatagaaaaaaactgtgtaaaataaaaaattttatttaaagaattgatgaaaaaacagaaaaataaaagtataagttagagactgctggtacagattctaccttatactttttatttttcgtctgttttcttcaattaattcagtcgaccatatattttggtttcttcatagagccaatcggccagttcgtcattataatctcctggcaggcatcgccatgtccagtttccacccagtgtagaaggtgtattcattctgccttctactccaagtccaagaaaatcctgcatctgcataatcgcagtatcggcaacacttgcccaggcacaacgcatcataccaatatgataaccttcttcttttgtaagacggaggtagcgaatggcattgttttggaattcttccggagcggtttcaaaccagccaaggatggtatcattatcgtgtgttcctgtgtatacaatacaattatttggatagcaatgtggaagataaccggaaccggtatctctgctgtcaaaggcaaattcaaggactttcattcctggaaatccagtagctgctaaaagttgttttacggagtctgttaagaatccgagatcttctgcaataataggcagtttgccaagtttgttctcgatcgtagtgaataaatccatgccaggacctggtttccaatgtccatttttggcggtggaatcaccgtatggaatggcatagtattcatcaaatccgcggaagtggtcgatgcggattacatcgtagattttcgactggtaagcaatacggtttacccaccattggtacccagtttctttcatgtagtcccagttgaaaagagggtttccccaaagctgaccgtcagcggaaaatccgtcgggtgggcatccggcaacttcgattggacaaaggttttcatcaagctggaattcttccgggtgtgcccaaacgtcagcgctgtcataagaaacataaataggcagatcaccaataatttttatattattttcttctgcatatgcttttaacctgtcccattgatagaaaaataaaaactgtacctttttccagaacagaatttcatcggtaagttcctgatggatggcttcaagagaatctttttctcttttctggagagtttctggccactctttccaggattgaccgccatggtaatctttaattgacatatacaatgcataatcatctaaccagaatttctgctctttacagaatttttgaaattgttcggaaagtgctccggatatacgggagcaggctgtttttaagacagtaaatttatgaccgtaaagcagaccgtaatctactgtagttggttgatcgccccaggagagagaggtatattcttcttcttgtaacagcccttcttcttttaaatcatcaaagtcaatcatatatggattgccggcataggaggagaaagactgataaggagaatccccatatcctgttggacatatcggaagaatctgccagtatgtctgtccggcacgatgtaaaaattgtataaaatcacgcgcgcactgtcctagtgttccaactccgtaaggggaaggaagggaagtgatcggcattagtattcctgcggttctcataagagacctcctgttttttctattttaattctttaattcttcaattgtttaattccatgacactttcaccttcaattaaatgaaatggtgttgttttatgtgttgcatgataaggataattaattcgctgtagtatcaggtcaactccctttttagcgagctgtgttgtgtcctgctgtacagttgtaaggcggggtacgcagtatctggaaagtgcgataccatcatatccaacgatggaaatgtcttctggcactctttttcccatgtcatagattgcacgcattgttccaagggcaattagatcactcattgcaaaaatagcagtgatagcagtattacggtttaaaagccgcatagctgcttgatagccttcttccatggagaaacggcaaggctcatattgcagtcgctggttaaatgaaagtttgctgtttttaaatccccattttgcaccggtaaatctgcggaaactgatttctgtttcggtcagattaccgccgaccacaccgatagaggtatgtccctttttagcaagatactcaatgacggactgggcagcttgttcatcacaggttgtcacagaagaaagattgtcaaagtccaaatcactgctattgttggtcaataaaaggcaggggatgtggatgtgggcaaaatcttctttaaaatattctaagttaccgcctaagaaaacgattccctttggattgcggtcgcggcaaagctggattgcatagtttacttcattggcatcttcatctatataataggtagaaacattttctccattctttaagaagagagactgcatctgttctacaatgtcggcaaatagcaggttagaagttccttttacaataagaatgacagaggaactggactgcattttcagatgtcgggcattactgtttggctggaaattattttcttcaatcacgctcaatattttctttctggccttttcgctgacatctgggtgattatttaaaacccgggatacggttccaataccgtatcccgataaacgagcaatatctttgattgtcatacgcattaccttccaaataaatgatatgtaatatattaccctttaactgctcctgccgcaacacctttaataatatatttctggcagcttaagtagaatacaataacagggataactgccatgatcaggcacgccatgatggcacccatatctactcgtccataacttcccttcatgtactggatgataatggagattgttttgtatttcttaatatcaagaatcaggtatggaagaaggaagtcgttccagatccacattgcttcaagaatacctacagaaatatatgttggtttcataattggaaggacaacagagaagaaagtacggatagggttacatccgtcaatcatagctgcttcttcgatttcaacagggatagactttacaaagccgcagaacataaatacggcaagtccggcaccaaatcccaggtaaacaataatgagtccccatggagtatttaatccaagtgtatcagcagttcctgataaagtgaacataaccatctggaaaggaattaccatggaaaatacgcataaaaggtaaattaattttgtaatcttgttctgtacgcgggtaatgtaccaagcacacatggaacagcatacgaggataacgataacagagagaacggtaataaatacggtccagcctactgctttgataaagtcgtattttgagatactggttaaatagttctcaagacctacataacttttttcatttggaaatttaaatggctctaaactgatgaatgctttctttttaaaggagttcatcaaaacgattaaaattggtgagacaaataatatggaaataagggtaaaaaatatagttgcaaaaataccacttgttttatttttcattattgctgtacctccttgctcttagtagcataaagctgaatcataccgatagcgacaacgatgataaagaagataaccgcttttgcctgaccgacaccttcatatccgacacgcccgtagaaggtatcgtaaatattcagtgccatcatttctgtctgatgcatcggttcaccgcctgtcagggacaggttctggtcaaagagtttaaaagagtttgtaattgttaaaaatgtacagattgtaatagaaggcatcatgtttggaatcgtaacatggatgagacgctgccatttatttgctccgtcaatcatggcagcctcgtttaaggagcctgggattgcctgaagtccggcaatgtaaacaatcatcatgtaaccaatctgctgccagcatattaaaatgacaagaccccagaaaccaagctttgcacttaatttcagtgccaggtcaaatttttcaaaaataccatcaaagattaactgccagatataaccgagtacgataccaccgattaagttaggcataaagaatatagtacggaaaatgtttgtgcctttgattttctgtgtcagtgcaagtgcgatagcgaaggcaagaacgttgattaaaactaaagttacaacagcaaaaactgctgtaaagccaaatgcatgagtaaatgtattgtctttaaatgcttctacataattggataagcccacgaaagaggcatctctgattgtagtaaatttgcaaaatgataagtaaataccttcgatgaaaggaacgatgaagccgatgataaatgctgcgaatgtaggaagtacaaaaatcggccagtattttttaatggacttttccatagtagcaatagcctccttaaaaaatacagggaggacggtatgtccaccctgtatctgagatatgtttataagtttttgtttcaatttgtatttaaattgttttactgttttaaatagaggagagtttaaacttgttataaaaagttattttgtagcggcagcggcttctttagcccatccgtcaacaaatgcagtctgtactaacttccagtttgcatctgtctggtctgctgcataagtagtaagtgcagaacctaagtcgttcttccactgttcagatggcattgtagagaatgtccagtctacaggagtataacctttttccatgtagtcgtttgcgatgttaaccagtgggttttcagattctaagttgtttttgaaaggaataacgaatcccattccgtctgcgccgcacatcatctttgtaccttcttcagaagttacgcaccagttcatgaaatcaagtgttgcctgaatatcttctttgcttgcatttttatttacacaccagtaattctctgtaccagtacaaagtccctgtttctcttcaccaggagcaccaatataaataggaagcattccaagattatcatctccaacatcagcgatatcaccatatgcccatgtaccattctgatagaatacagcctgttctgttgtgaattcagctacagcgtcatcaccagttttcttgcttaactgttttgcatcacatgttccattgttgatgtataaatcccagatgttacggtagttatcaagataagtacctttgattgcttttgtatctgtgattccgtctttctggtattcatagtaaataggaaggtttgcaagatgcgttttaaatctccagtcagaagaaccgtccataccagcggaagtaaatgcggagaatcctaattcatcttttctctttgtgatatcttcagcaactttctttaaatctgcgaaagatttgatatcatcctgtgtgtaaccagcttttttaagaagtgctttgttgtagattaaaccgtaagtttctgtacagtaaccaacacctgcgatttcatcgccgttctttaattcaaacttatcacttgtaagttcatttaaaatatcagaacctgttaaatcgtagcagtagtctttccatgaagcaagacctacaggaccgttaacctggaaaagagtaggagcttcggatttacccatctcactctttaatgtagtttcgtactggtttgctgctgctgttactactgtaactggaacaccagtttcgtctgtgtattcttttgcaagttcctgccactgttcatctgcttctggtttgaagttaagatagtaaacagaacctttggatgagtccttatcagaagatgctttcttatcggaacttccgctgccacatccggtgagcatggaacaagccatgattgttgctaagcctgctgcaagtaatcgtttcatttttctcataataatgaatcctcctttttaaatatccttgcgtgtcttgcgacttaagagtatgtaactatgtactggaatcgttttcggaaatgtttccagttgtttgataagcatattatataacttatatgagtagaattacaagtattttttgtcgaatacaaaaattttgttaaaagtgattggaaaacataataaaaactatacatattgaacaaaggatttgattgtaaaataaaatttttttaaaagggtatggacaaactaaaaaaagtagtgtatactcagccttaaattacagggaaatcctgtaaaattaaaaaattttattcccccctgcaccgtctcactccactttctgaacggtcagggcaaagaaaaggaggataaccgtcagacttgcggtgcggcagtgtggagacctgtcgtaatgtggcgcggaagtaatcgccggctgcgaggtgatatcgtgcggaggcagtatcactaaagtctaagaatatggcagaggtaacattaaaacacattaaaaaagtttacccaaacacagagaagaagagcaaaaagggccagaagaagagcaatcttatggttacagaagaaggcgtattagcagttcaggacttcaatcttgacatcaaggaccgcgaattcatcgtattagtaggtccatccggatgtggtaagtccacaacacttcgtatggtagccggcctcgaagaaatcagtggcggagaactcctcattgatggaaagagaatgaatgatgtagctccaaagggtcgtgatatcgctatggtattccagagttatgcgctgtatccacatatgacagttcgcgagaacatggaattcccattaaaacttcgcaagatgccaaaagatgagatgaataagagagtggacgaagtagcgcaaattcttgatattacacagtatcttgaccgtaagccaaaggccttatccggtggacagcgccagagagttgccattggtcgtgcgattgtaagagaaccgaaagttcttttaatggatgagcctttatcaaacttagatgccaagcttcgtaaccagatgagagcagagcttatcaagctccgtcagagaattgatacaacatttatctatgtaacacatgaccagacagaagccatgacacttggtgaccgtatcgttatcatgaaggacggaatcgtacagcaggtcggaactccacaggaagtatttgaccatccggcgaacatctttgtagcaggctttatcggtatgccacagatgaatatgtttgatgcgaaactcatagaacagtctggaaaatacagtgtagaattaggtggtgtttccattatactttccgaagaaaaacaggcagcactcgctaaaaataacgtaaaatcacaggagattacccttggaatccgcccagaacacatcgctttagcagaggctggcaaggatgccatcacaggtaaagtggacgtatccgagatgatgggaagtgcgattcatttacatgtcaatgcctgtggaagagatacaatcatcattgtacagacgatggatttaacaggtggagaagatctatcgatcggaagcgaaatctccttcgcatttggcggaaacgcagtccatgtgttcaataaagaaagtggagagaatctggaattcatttagagaaaaacagacgaaaaaagaaataataccatatcccacctgctctgtagtcgctgtgtttaagatgcttatgcgcatcttaaacacgctccgaagccgcatctgggatatggtattatttcttttttctgtgttttggctccagaaggaatgaattcaataatctttggggagataaagagggaaggggacggaaggttgtggcttattctgatatagccttcggcagggcgcacattgttcggtggacgatggttttgcgccgaccgagacggagtgtagataaatttatcattatattgtcgcaatatatcatttttctcttctggacgagataccttccgagcaagcagaagacttctgatattctcccccttatcttcccacatactattgaattcattcacctgaagccaaaacacagaaaataaaaagaatagactatagcaaatgtaatgtgagagcaagtaaaaatgccgattaggcattttctacgcagtgatatctttacatttgctatagtctattctttttattttcgtctgtttcccctaatgaatcaaatagtaactacctggtaattttcttgaaatcagaaatttgcttctcatcctatagaaatgataaaattatacttatgaaaaaaatcgcaggaaggataagaagattgtatgaggaaaaggaatagttggatacaaaagaaaagtgttgtagttataatagcagttcttttattaatagcaattttagctgtggcagcggaacttggaatgaaaagtggcagcagaccgctaggaatgatagaaaagattaagaatgggaataaggataataatgagagtaattcggattctgatttggattcagacaacatggaaggagaagatggggagagggaatccaagaatgattcagacagtgaattgaacacaggatacggttatgagatggatgtattttctgataagaacaattcaactgagaaaaagaccgtttatgaaaaaggttatgatcttccagtagacgagcaggaaaataaaacggcaaaagaagaattacatgagatgatgcaggctgtttggcctatttatgataaaagtgaaaaaggtgataccagcaatgtagtattaccgaataagactgtcaagaagatattggataagatagaaagctgttctgttccggcattttttagcggaagagaagaacatatgtgtaatgcagataaatttgatgcatttttaaagaaagcacaaaaaggagaaaaggacagtattgtagtatatgaagttcacgaagatggtggtatcggacggaataaatatatttttgacggacaaaatatgtatgtcttatatgtcggctccgtctggaatgatgatgaagacgtaatcagtattgacacaacttatacaagaataaaagaatggaactatgcaaaagatggttggtttactggagaatactgtgtaccagaaccaccggaaagatctgaaacagtagatggaaggtttaggattctggtttaatttgttaagctaaacagacgaaaaaagaaataataccatatcccacctgctctgtagtcgctgtgtttaagatgctcatccgcatcttaaacacgctccgaagccgcatctgggatatggtattatttcttttttctgtgttttggctccaaaaggaatgaattcaatagtctttggggagataaagggggataggtcagaagtctactgcttgctcgaaagatatctcatcagaagattatattccatctttaacgagtagtaaaaagaaagggcatatgaagttcgtcaactacccacgacctaaaggtcatgggcttgtaactgcccagtcgtactaacgggttacacctccgacctttaatccccgatagatattgctatctaaagtggcgttacatcatagggtggctgacagcaccctttacagacaagacatgctcatctgtaactgtatcaggtactaaacttcccatgccatacagtaaaaaaatcttttacggttaagattttacgcaatacacgaatttcgtattgcaacctcatatcttgtcaatgtacaaaagagtgtctttaatgagcagcacatctaacggttttctctttaagaactgctacggctattgtagcatattgggtaacagttaacaaggctcctcccaccacctaaaggtagtgggtttccgcctatggcaaacgaaagaattttatttatgaaaagccttgcattaaaagttattgattttgttccgttgtgctaaacgttccattttgcccaataaaacaaaaacttcgaaaaaagcagtccgaagtttctatggtcaaaattccacagcacaaattcacaaaatcaataattttaatgcgaggcttttctgatttaaagttactttactctaattttgctttagtaggataatctgagttagaaagcttgttgaattgataaaaaagtaacaatctagcaagccgaatctgttgtataaatgataaaaatacagaaaaagtacaatatctagtgctttttgagaaaatgaaaaaatattcaaaaaatgcttgacgtgagtatagtgttatgatattataatatgcgttgcacatgagaaacacatttttgaaagaaaaatgataaaaatcttaaaagaaagttaaaaaaatcttgacagatcagatgacatgtgataacatataaaagttcgcatcgcagggaacaaaagtcttcaaaaagaagatgaaaaaaagttttcaaaaaagttcttgacaaatagaaagcgatgtgataaaatataaaagctttcacatgaaagcaaaaccttgataactgaataacaaaacaaccttgaacgttaattcaaatttcattcgggttttcctgagagtgatgtctgcaggaaagtccatggaacagaacgaaagttcaaaacctaaataaacagtaaagacaggaaaagaactagtggttctggacctcgatctgacatcttaaacattttatttgagagtttgatcctggctcaggatgaacgctggcggcgtgcctaacacatgcaagtcgaacgaagcaccttttaagattcttcggatgattgatcggtgactgagtggcggacgggtgagtaacgcgtgggtaacctgccctgtacagggggataacagttggaaacggctgctaataccgcataagcgcacgagaggacatcctcttgtgtgaaaaactccggtggtacaggatgggcccgcgtctgattagctggttggcagggtaacggcctaccaaggcgacgatcagtagccggtctgagaggatgaacggc

SEQ ID NO: 400 - DNA, 65157 bp, Eubacterium hallii
tatttgagaaagagatggggaaggggacggaaggttgtggcttatttcgatatagcctattttgttcattccacgtggagccaacacacagaaaataaaaagaatagaccataggaaatgtaatgtgagagcaagtaaaaatgccgatcaggcatactttctgagtagcagtagccttctgacttctcccctcatcccctaaagactattgcattcattccttctggcgccaaaacacagaaaataaaaagaatagaccataggaaatgtaatgtgagagcaagcaaaaatgccggataggcattttctgcgcagtgatatctttacatttcctatggtctattctttttattttcgtctgttttcccctaatgaatcaaataggaataaaatacttttcctgttttttccaatcggtttgtgacttctgttctggagactgctgtggattgtccagttacagggtctaagtatcttattttggttgcgttatagctcatgacgatcacgtagcggctgctgcttattttggcgagtaccgggcttccctgactgacgtaataaagtatttcgtctactgtgcagccggtgaggttgcgtgtggtgtaaccgctatattttctcatgagttcttctatattatctttttcgatgtttatgctgcctggtattacttcttttccattgactgcggcgatcatggagaggcatcctgcgagtgatgtgctgtctgtgccggtttttatgacattatccattccggctacctgtgcatagtctgcgtaaatacatttccacaggatattttctttgctgtcgattacatttccccgctcttcatatgctcgtgcgattgcttctgtgagattcgtatagactgctttttgtacaccggatgcatatacatagtactgttctacctgctcaccgctattggaaagtttcaaggttacatcgtcttcatttaccattatttttgttaacagcaagtccggaactacctgaatgtatatgtaattcggaaatttgaaatacagctgtgtccaataggtatctgtatatttggaagtgagtgttaccgcatcttccgcttcctcttctttataacggatgtaatcttttgtgtttgttttgtgaatcttgtttcctgatcttttaccaagtgtcatttcaagggtgctgccttttatttcggtatccatgatatatcgtccgcttttctgatattctttgatcgtttttccatcaataccaacgatatggatctttgtgatcgggaagttgatcattccatttctgctttttgacacatcagcggcatctgcttcaccgtaaatgaaatcatttgataaaaatccgactgcacgaattcttttatcaaaattacatgtaaagttctgctttttaccggattctaagtctatcatctctatctttttattcttgtaaatgtcctgctctttttctatggcaatgatgctctgatctttggatgccgtaaggctttcgtttacaagtccggcttctacgattttatccgacttcttttccagatcaatttcatgtaaatctccttcaaggatacagtaaaatacggattttgaattcaggtaagagaatttttcaagattttctttcatactgtcgtatggcagcgaagttgataagaaggatatctcctcgttacagtttgttccggcattatatttcatgatctgaattccattcattccctcatgtctgccgcgattgatatagccgtaaacaagataaaaaatgtttcctttcttgtccatacttaataactttattccatgattacttgccgcattccttatatccggcagattttctgatgaaaggctgtatatcttgtacatatctgaagactgataatcatagtaccagagctgtccttgtacagcaaagcatactttataacctttgtctgcataaacataacttatattcttcttgttctgtattcccagactgagaagattgtttgcggaatctataatagaggaattataataggcatccattgttcgctcataatcaagcagatacatcctttctgctgtataacgcagtttatatgtctcctttagatcatagtactgaacgacaccttcactgacttctgtagacagaattgtacttacctgtattaccgtgtatgtgttattgatttcctgcagtgtgattcttggctttgtctcctgctttacttccatgttgccaaaggatattgcttcacttccggaatgaatattcaccgattcaaggttatcctctatcgtatctgcggaaggctccagatagctgacattctctgtcattgtttctttactgaaaagattattatggaacttcaggacaaaggcaaggtaatcatctaaatgatatcctgaaccactttgtatcttcgtataaaaattaattcgggtattgttatccagacgcacaccaaactttagataatatactttattttccgataaggtatttttaaaggtcaacgttcccagcttgatatttttctttttatttgaggttaactgatttagcgtaccggtttctgttggcttatccggtgttttttcaaataatgtatactgaatggctgtaatgtcgtaatcataatcgtgcaactttaaaattaccgcatttttattattggtcaatgtaatctgatttctcactaaagataaatcaatatcttctttatatcccgccatcaaattataactgcttgtgtcgttccctatttcaaggaccggataagacggattggcaagttctgccacagcacttcctttttccatgctgatacgtccgttaaaaaaaatcagtgcgcctataaaacacactactgctactgcaatgtgtaaaatggccatccgtacatttttactcatcgtgcgtacctccttcttctccttcttcctgaagaagtttccacaatgttggggtaaatccaaactgcttacagaaggcatctacctgctgtgctgctttttctttctttttatccgattgttttttgcgatgtatcgcacgaatcaaaagattctttggcgtgtgttccatatcaataaattcaagaatctgcgtatcatacccctgctcttctaagattttagctcgaataccgtctgttgccagtgcacagaaacgctcttttaaaataccatagtctgttattggctcaaattctgaggcggcaatctgcttatttaactcatgctggcagcatggaacagataagataacagatgctccccatcgcaatgctttatacatcgcatagtctgttgccgtatcacaggcatggagagttacgaccatatctacctgtgttactccttcaaattcttctatggaaccttcataaaaattcaatttatcatagccgtatttcactgccagacggctgcaattctttatgacatcttttttaaggtcaagcccgatgatgcagatatcatatccttttaatttttttaaataatagtacatggcaaatgtaaggtatgacttaccacagccaaaatctaatatcgtaatctcacgattctgcggcagatgcggcagaatatcttcaataaattcaaggaagcggttaatctgtcgatatttatcatactttgtacggacaatctttccttctgctgtcataacaccaagatcttttaaaaatggtacgaccgtcccttccggtaaaatgtacttctttgtcctgttatgcagcaaatgacttttatccgtttgcatctgcgctttcactacattattctgcttctttactttgatcgctgccttcccttttttattgatgagtgcagtaagttcggaagacaccgtctgaagctgtacctgtttatatgacggaagaagacattctaattcttccactaattcattcttctttagattcttatgaaaaacctgtgtttttgtgtatgccgcactctgaaacataagcttgtcctttactaaaaccggacggatattatacttctttatctcttctgcttttcttggattgcttatggtaagaagaagcatctgttcatttaaattctctttgatcttcgtgagtaaaaactccataattcatctcctgttgcggaaaagcgcatagcgcttttccatattaattatctatattaattatctatttgaaaatactttttgtctgcgataataccgctgcctgcgatgattgatattccagtgcaatactacctgtattaatgtacgaaacggagagttcccatcccgaagagagacttcgataaaatacggatttcttatcattgcctcatcattcgtctgtatcatctcctgttcttcacgatactttaacttatcatacaccatatctgcaatttttaaaatagttaccttatccggatattcggaataaatagagcttcccgcatattcataccggtcaagtaaggcatccgcaacaatccatacttcccgaacaaccatcggcagcatttgaataagatattcataatctttccagtatttctgttcttcctgctgcaactgttctggcgggagtaacgattgtgtctgactgtcattctggcataccatcatttcacgaaatcccggcagccactcaaaattaaaatcttcttttttactcatgtcatctttattcatgtcatccatgaaaacgcttcctgctttcacccggttttatttatcatatgcaaaaaaatagatgaggttcgatttctatttttttaaatcaagcaacggaatcacctgaactaaatcgctcactactgccacgcatttttcctgttgttcttccggaatcggaagcagatctggaatgtttataacaggaagattccccgctaaggctgcctgtacaccattagaggaatcttctaatactaatgtttcctctggttttacatcaaacttttggcatatttctaaaaaaatatccggatatggcttccctctttttacatcttttgaagaaagaaccatatcaaaatattctgtcaaaccagacttttctaaatattctttaattacagacgtatccgaaccactcgctaccgctgtatgtaacttcttttctttaacagcgttcagcagctctctcaatccgtttttttctggaactccttcttctttgataatctgttttgcccggctgccgacctttttataaatgccttccgcatctgtatcttcaccgtaataatcataatatttcttctgaatatctctcgcattcattccaagaaaacttgtaaactgttcaaatgtcgggtgatatccttcttcttttacaacttccataaatgctctgcaatttacctgttctgttgcgaacattaaaccatccatatcaaaaataactaattctaacatatatacctctatatttttctatcgcaaatgtaatgtgagagcaagtaaaaatgccaatcaggcattcgtagacttctgtcctcttttccatctctttccaaagactattttgcattcattccttctggggccaaaacgcagaaaaaagaaataatatcatatcccagatgcggcttcggagcgtatttaagatgcggatgagcatcttaaatacagcgactacagagcaggtgggatatgatattatttcttttttcgtctgttttcctctcaatgaatcaaatagttatccctgcatcttctccataagacgtgctgtgtcttctgtaagcttcttcagggaattaaccattgctgtcttctgagctaccagctcatcacactgtttcttttcttcttctactttacgcaggctgtcttcatgaatcttctttgcctcttcaatcgcattatctttattctcctgggcatcttttaagagtctttctgcagtcttacgtgcttctccgataatatctgctgcatcctgtcttgcctgctctctttctctttctgcctgggctcttgcttcatcaagaatggcattctgtctgccttctaaatcagaaagctgcttgcaaagtaagtctgcattcttcatgtatctttcgtatgcctgatccgttgtttccggtgcttttgcctcttcggcagcggtctgagcttcttgtgctcttgcaagcgctgctactgtttttgccttctctgccttgatttgtgcttctaatgcttcaatcttcttctgggctgctgctaactgtgcctttgccgcttcaatctcatcctgcgcttcatctgcacttgttactgcctctggtgtatctgctgttttataagctgtttctggtgcagattcttctgcagcttctgcttctgtttcctgctcttctttgtcttcttctgcatcaacgatgtcttcctttgtatccttctctaactcttccatcgtcttaccggttgccgctgctgctattccgagagctgtcttgctctctttctttaattcttcgatttctttttcttttgctaagatgatcgcctctgcctcatcacagatcttatccagctgaatatcgacttcatctttatcgtaaccaaacattgatgtcttaaatgtcagttcttctacataggttaataattcctgcatattcatggcggttcccctctttctctggttcgtatcgtgcagtatgtatatacgattaaatccagtcttctctaaaatcttttcttactatttattataaacattctatactatttgtccagtgaaaatggtaccttttagaatgtcagacgcatctgataccatgtcactccaccatgaacggattccgaaattccttctttctgaaaaccaaacttctcataatagtgaataaggggctctttacaggttaagacaatgcctgttctatcctgtgcccttgcatcattgatcacataacgaatgagcttttctgcataaccatttctccggtaagcaggaagcgtacttaccccaaaaattatctgccatgctcccccttcctcgtgaagctctgctttttcatacatttcatctgtcagatcctttttatctgttaccatcccatccacaaatgcgattaatttctctccctcgtaacccttttcacacaatagccagaaatgcgtgccatatgccttaatccttcttgcaaattcctcttttgtcgctgcctcagcaggaggaaaacagtctgcctctactgatgtaatcgcatctaaatcatctatcgtcgccattcgaatctgcatatgttccattgtaaaagtctctccttattaattatcgttatttatttaccataccataacacgtttggtatataatacacatttggtactcattttatatatttatagcatattataaattacttttacaaaatttcaatgttcattttttgcgaaaacagatatttcattgctataataatgtgatgatgtcagagttaaaagggtaaaaactgcgatgcaggaggagaaaacgcaaaaaacccgggaaacatataatacattatattatatatttcccaggttttcgtctgtcttatctattactttcctgcgatttctaatcgaatcagtgctcgtttgagtgccagttctgcacgtccgatatcaacgcctccctgctcggaggaaattcttctttgtgcacgtattttggcttcttcggcacgtttgatatcaatatcctgtggccactctactgcttctgcgagaatggtcatcttttccggagtaatctccacaaaaccggaaagaagtgctgcctgcttctcttcattcctttcggtgatgataagtctgccaggtgcaataatctgagtcatcgggatgtggtctgcatatacgcctacctgtccttctacggtattatattctaccatgtagatgtcattggaataaaaaatcctgtccggcgcaataatctcgagtcggaatgttttgtctgccatagaatcacctacttattatatctggctaatacgtcatcgatatttccggcattcaagaacattccttccggaatctcatcgtatttaccttcaagaatctctttgaatccctggattgtttctccaagcggaacgtaacgtcctgttgttcctgtgaactgttctgcaacgaagaatggctgagaaaggaatctctgtacctttcttgctcttgctacaagaatcttttcttcttcagaaagttcatccataccaaggatggcaatgatatcctgtaattctttataacgctgtaatatttcctgtacaccacgtgctacctgataatgctcatctcctacaattcgaggatcaaggattctggaagtagattccagtgggtctactgccggataaataccctgttctacaatggcacgtgaaagtacggttgttgcgtcaagatgggcaaaagttgtcgccggagccgggtcagttaagtcatcggccggtacatatactgcctgtacggatgtgatcgacccgttctttgtcgaagtgatacgctcctgcagcgctcccatctctgtctgtaaggttggctgataacctaccgcacttggtacacgtccaagtaaggcggatacctcggaacctgcctgtgtgaatcggaaaatattatcgatgaataaaagaacatcttttccaccttcatcacggaagttctctgcgattgtcagtccggtaagaccaactcgcatacgcgctcccggcggctcgttcatctgaccaaataccatcgctgttttatcaataacaccggactcactcatttctgtgtagaggtcgttaccttcacgtgtacgctcgcctacaccagtgaatacggaatatccaccatgctctgttgctacattacggatcaattcctgaataagtacggtcttacctacaccggcacctccgaaaagaccgatctttccacccttttggtaagggcagagaaggtctactactttgatacctgtctctaagatttctgtttctgttgcctgttccgcaaaagtcggtgccttacggtgaattggatttctcttcactccttccggcattggctttttgtcaatcggctctccaaggacgttaaaaatacgtcctaaagtaacctcccccacaggtacactaatcggtcctcctgtggcaatggcctccattcctcttataagtccgtctgtcggacccattgcgatacatctgataatatcgtcaccgagatgctgtgctgtctctgcaaccagcgtggagccatcttttctacggatttcaacggcatcgttaatttctggaagaacacccttgtcaaatcggatatcgagtaccgcaccgatgacctgcgtgattttacctgtattctgtgctgccatttatttactcctttaatattcgtgtaaacaggattaaaggtatgaatgtctggacacaaatgacctcttcatcccttttcctaattacatattgttaattcagagcttccgcacctgaaataatctcggtcagttcctgtgtgatcgcaccctgtcttgcacgattatatgcaagagacagcgtggagatcatatcctccgcattactggtagcagcatccattgcctgcattctggctccgttttcacttgctaccgcctcaataaatgctccatatacaatactgtttatatactttggaatcagtaaatctaaagattcttctgcttccggctcataattcatcggtgcctcactctttttatctgcactctcttcttccttcacttctacaggaaggagcttgataaactccggagtgtgtacaaccgtattcttaaagctggtatacgccagataaatctcacctacttctcctgcctcataggcatcaagcactttacgtccaatctctactgcatcagaaaagaggggtgcattgatgatctccgaatcatcagaagcaatataatatccttttcgctcaaatgattcaatacccttcttaccaattccgtaaacctcaacgctttcctttggaagcccgctttctgcaacgagctttacaatattattgttatagccgccggcgagtccacgatttgaggttacaacaatcactgccttcttcttagaaccattcgatgtcaggtatggatgttctatatttcctgatctggagagaatcgactgtaccgtatcgtacattttctgaaaatacggctttgcactctctgctctggtcttagctttctggagctttacagtggataccagcttcattgctttggtaatctgctgcgtactttgaatactttctttccgcctcttaatatctcgcattgatgccatattcaatcaccatccttaaaattgattcttaaattctgtaatggccttctgaattaatgcatctgtctcgctgttgatctcacctgtttcgcggattgctttatagatttccggatactttgtttccacaaattcatagagtcccttttcaaactctgcaatacgttctaccggcacatcaagaagatactttcttgttaccgcataaatgataacaatctgcttctctacagcaagtggctgatactgtggctgctttaatacttctttaatacgctcaccctgtgcaagacgctctcttgtatcatcatcaagttcggaaccaaactgagcgaatgctgcaagttcacgatactgtgcaagttctgtacggatcggacctgcgatcttcttcatcgctttaatctgtgcggctccacctactcgtgatacggaaagacccgcattgatcgctggacggaaacctgcgtggaacatctctgtctccagatagatctgtccgtctgtaatagagataacgtttgtcggaatataagcagaaacgtcacctgcctgtgtctcgataatcgggagcgcagtaagggaacctccgccaagttcttcagagagtcttgatgctctctctaataatcttgaatgaagatagaatacatctccaggatatgcttcacgtcccggcggtcttctcagaagcagggacagggtacgatatgccgtagcgtgcttacttaaatcatcataaatgataagtacgtcttctccacgttccatccactcttcaccgatcgcacatcctgcgtatggtgcgatatactgcagcggtgctaattcactggctgtagcagcaacaacagtggtatatcccattgcatcatgttcttttaatgtctttacgatacttgctactgtagaagccttctgaccgatggctacataaatacagtgcatattctgccccttctggttgatgatcgtatcaaccgcaatggcagtcttacctgtctgacggtcaccgataataagctctcgctgtccacgtccgatcggcaccatagagtcaatcgccttgattccggtctgtaccggagtatctactgcctgacggtcgattacaccgtaagcaactctttctacaggacgatacttttctgtatcaatcggtcccttttcatcaatcggctgtcctaatgcgttaacaacacgtccggtaagtgcatcaccaacaggaacttctactactcttccggtagtttttactacgtctccttcgttgactgcgcgagaatctcctaaaagtacaacacctacgttgtcttcctccaggttcatgaccataccgtacacttcacccgggaattccagaagttctccctgcattgcattctccagaccatgaatacgcgcaataccatctgccacctggatgacggtaccgacatctgtggtttccagcttcgccgtataattcttaatctgctccttgattacggaactgatttcttccggtcttaaattaaccaagcccaactacaccttctttctccacactcaactttgataatcccttgctgagcttctcaatctgcgttttaagactgctgtctaacactctgtcttctattcggataatcagcccgccaagtacagacgggtctacctgataatcaacttcaaaggaagtgtattttgtcgtctctaaaagacgctttgtaagtttctccttctgacgggcagaaagttctgttgcggaaacgacctttaccttaccaattcccttatattccttcgctttatctacgaaatattcaaaaatctttggaatgtctttctgtctgtccttttccacaataatatttaagaatcccagtatctcatccgatgcccgcccggaaaatatattcttcagcaagtctaacttctctatcttgcttacttccggatgatttaaaagagagagtaagtccgcattctcaagaagaatctgctgcaatgtctgcacctcggataaaagggcatccatcttgttctcctcaactgccagctcaaacaaagcattgccgtaaatactgcttactcgtttagccatgtcttatcccccatctcttttaaggtctgctcaaacagagcattctgtgtctcctcatcaacagatgcggcaatgatcttctcagacataagtgcagcaactgtaatgatctcctgcttcacttcatctttgacacgtttcttttcaagctctgcttctttctttgcattatccatgatacgggccgcctccgctcgtgcatctgcgataatttcattctcccgctgcatggccttctttctggcatcacttaaaatctgttctgcctctttatcgattcgttttaacttcgtatcatactcatctttaaaacgaactgcctgttcccgactctccttcgcctctttttgttccttcattacccgctctttacggtcattcaaaatctttcttaccggatcaagaagcagataacttgcaagtaagaacaaaataaagatagcgagcatctgaaatgctacctgaaataaaagctgtgggtccagaccaaatattctgttatcatactttagggcctctaataacactttatggcctcctttcgaattctcgaggactcatcttacagctttccgatcaatgggttagcgtacagaagaatcagcgcgataaccaatccgtaaagacctgttgtctctgctacggcctgtcctaaaagcatggtagacatgatatcaccttttgctcccggattacgtcctactgctgaagcaccataaccagctgcaataccctgaccaacaccaggtccgatacctgcgataaccgcaagacctgcaccaatcgcggaacaagctaaaactaaaccttcgtttgtaattcctgtcataataaactcctccttaaatacacttcactcttttgtcagcaaaccatttcttctaaattcttactcataacggttcgctacgaataccattgtcaacattccaaatacatacgtctggattgctccggaaaagaaatcaaaatatgcatgtagaaatgccggtattccaatctttgcaaaccacggcatcaatgcgtaccacagacccagcataatggttcctgctgttacattaccgaacaaacgcagtgacatggagaccggcgtggcaaactcactgatgatattaattgggagaaagattggaaacggatctaataaatcttttatgattccaaatccctttgtctttatccacgcatattcaatcatcacaaatgtgatcagcgccagaccgaatgtggttccaaaatctgctgttggcggccgcagtccgaaaagtcctgaaatattggataaaaagataaacgccatcagcgcctccacgtaattcaggtacttcttcgcatgaatacccatgttgttctcaaccatggcatccatcttctctacgatcatctctactacattctgtacaacattcggttcgtcataatttttcatgatctcatgtctggcgaacaatatcaatgccagtaatatcagacagacgatcactgttgtaaccatagtagtattaatagagagggtagtcccaaacagcttaaattcataataactatggataaaaaaatccacatcgctgcttcccatacctttaccttcctttcttatataatttttttgttatatatacattagtatatgcatggaaatgtgcagatatcttcaacccaaggattccaatgatgattcccggaaaactaaaatatcctgagcgcattccgatccatgcagccaacaatataaccgctgatctgaaaagtgagccaagtgccatacttcttcccgccttctgttctgtcatcacaagacaacggttcaggcctttgtacatgctcacactaagtccgaccgctacagctgttccaagcaaaagtcccatactgtagctgcctttattctccacgacaagaagtcctattacttcaaaaacaatactgtatacaatacatccgaaaatcaaatcaaataaagtctcattgtctttatttatccatcttctccagttcacctttatctgattctcctttccttctcccactgatgcaagtgaaaaatctttgccagctgcacacaaatctttactttataaaacgcatgatcatcatatagcaggaacggaatcccgctaatattcccaacagaagaaacagcggaaaaatccagctgatctgcagtctctcagataaaaactttccaatgatcatacaaaggaatatacaggtcagcatactgattcccaactgagtgatcaacgcaagcatccttaaaaaagtatagtccttctttcttcgtatcatacaagaagttctccgataattctgtctgcaaccgcttccatcagcggctctagtatgtcaaaacactgctgatatgtctctgggtcttcttctgtcaccttcggaatcttctcctctgcttctgtactgtctatatctatgaatgttcctattgacatatagctggctgtctgtacatcaaaagattctttgatctgttctgccagtccttttgtaatagtcagcaccagatctgctgatgcaagatcttcttccgtaagctgagcagaccggaaattctctatgctataacccttttctcttaagatctttgccgctcccggagcaaccggctctgagaaaagtacaaccagtcctcttgacactacctctatattctggcagtttctcttctgcaatatacctcgtaaaatacattctgccataaagctccggcctatattagtctctcccactataataatcttgcgataatccaaactaatccctcctatagtgtaatcagatgatagccggctgcttttaacatacggttcataatagcattccccaaaccttgctcaaaaaaactctctgaatacatataatcacattccagatcatcaaattccctgagaatgcggtacagatttgccgcaacagattccggcttctgtctgcttccaatacttcttaaaatatccgcatgataagcatccaacgtttcgtcagttcctatcacacctactttatatccctcttccttcttctctctgacaagttcattaatcttagcgatcactttatccttatcaccttctaccagagtaagctggcctttaggcgcataatgacgatacttcattcccggtgccttagctacaacgtccttcttcatagtacgtccggaaactgccggatcaatcttcacctccggcaaaacttcttctaacatatccttcgtaatatatcccggtcttaaaatggtcggaatacctatactcatatcaatgatcgtggattcaatccctattccgacagctcctccgtcaagaataagaggaattctgccctgcatatcctcatatacatgggatgcaagtgtcggactcggtcttcccgatgtattcgcactcggagctgcgatcattcttccactctcccggataaaatctcttgcgatcggatgagacggcatacgaatcgcgaccgtatgaagtcctccggttgtcccgtccggtacacaactctttttatttaaaataattgtcaaaggtcccggccagaacttctccatgactgccttcgcctcatccggaacttcttctgcaatctcatacacctggctgatatcgtggatatgcacgataagaggattgtccgaaggtcttcccttcgccgcatagatcttagctgccgcctctgcattcagggcatctgctccaagaccatatactgtttctgttggaaaagccaccagaccaccttcccggataatctctccagcctttctcagtgctgccgccttctgttctgacgacacactctctatatttaataattctgtctccacaaatgttcacctctgatatattgatcaaacgctgcctaaacgaccgcgttcctgcacttagcacattataaaatcgattatctaaaaatatattaactgacttttgcatcatatcacgttttggctataaagtcaaaaaaagccacctttgcgtctgtatttttcagcacttttacactctctaccggttatgtactctctttttttctcatatatataatgatatatataataattaaggatctgcattatgaagatacatacgcatcccattattctatctatattgctgttttgtttcgctgccggcgcattctttatcggtcatatggccctttcttatgctacgttccaggcaacagaaaacttctgtgttcttcttgatgccggacatggcggagctgacccggggaaagtaagtgcttccggtattaaagaaaaagatattaatcttgctattactctaaaatgtaaatctgtcttggaacagaatggtattaaggttattctgacccggagtgaagaccaaagcctcgaagacggcagttcctccaataaaaaatccagtgatctaaaaaaaagaaaagcgcttatcagagaaagtaaaataaactgtgcagtaagtatacatcaaaacagcttccctgattcttcttcctgcggagcccaagtattctatcacccaaattaccccgaaagcaaacgtctcgccggtctgatacaagcacagatgcacagccttacaggaatagaaaaccaccggaaaattaaagcaaataccgactattatcttcttcgggataatgatactccgactgtgattgctgaagtctgcttcctctcaaatccatctgaagctgctatgattgcagaagagacgatacaggaaaaggcagcctttcaaattgctatgggaattatgcagtttctgcacgttcatccgacgaattcaccgtcgatattatccgaaacctaactattcaagaatgcatcgtcttctctaaagccttctcttttgtcaaaagtaccatctgaataaaatatcttctgatataaagtatcttttgatatgactatggatatacgcaagaataccttacattcttgctgcaaaatacgttcctattccgaaactgatatctcacttacctgttaccagctgactgatcatcctgtattcatctgttactagctatattactaactatgttactacctgctgccagtttgctctgtatcctctcttcaccgccggaaataccagcgcaagcacagtataccatttttgtttttattttacaatattttccttgtgtattttctttcctttttcttaaagtgcaatattccgctatctgcggcacattttaacactttacagtttggggaataatgtttatactatacacacacagatatctgtcagcatatatctgcacatattttagaaaaagccggcatctgtggcatatcacagcattgcctatccgtacctgctgacagattattttttgaaaaaggaagtgattttatgaaattagagaaattaagtgacacccagatacgttgcactttaagtaaagaagatttaacccagagacagcttcatctttccgagcttgcctatggttccgaaaaagcgaaagaattattccgcgacatgatgcagcaggcatccgctgagcttggatttgaagcagagaatatcccgcttatgatcgaagcaatcccaatatctaatgactgcctcgttctggtcgttactaaagtagaagatcctgacgaacttgatactcgattttcaagattctctaaaataaatatggatgactcatttgacgaagacttttccgagatagacgatgatgatttcgataccatcgattttctcgatgacgaagaagatgacgacgagataggtgatgaacctcttcccttctcttcttcagaagatttagacggttctgattcctatcagaccagctcttctaaagcagactcttccaaggaacgctctgccatcgatgaagcactggatttgattgcacctttcacacaggcgatcgcccaggctaaaaaagatgccctcaagaaaaagaacgaaaagaaaacagccgctcacgactgccagtattactctttccgtaacttctcccaggcatcccagcttggttctttcctggctccattctatgaaggagaaagttccctgtataaagatcctgtttctaataattactatatgatcctgcgcaaggcagaaagtcaggaagatgccttccaccgcgcctgcaatattgccgcagactttggtgtgagaatctccgcatcttatgcaacaccagcatatttcagagagcattttcagacgatactcgcagagaatgccattgaaatgctctgtgagctggtttaagatttcatcacatatgctaaaaaatgacctaccccagatgcttcgaagctgcatccggaataggtcattttcgtctgtactaaatttacaatttaaatctacaacttagagattatttgtctttgtttgcaaggtaatcgttgatgcgttttaatacctgatcagcatccattccatgtaccatgcaagcttcttctaagctttccatagcggaagatgggcatcctacacagtgcattcctgctgccattaagattgctgcgattcccatatccatctgaagcatttcaccaattaatgtctgttttgtaatctgctgtgccataaatatatacctccaattcgtatattgcttatgctcctgcgagctatcaagcggttttatctgtttattttgacttttgcaagcctgaatttcagtataatacatgaaagaaaaaagttcaactgttagattgtcagttattcttgattatttctcaaaaactgtcttttttagaaagtttataactgttcaggcacaaaattaaatacagacaaactgcttatttttcaatggctttaataagattgatcatttcaatcgcacctacagcacaatcataacctttgtttcctgcttttgttcctgcacgttcgattgcctgctcgatattttctgttgtaagaattccgaacattaccggaacgcctgcctgcagaccaacctgtgcaacacctttggatacttcattacatacatagtcatagtggcttgttgatcctctgattactgttccaagagcgattactgcatcatatttacctgtcttaaccattttttcacagattaatggaatttcgaatgctcctggtacccatgctacatcaatgttttcttctgaaattccatgacgtacaagaccatcaatcgctccgcctaataacttagatacaataaactcattgaaacgtgcgcacacgattccgattttctctttttttcctactacatttccttcgattacatgatatgccatctttttatcctccatttattttaaatatttaacaagttgttttttataaagtctgattgggcaaagctgctttatttagtattttgtgtaatgccccatcttttcctgctttgttttcaggtagaataagtcatcggagttcgcctcaatgataatcggaacacgctctacgatttcgataccgtatccggataatccaactacctttgccgggttatttgtcataagacgaagttctttgattccaaggtctgcaaggatctgtgcaccgattccgtaatctcttaaatcttccgggaatcctaatgcaaggttcgcttctacggtatccattcctgtatcctgaagctggtatgcttttaacttattgataagaccgattccacgaccttcctgacgcatgtataagagaacgcctcggccttctttttcgatcatctggattgctgcgcggtactgctgtccacagtcacaacgacgggaacctaatgcatcaccggtaagacattctgaatgtactcggcataataccggtttaccatctgacacatcaccttttacgatggcaacgtgatgctctccatttaacttattaacatatccaaagatacggaaatgtccatagtgtgttgggaaatctgcttctgcttcacgacttacgaagcattctgtctttcttctatactgaatcatatcagcaattgtgataagctttatgtcgtatttctttgcaaattctacgagatcaggaagctttcctacaaagccgtcttcgtcaagaatatcacagcaaagtcctaccggacgaagtcctgacataactgctaaatctactgctgcttctgtaaatcctgttctctttaatacgccgccctttcttgctaccttcgggaacatatgacccggcatacggaaatcttccggtctggcatcttcctttgttgcagcgataactgttgcggaacgatcctgtgcggaaattcctgttggtgcatctgctttgtcaaaggatactgtagatacagatggctctccgtctgttccctgccagatcaatgcttctaatccaagctgtcttgctacatcttcagacatcggcattgtaattaaacctttggcattcgttgccataaaattgataacttccggtgtggcaaattcgccggctaccagaagggaaccttcattctccatatcgtcatcgtctactgcgataaccatctttcctgctttataatcagcaattgcttcttcgattgtgttaaacttaatgtcgctcatttatcctaggtcctcccttaattagaatccattttgtctgagaaaatccattgtaatgcccgttttctctgtcgtgctctcttcttcctcatccggtatacttccatactgaagaagcttctcaacatatttacctaccatatcattctcaagatttacggtgtctcccggcttcttgtcaagaagggtcgtattctgtcccgtatgtggaataacagaaactgcaaagctcttattatcaacctttgctacggtaaggcttactccatcgatcgtgatagagcctttacttataatatattttaatattgctgcagaagtatctatcgtgatccatacagcattatcatccttcttcatggaagaaatagttcctgttccatcaacatgtcctgctacgatatgtccgccaaaccttccgtttgccgccatcgctctctcaaggttgaccttgcttccgctctttaactcaccaagattcgttcgtcttaatgtctcatgcatcacatctacagaataattattctttccaatagatactgctgtaagacagacaccgttaagcgctacactgtcacccagatgcagatctcctaaaacagtacttgctttaattgtaatgactgcggaattcgcaccttttttaatgctctggatttctcctacttcctcaataattcctgtaaacatacaatctgcctttctatgcttctatataatttgacttcttttataccagatcactgcatgctttgtactttcgtaatcttcaaaaacattcataatctgctcatttttcttcgaaaactgccgattactgcaattcctgcgctttttcgtattccagtaaaatatcctgcccgaattcctgcattcctattctattaaactgccatgcatcggctgcccgagtaagtccctgcccttctaccggagtctttgcctgtgcccctccaaaaatcttaggagcaatataacaatatattctgtccacgattcctgcctgcaatgcactctcgttaagctgaccgccgccttctaaaaggataccatcaatcttacgtgccccaagttccttcatcagaaccggcagggaaatcacttctttttgttcttctgttatatccgctgtcgttactcccggaatccgtaatacttccacacccttttcctgaagctgtgctgccttctcttcatcggcatccggcagacacgccacaataagtggctgctgtccggcagtccgtacaagctgggagtccatcggaatccgcaaatgactgtcagcaataatacgaatcgggtctcttccgccttctatacggcagttgagcatcgggtcatccgcaagaactgttccgattcctgccataatacctttataatgattacgaagcgtctgaacatgtgcccttgattcctcgccggttacccacttggaatccccggtataacaggcaatcttgccatccatcgtcatcgcatacttcatcgcaacatatggtattccggtacggatatagtggaaaaacacatgattcatcgcatcacattcttctttaagaaaatgtggaatcacctcgattcctttctcgcgaagcatctggaatcccttaccagatactaaaggattcggatcgtctgaaccaacaactactctcgcaatcttctcctcgataatcgcttccgtacaaggaggggtctttccgtagtggcagcatggctctaatgttacatagatcgtactgccttccaggctgttccctctcttcttcgcattcgctatcgcattacgctctgcatgaagctgtccataacattcgtgataaccctcaccgataatctcaccgtctcttacaataacagctccaaccagtggattcgggttcacatggccacttcccttcttcgccagttttatggctcttctcatatacttctcttccggcatgtctcaaacctcctgcaagtaaaatcagataaaaaatcagataaagaaagaagcctgtaaaataaaaataccctgaaatctacatcgataaatttcagggctataattatcttaatcattcataatacttacatagtctctttcttcttctcacatccggactgtaccgtcggctccggaatcacaccggatcatgctgtcgctcgcgggcttacgcttctttctaatatcaaaacacaaatcaaaaacgcttaccgccggtcgggaattacaccctgccctgaagaatatttatttccatgggtattatagcgcattatgctatattattcaactgttttttatacatttttcacaaaacattttacccaaaactctttttgcatgatctgcatcaggaattcaagtcgagccgccgtcactcaccacctgaaagaggtgggagtcttctcgactgagataaatcactttccaccaatctgttcttcataaacactgataagatttacgttatatttttctacttcattcagacaggatgtgtcaaaatcattcgccgcaatctgtggaacataccactgctgccgtttaaaatactcctgtaactcctgatcgttaaacattcttccatgacgggcaaagatttcattccttgtaatcttcaatccatacgaatcaagaatcgataaatcctgtaatgtgtacttcgtcactgttgtataggataaatgatctgctttctcgtagcggtttgaactcttctcattcccctgaataagatatacccttgcatctgcctcactgacttctgtatcgggatctgaatctgcagccgcattcgtattcttatccgagtcagtggcagaatcaagaaactcttctatgtttaaactctcttctgtactcttctcttcctgcgaacctttctgctgttctataccctgtttctgtttcttcatatattctgtatcagcagcagcaaccagctttgcatcttcattcttcttaaccatcttaaacccaatgattacaattcctacaacagaaaaaatgatgattaccgcaaaaatcatcaatcctatcgttttatatctctgttcatcacttctcattcatctagcctccttttggggcactacccatgtcctatctggattgctttaccaacattataaatgaatttccatttgtatacaaccccaaacgtcaatagttaaaagtaatttaatatcttacaaaatttaatacaatttttctctcagtttatgcttgatattaaaagaaatctagtatagaataaggaatacagaacataaagttcaatttatctaatctaaaggaggatactataatggcatatgtaatttctgatgattgtattagttgtggaacttgtgaaggtgaatgcccagcaggcgctatcagcgaaggtgatggaaagtacgttatcgatgcagatacatgcatggattgcggttcttgtgcaggcgtttgcccagcaggtgctatcagccaggaataattcgttacgattaacgaagtgtaaagaagacatcgtgaaggcggtgtcttttttatttattttaattcaagaaagcctgatataacatttatgatgctataccaggcttttacattctcatttatcaaaaagatgtcacgaaagtatatattataatttccgcttatttttacggaaaaacaggctcttttttcttgtgccatctttggataccgctacttcctgtcttgctttttgaacacttcggatcgtttcatccagccgtttatatcgttcctcttcgcgctgttcctgctctaccatcagctcgtctacttcccgaagcattttattgcagagatgattccccatggcatctccaagattttctgcctgttcgcgaagtgcttttccaacaatccggcccataatatcttcaaattgctgcattttcgcttctcgttctgcaactgctgcatcttctgttttattatgaatcgcgattactttgcagttttttccagaatcaacttctgtctcttctctgtttcttcctgctatgtttttatttttttcttcggttccttttcttctgttttctttttgtatatcctctctttgtacctcttctctttgtgtcatttctttttgccttgcctgttctagctgctctaattcctgattctcaagttcttcctgtgttgtcagtagtttatgtatatcaatcagctttttttgctctagatccggcagtacttctttgactgcttttaattgaaagcctttattctttaattctttgatacagtgtaacagctgtatttcttcttcacgataatagcggtgccccagttcatttcttggtattttaagttcaagttcctcttcccagtaacgaaggacatgattttccaccgacaaaagccgggcggcttctgagatggtatatttgttttctttcataatatgatccgctcctgttccacacaatatattttacctgaaacatactcaagcatggttttattatagcaactttaagaaagcactctcaatgccattcgtcctctaaataaagataattactgacaaatacgggcaaaaaaagcaggttatctacataacccgctctttattcgcaaacttcgtatactgaccaagccataccagctcgacacttccggtagaaccgtttctctgcttggcaacaattacttctgccagattctttttctcggtatccggattataatattcatctctgtacaggaacataaccacatcggcatcctgctcgatcgctcctgactctcgaaggtctgaaagcatcggtttatgatcctgtcttgcctctactgctcgcgaaagctgcgagagggcaatgatcggaacatccagttcccttgctaaaactttaagtgctctggaaatctcggagatttcctgctgtctcgattcattccttcgggattcgcttccggtcataagctgaaggtaatcgatcacgaccagctctattccgtatgtctgcttatattttcgacatttagaacggatctctgccagcgttgtcgctgtatcatcaatgataagctttgaattaccgataagggcagcgccctctaaaagcttttcccagtcggaatctcttagatcaccggttcgcatctgctgagaatctaccatggattctgatgccatgagtcttgttacaagctgttcttttgacatctcaagactgaacatggcaacggcatgattatctttaaacgctgcatactgtgcaatattaaggacgaatgctgtctttcccattgccggacgtgcagccacaagaataagctctgccggatgaaggccggtcagtttataatcaagctctgtaaaaccagtagctatcccggtaacccgcccttttgtctttgaggcttcttctatcgcacttaaagaattcaaaacaatctgctgaatcgggacaaagtctgacatacggtttcgattctgtagaagaccgaaaatatctttctctgttttttcaagaatcgcttccgtatcttctttcccaagataacattcattcccgatattctccgttaccttaatcagtgcacgtaacgttgctttatcgtgaacaatctttgcatactgtccaatattggctgctgtaggaactacttctaccagatcacgaaaaaagtcaaggctcatcagttcttccggaacttccttttcttttagcttattctggagagtaatcagatcgactgcctttccttcccggtaaagttctaccattgcctcaaatacgattccgtactggcgctgataaaagtcttccttcgtgaggatatcttctgcctcaacgatagcatccctgtccatcagcatggaacctaaaacggaacgctccgcctcctcactgtgaggctgtattctttttataaaattctcgtctactgttggcattgatgatcctttctaagacggcgggaattgagattataatctcaattcccgcctgtcttctgatgcgttactggggttgctattttatagtttcctatatagctttagtataacaacaccactaaaatatagaaatattttaaaagttcattataagaaatatgaatttttaatattacttttctgttacttttactttaagttctgcagttactttaggatgtaacttaatctttacattatgaacaccaaggctcttgatcgcttcatttacggaaatcttctttttatcgatatcgtaaccaagctgttctttcgctgctgcggcaatttcttttgtggagattgcgccaaatgtacgtccgccttctcctactttcatcttaagctctacactcttatctttgagttcttctgcaagaactttcgctgctgctaactgttctgctgccaccttatcttcatgtgccttctgaagctttaaatcattgatatttttgctggtagcttctacacctagcttctttggaaggataaagtttcttgcatatcctgcattcacttccactaactgacctttttttccaagagactttacgtcttctaataaaataactttcattttaatcctcctatattgttaatgtcctcaccacctgaaagaggtgggagtcttctcgactgagataaagactctgagagtacatatttagaaatcttatatatcgccatcttcacgcatctgctgcaaaacatcttctaactgctgctttgcttcttcaagggtaacattttttaactgggccgccgccatcgtaagatgaccaccgccattgaacttctccatgatgacctgtacattaagctcatcaatggaacgtgcactgatatatatacagtcctgtaacgatgtcaaaacaaaacttccccggattccctgtatatttaacaatgcattggccgccttggccccgacaacagtcgctccggatacatttgctccatcgaaagtggaaatagcaaattcatccatgtaaatctcagccttgttaataatggctgtccgtatccggcaatgttccatatcttcacgaaacatctttcttacgcgggtcacatctgcacctgctcttcttaaaaaagccgccgcctcaaaagtacggacacctgcttttataacaaaattatcggtgtctacgagaataccggaatacatggcatctgcctcgatattcttaagcttcggcttatctacgatatactgtaaaatctccgctaccatctcacaagttgacgatgcgtacggttctacataagaaacaactgcgttctttatcgtttcattattctgtctgtggtgatcaagaacaacaatcgttgagacagactttaaaagctccggacactctgtcattgccggaagattgacatctacaacaatgagcatcgctgacttatctttaagaagcagcgcttcctcattcgttacaaaaatatcttcctcttcctctgcccgctctttgtagattccctctacgatcggttctattgccggacaatccttatccataacaatatatgtgctcttactcaaagtctttgacagacgataaataccaagagccgcaccgacacagtctgcatccggattcttatgtcccatgacaaaaatcttatcatgcgtaagcatgatctcacgcagtgcatgcgctttcactcttgcctttactcttgtactcttctctactttctgtgtcttgcctccgtaataagaaatcgtatccccatctcttactactgcctggtctccacctcggccaagggcaagatccattgccattcttgcactttcatatgtttcggtatagcttcctccattcacaccaacaccaatacttaatgtcatggacagctcattaccaatattgatcagacgaacctcatcaagaatagaaaatttagattccatcagctcttcgagcttctcttcctcaaatacaaagagaaacttatccttctcgaaacctttgatgatcgcatcaagtccctgcatgtacttcataatctttcgttctactaatgcaagtaaaagcgactgccttacttcttccatattttcaagaacttcttcgtaattatcaatatagatcagtccggcaaccagactcttcttcttcgactcttcctcatatccacgaagctgcgtctcatcaaaaaagtaaaatacctgaagaacgtctccttcagccccatcatcctgaatctcttcctcttttccacgttccagattcttaaataccatactcttacattccacatgatatttatgttcttcctgtgtgatacagtattctttcgtctgtccattctgtggaaaaacctttttgtaaaggcccggaaagatctgtgtgatactcttctttatgatcttttgtcccgcgatttctgaaaactgtttattataccagataatcgttccggactggtctgtcattacatacggcaccggcagttctttaagaatctgcttctggatctgactctgttcaaaccctgccgtaagcaattcattattaatcatcttttctgtatattcgtaacacaaaacagatgcaataagatatatgacatctcctactaagatcgtatatccaagaccgggattcacttcaatcacacctaaggccgctaccaatataaagaccaccacaataataggcagccataaattcagtgcgacctttcttgatatattcttttctcgtttcatttctttctcccaattaggaaatatacattgtttccagctcacatgcaaaccctctatgtggcctgcagctgagcagcaacctctctgattctaaattgttacagatatagtatgagttattatagcactgtttttcctaatttaaaagcaaaaaaacatccctgctgtgattcgcccctaaaactctccggcaaaaaatgctgtaaagttgttttatatcttcaattttttcagattttaatccttaatgaatcctaatgaatcattgcgatttttgtcaaaattcagtataataaacatcagtaatatttcatttaagggaggttcgtatgaacgataaattttcactattaaaaagaatgcgtcgtctttccggtattttagttcacccaacatctttgccaggtaagtttggcgttggagatttaggtccggaagcctatcgttttgtagatttcttacaggaagccggacagcatttatggcagacacttcctcttggccctaccggaggacataatagtccctatcagtgtttctcctcttttgcagggcagccattactgatcagtccagagcttcttctgcaggaaggtcttcttgcggagtcggacttaagtaatgttcctgcttttccggaagaagaagttgactttaaggctgtacaagcatacaaagaagaacttttcaaaaaggcatttacccgttttaaagaacttccggaagaaagcgagcttaaatccgaactggctcttttctgtaaaagctctcactggttagatgattatgctatgtttatggcaatcaagaagtccaaagacggacttcactggttagaatgggagaagaaataccgcaaaccaacgaaatctcagaaagctgtcatcgaacgtgacctcgaagatgagattctttatgagaagttcctccagtggacattcttccgccagtggagccagctcaaagcttacgcaaatgagcgcgatatccttttaatcggtgatatcccaatcttcgtttctggtgacagttctgatgtgtgggctgaaccaagattattccaggtagattctgatggattcccaaccgttgtagccggagtaccaccagactatttcagcgccaccggacagttatgggggaatcctctttatgactggaaatatcacaaaaagaccaattatacatggtggatggatcgttttaagacacagttcttattaagtgatatcgttcgtattgaccatttccgcggtttagaaagctactgggagattcctgctgattctgaaactgctttaaatggcaaatgggttgatggaccgaaggatgatttctttgaaacattaattcaatcttttggagaagaaccacctatcatcgcagaagatctcggtattattacagatgaagttcgtgcattacgtgataagttcggattaccaggtatgaagattcttcaattcgcttttgaagatgatgacagcaattatcttccttataatcagccatataactgcgtatgctatacaggaacgcacgacaacgatacaacaacaggctggtacgcctctgcttccgaaaaagcccgcgataaagtacgccgttacatgaacaccgacggctcccagatcagctgggacttcatccgtacctgcttcggcactcctgcccgctttgctttaattcctattcaggatctgttctgtcagggaagtgaatatcgtatgaacactccgggaaaagcagaaggcaactggacttatcgcgtgaagaaagaacttcttaccagcgatgtcgcaaaacgtctttatgacgtaacaaaactttacggacgttaaaacgtaaggaagggggaaatcatgacttttcgttctatctgtattgcagtttatgtgtttttttatttgatctttacgactccggaaaggattcgtttaaaaaagcttgaacagaccgacccacaggaggcttcccgcatcgcacaggcgcatgttcaaaaagtatttcgacatcttttaaaaatatccggtgtcacgatcgaggtaaatggactcgaaaatatccctgatgaagctgctcttttcgttggaaaccatagcagttactttgacatcatcgttaccggcgctgccatccccggcggtgtaggctttgtagcaaaggacagcctcggaaatattccaggactttcttcctggatgaagcgcattcactgtctgtttttagaccgcaaagacatccgcaaaggattacagaccatccttgaaggcgcagaatatctaaaagaaggatattccatgtgtatttatccagaaggtacaagaagtacaaccggagaacttggagaattcaaaggcggcagcctgaaaatggctcaaaaagccaaagcccctattgttcctgttgccatccgcggcactagagacatctttgaaaataatccggggcttcgcgtctgtccatctcacgtaacgatttcattcggcacaccgtttaaaatctctgaactcccagccgcagaaaagaaatttgcgggcgaacatgcaaaacaggcgatcgcagatatgcttgctcaacaataaatagtgaaaaaatagcataaaactgtaattttttcttttcaattaacgtaaataatgttagaatgaaatttgtgttatcaaaaagaaggagcttccaatttttctttactgcacttacttttgcagaagattttggaagtacctaacaatgtacaggaggaatattatgaacccatggatcgtttttgcaattatccttttaattgcactcgccattctcggattcctttattacaaaggttccaagcttcagaaagaacaacaagaacaaaaagaacagttattcagcgccgctactccggtcactatgctcgtaatagataaaaagagactccctttaaaagattccggtcttccacagattgttattgaccagactccaaagagagcacgccgcgctaaagtgcctatagtaaaagctaagatcggaccaaaggttacaagtcttatcgctgatgagaacgtatatgacttaatcccggtaaaagctgagattaaagcaatgctcagcggcatttacatcacaagcatcaacaacttccgtaaagctccggttccaaaaccagagaaaaagggaatgatggctaagcttcgtaaaaaggcggatgatttatccactaaataagtttgtttttgtgtgaacagacagacgaacctaaaaaagaagagatataacaaatgcttcgtatcactgcactcttaatgctcaatcgcattaagagcttgctctaaggcgcatttgttatatctcttcttttttaggttctgtttgttggaacaaaaatcaaattgtgaatggagtgaatgaaatcatcttgtggttagaaggggataaaaaagaaaaattattctctaaaaagtttgagttttaattttcatcttctttcccgaaaaagcaattcccatttttaaaatatttataattccatccttctccatttcagtactgtagcggttagaattaatctgtttcaaagcagtttccgacaatttttctaattctgcttcattcaatccgccttttgattttaattctatgattatgcccgaatattttttatttcgtggaataaggctgatatcatatcgcccatcgccggattctctattggattttattttatactgggtatccgtaagtgaaactaatcccaataataagccatgataaaatccctctgtaccagcatcataaaaactaattgttttatctatatattctgtgattgcatcctgcatttttcccaaatcattggtataaatactttctgctattttatttgctgttgttcttttaattgcgccaatctgtaataaatgcgataagatttcgtttttatatacagcagcgatttctttatttggaatagaaacttcgcataaataagaaccatctgcctgcaattcttttttcaatacttttaaatagccagtaaccaaaagcaaactatatatattttctggttcttcgctgagtaatttgtaaacaacattttggtcaattcttgctattacacattctccctgtaaaagagcatacagtttttgcgtgatatcttctgtagcgatactcagaacatcgcctaaaatctcattttttcctgtatttacccaataagcctgtggaatacagccttttgcaatataactaattaccgaccacggattatagatttcttcgctgccaaaaatatagccatcataccattctttcagttctttttctttatctgtcacattatagtattctaacatttcgtatacttcaggataggtaaaaccaaagaaattactatatgcattatctagtacagaatttacaacaagattgtttaatccactgaaaatactttcttgtgcaatccgcaaaattcctgtgagaaatccataagaaagatttttgttatctttaaatgctccagagaaaaaattacgcataaatccaatgatttttttgtagaaatttctagaatatccctcctgaataggggtatcatattcgtcaatgataatgatgggggcttttccatggtgttcggcaagcattctggataaaatctctaaagccgatgtaagttctacttctgttgctgtcccgttcataatcttaaagaaatattgtttttcatattctgcaatattttcgctgttcataagctcgcgatgccttccaaactctgcttgaagcagtactctgattttatctattgtagcttcccaggaatcaaactttacatctttaaaagtgagaaatataaccggatactttccctgatgctttgtatacttctccccacatttccaaattattttatctgtaaaataaatacttgtatcttctgtactcttttcaaaaaacacccttaacatatccatgtttaaagttttaccaaaccttctcggtctggtaaataaggatactaatgacttttggtccaaaaattctttgattaacagcgttttatctacataatagtactctgcctgcgctcggatataatccgatatacctataggaagcggttttttctcttttgaaacatcttctttgtgatagctatctttattcatatgaactcctccttcctttttattaggttcattataacagacgaaaagccgaaaatacaacattacaatttgtagcttttctgtttatttgaaaagagtagatattttttatacgactagaaacagggaggcttgtctgttcatcatctcaaccccgtataatcaagaaaaaaacaagtaaaactgactgtttctcttccttcattccggtaaacatgcatctgatctgtttcaaatttataaacctgttctttattgattatctgcgtatgcccatgacattctatcgtaagtacaccttctgttactgtaatgtactctcttgttttttctccatgactcccactcatatagaccccgccgggttctatgtcaattcgatatacttctacggaatgagaatcttcataaggaaaacacgtccagactttatattgcccttccagttcttttgtaggaaaaatttcttttggacttacaaggcaaaaatcttctctcggcgcatcaatgagtgtctgaaattctatgcggagtccgcttgtaattttcccaagcacaccaagagagggattagctgtacctttttcaatctgagcaagcatacttttgctgactccggtctgttccgcaacctcgccaaggctcattccctttgacaggcgaatctgttttaaattaatcgctacattatatgacaaataatccataaaaatcctccttgatgtgatgatttgcagaaaatatcaatccaaatcgctaattaatgtcaccataatatcaaaataaccagaagactacaactcaaatcctcacaaaacttctatttatcaaagacagaaggtcctgcatttatattttagcagatgcgtctttagagcgagcaaaaatgctaaccaggcattttcgcacagcgaaacagagcagatgctaaaatataaatgcaggaccttcgtctattcattaaatagaagccagcaccctgtcaattgctgcatcgattactttatcaagttcttcatcgtctgcttccggcataagtgttgctgcatcttcatcagaaataagttcaacaagatcaccgaaggattctttgtattttctcttacatacgacatagaatactacaccgagtaaactccaggctcctaccattccccattcaggaaggatcaggcttccgccgctgcctgggatacagtacatacataccataaatccggacatgatgactgccatcgttccgaagaatttataagctggaactttatatggtcttggcatatcgggttctttttttcttaatatcataaaagaaaccgctaccatacagtaagcaagacagcatgcgaagttacctgcatcagaaatccatacaagaagctgtcttccggcaaatggagcaagcattgtaaggacaccaataagaataagtgcattaattggcgttttatgttttggatgaagttttgcaaatgtttttggaatcatataggattctgccatggaatacattgcacgagaaccaccaattaagaaggagttccaggatgtgataataccgcacataccaccgacaataactacttttgccatgattttcattccaaatgctgttcccattgcatcggctgtaacaagtccggttgcttcctgtgattttatgatcgcacctgagtcaaggacaagtcctacggcgataattacaagtgcatagaaaacaacggctaaaattacagataaaataagcattttaccgattttctttggaggaacattaatttcttctgctgcctgtggaataacgtcaaaaccaataaaataaaatggtgacattgctgcaacaccgagaattgctttaatattaagtcctgcggtgtttccgacaaacatctgtccattcagattatccaccgtaccgttgattacagaagctacaattaataaaataccggcaccaccgatgatacaggtgagtactgtctgtaaaatagcggctgttttggctcccataatatttatcatcataataataaatgctacgataatggctactgcaagccaggaagcatatacatcaaatcctgcaactgtatacagatatccttttaaaaatccaggccacaggtaagtgatgattgttggaaatgcacaagcttcaaagcaggctacactgacatatcctaaaacgattgcccatgtacagataaaggaacctgtcgctcccatcgcacgatgactaaatacatgttctccaccacactgtggcatggctgcggttaactctgcatacgttaaacctacaaagaaaatcataacaccgccaagggcaaaaccaagcgctgctccgagaacgccgcctttttcaatccagcttccggttgatacaacccagccccatccgatcatagctccaaaagcaatgacaaggatatcccaggcactaaatactttgttaaattccgattctttcttgttcatatcctgtccctcctattcatgaaatactttctttgctacttcttctatcagttctgctgtcccatccacaccaagaagactgctgtctatcagcatatccctgttatggcggtcaccacgattacttccggttaatgcaagatgccgcttatgataacgtttatctttttctgtaataaacatcttcgcatcctctgcagaaaagttatggcttttcataacattttggattcgaacatcttccggagaataaatgaaaattcgcaaaattggtttttgttcctttaaaatatagtcagcagaacgcccgatgatcacacaggactctcgatctgcaagtttacggataattgttttctggacgtgaatcgcacgctgtgttaagtctgcatatttggagaaagaaccacgaacatcaccttctgctccttttccggcaattgttccgccttcttctactttttccataatttctttcggaattccgacttcttttataatctcatctactgtatcacgatcgtagaacttaattcctaaatccttggcaaccttttttccaatcatgttgccttttgcgccgtattcgcatcctattgtaataacaagatgtgccatattctattcctttctgatttctctaactttcataaataacttttataaaaatatctcaataaaaaaggcaaggggaccacaaacttttttgtgacacccttgccaatgaaactatatcaatgcttttactgtttcttcaataattgcgcatgcctcatcgcactgttcttctgtaacgatcagcggcggaatcatacgaatgatatgtgcgccaattgctgtaataagaagctttctgtcaaggcaaccatgttttacttccacaccggatattgtatcatcaaactctacaccaaccagtaatccctgatgtcttacttcttttacgtgtggaatctttgctaatttcgctgcgaaataatctccgactttctttgcatttcctgctaagtctttatcaagaagttcttctacttctgctaaagctgcggcacagcttaccgggtgtccaccgaatgttgttccatgggaacccggtgtaaatgctttagaaacttcttctgtcgcacagattgctccaattggcattccaccgccaagaccttttgccatggaaacgatatctggttttactccgtaattcatgtaagacattactgctccggttctgcaccatccggtctgtacttcatctaataataaaagcattcccttttcatcacagaattctcgaagtccctttaagaactctggtgttgcaggatgaacaccaccttccccctgtaccggctcgaccatgatcgcgatcgtattttccgtacaagcattcttaaatgcttctaaatcattatatggagcataggagaaaccgtatgtcatcggaccaaaaccaatctggcatccattacccggctgacctgttgcggacattgctccaaatgttcttccatggaatcccatcttagcagttacgatatgatatttattcggaccatacttttcaataccatatttacgagccatcttaatcattgcttcattcgcttctgtaccggagttctgataaaagatcttatccattccaagagtcttacaaactttttcagcaagtaatgcctgtggaattgtgtatggataattaaaagtatgcatgatatcgtcaacctgatcttttactgccgcaacaacctttggatttctgttacctgcgttatttacggcgatacctgcataaaaatcaagatatggagtaccattctcatcgtaaatgtacattccttctgctgtttctgcaagaaaatcaaaacgctcatatgtctcgatcatatatttatttactttgtctttaatatcctgtacgctaagtcctgtgtcttttaatttcatgataaaatcctccttattatctaaaactctcataattttcattttgcaaaccggtttttatcatataggagagtagctgtttctcctatgaaaacaaaaaagcaagaatacctacaaatacttgtaagcacccttgctttaactgtctattattttgtacggctatacaatatcacgtctataataatctgtcaatagataatttaagaaagttttttcgcttttttcaaaggttttcgctcaatcacacgaagtaattcaatttctttattgcattttgtttattatattgttcatacattttatcatgcagactcggttttcatctgtatgtcagttcaaattactacaaagcctttctatatagctctgcaatctcttcctgtgtaaatacaaccggattgttcgctatgctcgcagcagataccttcatgcagttttctgccatccatggtatatcctcttcagcaatgccaagatcagataatttacattctaaatcaatagcttttaataattcacgtattttatctgcacagtcagcggcagattctccaccaaagatttttgcgatctttgcaaatttttcttcatttcctttataagaagcttcaattactatcggagtgagagctgccaatccctgtccatgtacaatatctttaagaccacttgccggatgctccattccatgagcgatcgtcactcctgccgtattaatgaccataccaccgattgtacttgccattgtgatattttcccactcttttttacttcctgttccattgtatacagaaaccagattgttcgcaatgagttcaatcgcatagatactcattgcatcagtaagtggctgtgcgattttggacgtataagcttctatattgtggcataatgcatcaaatgtaacggaagcaagtactttctttggcattgtcatcatacattccggatccacgatagatacctttgctacgattgcattgcagcgaagtgactttttgtccccattatccggattcgtgagaacggcgaatccattcccttctgaaccggtaccacaggttgtcggaatcaatattaatggcagcgcatcatcactggtcagacgattataaatataatcattaatatcgccttcatttttacttaaaaacgcaatagctttcgcacagtccataatacttccaccaccgatggcaacaacaacatcacagccatttgccttagcaaaatctgccccttcctgagcagttgttgtcagtggattctggcttactttatcaaaaagaactgtttcaagtcctgccgtctttaagctgtcatttaccttgtcataaaggcctgacctcttcgcactgcttcttcctgttacgatcaaagcctttttaccatacggtttggtcaattctcctgtctctaaaacctttcctgaaccaaatacaagatttaccggtaaaaaataattaaattccatgatacttccttctttctttattttataaatactactttttataaatactacttttataaatttgccagaatagattcctcaaaaatctttaatccagcttccatctgttcttccgtcatacataatggtgcaaggaatcttatcacattgccgaaagagcctgcattttccagtaaaagtcccttctgaagtgctgtctgaatcagttttgatacaaattccgggtttggctccttgctttctttgtctttgacaaattctacaccaagcataccgccaattcctctgacatccccgattatatcatatttttctttcattttttcaaacgccttccttacgacggagcctatatgaagggattttgcacagtaatcttcttctttcatgatttccatcgtttttatcgctgctgcacaggctaacggattaccgcagtaagtaccgccaatcgttcctgccggggctgcatccatgacctcctctcttgcactgatggcactgatcggcacaccagctcccatagacttcgctgtggcaataatatccggtgctgctcccgcctccttccagtattctgatgtaaaatactttcctgtacggcagttaccacactgaacctcatccgcaataagcataataccgttatcatcacaaatcttgcgaagtttcttcacaaattcaatgggagcaggaataaatccaccctcaccctgtaacggctcaataataattgccgcaacatcacttgccggagctgcctcatcaaaaagctttaacagtttgtcaatatagtactgaatagcttcttcctcgctgtatccttttggtgcacgatacagattgggtaactacttccacataaaccttttggaacagcctcaccccttctatctaaaagagcctttgccttcgcccctggtacactccctgtaactatttccggtaatgaatctcttagcatgccacttcctcctaactataaaacgtactcttagaaccttctaaaagaattttctaaatacaaagaaaaaggtgcaatcccagccttcactgttatcgcacctttgcttgtttcttatttatttttattgcttatttctttcatggcattactataacacgattaaattatattaccatcgtcacgatacacaaaattattgtgcaacattcataattgctatttcattcatctaggggaaaacagacgaaacgggaaaaggctaatgattgcatctgtaaagatagtcgcggcgagaagaatgcttattcgcatccttctctggctccgacattacatctgcaatcattagcctttttccgtttctgtgttttggctccagaagaaataaattcaatagtctttagtaaaaagaaggggaaaaaatcagaagactactgaattcattccatgtggtgccaaaacacagaaaataaaaatgacagaccatcgcaaatgtaatgtgagagcaagtaaaaatgccggacgaggcattttctacgcagtgatatctttacagttgcgatggtctgccatttttattttcgtctgtcactcttttaaatcagtcccaaaaattcatcaatctgatatgccagataccagtcacttctatctttggtagagttaagtgcttttcctgtaatttctgagatttttttcaagtgataggaaactgtattcctatgcagaaaacattctgttgcgacttcgccgatatttccatttgtttcaagataacattttaaaatacgaatatattcgctgccattttccctgtcgagtcgttctaattctcccagcgttttttcacgatatttttccagttttttgatattgtcaatcgacagccatagcttgcttattcccagttcctcttcctgacagatctgtttgtctttttttctgccccagcggcacaagtaggataaatctctgtatttctcccagagatttgccacaatcgtctcttcatctcctattgctatatatacctttttttgcccggaaaactgctgtgaaagctgtgctatctcttctgctatctttgttctttcttttcccggagatatccgggctatgagtgtgatatacaaatctttctgaaaaacgactgcctgcacctttttgtgtgcaaatatctgctggcattgccgaatgaatcgatagaaaaactgcgtattatcaaaatttctctccgcctgcgtattgccacctgccggaaaataacactgtaccataaaaatttctgtgtctttatgaatatgatgttcatgcagaaccggcatatactgttgttcttctttatgtgaaaaaatcgctttttgaagtgcagtttctaaactgtcttgttcttgcattgtcttataaatgagattgcataaatctctattgaagtctactaaatggacttcccatggcagtacaaaaatgggaaatcccacttcttcgctatatgtaataacactgtgtggcactcttgttatgtactttcctacattgatgaccaaaccgcttgctccagcttcgtacagactttttacaaaacattcaagcatttcttcatctttttctttgattccagttgtaacaatcagctctctgccttttaaaaaagagacgtaatccatctcttcgactgtatgtacccagtcaacaagatttcttaagcctcttcctccggcaaccagcttcatattgtaacggtgtaacgccacctcatagatttcttccaatattatcgccattgttaccctcatttattttctttcattctattccataaacttcgccagcactgtcagatcataatccgatactaacattccgttcatgataagagaatacttcaactgtaatttaaaatgtgcatctccatgcagcacccggatcttctttgtgtcagataccagttccatcggtcctgccggtgactgataaatacagtttttattatgctgcgtatcaaatacaagaacggaattaaaattgcctgcacctgttttacgaagttccacgctgccagatgaaatagtgaggcggtttttaataaccgccccttcttctgtccgttctgaataaaaaatgtaatgaacatcatttttataaatataacttccttcggtaaccagcgtcacaggttcttcctgatcaaaacctttctgaatcccggttatcgtcagccagacctttcttgccataatcgtatccctttatacgtcgtatctgttcatggcaaggtcaatcagcttctgaacaagagccttcttattcagtcctcttgcttcccaaagcattggatacatactgattgctgtaaatcccggaagagtattaatctcattaaatactacttcattcgtatcctttgtaaggaagaaatctactctggataatccggagcaatctaatgctttaaagatggctaccgcatctttacgaatctcttctgcctttccttctggaagctcaggatctacaactgttcttgattcctcgttattatacttcgcatcatagctgtagaattcttctgcagataatacttcgccaacaccggaagcctttggttcattcattccaagaacaccacactcaatctcccgtcctacgattgtctcttctactaagatcttagaatcatgctttgctgcaagatgtaatgcagtaacgagttcttctctgttctctgccttgctgactccctgagaagaaccggctttagaaggctttacgaaaacaggatatggaactcctgcttccactcttgctacaacttcatccatgttggaaagctcgtgtcttcttacgccgacaaactttgcctggcgtactccgatcgcatccacgattactttagtataaaacttatccatagagcaggcagaagctaaaacaccacagcctacatatggaatcgctgctaactctaaaagtccctgcactgttccgtcttctccgttcataccatgaagaactgggaacacaacatcaatagaaatacgttctgtcttacctcctctttctaaaaggagttccttgcttccggtatccggacaaatataagcactcgtcttgctgttcacccaggaaccatcttcaagatgagctattgtgtcaatcagcttccactgtccatcctttgtgattcctaccatgatcacactatatctttctttatcaatactttcaattactgtttttgctgaaataagagaaacgtcatgttctgatgactttcctcccataagaactactatatttttattagccaaaattattcaccctttcaaaagctctttttaaattcacttcacgccttattttagcacatcgaaaagcttttgaatacttaattttaaaaatatatgcacttatccaagtacatttcacacatttatccccaatcataaaaggtgtctgcagttatcctgcaggcacctttttctagccttctgtatattctaattccaataccatccatatgcattatagaaatcacttacatctttatcggaaatagagttaactaaaccattgatatagttgtaagtctgtggacgctggctctttaatgctgaaacattctccgtataatcgcggaaagattctgcgaaatactcgcctgcatcctgtgttacatatgctttgttgttaccaacatacgcattcttctctgtattataaatcttcttaaattcagaagtctgatctgctctgccttttaatgccgctacaaaatggcctaactcatgaagcagataagaggactgacctctttttaactgaatattatgattccgtacactaaatacacctgttgtacttaacttagaattcactttaaatccgaatcctaaattaacaaatgcattatacactcgggaatctacatgtcccttaatatcactgaaatcattgatcgcaaatcctgaagttgcatctgctgtattgtcagatgcctcattgctactcttgctggttgtgattccaagattcgtctcggttgtcttaactgttgttactacagttgtcttaattgtcttaactttagatttcttctttgtgcttgtcttctgtgtagtctgaacggttgtctctattacagtctgaacagaagcgctcttctttgtacttgtcttcttctttgtcttcttctttgtcgttgtctttgtcttcttcgatgcctttttcagtttcttcttctttgttgttgtcttcttagaagtcttcactgtaaccttaggagcctgtccaagcggaacttcctcctcgcctgctacaatctcatcagagcctgtatccggcatcgtatctgttatatctgcaaatgtcttgcctgtaccaccattattggtataaaaaataatacctgtgcataaaataagagtaataacaaggtaagcggctgaaattgcaaatgacttattacctgtttttctcataaaaaaacctccctctttgatatgtaagctatacggcagcagtactgcttttctttgtacaactcgactatatgccgtaggctacatctcaaaacccactacaaggacagcgcagacagattttgagagtagataaaatgccctttttatggcattatcaaatgttacgagtttattatgagaattgcggggatgaggacttacgtcctcggattcaaaaagccgcctatatctctagcagatatacgcggccgctcataatattcgataataaatccatacgcattaaatacggcaaccggctgtcataggcaatgcccttagacccttggctttgcgtcccctgctttcgcaaggtttgcccactagaatatattagtttacagtcctataataccatagcctttgtgtaacgtcaatgaattttcgacaaaaatcaccaataaaattcctgtatttatttggggagcttattcatcattaactccggtgctgccgcataatctaatgctgtttcccgggttatttttcctttttgatataggtttgtaatataggagtccattgagaacattttctcctgtccggaagatgcgatcagtccatcaatctgatgtactttattctctctgatcatgtttttaatcgcacgatttacagtcataagttcaaacgccgggatgagctttccctctttatccggtaataactgttgggagacaacggcatttaatacagaggcaagctgtacgattacctgtctttgctggttcgcagggaacacatcaataattcggtctactgcatttgccgcaccaagcgtatgcaaagtggaaaagacaagatgcccggtttctgctgctgtcattgcgatattaatcgtttcataatcacgcatttctccaagaagaatcacatctggactctggcgcagtgaggcgcggagcgccactttataactttctgtatcagaacttacctcgcgctgacttacaatgctctttttgtgacggtggagaaattccagcggatcttccaatgtaatgatatgctcttccctcgtactgttaatctgatcaatcaggcaggcaagtgttgtggactttccacttcctgcagagccggtcacaagtacaagtccttttctgtattctgccaactgcatgatctgggatggaatactaagttcttctggattcggtaactgaaatgctataagacggattacggctgccagggaacctctctgacgatatgtagatatgcggaatcttcccagattcgatatggagaaagaaaaatcgtcatctcctgccgtctctaatgtttctatctttctttcctccgcaatcgaataaatatcttcaatcagtttctttgtatcttccggcatcagccgttctccgattctgaccatctttcggttaatcttataagtaaggggcagacctgctataataaataaatctgatgcgcccttttctgttgcttcctgcaaatattcctgtattcccattctgccttttcctcccaatataatgtattcaagaatgtcccgatattcttgctgcattcaaaaaatgtcccggcattattctatacttttcattacgtcaagcgattcatctgcctgccagtcctccggtgaacaaagctgccatttttttatataatactgcggaactgtacctgtcttatccagatgcagcgtgacaacaagctgctgcctttttgaaacactttctataatatttatttccgacaatatcacagttttttgtttcaccgtcttttgtgccgttcccttttgtcctatttctttttgttttgctgtctttttctgtgcccactgtttctcaagttctgtattcttctgtgcaagctgttcctgcactttattcaccgctttatagtactgcgttgtatgcgccgccgtcttcttcgtaagtgcataatccgataatgcattttgtaaggataacacagcaaatgccgccagacatacattcataaagattaagatgattaatgaaataccaagattcattacagggatttcccgctttttcattattccatcccctccttctgtgtcgatgcagcgtgctttgtattatcctgtggtacataaatgctcagattcagatgataaatttcgtctttctgtgctctttctgcttcctttccggaatatacagcaatctttatcttttttaaatctgtttttttactatcggagttctctgcagactttgtctctgcctctttttgctttgcatcaatttccgatacttccagccaatatgccatatccttcttctcacactgcttccagtctttatcataataaacatatcgatgataaagagaatctgtacccccttctaaaatctctgccatagaagaggcttcctgctgtgcctgatacagattcctcgcttcctgactgagttcatgagactttgcaaaaaaacggatacagattcctgcggtacatgaaaagaataaaatgcatatcattaattcaattaaaaacaatcctgactttgaatgtcttactcttctcatcgctcatcttccccataaatccttgcataaactaattcttcctgaccgcttccactaagatggatccggagcagatcctccttttgttttatgacagaaaatgtatctgcgctcactaattcctgtccactttcccattcgattccccgctctttttttgtaaaaagttctcgcagctttcccttatataaataaatgtacgtcacatatcctgtattctccggctcatacagcgccagcactgtccggttattctctgtcaaaacttctacctgtgaactgctgctgtattctctgatcttttcctgcacataagcagctgctgttcttactgtgtaattctgcttcaatccatccgttgttttctgataaatatgtgcgcccgaaagaaccagagagactgcacaaaatccaaaaaaaacaataaaaatcaacggaaagatcatatcaatcgtatgtatttgcttttgtctgttattcatctaataaaatcacctgtacttccggccggatattttttgcaataacctcatagcttactttatactttttctcattccatgtgattccgtaatgcttctttaaatacgcaagagattctggataggcaccttccactgaataacagtggacagcagactggattaccgcattttgaagactttcctgttccttttgtgtggtctcttttgtcactgacgataccccaaaaagcagtatcccgatcatcagaataaatacacagattggaaaaataagctctgttcgaataaaaccttttctatctttcttttttatattctctcctgttccattctccatttcacattctccatcgtatattttgacatttcattatccaatcacagaaagaattcccataagcggcatcattaccgataaaagtaaggcacccacaagaatggataaaataatcaccattgtaggctcaattactgagacaaaattttgaatttctgctgttacttcctcatctacctgtaccgcgatcttagaaagtgcctgatctgcctccccagttctttctgcgatcatgatcatccttgcatggaggggcgaataaatctgtgtttcttttattacttttgaaaaagattctccttcaaacatcttttctttgctgtctaaaagtttcttcttcgtctcctcatccccgtccacaagcgctgccgccatatcaaatgctcttccataatccattccactctgcaatgccatagaaagtgcagaagatattctggcactgtttaatctttttacaatagatttacttgaaaagaaccgtcctgtcagtctgcgcaaaacagtatttccctttatcgtctttaaaagccaccacacgcctgccacaaaaatgcagatgaacactgcaggaatgacccaatactgctttaatacttgcccagcttttaaaagcaccgctgccggtcctgtaatctgacttcctaactgctcatacacctgattaaataccggcatgacttttacgatcattacaagcataattgtaagcagcatacataaaatcattagcggataggaaatcgcactccggatatcctgcattgtattttcttcacgctcataataagctgccagacctttcatcgtcacgtcaagattccctgtttcttctccaagctttgccatctgaatcacgtaatccgggaaaactcctgccctttgtagtgcttcataaaaaatgcctgtttcttcaagacaggttcttatatctgcatatattctcttatattctgtattctgcggttcaacatccgcttccataatcgaaataccttctaacatggataagccggattcaagaatcatcccactctgctcacaaaacacagcaatctcattatttgataacattttctgtccccttatatatctctcccctgttgattatgattccgaaatcatttgcaaaagcaaaaattcctaatgaatatactgtacgttgtaatttgaagaatccgtaatgaaatcctttattccatctccaccatcagccgcaaaggtcggatccatcatcgtccagctctttccgtcaaactgaatcacattatctacccatccccgttcttcaagataggtactgatccaggcatgataaatattcgttgcatatccgatatcaagacgggtcggaattccggaagaacgaagcattgccgtcatcaaagctgcataatcaaaacagattcctttcttcgtcttcaatgtctcatcaacattcggcaaatatccgctctttaccgtctctgccttttcctcatcatacactatattctttacaacatactcatacactgcctgcactgcctctaactctgtctttccctctgtcagcttctttgcaagcgtaacagccttcgtatcctcattaaaattcacatattgattcgaatacaaaaatggtaaaacttcatttgcaagcactacatccactgtcttcgtaaaaacaagggcataccggttatctcccacattttcataagcagatactgcataattcccgttacctgctgtaagcggaagtgcattgtagtgaccatccgactcaaaataatatcgatacgggatattatcacttccttctacctgcaccattaatttatctgcactgccttgatatgccaccataaaatatccctggtccgtatgagacaggtcaagcgatactccctcttgtttctctgtcaccttcccatccgcctgcggaagaaaaagattccctttatgataataattcggtatatcgacaatcccctgcgattcaagccgtacttctgtcttttgttcttctgcctttcgctctgctgaccggtcagaaccggatgctccgcagcccacaaggcaaaataccaataaaaaaatacttcccctctttaaaaagcggaaaaagtattgttctctatacttcatttttattttaccgtcctgtaataaacttccttacaattatactctactttgcaaaaagttccaagaactattacccagaatgataaagttaatccgttgactcaaatctcaaatttatgtctatactttacctatgaacaagttaaataatacaaacaaattaaataaaataacattttctatcagcatcattatatttttattattcagctgcggtatactgtgtcagacttatatagaaaaaacctgtttactctatgataattccctgcggttccatgtacgtgcagattctgatgaaaaggaggctcaggaaagaaaactgatcgtgagggatgctgtcctgcaatatgtaaaaacagatgtggaacaggcacattctgccggggaattaaaacaaactcttgctaaaaaaacaaaacagattgcccggattgctgcaaaagctgctgatggtaaaccggtccgggtctatttcacacaggaaagatttccaatacgacattatggagctgccatcttccccgccggggaataccaggcattacgtatagacatcggcaaagcgcaggggcataactggtggtgcgctttctatccaaaactatgttatatcccagaaaaaaaggtgaatctttttcatgtattttatagattaattcattaggtgccctgcagcagttgcggcaggcacctgtttctttttttattttttatctatcaatacaatttttccatcttctattacaatctgatgcaatacgcttttttccggtgattgttctgtgtgccgcaggtaatcaattggagtttcgcagattttttctgtattatttttttgatcagattttattttttgctgttttttgctttgttttataagaagacttacttcctgaccggctgctccttttggaatattttttactttgtaaagcttgtcgggaggtggtgaacttgcgacaagaaaaacattcggtgatttctgccagtcaccgtcccattcttctaacagtcgcatacaagcctctttattttctgtcatttccaggctgaaaaaaatagtataaatatggttccactccatttctcccggaataatccgaagatatttttcttctaattcttttaaggtttttgcttttatctttgtaatctgacaaggaatttcctcgtctcgttcttccatcttatttaagtctgctcttgccacctgaaacgcatatccgttttcttcgcctgataatctgtccacatacagggacaaaacatagcttttttcttctatatccgtcaggtgccggcagctggttaaagaaaaggaaaccccaaggacaaaaagaattgtaaaaagatataaaatcgattcttttttctttattttatccgctgtttccgtattctttccctgtttcttattttttgtattttttctgccggcgatatatacgaaaaccggtaacagcaatgcaagcggaacatccacaaatattttatatttcaaataggaattccacaaatatggttgtttttccacaagacaggctaaaaaaagaagacaaagtatgcttattcctgtcacgatcgtttcttttaggattggttcttttgcggttgttttcttcaaggttgcttttttcaggatagcttcttttgatttttttaataaaagctgttctaacatcttttttccataataaagatatccactgattactgctatcatacagaaaacccagactatggcaggaaggatatcaaagcgttcaaggaatccgcctgacatccgaatcagctgcatcatttttattaccggccacgctgactgtgtagtaagtgtttttcctaatgtccgtactgcaagaaaaataagcaatacattacaaaagaaaacaccaaaagctgctgtaataatgcttctttttgttttttgttttgttttggctgccgattttaaaaataaaaggaattctatcggactgccacatacgaaaagaatatatccgtttcgcaggttttgtatcgcggtatctgaaaaaatatcccgccagacatcttttatggttcccggctgtattaatgtttcaatgcccacaaaggataagaaaactgcaataccatacgacacaaaaatccatggaaatatgagttctaaaaagcgggctcttttttgcagattcgtattcagcgtataccagagaagaagcgccgccggaaacagtataaaaaggaaactgcttttcggcatatatactgtctgtatcgtttctccaaaaaagtaaaagagggctaccacatttatagcgaatcgaataaaatagatactctgtattgattttggaaggatttctgtataactttttgcattttcagaaaactgctcctgtatcttttcagagagaatataaaatacaactgttgcaatgattaaaaaaatcccgtaaaaaagcaccgccacaccgccggactgtccattataacaggcaagggcaggaacggacagcgcccccgccccaaacatttctataaaaagcatccgccgcagctgtcttagcgaaaccttgttttctgctgtcatcatctgccctcctttttccgaatccgccgtccttccctggtaaataccgggcgttttaacatataggcaaatggatagcggacatagtcgtcttttttctcgtcataatttaaattctccccacagacagatggcagcatatagggaacaccaaaggattctaactgtgataaatgaaagagtaatgctacaaaagtgagtaaaaatccatagattccccagattgcccctgtgaaaataaaaagaaatttcagcagacgaaaaacggacccgaacgattcatttggcacgataaaggatgcaattgctgtaaaggaaacaacgatgacgacaatcgtacttacgattcccgcttcgactgccgcctgcccgacgatgagtcctccgacaatgccaatcgttcctccaagctgccccggcagatgaatcccggcttcttttagcagctcaaattgaaattccatcagcaggacttctaaggcaacaggaatcacgattcctgtgcgtgccacagcaaccgataataaaaaagaggccggaagcatttctgtatgaaaagcggcaatcgccacataaagacctggaaatcctatggcaaacagtgatgcagcaaagcgcagtactctggcaaaagatgctacttcaaatcgtgtgtaataatcgtctcccgcctgaaaaaacatatgatatgttgctggcagaatcaaaacacccggagaattgtccactgcaagaacgatccgcccttctaataatccacttgctgctttatccgggcgctccgtatgctggaactgtggaaacggactccatgcattttcttcaagaagctgctccaccattcccccgtcaaaaataccgtcaaagcttatatttttcactttttcccgtatcttttcaagaagctccggccggacaagatcttccatatatataatcgcaaggtctgttttcgaacgttctcctgtcatcgtatgttccatcttcaggcgtggatcacgaatcctccttcttatcagcgctgtatttatccgcatattctccgtaaaactatctttcggtccccggattaccatctcctgctgcgtttccccgacacctcttgatggatactttttcgttgataatataattgcttttttgcagccttctaataaaaggagggtattaccggataaaatatctgtcaaaatgtcttcaaaggtttcgtcttctttccaatccaccgtttccatcacatgattttctatataagaaagcagctcccgcccacttattttctcttcccatttctgtttaagaagcggacgaatcacaaaatcttctaccatatctgcatccgtcatgccatctacataaattgccgccgcccggcaaaaatccacaatacaaaatggattcttcacgatatcaccgcttcgttcaaacaccgcttctagaaaagcataatctttatcaaaatcccctgtgagactcccttttattttctgatcccggccatatactatcttcacatttctccctcttttcctgcttattttgtatacaactccttaagcatcttttacaaaaataccttgttagtattgagaaattttttcttttttataccagcgtttctttcttgatttttcgttaaaatgcgttataataattgtatacaagatacagaggaggtacaatttttatgactcagcccttacagttgaaagcatatgcaaaggtgaatctgggactggacgtattaagaaggcgggaagacggttaccacgaggttagaatgatcatgcagacagtgaagctttttgacctcattactttacaaaagaatacatgcggacagattcggctttcctcgaatctgccttacctccctctcaatgaaaagaatcttgtctaccgggcgattaacacgattcggactgcgtataatattccagacggtgtcgatgccacaatcgagaaacatatccctgttgcagcaggaatggccggcggaagtacagacgcagccgcagcgctggtaggcatgaatcagcttttttctttgggaatcacacaggaggaacttataaagcatggactgaccctcggtgctgacatcccattttgcattatgagaggaaccgcactttctgaaggaatcggagagattttaacaccactcccttctattccggcatgctggtttttaattgtgaagccaaccttttccatgtctacaaagtttgtttatgagaatcttcatctcgatgaacagacgaaacatccagacattgatggcatgatccaggcgattaatcacaacgatcttaccggtatcacttaccgcatgggtaatgtattggagcaggttacacaaaaacattatccggcaattatacagattaaagaaaatatgagacggcttggcgcacttggtgcacttatgagtggaagcggttccactgtattcggtatctttacttcaagagaagccgccggaaaggccgctgaattcttccgcaaagatccgggaattaaacagactgccgttgtccgtccattcagcaaggaccttccacagtccaagcctcataaaaaccataagcattttacaaattctacaaagaaatatcattcggcaacacaaagagaaaaatattcaggaaaaaggggaaggagaaatactcatgaaggacacaaatcttaatgtaaatgaatatctgccacttcgcgacgttgtatttaacacactacgccaggctattattaccggtgaattcgcaccgggcgaacgcctcatggaaatctctcttgccaatcgtcttggcgtaagccgtactccggtaagagaagccatccgtaagttagaactcgaaggtcttgttatcatgattccaagaaagggcgctcaggtagctaaaatcacagaaaagaatctccgcgatgtcatcgagatccgtacagtacttgaagagtttgctactgtactcgcctgcgaacgaatcacacaggatggggttctaaaactacgtcaggcacacgaagacttcattcatgccgtagaaaaaggagacattctcgatatcgccaacaaagatgaagcattccacgatactatttttcaagcaaccaacaatgaccgactgatttctatcatcaataacctgcgtgaacagttctatcgttatcgtatggagtatgtaaaggatatccgccagcgctccaatctcgtagaagagcaccgcgaattactcgatgctatctctaccagagacaccgtaaaagcaaaacagctgatgagagcgcatatcctcaaacagcagcaggaagtaattaacaatattcaggaagcatagccagacagcataattatagtaatattatggtaatcatgctatgctgctgattattgctttccattataaaaacatataaaaacagccataacaggcaacgttgatgataaccttgcctgttatggctattttttaattataagtttactttagttcttagtattattatcccttttattattctttagaatatctgttttcttcatatagagcaaggcctgatcataccttgaatacctgccttctcttcctttttttcgtgtgcgtataagaacacgaatcaaaagaagaataagaagaagaatcccaataacagatgccgtaatcgtcgggtctatctggaatgcctccgccgtaacatgaatatgctgcggttccccggttccagtacaatgccccctcacaagcaaacgatgtgtattaattccgtatggcgtacaggtcattaacgtacagtaatcctttttatcttcaatctgaagacaactcgtttcatttggcaggataatagaaatattatcaacctcgtaagtaatctcacgattcaaaaccaatgtcacttagttaagcttattggttcactatgaggcaaacctctaacaaaaatttataaattatagttgacacatcaatcaaaatgtgcgaccgctctcgttgctgatatatttttaaggtaacgagagcggcccttgaattagaactatatttcattctgattcaaggaggtttacctatgacatttcctgaaattgtcaaaactacactttgggacattattgatgagatgtcccgctcactttcttcttttgtaaaaaatccagataaggatcttatccgcaaacgcaaacttgattttaagaaaatgatgcatctgatcatttccatggaaagtggaagcctaaatcatgaacttctcaaattttttgagtatgattcctcagttcctactggctctgctttttatcaacaacgttccaaactttccgtttctgcattccgtcaccttctcaaggaatttaaccttaaattccccttagaaaaatttcgcggaaaatactatcttattgcgtgtgatggttctgaatttaacattgccagaaatcttaaagatgcagatactttccacgctagatgcacacaaatccattaatttgtaaaaagcttaactaagtgacattgattctgacctgtaatcccaagacgaaacgagatccaaatattgaaacatatattggtcagataaaaaaccaatatccttctgtagaaaaagttgaaactatgttcaaagaatttcacgcattattatttgggaaggacgaaacgaaactggatgaatatttggaaaaatatagtgagagcaagatagaatcattttgtaaaggaataaaaaaggatatcactccggtcaagaatgcgatattcctttctgtaagctctggatttgttgaaggaaataacaacaaattcaaagtcctcaaacgtattgtatatggtagaagtggattagtcaatctggagaaaaaatgtaaactggcttttcttcctaagaatcaaggtttttcactttctgcattgctataaaacattagctggtatcaattcgataccagctaatgttttatacagtatacccaaagttcagaaagaaccgaaacgtttccctgccgcccagtttttataatgtgatatctttatttgccaaccttctgctctcagaatattggcttatcagttcctaatatagtgcactctgctctcctcgtaccggtcttcctgcgctctctcctccgccgggtaaccgcaaggaatcagcgcgaacgcatgaagatcctcgggaatatccagcacttcccgcaccgctttcattctgccttcatccggcgatattcccatccagaccgcaccaagcccaagctcatccgcctctaacagaagattctccaccgccgcactcatatcgatgttaaaatatttcggcgcaatccccttggaccggaagcacggcacaaacacgaccggcgcgtccttcgcacattttgcataaggcgaagcctctgacagccgcccgatcaccgccttgtccttcaccacataaaattcccacggctgctgattgcacgcggacggagccgccatcgccgcttttaacatcagctcgattttctcctgctccacgtccctgttctgatattttctaacgctgattctgtgaaaaatactgttcatcccgtatccctgtcctctctgcatgttcctgccacgctctgtcttattgtccggcacctcatattccggctgtccatactttttgctcaaacttttctctgtccttatataacacagaatatcgcctcgctttctataaggtttctcatcactttatccggaaatacacttgcatattttaatatatccttttttgatatgttattagcacctatatattctgctattcgttcctttttatcatcatccaacatatttggtgtaatatcattcatcaattctagaaaagccagtattggcacattatccctattaatttcaactctcgctcttcttaatacaactctttgactacctactgtaacctctctgactttagaactctcattgttggtatatatctctagaacatttggcatctgtgtagttatcttcaattgattttgcagcgtaatgcctgaatagtaaccgattattcgcctagaatcgttaatgtacttcttctcaataactttacgcggattcaatatgctttttccaaagaaggtgtctgtagaaacataatatactcccttttcatacttgcataaatctccgctctcacaaagcaactgtaactgcttcataatccaaggtcttgaataatcttcaaatgttatttccgataatagtattggttcatttgtcccatactgttggtataacatttctagcaaagtcatcggcacacatctgctttccaagtattgtatccttttctaaacagattataccttttttcactctcaaggtcaatattatcatattcattcagcaaactgtggcatatcataattcaccatcgccctataataactgtccatggtactacctgcattaaacagaatagtcaacagataacttttaatattccttaccttggtcgtgttcttctgtaggcaatccatatagagccatgttgccttgcctctttttccattctccacaatcccgttctgaatagattccatcatgacaagcattgtgataggactaagttctgtacctaagtctctgataccatatatactgttcaaactttttctgcgcctgctccacgtctccgtatactttccaacaacccacacacttacattctttggtctcgttttcaataaatccctgtacatcctccgccggatatccaagatttttcaagatacaaatagtcctctcatccgcaaaatcctgctccaattttgccggacgatatctgctgaagtatggttataaacttcaggcaccagtcctctggagttgtggaggacggctctggcattcttgtatctgtgcggctcactgccgtaaccgaacctgctcggctaccaaacttgtttgactgctcatagtctaacctccatagtcagtcaaaaaagttaagtgctcaacttttttgactcagtatcgtgtgagactattattgcagaaaattaatcggatgaacaggtacttgctatggtgcgtttacagtatgggtatcggatgaatttgttattcaccaaaaatacctcctgtatttcatctcatacaggaagtactttttctgaattattctacttatttaactgttttttataagcttctgtaatttcaatgctcttgctgcatccaattctttctgctccggcttcaatcatagccagacatgtttccaaatcacgaattcctccggcagcctttacttttacttcatcccctacagtttctttcattaattttacgtcttccactgttgctccgcttggtccaaatccggtagaagttttaataaaatccggctttactttttttgcaatttctgccacttttacaatttcgtctttttctaaatagcagttttcaaaaataaccttgatgagtacattgttatctctgcataatttgacgatttgttccatctcatcttcaatatatgcataattgccattctttaattctccgatattaattacataatcaatttcatcggctccgttttcaattgcattttttgtttcaaatacctttgtttctatcgttgtctgtcccaaaggaaaactgattgctgcacctacatgtacctttgaatcttttaacaattctttacagcatgcaacaggagatgagttaattgcaaccatggcaaaaccgtattcatctgcttcacgacaaagtttttcaaaatcttctttctgtgcataggcttttaactgggtatgatcaaaataagccgctaattcttttactgtcaattctttcattcttttttcctcttttctactatttttttaatatttcataagcttttgttgtacaaactttatgaattcccaatttgaataactcttcaacctgttcttttgtttgtatattttcatttgctataatttccaacttgcctttggaagctgatacaatcgtctcataagcttcttttcctgcaaaaggtacttcatatggcataaacccggcagatgtaaccaatgatgtaataccggcttctatcgccatctcacatacctcattgatctgttctttgtttaaaacaccaatttccgtgataagttttaccggaatccctttggcagcctgaacaagtgctttcatctcttcctgtgtttcttttttatgcccactcaaatagctcccaacctgcatgacagcataaaatccgtctattttttttcctatttccaaaagatcttctatttcctgtacttttgcttctgtcaaatatgcaccggatggataggatacggctatatttattttaatgtcgtcattgttttctttttctaacatatcggaaaccaaatccaaagcggaagaacctattacaatgttgccaattccacactgtaaagctttcaatacaagattttcacactctgtgtcaccaatacgatattcttgtatattcgaatattctaaacggtcaactatattcattcctctatccctccataaattgccaactgtcttttcataaatgtttcaacaatatccaatgcactggctgtatgaatcacctgacaacctaaatccatatatttttcaaaggcttctaatgtacggatatttccagatggatgaatatcgaatctgtttggaaacagtctcttaatcaattcgacttcttcatatgatactcccagtttacatcccggatttacttttacagaatatacaccggcactgtctaaggcacgcagagtatctgccatttcagtgtcactcagcagtgtagcaggtattacataagcatttttagtaaataatccgtcaaactcttttacaatagcagccgcttctctttccacatccttatatctgtgggaaaaaattgcctgccagtcaagacatacacatacatccaaaattcccatttttaaaagtgtttccaaatcctgcattttcttttttaatgtcattctgcctaatggataggaaaccgcacaatgcaggttaatttctccctgagtcaattcctttaacataggcacaaaattcatttctgtatcaaatgccattggcttaaatccggtttgcattaatcggtccaatgccaattttacatcctgttctgtttttgcaattccctgaactccaaaatggcatctctgcatcatgaatcgtccttcttctctgactctgtcagcaattgcaggattttttatttttgtccaatctatcattttttcctcctttacttgcataaatatccgccatcaacagggattgtcactccacatacataatctgaagcatcggaacacaggtataataaagttccgaccaaatcatccggttttccccagcgtccttttggaattcttccccgtttatattcatatacttccggattttctttcatatccaaagtcatcggagtttcaataaaccccggagctattgcatttgcattaataccgtatttactccattcgtttgcaacggcttttgtaaactgtacaacagctccttttgagctcgcatagggaggaacattcgtacctccgaaataactattcatagaagccatattgataatttttccgcttctttgaggaatcatgtatttccccgcacttctggtcattgcaaatacagcattaatattcacttccattacaaagtcccaatcttcatctttaaattctataagcagacctcttttttgaacacctgctgaattaaccagaatatccagagtcccccccagtgcttctaccgcctgatcaaatattagctctctgttttttctatctgtcaaatcacaccgaaaggcatatacttttcccaaagcactcagttcatccctgatttgttccagtgattcactataatcaagcattgccacttcaattcctgcttctaccattccttttacaagtgcatatccgattccaccggatgcacctgtaacaattgctttttttccttttaaattaaacatgttcataaactcaaattcctttatgtaaaataatttcttatccgataacagacggaagtatggtctgcaacactgataaattaataatctgcatcaacataattacagttgccggagggtcaatatgagaatctgcataactattaaatgttaatgcggcacattcacaggctacactaattacaatggctaccaaaacactacccaatatggttaacggaatatttgttgttcccgcaaataaaatcattgctgtggttcctgaagttacagctgtatgatgccagctttccatttgcaatcctgcacatgcaaacgccaaagacattgcagcaagagcaaaaccaatgtttcccatattttggaaaagatataaagcttctttagaaccatccatagcaagctgtccgaaagaaatcgatacacctgaaattacaattccgacacaaagtcccactgttgccaaaaatctagttcttttcttatcagggaagaaacttctcttttcattccctgtataattccctaaaataccagaatccgtaaataagacacgcgcaatcagacctgatgtaaacacggtaagtgcaacggtatctgaccagccttcaagaccaaaaactattcctcctaacagtttgctgtaaatatactgaatcacaaatccaacaataccaaatactcccccgactaaaagtacactactgtctcctgtggaaaagagaggtactgacaaatcctgcccgttttctaccaatccctttttctttgctaaagcggctgctgctactgctccgccaaatgccacatgtggtccgaatacagaaccaaaacttaatgtacctattacaggcattcctgattctcctgcaaaaatggcaataat

SEQ ID NO: 401 - DNA, 61813 bp, Eubacterium hallii
aagaattagagactgctaatatttcctataaaaaatatattttcaaggacaaagaacttgttcctgacgaaaaaacactcggttctttaatgatggcattcccaagagactgtgatgttatcatcgcaattggctctggaactctgaatgatctatgcaaattttccagttttcagcttggtcttgattatatggtttttgctacggcaccttccatggatggctttgtatccattggagccgccctcattaccgattatgtaaaaacaacgtatcaggcgcacgtccctctggctgtaatcggcgataccgatattctcgctgcggctccgatggagatgattactgctggtcttggagatatccttggaaaatacacctgcctcttagattggaaaatggcacatattatcactggggaatactactgtaagaccattgcggatatggtaaaagaagccgttgaaatcgttgtggaagaaagtacaagaatcaaagaccgtaatccagaagcaataaaggcagttaccgaagctcttgtgttaagcggaatcgctatgagttttgtcggtaattcccgtccggcttccggaagtgagcatcacctttcccactattgggaaatgaaatttcaggcagaaggcaaaaaacccgtcttacatggcatcaaagttggtattggcatgattattgttacaaaaatgtatgaaatgcttgaacaggaacattttgactttacttctttaaaagaacgttcctttgactatgccgcatggaagaaaaaagtcaacgattgctatcaggatgcagcccctggtatcattgctttagaagaaaaaacacagaaaaataatctttccgaaagaaataaacgtcttactatccttgaggaaaaatggtcagaaatcgtgcagacaatacgagaaagccttccttcttccgcagaaatggaatctttactttcctgccttggagcaccgacgaaacctgcacaaattggcatatctcctcagcttgtagaagatgcgattttacttgcaaaagaagtaagaaaccgctttactttattacagattctgtgggataccggattatcagaaagttatgcaaaaacaatagcaaatctacattaatttttactgaccaattaaattcgacataaaaatcatttactattgtaaataactttttactctgatatcataatatcagggtcacaaaagtcaaattataaaaatataaaacaaaacaacacgaagggagaacgtacaaaatgagtaaatatgcaattggggtagactacggaacactttccgtacgtgcattacttgtaaacattgaaactggagaggaagctgcaacaagtgtttatgaatatccacatggggttatggaagaacatcttccaacaggagaacgacttccttccggctgggctttacaggaaccgcaagactatgtagaaggcttaattcttacgattcgtaatgtcctcgctgagaaaaaagtgcttccggaagaagtaatcggtattggcgttgactttacctcctctactgttattcctgtaaaatctgaccgtacaccactttgccaccttgaaaaatttgcaagaaatcctcatgcctatgtaaaactgtggaaacatcatggcgcagaagaagaggcacttcagatcgaccgcattgcaaaagaacgcggtgaaaagtggcttccactttacggcggaaaagtatccagcgaatggatgattcctaaaatcttagaaacattacatcatgctccagatgtttataaagaagctgaccgcttcatggaagcgctcgactggatcatctggcagatgactggcgaagaaacaagaagtgcctgcggtgcaggatacaaagccttctatcgtcacgatagcggctacccaacaaaggacttctttaaggcacttgatcctgctatggaaaatatcgttgaagaaaaactggatgctccgatcaaatctattggagaaactgctggatatttaacagattctatggcaagagaacttgggcttttagctggtacccctgttggaacaggtatcattgatgcacactcttctcttcctggatgcggaattggaaagcctggtacaatgatgattatcgtaggaacctcttcctgtcatatgatgctttctgaaacagaagcaggaatcgctggtgttggtggacttgtaaaagatggtatcatgccaggctacttcggatatgaagctggacagtgctgtgtaggcgatcatttcgcctggttcacagataactgcgtaccggaaagctatgagcaggaagcccgctcccgtggcatctccatccatcagcttcttacagagaaattatctggttacaaggccggacagagtggattattagcactcgactggttcaacggtgttcgttccccattaatggactttaacttaaatggtctgatcatgggtatgaacctccttacaaaaccagaggaaatttacctttctttaatcgaagcaactgcttacggtacccgtatgatcatcgaacagtttgaaaatgcaggcgttccggtaaacgcacttgtattaagtggcggtattccagctaaaaacaagatgcttgttcaggtttatgcagatgtatgtaacaaagaaatccgcatttccggaacagatcaggcaagcgctctcggtgctgcaatccttggtatcgctgctgctcctgaacgcgttaccggctttaaaaatgcaaatgaagccgctgaaaaacttggaaaagtccgcgatgaagtatacaaaccaaatccggacaacgtagcagtttatgataaactgtatcaggaatacgaaacattacataagtacttcggaacaggagaaaacgatgtaatgaagagactgaacaaaatccgcgaagacagattaagtgaataggttctaatctgtagatttcgtatagacgaaaaaagaaaaaatgatatatcccatctgctctgtagtcgctgtgtttaagatgctcgtccgcatcttaaacacgctccgaagacgcatctgggatatatcattttttcttttttctgactattctaaatccacagctggcgaaaatggggattctccagaaagttatgactttccatgggattaaattctaaagggttaacattcaacaggaagtgtattccttctggagattttcattccaaattcaagtcgagcagccgtaaatttcttaggcaatcccctctttttctgacaaaaatattgattctatctggtgccaaagaacagaaaagcagaacttttatatagaatccaatgtgatgtcggagcaaataaaaatgccgggcaggcattttctatgccgcgactatcttcacattggattctatataaaagttctgcttttcgtctgtcttgccctacaaatctatatttattgtttttacctcttctattgcttcttctttgaaattctgtttttgtacttcgtcaatatcaggaagttcttcgatagacgatactccgaaacaacgaagaaattcttctgtcgttccaaatacaatgggatgtcctattgtatcgagtcttcccagttcttttattaattgatactccagcaatttattgactgcaaaatcactttttacacctcggatagcttcgatttcctgtttggttactggctgcttataggcaacaatcgaaagggtttctaacataacatcggtaagtgaacgctttttcggctgacttaccagctttttcacatactcgtacgtttcaatcttcgtacagatctgatatgctccatctaattcgattagacagattcctctgtctttacctgcataatcgcctttcatttcctctaataaatctttcagggcttcttcttctacttcaagaacttctgccaggcgggaaagtgcaacggattctcccatcgtaaataaaatcgcctcaacgattccttttattctttctttatccttcacaaacaaaatcctttcattcttgtttcgtacatatttttattgctttttcattcttgttcatcagtttcttttcttattcacaggaatccagataaatttctgcaaagttgtgttcctgaactaccttgacttctcctactttcatcaattcaagaaccgcaagaaatgtcacaataaccatttctttcactggctgtatatcaagtaaggtacggaagttaattcttttcagtccccgaatctgacatcgtatatcgtccatacggtcttctactttatatttttctttttgaatctttccaaattggcttcgtaccggatcttctctatcttttttccggcgcatgaccatttgaaaaatctggtttaatttttctaaggtaacatctccaacaatttcacctggccggattggttcttcataatgcttgatttcttccggcacagtttcagatttaaaaaatactttctgcgcatccacacttaaatcttttagctcttctgctgcatatttataaatcttatattctgtaagccggcgtaccagttcttctcttggatcttcttcctcttctttttccggctgcggaagtagcatctttgactttatctttaataatgtcgctgccataacaagaaactcactcatagattccatagaataactcttctccatctcgcgaatatactccatgtactggttcgtaatctccacaatcggaatatcatatatacttactttatttttctctattaaatgtaaaagaagatccaaaggaccttcaaatacatccaatttaatatcaattttcatgctctgctctaatttcatgctctgttctaaatctctttcgatcaatatctaacgatgcctcatctagcatcggtaaaggtatttcttttggttccggaagaaattctactttataaataatcgctgctaatgccggaatcgtaatcttgaactttctcttccaccacttatatcctgtcaattctgccaggatatctgcctttgacccatcaaaatatccgccgtattcctttctctcaccagatagcacctcatggagtacagcataatgatcatatccaaattcaaagtcattatactgttcatcactcatattcaatacaataataaaatgatcttccccacacattctctcataaatgtaaactcgttcttctaccgcttccacttcaatccagcggaagttcgcagaattataatctccattaaaaaatgccggttcattaatataaatctgatttaaatcttttataaaacgatggaaatcctgatgctttggataatctaacagcatccagtcacattctttttcttcatcccactctctgaattgtccaatttcgttacccatgaaattaagcttctttccaggatgcgtatacatataagtatagagcgtctttgcctgctggaacttcagatcatactctccccacatcttctgtaaaatcgttgcctttccatgaactacttcatcatgtgaaaatggaagcaaatagtgttcattataaaaatacatcatagaaaaagataatttatgataatggaactttctatcatatggatgaatcttaaaataatctaatgtatcattcatccatcccatatcccatttataatcaaagcccagaccatcgtactcaaccggtgccgttacttttggaaagtttgtagaatcttccgcaataagcataacagaaggatgcaatttttgcaaacctgaattcatgcatttgataaaatcaagtgccccttcattaattccctttgaagaatccccctgccagtaaatcgcattactgatcgcatccatacggattccgtcaaagtgaaacttctccatccagaaattcgcagatgactgtaaaaagctgcgcacttctccccggtaataattaaaattgcaggttccccattcactgtagcctttgtcctcatccgcatactcataaagagcagttccatcaaacttattaagcgcataagtatctgaaataaaatgtaccggaacaaagtccataatcactccaattccttctttatggaaaagatccaccatctccattaactcccctgctgttccataacgggaagttggacagaaatatccactcgcctgatatccccaggagcaatctgccggatgctccgtaagcggaagaaattcaacgtgcgtatagcccatttcctttatataaggaataagctgtcttgcaagttcattataatgataccagccgttctcctcatctgcttcattctttctccacgaaccagcatgcacctcataaatattcaccggaagatcataattcttacatctcttctttatccatgcactatcagaaaaatgatactggtcaagatctacaataattgatgcggtatctggccgcacctgtgaaccaaaactatacggatcaaaacggtcaagtacaatcccatccttctgataaattcgatacttgtacatcattcccggttctgcatcttcctgtacacattcaaatacaccgctttgtgcatcctgaatcatctcatcctcgctgccatcccagtcattaaactccccaatcagttcaatcttttccgcacaaggtgcgtaaactcgaaacagcacgccatctttcgttatgtgtgctccaaaatattcatacgcatcaaatgcttttccaatataaaattcatgtaaattcatactcgtatccccttattttatttcacccagatatttacttctattttaagcaattttcttcagaatggcaacaaggaaatgcatatttttagtcaccagccataaaatgtactaattcttatttggagtatcctatgctaaaatatttttccaaacacttaaggcaaaaaacgttttatattttcacctttctgcttacaacaagtcttttcttctctcttattttttctcctgtaaagacagtcgcctcatccactttacggcaagtaactaaaaacaaagaaacgaaacaccccactgacatcagttttcaatctgccgccccaaatgctattctaatggaagcctccaccggtaccattctatatgaaaaagacgctgacaaagaaaaacctcccgccagcgtcacaaaaatcatgactcttttacttatatttgacgcactgtcaaaaaaacagattactttaaatgataccgttactgtcagtgaacacgccgcatctatgggtggttcacaagtatttttagaacccggagaaacacagactgtagacactatgattaaatgtattgctgtctcttcagcaaatgatgcctgtgtggcaatggccgaacatatttatggaagtgaggatgcctttgttgcaaagatgaatgcaagggcacaagctcttggcatgaagcatactcattttattaactgctgcggcttagatgccgaaggacattatacgagcgcaagggatattgcccttatgtcacgagaacttattataaagcatccagatatttttcattatacgactatatggatggaaaatatcactcatgtgacaaagcggggagaatcggagtttggactttccaatacgaataaattactgcggcaatatcagggggctaccggactaaagactggaagtacttccaaagctgggttctgtctcagtgcgaccgcagagcgtaatcatatttcattgattgccgttgttatggcctgtcaaagtgcaaaggagagagtgaaagattgtgcctccctccttgattatggcttttctctttgtaaagtttatacagacaaacagccacctgcactttccccggtttccatacataatggtacacaggaaatgctttcctgcaaatatgataaaaacttttcctatgtttttacttctgaaattgatccaaataaaattcagaaaaaagtgatatttcagaaaaatctttcagctccaattaagaaaaatcaagtaattggcaagctggagtattcttatcatcaaaaaaatatagggtctgtctccatacttgcctcgcactcagtaaaaaaagctacttatctcgactacttaaaaaagttaattttaagctactaaaatctaaaggatatcgatatgttctcctgctaatgctttgttcatgcttcgtactgcacagaactttccacacatagaacaggtatcttcatgttccggttttctgtcatcgcggactttctttgctgtttccggatccatcgcacatgcccactgagcttcccagtctaatactctgcgggcatctgccattttatcatcgatttctcttgcaccgcgaactcctttggcgatgtcggctgcatgtgccgcaattttagaagccataattccctgttttacatcttcaagatttggaagtgccagatgttctgccggtgtaacataacaaaggaaggctgctccgttctgggcggcgatggctcctccgattgctgatacaatatgatcatatcccggtgcaatatctgttacgatcggtccaagtacatagaatggtgcaccggaacagattgtagactgtaacttcatgttggcggcaatctggtccattggcatatgtcctggtccttctaccatcacctgtacatttttctcccatgcacgttttgtaagttctccaaggcgaaccagttcttcaatctggcatacatcggaaccatctgcaaggcagcctggacggcaggcatcaccaagagaaatcgttacatcgtattcctgacagatatcaagaatttcatcgtaatattcatagaatggattttcttcgcctgtcattgtcatccatgcaaatacaagagaaccaccgcgggatacgatgttcatttttcttttatgctttttaatctgatcgattgtttttcttgtgattccacaatgtaatgttacgaaatctacgccattctctgcatgaagacgtactacatcaataaagtcttttgcagtaagtgtatctaaatctctctgataatgaattactgagtcataaatcggtactgttccaatcataaccggacattctgaagtcagttttttacggaatggttctgtgtttccatgagaagataagtccatgatggcatctgctcccatattaactgcttccattactttttgcatttctatgtcataatctttacagtctcttgaaacaccaagatttacattaatctttgtctttaacatagaaccaacaccctgaggatctaagcatttatgatttttattcgcacagatagcaacctttccttctgcaacaaatgctctgatttcttctggtgtcatacgttctttggctgcaaccttttccatttccggagtaataatattctttcttgctgcatccatctgtgttgtataatttctcatcttctgttacctccaatttattattaatatttatcgtgtacttttttataaatcccacatatgatcaagcggaccgtttccctgcccaagattcagcatcgctccaattgctccactaatataatcctttgctttttttacagattcttctatcgaaaatccttttgcaagatttgcggctatcgcacttgaaagtgtgcacccggttccatgggtatttggattattgatcctgcaggctggataccagactttttttcggctttcaaaagatttctcatacaagaaatcatcggcattttgctcactgtgccctcccttgctaagaactgcacagttccatcgttttgcaatgatttctgccgctttttctctcgtcttcctgtctgtgatctttcctcctgataaaaactcagtttccggaagatttggagtcagtaaagaaatgttcggaaatagtttttcatataatacttctcttactttctcttctacaagaaccgttccgctcgttgaaatcataaccggatctgctactacctgctttattgaatatttttgcaaatactttgcaataatctcaacctgttctttggatgcgatcattccaatctttacggcatccggctttatatctgaaaaaacactatccatctgttcttcaaaaaagtctggcggcactggcataataccggtaatcccttttgtattttgcgctgtaagtgcggtaatacagcttgttgcataaactttatgcaccgttaatgtttttatatctgcctggattcctgccccaccacttgcgtcacttcctgcaattgtaagcactgttttcattttgcacttccttatcttctttctgacagtctgtgtagctgctgttttttgcgttgaaagacctgacagctttctatttcataaaaatcttttacataaatatcagaaaatgtttggatttcttctgtattatccctgctatatgcatcataaatactacatacaggaaaccctgctttggaagcagtctttactgcatataaagaatcttcaaacacccaggtttcttcttttttcgtctgtaaatgttctcttgccagttcgaatactttaggacttgtctttcctgctcctgcctcttcacaggtaatcatcccgtcaaaatctttccatacaccattacgtataagagctgcctttgccatctctgcatccgttgctgtcgcaatcattaacctgacctgatttttctttaacttttgtatcagatcacagacacccggtttcagtactacctctttaaaataaaaatcttttactacctgattgacaccttctaatatttcctctatcgttacggaaagtttatattctgtttgcatatataaggcaccttccggaagggataatgcatcaagtctttcctttaaatctgacctggcttttatgccaagtgtggcaagatatctcgccccggcattctcccagacaggcatcgaatcaagtaaggttccgtcaatatcaaaaattgctccctttatcacactctaatgcctttccttgtcgtttaccatcgctgttgttttttccagtaaaactcctgtagcatcttcaatatcttttgccgcaaaaatagcactgacaactgcaattccacaaataccgcttcctttcagcgtcagaatattatcggctgtaattccacctatcgcaataaccgggatatgaactgcttcacaaattgcttttactctttctttgctgatagcggatgcatccttcttcgtcgatgtagaaaaaacagctccgactccaagataatctgcccccatcttctctgcaagaactgcctgttctactgtctgtgcagacacaccaagaatcttatcttctccaagaatctttcttacatcatccgcttccatatcgctttgtccgacatgcaccccgtctgcatccatctccttcgcaatctttacattatcgttaatgacaaatggaacatggtatttgtgacacaattctttcagggcgattgcttcttctagaaaatgttcttcatctaattctttttcccgaagctggataaatgtcgctccaccttttaatgctttttctacctgttcatacagtgtttcttctccaagccaggaacgatctgttaccgcatataaaagtaaatctttttttaactgttctctgttaacacagctcatactttgctctctcctctaaatatactgttcaagaatgctccggcattcttgttgcgagatgcacgtcatgcaatgcatgacagacttctaattattcaaaaaacaaatacacttacatgaattatcatatattcataaatgggaagtaaattaaggatatcctcttagaatatggataaagaaacgataaaataataataacttctaaaactgaaaatacgtatcaaagaaatatcagaattttaaactgactttaaatgattttaaactctgaaaagaaaaacgcatatacaccaattacggtatatatgcgaatcaatctacgctatccctacgttggcattatccaaatcaggttatgggtctaagcaccttagcttactctcagcctgctcctgcaagctccccgtatatgaatttaccaatatagtacgctatttattcaaaaaaagcaagcataaattccaaaacaatctttaaaaacaatctgtgatctatatatcagttatcctaatgcaacatctaaaatcatcataagactaaaccctgccgcaaacataaaaatgccgatatttgttgtttctccaaccgacattttcggaacaagctcctccacaacgacatagatcatcgctcccgctgcaaagcttaaaaaatacggaagaaccggaacaaccagactggctgcccatacagtaaatacggatgccaccggttctactgccccggaaaggactccatatatgaatgcttttctttttgacattccttttgtacaaagcggcattgaaataatcgccccttccgggaaattctgaatcgcaattcctaatgcaagagaaaacgctcccattgctgtaatatgatctgcatgattcaataatcccgcatagatcactccaacagccattccctccggaatattgtggagggtcaccgccaacagcagattatctttttgttctccttctatgcattccggtggagcaaaataatcaattgccattaaaaataaaattccaatccaaaatccaattgctgccggaataaaacgccacactccaagtgaagccccctgttcaattgccggaagcagcaaactccatattgatgctgctatcattactcccgctgcaaatccagtaagtgctttctgcatccccttgccaagttcatttttcaaaaaaaatacacaaaatgcacctaatgttgttcctataaaaggaacactgagaccttttattatctctataagcataaaatccctccaaagacatctttatttattattttttattttaaaataaaaatctgtcctatttcttaatatgtctttgaagggaaatgtttctttttttatttctttttttacaacatctttttctttttaaaataagcaacacacaaaattacgatcgtaagacttacattttctgtacattcatatatgcctgatcatagaaaaattcctgtgaatttaacggtgtttcctgcactgccacaatctcataatttccatggctgtcttcttgtcttgctttttggttatcgctgagcattgtgataaacatttcttctaactgcacttttaaatctttatcataaatcggtgctgcaacttccactcttcttaatgtatttctcgtcataaaatctgctgatgcaatataaattttttctctttcctgcgttccaaaaatatagatacgagaatgttccagaaatctgccaacaatacttcttacctgaatattctctgttcttccttttacccccggaatcagacagcatattccacgaattaccatatcaatctttactcctgcctgtgaagcttcgatcagtttatcaataatcttcttatcggtaagtgaattcatttttaaaccgatatatgcttcttttccttctttagcataggatatttcctcatcgatcatcgataaaattctgctctgaagacatcttggcgcaacaagcagatgctctacattatctactgtctcttccatggaaagtgcctggaatacttttgctgcttcaactccaatctctacattggctgtcataagagataaatctgtatataatcttgctgttttttcattataatttcctgttccgatctgtgtataatattctacctgaccctcggactttcttgtcacaagacataactttgaatgtactttgtaaccgtctaatccatagatcacacgacacccggcatcctctaatcttctggaccattcaatattgttttcctcatcaaatctcgccttcagctctacaagaacaagtacttcttttccattttccgctgcatcgatcagatactctacaattttactatgctttgcaacacgatataatgtcatctttatagaaataacatctttatcatttgcagcttctcttaagaaattaagaaatggtttcatactttcataaggataagaaagtaatttatctttttctttaagctgtggaaaaatcgattcatcttctttaaactgtgctgatctttgtggtattcttttttcgtaaaacaattccggaacttttcttagtgtatcctgaatttcaaaaacaaacgacaggtctaacggagactgtacctgaaatacatgatcggaatccagctctaaataatcacataaaatatctacaatctcgccatccatctctcttgtgagttctaaacgaaccggcgcaagcttctttcttctcttgatcaattccgtcatgaaatccctgtaatccagatcttcatcatataatgcatctgcatcaatatctgcatttcttgttacacgaatcaatgactttgctttaatattatatcgctcaaacacttttggaatataatgtaagatcaattcttctaccaacatataagttcctgctgttggcaattcaactaatcgcttaaatcctgtattactgcatggaataataccaagcttttcctttccactctttgtctgcaatactaccactgcataaatttcattatttttcaaaaaaggaaatggctgtctctttcctacaatcgttggagaaatcaccggcgcaatttcacttaaaaaatatctttcaagatattcgctttctttctttgaaacctttctaaagtcaaccattcggactccctgctcctcaagctgtcccataattgtttcataaaccgcatcctttctgcgatttaactttgttacctgatgaagaactgcctgaatctgctcttttgccgtcattttcgttttattatcacgcatctttccaccaagaagcatctgatcaatcaaagatcccactcttacccggaaaaactcatccaaattactctgataaatagaagcaaacgtcagccgttcacataatggcacctttttattttctgcctcttctaatactctctcattaaactttaaccaggataattccctgttcatatatacctgctgactcatttattaatttcctccataaaatcatattttctctcagaatctcctcatatctgatatatttatcccttatgtctgataactgggctatgataacacaggaaagtaaaatctgagaaagcagtcccgtaaaatgaaagtaaaatactaagtcctggttttctgtttttggaacgaaatggagatttgtattttgggggccatccacctattttgacaaatgtaagattgcttccaatactcctccagcaacacatcttgctttatcggatatatgataacagttctcctgttcttttacacgaggatcgacatcagcaatttttaatcctttttttaccgaatatccttcccggatcataccacgaatcacaccgccgataaccgtttccactggcgttccctcgatatctgcgagtatatctcctggctctacgatttcaccaatctgccttaaaatgtgtaactttcctgtagcaggtgcatgaatgacccgctcttttgcataaccccctatcattccgggaattccggtactcggagctgcttctccttcataaattactctgccaagattgtggcctctttgcgtttcaattactgcatccacatcttttcctgcacaaaaccccggaccaactcctataacaacaggcgcatctgttatctttgttccaagatttttctttgccaatatagcatctacgactactggaggatgcagagtctctattgtacttccattttcatcaatcatcaccggaatctgtccctgttcataaattgcaaatgcctcttctaatgaatctgcccgttttgcaattacaccttccacctcgacttctttatcaaaaactgcttcgcaaaaactgattgttcggcgaatacagcttggattcgcaatttctaataccaatacagaaaacctgctctgatgtaatttataaatcgtacctgtggcaatatctccgccaccgcggactacgattaattttttcttccattcttcaaatgtatgcatttctctttcctcatattttttctttgtgaaaaatattctctttccattctgtgtgtgatatattatatactatatcatgatacacaaatctgtttctaactatccgtcacagaacggaatcatgtttaagcaatattaaatatactatcgaacgaaatccaggtcaaatatttgattacgaatatttgaaaaatcattttttattttattaattttttcgcaagggagctttattttgaaaaaaaatttttttaaccataacctttcttctcttctcggtcttactgacagccatatcttaacctttaccggtgggggtggcaagacctctcttatgaatattctgggcatagaatttgcaaaacagagaatcccaacgcttcttactacaacaacgcatattatgaagccagacttccttcccagtaaagcttgcattgaagaagagaatttagaacagataacctccttttttacgaatttagaggaagatattttacctcttgccgctttaggaattcctgaaaaaaagatatataataaagtcaaatggaaaagtccgtctataaactttatgaaaaaactttccctattttcacgaaaatattctaatatttctttgcgtattttatgcgaaggcgatggttctaaaagacttccgatcaaacttcctaaagatggagaacctgtttttttcccaaagacagataccgttatcggcgtaattggactatcctgtcttggaaaaccaataaaagagatgctttttcgttacgaactccttccaaaactcatttttactcaaaaaaatttttcttcacaaaagaatttcacgaaactgccacaaaccacacacaacatcactacagactttttatactggctatgtctttctaaaaatgggcttcggaaaaatatttcttccgaaaaattttgtattgtttttaatcaggcggatgttctcgacgaaaaagctctcgcggaaatgattacattaaaaaataaaataagggatgagggaatttcctgtcatattctttccctgaaaaacaaatatattattaagtaataatttgccgcaggcaagctgacacccccaaagatagaaacgtccgccttgcctgcggcaaattactacttatctaataactcttgttcatctactccttctaagactggtgcatcttctggcaaaaattcaataagatctttatcaagacgaccgactcttgcttgagaataaacataatatccggcatcttctaatctttttcttcccttctggaaagacttttcaattaatattccaatcccggttaaatctgcaccggattcttttatgaggcggctggctcccatagctgcttctccatttgcaaggaaatcatcaattaataaaactttatcgttttgatcaatataatcctgatataaggtcagttcatagcttgttccttttgtaaaggaagttactcttgtctgatatacttttccgtttaaaattttggaagtctgtttctttaaaatgaccataggaacatccagatattttgctgtcatcaatgcaggagcaattcctgaactttcaatagtaaatacttttgtaattccgtactctttaaaatgctctgcaaaatcttttccaagtgcatccataaattcggagtctacctgatgattaataaaactatctacttttaatactgttttccccagtgcttttccatctttttttattctttcttccaataatttcactttttccacctcatattatgtttttttccaaatttattttatcctcttgataatccatatctgataattcctgctcagtaacataaactttatatatcatttccggatgttcttttgcaatccgcttacctcccttatccccttctaatgccatcagttcttcaaataggattttaggaaatattacgggatttccttctctttcttttgttacacacatatggattccttctggatttctgtaaaagctttcaaaaagcttttgcaaactttgtttttgcaataacggctgatcacagaccataaagcagcaaccggcatatttttcgtaatcttttgactgtctcaaatgacgaattcccaaatgaatggattctgaaattccacgttccggatgggcattccatacaatatccatcttcggggcattttcttttacataatgcttaatcggctcatatctcgttacaataactttcattgctgcatcagatgcacatgccaagtctacggcataggtaaaaaggcatcgattcccaaacggttctaatagtttatttgaaccaaatcgttcactgtaacccgaagccatgagtacgacagctatacgtctctccattcctctatgcttcttctctttctagaagtcccatcataacctgttccgctgtaattggaagggttcggaaacgaagtcctgtcgcattatatactgcatccgcaattgccggtgccggtgtattgattacaatctctccgatagactttgctccataaggaccggtttgctcataactgctctcaaattccacgctgatactgcccatatcaagtcgtgtaggaatcttataggacataaagtttcgattcttcatctttcctgcctctgtatactgcacatcttcatacagagtcattcccattccctgcacaataccaccttctgtctgtatacgtgcaaggttcgtattgataacggttccacagtctacggcagctacgtaattaatcggagtaatctttccggtttctaagtccacttcaatctctgcagctcctgccataaatggtggtggtgaaactggtgaagtatgagactctgtcacttcgattattcggccatttcctgcttctaaacttgtaatcagatcagataatgtcatgctgtgttctggattatcattctcgctgatcgtctctccatcaaaatctacttcgcctgactttagtcccataattgcagctgcttcctcacagattctctttctcatggattcacatgcctttacaactgcaccaccggtaacatacgttgtacttgaagcataggaaccactatcatatggcgactgatcggtatctactccacgaacaatgatgttatccatatcacagccaagaccatccgctgccatctgtgcaagaatggtatcacaaccggttcccatatcagaacatccaatcattaatgtgtaaaatccatcatcatttaacttaagctgaacagatcctacatccaggccacctataccggaaccctgcattgccatagccattcctacagaacgaaccgtatgcggacctgttttcacatatggatacttttcatcccatccgatcatttcttttactttagcgacacatttatcaagattacaagactttgtgacctctccaaaataattcgttaaaacgtcaccttcttttaccatattcatttcacgaatcttaaccggatccatatttaattcatgtgccagttcgttcacagcagattctactgcaaagattccctgtgttgccccgtagccacgataagctccggcagacactacattcgtataaacaacctcagtcttgaagcggaaagcttccatattgtataaagataatgacttcgtacctgataaatctacggttgtcggaccatgttctccaaatgcgccggtattagagagtgtagataaatctattccccggattcttccgtttttatctgctcctaatcgtacatgtacctgcatctcatgtcttggtgagccatgaataaaacattcttctcttgtaaatactattttagccggcttccctgttttataagttacaaatgccggataaatttctactaccgccgtctgttttgcgccaaatcctccaccaattcgtggttttaccactctgaccttggattttggaatatttaatcctctggcaacgattcttcttgcatgaaacggaatctgtgtagaggatattaccttgattcttccgtaaatatcaatagaagtaaaggcacaaaatacttccatcatcgcctggctcactgcctttgtatgataggtccggtcaataatatactcacattctgagagcactttatcaatatcaccgttgcctctgcactgagaagcacagatatttctctttacatcgtttccgatattactcttgactacataattatcttctggatgaataatgatcggattatcaattgccttcgtaaaatcaagaatcggttctaatactttatattttaccttaattctcttcatagcctggtttacgcagttctcatcttttccggcaataatcgcaaccggatcaccgttatatcgaatatgctgatcaagaataagtctgtcatccgggcttggctcagggaaagtctgtcctgcctgggtatatcttttctctggtacatctttataagtaaaaaccgcttcgattccaggaacttttaatgctgcatctacagaaatatcctcgatccaggcatgcgcatgaggacttcttaataacttcaccaccagacaatccgccggggcaatatcatctgtatataccgggcggccggaaagaagagcctgtgcatctttttttacgattgctttatttacaaatctggtattttccatcttttgtattattcctccactccaaaatattttgcaagggcacgatactgaccctgatatcccgtacatctacataaattaccagctaaatattcctttacctgctgcattgtcggattcggaatctctcgttttaatgccagtacattcattatcattcccggactgcagtaaccacattgatctgctccttccttcgcaagataatctgaaaattctgctgcctcttcctgtacaccttctaatgttgtaatcttatgtcctgctgctctcactgccggaatactgcaggaaagaaccggtttttcatccatccataccgtacaaagcccacagtttcctgtatcgcagcctcttttcatgctcttataaccttgttctcttaaaaagtctaacagcatctgatccggggttgtctctgcctgaatcttcttttcatttataaataactctattatcatctgtctattcctccgtaagccgggaaatacaacggctaatcaatacttttgacaactgctttctatactgtttgcttcctcggatattgctgccatactgaagtttatcgattactctcttggcatatgatgccacatcttctttcgataaagaatctgccagttcctcgtcaattactacttctgcatgtttcggtcttgcaccaaggactgtttcaaaacgaccatctaccatggccatcgcgcaagtcaatgttggaaaatcggtttctgtcattctaaaactttcatatgcagtctttcttccatcctttttcacatagatatgtgtcaaaatgtcgttatctaatggcatataaataaattctcttaatgaaacttctccttttttatagaggataacctgtgtatcacaagctaaaaatgcagttagaacatctgaaaagcctagtttcgggaaaatacttccacctactgtcgcacaatttctaaactgcaccccaacaatgtgacgaactgcttctttaaataaattctgaaactctttattcaatccctcatgcatctcaatgtcacgtaatgttgccatacatccgattcgaaatccactctcgtcttcttctatacgatctaagccaagtgtagataaatcaatcgcatttaaaatatttctgtttcccatcttcagccacaggtttccaccaataatgacattgtttcttcctttttggttcagttcccacgcctgttcgagagactctgccataatataatttcttattgtgtgcactataactctcctttgtattttattatctgcctacaagaaaaaatcctatctctcaggattctacgttaatttattattatacatgaaaatctttatattttccatacctcagcaaaatcctatagaaaaatattaaaaatcttctttaatatcagaggacttatgtatgcctctatgtaacatcccacaaaaaacaatcctattataagtaaaattatgataatcctgtctttaagtaatgtttgcgaattcccatgccttccccttgaaataaccatataaaaatttccaatgaccgcattacggaataagtaaacatatatgataataaaaatcataccataaaaaacatattgcggaaataaaaaacagactcctccgaccatgcctgtccaaccatattttaataccatgacagaaagcaatattccaataaatattgatgttatataatccagaagacaaaaaacaatatatggcgaaaacaaaaacagaccaataaaaaataatattaactgtctaaaacgtacaaaaaatacatacgaacaaaatgtagataaatctatattttctaacattttcatatactctgtaaaatcaagaaaatcagatagtttaaatatctgcattttcatcgtaatattaaaaaaaagtgttcccgttattaatcctgctatatacaacattccaagaacccttttgccttcaatcgtataatacataacatcctccctgtaaacatatttattaaaatatattcacagaaaataatcttatgatttaattcatcaggagcgaaaggtcagccttctatcacctgggtaccggaaggaatcccatgtaaaaaagtattattaaaaaaagcaaaattctttttcaagaattttgcttttttattctaatctgtatcagtcttctgcttataagataaatatcttactttgcgtaatcaactgctctcgattcgcggatcacattgactttaatctgtcccggataactcaattcattttcaatctgttttgaaatatcccttgctaataaaatcatgtcagaatcacttacctgttcaggaactaccataattcgaatttctctaccggcctgaatggcaaaagtcttatcaactcccttgaaggagttagctatatcttctaactgttttaatcttgtcgtataagtttccaatgtctcccgtctggcaccaggtcttgcagcagaaatcgtatctgctgcctgtacgatacaggcaatcaggcttgttggctcaacatcaccatggtgagattccactgcattaattacgacagaggattctttgtatttcttacacaaatccacacctattgaaatatgagaaccttccatctcctgatcgacagccttgccgatatcatggagcaatccggctctttttgccaaacgtacatcttcgcctatctctccagctattaaaccggataactgggctacttcgatggaatgtttcaatgcattctgtccgtagcttgttcgatatttcatcttaccaagcagacgaaccaattcaggacgaattccatgtacacctacttctaatacagcggcttctccttcttccctcattgtctgctctacttcattctgtgccttctccaccatctcttcgatccttgccggatgaattcttccatcaacaattaacttctcaagagcaattcttgcaacctctctccgaaccggatcaaagcttgataaaataactgcctccggagtatcatcaataatcagatcgactcctgtcaatgtttctaaagtacgaatattacgaccttcacgaccgataattcgtcccttcatctcatcattcggcagctgaactaaagaaattgttgtctcggctacatggtctgccgcacatttctgaatcgctgttacgacatattcctttgcctttttggatgcttcttctttggccctggtcttcatttctttgaccatgaccgccatttccctttttacgtcatcttcgacagttttaagcagataatcttttgcttgttcagaggttaatcctgaaatcctttccagttcctgcagacgtttttcatgcaactcttcaacttttgctttctgtttttcgagagcgccttctttatgagcgagagactgttctttcttctctaatacatcagatttacgatcaagtgcttcttccttattcaggacacgtttctcatatctctgaagctccattcttcgttctctactttccttctcaaagtcattcttagctctgagcgcttcttctttcgcttctaataatgcctctcttttctttgcttcggcattctttaacgcatcatcaagaatctctcttgccttttcctccgcacttcctactttcgcttctgaaacactcttacgataagcgatcgttgcaaaaacagaaataacggcagtcagaacaactgcaatcagaatagcaatcacagtaattggtgacatatctacaggagcacctccttatttagttttcattgtacaaaagtacaacacttagattctatacttatattgacaaaaagtcaagtataatatgaatctactataaaaactgcacagattattccgtcattttatcctatataatattacttatgccaaaatttaaaagatattcaaatttttctttgttaacgctatctgtatttctcttttttcccgaaatacagacaagtacgcagtaaatccgtcccaaaaaagtctttattgctcaataaaagaagttctctgtatcactttcttcttctaataattccccggcttttgtcatcgcttcacgaatcagctcactatcgtagccttttcgcgcaaaatgtgcataaatcttctgtcttgaagcataatcaagctgcggaaatcttctcatatacttctttacctgcatcagtatatcttccatctcctgaccgccttcttcttcaaagacagtttctaacacctgcgatgaaattcccttcttttgaagctccatcttaatctgtaaaaaactttttcttccttttttaaaataaatatagtctctggcatactgaacatcgtccacatacccgcaggttctgacataagctatcgtctcttcaagcgtttttgtatctgtaagtgactgctgaagtttatctcttaattccttctctgtcttatctcttttcgctaaaattgcaatggcacgatgctttgctcttggcaaagcgtactgaagacgaatcctttcgaattcgtcttcttctaacatactgccttctaaaagctttaacttctttatctctcctggatagagatagattccttctcttattcccggatccacgtaaaccttcttcttatccgtttccctcaatgtaactgtataactcatcttcttattcttccgttacgaggttgtcaaacttatctttcgcttcttccgtatccgcagtctgcacagcagtttctactacggtatcggcaggaagtccgtaatattctcttacctgtacttctacttctgccatgatctcaggatgttctcttaagaatgttttcgcattctctcttccctgaccgatcttctctcctttataagcgtaccatgctccactcttctgtactgcatctactttcactgcaagatcaatcaaatctccttctctggaaattccctgaccaaacataatatcaaattctgcttctttaaatggaggcgcaaccttattcttaactaccttcacttttgtatggttaccgatgatttctccaccctgcttaattgcctctactcttcgtacatccatacgaacagaagcatagaacttaagagcacgtccacctgttgtcacttccggattaccaaacatgataccaaccttctcacgaagctgattgataaacactactgcacagttggaacgattaatcactccggtaagctttctcatcgctttagacattagtcgggcatgaagaccaacctgctgatcatccatatctccctcaatctctgccttaggtactaaagctgccactgagtcaacaataacaatatcaagtgcaccggaacgaatcatcgtctcagcaatctccaatgcctgctctccgttatccggctgagatatgtaaagattgtcaatatctacaccgatcttctttgcatactgtggatcaagcgcatgttctgcatcaataaatcctgctattccattcctcttctgtgcctcagcaatcatatgaagggcaacggttgtcttaccactagattccggaccatagatttcaatgatccttccacgcggaacacctccgactcctagtgccacatcaagactgattgagcctgtaggaatcgcctcgatatctatattcgcactggaatcccccagcttcattatggatccttttccataattcttctctattgcggctaccgcattattcagtgcggcaagtttcccttctctgtcatctccaaggtactccactctgcctgcattcatattctctttcttacttgctgccatgctattctaatcctttctaataataaaattaataataataaaattaataaaatctataatactgataaaatattctttctcgtatcattagtatagcacatttgttctttaaaaacaagcgttcgcaaaaatttgttcgtattttatcgattatctaccttttccggataaagatcatgatttacaaggcgatccatcgccactttttcccacattgttcccggctttccatagttggtatacggatcgatcgatattcctcctcgcggagtaaacttgccccacacttcaatgtactttggctccataagctgaatcagatccttcataatgatatttacacaatcctcatggaaatccccatgatttctaaaactgaataaatacaactttaaagacttgctctctaccatcttcacatccgggacataggaaatataaatcgtcgcaaaatccggctgtccggtcattggacaaagacttgtaaactccgggcagttaaactttacaaaataatcatgatcttgatgtttatttataaaagtttccagcatttccggtgcataatcctgcggatactttgttttctgatttccaaggagagtcactccctgtaattcttccttttctctgctcatatatttctccatttttacttttattattatttactatttatttcattccaatttacaaaaaacgtccctgcactccgaaatcatcacagtactgaaatgtagtatatacattttcttttggtactttcaagtcttcttccataattgcaaaaatcgcttcattgaacttttcacaatccgttcttgtcactcctgttttaaaaacaacatgaacatatgctccatattcaaggaattctcctcctttgtaaatatgttcatcagaagaaatagacaccataaggcctgctgccgtctttcccggtactgttgtgattgcctcccctaacttctctgtaagaattctttcctgttttcttgatgcctgctttgctaactttacttcaatatatggcataatatatcccccttttcttttacttttccttaatgtagttccggaaccgcattcttataagtagtaaaatgatagatcagatcaaaacaatatctctcttcacttttttctaccatactccagttttcttctttatcaagattcggcatccatgtatctgcctgatattcataatcaagacgggtaatatatgccgtatcacaataaggaagcaacatatgataaatactttctccacctgttacaaaaatactttctgtgtcatatttggaaagttcttcccacaattcttcttcgctgtgaacaacaatcgctccttttccattataatcttttttatgtgttaaaacaatattaactctattcggaagaggtttccctcctggaaaactttctaaagtctttcttcccataacaataacatttcctgttgtcattgcactgaagttcttcatatcttctgaaatacgtactaaaagttctccatcttttccaatagcccagtttttatctgctgctgcaatcagtttcatttttctcctcctatcatactctacgctttcggaatcttttcacaaaagcaaatacagtaagaactccgaaagtacatcactatttatattgcaatcggaatattctttatctgtggaccggcctgataatcttcaatcataaaatcatctactgtaaatttataaaaatcctttacctctggattcaatgtaactttcggtgccggataagttggcctctttatcagttcctttatgattgggatatgacgatcataaatatgcgcatcagctatcacatggacaagttctcccggctcaaaaccacttacctgtgcaaacatcataagcaatgctgcatactgtacaacattccagttatttgctgccagaatatcttgtgaacgctgatttaatatcgcgtttagacgattgccggttacgttaaatgtcatgctgtacgcacatggataaagattcatctcgtgaagatcttcatgaacataaatattcgtcataatcctgcggctaaacggattctcttttaaatcaaataatactctgtctacctgatccatctctccttctttatatttatgcttcttaccaagctgataaccatatgcttttccgatcgaaccgtcttcatcagcccattcatcccaaatatggctatttaaatcatgtacattattagattttttctgccatatccataaaatttcgtcaattgccgaacgaatatatgtctttctgagggtaattgccggaaattctttcgataggtcataacgatttaccacaccaaactttttaatggtatatgcatacgttccatccggccattttggtcttaccttttccccttctgtactataaccattttctataatatcactgcacatatcaataaacaacttatctgcatagctcatatcgtaacttctccttttttaatccttatgtaatatactcctggaatctgtttatgctttactttactccaaaagtatatgtattatcattattcgaaatcatatcgtatattgtcaaactgattagtaattgattttctttttaaaaagtattagaataaaatataacaatcataccaatactttcattcggaagattcttcatgggaatgcctgaggaatcagaaccgactgaatacagaaagggcgtaattatgaaaaaacatcgtattatttcaattgcgttatccgtaatcggtatcgcagcaacagtatctctggcagtatatcttttaaaagaccgcataaaaggttgtccattctgcggtaacaactcttctgatgaacccgaagaagatatctttgattccgatcttgatgatttagaagagtttgttccagtagaaaaagaagaaaaaccttcttcccagacaaagatccgtcgaggatacattccattaaaattccattcccatgaggaagaggaagcttaatttttaagatcattattttatctattgtactttatttataatgattttcgggaggctgcaggatttatcttgcagcctttaacatttcttttaattcttctacactgaaggtatagtgagaattacagaaatgacaattcacttcgattggctttccttcttcgatcatatcggtgagttccttttttcctacactgaccactgcccttgatactctttcttttgaacagttacaataaaactctgtcggaattttatcttcaattgtcatatccattccttcaaacaactctgccatcatatcttccggtgtctctcctttgtcaagatgtgaagttacagaagtaaagtcttttaatcgttcttctaacgctgtgataacttcatcgctggcaaatggcatcatctgaatcataaaacctccggcctgtcttaccgtattctccttattcatgagaacccctaatgctactgatgtaggaatctgttcagaagatgcaaaataataagtcaaatcctctgcaatttctccggtaatcaggtttgtctgtccagaatacggttcttttaaaccaagatctttaattacagtaagaacaccatttccgattgcaccgcctacatcaagctttccctgggcatttggaggaagcataacatctttattataaacatatccctttaccctcgccttcgcatcagatgtcacaacaagcccgcccataggaccgtctcccttaatctgaaccgtaacaatatcgctgtcattcttacacatacttcccatcattgctgttcctgtcattaatcttccaagcgctgctgtagcaatcggacttgtgttatgaatctgtcttgctttctctactaattcctttgtattcgcagcaaaaaaacgtacctgtttgtcagctgccatacctcttataatataatcactcattctaattcctcctgttttttccatgttcctgcgcaactaccacgatccggccactatccggctgtggagcctgcatcgtatattcctcataggcctctaaaaaaatcagaccactttcttctaataattgttttatttcatcaagagtatatcctctctggatatgctcttcctgaaattttcggtaaatgtctccttcttcctgtacaaatactttaaggtcaatatcattcaaatgactgtcctcatcgtattcattaaaccagatgaaactaacatcttccctatcttctgcaatcactgtctctccgatcagctcgcggtatttatattctgtattgaaatcaaaaataaataccccttccggatcaagataattatttaccagctgaaaaactttccttaattcttccttttttgtaatataattcacactgtcacaaacagaaattactgcttttaccgtcccatacaattcaaactctctcatatcctgtaaaagatagaggaaatcctgtgaagtcttttctctggcaatctgcagcatctctacagaattatctactccaatcatatcaaatcccgctttgccaagcaaagtcatcagctttcctgttccacatccaagttccaataccagaccttctgttatctttctgtcctgcaaaagatttaaaataaattgtgcccactcttcataaggcacattatccatgagttcatcatatactctggcaaaattttcgtaacttcccatttatttttcctcgatttcttttcctatcgtttccgtcacatagtttcgtctgtttttaatgatcgaatctttaatgtgctctcggaatctttatgtgcttgattttgtgagtacattttataataacggagcaaaaatccgcaaaattccctgtagtaataaaaaaaacatattttttttgcacatttcttccgtaatgtggttacagtcttctaacgtatctaatatgtcctgcttaatagccatgactgtatgacaatcatataaaaacagtccattttcaaaatgtaaatacaagctgcggtaatcaagattaattgtcccgactgttgcgatcttatcatcacagacagcacactttgcatgaacaaatcccggtctgtactgaaaaatctttacgcctccttctacaagctgaggataataagactgtgttacaaggaagatcatcttcttatcaggtattcccggtgtaataatccttacatcaaccccacgctttgctgccaggatcaaagccgtaacgacttcattgtcgataataagatacggtgtgaaaaaataaatatatttctgtgcgctgttgatcagattaatgtatacactctcgcctacaaattctgaatcgaggggatgatccgagtagggaagaacaattcccctttctttttccggcaataacgctacctcttccaaagaaaacttctcatagtcaagcttttctttttccggtgcaaatgcattccacatctgtaaaaacatctgtatcatactgtataccgcttttcccgttattcgcactccattatctttccagtaaccaaatctctgcttctcattaatatattcatctgcaaaattaatcccacccgtaaacgcagcatttccatcaattacaagaatttttcgatgatctctgttgttaaatacggtagagaaaacaggaatatatctgttaaaaactacacacttgattccttttttgcgaagagaatctgcataatgtgatggaagattaaaaatacatcccacatcatcatacataacccttacatcgactcctgcctttactttttcctctaaaatgtcaagaatcgtgttccacataatcccttcttctataataaagtattccagataaatatacttctgcgctttcttcagttcctcaaccataatacgaaaacattcttctccagaaggataataatctacttttgaatctttatatgccggaaagcctgactgatgttccagataataaatctgcgatgctgtactcccgtctgtaagcttcaattcttcttcaatctgtgggtcaatttttaaatgcctctcgctctcttctatcatgggttctaactttttacgaagataagatattggttgttttccacctattgtaagatataaaagcccgccaaagagcggaaataacaatatgacaataacccacaccagtttcactgacggattatcactccggttcattatatatataacaactaagatgctaagtattttaaatgcagctgtaatatactgactgtaagatgtaaatttaagaaataatccaacaaaccataaaacctgcaaaaaaataagaaaagtcacaataacgatacgttgtgatagaaatttcaaaaatttacgcattctctcctcttctttcctctaaattcatgtatttcaaatagaacgcacgtgaggattacattctcactgagaccaatttattaattactcgccacttatggaagtgagaattttctcgactgagataaactttttcaatgaaaaagaatataaataaatctcactgactcttttttctaaaatctgctcaagggctgctttataatataacatctgattcccgtatcggtcaagaagctgctgctcttccccttctttaatctggtctgtcttatagtcaattaaacacagatgattccccatatctgcacaggcatctatcacaccctgtacaacaaccgtatcctctgcttctgtgtcctgattgatcagagaaaccggcagccctactgtaaatgggagttctttttttactttacctgcctcatccattttgcgtattttttcgccttgttccgaaaataaaaatgcttctattccccgatacagccacttagcggaaatctgttttgattcaggataattctgttctaagtcagtaatccaatcaaaaagctgttttttcgtctgaattttagcaaatggaagcatttccattattttatgaacgatggttcccttcgccgctccaccgacttcttctcgttcttctttaagaaactgtgggatgatcctttcttcctcgtccggctcatacacaacactctcttcatttggaagcgttatctgcgaaagagactttaactctgaaacagaatactttctcttccactttgttgcttccatatttggatacacatgagaaaaagctttcttaatcagagaactgtcctgcccttctacgtattcctccataaaatgccgataggaaaatgcagcctcttctctttctctggcattaaaaagttcttctatatcagaccagctaaataatcgtgctttcagccatattttatctgtattttgaaattgttctgccataatcggaagaatccaatccatcatacttcctgcacgccatttttgcgcctgtatacttgcccgcatcccagcttctaactcttctgattttattaaccctgtaagaatcagctttctctttgctctggtcattgcaacatacaaaattctcatttcttcttcaagggtatctttccacgctttttcctgaatggcttttttcatcaatgatggatgatgaaaccgtagtgttgtattcacacattccattccgatgccaagttccggatgacaaagaactgccttatttaaatccatacgattaaattttttagacaagccgcttacaaacactaccgggaattctaaccccttgcttttatgaatcgtcataatctttacgacatcttcctcttccatactggttccggcttctcccatttcgatttcataagatttaagctgcttcatatagcgattaaaataaaacaggcctttaaataccgttttttcataatcttctgctttttttagaagcattaaaagattttcttttctcttttccccatccggcataagctgcacatcatagtaaaaacctgtcctctcgtaaatatcccacaacaatgtgctaagcggctgttcctttttttgctgtctgaaatagagcagatccataagaaaatcccgaatctttttctttaattcttcttctgttccttcctgcatataaagacgcataaagtcatataacgtatattttccacgcacaggttcttcaatgagtacccggagtttcaccagttcttcttctgtaaattttccaatagaagataacatgaccgatgccattggaatatcctgatatatattatctacaatagaaagataattcaacatgactgtaatttctcttgtctgaaaatatcctgttttattatcacagcttaccgggattccctcttgctctaaaaactcagccatcggttccattcttcctgccccggatcttaacagaattaccatatccccatagtgataaccttcttcaattaattctttgattcttttacagatgaccgcactttctgccaaaatatcttccggaacttctttcagtgccgatgcactgtctttttggaaaaataaaatttccgaagtttcttcatcctgcatcatcggaccaccatctcccggacgaagtgctgtcttttcattatagtcaaccccgccaaactctttttccatcaactgcgaaaaaatatagtttgtgaatgtcaatactcccggtgcacttcgaaaattatcccgaagttcaatagaaactcctgcatcaacctgcgatatatattggtcttttcttcttaaaaacaaatctggtcttgcctgtctgaaacggtaaatgctttgttttacatcccctacagtaaatagtgaattgtgtttcttattcaacaacatttctagtattgtttcctgtacaagatttgtatcctggtattcatccacaaagatcatcttatacttttttgataattcctttgccgtttctgaaggctgcgcctctccctgtttatcataagattctactaaaagttctaatgcaaagtgttctagatcatcaaaatcataaacatttttttcttttttacacaaaaaatatatttctgcaaatcgctttgtaagagccatatattcttctaaaagaggatagattactgctgcttccctctgcaattcttcagccgatgccgtaaatacattctctttctgactattgatctgttctcttaccttctgatgaaactcctttacttcttcatataattcccactctttttctttttgggatgctcttggaaaagaggaaatcgatttttgagataagactttataataactattgtagtctttcgcttgggtcagagaatttatatattcttttatctcctgaagaagtcctgtatatttttcaggagcatcttcagtgacactctctaatagctgatacagttcttcctgtatttgtaaactttccttttgtgctttggaaagaagaagagtcactgcagtagaagtatcccagccatcttttcctgcaagaatcgctgcctctttccctgtcttttcaaaccagccgtctgcattaggaaaactgcgtgaaaaacgatacaaatcttcgatcatttcttcaagaacggtatcattctttcccggcgcatatgcttcaacaaactgtagaaagctttctcttcctgaggcatatgcttcctctaatacctgttctactgcctgttggcgaagcagaaataattccccttcttcaccaattcgaaaggaaggatctatcgcaagttcattataatgtgttcgaatgagatgattacagaaactgtgtattgttgaaatatccgcctgccggatctttcttatctgttttctaagataaagattatccggatctttttccaggcgttcttctaattcggttccgatacgttctttcatttccgccgctgctgcattcgtaaatgtcattacaagaaaacgatctgcttctatcggatgttctttatccatgatcagttccgccatacgactcacaagaactcttgtctttcctgctcctgctccggcagataccatgatatttttccctctcagaaatattgcctgttcctgttcttttgtataattcatcttactctccctcctctcttattttttccaaaacttcttctacagataaactctgaaaactctgatattcatatcccggcaatttcacatcaaatccacatacatcggcaaacggacaataatcgcaggctgttccctttttatttcggtatggtcttggacgaatttctcctttataaatccttcctccaagttcagccgcttttctttttgcatacccgcccatataatgaaaatcctgtgttcccattaccggagaatttttatatggttctcctgattttttcagacggaccggcatagacagaaagtcaccgtcaggtgcctcaagtttatttaaaatatctccatcactattcgccattccagacatgcggaaatttttaagcagactctcttcctctgcatgatctgctttaatgataggatcttgtaactgataatagaacacaccagcaggtgtcacttctttctctgtttctttatgatatatctcctctgctgcattcatataaataatcaactgtagttccagtccataataaaaatcttccatttcaaactttttagcaccggatttatagtcgatcacacgcataagaaccctgtcatcttcttcacagacatccaccctgtcaatcgttcctaagagaaacattttccgtccatttgaaagaggcacttcagcctctcttaatcgctcctgctttccaaagtgaagttcaaaacgatccggttcaaattcactgttctttaaatgtgcacgaagaacccctatcgtccttctcataattcgctctactgtctttatcttatattgatttcttgaagaactgtaaaatacatcaccaagattctcatccatagcagtttgcaatgcttccgaaatatattcattctgcaccttctccggaattgttttccagctatagtctgattccttcaccttttttgaaaaagtttccaatgccttatggaaaagatttcccaaatccatcggtcgaatcttgtattcttctctttcttttaattcaagaccataaatacaataatactgatatggacaggcagcaaatcgttccagcctggttacactgcctgaaatttctttcccataaagttcttccattaaatcttccgataattttggttcctcatatgattcttccagatactgtccatatttttccagatcttttttcttttctgaatacttattccaataatttgctaacataagaaaggctttattcttttttatttgttcgggatgatgtttcatttgaagaagaccctgcaataaaaactctctgctatcttcctcattaaaataatatcttttttcttcctctggatatttctttctattcagctttggaaaaagataagttaaattcttttgaagaacagaaggtcgaagtgctgtcccgtcactgtccgttaacgaataggaaaaatagagttcttccgttggcttagaaaatgccatatacatataaaactcatcttccatcgactgctctaaaagattttgtgacagagtaattccatattgctttaaaagttctttttcatcatcactaatgattcctctatcttctaaatttggaggaatctttccgtcattcatccctgtaatgaacaaaacttttatctcatgcagacgagatcgtttcaaatctccaagcacgacctgatccatagataacggaacaacgccaagccccagagaatccaaaccggcatccataatttctccaagttcttttatcgtcatcttctcttccccgaaaatcatgacgatcttatctatcagcgaaatcaataattcatataactgtctatattctgttgcttttacataatatcctgcatcctctgccttttgtgcacagtaagaaaacttttcttcaaaagccagttccgtcatcgtcagataaagcgctttcattttatcttttactgaaacttctttatccctcattacctgacagaaatgctcagtttctttcataaaacgttcctgcaaagtatgcagttcctttatcatgtcttcctctttgttctttaagcgccggacaaatggttttttccacatagaaagtcctctgatacctgcataaagaacatagttttccagataatcagcttcttcgtccataagatcagacattcctgacttcagataacgaaaaacactctcataagaatagtccatctgtgcaagatggaatagtgaccttactgcctcaactccagaatgataggataccttttttttcgtatcttcaaataccggaatatttaagattgcagcctttcgtttaaatgcagatgcgtattctgcaacatctccggaaagaacagcaaaatcccgatatcgatatcctttttgtctcacaagctgttctattttatgcataacataatctgcttctccatcaggattgcggcatactgtcatatgaattcgttctggaaaatcatcatatgattctctgttattctggaataaatgttgttctaaaaaagctgtttccggattatttataaatcttggagcgattttttctctaagattaactatctcttctacttcctgcatattttctttacaaagcatcagcaatgcatctgctgttttcttactggcattgaataaatcttccgacattcctttttgtcccggaataaattcaggaatcgtcaccgttacattaatctgagcagccaccttgagcaattctcttaaaaaagaaatctgtaccggtgtaaatcctgcaaacccgtcaaaataaaagactgcattctttaacatcggcgccttctctgtaaattctctggcaatatcaagaatctgttctgttaccataaaccttccctctattgccttttcaaaatgctcgtaaattcttccaagttcttcacatttattacaaagagatttgttctcgtctaactgctttgttacttcttccacctgtttccatgaaacaccataaccaataaactccatgagcattgattttagttcatcaataaaacctggtttcttcatgctttttttgaaataaaggaaatccccttcctcttctgaaagaatctttctaagcatcatcgatacgcccagatcttccagtatttcttttggctgataattacattctgcaaaaatacgataggacagacgatgaaagcttagtacatctatattaaaaaatccatgtcttggatgcatctttactattttacgctgcatctccagactgaactgttccggtacaataacataatattgtttttccggaatctctatagaacggcggatcacttccttcaccagatattctgttttcccctgtccacttcttcctgtaatatatctaagcgccattctctatgcctcgttccagttactgagttcttctcttaatacagctaacaaatcactttccggtattttccggactacctgtcccttcttgataaggagtccttctccctttccacctgcaattccgatatcggcctctttggcttctcccgggccatttacaacgcatcccataacagctactttaatatttaaactatcaaactctgttaccattttctctacttcattcgccagtccgataagatcaatattcgttcttccacaagtaggacaggatactacctcgattccaccttttctaaggccgagtgtttttaatatctgctttgctgaagcaatttcatttaccggatctcccgtaagcgaaactcgaatcgtatccccgattccctgatttaaaataataccaagaccaattgctgatttgatatttccgcggaacaaagttcctgcttcggtgatgcctacatgaagaggatactgacactttggcgctaataattcatgcgctctggcacacattaaaacatcggacgacttaatacttactacaagattatcgtagcccatatcttctatcatattcactttatcaagtgcgctctccacaagcccctctgcagtcacttttccatatttttctacgatatgtttctctaatgaaccactatttactccgacacgaatcggaacattatattcttttgctttatcaacgactgcctttactctttcagaagaaccgatatttcccggattgattcttattttatctgctccattctcaattgctgcaatcgccatacgataatcaaaatgaatatctgctacgattggaatatgaattctttttttaatttctccaagtgcctttgctgcttctaatgtaggtaccgtagaacgaataatatcacatcctgctgcctctaactcaagaatctgtgctacggttgcctctacatcttctgtcttcgtattcgtcatagactgaatcagaatcggatttcctccaccaatcaccctgtttccaattttcactacctttgtttgttctctgtacacagcagttcctcctttttataacgtacatatttgccagaaaagagcctgccgcacctttagctgcaacagcctcttttcctttcttacactttacattcgatatagaataaacctgtataagtttatctgtctgttcatttatataaaaaatatatttttaatatcattcgccatgacaataaccatcaaagccatcaaaagaaccaatccggcaaaatgaaccattccctccttctctggaggtactttcttccttcgaatcatctcaatgataataaacactaatcggcctccatctaatgccggaagcggcagaagattcattacacctaaattggcactcagcatgattgcaaaattcaaaaggcttaatacaaccgtcttaatgccatacacgattgactgctcataggtgtctccgatcatattgacgattccaaccggaccggacagatcgttcaatttaaaacgtcctgttatcaaatatttaagactgaggaaggtagatttaatctgataccttacctcaagaatactgtactttactgtaccccaaagaccttcttttgtactttccttcttagaaattccaaaagcataacttcctgattctgttttctttcgcgtaaccgtgactgtctttctttttccgtctctttcataggttactttcacatctgctttgtcattatgcatatagttaaaaagagaaatctcgcgaaaattatagattcgtgagccatctaactttacaatatgatctcctgcccgtatacctgcttcatatgctccgctatctgttggaacttcacttgctaccgcagggtctgaccctccgaagccgacaacaaataatgcaagaacaaatgccagaataaagttaaaaaacggtccggcaaatattaccgagaacctggcaagtggtgactggcttccaaacgctcttgggtcctgacaggcatcatcttctccaagcataacacaacaaccgccaaatggaagacactttacggaatacttggtctctcctatctgctttccaaaaatagttggtccgattccaatcgcaaattcttcaacacaaatcccgtttttctttgccagcaggaaatgtcccagttcatgaaaaataacaataacactaaataaaacaattgcaagaattattttcagcatgaattttcctttcttttactgaagtacggaataaacccactgctctgttgcaagaatctcttctaaatcaggatgagcagatactttatgggcatccatacacttttcaatagaacggacaatgtccgtatactttatctcaccttttaaaaactttgcaaccgccctctcattcgctgcattaaaaacagtcggcattgttccgcctgtctttccagcctcaattgcaagagataatcctctaaacactttataatctggtttctcaaacgtgatctgagataactttgaaaaatccagtctgtcacccggaagacttcttctttccggataaaacaacgcatattctatcggaacacgcatatccggcgttccaagctgcgcaataactgctccgtcaatatactgcaccattgaatgaatgatactctgtggctggataacaacttctatctgagaataatctacgccaaaaagccactttgcctccatcacttcaagtcccttattcaccattgtcgatgaatcaatcgtaattttcggtcccatagaccagttcggatgattcagcgcatcttcaagtgttacagtttctaaaaactctgcgttctttccgcgaaatggtccgccggatgcagtaagaagaatcttatcaagtgctttcttcggttctccctgaaggcattggaatattgcagaatgctcactgtccaccggaagaatagatacgccgtattcccttgccatcggaatgatcagatgacctgccgttacaagtgtctctttgtttgctaatgcaatatccttaccctttctgattgcctccatcgtcggtaaaattcccatcataccgacaacggctgtcacaacgacatctgcactgtctatcccggcaacttcaataagtccatccattccgcagacaacttctaccgcttcacccgcaagttcttcttttaactcctgtgccttcctctcatcagataagcttactaactccggatgaaattctcgaatctgctctttcagtcgttctttattactgccggcagcaagagctactacctcaagctcatcagaatgtgctctgactacatctaacgtctgtgttcctatcgaacctgttgaacctaatatcgctatctttttcattttaatcccaccaccatcactaacatataataaataatcggtgccgtaaatataatactgtcaaatcgatccagaatacctccatgccccggtatcaaatgactgtaatctttgatctcataatttctcttaatcgcagaagcacctaaatctccaatgatactaataagaccgcccacagcacatactatgccaaatactatgatcaggttataatgaactgacaggaaattctttgagatcaaaccataaaggcagccaagtaaacctgctccgataaccccacctacagcaccttctattgtcttcttcggacttaatattggagacatcttatgctttccaaataatcgtccggcacaatatgccagtgtatcattaccccaggcacttaaaaatacaagaactaccatgtaagcaccatcagaaagcatacggatccgataaatacaggaaagcattattgtaacgtaaaataatgcaaaataagaaatcgccacactcgaaatctcatatttaggaaaagtaaacacatataccgctatcagcataataagcaccagtaatgccagcggcattatatactgttctaatccaagaagtaataacaaataatataatatactacctgtgtatactatgacaccaagagcagacttctccatatggatcactcttaacaactcaaatacaccaatcaaagaaatcgctcccactacaaaaaatgtaagaaagccaccataatatagtgtaacaaacgctataatcaccagaataattccgctgatcaatctctgtttaaacatcgctgtcctccttatcagactccgccaaaacggcgttctctggtattataatactctacagcccgtattaattcctgcttatcaaaatccggccagagtacatctgtaaaatagaattccgcataggcaagctgccataacagccagttagaaagtctctgttcgccacttgtccgaatcatcagatccggatctggcagatcctttgtatcaagataagaagcaaaccgttcttccgtaatctcttccacagaaaatgctccctctttgcaatcctgtgccatgtggcgcattgctcttaccatctcatccctgcttccgtaattaagcgcaatcgtaaaattgagtcctgtattcgctgcagaaacctcttcaagttcatcaattgctgccctgatatcatcatctaaacggctcttttctccaataacacgaacccgcatgttattctttgctgttctttcgatacaatcttttaaatactttcgtaaaagcctcatcaatgcctttacttccttatccggacgtctccagttctctgttgaaaatgcatatactgtcaaatacttgattccgatatcccacgcatcttcacagatctgttctactgtcttcgctccctgggaatgtccataatttctaggcatcagacgtttcttggcccatcgtccatttccatctaatataatagccacatgctccggaattacaagcatctttccattcaattccttttccacttatctgtaaacctccaaacttctaaaccaatcttataatgaaacacataagaaaaaccagacagccagtcacgccggccgcctggttgctttccatgatactatactgtaagaatctcctgagacttcttatcgatcattccatcgattgtcttaatatgcttatctgtagctttctgcactttatcctgctgatcttttaattcatcctcagtaatctcattattcttgttcgccttcttaagcgtatcattcgcatctcttctgatattacggatagcaaccttcgctgcctcaccctttttcttaacgtcctttacaagttcctttcttcgttcctctgtcaattcagggaacacaagacggataaccttaccatcattcgtaggattaattccgatatcagactgcataatctccttctcaattgcctttaaaagagaagtctcccatggctgaatcgtaataattcttggttcaggaacagaaacattaccaacctgctgtaatggagtaggtgttccgtaatagtctaccttaatcttatctaatacatgcggattcgctcttccggcacgaatagagttatactctctctccagactctcaatagacttctgcatcttctcttcaaacttctttatcataatatgtcctcctacattatacttattctctattattgtgtggtattaatttacaataatccatcttgattgtcaagctatttccagtttttatttatcaaacaatacctctataccgtaacatatgttccgttaaacttgccactcattgtatttacaatactgttctcctcttccaaaccaaaaatgactaatggcatcttattctcaaggcacatgattgttgctgtcaaatcaataacaccaagctttttggaaagtacttcatcaagagaaatctcatcatacttcacagcatccgggttcaccttcggatcactgtcatacacaccatcaattgcttttgctaaaagaatcgcatccgcttcaatctcaatggcacgaagagccgtagctgtatctgtggagaaatatggatgtccggttccgccggcaaagaaagttaccactccatcttccagattattcactgcatcatcttttgaaaaaagttctgtaaatgctccacaggtaaaaggagtataaaccttagtcttcattcctgcgtgacggaacatatcagaaacataaatacagttcattacagttgcaagcataccaatctgatctgccttggttctttccatgttctcgctagttcttcctctccagaaattaccgccgccaataacaatagcaacctgcactccatcatcaacgatctgctttacctgctctgctacttttaatacggttttctcatcaaagccagtcttcttctctccggctaacgcctctccacttaactttaataaaacacgttttaaaccttttaaatctttcatgtaaacctccaaaagtctttatcccatgataatcttccgggtgcgaaaatcataacgaatctctgtcttcttaaatttctcatctacatcaataaatttaagcatagtatcatcatgcgctaacactggatagttcatccctgacagcaccgaaaaaaagacatctatgatcatatatccatttttcctcgaaacattcgacaataatactttcatccttcacacctctgattctctacctcgtacaaaaaggcaaagtaatacttaataacattatagccgattctgctcccaatgtaaagaaccagatatcaatcctgatttgatggattaaagaaacgaaaaccagaaactttatatagaataaaatgtgaagatagtcgcggcatagaaaatgcctgaccggcatttttatttgctccgacatcacattttattctatataaagtttctggttttctgtcctttagcgccagatgaaatcaggatttttgtctgagggaaataaggggcttgtccagaaatctacgattctccttcaattcaagtcgagcagcagtgaaaaattaaatgtcaattcttttgaatttaattccatggaaagccacaatcttctggagaattcccattccttccaactgtagatttagatagtcagaaaaaagaaaaaacaccctatcccagatgcggcttcggagcgtgtttaagatgcggataagcattttaaacacagcgactacagagcagatgggatagggtgttttttcttttttcgtctacatcaaatctacaaaatctaacctaaattgcggattttaaagtctctttcggcttctctttttgcatctttctttgcaatatcctgtctcttatcgtataacttcttacctcgggcaagaccgatttcaacttttacaaggctgcctttaaagtaaacttttaatggcattaaggtgtagcctttcattttaatctgaccggccagtttattgatttctgatttatgaagaagaagctttcttacacgaagtggatcacgattaaaaatattccccttttcgtaagggctgatatgcatatgattaatgagcacttctcctttattacttattgttacaaaggattcttttatactacatttgcccatgcgcaaagactttacttcggttccatgaagagcaattcctgcctcatatttttcatcgataaagtaatcgtgatatgcttttttattgttggcaattaatttaatgccttctgattttgccatacaaattcccctttcctgtcataatatactcttagattccttgccttactgaaccccataagtacatatatttaacgatgctaaatctcatcaattttctttttgctgtaaagatggagcaggcggtctgcttcctcatcatcaatccagtcatttaaaagaataccgtccttatctggaaggctgcttccggtctcgtcaaattcagaatcttcttccgcaaaactatctcctggtattccatcaccataataatcatctggatcaggataatcagcatgctgcgaaaattcttttaaaacaaaatctatcgtacgttccattttatctgcagaacgaactacaatttctaccttttgacccagtgtgaaaattcgtccggtatgttctcccgtaagcttatagctttcttcatcaaatacatagaaatcatctaacaggctgttaatcggaaccattccttcgatcgtattatcaagttccacaaaaaatccccaggaagttactccggaaataacacctgtaaaggcttctcctaaatactgctgcatatattctactttttttagtttgtctacttctctttccgcatcctgtgcacgacgttccatagtagaactctgctgtgccaccgatggtaatatggcctcataatgttctaaccgcttctgattcagcttgccatgaatattctctttaataattcggtggatctgtaagtcagggtaacgtcgtatcggtgatgtaaaatgcgtatagtactgtgtggaaagtccaaaatgccctacattcagcgttgtatacttcgcctgtttcattgatctgagtgcaaggcggctaattaatggttcctccggttctccttctaatgaaaaaagaagtttctgaatttcttttggatgaaagttctctcttccggtcttcatataatatccaaaattatggataaatgtatcaagtttctttatcttatcgctatcgggtgtttcatgtgtacgataaaggaatggaatttcctgccagaagtaatcctcggcaaccgtttcattggcaagaagcataaagtcttcaatgatatccgttgcaacatttctctcatatggatgaatatctatcggatatcccttatcgtctacgatgatcttagattccggaaaatcgaagtcgatcgcacctcgttttctacgcttttcctttaagattgctgctgcttctttcattaaaaaacataatgcacgaatatcttctctttctccttctggatgttcctgaccttcaagaatcgcctttacacctgtataactcattcgttcatcaacacagatcactgattccgtaatcgtatgatcaagtacattaccatttacgtcaaatgtcatcatacaactcattgcaagacgatctgttcctgcgttcaaagaacaaattccgttggaaagttctcttgggagcatcggaatgacgcgatctgcaagataaacgctggttgcccgttctaatgcttctttatcaagcggtgagtcttctttaacgtagtgagctacatctgcgatatgcacaccgagataatacttctcatcctttttagaaagtgtgattgcatcatctaagtctctcgcatcttctccatcaattgttactgtaagaagatttcggaaatccacacgctttccgcctggctgttctgaaatctcctgaggtacagactgggcttctttcataacagactttggaaattcctgttcaattccataagcacgtataatacttgtcacatcggtagctggatcatccattggtccaagaatttcaataaccgctccttctggtttctttctttctcctccaaaatccgtcagacgaactactactttatctccgtcctttgcgccactcatatgcttcttagaaataaaaatatctttatcgtaatgacggtcatccgggagaacaaacccgaagctggtattcttctggaaggtaccgacaagtgtcttacagccacgttctaatatttttaagaccattccctcacggcgctttccttctcttcctgacctctttgtcacttttactttaacaatatctttatgaagcgcaccgtttacctgtgtcgcaggaataaagatatcttcttcttctccctcgaccgtcacaaaaccaaaaccgcgtgcattcgctgtgaacacgcccgtaacattgtgattctccggcttaatatactttcccttcgctgtaagttctacgcttccatctctcacaagagcatccattacttcttttaatgcacctctgtctttatgtggtacatccataagatatgccatttcttttaattttaaaggaatataatccgggtcataaatcatatcccgtatgctgtttttacgctgttcaaataataatttatctttcataaatagcttcccctgtcaaaacttttgtcaaaaaaagccgtctcagttcagtttgcgaattgagacggcatcatagtctgctttaaaattactggaaaaccttcaggcaaaggccaatggctactacgaagaataaaaatccaagaattgctgtaattctttctaacttaccttccttagtccgaccacggttctttctaacataagaatcagaatcaacctgtccgcttaaggcaccgaaccctgaattcttgctttcctgcatcattaccactataatcatcgcaagacatattaacataaatacgattgttactaatgttctagccaaatttcacacctcctgccatctacacaaaatctaaactattatagcacagttttttccacaaaacaagcttttaattctcttctgttgtagattcggcagatttctcttcctgttctgcaagataatcatgcgtactttctgttactccatcaacaaagatatcaaaaacagatttcgactgtgtcatggattcctgtaaatttccatttttaatatactttttatatttcttaaactttttgttactctttgctaatgtatcaagagaagaaccatcgaccgtaaacttctctatattaaatacttttgcatttccagctcttaaattcttctccagttcagcaactttttctacagtaccgtctgatatatgctcatcatttaactgagaaagaacaacggcgttctctgcataaccagctgtccagtctgttgcgatttctttgtcttttaatactttattcactgcataggtataatatacactccagtcagatatcgcagaagtaagtgcatcttttggtgcggtagaaataagattgacgtcatttccaatcaatggagtatcattctctgcacataccgttgctacagcagtggtatacgtatactgtgccatcatcttcacaccagctgcaataagctgtcttgctgccttcccatctgcatcataaacgcctcttttaccgacataacgaactaaaacagaggactgtgaacaagctctttctactccaagataaaatgcattaatacagcttgttgtctttgcattcttttcgcatgccacaaatccgatcacacagtcttctgcggaaatatctcctttatcaagaagatgatttaatttgataccagcaacgagaccagctacatgatatgcttcatatattcttgtatcgtagttatgaaagttagaaagttcactgtccttagcaagctttccgccttcctgacaaaactgtaccttcggatacttcttcgctgtttcttctaatacactttcaaactccggattttcagaaaaaataatgctgcagcctttttctgcaagttccgctgctttcttctcacaatcagacttcttaacactttctttaatgatgatctgatcatcttttattcctgtctgctcctgcatcttgcggattccctgtactcgcgcaacggtatctggtgcatctccgtctgaagagagcagataccccactttcatacttccactgtctgcagtctttgtttcctgctgctctcctgtattctcaggaaaaagtgacttactgcttccacatccacagatggaaagcgccatgatcacagccataactactgctatatgttttctcatgttttcgattcctccgtttctttgcttaacggtcctctctaaaatatgccagtcccagactattcggtggctgctgctctctcttcttacgaagactcgtaatgataagaacaatgattgttaccagatatggaagcatcttaaagatttcctgcatacttcttccaagtcccggtatataaagatataaaatatacaatccgccaaataggaaggagccccagattgcattgacgggcttccagagggcaaaaataacaagcgcgatcgcaagccatcctctgtcaccaaaaccattattcgtccaggttcctcctgagtattccattacaaaataaagtcctccaaggccggcaattcctccaccgattaccgttgcaagatatttataaagcgtaacattgattcctgccgcatccgctgtcgctggactttctcctactgcattcaaattcagtccccagcgggtacgttttaaaaaaaacgccataagtagtgtaataataattgcaaaatatgtcaagaacccataattaaaaaatatctctccgattacggggatctttgataaaaacggaagctttgcacgataagcatctccggtaaccgctacagaaatctgtcctacaccaccggcaagtgtcgaaagggatcctccaaaaaagttaccaaaaccaacaccaaatgttgtcaaggcaagacctgccacattttgattcgctcttaatgtaattgtcaatacactaaaaatcaaaccaccgaatgcagccattaaaaatgcagctaacagggacagaatcattccaaccagaccatttggatgtgcggcagccttttcataataaaaagctgcgataagaccagcaatcccacccatatacatcattcctggaactccaagatttaaattacctgatttttctgtcagaatttctccatctgcgccaaagagcatacagacaccctgcataatggccttttgtacaaatgtaattaatactgtcatcaatctcttcctccttatgcactgtgctttccgcgaaattccaatttataattaatgaaaaattcacatccgataacaaaaaacaaaataattcccgtaataacatcggaagcattttcattcagattatactgtgtcgcaatctgaatcgctccctgctgcataaatacaagaagaaaagaaatcactgccattgcccatacattaaacttcgcaagccatgctacaatgatcgcggtaaatccgcgacctcccgccgtacttgtagaaatcgtatgagaagaaccacttacaagaataaatcctgcaagacctgcaattcctccggaaattccaacggtacggataatcactttacctacgttaatccctgcgtatcgtgcagtattctcactctctcctacaacagaaatctcatagccatgttttgtacgcttcatataaataaacatgaacaccgttaataataacacaattacaagattccatccatagtcaagtccaaaaagaggaggaagccatcctgcttttgtcggcgcattaataattccaaccgaatttgatccaaccggattctcccaatatacaatacaaaatgttacaacctgcatagcaacgtaatttaacatcagggtaaataacgtttcatttgtattccactttgccttaaaaaatgccggaataactccccagatagctccggcagcaaaactgcaaagaaacatcagtacaagtaacactcctgttggaagagcattccctgcatagatcatcattgccgcagaagcaacacatcccataagaatctgtccttctgcaccgatattccaaaacttcattttaaaagcaggtgttaccgcaactgccacacataacagagtcagtgcatctcttgctgttacccagaaacggcggcttgttcctacggcgccttctacaattccttcgtagacttctacaggattcatcttaataatcataaaaataaaacctgcgcatacaacaagtgaaaggaaaattgcagcaattcttaccagccatctctttccagatggcatatcctctcttttcgaaagatgtatcagtggttctttcactgtattatccattatttttcctccttatgggatgtcatcaacattccaacttcttcttttgttgtctttctggcatccacaattcctgttaccttaccatcacaaagtaccaggattctgtcgcagaattcaagaagcatgtctagatcctctgctacacatacaacggcaacgccccgttctttttgtttgtttaacagattatagatcatataagaagagttgatatcaagaccacgcaccggataggcaacaagaagaactgccggtgaagaagcaatttctcttcctacaagaatcttttgtacatttcccccggaaagtcttcttacaggataatcaatatccggggttacaacatctagatcttctttaatcttttctgccagctcttttggtgcttttaagctcgtaaagaaccctttcccttttctaaaagaacgaagaagcatatttcctgtcatacccatagatccgacaagtcccataccaagacggtcttctggaacaaaagaatgacggactcccagttcattaatctgtgctgcattatatttagccagatcaatatcctctccttccggcgagtggaaaacaacacttccggaagaaagcttcgtaagtccggcaatcgcctctaataattctttttgtccacttccggaaattcctgccacgccaagtacttctccaccaaatgcttcaaatgaaacattctctaatgtatgcagtccgtcctcattcgtacaggtaatagtatcgattgtaagacgctttttaagatcatgcggcatcggacggttaatatcaagggaaatcttttctccaaccatcatctctgtgagagattctacagtcgcctctgaagtttgtaatgtcccaatatactttcctttccgtaaaatcgaaacacgatcagacaattctaaaacttcatttagtttatgtgtaataatgataattgccctgccatcatctctcatattgcgaagcacatcaaacagtttatctacttcttgtggcgtaagtactgctgtcggctcatcaagaattaaaatattggcacctcgatataacatcttaacaatctctactgtctgtttctgagaaacggacatggtatataccttctgtgccggatcaagatcaaaaccatacttatcaacaagctcctgaatatctttatgcactttcttcatgtcaagaaccgcgcttccctttaatcccaaaataatattttccgctgcggtcataacatcgatcaatttaaaatgctgatggatcattccgattccaagatcaaaagaatcctttggagaacgaatcgatacttcttttccatctacaaatatatgtccctcatctggaaaataaattccggaaatcatattcatcaaggtggtcttcccacttccgttttcgccaagcaacgaaagaatctctccccttttcacctgaagattaattccatcatttgcgacaatcttgccaaatcgttttgttatattttttaattctatggcatatgtctgttccaactttttttcctccattatccgactattcaagtcgagcagctgtcactcaccacctgaaagaggtgggagtcttctcgactgagataaaatattgttttttacataatcaggcagagccactgatatggcggctctgccttagtaaactgactgtttaattactttgtaatggagtcaattccatcaataataaatgtgaatgccggtgcagaagtcattccacctgccacgtcggattcatggaaatatccatctttgatataactctgaagctttgtagcatcctcatcaccggactctacaagttcttcaagggtcttaccaccgacggtaaacttagaagtatcaaatacatgaattgttccgtcttcaattcccttctgtgcttcttctactttttcttttgttcctttagcaacggtcttatcattcagttctgtaattgcatctgctccatcttttacaccttttgaccaatctgtatcaatggctgttccctcaattacagactgtacagcatatgtgtaatacggaccccagttgattgttgcagaagtaagagctgcatccggagctgttggaatcatatcgatattataacctacacaaggaaccttctttgcttcacatgctgtaggagctcctgttgtatcggcatgttggctgattaatacacaaccatccgcgatcaactgctccgcacattctttttcaagatcaaaggatgcccagctgtttgtatattttacttccatcgtagcagaatcacaaacagacttcacaccaagatagaaagaggtaaatccactgataacttcggcatatgggaaagcccctacataaccgatcttacatttatcttttgtaacttcacctttttgaatcatctcatttaacttcatacccgcaacaacaccggataaataacgagattcatatacgttcgtgaagaagttgtgcatattagcaagcccactgctctttgcctgatatcctgttgcatgacagaactgtacatccggataatctgcagccgcctgaagaatataactttcatgaccaaaactgtttgcaataataatgttgcatccctgttctgccaggtctaccgcagcatcataacaaccttcatcttctttgatattggtcttgatcactacctgatcatctgtaagaccaagattcttcttcatctcttctactgcttttaaatgtgcttcggtgtatccttcattctcatcaccgatcataatacatcccactttcacatcggatgctgctacaggttttcctgctgctgaacttccctttgcggatgtagaaccttctgatccactgtttgaagaaccgcaagcacagagtgatgctgtcataacagcggcaagaataaatgccagtaattttttcattgtctttcctcctctatatttgcttctgaaaaaatacacttctatattagactacatcttttcataagtaaagtcgaaatagagagaaaataagattttttcttattaatccttcaattttttaattttgtaatataatctctcaatttttcatgatttctaagatgactctcctaaaattctatctgtagcatttcataaatcactttccataacttccggaattcccaagttcttcttcaatccgcataagctgattatattttgcagttcgttctgccctgcatggagcgcctgttttgatctgccctgcatttaccgccactgccagatccgcaatcgttgtatcttctgtatccccactccgatgagatataatcgtgcgataaccagctttttgtgccagtaagatcgcatcaagcgtttcagataaggtaccgatctggttcggttttattaaaatcgcatttgcgattcccttctcaattccttctgacaaccgttttacatttgttacaaaaagatcatctccaacaagctgtaccttttctccaaggcgataggtaaggactttccaccctgcataatcttcctcgctcaatccatcctcaatagaaatcaaagggaatttttctacaagttcttcataatattgcaccatttcttctgcatttctgtaaatttccttttctttcatctgactttcccctggaaaataataccgtctggtattttcatcatacaattcggaggctgccgcatccattgcaaaaaagatatccactccaggctcatacccggcaagctgcgttgcttcctgcaataatgccagcgcttcttccgcagaatttaaattcggagcaaaaccaccttcatcgcccacaccggttgcatactctttttcagctaacgttttctttaactgttgataaatctctgcacacatctggattccttccgataaagactctgcaccaactggcatgatcataaattcttgaaagtcaattgaatttttcgcatgacaccccccattaatgacattcatcataggaactggcagtactttgccattcacaccgccaacataacggtaaagaggaattcccagaccttcggccgctgctctggccactgcaagagaaacgcccaaaatagcatttgcaccgtatttgcttttattttctgtaccgtccgcttcttttaaaatatggtcgatttctctttgttctaaagcattgcagccgcataaacgatcactgattcttgtgtttacatttgtaactgccctctctactccttttcctccaaatcgtttttcctcatctcgaagctccaccgcctcaaaacgacctgtagaagctccagaaggcacaattgctttcccgcttgcaccacttcctaatcttaccgttacttctaccgttggattccccctggaatcaagcacttctaaaccatgtacttcttcaatactaaaatcttttttatttaaaccttttttcataaaaaaattcccccttactgaattgtgaaaataatttctttctcatatactctcttaatctttctgtgtctgattttacgaaagattccaaaagtatattttcttcagtatgggagaaatttcattttttatacataatttttatatgtacttacttatattgttcaatatatgcttttaccaccgctacaagcttctcatagctcatacttgcagtatttaggcaaaagtcatagtttcttgaatcattccagtctttcccggtatgatatctgtaataatctgaacgatatttatccgttttttcaattttgcggataatctctttttctgtaccgccattctgtgtctttacgcgggcaatacagtcttcctttggtgcataaaagaataaacgaactacatccggattatcctttaaaataaaatccgcacatcttccgataattacgcaggattcttctgccgcaacttctttgataatcttcgcctgataattaaaaaggttgtcatctgatacgaaatcatcactttctggagggaatatctcccccttgtaaatctttttactgatgccaaataaaggcagactcttcaccttctcatctacttctccaaacaaagcttcattaataccactctgttcagaagccatacgaagcaattctctgtcatagcaatgaataccaagttccttggccaaaagtttgcctaaagttcttccaccacttccataacttcttgcaatcgtaattactgtatgttccattgtaacacctactctcccaaatatgcctttttaatagactcattattcataagttctttcgcatcaccgctaagagcaatcttacctgtctccaaaacatacgctctgtcagcaattgccagtgccttcttcgcattctgttctacaagaagtactgtcgttccggcggcagaaacctgctgaataatcttaaaaatctcatctacaaaaatcggtgacagccccatagaaggctcatccatcagaatgattcttggtttagacattaacgcacgtcccatcgctaacatctgctgttctccaccgcttaatgtacctgcagactgatttcttctctcttttaatcgcggaaaactttcatataccatctctaaagactgtgcgatctcattcttatcttttcttgtatatgcaccaagcttcaagttctcatacacagaaagattcgcaaatacacgtcttccttccggtacatgtgccattcccattgttacgatcttatgtcccggtacctttgtaatatcctgtccttcaaacagaatatgtcccttctttgcctgaagcataccggtgattgtctgaagagttgttgtcttaccagcaccattcgcaccgataagagcgataacttctccctgatttacctcaaaggaaatccccttgatggcctgaatcatcccataatatacttcaagatcctttacttcaagcattgccataaagttctttcctcctattctccaagataagccttaataacttccggatcatttaaaacatcttttgtctttccctgtgccagtacctgaccaaagtttaatacggtaagttcttcacatattcctgatacaagcttcatatcatgttcgatcaataatactgtcatatcaaaattatcacgaacgaaacgaatcgtatccataagttctattgtttcattcgggttcattccggcagccggctcatctaataaaagaagctttggatttgttgcaagcgctctggcaatctctaacttacgctgctctccatatggaagattcgatgcaagaaagtctgccttaccatcaagctcaaatactttcagaagttccattgccttttcattcatctctttttccatcttatggtactttggtaaacgtaaaatgcctgtcaaagcggaatacttatactgattatgcagtccaatctttacattgtcaagaacagactgctgggaaaacagacgaatattctggaaagttcttgcaatacctgccttattaatctcaattgtcttctttccaacaagatcttcaccatctaacttgataataccgtctgtcggtttatatacaccggtcagcatattaaagacagttgtctttcctgcaccatttggtccaatcagaccgtaaagctgtcctttctttatctcaacctcaaatcggtctaccgcacgaagaccaccaaaagagatacccagattctttacttcaagtaatgccataattactgtacctcctctgcttttgcttttttgccaaacattctcttaatggaatacttttctctccactcgattgcttttggtgcccagttaaagagcatcatgataattaatacaatcgcataaatcaacatacggtaatcggcaagtccacgaagaacttctggaagcattgtaagaagaactgccgcgataatagatccacgaaaacttcccatgccacctaaaacaacgaatacaagaatcatgatggacatattataaccgaagtttgcaggaagtgctgttaacgtagacagattatgtgcataaagtacaccacccgcaccggcaatcgctgctgaaattgtaaatgccattaatttatactttgtaatattgatacctacagattccgctgcgatacgattatcacgaatcgccatgatcgcacgtcctgttcttgagtttacaaggttaaaacaaacaaataaactaattaaaataataataataccaacaacaaaggtcgactgatttggcgttccgacaataccttttgctccatcaataatcttttgtccatctgcctccatatttaaagaggcactgtcctttatggagaaatgaaatcctttactgtcttttccaagatacataacgttaattacattcttgataatctcaccaaatgccagcgttacgattgcaaggtaatcgcctctaagacgaagaaccggaataccaataagccatccaaaaattgctgcaacaactgtaccgataagaatcgccagaataaaacgaagtgtttcattcattcctgtcgccatcatacattttgaaaatacagcacttgaaaatgctccaacacacataaatcctgcatgaccaagactcagctcaccaagatatcctacacaaagatttaatccgatcgctacgatagaataaatgcaaagcggaacaagaagtccctgcatcagactcgacatcattccggtagataccataacctctacaataataaatactgcgattaccatagcataggtaatcaacatactttttgtctgtttgttcatactttttaaatttgcttttttcatttcttatgccacctacactttctcctgtacctgtttgccaagaagtcccgtaggctttactaaaagtacgatgatcaatacggcaaatacgattgcatcagataactgtg

SEQ ID NO: 402 - DNA, 60720 bp, Eubacterium hallii
tactaaataaacaacaggctgaatagcaaagtatgccattcagcccattacattatatttttgtattctataaacctatgattttatcatcaatctgagaggtttacacagaataatttacactacctaacaattataccagcttatcttgcacaaatactattaacaaaaataatatagcagccaaagtctccgataccttttcgaacagccttatctgctttctcgtctcctaattgctctctccactgtacttcttttccctgcatctttaaatatcttgcaatcatgttaaaatgaagaataacgttatcatgacaggctgtcctgaaagaatctttatccattttctcttctattgagaatgtatgccactttgcacggagatccgcatagggaaaaatagcattacacaaatcatcatacaattccaatgcatcttcatcttctccgatttccagcatcatattttcgtgcatctttctcatttgttcaattgttatcgccccaggttcttttacatagctatcataagtattgatcattttgttattctcctttttattcataatgtactctctaaaatgaactatcaaatttattagtcaaacatataccagaaggggatgctacatctctatctaaaggaattctctatgttgttttctgtattttaacagaccaacaaacgagaagttctcagtctgttttacagttcataataatataaacagatgttttgatatgttccatccttcatacggaaacctttcggtacaattccaatctgtacaaaacccagtcgttcatacaaatggcgggcatgaatattgttttccaccacagcattaaactgcaaaattccaaagccatactgttttgcctgtacaagacaatcatctactaatttttcaccaatatgctcgccgcggtaatcggtatcaacagcataactcgcatttgcaatatgcccacagcggccaatattgtttggatgcagaatataaagccccacaatttttccattgttgtctgcaacgccgcaatatgtttgtgccgcaaaaaagtctgcacctgttgtatcgttcaaaaaatcttcttgtggaaaagcttcgccatcttctacgaccttattccagatggagatcattgcaggaatatctttttctctatactttctaatttccataatctatcctctaaattctaatttcatgacatcatttctaatactgattctaccgtattttttaatctcagtccatctttttatatccaagcgatagaaaaacttttctgtctctgctccgccggaagatatttcattgtaatactttttaatacatttcttgttttacacaaattatagtatgtaataatattataataaattattttattatttgaagatcaatataattatttttccaagaaaatttctaaagtatatccttgtaaaaaagaaaagcaccgaaaacccactgtttaagcgaattttcgatgcttctaatacagaatcgaggcgacgggactcgaacccacggcctctgcgtcccgaacgcagcgctctaccaaactgagccacgcctcgttttcacaacgattataatatcaaaattaacgagacatgtcaagtttttacgagaacaaattctgtgaactaccctcttctaaatccagtgggttaaggcagtcttatttcaaatacatttaccagcgagactttctttttaaatattatccttttttcttttttggaaatataggataataaaaatcatggagagtgaaagtaaacctactaaaagatacatcgcaatcgtattgttatctcctgttttcgctcctggtgttccctgatctttattttttttcataggtttgttattttcttttaaattgactttatcataatcgttcatttttggtgtaatcggaatatcacttccgtccttgttctttccttctaaagaaacttcatttttcaaaaattttattgatggaatatctttctttacctttgctgtgtaaattaattccacagaatcccccgcttctatcttatctaaaaagacttttttgttttttatttcttttactttaaccgtattgctcttcttacttcgtatactgcttcctactttatgagcaaaccctttcatttgtacatattttttcaactcttttgacggttcttcttttattgttatatttcttgcacttgctgttccactattcgatacagtaattgtaaacttaatttcttctccggctttatatgttccatattttctttttcctgtataccttccattctctaaaacaatattctttgttttgtctgattttttcgcaacgacaatgtctggcactcctattcctacggtatcgttatctgtcatttccggagtttcgattatatagattttttctctctttccattgtcattcactgtttcatattgtgcggtgatatggatagtattattcaaatgtgtgcctgcctgcactcctgtctgtacctctgctttcatgtgcagtactacactgtctgctgcttttaatttatctaaatgtactatgtattttccttcttcatcttctttttctggcatccgttctacacaaactgtatttccctgctttgttgtaatctggcctgaaacaattgtaacagtccctggttttataatttcctgtaatgatttatccatgaaatcttctactaccaaatcatacagatccgctgttccttcattacttatatttactgtataatctatcacatctccgtattcataaatgccttctttttttacgccttcgtaacgcccttttactaaagtgactccttgtgttttatctgcaagcttagaaactttagcaactggagtacctggaatattgatagtatcttcatctttcattaattccgtaactggaatttctgtatactttttactttcttcttttaactcttctattgccagcttttgaatctcttcataggctttctcaattgctttcctggcttcttctgccatcggatctttctttgtatcttcctccgcttcgtctttcttttcatcgtctttattattgtcattcttatcttcttcgtttttatcttcttcgtttttatcttcttcttttttattctcttccttatcctccggattattcgtatcttcttttttatgttcatccgccttgctccagcatgcatataaatctacatctttttccggcattacataccactgtgttggaagatattctgcttctccggtctttttcgtactccagcctgtgaatttgtatccgccacatgaaaaataatttttatttatctttatttttgctcctgcatatgctggtgtttctgaatcgatttctttttgttctgctttcgtttcttctgcttctgatggataatttgagtggtacactaatttatattgttttacatcttttgaccactgtgcatataatacagtgttttcttttaaagtaaacttttcagatggtgcataacgctttccgcttccatctgtctttgtattccatcctacaaacttctttccattattgtggaatgaatttccgtctattagcacttctttttcttcatcttcaccatcatcagaaaaacattctgcatctgtgtatttttcttcttctttcgtattagaagaatagatgagtttcttctgctcaatctttttccactgtgcatataaagaaatattctttgatgggataacgaaggtatctcccgaattatattgctttccacttccatctgcttttgtattccatccagcgaaaagataatctgcatagaaaaatctgttattctgcaataaaatgctatttcctgcctctttcggagtttgtggatctacagaaaatgctgttgtattattatttgcgcgataaaaaacatgatacttttcaatgtcttctgcattatcctgaagtttttcccactgtgcatataaaattatgtctgtattgatttctttttcttctcctggtttataagcatccccttttccatccggtcttgtgttccattgagtaaacatgtaacaatccctgccgacttcgtagcgataggcgtttccatcaatttggactgtggttcctgcttcacatggagtttctgcatctgttcttctctttccgcttccattattggcatcatactgtaaatgatataccggtcgtttctcccactgtgcatacagattcaggtttctttctggcattgccactacctcttccggagtatattgttttccttttccgtcttttctggtattccatcctttgaaagtaaaacctggataagaaaaacgattttcatttaccgttaataaagtacctgccagtctagaattctcttcatctgcttctatctgttcttttttattatttgaatgataaatcagattataaactggatattttctctgattattataatcttgacttgcttcctcttctttttcatccggatttttcttccactgtgcatacaacttcacatcatttcccggcatattatatactgtatctggattccatctttctccacttccatccggattggtattccattctgtaaaataatgtccttcatataaaaaggcattgccgtttacagtgatcttgtttccttccctgcatggagtttcactgtcagtttctatttcgccggaaccattgttcgcatcatactgtaatttccatcttcttttctctttttccatcttttcttcgtactctttgtatgcttcttcgttgccctttttataacgagctgtaagttctactatatttttcagttcaaatagatttccaacatctagacggacttttccttttaagaatacatcaacggcatctcctgctgccaggaaatccatccataatctttgtggttcttctagactagttcgaacttttcttccattctgtgatgtatatgtactttcttcaaaagatacgctttctttttctaaggctttttccagctcctcgctaagtgtatcctgcaaatacaaatcatacaaattagatgttccattatttgttactgtaatcttataggtaacagtcgttccgttttcatatactcctgaaatttttgcttctgcattatatcttcctgcttctaatactgctccttttgttctgtcagcaagtttagccgctcttccttccggtacacccggtatctctattttatcttcatcttctttttctggtacttccacatctttgtttccatcaaaataccatccattaatacatactttattagaaacattataaatgttggctatgcccggcagcaaatcagcttcataatataggacaatataatcatctgcccacagtcggtctgttccatctccatcttctcctgtactgcataaaaggagcgtatctttatctactactttagctgtgattttcttcttatgagctgtagtaagaatatacaagccttcctctgttgtctgcgtttcatcaaaaataaacttggcactttctaaatttacgattgcttttaattcatcactcatagcatctttcaccataatattctttaatgccgcttctccattgttttttactataacagaaaatctgactttgtcccttgcaccataaattcctggtacctttattcctgatgtaatttctccattttcaattgtgattcctgtcgttttatctgctgtctttatgacatcttctcccggacttcctggaacattgataaaatcccaatctgtgacaaggctattcccttctccgtctaccagcttatctgttgaaacatctcttaaatgaatatctcctttttcttctgttccattatctgcatactttgcttctgcatacacatcattacgaagtttccatgcatcttttgcatcttcctttaatcggacctttacatgaatgtccacactgtcattcacatttaaatgctgcagtactagcaccagatcggattctaaggataaatatgctgctactttatccccttctcttgttttcaaaattcctgaattcggtacaacaaatgctgctgtttccatatcggcatatttagaaagtgtctgttctgaaaattctccttttctatccatatcatctgtaagccgaatctgataaagaggaacatttcctgtattcgttactcggatagtgtaatctaccatttcccctgctttatatattcctgcttgtttttcctctatataacggccggtcttttcatcaaataacactgattttccttcttcattcgttgtcttatctgcaatctttgcaacggaaaaagcagggcgcatcaaaacatttgatgcatcaagcatatagattacaaatggattattctgctcgattccataagtaagttctacttcataaatgccatctcccttaatatgatctaaggctcctgttgtttcttctacgacatactttccaatgtacagctcacttccttcagtgcttgctccctttccatcttttcctgtaacaattctgtctgcaacacttcctttagaaataagtggttccgcctctttcaacggttttttatcctcctgtaaatcccaaggcgcataaatatcttctgctgcttttactgtaaatacagcaccttctacgctctgattctcgtcatcttttttcgtaatcgttaactttgctttctgtaatggattacgataaatcaaaactcccgtctgtctctttcccgtaactgtactttcaaaaataatattacttccatcttctttactgttctcagacagttcaaaagtccactcctgtcctgttaagatacatccctttggcgctttcttttctgtaatcttatattttcccagattatccagcgtatttttaaatgtctctttattctgataaaccggatgtccttcttcatctttcccttctgttaatacaaataattcacgataggtacctgttgcagctgaccactgggataatacaaattctgctccggataaatatgctccggtatccgtactttttttataaacctttacaatattttttgccgcctcataattcttattgattaactgtttattctctgtaatgcttgttgtattatcaaatagctcctctgtttttaatgtatttatctcataataccagttcgtattcactgaaggattccagatatttttatatttttctggaatagaaatctcttttatatagtatggtccattaccaaacggttctttgtaaaaagtgtaggatggcatggatgtaaacaatgcaacgccgttatcatccgttgttgctgtatacaacggttccttggcagaattcttatctgaacctccaaataatccaaatacaacgccttttactggtttacctgactcctcatctagttttttaacacatagcttcattgcaattttagaagctacatcattagattttctctctacagtactccctttatcatttttaacatataaagtaccgttattacttactgcaacactgcccttgcagcttcctgcctctggtactttttgcttaagtgtctcattctcctgataccactctgcgattgaacgatgaatcgcatgcagctcctggtctgactttacttccacttctatatgtatataataggttctcccataaaaagctgcctttccaagcctttcatccactgcttttacctgaaccgttgtgctgtgatctgcctcctctttctttataatatgaaaatatgaggtcatatcactataattaatccccattgtctggaaattattacttactgcctcatctgcatagactttcacagattttacatttaaaagcgcatccactctgtcttcaatctggaacatcgtatactgtgcattcttcacattagaaggtgttggcgcaacggctgagagtacataggtaaacacctgatttctctcagacagacctgcaaatcggcttcctttctctgagttctgtccatttacattccctatataaacagacttcattacttcctctggtaatggagcaattccaacatccgctctgactcctaaaaagcctgtactgttagaccaatagtatgaattagagttttcgagtgtactttctgccggaattccatatcctccttttacactgtaagctgcatcaccgccagtatctttctgatcacattttgctactgtccagcggcagttcacactactgcccgaaaaaattcccattgctgttgtatgttcattattactatttaaatctgtacttattcgggaagatacatatcccttagaacctgaaatcaaaccatttttattatattgtagttttgattgtgatgtattaaacatgactatcttttcaaaaccattcccaaagtctactccttgctgtgcatcaatatcacaaaactgaatcatgccctttatgccggctactgctgttgttgttccactataatagaattccagacgagtctgtagatgatctgttcccataactgtgattccgattttagactttccaaatcctacataaggtgcttttaaatctttattcgctaactgctttctgacagctgttccgggaaatttatatcctgtaacggtcatcttcatatctatggcatatgttctcttagaaccataatcataccaggttcctacattggtatagattgcatatggattctcactacatttatcaagattaaatactttagacacaatacgcccatcttttaccgcatcatatacatcaccaaattgcttctcaggtcctttctttactgttgcaaaagaaactcccccaccattgcctccacctacagtaaccgtagttttacttgtaaaacgaggggtaaaattgtattgcttcccattagaataactttcataaatatatttagaagcagcattagcatccgcaactactgcaagattacctccagaagctgcatttaccttcttactgtttttttgtaacagaaaataatgacttgtaatatccggcatagtcaccgaatgattcgtatctgggcgcacagttctaagcgtatatccacttactctttctaattgctccctctcttcttccttcttcgattgctgactttctgtcgtctcctgtacttgttcgggttccttcgcatcttttattgaactatcttcagcgccttctttcttctctgtccggctttctgctttcttctctgtcatctcctgttcttctggtatcacctcattcttttcttcttgtgttcctacggtattatttataacatcctccttatctttctcttctttcttatcttcttttttgtcttctttcttgtcttcttttttatcttctttcttatcttctttatccttatagtccgatgaatctttctcctgatttccttcttcctgactcttctcttcctttattatcgtactttcttcctggcttttcatctggtagaaatcgttaactcttactgtacctgtaccggcagcctgactaatctgtatattcgtaaataaaatagctgtcaccagtataaataagagtatctgctttaacactcttcgcacgttctgacctcctgaaaatcatatattcctatctataaaaatatctttatatcatctatccccctttcttatctaggaattttttccattttattttatcatcctttttatttcatgtcaatattttactttaatgttttattttaacttattcggagatgagggaggggatagatgagagctaaaacttgaataatgcatttcaaaaaataatactgttttctatcttttctaatttcctataaatatcttataaataaaaaaggagcaggtaaaatgtcaaactgcatttttacctgctccattattactatatctgcaatgctatgcttttatcgatcgatcatactgattgattcaatagctacgatacctccacgaactacttccacatggtcaaacttccttgttaaaagtgcgataaggtcattatttcttccttctgtattgacactctcaagtaatacactattaatgccataatcaattgcttttgctccaaatacctgtgatatacggaaaatctcacctttttcaaattcagaacattcatgtatctttacaaaaagaatctccttcatatgagtcggtgcatcagtaatatcatttaacttaattacttctacacaacggtttaactgcttcttaatctgttcaaaagttgcatcatccgaagacagaccgattgtcattcttgatacagtagggtcttctgtaacgcctacagtaatactggaaatgttataggactttcctgacatcattcctgagatacgtgccaaaacaccaattctattctccacatacagagatacccatctttttttcttttctgtatttatctctctcatctctgtatcctcctataacataatgtcttcaaaacttgctccacctttgatcatcggcataaccaattcatccggagctaccatacattctacaataaccggcttcttattcttttccgcataatctctcgcttcaagaatcgtatctcttaactgctcatcctctgtgacaaaatatccttttgtaccgtaagcctctgccatcttcacaaaatcagggacatattccgggcatacccagcctggtgtaccacacttacccttacatgacttatgataacgcagacaggtaatcgtataacgctttttaaagaacaattcctgcatctgacgaaccattccaagtcgattattattaaatactatattgactaacggaagttcctgacatactgctgttgcaagctcctgcatattcatctggaatccgccgtctccgctgattgatacgattgacttttcaggacatccaatctgtgcacctacggcggaaggaaggccaaatcccatcgtgccgagtcctccgctttgtaccagcctatgtgtagcatctaacttcagatactgagatgcccacatctgatgctgtcctacgtcactggtaaataccgtatctctatctgcatatacttcattcaatgtctcaataatgcgctgtggattcactccatctttcacttccatctgaagtggatattctttgtcccagccctgtatctcatcaagccactctttatgctccataggctctgtatgttctaatatctttaaaatagctgccttcgcatcagcaacaataggaatatctacggttacatttcttgaaattgctgctgattcaatatcaatatgtacaatcttcgcattcggtgcaaacttcttaatctcacctgttactcgatcattaaaacgacatccgatcgagaacatcagatcacactcatctgctgtcttattcgccgcataagagccatgcattccgatattaccgatatacaatggatgttctgtagatatcgcacctcttcccatgaccgttgtaattaccggtgcatctatcttttccgcaagctttgtcatctcctgctgtgcatgtgcaagattcacacctccaccaattaaaaacattggctttttcgcctcttctaacagcgttattgcctttttaagctgtcctacatgtacccctttattcggcttatatccgcggatattcacttcggtcggataagaggtcgaaccaagttctgccataacgtctgttggcaggtctacgagaaccggtcccggctttccagatcttgcaatgtaaaaagcttctttaatgcgctgtgccagcatctctctgtcacgaaccataataacaaacttcgcgatatttcttgtcacaccaataatatctacttcctgaaatgcatcattacctattaaatgttctggaacctgtcctgtaaaacatactaatggaatactatcataattagctgtagcaattccggttaccagattcgttgcacccggaccactggttaccagacatacgccaaccttgccggtcgctctggcataaccatctgctgcatgaatcagaccctgctcatgtcttggcaatacaagatcaataccgtgacaatcatggagtgcgtctagaagattgacgaccatgccacctggatatgcgaaaatcgtatccacgccttcttttttcattgcggttacaaacaggtcatttcccgaaaccttcattcttacttcactccttcttttctcattcattttcattattattaattgtctttggttataacttttagaaaatttacattcaaaagttaataatcttttttatgatataccaaatactttccttttgtcaatagtatgtctatgtatacaattctgtctaggaaaccagatgcaaaacaatacttactgtctgttatagttgatcaggcagcctttgagaatgatttctctctcatcgtctgttaattctcccattttcaatacaaatggaacaagacttccatcttttacaacatacgcttcaaattcagatgcttttgcctctactgcttttcttacatctggaaggaaaatgtaatctccattcgtaaatggtaagtcacctttttcaatgaggaatgggagcataccccagttgataagattggaacgataacgctttgttgcatattcgtttgcaatgttagcccatcctcctaatactttctggcaggatgccgcctgttctctggcagaaccatctcctggttttaccgcaaagatcgtacttccgattccgatattttcattagtaatctctgcatactttgtatggatcgcatcgataaccggtgctaattctgtcagtgcctctgcaggattcttatctgcttctactgcttcctgcgctgctcttacttcttttgcacgtcctacatacgcaggatcttttcttgaaagagtaaattctgcaagtccaagtggattagaacggtaagaagacgtttctccagaaggaatcaattcatctgttgttgttaccggatcatgaatctctgaaacaactttaaggatcatattctctggaagggcgctcatctttggccagtctttaatatttggtccaaacttaatctctacagaaggatctgcaacccctttactgtcaaagacacgatttgcataaatgctgctgtcaaagtgatactttcttccgctatattctacatcaagatctgttgcaggtgtaagatatcccttatttgctgctgttgctgcaatcgaacgggcatccattaaagctacagaagcaatctgtccattctgtaatttagaaccttctctgttcgggaagtttcttgtagaatgacgaatacttaaactgttgtttgaaggagtatctcctgcaccaaaacatggaccacagaaagcagtctttacgattgcaccactttccataagtgttgctgccgcgccattctttaccagttccatataaataggggtacttgccggataaacgcttaaagtaaattcatcagctccaatggatttccctttgatgatatctgctgctgcacataagttttcaaatccaccacctgcgcagcctgcgatgattccctgttctacgtaaagctttccgttatgtactttatctgtaagtttaaaatctacctgtccatctaaacttacaagtgccttttgctcgcaatcatgaagaacatccataagatttctattcatgtcttcgatcgtatatgtgttacttgggtggaacggcattgcgatcattggacgaatcttacttaaatcaatcttaaccattccgtcatagtaagcaactggtgcaggattgagttctttataatcaccagctctgccatgaatatcataaaaatctttaattacatcatctgttttccaaatagaagaaagacaggttgtctctgttgtcattacgtcaactccgatacggaaatccgcacttaacttctccacaccaggaccaacaaactccatgactttattattcacataaccgttctggaatacagctccaataatagcaagcgccacatcctgtggtccgacaccctttattggctctcctgtcatatagattccgataacgcctggcatattgatatcatatgtctgatttaaaagctgctttacaagttcaggtccaccttcacccatcgccattgttccaagggctccgtaacgtgtatgggaatccgatccaagaatcatcgctccgccacaggcaagcatctctcttgcaaactgatggataactgcctgatgaggaggtacataaattccaccatactttttcgcacaggtaagtccaaacatatgatcatcttcattgattgttccacctactgcacataaactattatgacagtttgtaagaacatatggcatcggaaacttctctaaacctgaagcacgagctgtctggataattcctacataagtaatatcatgagaagtcagcttatcaaaacgaatctttaacttatccatattatcggaagtattatgtgcttctaaaataccatatgcaatcgttccctttgctgcttcttctttagaaggtacattcggaccaattactgcctgaagctgcgctgctgcctccggagtatcttctataatctctgttccgtttacaagatacgctcctgtttttaacagttccatcattctatcctgctattaaagtctttgctcaaatagcttttcctttcctaaattcaaaaatacctcgacattcctgctgcaagatgcacatcatgcaacacatcctatcttcttctgcgcatctaaagcaatccgccagaggatatatcaataaataaactacgttgatacggatatctgacaagttccgcatcactgcatacgttaattatattagcataaacgcaggataaaattcaataatacttaagtgttattaattttctcaagacgctttgcatatctgcgaaaaacttcttgtgctatcacttttccgatcatgaatactgcaataaagagacttcccacttccagaatccgccgcatattcccttcttgatgtatatacagcgatattacaactgacaaacacataaatatacacaagctgtctaagatctgttcttctacttttttcaatgtggatgaaaatttttcctgtaaggtagtgttttctactccgcaagcttttaattgggaatgttcaatttgtacatcttcttgtaactcttcttgtaggtctcctgattgtaagtcccttaatttcgaatcatcccattgcgaatcttcttgtgaactttccatggtatgtatcacgattgctcttcctgtattttccgtaaaaacctgtcctgattgatattccttatatggtttcgttaaactaatcaccgagctgcttatctgttctcccttttttaatcggacaatatcccctcttagtacatacttccatggtattctctgaaaaacaccctctctgagtacaattactttctttgctttcgcttccttctgtttaaaaaatatttttctactccagaatgctgtccttatatttataataatgagaaaaaataaagtaaagaataacaaaagttgtattttctttggaaaatagaatatccggcttatcccacacagataaagaaagaaaaagaaaaacggattctggcattctttttttaaataaataagccaaatccgttttttctcttttgcaatattatacgtaccacagatatgccgcctgcgccttacttctgcaagactaagaccagactgcacatctgtcccgtattttaattctaaatattcacttgttctattctctgcttctttatacttcctgtccatattcatagtaaaacctccgcttcctaaaaaattctaataatacatcttttaaaaaggcatctataatgttttactaaatatatgtaacctatgaaaagaaatatacctttcactgctttcttttcgatttaaagcaattcctctactctttttcaagaatctggccggtacggtatgcgtgaagaagtttttcaagatcgctgatctgctcttttaactggcggccggtttcggtatctcctaccttctctctttgtgcggaaatctcacgaataaccgtatcagaatgtacatcgatttctttttcgatcacatcttctgttgaagtgaatgtctcatgagaaaccagacgaagtcctctggaattatagattaatgtatagcctgcaataccggttgttccacgatatgcctttgaaaagcctccatcgataatcatgacctttccattacacttaaccggggattctccttcttttacatgaacaggcatatgaccattgataatgtgtcctttttctacgtccacgttaaactctttgagaatattgttcactacctcttccttctcgatcagtcgataataatggtcttttctttcaatctgtacttctttatctgcgataaagtagcgttcaaatgttgccattttttccttaccatataccggagaattctcattagaccagatataccacataatatccttaccatattcatgttcatctttattatcctgctcgtaatacccttttcttgcatagtattcaagcacatcataaagttcttttccagaatactgtttattaccaatctttactttacggaacttaccgttctcatcaaggggtacacatccatgataaagcagattagagttatagcaaagatacagacctcccttattaaacaagaaacgaatatgctcctgtaatttctcacagttcaggaaattcatgcaaaggcggttcatcagggattcttccgcttcggaaagctcatacgggttgttcggatctatcgtcgggaaggacttatcaagaagttcatacttctttccatcaattttgatcgttccttcttcataatcaatcttatcaagaagaagtcttctgtccatattaaactccggtcttcttttaataagctgtccttctaacttaaactggataatcgcaatcgctttatgcatcttcatattaagagatacttcctgcagattagaatcttcctgtgcatgcacacgaaaacattggcaaggatcattcgcataagtttctattgcaaaacttgcaagaggaacaagattgattccgtatccatcctctaatacactaaggttattatatcttgccgaaagacgaatgacattggcaatgcaggctttatttccggaagcggctcccatccatacaacatcatgattcccccactggaaatccacattactatgctgcatcagatgatccataataatatgcggtcctggtcctctgtcaaaaatatcaccgatcacatgcagtcttgtgacaactaacttctgaattacccctgcgattgcaacgataaattccttggcacgattcaaacggatgatcgtatcaaaaatctcattataatattcttccttttctacaacacgattattctcacttaaaagttcttcaagaatataggaaaaatctggtggaagactctttctaagcttcgatcttgtatacttggcagaactttccttacatacagcaatcaaacggtgtaacgataccttataccagtcctgaaagtcttcttctgacatctctaaacgcatccgttccactttctgctccggataataaatcaatgccgccagactcttcttatctctggcacataatgtattaccaaaaacatcttctatcttattacgaatcgctcctgagcctgtccttaatatatgtaaaaactgctcatactcaccatgtacatcagaaacaaaatgctctgtctcttttggcagattcagaatcgcctgcagattaataatctctgtacatgcttttgcgacacttggatactgtgttgccaggctttgtaaaaacttcagattcaacttctccataattcctcccccttatggaatgatccatattcctatatttctccaaactgctgctttatgccttacctatgttactcatgtaaatcagtatcactatctttctgtttcatctttggttctatcttctgttttatctttctgttccctctccatggaagcaagctctttcttcttttgttcaagctgaagatatggacgcatctcaataagcggcgccccgttattacgaatataatcttccgtaatggttacacgaccaatattgtcatcctttggaatctcatacatgatatccagcataaacttctctatgattgcacgaagtgctctggcaccggtatctttttctaatgccttttctgcaattgcagtaagtgcaccatcttcaaactgtaaatcaacttcatctaatgccagaagtttctgatactgttttaatattgcattcttaggttctttaagaatatcaaccagcatttccttcgtcaaggcatttaatgtgaaaatgattggcaatcttccaataaattccggaatcattccaaactttctgatatcttctactgttacattctgtaaaagattcttttcgtgatcatatttatcttttaattccgcatggaatccaatagaagaatgctgcgtcattctttctttgataatatcttctaatcccgggaaggcacctccacagataaaaagaatatttcttgtattcataaccgccgttggaaccattgcatttttagaacttgctcctactggtacttctacctcactaccttctaaaagctttaacagaccctgctgtacagattctccacttacatcgcggcttgtcgtattctttttctttgcgatcttatcaatctcatcaatgaaaataatacctgtttctgctctttctacatcattatccgcattcgcaagcagctttgagagtacactctccacatcgtctccgatataacctgcctcggtaagagaagtggcatcacagattgccagaggtacatttaacagtctcgccagtgtttttaccagatgcgttttaccggaaccagttggtccgatcatcagcatattggacttatcaatctcgatttcatccatagtatttgtaattacacgtttataatggttatatactgccacagacatgactttttttgcatagtcctgtccaatcacatactcgtcaagctgcgctttgatctgatgcggagcaggaatattctttaatgtaagctttggttcttcttttttatttttcttctttttcttttttgctttctttgtttttggtttctgattggaaaggtttcctgataataactctccaaggttcatatcttttaagttattaaaatccatattggaaaggtcaaggaactgaataccattccctcctccaaacccagaattaaaagaatcaaaggacttctgcatacagtcagaacaaatgcttaagcctgttggcatatgaataagctttgctccctgcgattctgtacgatgacagacacaacaggaatccatcttctttttggaatcgtcatcctcatcatcgtcctcgtcatcttcttctacttcatagtcctcgtcgtcaattttttccgcattgtcatcttcaaccatatcctgctcttctttttcattgaaaataatttgtgtcagagcatcctctaataccagttcttcctggtttcttgtattttctttcttcatttctctatctctttctatctcccgtagttactgactctgccttctgctttttaagattgcctccccaagcagcatatcttctggtgtggtaatctttatattttcataacttccttttatcatgcggacaccacgaataccatatgtttccatcaccatgccatcatccgttacagaatcatctttggcctccatcattttccggtaggcttcttttatttcttttgtaataaaacactgtggggtctgaatctgccacatactgcttcttggtggtgtagaaaccgcatagcaattatcatctacgatcttgatcgtatcttttaccggcattcccataacacaggacttgtctttttttacctgctcaatacaaaattctattaattccggcgtaataaatgcccgggctccatcatggatcagaacataattctcttccgggataacacacaacgcttcatataccgaatgataccgttctgctcctccggtaacaatcttctttacttttttatatgaatatttatctaaaatattcttctgtgcgtattctacctcacctggagcgaccacaagaataacttcatcaacagaactgtcttcaaaagcttctaacgcataggtaataaccggtcgttctaaaagagtcatatactgcttttgtatatcagaatgcatacggcttccttttcccgctgctaagacaactgctgtcactttctctttcatgtactcccctcctgtactctcctatgtactttcggaatctttttgtgcttgattttgtgagaaaaactccgagagtacattcctttatactcctgaaatctttttgtacttaattatatgaaaaagattcctggtacagattcctaacgttctccaatctttaaatttggctttgcatttaaatcccagccatcccggatacctttcttatattcataatatcctgcaacaccgatcatcgctgcattatctgtacaaaagattggtgacggatggtaaaattctagtccgtttttgcggcaggcttcttccatctgcgcacgaagagaagagtttgacgctacccctcctgcgattgcaacttttttgattccaaggcgctttgccgctcccactgtatgttctgtaagcacatctgttaccgactgctggaaagaagctgccacatcggcacgattcacttcctcccctttcatctggcactggtttaaataattcagtactgctgattttaaaccactgaagctgaaatcatccggtgcatctgttattttagctcttggaaatgcgattgcctttttattgccttcctttgcaagcttatcaatcttcggtccgcccggatagccaagtccaattgctcttgctactttatcaaatgcttctccagccgcatcgtctctcgttcttccgataatctcatactctccgtaatcctttacgagaaccaggtgtgaatgtccgccggaagctaccatacataaaaacggcggctctaactctttatgttcaatatagttggcgctgatatggccttcgatatgatgcactccaactaatggtttcttcgtcgcatacgcaattgcttttgcttcggcaaccccgacaagaagtgcaccgacaagtcccggtccgtaagtaacagcgatggcatcaatatcctctaaagaaacacctgcttcttttaatgctgtttcaattacaatattaatcttctctatatgttttctggatgcaatttccggtactacgccgccaaataatgtatgcagtttgatctgcgtataaatggtatttgataaaacttctctcccgttttttacaacagccgccgctgtctcgtcacaggaagtctcgattgccagaatcagcacatcctttttattttcttccatgtttcttattcctcctcaaataacagagtcgtactttttccgtcctttcccgcactggtacgggcaaatatcttccgcacttcttcaagatatacttccggtcttaccagggaaggactgtagtgcgtaagccacatcttcttcacgtcagctttctttgccatttctgccgcttcataaaatgtcatatgtttatattctattgcttttgctttcttctccggctcaccatacattccttcacagataaacaaatccgcaccttttgcatggtctacaatagatgctgtcggtcttgtatctgtagtatacgtacatttaattccttttcgtgccggtccaaggaccagatcacttgtcagtattctgtctggcaattcaatggtttcccccttttgcaggcggttccagtattgcatttctacattgttctcttttgctttattgatatcaaacttacctgctctgtcaatctctatcgtatatccataacaggttacattgtgattcacacgaaatgccgtaatccggcatccagctacttcaataacttcttctttttcttttagctcacgaaaaacaatcggaaatggtaaatccggtgcaattaccctcagtgaattcactacacgctctaatcctcttggtcctaccattaaaagcggctctgttctctgtgcatttccaagcgttaaaagaagccccggcagtccactgatatgatctgcatgataatgcgtaaaacagatgacttcaatcggcttaaaactccagcctttttccttgattcccacctgtgttccttcaccacaatctattaaaatactgtttccattgtatctcgccatcaatgatgtcagtttgcggtatggcagcggcatcattccgccacaaccgagcaaacacaattccagcataatctccctcacttttctatagcagttccgtctgttcctccacctttaccggaatccgaaactgccctgtccatgtatcataacaggactcacacatatgaaatatatgtatttgtccatctttatttgaaaaatatccccattcttttttaatggaaatataatcttctcttttagtactgtctgttgtttctatcttttttccacaggaattacagtatacttcatacacttttttctccattctattttccatagcctccatctttttaaaactttttctaaatgattatcctacaacatttttcatatgaaagtttctcttacatatggaagttcctcttaattatacagaaaaatgtgctaaaaaacgttagtaactattggtatttttaagattgccataacataagtctagcatcttcctgtggatgttcataataattctttctttttccgacttctttaaatccggcatgtttatacaaagtaatcgccgctgcattagaatcccgcacttcaagatatatactataaattccctgctgtctcgcctcgtctaataactgctgcagcagctttctggcaattcctttcttcctgtaagcgggaagtacggcaacattggtgatatctgcttcatctagaactactttcatcccgatatagccgataacctctgtctcctcttttacaagaaaagaacaatatcccttagtatgaaacatttcctttaatgcatcaactgaccatggtaccgaaaaacattctttcatcagaatctctgtctgttcacagtctgtttctgccattggacaaattctcattcttctaacttctttcccttcgcttcaagttcgcgctccgcctgtgactttctcaaataaattggtgcatggtcactcgccggttctgccttgccttcgtcgtataatctcactgcacgaatggcaaccgctcctgctctttgacgacttaaatgtgccggtgcataaaaatgttctactgtacagaattcctcaataatatctttgtataccggaacaccatctcctagaaaaataacctgttttccaagcttttgtccaaacgcattacactttttaataatgtcttctaccggacctgcctcctgagctacaagttcttcaaattctgtccctcctgcaaaatgatagattcctgtataaacctgctttcttctggcatccatcatcggacagatcagcgcatctgtcccataaaaattacaggcgattccttctaatgtcggaacagaaatgattggtttattaagcgcaagacccaatccttttgcagtggcagaaccaattcggagacctgtgaaagaacccggacctgctgcaacagcaatggcgtccacttcagaaagttctgtctgtgtcattttcacaatctcatcaagcataggtaaaagtgtttgtgagtgtgtctttttgtaatttaatgtatactctgcaactaaggtttctccatctaaaatggcaacggaagccaccagtccagagctgtctaatgcaagaagtttcatctatctttgcacctcctcaacagtaatcagacgataatcaaatcctttcgacaaatctttatcgatatggatttccgtatattgttccgggagcagttcctcgatcagattcgcccactcgataaagcagacgccttctccctcaatatattcttcaaaaccaatttcgtacatttcttccgggtcactgatccggtatacatcaaaatgataaaacggaagtcttccctcatcatatacctgcaaaatagtaaaggtcgggctgctgaccggaccttttattccaagacccgcagcaaatccctgtgtaaatactgtctttcctactcctaaatctccataaaggcaatagacctgtcctactgctgccttttgcccacattgttttcccagtgcaaatgtatcctctgcgctgttactttctattctcatctttacctcttttttacctctttttcatctcttttatgaaattcatgatttcttcccgctgcgttcccattgccgcacttgggattaaaaatgcattgttctttccggtataaatcactgcaactgacttataaaaaattaattttgtaatctttttccattctacatcaattgcatcatctcctaattccagatgcagtccccactcatcaaacatatagtgaaattcttcattataaattggattcagctttttcgcattctttgcacgaagatttgttgtaaatggaatccatataagaataaataaagaacagatcaacggcatcgtaacacttccctgcttcttaattaacacagcaagaggccatgcaatcgctaatatcgttacgatgatcattaatggctgacgatacgtatgaccaaaaagaaatgccttcaattccttttctgttacattggcatcaactcggaaatgtctgccctgtggctccatcatttcttttttcgcaagttcttccggctgttcctgtatattctctgttacgattgtttcagaacgctcctcatcttctgggttttgactgtttttttctacaagctgatcttcatcctgtatactttcttcttctagaattccctccggtctgtcaagatcagcaaggttcatcttacttattttttcaaagtttttcacgcattactcctcctgcaatggtcacagcattacttgctgtggtcaatcttcatcgtaagctggattctctttttatttaaatccacactcataacctgcacatctacaatatctcctacgctgactacttcaagcggatgcttaatatagcgctctgtcatctgggaaatatgcacaagaccgtcctgatgtaccccaatatcaacaaatgctccaaagtcgatcacattacgtaccgttccttttaaaaccataccttcttttaagtctttcatttcaagaacatctgtccttaatacaggctttggcatctcacttcttggatctcttcccggcttctccagttcttctacaatatcatgcagtgtcatttctccaacgccaagactttccgctgttgctttttcatttgtaatctgagagtgaagagtactaagtccgccattacgaatactttcagaagtataacctaaatcctttaacaacttcgctgctgcctcataggattctggatgtacacttgtattatcaagcggttcctctcctcccggaatccgtaagaatcctgcacactgtaaaaatgcttttggtccaagttttggtacttttaaaagttcctttcttgtatggaatcgtccattttcttcacgataggctacgatattctttgctactgctttactgattccagaaacataagaaagtaatggaacagaagctgtattaagatcaacacctactttgtttacacagtcttctactacaccatttagcgcctcttctaaacgcttctggttcatatcatgctgatactggccaacaccgattgcctttggttcaatctttactagttctgctaacggatcttgtaatcttctggcaatagatgcggcacttctttgtcctacgtcaaattccggaaattcttctgtggcaagcttacttgcagaatatacagaagctccggcttcatttacgataacataagctaccttttccggaatctctttaatcagttcagtaattacctgttctgattcacgacaggcagtaccatttcctacgctgattacagaaacatgatacttcttgatcatctcatgcactgttttctttgcctgttctactttacactgtggtgcagttgggtaaacgacaacggtatctaataccttaccggttgggtctacaacagcaagcttacagcctgtacggaaagccgggtcccagccaagaactgttcttccttccattggaggctgcataagaagctgttttaagttctttccaaaaacagtaattgcaccttcctgtgctttttccgtcatctcactgcggatatctctttcaattgccggtgcgatcagacgattataagcatcaaacactgcttcttccatcagtgtctttgtatttggattgtcctttatcattgttttattcaacgcattgacaatctgtgcatcaggagcctctaccttaaccgtaagaaacttttctttttccccacgattgattgccagcacacgataccctgtaatcttagacagttcctcgctaaaatcataatacatttcataaacagattcagccttttcatctttggctttcactacaagacgcccctgcttcatcgtacagtttcttatactcttgcgataatctgctttatctgcgatcatctccgcaataatatcttttgctccggcaagcgcctcttttgcattaacaactccttttgcttcgtctacaaagctctgtgcttcttcttccatactcttagaagttgcctgcaaaagaagaatgttcgccagtggctctaaccctttttcctttgccttcgtcgctctcgtctgcttctttggacgatatggacgatacagatcatctactgctacaagagtttctgccgctaaaatctttttctttaaatcatcggtcatcttgccctgttctgtgatcgcgttaataacctgctctttcttttcttctaaattacgaagataaagaaggcgctcatgtaaattacgaagagtctcatcattaagggctcctgtcatctctttacggtatctggcaataaaaggaatcgtatttccctcatcaatgagctgtaccgctgcttttgcctgttcttccctaatcgtaagctcctgcgccagtttctttataatatccattaatctgtctgctccttatgtctgtactttttattttacgatctgctatgctttttgcggtgtagtgatccacctgagatatgcattcataaatgcatccaggtttccatccatcacactctgtacatttccggtctcttccccggtcctgtgatcttttaccatcgtatatggctgcataacataagaacgaatctggtttccccagccgttatcggatacttcgccacgtatatctgataatttttccctgttttcctgctctttaatcagatataactttgcctttaacatctgcattgccttatctttattcttgtgctgagagcgttcattctgacactgcacaacaacacctgtaggaatatgggtgatacggatcgccgaatctgtcttgttgatatgctgtccacctgcaccactggaacgatacgtatcaatacgaatatcttcgtccgcaatctctacagataaatcttcctcaatatccggcataacatcacaagaggcaaaggaggtctgtctctttcctgccgcattaaatggagaaatccttaccagacgatggacgcctttttctgacttaagatagccataggcattctctccatttacttcaaaagtaatggacttaattcctgcttcatctccatcaagataatcaagaacttctgtcttaaatccatgactgtcagcccatttactgtacatacgatatagcatacctgcccagtcacaagactctgttccacctgcaccggcatgaagcgttacgattgcattatttttatcgtattcaccggataacaatgtctggatctttagattatcaaactctatttcaaactcgccaagtaattcttcaatctctggaatcacactggcatcattctcctcattcccaagctcgatcatggtagagacatcatcaagtgtcatctccaatgcatgatatgctgataccgtatctttaaggttcttcagcttctttgtcacttcctgcgccttatccggattattccaaaagccttcctcccgcatctcgctttccagttctttaatctgttcatgtttatgggaaagtgataaagaaagaccaagttccttcatcggttctttatattgatttaccgtaaatttgtattgttctaattcaaccaattataaaaccctttctattatatgataatatgataaagaaaggcacagtgcctattcattcacaggtgcgtttcctgacatctgctgcaaaatattcactgtgcgaaacttttcctgccttaatttgcaaatctgccacagcagtttttatatttctttccgcttccgcaaggacaaggagcattacgtccaatctttgcttcttttctgcggtaaggtcctctttcgacaagctcatccttgtttgtgcctgttgctcttgcaacctgctttctttcaactttctgctcaatctgaacatgcattaaagcgccaactgtatcatgacgaatgttctttgtcatctcctcaaacatctcatatccaaggaacttgtactgaacaaccggatccttctgtgcataagactgaagtccgatactctcacgaagctgatccatatcatcaatatggttcatccacttactgtcaataactttaagaagaataacacgttctacttcacgaataccatcattaaagattgctgcatcttcttcaccaagctctacaccttcttccggtacattcaccttggcaaattcattaaagtctttctctttcttatggtaaatcttcatcgcctcatcctgaagacgggaaatgagagcttctttatcattcttctctttttcttcgtctgtaagagtgattggctctaatggaatctttcttcttaaagattcattcagctctacaagattcatctcttttaatggctgttctcctgcgagcatatttacatcgtcagcaacaacatccttgatcatcttgtaaacaacatcccgcatactctcaccatttaatacacggcgtctttctgcgtagataacttctctctggtcattatttacctggtcataatcgagcaggttacgacgaataccgaagttgttattctcaatcttcttctgtgccttttcaatctgctttgtgatcgtcttatgctgaatctcttccccttccggaatctttaacgccttatatacgctcatcatacgttcagaaccgaacagacgcatcaggtcatcttcaagagataagtagaacttcgattcaccaggatccccctgacgaccggcacgaccacgtaactggttatcgattcgacggctctcatgtctttctgtaccgataatctttaatccaccaagttctgcaactccatcttctaacttgatatccgtaccacgaccagccatattcgttgcgatcgtaacagctcccttttcaccagcatgtgaaataatctctgcctctaattcatggaacttcgcattcagtacgttatgcttaattcctctcttacttaataattcactgacttcttctgatgtatcgatattaattgtaccaactaagaccggctgccccttcttatgagactctacgatatcgttgataactgcatttaacttttctttcttggtcatgtaaatagcatcttcatgatcgatacggatcattggcttattcgtaggaatctctactacgtccatgccataaatatccatgaactctttatcttcggtcatagcagtaccagtcataccggctttctttgtatacttattaaagaagttctggaatgtgattgtcgcaagagtcttagactccctgttaacctttacatgctcctttgcctcgattgcctgatgaaggccatcagaatagcgacgtcccggcataatacgtccggtaaactcatcaacgataagaacttcgttatcttttactacgtaatctctatctcggaacataaggttatgtgcacgaagagcaagaataatattatgctgaatctcaaggttctctgcatccgcaaggttcttgatatggaagaactgctctaccttcttaacaccctctgttgtaagcataacctgcttatccttctcgttaacaaggaaatctccatcttcctcgatatcaatacccatgatggcatcaatcttagaaagttcaccatccgaagtaccacgctgcatctgtcttgcaagaacatcacatgccttataaagatctgtggacttaccactctgaccggaaatgataagaggggttcttgcctcatcgatcaatacggaatcgacctcatcgacaatggcataattcagttctctttgtacaagatccttcttataaataaccatgttgtcacgaaggtaatcgaaacctaattcattattcgtaatataagtaatatcacagttatatgcagcctgacgttctgcattatcataactgttcaaaataacaccaacgcttaagcctaagaactgatgaaccttacccatccagttcgcatcacgcttagccagataatcgttaacagtaacgatatgaacacccttgccctcaagcgcatttaaatatgctggaagagtagaaactaaagtcttaccttcaccagtcttcatctctgcaatacgaccctgatgtaaaataataccacccatcagctgcacacgataatgcttcagatggatcgtacggtctgctgcctctcttacaacagcaaatgcttccactaacaggtcatcaagagtctcccctgctgccagacgatctttaaattcctgtgttttggcacgaagctcttcatcgcttaatgcctgcatcttctcatcaagagcctcgatcgcatctacatacttttcaattctcttgatttctttctcacttttattgccaaaaagtttatcaacaaaactcatctttacctcctatttctatcgtaaatcacttcctgacttacgtatgcccccactgacagaagatggggtcacacctcctgagttggtaatcttcttctaattttaaacatacagattatattgtaacattgataagctctcttttcaagctttaatccccttgatatacagaaaaagggaaggcagataattatctgccttcttccttcgtttctaaatgaattcatgtatgtttaaaattctggttcaatcaaaccatatgttttatcttttctcttataaactacattcacttcaaaagtctctgcattacggaatacaaagaaactatgccctaacagctccatctgtacgcaggcttcctcaacatccatcggcttaatagcgaatctcttactctttgtaaccgttactgtttcatgattgtccacatcttcttccatgaactcatcattaaacttcacttcgcccttaccgtacttggaaatcttcgtcttatacttgcgaatcatacgctccagtaaatctactgccatatcaatagaaacatacatatctgtacttgtaggttctactcttaagatcgttcccttcataggaatcgtagcttctactgtctgattatccttctgcacgcttaatgtgacctgaacttctgtctctggagtgaaaaacttctccagcttgctgaacttatcgtgtacagcctgctttaatccctcggaaacctccagattcttgccgtaaataatgtaacgcatacgatcacactcctttttcttatattataattattataccaacaattcttcattctggcaatgaattatttcaaaaaatcatacaaaacagatgttttatattgacgtgttttttccaatttttcctttcgtttttccactgtggatattgtggataactcagtggataagtctgtttttcaacatttttcgatttttttcttcgtggataactgcaaagagttatacaccgacactttgttcttttttatgttttgtaaatttatgtatatttcattgtctattatgcacaattttcagccattcctcatagaaaaatccgtttttaaccgttttctgaaagtattctttattatccgacatttcgcctaaagttttagacttttcagtcgaaatcctcttactttttccgaaacaaaaggcagaatattcctgcaaaaattgcaaaatcactcatattaaaaaccaggttactgattttcttcactggaaattcaggaaaacgaatataatctgtcacagaaccttttttcattctgtctataaagttgctaagtcctcctccaagaagtaacgcataaccgattcctgcaatactcaccctgcctttttgccgttcttttcccaatacgaacgcacaaaagcaaagcatggcaccggatatcccttttaatatctttggatatgaagaaaggataccactggctgctcctttattctctagaaattcaattcttggagacagcttccttctccatccatcctgcatagcatttaccgtatttattccctctccagacctggtaaaatgttcttttcgatgctttcctctaagagaactcctgaaatattccttcaaaaatttatctcctgcaataatcaacgttacaattatgaaatatatcactttgatacctcctgtgcatatgttaaattatacctcaaagaaaaggactgagctactttgccacaaccaaatacttttttatctgtgcgcggactttcccacacgtatcacacaaaaaatggcgaaacccctgcgttaaaagatattcacttcgaccttttcactggcgaatttgcagcgatcatcggaccttccggctgtggaaaatccactcttttagagttgattgccggtctgattcccttacaaaaaggaagccttcgttatccctttttaaatcagccgccttccatcggctacatgctgcaaaaagaccatttattagaatatagaactatatataaaaatatcattttaggtctcgaaatacaacaccgtcttactgaaaaaaacttagaatatgtccagaaattaatgcagcaatatgacattgctgattttgcagattcttacccaagagaactttccggcggaatgcgccagcgcgctgccctcatccgaacacttgccttaaaaccggactttcttcttcttgacgaaccattcagcgccctggattaccaaacccggcttgatgtctcagatgatatcgcaaaaatcattcgccaaagcggagtcaccacccttttagtcacacatgatctgtccgaagcaatcagtatctccgaccgtattattgtacttggaaaacgtccaggccacatacgatcaatcataacaattgattttggatcagaacaccagctttcttccaaagaagcccgcattcatccccaatttcaaaattactttaaccagatatggaaggagctgaaacatgatgaatgaatcagcaaacaatctatcaaaagaacaacaattctatataaaaaaaacaagacatcataaacaccttgtcctgttctttcaaatttttatatttgtattttttattattttatgggagatatcttcccacaacggaatcatcaatgcctttatctttagcagcccttcccagatgcttcttgcctgtcagaaactatttctcaccggagacctcttaaaacacattggcatcacacttgcagagacgttcggcagtttttttctcgttgcctccataagtcttcttgttgccatactcctttggtggaatacaacattaagtgagatttttgaaccgtattttgtaattttaaacagccttccaaaatcagcaatggctccgatctttattgtatggcttggcaataatatgaaaaccattatcatcaccgccatatccgttgcaatctttggaagcatcttaaatctttttaccagctttcagacaaccgacccagataaattaaaactgatctataccctgcatggcaaccgattgaactgtcttaccaaagttattcttccgatcaactttcctgcaatccttagtattttgaaagtcgatatcggactttgcctgattggagtagttattggagaatttctcgccgccagaaaagggcttgggtatctgatcatctatggctcacaggtctttaaaatggattgggtaatgctctctatcgtgctactttgcctgattgccgcattactgtatggaatactcaatcgactggaaaaacactttattaactcttgatttgtgtagaagacgaaaaaagaaacaatgatacattccagatgcggcttgggagtgtatcattatttcttttttctgtctgttttaaatccacagtttggcaacatggaatgtgccagaagaatatgactttccgggaaatcaaatccaaaagggctgacattcaatttgtaggattgggttaaacaatcgctgcaataaaattttctgctgaattgtaaggaatttatggtaaagaaaagagaatttttataaatattgcattttgtgactttgcgctgtagaattttgactctgaaaacttcggacttgtttttccgaagttttcgttttttgaggcaaaatggagcgtttagcgtaacggaacaaaatcaaacttataaaaattctcttttctttagaataccaactacaattcagcagaaaacatattccttgtggagaattcccattctcaccaagtgtagatttaggatagtcagaaaaaagaaaaaacaatatatcccagatgcggcttcggagcgtgtttaagatgcggatgagcatcttaaacatagcgactacagagcagatgggatatattgttttttcttttttcgtctacacaaaatctacaactcagaattttccaagaatcagtacttttttcccttcaaaggcaaaaccatagtaataaatctgttccctatcaatacctcgttctattaatacattactgtactttctttgttctatctgcgccagtgcattctctgccgctactttcaagtcactgtcttttgatggattatatactttaaattcaaatataaaagctttatctgctttgtttatcggttcaagcataacatcataacgcccaaatccactttcccgattcgatgaaatgtaatatcggtctgcaagctcgacaatcagtccgagtacaaagccataatagaatctttccggttccatcttttgcgatggatgtctccccacatcaaaactgctgaacatttttattgaaatctcattcatgaactgattcatatattctatatcattcataaataacgcttttataaaatcactgtttgtaccagccgtctttttaaaccatccatgaatcatattttgaaacattctttccacttctttattcgtaatggacagctcatactgctggttatcatctgtctcatcttccgggcttctttccacttttagataaccggatgctaataaaagactccagatggcttgttcattatcatctaattcctgaaatacaatctgctcatcaagaatcgtgaaaatatgctgcctcaaaagcagtgcttccatatcggtttttatttctttacttccttctctgagcagtttactaatcaaggcatttgagctggtattagcccaatatagttttatctttttctcatctagaaaattagtaattgaccatgggttataaatatctttgctgcttccaaatgtaaagccgtcgtaccattcttttactttctgtttctgtcttccaagacctgctatatctaatgcctgaaatacttccttttctgtgaaaccaaacatttctctatatttctcagaagttgtggttactactgtcagattattcaaatccgaaaaaatagattctttgctcactcttgtaatcccagtcataagccctcgttccatcgatgaattcgtcttaaaagctgaattaaaaatgcctcgtacaaaaaatgtcatctgttcccaataattatgaacatacgcttcctgtaatggcgtgtcatattcgtctaacaaaataattactttctttttgtaatattgaaacagatgatatgccagcttcggaattgccatcgctgcttccgcatctgacatttctgttcctactttttgaaaatattctgtttcttttggatttaaaattcctttctctaataaaaaagaatgttgctgatacaattcttccaaaagcaatagtatgctttctcttgcagattcgtaagtaattccttttacagatgcaaagcttaaaaatataaccggatatgttccctgcagatctcgatatttcttttctttccagatagaaagattttcaaacaggtctgaacgtcctttatattttactgaaaaaaaacaatgtaatgtactaagatttaatgtctttccaaagcgtctggggcgtgttattaatgtcacactgtcattattctcccaccactctttgataaaagcagttttatctatataaaaacttttactttttcgaatactctcaaaatcctgatttccaatagaaataactgttgacatagaacccctcctttaatatttttccggcatatgaatgatctaaaaatttaatttagcagaacaattcacctttccttcaacatatcagcctaaatctacctttaagtctccttctttaatccagccttttttcctcataaacttaccaattgcccagcttaaaagaacaggaagtacaaagcagactaaaatcattcctaaccagtcaaatgctccaacggcatatccttctggcatattcgaccagcctgtgataatcccgatcggacctactaagcccgcggttcccatgccggaagaaatcgccgcaccgttattgcgaagctggaaaatgcatgtggcaaccggacctaaaatcgcggaggtaagtaccggtggaatccacaagatcggttttcgcatcagattcggcacctgcagcatcgacgtcccaagcccctgtgctacgagacctcccactccattatcaggatagctgatcacagcaaagccaagcatattacagcagcatcctacggtagctgctccaccggcaagcgcaagcccattccatacgcccatagagatactgccatctaaaacgcctgcaagaacggcaccgccactaataccaactgctgcgcagattgctgcggagctgattggaagagtaagtacaacaccgacgacaacagaaataatgattcccatgaagaatggctgtaaattcgttgcccagccgataaatgtaccaagggaatcacagattgttttgaaaatcggtgcaagtaccatggcgcatcctacaccgacaataattgttactgccggtgtgacaagaatatcgatcttcgtctctttagagacaagcttaccaacttcgcaggcaataatcgcaacaaacaaaactgccagcggtccgccggaaccgcctaatgtatttgtcgcctgtcctactgcacataaagaaaataacactagtggtggtgcatctaatgcatagccgatcgccgctgccatagcaactcctgttaccatggtcgcataattaccaatctgccataaaatccagcaaaaatgattccatgtactaagtcctgcgacttttgccgctaactctcccgtatctgtcactgatgccaatgctgccatcagacctgttgtgccgacattctctgctaatgtcttaatgatcgtcccgatcaagagagatgcaaataatccaagagccatcgctcccatcgcatcaattgcatatctcttaaaagaaatctctacatttttcctttttagaaagctctgctttcctacactttgttctgtgttgttctgcttcttcatctttctcttttttctttctcttttttctttctctttctttttatttctttttattttcactatctaaagccgatcttgaaatccattcaaaaatcccataggatctgacaagattttaaaaaaatctatacggcttcaaacagttacattctataatactcttcacagaaacgcaatgttattttcgtaaattttttacagtgtaatacctgttcatgcgtatttaaaaagcgctggacatatggcatagaaaaaaggagagacagcaacgtcccctctttcgcagaagcattgctgtctcctctttttgtcataaaggcaaatcataaaaacttttatttatatcatcggattacttctttacaaacttacatctgtcaagtccataatcagataacatctttttgtaggctttgtatttacgttttggtacataaacctttgcgtgcttcacttcaataaacacatgtggttttcttaactgttttaactttgtacctctaaacacaatcttttcgagctttttattcagacagaatgcgtgagctcccatgaaggaaacattctttccgatcgtaagcttcttcacattcggacatgcatagaatgctttatgtctgatctttcttacagagtccggaatcacaatatttctgatcttcttattcttgataaaagctctcgttccaacggaagttacattgtacttaattccattccatgctacgctctttggaatagagactttcttcgcactgcggccttttacaaatccgatcacttccacttctccacttccgtcaaccattgtgtttgtcactttatatctataaataccatttgtgattacatcaccttttcgcagtccgacaagcagattacaagatgcgctcttgccactttctgttgtaaccgtaatcgcaagcttacctggtgcgattgcctttacattaccattctggtcaactgctgccatagcaggctgtgaactcttccagcttaaccaatctgcgctgttttccggtgacagatatgctataagctgttctctggcattaggagaaaggacgatactatttttattgagtcttactccagttgccggaatcttattacttactatgatctttcctgccggttcatccatatacgtatctgtaattgcatatttcactgtataggtcacgtctgcttttccaccgatatttgaagggacatccaaggtcgctttctgtgtgccggcattacctttcgtatctttttcatcgatcagcttaccggatgcatcaaacagaccaaccttcatagcgttttcaagacatttaccttccagtaccacttcattctttcctgcggtagcaatcattctttccgttacgtttactgattttactttcggtcctacccagacttttacgctagaaacaatatcctggccattctcatcctgcactgtagttgtcgtactgctatttactgccattgcagaaatcgtaatgtatccatatttattactggtctttaaaatgttctttgctgtatctaacttacaatctgttccattcgcatccaatgaatatgcaatctttgctggataagcctttaattcttcttcactgtacgcttcttctaaatcatcataacaaattgcttttaatgttgttacatctaacacagtgttaaatgcaatagcttcaggaacatcttctaatacgattttctgaagtgaacgcactcttggtactttcaattctaaagcgttacttatgacttctttattcagtcgattcgttgctcgaacagtaatattggccttcttaccggcttctaccgcaactattatattatttctatcaaatcgaaatgccttttcattatcagaattccatgtaagcggtacaccgtttagattatagtcttcttcgtactgatccagtccctttacgataaaatactcggaaacataagcattctctccatttttcaatgtagcatctgcatctttttgctccagttttaatgtatcaagaactggtttttgtctcacatttaaagtaaactgcgctgccagcgctttctcaccatttacatttgtaaatgttccctttaaaataacatttccagtttcaccataatctacagttccctctgttactgacagattctttgctttcgaatcaaaagatacctgtgcactcttaatcgttcccttatccgtcagttcccatgtaatactatcgacttcttttgcagaaagttcgtaaggatctccattctggtctttggcagtaaaattcaccttggaaagatcataaacttcgccttctcttactattgcagaatctccggtatataattcctttacatatggtttggcgataacattaaagttgatggtgttcgattcaaccatgttttccccttcacccacagcaagctgtaatgtatcagaaccttttacaagcccaagcagtgtatccgcagttactgcagaatactttccaccggtaatccaccggtacgtttcctttgtccagtcataagactcaccatactggtcaagcgctgttactgttacatcctttttcaaatcactttcataagcacttccaatgcctataccattcttttcaaggtctgtttgaatcgtaaccgaacttaactttcttgctggttttacattaagctctactacattagatattacgttatatttttgagaaactgccgtaatcttatatattcccgccttacgtatcggaagtttattctgagaaagttctgtaaaggctgcactctgcccatcaatctctactgcccatttcacatcagaagtatccttccactcaccatcatactgatcgaatgcttttacagtcagtttagataaatcaatctcttttggagagccctggtcattataaataaaactctccaacgtagccggctgcgtgtcatcagaaatcgtaagggttgttaatgccttcctcggcagcgcctttacactaatccattctgaatgcttcccacgataagtcgcacgaatctggaatgttccactctttgtaaaggaaagctgattattctcaagcttaattccatcttcctcatccagtcttgattcccatacaatcggtgcaccggaaatctttttatctgtgctgtctaatgcataacctttgatttcttcattgccaaacagattcaccggtgtttctcccacataagtagttaccgttccttctgcctgcacacttccgtcaaatggcttcgtcgtcacattcactttaattcttgcggttgaatcaagagattcattcgttgatattgatggagaagatttctctaaactcgtatagacatcttcatcaatcacatattttagatacagcgttccttcttcttcccctgctgtaagaatctcttcacctgtcgcagtatttctttcaatcgatgccttcttacttcccgtcaattcatgtccttcggtatccgtaagtatccaatgtcccttatcctggtcaaatccataataatcaacatcattttcattcgttccatttaaagtaacagtactaatatcaaatgtatccccaccgatcatattcaatgtcttcacaccgttaaccactttgatattctttaacggatataacggtacgatcgcattaatattagaattcatactcactgcatcatagctgagtactccacctgtcacagacattggacacttcgttgccagccaggttaccttatctttcaaagtaacccctccattacttacagctctttggattgccttagcagactgatcgatcgaacttctgactgccttgccattcttcgtattctgacctgttgtcccacttcctgatgtatcttccgtataataaaatgttacactgttcatcgcagcaatgacgtcgtcacttaccccttcctttttcaaggagttcttctccgcttcgccaatcggctgaaccactttactgtaacgtcctgatgaactatcatatcccatttcattatctacagcagcaccattactatcttttacctgtcccgaatacagattatactttttccctgataactcataaacagatcccattgtaaccaatgtttcgtaatttacaggatattcttcttctaaatctttcgattcaaatgtattctggatcttaccctcttcattaaccaggactcgatgaatcttaaccttcgccatctccacgccaacatcttcctcattgatcgttccacttaaaatatctttccattccagtccagttaattcatccgcagaagaaccatcatcacgcttttctgtccatccataagtttgtccatacgactgctcatagtttttcgttgcggtatatctgactgcacgattatacagattatccattgccgttatcccaccttttgcggaggaagagccaaatattgtactaaaatgactctgacgataaccggaagtactaaaagactgtaccgctgcactgtcatcatatacaacaccagataaagagaaaatcgccactttataagtaatcgcaaccggacagtcatatcctaactctacattcgttactgccttagatgattccattccaacagccgtctgtgccggaagtgtcatactcgaagatactttattctccgatgtttcactatattcctttgtttcggaataagctgtagataatgcctgttcacacgtcacttccagctttaaggtctgttctacttcaccaagaagaggaattcctcccgaaagtgttgtttcagaaccgatcatctggctataagaataactttttccagtttcaagagtattcgaggtcgtcacagaattcgactgagtaaattccattccgacatctgcttcctgtttcgattcattcttatagtagctaagtaccggattattcttcccacttgttttatatttgacaccggaaacattattatctactgcctgctgcaaagaatcatacttctgcgcctttgtaacatattccagcccttctcctgcaagcacagataactggaaatcataaaaagcaataccaaacgaattgtaattatatttataagtctttcctgccctgtctacgcacgtcacaagcgtatataaaacatcctgcggtgtctcatcattaagctggcttaatgtatcatctccatccgttgctttcagtacatcactgccactgatttttcgattaatcgctcccgcaatctcatctgctgcctcctggcgtactttttttaaatccgtagcataagaaagccctttccattttgtgtaatcattctttcggcttccaacagtatgttctgttgtctgcgctaatgcatatgccagatccgcgtatccacttctctcccggttcgagcttcctgtaaagttcttcttaaatccaccgccagcattcactcttgctgtataatggctatgcgttccataaatctgttctgcaagagaagcccactggccaagcacactgtcgcttccatcagccatatccttcccactctgtaaaacagcctgtaaaaaagcaagctgattggtcggatcggtgcgccccgtcttgctgccatcatgaatatcaaaatatgtcttgccatcaatcactactgaccggattcccacgcgattctttgcttcatgttccgcaccatctgcaaaccggtactgcactcccaccttagaagccgcctgggttctaattggagatgccagaccaactacgaccggtatcgtaagcatcactgtaagaatacctgttaacaactgccttgttcctttgtacttcatactctcacctcttattcttatacaatatttttattcctgttgtttatgtgccttcctgtctcgaagccgaatacaaatcaccgtaaaaataactcctgccacaaaagctattataccaataatcacataaacatctgctccattccgcaggagaacagatccatacccgtcattaaccgtaggaattccggatacatgtgccatttgaagcaggattcccatacataccgttaatccagcaatcagaactgtcatactgccaagtatccttctgtcatatcgattgcgaagaacatttatccgccggtgaatcttgcaccgtctgatctccccttgattcatacctttcctccttccccattctttttttgcaaatgatacatatttgcaaatcttatttacataaagacatataaaaaaaaatcctttcacctattttgaaaaaaatcaaaaataaatgaaaagatctgaaaagatttttaacctgttctatatattctacatcgaatacttattcatttttatcagcaaatgccatcctatgatcaacagcaagatcataacagacggaaacagatatccaatccatttccatattccatctgccgaaacaagtaaattaaaaatagcatgaaaagcactactagccccaagcaaaccgattgttcctgccactttcaaaaaaccccggcaaaatatataagccattccaaaaccgagcaaaatgccacataatatatgtaatgcccctgctgaaataccacgcacaagcaaaatatcaaaatctgctgctccattttccgtcaaataacatacattctcaaatgtagcaaaacctaccgcaatcgcaaccgcagctccgggaatccccttcctttccggttcaaaaatcaaaagataaaacaacagcggaagaagcttcatcacttcttcacaaaccggtacgatctctatcgctgccacaaccgcatctgtatgataataccccataaaaaaactgctgatataggcagacaacacacacattcccatcccgatacagataaacagcatatatttacgcatatctccccgtataaaaatcaatgagaggaaaagcggaatcgaaatacatataaaaatattctcaatatacatcatctcgggacacctcccaaactgtacatggtaataataacatattgacaatcgtcaaaacaaaatcaatcagaaaatacaaattaaaccttgtatagtcatgaataaaattcgaactcacatacagcaccacttctagcacaacacacacaatcatacagtaacataccccatgcggctccttctcatacaaaatccggaatacagcgataaaaacaatcacccctgccaccatcgcaaaaataccggtagtaagaaataccggtccaaaaattccgctccacatagaagcaatcagaactcccgctccacatatcacaggaatctttgcaatccgcatcttttttatcctgtaccgcacgatctgataggtatgcataaacaagtaactggcaatccatgagatttccgacacataaaacacctgcggtacaacgccccgaatcacaagatgaagcacaaaataaagcgttcccatcataaagcagctatgtaccagcgccagtataatatacaagcggtctctcttataaaaccaatataccatatctccaagcgccgcaacaaaaaataccgctacctgaaatacattatcaataatctcaaaattcatctctgttctctttctcgttcttctcgttctttttcttgttcttcttgttgttttttcttctcaggctgtccgtctgtttccattctgtactgatactccctcgttctgcgcttatgttcctcaacccttcgcaaacgatacaacaataccgtcacacatacgccaagcgcaaatgctaacacacccatacaaatatatcccaatgcctcataatgccccaacatactcgccgttcccatcgtataatcaatattacctacagaagcctgcttcaccactcccggcatgaaacttcctattccgataacaagcatcagacacaacgctacaccacacacactaaacatacactgtttcttacgtctttccttacaccgaagctccagtgttcttctataaatcaattgctgacgctctttattcgtccgcatatgaaaaccctccttgttctaaaatcttcctcaaactcttctttcctctatgtaccagattcgtcatctgctgttcactctttccaagaatctttccagcctcactataactcatcccctctatactcacaagatataacgcctctctgtactctgtcttcaacttcgccatcgcctcataaagacaattttccctctcattttgcaaaagccttgtctccaccagttcttcactcggcaattcaaaatccacctcatccaaatgcaaaaaccacaacttatgtttttgtgtgtgacgaatcgtcagatttctcgctgttttataaagataagctcgaaaactcccctttccatcaatcggacgctccttcgcaaaaaccctcgcaaacgcctcgatcatcaaatcctccgactcatgaatatcatgaatatagccatttatataataagtaagtgcatctccatatcggtcaaccagtatgtccgcactttcttcccttccctctaagtactctctgtaagccatctcatctgaaatcacacacataccccctcgtatccgtttcattcctatagacttcctgatccgatcaaaatcaccaattccacctcggaccgtatactctattttatacgaagaccttgcattttacaagaaaatgtaaaaaaaatcgtataccagcctctgatctacagccgccggtatacgattttatgccaggtgtgaaatgatacgcatctcacaataagaatgacttaatatcctttccataagatatgtgctacagtgtctatgcctcttctacaaccagaaaaacctgctgtacttcataagcgataattcccattgctgcgattgcatttttgtaaataggataatgccttgtagacaaaaatgcctttgctaccgacattctccaccaaatgacaaacgttccgtcttcttcaagattaacatcatatttgtattttttatcaagtacagttagttccccatgatctccccgctcgacatcccagccatactttgaaataaaaactggctgcatttttttaaagaattcatcagatgtgacccctgccggaagtttgaacttcattctgcgaagccgccttactttatggtctgcatatgtatcgatcaggcatacaagacacagcaagataaatgcagcaattgccagccatcctgtgaaatcccctttcagaattccaattatcaaactgattggaaccaggatatataatttacggaatttcttgatttcatccggtaagggttccggcgaggtgactgttcttgcctgcgaagtctcctcctctcctcccatacttcctcttatgtagccgtcatgaacagattccatgaatcctttctcttttttctctttctttgccattgatgatttctcccattattctccacttttacattccctgcttatttgtctttatagccttttcttaacggtgcttatttaacggaaaattaaacactttataatagccaccggaattaaaacccagccaaacataaagcccagtataaatcgtttaatccacaaggttcccatcggtccgataataattttgtttgcataaaccgtctgacctacagaccagtaactaagtactatgtacaaaatccatacgattccattaagtgtatctgccataattctttcctcctgtgtgatgtgttattgttttttgttggctttattatacggattgagctagacagaatgtgtccaggcaataaaaaaattctgggttttattccagaacttttttactaatggatttagtatagacttttttattattatagaaaaaacatcgtatcataatatttttctacaaatttcctgcatcaaataatcttagaaacccaaaatattaacatcgccaaggaaatcaaaatagataacactgaaaaaataagtggcgctagtcccatcatacacagcactacaactatggctattatcgctattattaataatatttttataaataatgctgaaaaaacaaacttcaatattatactcaacacaaaaataacaattcctagaaaaataagccaaaataaaccttctgtaagtgcaatatcttttgtaagtacaccaataataacatatagaactattaaaaaacaaataatcttaaacatatcctattgtatctccattttagcttatcccattaataaatctttatatcttccaaaaataaactcttgtttcacttcccttataaatttggtgtctgtaatcaatctggtaattgttactgccaaacctcccaaatctaagtgtttcatatctcttgtggctgcgactaccattaaattacttgaagttgccactgcatttgaatacatcaatatttttcttgttcttacttcatacattttttcatctgttttcccatcaaaaaacagtctgtgaagcatggcaatcattgtattaataaaaatagcataggaagcctgcttccctactgtaaccacattcgccatatcaaacccataatttgctaacagagaagcttttttagggtcaataacagatactattggtattggtaaactgtttttagtatacaaatccgagcgtaaatggactatttcctttaaaagtgaagttgctacaattaccttgccttcataaccaccagaaactactttttctgctgtcttagataaaaccaaatgtgtttgtgctctgcttttaaaataatctcgtttattttcatttgtatagatatgataagaaaccaaatctgaagttgttaatgtcgaagttgcaatattagctgtcccaaaaactagccccaaaatcggatcatgacctatcgctttcactctatgtccaagctttccagctccactcaaagctccatttgctcctatattggcatcaaacggaactggattgcttataatttcttccaaggacggattataatatctatgtattcgattagagtgttcctctctatgcccccatgtcgaagctgctgccgttttatcatctaatctttccggaaattttgttaataaatattgacgaataagctgtaatccaattgctacaaaaaggaactccatatctaatttagacaattttgttgccttacaaaactgttcatctaaattatttaaaatattctctgtgttctcagctatctttcttacacgctctacttcttgactttctttctcaaattctcccattgtctgactaaaatcacttgcatttttataatatcttctaagcaattcttcataagttcccatttttcacctcacaaaagagtatttaaatcattaactttgatttttccttctacaagagcgtctatcgtatcagaaataagatgcatcatagctttaatttcctcatcagcttctctttctaatctcttcaactttcttttcatatattttattttttgttcatataattcttttgcctcctgatatccctcttgctctgccttatccatttgcctttttttatactcatacaccatacctaacgcagcactaacctgtaaatatggacttaattccatgcatggattcattcccatccctattgcagaagacactccaactattggtatatcatattttctagaaacttccttagtcttactctctacctttttttccactttctttttttcttcttttaaatctgtagctattcccaataatttggcagatttccaatcataaaattctccatgttttttaattattttagaaatttctttatagttccactccacctcctctaaaactcttttatactcttgtgctgctctttcgtatcctctctttttcccctctgtcttagcatctgaaaaaattatttttacttgttcaggtattacctctttcttccttttttcaacaggtttatttatacattcaactacatctacaattgtactagctaccgacttttttctgaaaatactcataaaattcccttctatcttttaattattacttccatactctattttttcacgtagacatttaattttttcttgatattcttctaattttttctttccttctccctttttttgcgtttgtttttctgtctcatttaattccttcagtaattcatctttaattttatcaaactctctagctgcctcattaatttcattattatagtgtttttctgtctcttttgccatatttaaaaactgtaatttaacactatcttttgcttctcttaaatctttcgcagccttcttttccgttaatactcctattgcatccatggctatccctgctcctaccaatgcagtattgagatatctacccattcccgcaatatttttactaatcttaagtgcctgaaatggtttaaatttgtatcctaactttccacctatattttttactgctttatgcaaagtacttccattaaccgcccatatagtagcctctttccctgcctctacattagacagcttggcaagagcactagttattttaggagccgcttcatttgttgcttttccaattcctttttctatagttgaaattaattcattacctttttctccttcaatttctttctgtaaccttttttcttcttttttaaaataatatattgcctgctctgactccatgatttcctgtacttcttcatctacttcttccgcatataactcaaatttttcctctatatcttgtgctaacttttcttgtaatggatttgaaaatttttgaaagtctccatcatcaaacttataactagagttgcctaaattaattgcaatttctgtcccctgttgaatatatttattaatagtctcttgcacactcctattacactcatttctacaagatgcttttttattatcaattactttacatattttctgaatcaaacgctttctttcttttaaaacttcatcttcttctaactcaattaaactattctcaattgaacgctctaagactgttattggtgttaacattctacctgtaagcccttttattttaataaactcatctaatgctttaataaactcttcaaaatgactatcttctatgaaatcatcatcatcatccttaataccttctacataatccgctgcatcaaaaaagaaatgatgaaaatcaattaatgaacagtccggttcaagagtcctattaatagaatctttataatttttaactaaaacatcatattcacctgtctctttgctcattttattaataactaaaaacattttatttttataatatttagctaaatctttaaaatcattttttgttacttctctaaacaaatcacttgttatacaataaattaataaatctgcactttttatcgcattccttgtcaattcatcatgttctttattttcatttgtatttaaacctggagtgtctgttaaaataaaattcccccatttataatttgtaacttctgaagttgcaatatctgaatcaatctttatgttttcttctccggttaatgctttaattatagtagattttcctgctgaatactgcccaataaaagctaacgatatcttatctttactgtttatggatttatagttttcttcgagcaatactttttccttatccaaatcaagttcttcataaattttcaaaatctctctgtataacttctgtgtctcctgattatatcttcccatctcaagtttattttccattatttttctcctcttataatttttacatttatccccaatagctcttttattttattagcattaaagttctttcccctttctatttcaataacaaatgtcttatcatctaccaatcttctcctctttgttttaatattttttgcagacaacctttttatttctggatcgtttgaaatatactgcaaaattcgtaacgcaaaagaagcatctaagtattttaatcctctataaaatacatcatagcaatcctcaacatattctttagtctgtttagttgttttatctactccttctaaaaaacttaccaatttttttgtattttcttcaaaaattacaacttcatttttttccacttttttcctcaaatgctgtttgtcatactctattaacttttgaaaattttttcttgtaattccctttgcctcctcaattttttgttctttactcttaaaaaaactactaatgaaactaattggaattgcaattaatgatagtggtctgtatatacaccctaaagcttgtaatgccattgaggctccctccaatattccttttataggaatcatacttttatcattctttaaccactttatatccttaaactctatttcttctgtaatatttatattagcataatgaatttctttctttaattctttaataatatctgacaactcattatgatatgaatttaaacacaaatgtacttctgattctattttctcatacaatttatatttattcctagtttgttcatatgctttttgtaattgaattgtacttttcacattataattttgctttacatagttttctgcttcttgtgtaaaaaaattatcaaacatcccgtctataatcttcgtaatctgcccttttgttttatcctgtaatttttgaatgcttttttctttttcattacgcagtttagtccattttttttgaaatttatctaacatctttaattcatcatctattgtatccatagacttatacatcttaactgctggttcatccaatagagtttgtgacttataaattgtataattttcttcaatcattttttttaacaggctttcaaactgtttaaagttagaagcctgaaaaatcaaaggattattttcttttctaccaacaatagtcgctaataaaaatacaggaacaatttttatcatttctacatatctatttttctcagcatttcttttaattctctctatccacccctgtaaatttttttctccattatcttctaaccattgtttgggatttttttcaaatttctttctgtgactttttttattaatatcatctttatgatttaatagaattactattggtttatgataagatgctatatcattaatcgtttccaatatttctgacgtaatactatcatctgctattacaaaacatataatatctgcccgagatataactttttttgcaatttcctcatctttctttccactagattcacctgcaccaattcctggtgtatctattatttctattccctcccatgaaaaaactctattaaatcttgtagttctttgtcccccctttcctataaattcttcaccttctcgacacattattgaatgcaatgtagattttcccgcttttgttcgtcccattagtgctatcgaaaattgctggctggccaattctttttttggtaattccgattttaatccttctaaaaccccaactacctcttgtttaaaatcttgtttgaatttttgtagtattttccctagttcttcatcatttaccacattggaatttcccattctttcgttcagagatatacattctttcaatatttcttccactacctcttccatagtcttaaaatcttgttttgctaatttctctaaatttctaaaatctaaattaaatgtggttctcgttttggatttttgttttttatttatatatatatcaatttccttaagagccttccttttttcttttgaaaaatttctcttatccaaatagccttccatagattcaagaattttttttcttcagtatcaataaatttatctttaaaagaatcgtgatttacaatagccaactgatatgcgtatctatacaaacagagcctacttgatacattttctataccaaataaagaaatagcttcattataagtaactttttcatctttatcatttagcacatcatatattatctctttttcttcctcaccccatctattcttttttataatcatatttaataattctacttgcctagaatgcatttcatcgttcacaactataatatatcctaaaatagcaagtatcctattatcactcaagttcattaacaatactcctttttttgtatgtctcttttatcataatattattaaagctatatctgctacctctattcttccaaagccattttcaattctgcaatttccatttgttcggatgtaatcaaaataaccaaatctacaatctgttctaacgttttctgtaaagttgtatctgcttctttttgtaactctcgaagattacttttcagatttaaaattttagttctatacgatttttgtgcttctttatagccttcctgttctgctttgtacattttattttctttatatctatataccaaatctaaccaatataactgaggtactgtcattaaaacattatctacaattcttcccatttttaatttttctactggaatattatatttttcagatactgtagctatctttaaatccatttcattttctaattgttttttctcatactgcaccacaataagcatatctgataatctctttgattgttcctgataaaacccttttttcttccgaacaatctcttctatttcattgtagaatttctctgcttttttcaatacatcatcatattgttttactgctttttcgtatccttttttctctcctttagcctttgtatctgtaaatgccatttttactttatctgataatgaatttctttttccaaataatatgctcataattatctctccctattactgttgcttaatattagatttattttctctatttcaccattttcattttaaaaatttctcaaatttaaatctgtctctctttatggataggttatacaatctccactgcatccccctgtcctcttatccatctctctatcccttttccaaacacctccgcttttaccgtatacactccattctcgtgtttttcgacttttgcagtaggcaagcggtctagaactgcttcgatggatggtcccttatatttaaagcgtacggtttgaagcttcccgccgtacatgaactggactcgtttgcggaattctccttcttcgaatcggctgctgtagagtactcgaaagtgttcgtcgagaatttttaaattctgaatgcggtcgattcgatagatggttggaaatggatcattggctacatcgaagttctcacatagatttttgtcatcaatgaaggcggtcagatagaagtaaaattcggagaacataattgctgctggttttagtttccgtttttttatctcgttatcgccccgtttatattcgatttcgatgtagttctggttttgtatagcctggccaatgtcccacattttgttaaggaagcgggttttgtgctggagttcgacataatgctcttcttcattctgaatgagtttttccacttgcggctggtcgtctttgacgacagaggaatggatgagcttatcgatgatttctgtcatttcttcttttacaaaggctctgctatctaagagtattttgcagattgctaatatttgttgtggggatagtttatagacattattatattggagacaataccctcgggctttggtatcatagatgatagaattgattatgccggtatttaaatcgtctctttctaaaaaggcggtgatatcctggatatcccgttggatggttcggggattgaccttataacgctgcacttcttcttccttttttactgtctttccctctataagtttggtgtaaattcccagaattctctggattttatcgttttttatctcttcacatagtttcgtgtccattttcagataatttcccctctaatacttatttttcaatttatttctccaaaaaaattataccatattggattttttagtgcaatccgcttttacagtttgtttttcagtttttctgcttaatatataatggagaatgaaaaattttaccattaatgtatggttgaacgcttgattattgctgattattatagaaagggagaacggaatgtctatcatgctgccggaaattgattttgaaaaaattggacaacgtgtgaagcaggccagaattgataaagggtatacacaggcggagcttggagagattattggctgttcgaataatcatatgagccatattgaaacggggcagacgaaggtttctctttctcttcttttgaaactttcttatgcgcttgatacggatctgaattttttcctgatggatactccttatctggagaaggaaagtattattgattcagaaatcgctgacaagctttcccactgttcgccttctacgcttttgtccgtgaataagattatcgatattcttttggaacagcaggaacgggacaagaagccaacttcttattactagagtatgttctgtaaatgctctggagcgtgtttaaaaaatgatttttcaaacacgctctaagctccatccccggctttttctcctgcctgttctgtaatactttttatgagctggctgattctccgttcggtatatcccagttcttttgccagctcggaaccggtcatatcccacatatgttcttttacgtaatgcctgatatagttttccgtataaagttttttcggaaaggatatctggtgtcccatgtacaggtcatagattctccgcattactttttccccaaatttcagatagagttcgttgtatacaggacggtatttaagtatattttccttttgttctgcatcgacagtgctcttcatccgctgtcttatacttcgctctgtgcattctagttctgccgccatcattgcagttgttttcttttccctgttattctgtatgtagtgattgatatattcttctgtatacagctttttcggaaaagagatctgacgtcccatatagatatcgtgtatttgtcttgttatttcttccccaaattcagaaaatagcagtccgtatatggaacggtaactttctgggttgctctcgttaaatattgccattttttcgtgttgtcctgttttacattttttctttttgtattcttccatgcgctgcatgagcatttttttctcctctgcctttcttactgctattatacgcattaaggtggacagaaggtgtctatcttatatgttttttgttttgctttgactaattctcaattgcaccagacgaagaatattttaatgttttttcataaattaaaacttttcgtttatatactcttttttattatagctttttgcaaatccaattactactcacagatttcttagaaattttccttatttttatacaaaaaacaccccgattagtacttaaatataccaatcggggttattatttatattacattatacttttgtattttccagatattctaaatattctattccctcaaacacagtagaaaacgttaaatctgatacgaacaattgataatctctgtcgtcacattgttctatagaagataattcttctcttaacttctccattctccaatggcaattatcaattgcatttttataaagttctgctatcttatctgtactctctttgtctccttttttatatttaggacattgcttcttcaaaagctcaataactttatctttatctgcaggtatatgaatcgctggagcacatttctcgtaatgtaataaaaaataatattctatgcatcctcttgtcatcaataatctcacttttatctgtgaatttaacttccgtaactttttaataatagaataatattcattccatttccccttcaattcatcttctgtatcaaaaacaagccatatctcatcaatttccgactttacatcaaagtaaatcccttttttattaaatgctttctgagctgtatggaatactcccttcactctatgcactgtgagattggcagacatatgaaattttttttcgcatgtatttcatatagacctgctcactttcaccttcccagaaaataataatatatggctttctattcctgctattaatctttcttgccatatttactcctcatctatatatggtactgctccatactttccaagaagatatgcttttgctatattttcttccaggcgcactgaaaaatctgctaatgaatacagttccgactctcctgtcatattgtctttgtctacaaaataatattgatcccttctcaacattcctctgttcataatatctgtactgtgcgtagtaaatattagctgtgctctctgtccatcagattgattctggaatttttctataatgtactgcactaataagggatgtagtctattctcaatctcatctacaattaacacaccgccaacctttagtgtatcttgtattgctgccgctcttgacatgagacgaattgttccatctgattcttctgataatggtaaggcatactcctgaatatttccctgactgtcttttcctttgtgatatgatgtagcttttaactcattaaattgcaaaataccctctggactttctgcatctgctgataaactttttctaaattgctctattgccttctctatttcctgtctttgctgttccgtaacaaactccgggagttcttccagattactgatttctgtattattaatctcaaacttcatatcactaataccaaaatctgcaacttttgctatttgaataatagattgcaataattctttatcttccctatgtgaaagaatattttgtcccaaatcagaataatctctggaaaaaaatatttcttttctaaaccactgcattgctttaatacatggttcgtaattcataacacacgatatcgcaaaaaataattggtttgtcgcaactgcctgctttattaattccttcatcgatttttctttattcgatgggaaatgaaaattctgatattctctggtaaatatctctgatttttgtcctttcggtgctgcatataaatactctgttactattttttcttttgtagccgagaaaccataccagtatttaatgtcattacttatatattcaaaatgaaactctgttggtgttttcttagaaatatcatctaactcaaatggtctgactggaacctccgcactctcgtactgtgtcctctgtgcattgcgaataaactgaactgcaagccaaaatgcccggatcagattactctttcctccaccattctttccatatatcgaaatcactggaagatatgactttcttttgtgttttaaaagacattcccgttgatcatttaaaccgacagcctctaaatctaataccgcctcttgctttatagaacgataattctttactctgaattttaatagcatatctttccctccaatcaaaagaatatcattattatattcaaaattcaattaaaaaatattgttttttctcatattttcattatattaatttattttttagataaatactgttattcatgtgtctgtactatcattttccccctgtccctcgccacttctcttcaaaatggattgggttatgctctccatcgtactcctctgcctcatcgccgccctactctaccgcatcctcaactacctcgaaaaacgtatacgataagacaaaaacaaaagcctctctaacttctatccaacttagcctctcaactctctcccccacttctcctcctgacttatttaagaacagaaaagagaaaaatcctataatagcagctgcgatgtcggagcaagtaaaagctgcatctcctcccgagatgcagctttctacgcagcgattatcttcgcagatgctattataggatttttctcttttcgtcgcttaaataagcttccctactgatcaaatgaccagctgccgtcatcgttttgtgttccaccaatgacatcctgtccatctacggatactaatacgtctgtgctgctgatatcgtctccttttacagagaagtcataatattctttatcacctacggttacttttttcttgtaggagtattctgcgtcactgccgtagtaatcttttgcctggcttaacgcatcatcctgggaaatgctttcggagctgttgcttgatgaatcagagtcagagtctgtatctgtttcgctgtctgcttctgttgtgcttccttcttcagaagtactttcttctgtactcttttcttcttcgctcttgtctgttgtgttttcttcgtcaaagccgtaggaactatttttctttgctgtgatatctgttacggagtaagcgaagttattatcatcgccatcgaatgatgtctctgtgattgttacctgataagttcctcttacttcgtctgtatctttgttacgaagttctgctgtgatgatatagtcacttccgtcctttgtacagtctgtgatatatggaacgaggcttcctacgtcaccttttaagaatccatacatgtctttatcatcatcgtaggttgcgtatttatctccgtctgaaatttcagggaattccatgtc

SEQ ID NO: 403 - DNA, 59184 bp, Eubacterium hallii
  modified_base (24813)..(24908): a, c, t, g, unknown or other
  misc_feature (24813)..(24908): n is a, c, g, or t
ggaagaacagattgatgcccgaagaatcattattgataatgaagttatgacagagttgaatcaggagcttacggcagcgggaaatgaactggcagtgaagcgttttgatccggatagctgtggatacacatttcatgtggaagagggagcggtgacgatgttttcaaatacaatggtatgtccacattgccataatgttcttccacagaacttttttaaatatgagatgcttatgattggtttagcaggaagtgttgcatctggtaagacagtctatctgtgttcgcttatgatgaatggatttgatgtgatgcaaagacagaaccttaccattcgtaatgcttacggaaatccgaatgatgattataagatggagatggaacggaatgcggataagttgttacgctatggaatctgtccggaatcaacgagcaaggcatttaagaaaccgatatttttggaagtgacctatcggatcggtcagaagaatctccacatgatcacttcaatttatgatgtggcaggagaattaatacgtgatagtgccggaaccggaagaaccggttttgttcgtcatatggatggatttatctgcctggtagatccggcacagatgcatttggaacattctcttattaataagcagattccggatgaggaacgggttcttgagaagctatatgttatgagtaaggaagaacagatgtctattcagcgtatgagtaacgagaacggaaaacaggtaatgaatcaggcagatttcatgatggagaatacaataagtgatgagtatttctatgagagaaaagcggataccattttagattctattcgttctgttttaggagatcatgaactaaagcaaaaatatatggcacttacgatcgcaaaaagtgatttgttagaagaacttggagaaataaaggaatatcgaggaagcagtcttttatttgaaagaaagcaggtgtcctacggctttatgaatatggatcatcattttttaagacaggaaatattaaaacagatttttgatcagaaggtttttcgtctgcagcgtaatctggatgattataaagaaagtggactttttgcagtttcagcacttggatgtgaaacagaagagacgatggagggaacacagaaggaagtaaggacggttggaagagtacggccaatcaggacggaggaaccaatcttatggatgataatgaagtttatgcaggaaagagggtggcttgagtaatgaagatagaatatttaattcatgaatatacatggtccaatcattgtatttccgggaataaactcggttggggaattgtagcttcttccataccggaagacaggacatatttaagagaattagagaaagtagcgcaggcagcggtggttgacaaaacaggaagaatcgaagtagaagaacttgtatacagccctgtctgtgggtttgtcaagatgacatctattccctgtgaatcaggagaagataaacgtcagaataaaagggtaagattatatcagcccaaagcgccggatcataatccggcagtatatcttgctccaggaatagaatggacggagggggagagtacaggatttctcccaccattaacattagaagaagcgaaatttgatcgagaagatatcttacgagagctgtgtcttgaagagagactacctgaatttatgcaggtggtcttttggtgtttgtcaggacattcggaaggtcttaatattgttgctccgaactggaaggaagaagagtttgccgcgaatgcacagaaagttatgtatgtgatccacagtttacttccacagtgtatcagggagaaggcaggttatgtttcatttacaagagaagccattccatcagtacctttttatttttccccaaaagtatgtggaacctattcctattctctttctgaaaagaatgggtgggatgctgactgggatgcactggatcagtatttttatcatggcattgcaaaggcaagtgagaaacaagattctatttatcaggactttcagcaggcagcagcagagtatttaaaaaatgtgcgtgatactggaaatcttttgaaaaaagtagaatggattttttatgatattgcaagaaaacatggaaagaatcccctctccatggaatatcttagtaaaaatataccagagctgctatactgggtttgtaaagataaagaattaaaatttgtggcagaagatattttggcagaagtacatcagcatccatttttacaggcagagagacaaatctatatcgaaagtctcattgcgggagtaacaggacgttctaaaaaagtcattttaatggaaatggatcatgttttaagagaagtttatgatgaagataaaaaggagtttgcttctttgttatctatgattcgagaaagaaataaagaattatatacaggtttgttatgtggtggagattttcacaaagaacagtcagagtacagccggcgtatgtatcatcttaatgcttccgatatggaaaacctttacaggtatgtaagggagtttagcgagcagagtataccgggagagcgaaaagacgatattttaagaaccggaatcggattactcaatgcgaatctttttaatcaaaaaggttatgaactgtttgataagattgctgttcatctgaacagaaaagagcagtggataaagatacttgaagattttgtagtacagcttcaggcacatgtctcattatttgacagaaagcagatggagacggcttgctatatagaggatatgctgtatatgtataagccggagatgacaagggtactgcgggaagaacgtggacgaagaggtcataaagtaaaaaaagacggaagaacaaaggacagcggtgaggaggaatgtgacatgggacgtagacataaagaagatgcgtcgatagaaaaatctgtaagcaatgcggtggaaagtgtggaggcagaatctgtggaagaagagcaggaaggcccgatgattccatttttatttataggtttcccacaaggatttctgacgggctgtattatgtatttatctcattattctctgatgatcggacactggaagatcgctcttggtatggcaggaatgtgggtactcctcatgttgaattatgagggggtaattcttcagagaaaagagagatatcctttatggaaagtgatcgggctttgcctggtagaaggatggattatagaagcggcaggctggttcttccgttcacagaaagtaagactgtattattttattgttcttggagtggtcgcagtatgtattcagatcgttaatctgatccagatgcagaaagcgagaaaaaagcaggaagaataacaggaagaatataaaaagtaacaggtaaataagcgcagataagaatgagggaattatggaaagattagcagacgatacaatagaatcttttatgaatgcaatagaagaacggctagctgaaggacagaagaataagattccgttttccagatttttagaggaaaaaatggatgcttttgactatagtaatacctcgctggccaaaaaggtgtttcatcgagtggaaaagaaaaaggaaggaaccgttacgtatgttcctgtgaccagacaggcaatcggagcctggcttcggggttccatgccatcttccagagatatctatgttacacttggaatggcatttcagatgaatttggaagaaattaatcatattcttttagaaaattatatgggatacggactgtactgtaaaaatatagatgatgccctgtggatcgcattgatcaatggacttttttcgatagattcttttgaagctgtcagagagaagattgaagatattttagaagaaaatgtgcagcaggacagcagaagtcttgcgacgatggacttgtgggtaatgctttctgaagcagggacgttagaagaattttatgaactgatacggatttataaagatgaatttcgtgatggggcaagaaagtttggacagtgtcttgaggaagtgattgaagaagaatatggatattatgataaggcggcctggtttttaagagacattggatgtctgcattgtgaagcgcagttttcaaagataagagcaggaaaggctgttgttacaagagagtggcttcttcgtttttgtattgccctgcagccaacctatgaatctattgaaaaacttcttgcaaaggcgcagatggagccgcttggtatcactccggcagaagtcattattgagatgatcgcccgatataagtcgaattctgtagcaaacagccaggaaatatggatcatgattgaatcggctgcagagagacttcgtcagaagggctatgaaattgaggaagatttatgccgtaaatataattctgtttatgaacttccggtttcacagaagtggtggttttctttctgtattggaaagcagcttttacagaatgaaaagaacaaagagtttggttatgaaaagaacggatattgccgttttgctatggaagataagttactttttgatgatatgaatcgaaataaaaagaatgtctcttttaagaaaagtgccgcagaatatatggaaacaggaattcctgactggaaacaggcagaatttcaggaaataccggcgctttctattgagaagaattatgtgccggatgcccttgatatggaaaagtttgaggattactgttacgtgagaagaccaagccggtttacaaaagactttttgcgtaatgatatgtatttttacgcagcgacattgtattcagtgtggactggaaagtgttatcagaaagagaatggaaagcgtaatgtagaagaaatcagacaggagtttgaaaaacattctcttgaaggagaagaattcctgacagtacttacaaagatgatcggacatgaggaagtacttttagaaagtaatcttgcttctatggtagaagccgttgcaaaagtaagacagcgtcagtaaaagttcggaaagcaaatatttgaataaagatactatttatggtatgctcctgttgaaagtgattgttacaaataacgaaaggcaggagctatatttatgtctattatttctcagataggggttgttattttaattgcatttattgtattagtgttgattcgttcaaataagaatcttaagaaagcttccgaagagggggagagtttcgtagatgagtgggcactgagacaggagaagaaggaggaaatcaagcaaaagcgtgaggagaagaagttagaagtacaaaaagagaagaaacaaaagaaaatacaaaaacaggagaaacggaaagaaaatctgatttacgagaatacagatgagcagtcagaagatatgccaatctacgaggacacagaggaacaagcagaagataggatattctatgataatgcagaagagcagccagaagaatggtctttctatgacaatacggaggaacagccagaagaagaccgtccgggatatgatggagagagccttcgtgtgaatacagactggttatatgattatgaagaaaaagagaaacagcgtcaggaacagaccagaacggaacagtataggtctgcaggtgataaagcagaggaacgaagcggtaagatcgttccgatgaagaagcgtcagacaacgggaatcacattgatgaagcttgatgcgaatcatcgggtgatggcaagataccgcgtaaatcagattccatttacaatcggaaggagtaccaataatgacctggttcttgatgatttgtgtgtggcaagaaatcattgccgtatcgtggaaaaagatggaagatacgttttggaagatgtaggaacaatgaataagttatatgtgaacgggatgatgacaagtcaggttcctttatcagatggtgttcgtgtctatattggtaatgaagaatttcagatcgaagtagaaggcagaagaagccagtctaccagattatataaaaacgtggagggtatttatgagtagacatgataccggaacgaagtcattttcgtttgagagagttctgtgggagatacaaagagccttttattcttttaagaatagtccggtcctcgctcttttgctaatgcaggcagcagcattcatttttgtgcaggcaaaaggagcaggaaagatttatcttgatatgataggaattctgcttggaattactttattatcctggttttttacatcggtgatccatggaaataaaaagattgtcatttacactttactgcttcttaccgtaggaacgatgcttcaatgtattttcagggaagaacaggttttaaagaatccacagtattatgagacacataatccggctgccgctttgcagtttcaatatattcttggatttgtaatggcgcttgtagcggcattcctttatctgaattgtaagaatctgtcctcaacaaaggctctgaagaagttaaatttatcgtctgtaaaggtttgcaggatattcttttatttttcattgtttttatcagtgattacactcgctcttgcaaagagtgtaggaaacgtaaggaactggattacaatcggaggagtgtcgctgcagacaacagaatttatcaagtttttgtatgtatttatcgcagcgggacttcttggaacgaaggagaatccggataaagaaaatatcagagcattttatatcgtgacgttcatagaagtattatttctggcattacagagcgagtttggtacgatgctcttgattctcatgttatttttgacgtttatatttttatttataccgaatatacggtgttttatcggaacagtgcttgttatggcagcaggatctttagggctttcggttattggaatgcagttgacaaagtggaaagctgcgggagtatttcttggaacgaataagattgcacagatttttctttcaaattataacaagattgcaaatcgttttatttactggcttcacccggaaaaagatgcattaggacttggctaccagcttcttaaggcaaaagaatcgatcgttcttggtggatggtttggaacatcttctgttacagaacttccggttaagacaagtgatcttgtgtatccggcgctgattcagcgatgtggcatggtgtttgcattgcttgtatttattgtatttattatgatgtggcttgaaggtgttcagctgtttgtaagaaagcaggaccgctatcacagggcggtgggagctggttttgtcttcatgctttttgatcagacattgatcattattgccggaagtaccggcctttgtccacttaccggaattacattgccatttatttcaagtggtggaagttctctgatgatcagttttatgatcgtgggattgatcgtagctgtatcaagtaatgtcaaatggaaaggaacgctagaagatgaagaagaacaagataaattttttaaggagaacgcagttactgcaaagtgccacacttatctgcgtcatcttaatgatcatttccctcgtaagagtttccgcgctgctgccgggcgtgtccgaagaagcggacaaaaagaagagtcaggcgaaggcaaaggtgtatgagaaagagtatgtcagagggtctattttagaccggaatggaaatacgatcgcattttctcagaagccgggaggtacacgtacgtattctcatccatatgcgttttcgaatctggtcggctactggtctaagatttatgggacatatggcgtagaaaagacgatgaatgatgtgcttgttcacagtgattgtggtaatagagatcaggaaaaaagaggggcggatgtcacacttaccattgacgcagcgcttcaggaacaagcatataaagatatcaaaaagtataaaggttctgttgtcgtgatgaatgcaaagacaggggaacttctggcactggcttcttctccaacctttaatgtgacagaaatcgaagagaaatggaaagaaatcaatgaaaaagaaggagtgtttttttccaatgcctaccagaatccggtagtacctggttcggtatttaagctggttacttccaaagagatcatagaggcaggaattgagaaagaagaagtagaagatacaggttctcttaaagtgaatggacagacgataaggaactatgggggaaaggcttatggaagtattgcctatcgggaaggttttgtgaagtcatcgaatgtatactttatgaatcgcgcattaaagcttgggggactgcggctatataaaacaggaagaagctttttattaggggaagatatttctcttgattttgcaacactacattcgaattttgatctaaaagattacgaggataatattgttgcaacaacagcatttggacagggagaaacattagttaccccattgcaaatggcgatgatcacacaaagtattgcaaacgatggagaaatgttaaaaccatatctttttaaatctgtagtcaatggcaagggaaagacaacgcaggaaggaaagacggaaaagctggtaaaaacaatggatgtggatacagcagaagaaatcaaagaagtgatgaaggaagcgggagaatcctatgggctttctgaagtaggagaacagggatactctattgctgcaaagaccggaactgccgagagaggcgacggaaccaacaacgcatggcttgtcacatttgctccggcagatgatccacagtatattatcgtagcgaaccgtttaaagacaacagaaatcggaaagacacttgcaccggtagtagaagatttatatgatacactgtttgatcatgagtaaaaattcacgaagagacagcgtttccgggggatgattgcccgtttcaagaagcatatatacagaaaaaggaagggatttctgaagcgaattcgtttgattttctgttgcttgttctttttgttcaagaagagcatggagaaagaacgtaagctcctgaatcaacatctgctgtcctttaagatcaggagaaagattataagaaaagcggagtgtatatggcggatttgggttattcagaaaataataacagtaagtaaaatccagaagagtgaccatcctatactgatccattgttcttatgagaagattggacggatgaagatcggtataaagaataccgttttctagaagataagcaagcacttctccggtggaaaatagaatccgtaacagatcttttaaagataaagatggcacaagttcagggagtaaagtgccttcgcagtgttccatacaaagagtaagaagcggaacgcttgttcccggtaaagtaaagtcttcctgaaatccataataatgtggaagagacgggtgggacagaggagataatccttcatattcatcaagcagagcctggcggacagaaggaatattttcactgcattttaatatgtattgatgtttagaatctgcagccgtatatattaaaatatcttttttcttctgataaaaggtaagatcagaaaaagattcaggaaacatggaaaacctcctttggtagatatgtactctcggagtctttcttgcacttacttttgtggctgcttttccgccagtcgcagccgaatttcatcaacgtacgcaccgcgtacgcctcaaaaatttgggcacaactgacaaaaaaacttctcacaaaatcaagcacaaaaagattccgagagtacatagattttttatgtgattcagtgtatcataaagaaaagaaattttcaaatagagaggggaggaagtacggtggctttcttttttgcaagtgaaataaaccgacgctcatccaatgaggacagctattgccagatggagtttcgtatgaatgcggaagcagcagtaagagctatggtagttgctgatggaatgggtggactttccgggggaaaatattattcagaagcagcggttaatatgtggtatcaggaactgcttgcgatgatgatgagtgaaagatttcgagggaatcctttagatagacagattgagattttgcaggaattttcggaagaaatatatagtaagttgaatcagaggttatataagaatggtttagatgccggaatgaaaggtggaactactttatcctctgtcatccatttctgggatacggttatcgtatcaaactgtggagacagtccggtgtaccgtattaaagatggcaaactcacattagtcagtgagatacagaatgtagcagagaagatggtcagggaaggaaagacagcacgaggatcggtattgtattatcagaataagaaccgccttcttgattatcttggcaagcgaaaggaatgtataccgtattgttctgtgtttcaggctgaagaagctgatgggatattaatggggtcagatggagcatttggagaccttacattagaagaaatccaatcggtactttgcaactgtgaacgtccacaaaaggtgatcggacggatttttgaaaaggcaagggaagcaggagaagaagataatcagacggcaatcttttacctcaagaaggaaaaagaaaagaagaaaaaagaagtcgaaatggaaatagaatttccaaaaacagatataagacaggcagttcctaaagaggagaattgctgttatacaaagctttcagagaaaaagaaaccgatatcgttaaaagagaaattattaggaaaccgttttataggagggcggtaatatgaattgttattttgaagagggcgaagtttttacctggattcgtgacagagagcggtccggcgaaaatatggtcgtatctttaaaaatgttaaaagaatgtcaccgtaccggaagtaagcaggcaatgatagcggaagatatccgaacagagaagaaatactttgtaaaggtgttgttttgtaatgatctggagcaggtttacgtagaaaaagaaagtaaagtacaactgtattctccgtatattattcggatttacggagggatgcttgatgagaaaaataaacgttttatcacattagtagaatacattgaagaaagtgatctgtccgagctgatgcgcggaaagggaatcgccggagatacctggaatgaaaagatgagagtaaggaaccgtatcgcaatgaagttcttgtacggtattgatcactatatgtctatgtatcagcaagatccaattgttcatagagatttaaaaccggagaatgtactggcttctcctgatgggacgatagtaaagattattgattttgactgggtacatttacacgcatccaacgtaacagtgatgcttcggagagaacagaaaggaaccccggggtacgcagatccaagatattggaacagttacatttgccacccggagatggatatttattctgccggtctggttctctattttatttatacggggaaacatcatttctatggaagtgaagaaataaagaattatatgataggcgatgattatgcgtatcagttaaaagagatgccgggaattgatgagcggttaagcaggattattgcgaaaatgatcgcaagagaagaagaacgttatggaagcattaaagaagtgattcaggatatgacagtgtacctgacatctgtaagaaagcttccggaacttccggaacttctgacgcagtcacaagaagagaaaacaatccgtttttcttatcggatcggcgatgtgaaatatagtccatatatgaaaaattatcgttttattccgattgaatttggaacaaagcaggaacgaagccagaatggaagaatgagtggacatatcttatccttttatcgaatggatgataagattaaagtcattcttttacatgaagactgccatattataaagcagcaaagagaaggagaagtctgtgcaggggatgtatttacctacgcaggaacaaatattgaaattttgcagattaaaagataggagatatgtcatatgaacgagaactggaatccagaaattcctttaaatttacagcagaattttaaaaaagaaaaagaacaggcatttacattatatttagattttgtagtagatgcaacagcatctatgtacaccgtatttccggcagtatattatgcggcggctcattttttagaatgtttatcaaagtatgaagtctatccgcagattggacttactttaataagaaatgaagaaaacggagaagagacagagacggttttatttgaaggaagagatgctttcacttcggatatttcagcttttttaaaaaagttaaagggaataaagctttacggaggcggtaatgatggaaaggaatctgtccataaagcaatcggaagttctttacgtaaattcccggtaacaggaagaaataaagcagtgctggtttttacagatgcctatggaagtaatgattatgaagaatatattcagtatccggtcggtcaggtaatctttttttcgacagatgaaatgagtgaggaagattttcatttttgttttgtaaagccggatggggaattagatgaagaagcctctccaatgtttattaaaattgataaattacttaagccaatgagtacagagtttttggacaatattgtaaaaccgttaaaagatctgatgaaaggtgtgtcgattggtgcataacatcatttataagaaagtgaggtgagaggcatggaagaaatagaacgtatggaaactgtcccaatgggaagcggaagtaaagagcaattatttgaaaaaggacatccggtcattcgggaattaaaaaggattccggaaatcatttttgaggagcagatcgcaatgctgccttcttccgcaatcccggtaaagtctttatttgcaagaaagcagatggatcattatcatgttgactcactgattttgaagaagatagccatgcaggtattgcacattttaagacagttatccgaatgtcatatttatcccggaattattgatctgcaggacttatatgtcgatatgaataacagtcagtatggggtcgtacttctgcatccggaaaagtttcagcttcttacatttgagcaggattatgaatggtatccggaagatgaaagaatatttggtgatgccgttttatttgatgagaagatgcagcagatagcagataatcgtctgatctacaagattcttgtagcaagtgcaaggggaaatgttaaagttccgccactaaaaacagaagcagattattcagaacttttctataacattctttccgaagaatggaaacagatttttgaaagaagagaactctgtagttatgagaagctgcagcagttattagaagactctatacaggtagaagaagaatttgccagaatgacgaaagaaagcttagatgaaaagtccgagcagaaaaagcaggaaaaaacagagaaattctatactaaaaaggaaaaggaaagcgaagaagaacagtttgctctttttgttattttaagaacagaattagacaattcccaaaaaataagcaaaatgctttatcttttacaagatgagctggaattagagaacacccttttaggacatagctgccagcaggcatttgtctttggaaatggggcagtacaggtaaagaagttccaacgatatcataaagatttccgatgtcagtttcctcaagtaatacgagattactctgcaggagaagccttaattatcgggacagatctcctgcaggaaaagaaagaagaactactactgaaaaataagggagaaaaacaacagttttatctgtatatccttatggatggcagaataaaaaacgatcagctctttcagatcgctcttacaaagcttaagaaagtcagggaagaaggcgtagaacttaaactgaggatggtcgataacatttactgtgaagcctgtcagaaactaaaagatgttgtggaggatacccaaagatgctgctaaataagttaaaacagttccatcaacagaccatggaacgatatcgtgacgaagaaaacatggaaccatggaagaaagcagtcatggaaattcatgaaaaagccacatttcttttttattatgatacaacactagaacaaaacagcagaacagcaacccttcgaattcagggaaccctcgtgaaaggggaactccccgtaggaagcgtacttcacttttatacaggggaaggcagacatgtaggaagtggcacgatattaagtgaacccgaagaaaaagaacagggaagaaaaggtctgctaaaaagacgaagaaacgaattcgaaataaagatagatacctatcttggaaaagaaacgataaagatgaatgagacacaaaaaaagaaaatgctgaagcattttgaaacccaaatatcattgataacaaatcctgatttgatggattaaagagacgaaacccagaaactttatataaaataaaatgtgaagatagtcgcggcgtagaaaatgcctgaccggcatttttacttgctccgacatcacattttattttatataaagtttctgggtttctgttctttggcgccggatggaatcaggattttgtgtggagaaaataaggggtttctccagaagattatgatttttaatcaaagaactatttcgccattagaaaatagcagtaaaagccaaagtatttcgattgctccgatttcttttaatgtaatatatttataattccgtaagaagatatcctcatctggagatttttattctaattgaaaaccatagacttctgggcaagccccttattcacatccaagatttaaatgctaatttccagttggagtcaaaaaacagaaaagcagaaatttgatatagaagaaaatgtgatgtcggagcaaataaaaatgccggtcaggcattttctatgccgcgactatcttcacattttcttctatatcaaatttctgcttttcgtttctttagtccctcaaattagcatttaatccccattctcaccaactgtagatttagaatagccagaaaaaagaaaaaataatacatcccagatgcggcttgggagcgtgtttaagatgcggatgagcatcttaaatacagcgactacagagcagataggatgtattattttttcttttttcgtctatatgaaatctacaaatcagtattgggtgttatcggaagagtgaaagtaattcgttgatatcttttccttcgctattttgtgcgagtgtcatgagctgttttaatttttcgttctgtttgccttccgagccattcataagtgaatttaagaggaagaacagagaagaatcggagaatggattttgctctgtagagggtggcgtatctgctgctgatgtggcaggtgcggatgattgcacaagctcaggatgttcagagagtatttgattatatttttcatagaatcttgaaaagttcagaatttgcaggatattatcaatttgatgggctttttcttcggaaacggaattacggacagaacgaagtatagatgcaatatcctgagagttattttcaaagccacatgcgcttagtcgttcgctgttatcaaatccttccatgattttctgcatttcagatattttgagacagagagctaaaaattttccaagattggcattacagtgaggaatgatattttctaaaatagtaagattatcatcgctaatgagacgggaaagtggggatggggaatcatttaaattttgcatggaaacctccttcaaatagaaagattcagatagaaaaattttgagaatatataggaaaactacctgaaacattttcatataatataatgatgtcagggtcaaaaggtcaaaacaccgttcgtgcttgcacgataaggtgtttgactttgggacccgcgaaatatgagaaagtagcgatttacgtagtaaatcagcggatttcgaatgtttcagaattacgggagtagcgttagctatggagtgattcgtgacatcaagttaggggcaaaatactttttgaccctgacatcattaatatgcaggtagatttatctgtaattatttcatcttatgagaggagagataggattatgaatgaaaatcttattgtagaagataatacgatttatgagatagatccggaatgtcttaagaaaaaacgagagcgggaggcaagaaaaaagagtgaagaaaaattaaagaatgatgcagaataccggaagaatcagcgataaaataagtaatagagaaagataagaaatagggataagaaataaaaaaggcattctaccggcaaaaacagtgcaggtacaatgccttttctgttagttacagtttagtaaattggtaaagaatcagcagccgcagccacatccacagccgttgccggaagtaccgataccacagccattgccacagcagcagagaatgagaatgagccagattaaattatcattaccacatccgcatccacagtcgttgccgttattacagcataaaaggattaaaagaagccagaagcagttattaaaaccaccatcgttaccacagccacatccacatccggaagaacaggaattctggcagtttgtagcagctaaatcactcatgggatttccccctgttttttgattacagtttatagtatgcatgataaaaggaatgttgctttccagtcggaaaaatttccgtaaacagaaaaaatacaggagaatttttaggaaaggtaaaagaacagaaggattggtatgtaaatatttcataaaaaatggaattaaaaaacgtttttcttgttttttttgaaaaaaatgaaaaaatggcttgttttttattcaaaaatagcatacaattaccactggtataaaaaagaagtaaagaaaagcagttaaaaccttgtttttaattgctttggaaatatattagtgtttacactagataaattatgggaggtaaagaagtgaaaccatacagagaattaagcaaagaagaattactggcattacaggaagaattacaggcagaatatgatgcagaaaaagcgaaaggtctgaatcttgatatttcaagaggtaaaccaggaaaagaacagcttgatttatctatgccgatgatggatgttttaaacggagagactgttcttaatgcagagaatggaacggatgtaagaaattatggtgtgttagacggtattccggaagcaaaagaacttatggcaggaatggtaggagcgaaaccttctcagatgatcgtacttggtaactccagtcttaatattatgtatgactgtgtggctcgtgcagaacttttcggaattatgggaagtactccttggtcacagcttgataaagtaaagtttttatgtccggtaccaggatatgacagacatttcggtgtgacagagcagtttggtattgagatgatcaatgtacctatgacagaagatggtccggatatggatgtcgttgaggattatgtgaataatgatccttctgtgaagggaatctggtgtgtgccaatgttctctaatccgggtggcgttgtttattctgatgagacagtaaaaagatttgcgaatttaaaaccagccgcaaaggatttccgtattttctgggataatgcatatggtattcattatctgtatgacagaccagaaagtgagcagccacatattttaaatattttagaagaatgtgagaaggctggcaatccggacatggtatatgaattctgctcaacatcaaagattactttcccgggagcaggtgtggcagcaatggcctcttccgaagcgaatgtcgctgatatcaaagcaaaattacaatggcagacaatcggaccagataagattaatcagttacgtcatgtaagatattttaaagatattaacggaatgaaagaatatatgaagaaacatgccgagatcattcgtccaaagtttgaggcagtattagagacattagaaaaagaacttggtgagttaggaatcgcatcctggagcaaaccagttggcggatatttcatttcctttaacgcccagaagggatgtgcaaaggcaatcgtagctaaatgtaaagaggcaggtcttgtacttacaggtgcgggtgcagcatatccatatggtaatgatccggaagattctaacatccgaatcgctcctaccttgccttctacagaagagttatcaatcgcgacagcattatttgtaacatgtacaaagcttgtaacggtagagaagcttcttgcagagatgtaatgtcggatgaattcaagaataccccggtatccagttctcagtctgcttttgatttgcacgacttgaatttagcagaatgattatgacaaaataataacagatatattaaaaagagagaaaattcaccagttagcatcaaaactgggaacttcctctctttttttgtcattaaaaaaagagtagatttttgtacaaaatgaaaaacatagcaaaaaagttgtacaaaattggatacatatattctcataagctattgtttgtgatatagttaacacaataaatttaagggtaattatgactttaacaaactagggaggtatctatgagaggagtagaaacaagaattcaggaaatcagacatgctgtatttactgaagtagctaaaatggcttatgaagagggacctgttgataaaaagattgaggcgctgccttataaaatcatacctggtgaaaccggtaatttcagaaatgacgttttccttgaaagggcaatcgtaggagaacgactccgaatggcaatgggtctgccatacagaggagcagcagaaccagcaccggtatctgatggaattatggaggcagataagccagaaggctactatactccaccacttattaacgtaattaagttcgcatgtaatgcatgtgaggaaaagaaagtacatgtaacagatggatgtcagggatgtctggcacatccttgtatggaagtatgtccaaagaaggcaatctctcttgatcgcgtaaccggtaagtccatcattgatcaggatgcctgtatcaaatgtggacgttgtgctactgtatgttcctataatgcgattattgttcaggaacgcccatgtgcaaaagcatgtggtatgaatgctatcacatctgatgagaacggaaaagcaacgattgattatgataaatgtgtatcctgcggaatgtgccttgtaaactgtccatttggtgcaatttctgataagtcccagatttatcaggtaatcaaggcaatccagtccggtgaaaaggtatatgcagcagtagcacctgcattcgtaggacagtttggaccaaaagtaacaccggaaaagcttcgtgcagccatgaaagaactcggatttgccgatgtacttgaggtagcgatcggagcggacttatgtgcaaaacaggaagcagaggacttcttaaaagaagtaccggaggaacttccatttatggcaacatcctgttgtccggcatggtccgtaatggctaagaagctcttcccagagtatgcaaactgcgtatccatggcattaacaccaatgacattaaccgcaagattaattaagaatcacacaccagatgccaaagtcgtatttattggaccttgtgcagcgaagaagcttgaagcgatgagaagaaccgttcgaagtgaagtagacttcgtacttaccttcgaggaaatgagtggaatcttcgcagcaaaagacttagatcttgaagcaatgcatgaagacgtagacggcgtcaacgatgtatccgcagacggaagaaactttgccgtatctggtggagtagcacaggctgtagttgatgtaatcaagaaagaatatccagatagagaaattaaggtagctaatgcagaaggtttagaggaatgtcgtaagcttatgatgatggcatccaaaggcaaatataatggctatctgttagaaggtatggcatgtccgggcggttgtgtagccggagctggaacaatgcagccaattaagaagtctcagggagctgtaaagatttatgctacaaaagcaaatcataaagtagctactgaaacagaatatgtaaaagaattagataaattggtagattaaacctgattagtagatttcgtgtagacgaaaaaagaaaaaataccatatcccatctgctctgtagtcgctgtgtttaagatgcttgtccgcatcttaaacacgctccgaagccgcatctgggatatggtattttttcttttttctgactgttctaaatccacagttggcaaaaatggaaattctcctttgcctgtcctttctattccctcccaaaaatcttccaacaagtttcacgaactaccaacaaacagaatccaggtctgttttcgtcaatttgccaaaagtttgttgaaaaagttaataaaaactgatactattgtcataaaaaaccgctgtttaagtatgaaaaataacgtattttacaataaaatacgataacgataaatattaaaaagaaaagaggaaaattaaatggaaaggatacagttgtagttgatccggcagttgcgccaacagaaacaacaccggggaagacagaaggagaacactgttctgcatgtaatacggtattagtagcacagaaggtaatcccggcaacaggaaaacagctttctggaaatgataagccaagtactggaaatacaacaccacaaccacagcaaccaacacagcctgctaaagtaacagataagaaatccaaagcagtatataaagtaaatggtaataagacagttgaatataataaagcaaataaaaaagcgaagaaagcaacggttccatcaacgattactgtaaatggagtgaagtatcaggtaacatccattgcagctaaagcatttgccaacaacaagaagttaacaaagattgtcatcccggcaagtgtaagaagtattggaaaacaggcattcagcggatgtaagaatcttaagagtattacgattaagacgaagtatcttacaaagaaatctgtaggtgcgaaagcatttaaaggaattcatgcaaaagcaacgattaaagtaccaaagaaacagaagaaagcatatcagaagttcttaaagacaaaaggaattggaaaaggtgtgaaaattaaataaatgatgcagattagtggaaagtgtaagaatgccccggcattcctgctgatctgcaggatttagagtacaaaggaaaacgatatatccaggatgctccttcaaagagtgttaaaaatgcaggtgagtatttttaacacagaaaggaaagagcagatgggatatagcgttttccttttttcgtttatactaatttttgtttatgctaaagggttatagcttaaaattcattcttaataattattaagtagccagagaatgtttttgttatgtataatgaaaatgtgaacattcttttaatttatgataatgtttgatgatttttcaaagtaattgtgatatcatataaaaagtttcaagtgactatcttaaagctttgccaggctttttataaaggatgtgttctcagagttcttagtacatttgcttttatggatgattttttactaacgtatgtattgcgtatacctcaaaatttgaggcaggtctgataagaatcttccctcagatcaagtacaaagattccgagagtatgtaagagtatttaggaggtaagtatgtttcggaagaagaatgggcaggagtttatggatgagctgaacgcggattcatctgtgaatgataaagaagagaaaaagggatttttccacaggaggaagaagaaagagattaatctatatgaagatgatatgggctatatcgaggaggacggtgatttttcagaagaagaatatgataaagaattagatgagttacaggaagatgagaaaccggaaaagagaaagagaagattttggcatcggaagaaagaagatacaccggaagaagctcagacagaagatttagcagaggaacatcatgatgaagatggttttctcagtgatgaggatgcgattattctgcaggagccggaaaagaagaagttttctaagaagaagctggcgctcatctgtggtacggcagcagtcatagtgatagctgttgctttttttgttattcggaatatgggtggtacaagcgaaggaaaggcgtatgtagaatctgttcgtgagattacaggacttggaacggctgccggggcgaataaccgttatacaggaacggttgatgcggagagttcatggaagattaatttacagtcggatatgtctgtagagaagcgttatgtgaatgttggcgatcaggtgaaaaagggagataagctgtttaaatataatacacaggagctgaagctttcaaaagaaaagaaagagctggaacaggagactttacagaatgagattaatcagttgacaaaagacatcagttcctatcagtctgatttgaagtctgcaagtgctacggagaagattcagcttcagacgcagattttaacagcacagactacgattaagaaagatcagtatacgatcaagacgaataaagagacgatcaagacattagagaagaatattaaagatgctacagtaaagagtaagatgaatggtcttgtaaagaagataaacagttctctggaaagtagttcttcctcaggtgatgacagttcagatgatggttcagattccggagatggaagttcagatgattctacatatatgacaattcttgcagtaggtaactaccgtattaaaggaaaggtcagcgaaacgaatgttaacagcctgaatgaaggggatccggttattgtacgttcaagagtagatgattcccagacctggaaaggaacgatcagcagtatcaagacagatgctactgcagatgattctaccgagagcagcgatgagatggcttacgatgattcttcggatggtagtacaggagagactgcatcaaaatataatttctatgtgaagctcgatgatgataatggcttaatgatgggacagcatgttcttgttgaaccggataacggccaggatgagaagaaggatggtatgtggttgccggctgcctatattaagaagagtaatggtaagtattatgtatggctggattctcataataagctgaagcttcaggagattaaagttggtgagtatgatgagaatcttgatgagtacgaagtgaagagtggactcaagacaacagattacattgcttgtgatgatagtacattaaaagaaggtatgcgggttacaagagttgctccggaagatagtacttctgactacggagaagaacagacaagcgatgatgccgaaacatttggagcggatgattatgattcctatgaaggagatacttctgattatggagaagatacgtatgacagtgggtatgatgaaagtatagatgacggcacagatgcaggggatgatagtttcgatacaggaagtgacagttcagatattgttgatgatggaacgagcgacagtgatgttgcagactttggagaatagagattctctatcagaaaggacatacagcatatgcttttagaactaaaacatatttataaaaattatttgcaggataagattgtcataccagttcttaaagatgtgaatatctctattgatgagggagaatatgtggcaatcatgggtccttccggatcaggaaagacaacgttgatgaatatcatagggtgtctggatcgtccgacgaagggagaatttcttttagaaggggagtctattgtagattataatgaaaatcgcctctcagatcttcgattaaatactttaggattcgtattccagagttttaatcttctgccgaagcagaccgctcttgataacgtagcacttcctttaagttatgcaggcataccggtgaagaaaagaaaagagattgcttttcaggcattgaaaagagttgggctggcggatagagtacatttccgtccaagtcagctttccggtggacagcagcagcgtgtggcgatagccagagcacttgtgaataatcctaagattattcttgccgatgaacctactggagctttagacagccgttccggtattcaggtaatgaatctgtttcagcagttaaatgaagaaggtgttacgattattatgattacgcatgatgcgaatattgccaatcatgcgaaaaaagtacttcatatttttgatggagagattgtagaagataaagcaagaaaagagaaagaaaaacaacagtccgaaattcggagtgaggcagcagaaagtgtttcatcagaattagaaaaagatttcggagtgaatgcatgggaaggagagatctgatttgaagggaaagaagaagatactgcttgctgtagttttagttctcgttatggcagtgggaatcacttccattgttgttataagaaagagaaataaaattgtagtaaaagtattcccggtaagtagtctgaacagttctgactggtttgatacagatacttctcttacgggaacgcttacttcagattttatacaggaagtacatgtttccggtggacaaaaagtaaagaagatttatgtcaaaaaaggtgacaaagttaaaaaaggcgatattcttttgaagtataatgttgcggaaaaagaactggatttaaaacttcagaagcttcagattcaatcgtccaagttggaaattgctgagatggagaaggaattaaagaagcttaaaaatacaaagacagttggttcgatcaatacgggaaacagcagtgtgatggatgcatctgttaatctttccgatataaagggaacaagtcttcgttaccttatggcagaggcggaaagtgatggaactaccgcagtgagcaattcgaaagccgcgaatgagtcagatggaaacagtggttccgaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgttaatctttccgatataaagggaacaagtcttcgttaccttatggcagaggcggaaagtgatggaactaccgcagtgagcaattcgaaagccgcgaatgagtcagatggaaacagtggttccgaaagtggttccggaagtggaagcagcgccggctctgagagtggttcaggaagtggaggcggctccggctccgaaagtggctctggaaatggaggcagcgccggctccgagagcggttccggaagtggaagtggctccggctctgagagcggttcaggaagcggaagcggctcaggaagtggaagcggctccggctccgagagtggttcaggaagtggaagtggctcaggctccgagagtggttcaggaagtggaagtggctccggctccgaaagcggttctggaagtggaggcagctcaggctccgaaggtggttctggagaggaatcaggaaaggatgatgcgaaactttccttaaaatccagtgtgaatgatatttcagataaagcatctggtagtggcacagaaaaagatccgtatatatttaatttaacaatggatggcaaagtaaaaggttcttttattaagaagttgattactgatggcagttatgcggaatttcgtgcttataaatcagaggaagcaaaaaaaccatcagctacctttgagcttgatccaagtacgaaagtgaatgtttatgcagaagatggctatacggtcaatcagttaaatgaaggtggagatacaaaaactcttcataattctattgatctggttagtgaaaaagatgcatctagtggaaatggaagttccgccggaaatgcctatatttattatttgaatgtaaatggactggtaaaaggatctgtaatttctagtcttcataaagagaataaatatgctacatttatcgaatttgatgagaacggaaaagaaaaagatcgatatgaatataatccttctaaagtttttaaagatctcgatgaagatgaatattatactgtttccaaaggaaaagaaaaaagtctttatgatctgaatgaacgggcagcatacaaagatttaaaggcagaaagtctggaagatggacagcaggatgcagatggaaagtatacattctatttgcctaaagatggaaaaattagcggcgcactgattaatgatctgattaagaaggggttaacagcggaatttatagaatatgcttccgagacagattatgataatgaaaatacagaaaatgcaaataaattagagattacacctgacagtaagtttacagtggaacttgcagatggaacagggtatacgatttcttatttaaagagtaaagtaaagaaagaggattcagcggctacaacaaccgagaataaaggaaatactgttccaacaacaaataagacaccaacgccggcggcagataaggagatcaagtttaaacagaatcgaaagaaagtaaaagcgggtaatggctatctcttttctgtagtgtctaaagatggaagctggggaaatggagaggatgaccagagtaaggttacatggactttatcaaataatatttcaaagtatacaagtattgagaagacgaagtctggtgtctggttatatgtagatgaaggagaaccgtcttcttctattacacttactgcgcaggttaagaatgtaaaaggtatttctaaaactaagatatcaagaacgttggttgtgaaagaagcggacaccagcggtggagataatactggcggagacggcggtgatgatggagatggcggttctggcattgacgatggcagtggagataatggcggtgatgatggcaataattatactgcagcagagttaagggaagcaattgccgaaaaagaagatgaaatttctgaagccaaacaagatcttcatgaagcgcagattaactacaatgaagcaaaagcagaagtagataaagcgacagttaaggcaaagattgctggtacggttactacttcatgcgataaaggaacggttcctacagatggttcggcggctatcgtagttaaggcagcagatggaatgtatgttaagacttcgattagcgagatggaacttagcaatataaaggttggtggaacgatcaaatgtgtatctagtgatacaggagatgagtataccgcagaagtaaaggaaatttcggatttccctaccggagacagtagtaatgatggaggaagttccaatccaaatagttcttattatccggtcattggctttattaaagatgcagatggtttgagtccgggtggttctgtcgaagtttcttatagttcaaagtctatgggaacagcgaatgataatgcaatctacattcagaaagcatatatccgcacagaagacaaaaagaattatgtttatattcgtgataaaaagacaaagcgtctgaagaagcagtatgtcaaagttggaaagactatgaatggccagtatatggaaattatatctggactgacagatgaagataacattgccttcccttatggaaagaacttaagagaaggagttaaaacgaagatttccgaagatgacagcgaaatgatttattaaggaggagaacgatgcttgaaaatataagattatcttttcagggtgtatggagtcacagactgcgttctttcctgacgatgctgggcatcattatcggtattgcggcaattattgccattgtatcaacaattaagggaacgaatgaacagattaaaaagaatctgatcggttctggtaccaatacaacaacagtacagttaacagaaagtggaaactatccagcagaaatggaatatggaattccgaagggaattcctgttcttgatgatgccatgcgtgaacagttagctgagctttcccatgtaaaagatgcttccctttatatgtcacgtacacaggtagattacatttactataattcaacagtgctttccggtgggcagttgatcggggcagattctcattatcttggaacctgtggttatgtaatgaaaagaggaagaggctttacggagagcgattatgagaagtatcgtaaagtagcagtagtagacagtgtagcagccgactctctttttggaaacgagaatccggtaggaaagaccattgatataaaaggagagccatttattgttgttggtgtcattgaagagtctaccgccttcagcccggtaattaattctgtagaggattactatacttatgtatataacgacggaagtgcgagtggtattgttgtaattcctgatgtggactggaatattgttcagcagtatgatgagccacagaatgcaaagctgctggcagattctacagataatatgacatctgttggaaaagccgcacaaacattattaaacgaaacggtaacgaataaagatatcaaatatcgtgcggcaaatatgaatgagaccgcagaagaaagtcagcaggtaagcgcaacgacaaataaacagttaatatggatcgcaagtatttcattattagttggtggtatcggtgttatgaatatcatgcttgtatctgtaacagagcgtacaagagaaatcggtttgaaaaaggcgatcggtgcgagaaagaatcgaatactggcacagtttttaacagaagcggcggtactgaccagtcttggaggcatcattggtacgattaccggtattgcgttagcagaagttatcggaaagatatcaaatgttccaattgcaatcagtataccggcagttattctggcaattgcattttctacaataatcggagtagtatttggattgcttccggcagtaaaagcagccaatttagatccaatcgttgcattacgtcatgaatagtgttatcatacataagttaaaatatgcaaatgaaactatgagaatatgtagaacgcgcatatctcagcaagaatgccggggcattcttgaatcttggatatattaaaaaatacaggaataagatgtaaaaagaacaataagtaatagctgataggagaagagaatgggtaagtattttggaacagatggtttccgtggagaagcaaatgtaaatctaacagtagagcacgcatatcaggtaggtcgttttcttggctggtattatggtaaagataaagaagagaaatgtaaagttgtaattggtaaagatacacgtcgttcaagctatatgtttgaatattctttagtagcaggacttacagcttcaggggcagatgtatatttactgcacgtaacaacaacacctagcgtttcttatgtagtaagaacagaagattttgactgtggtatcatgatttctgcaagccataatccatactatgataatggaattaaactcattaattctaaaggcgagaagatggatgaggaaacaatccttaaagtggaagattatattgatggtaagttagaaattccgatggcagtacgtgatcagattggatgtacagttgattattccgcaggaagaaatcgttacatcggttatttgatttctcttgcaacacgctcttataagaatatgaaggtaggattggactgtgctaatggaagttcctggatgatcgcaaagagtgtttttgacgcattaggagcaaagacctatgtaattaatgcacagccagacggactgaatattaatatgaatgccggttctacacatatcgaagtgcttcagaagtttgtaaaagagaatcagcttgatgtgggattcgccttcgatggggatgcagaccgttgtatcgctgttgatgagaatggaagcgttgtagatggagacctcattctgtatgtttacggcagatatcttaaagaaaaaggtgaacttcgtaataatacagtcgtaacaacaattatgtcaaactttggattgtataaagcatttgacgaacttggtgttgattatgaaaagacacaggttggagataaatatgtttacgaaaatatggtacagaatggacatcgtatcggcggtgaacagtcaggacatattattttcagtaaatatgcaacaaccggagatggaatccttacagctattaaggtgatggaagtaatgttagagaagaagcagtctttagcaacattgacatcaccggttcgtatttatccgcaggtacttaagaatgtacgtgtaaagagtaaaccggaagcacagaatgatgctgacgtacaggcagcagtaaagcaggttgcagaaacactcggagcaacaggaagaatccttgttcgtgaaagtggtacagagccagtgatacgtgttatggtagaagcggaaacaaaggaagaatgtgaaaagtatgttgattcggtaattgaagttatcgagaaaaaaggtcattgtgcataaagtttttacttgaatagccattttgccaaaaactaaaataaataagcatgatataataactgcgccttagagcaagcgatggatgcagcgcatcatcgtgcattgacaggaggcagttgttatatcatgcttttttgtgcgtattgtttaattttttatctcagtcgagaagactcccacctctttcaggtggtgagtgacagcaaatttgtctcagtgggagtccaatctccgactgagataaacgctccgcgaggatgcgcagtgattctgtaaagaatatgtcagcttacgctgaccagaatcacgcgccaagtctcgcggctgctcgacttgaattgactataattgctgctatattgcattatggaatggatgttgtgggattttataaagcttcataaaagctctatagaatttcatcttgaaattttatttttgatgatgtataatatgtcagaacaaatgtttggaaaaaggagactgctcttgcatctgtttgcagattgctgtaagatatcagatgggagatgactcccacctctgcaggtggcgagcagcaagtttgtatcatatgttatgttagaatttcctggagagattttaattgactaaagatagtatttatttatcaggagaataatcatggagaatataacaattaaagatattgtaaaggctgccgaaggacagcttttatgtggagatgagaataaagtaatcaaggagttttcaatcgattcccgctccggtaacgaggatagcatttttgtaccgattatcggggagagagtggatgcacataagtttattgatggcgcacttaagataaatggggcgacgtttacatcagagcatgataagccgttaactggttttgaggacaagccatggattaaagtggcagatacagtagaagcgatgcagaaggtaggaacattttacagaaatcgtatgaatcttccggttgttgctgtaacaggaagtgttggaaagacaacaacaagagagatgatcagcacagcattagcttcacagaagagggtattccagacgatcgggaatcagaatagtcagattggtgtgccattgactctttctcatcttacagcggaagatgagattgccgttcttgaaattggcatgagtgaaagagggcagatcgagaagcttaccaatatgattcgtccgaatatagcagttgtgacgatgattggagtaagtcatattgcacagttgaaaactcaggagaatatttgtctcgagaagatggatattgtaaaaggacttccagaagatggtatggtctttttgaatggggatgataagttccttgcaccatatcgtggaaagctttctcacagaacatttttttatggattgaataaggaatgtgattatcgagcagaagaagtacgtgtgcgggatggacagaccctgtttcatttttattataaagacggcgaagcagagaaaaatatggaagttgttcttggcactatgggagagcataatgtacgtaatgccttagttgcattaggtgtcgcacatcagatgggacttgacatggaagtggcagcgaaggcacttagtactttccatggacagcgtcagcagatgcatacattaaagagctgtacgttgattgatgatacatataatgccagcccagattctatgaaggcaagtatttcggtactttcttctatggaaggtgtgaagggcaggagaattgccgcactggcagatatgcttgaacttggagaaaaagagagagaatatcattatgaagtgggtaagtttattgctggaacacaggtagatgaagttgctgcctacggtgaactttccgaagaaatattaaaaggtattgaagacaataatgcgagaattgttgtaaagcattttgagacaagaggggaattacaggagtatctcttaacatatgtacatccggatgacgtacttttattaaaagcgtctaacggaatgaagttaaaagagatagcagaagcatttttacagaatgaataattttcaggaaaagggagctttacagatgaagatatatataatgagacatggagagacaaagtggaataagaggagtaagcttcagggacaggttgatattcctctggcacctaaaggtatcgagcaggcgcagatgacagcagaaggaatgaaagagattccttttgatcatattttctccagtccgttaaaaagagcgtataaaacggcacagattgttcgcatggatcgtccgatagagattgtccgcgatgaccgtctgaaggagatgagttttggaacgtccgaaggaaagtgtatcgggaagattatggagaatccggcaatgacacgctatcagagattccgtcttgatccagaacattttcgcccggcaaagtatggagaatatttccaggatgttttaagacgaactgacgaattctttaaagaggagattgttccattagaaggaaaagcagagaatgttctcattgtggcacatggctgcgtagtcagaagttttatccttaatttgacaggacgttcccttggtcagttttggaagacaccttttggaaagaattgctcttcggtggcatttgaatataaaaatggtgaaataaatatgatttatgagaataagttatattatgatacagattgtcctgactggcagcaacagattccttcctataagaaaggatatagaaagtaaacatttataagtggatatttacaggtgaatatctatgagaagatatgtataaaggtaagtaattataataaaattgtgaggtatttatgggagaacagatggcatataatgcgaatagcattgcagttcttgagggactagaagcggtaagaaagcgtccgggaatgtatatcggaagtgtttcaaccagaggtcttaatcaccttatttatgagattgtagataactctgtagatgagcatctggcagggtattgcagtaatattcaggtgattcttgaagaagacggaacggcaacggttcgggataatggacgaggtattccgacaggaattaataataagacaggaattccggcagtagagatggtatttactatgttacatgccggaggtaagtttggtacgggaggttataagatttccggtggccttcatggagtaggagcctccgttgttaatgcactttctgtctggcttgaagtgaaagtacagtcagatggtaaggtgtatcagcagatgtacgagagagggaaagcagtagcaccgttggaagtcatcggcaagtgtcggaaaggcgatacgggaacgagcgttacttttttaccagatggagaaatatttgataaaacatactttaaggcggaatccattaagagcagattacatgagactgcttatctgaatcctggattatctattacttttgagaatagaagaccaggagaagaggaaaccgtcctttttcatgaagaagaaggattaaaggcttatgtcagagatttgaataagggaaagccggcagttggtgagattgtttattttaagaaaaaaatcgatgatattgaggtggaagcagcttttcagtatgtagatgaatttcaggaaacgattatgggattctgtaataatatctgtacgatggaaggtggaacccatattactggatttaagacaaagtttacgtctgttatgaatcagtatgcgagagaactgggaattttaaaagaaaaagataagaattttaccggtacagatgttcgtaacggtatgacagcagttctttctgttaaacataaagatccaagatttgaaggacagactaagacgaagctagacaatccggatgccggaaaagcagttagtgaagtacttggggaagaactgacgttatattatgacaggaatttagaagaactgaaaaaggtgattgcctgtgcggaaaagtctgcaaagattcggaaagcagaggagcgagcgagaacgaatctcatctcgaagtccaagttttctattgatacgaacggaaaactggcaaactgtgagagtcgtgttccggaagagtgcgaagtttttattgtagagggagattctgccggaggttctgctaaaacagcaagaaatcgccgtacacaggcaattctgccgattcgtggaaagattcttaatgtggagaaggcatcaatggataaagtgcttgctaatgcggaaatcaagacaatgatccatacttttggatgtggattttcagaaggctatggcaatgattttgatattaccaagttaaagtatcataagattgttattatgacagatgccgatgtagatggagcgcatattgcaacattgcttctgacatttttctaccgttttatgccagatctcattcatcagggacatgtttatctggcaacaccaccactttataaagcaattccgaagcggggaaaagaagaatatctttatgatgatagagcattagagaattatcgaaaaacacataagagtaactttacgctacagcgatttaaaggtcttggagagatggatgcagagcagctttgggaaacaacgctaaatccagagacacgtatcttaaaacaggttgagattgaggacggaagacttgcatcagaagttacatcgatgttgatgggaagtgaagttccgccgagaagagagtttatccatacgcatgcaaaggatgcggatctggatttatagaataatgtacgttcggaattttttcttgtaaagtcaaacaaagaaagatttcgaaagtacataataaagaaacggagagaaatatgtctgaacagattataaaaacagaattttctgatattatgcagaagtcttatattgattatgcgatgagtgtcatctgtcagcgtgcccttccggatgtgagggatggcttgaaacctgtacagcggagagtactgtatgcgatgcaggagttaggactttctgccgataaaccgcaccgtaagtcagcacgtattgtcggagataccatgggtaaatatcatccacatggtgacagctcaatctatgaagccttagttgtaatggaacaggattttaaaaaaggaatgccccttgttgacgggcatggtaactttggttcgatcgagggagacggagcggcggcgatgcgttacacagaagcaaagcttcagaaatttacacaggaagtctaccttgcggatatggacaagaatgtggtcgatttccagtcaaactttgacgaaacagaaaaagagccggtcgtacttccggttcgtatcccgaatcttttgattaatggagcagagggaatcgctgtcggcatgaccacaagcattcctccacataatctttctgaagtggtagacggagtgaaagcttatatggataatccggatattacgacagaagaactgatggaatatgtaaaaggaccggattttccgacaggtggaatcgtagtcaatcagaaagagctaaagaatatttatgaaacaggcagtggaaagatgaaacttcgaggaaaggttcattttgaaaaagcgaaaaagcgctcagaaagagacaagcttgttatcacagaaattccatacacaatgatcggtgcaaatatcagtaagtttattgcagatgtggtaggtctgatcgagaataagacaacaagtgatattgtggatgtttctaatgagtcttcaaaagaaggtatccgtattgtattagaacttcgccggaatgcagatgtagagcgccttgagaatcttctatataagaagacgagattagaagatacttttggggtaaatatgctcgctattgcgaatggaagaccggaacttttaagcctgaaagatatcataagctaccatacaagattccattacgaagtactcacaagaaagtatgagacacttctgaaaaaagaattagaacaaaaagaaattaaagaaggtctgatcaaagcaagcgatatgattgatctgatcatagaaattcttcgtggcagcaagagcttaaaagatgcaaagagctgtctgattcatggagaaacagacaatattacttttaagacacagaaatcgaaaaaagaagcttcaaagctttgttttacagaaaagcaggcttctgctattcttgagatgcgtctgtatcgactgatcggtcttgagattatggcattacaggaagaatacgcagaaatccttaaaaagatagataaatatcaggatattttagagcatccggcttccatgaagaaagtgatgaaaaaagatctggaaaaaatcaaaaaaatctatggatttgaaagaaaaacagaacttaccaatgcgaaggctgcagttgtaaaagcactgccaattgaagaaaaagaagttgtatttgtcatggatcgtttcggctattctaagattcttgataagagtacgtacgagagaaatgaagaaaccgtattaaaagaataccgtcatatcgttcactgtatgaataccgataaagtctgtgtatttactgatacaggtgtgatgcatcagataaaagtgcaggatattccatcaggacgactccgggataaaggaactccacttgataatattgggaattatgacagtagaaatgaacagattcttttaattgcaccggatcggacattaaaagaatcctccttattatttgttactgccgcatccatggtaaagcttgttgatggagcagaatttattgtacagaaaaagacagtcacagctacaaagttagcagaaggggatactttaacagcagtacgtattgtcagcgccaaagaaagtatcactaatgcacagatcattatgcagagtgaagaaggatatttccttcgttttccattagaagaagtaacaagaaagaaaaaaggagcaatcggtatccgcggtatgaagcttcaggagcaggatcatgtcaagcacatatatcttaccggagtggaagaggaagataccccatctattatttataaagaaaaagaactggtatttagtaagatacgactcatgggaagagacggaaaaggagtcaaggtaagaagataggacttgatttgtagatttcgtgtagacgaaaaaagaaaaactaccctatcccatctgctttgtagtcgctgtggttaagatgctcatccgcatcttaaatacgctccgaagccgcatctgggatagggtattttttcttttttctgacaactccaaatctacagttgatgagaatggggattaaatgctaatttgagggactaaagaaacgaaaagcagaaattagtatttaaatcttggatgggaataagggccttgtccagaagtctatggttttcattggaatgaaaatctccaaatggggatatcttcttacggagttataaaaggtgttataatgaaagaaattggagtaataggaagactttggatctcactgctattttctaatggcgaaatagttctttgattaatcataattttctggggacaccccttattttttccacacaaaaccctgcttttcgtctgtttctccttacaatcaggatttaaaaatatcatacggttgcttctattaaagttttaccatttaaatggagttcttttaccccaatttttttatttttattaaagttaaaacttaacatatatcctttatcaaaatgataataagagaggtaatcccacaattgtttttcgcctcttgtattataagcatcgcctctccatatttttagttcaataataaattgttcacctaaataatcaacgataacgtcggttctttccatatttcttgtacgagattctatataataatttcctgtaccgttgataattggtcttaaatataataaaaaatatcttcttccatcctcttcaataaatttctctgctttatctccaaataaatcattaaaatgggtaacaaacttttcaagaactaaacgcatatttaaatgaccatggttaataaattgatttttatctagtaagccagctttcgctatgttactgtttatagcttcttctgctagaaacaggttatataaaacggtttcaaaaattctatttgataccattacctgtccgtcattatttttaataaaaccaaacatttcagctgcttctatagaaggatttaaagagttatacaggatggtttttccattaaagagtaattcatatattatttcatgaagctgaggataatcttgaatcttgtttaccagagattcaaatagagtatttttttcgttaagaagaagtttgacggcttcaataattccagcttttgtccaggcatccgttttttctggaaagtttttacttccagcaaccctttcatcaattaatttgcaaagttttgatacaagaaatggatagcctgctgtgtaatcataaattaaattagcagatatttcggtattcattcctgtatgataatctgattcatattcattgagcattccctcaatctcttttgcagagaagctcatatcgaccaagaaatctgccgcaatattccagggactatttcttcgaggctctgctccattttcaaacttttgttttaaatttttaatatcatatacacttgataaaatcactgattgaaaagttggttttacatctcggttaatgtagtagcctctgatttgtgccagaaagtctaaaaatatctgattattagaagcattatccacttcatctataattaaaataattcctttagaagaaataccgcaccatttcgaaaggattctaaaaagcattgataacgtagttcttttacctataagattatttagatcatcactgattttgtttggaacttcttcacaagcatccagtaattcgctggaaaaagcatctacaaaagccatttctgtagaaaaatctgctgagctaagcatctgaaaatcaaggctgattactatatactcatctttcaaaaaagcttgtaaggctctcaaagttgtcgtttttccatattggcgagcacgatttattgtgaaatactgtccagcatctaccatacgtttgatctgttttaatttttctgtaatgtctaccatatagtgttctttcggtcgacaaatggcagttgtattaaaatattttggcatgctttaaatctccttcctcaaagtttattatattataacataaatactatttaattcattagagaaaacagacgaaaataaaaagaatagaccattgcaactgtaaagatatcactgcgtagaaaatgcctgttcggcatttttacttgctctcaccttacatttgcaatggtctattctttttattttctgtttgttggctccagaaggaatgaatgcaatagtctttggggagggataaggggaagaggtcagaagtctactacttactcggaaaatatttctgtcatgaaattttatttacttactctctccactatgttgactttttttcaagtttcactgatgataaggcgatttctttacttttttgtaaaatgataggccctttttctttactgctcgttaaagaaaggaaataatcttctggatgatagatcttccgagcaagcagtagtatttcttttttcgtctgtttctccttaatgaattaaatttttgtcacatttggtcttcttaatgcgttactatagtagaagcacttgtacaggggcgaaattaaaagaagcaggaggaagaatgattgcttggaagtttaatgacttactgtaaggaagaagatggagaaactttagaacttctctatcgtacatataaaaataaaatgttttatattgcgctgaaattgttagaagattcatcggaggcagaaaatatagtgcatgatacatttctaattttatcggagcatttaggacaaattggtaacataaaggataaaaaaacctggaattacattgttactatattaaaaaatcgctgttttgattggatgagaaaacagaagtattataaatatgcagatgataaagaaaatttcaatgtagaggaaagtttagatgcaaaggagaatatttttaaaaatcatttggaagaggaaattatcatcagggaaaaacaggaactattgataaagttgatcatgaatctgaaatacccttataaagaagttttatatttgcaatattataacgaattagggagtaaagagataggggaaattctttcaataaagccggataatgtgcgaaagatagccagcagggcgagaaaaatattgaaagagaaaatgatagaaatggggtatgggagatgacagataagaagtttgaagaattgttgaaagaagcagtggaacagtgtgctgaaaaagaatgggaggagatcagccaaaagagcaaaaagattcggtataagccatctaaagagtttgaagaaaagatggaaaaattatatcaaaaagagagttgtcaaaataattttatcggagatgagcagacaaaaagtaaaagtcagttaaaagatacaaaaagtgaaaaaagatattttcatatgggaaaaggaaaaaagagaattattttagttgcggctttagttgcggttttactctgtggcagtgtatttgccaaggaaacaatccgggagtggagaagcaatcttattgtaaaacaggaagaagatggtttacggattgaatatggtggaaaagaaaaggaagataccagggaagatagcaaaaatgcagttttgcaaaacgaaaagcaatcagaaaacaaagaaaatgagaaaataacagcaaatcagaaaaaaacaattgattatagtgtaccagctaagtataaattaaagtgggttcctgaaggctacaaaaaagagactgaaaacagcgatgagaaagatctatactggtattatatgacttatagtaacgaaaaaggagatttgatcatatataatcagcatgatgcagattatgtgattcagatggcttttgacaaacaaaaagacaggaaagaagaggtttctgtttgtggtgtaaaaggaaaatactttacgcatgaagataaaggagtcataatctatgaagtaaatggagttacatatacgatacaaggtgctgtatcaaagcaggagttaatcaaaatgctggagaacagagaaaggatagggtgacttctaaacaaaaaaatatccccaccattgtggagcagcactccacccggtggggatatttttttgtcattaacaaataaaaattgatgaacgctatattaataaacgataacagggaatccttcttctacatatttataaaggactgcggcagtagaatatggacagtttacacatccatgagaaccgttgcctctgtaaatagaaccgccgaaagaagaacgccatgttgcatcatgaagtccctgaccaccattaaatggcatccagaagcttaccttagaagaataggagccgccgcctgcattaggaccggttaaagttgcgtttcgctgtttgtaagtgagcgcataaacaccagtgtaggtctgatgtccttttgttgggtctccggtaacaacggaggagtttactttacattctccgtttacgaagagccatacttcctgattagaaatacttacttcaacataagagttaccgatatcatttttagcagattttctgcatcttgccttgtaggaatatacaggttctctttcaacatcttttccggattttagttctttgatcaactgggctttttctttatcgaagtagatcttccatccatagtcaccaccgtatacattgattttagaaccgtaggcagttgtgaaaggacgggaagaacccatcgtattatatttagaaccgagtttttcgatatagtctccaaccttactttcatctaaagttactttaaagtctttggaaatcttaacccaattcttggatgtattgtaatcaagagtttcctttgtgtagtcaaaatcataggtgatcgtgccgctggcgtacttattcgctttggcaagtgcatctgtcacagcctgatctttcgcatagtattttggaagcttgtaaagattttctttttcaagatcaatctttgtaataccggtagataagtcagttccgattaactgaagcaatgctttctttttcacagtgtttccgagaacttccggaacaatctcaaactggctgtctcctgcttttatgtaagcactctttggtgcgattacattctcttttttgaaacattcaagattatttacaacttcctttaactttgctttatcataagttacatctaatttaacggtatatttcttttctccaaacaggtttgtaaaccataaccatggattcatggaatcatgaagattggtaatctgactgccgacattgattacggttccgacatcattcgcatcaatcacttcagtacgttccttttcttttaaggaaatcttatgtgatgcaagatcatctgtaaatgctttctctgctgctgcggtatccatctctccgacttttacgtgattgattacggtattatgtggaaaatgactggaataatagtaaacaccgccaccgtaaacagcgattagaagaataagaataacagctgcgatgattttacctgtattagaggctgccttcttattactgcggcgatttcttgttgtattgctgccagaagcagcatttgttggttgtgtattatcactcattcgttgatattctcccttctcaaaatagttttgttaaaaaatttataaagatcaagtaacaaaacagtatcattataatacatttcacaagaaaatgatattaattattcttaaaattctattacaaatcccaaaatcacattgtttggataagactaagaaattctttgatctgatttggagtacgcttacttaagcttgagttatgaaagcgggaatccatggtaacttccggaccaaaccaggaaggtgccgtataagcgttggcatgctcgatatcaggaaattctacttctgccatacaaaatccgctgtagtccccttcaaatacatctagttcaatcagataagggggatctggaatcttatagcgttttttttcaatagaaatcccatctttttttgtaagaagatgtgtaaaagattcttctgacaggggcatctcaacttcttctcttgcaagaagaccagaagattttaaggttaagatatagtctgtattcttttgtctgacacgtatgaccggttctgtagaaatataggcctgtgttaaagtgtcacaagggtaatgattcaggtcatcaggtaaagattttattaaaaactttctttcgatttccatttcaattttcctttctaatcagatgaattattataataataacaacgtatttttatatgatagcatatttttcaaagaaataaagtgaaaaaagtatgaccaagcttgataaaaagaggtaattaagctacaattaaggttaatgaatttatcataaagacaaaggagggcttatttatgcgttcagtatatgtattttgtgccgatggttttgaagaagtggaaggcttgacggcagtagatttattaagaagagcgggtatcgatgtgaaaatggtgtctattatgggcagattacagataacaggctcacataatatttctgtgaatacagatattttaatagaagatatcaaggaagaagcggatatgcttttactgccgggtggaatgccgggaacgaattatttaagggaacatgaaggtttagcagatcttttaaagaaacaatatgaagctggaaagtgggtcgcagctatctgtgcagcgccatctgtatttggcggtcttggttttttgaaagataaagaggcaacaagttatccaggatgtcttgatggtattccggttggagtatataaagaagacccggttgttgttgatgggaatgtagtaacgagcagaggtgtagggactgcgattgcatttgcgctgaagcttattgaagtattaatcagtaaagagaaggcagaagagattgctgcttctatcatatactcagcgtaggaggaagaagatgcagcaggagagtaagattggatttttgtggcaatatgtgattgcctgtgtccatccgtctcagtataaagaactgatcaggaagaaaaaaggagcgtttattggatatatcagtgttcttattatgtttcttgtttttatagagaacgtgattccgtttgcagcatggacagcgagtgtgggaggatttgagaacctgtttttagagcgtattcctggatttactttagaaaaaggagagttccatagtgaaagcccgattgattttaccataggtggtgtggttcgtgttaaagcggattcatcggtagaacaatttaaggagtccgattttcaatcagactatgtacaggagcttttggttggaaagaagaatattttgattaaaatgccaagtgggaagcaggttatcagtctttctcagtttaaaaactggaggcttaataaccagggtctggtggaaatgctgccagcgctgtatatgttcctggcattttatctggtagtgctgctcattacgaaggcagtacagtatcttcttgtggcattggcatttgccttgatctgcaggggaagtgtccgaagaagtgatgggaagatggtgtccatggcagaatctttttatattgcagtgtatgcaagaacattggctgcaataatcgggagtgtgaatgcggcgcttggatataggatagatagtatgattcttatgatcgtgacagtatttattacgatgggatttatcatgcgtggagagatttctgtgctggatacacagacatcaaaggaataatgagtgtaaaagagttcataacgaacttgaaaagagacgaatcagtaatctgttgagaaatcagcagagaggtttaaggaggaatttgttatgtcaaaggttattatggttaccggcggcagccgaagcggaaagagcgtgatcgcagagcagaaggcaaaggaatatggaaagcgcagtgttctttatcttgcgacagcgattccagtcgatgatgatatgaaagaacgtatccgtatccatcaggaaagacgagattccgaatggggaacttatgaaggataccgggatcttggagaagttgtaaagagtacagaaaagaatacgatccttcttgattgtgttaccgtaatgattacaaatattttatgtgaagatgaggagagagattttgataagatttctgcttccgaagtagaaaagcttgagagcgaagtgataaaggaactgagtaatcttgtaaaggcaattcgtgatgaagataagacacttatcattgtatctaatgaggttggaatgagtgtgattccgtcatatcgtcttggaagaatttttagcgatatttcaggaaaggcaaatcaggttcttgcttctttaagtgatgaagtttatgtagcaatcagtggcctgccacttcgtcttaaataggtgtgcctatggctaaaaagaaaaaaagaaaagggagcggatttttttcaaatctgcttcttatattgtgcattctcattttttgtgttgcggcatggaagctgtgggggtattatagacattaccatggtgggaaaaaggaatatgagcagttaagacaatatgtggaggaaaatgctgatcctgacgaacagaaaacgaagaaggagaaggataaatgtccggttacagtagattttgaggcacttgctaaggtgaatccggatgtaaaggcctggatctatattaagggtacgggcattaattatccgatcgttcaagcggcagataatacgacataccttcatcggacatttgaaggaaaggatagttttattggtgcaatctttttagatgcaggatgtgaatcggatttttcttcggaaaacagtatcgtttatggacacaatttgaaaaatggccagatgtttggtatgctaaagaagcattatgatacagagtataacccggatgccgattataaaaagtatcagaaaatctggatcatcacaccggaggaagagatagaatataaggtgtttgcagcaagagagattgatgttaatgaggattctgatgtatatacgattgcatttgcttctgaggaagactatgcatcttatttgaagaattctattgaaaaggcactttatagtctgaaaacaaaaccagacagtgaagaagatattctgacattatccacatgtacttcttcttcggaagccggccgttttattgtgcaggcaacacagatacaaaggacagcaaagtagtagacaaggagtagatatgagagagaaaaatatatgggagagaatcaggaattcttcgaattgcagagttcttattcttaatctgattctgactctttgcctgaatcttcttctggaatttacggaaaggagatctgtaggtgaggtgattacatttgttcaggaaagaacatttgtatttctctataatggatttattatatttttatgtttttccattgtatttttagtaaggaaaaggatttttgcctatgtatttatcagtggctgctgggttttagtagcgattgcgaacggagtagttttaagtgacagaaagacaccgtttacggcagtagatcttacattagtaaagtcggttctgccgattcttggcagttatcttgaagtgtggcagattcttggaatagtcatcttattagtggtcggaataggtggtcttgtatgtctttacctttattctccggaagataagcgttcgaggcatttggtaacagaaattttatgtacagcagttactgtagtatgtttttgtgcggtaacgtatgtcggagtcggtaaaggaatgttgattaagaagtttgataatctgatcgccgggtataaagattatggggttgcctatggtttttgtgtcacagcaatagataccgggattgaccgtccaatcaattattcaagagaaacggtaaaccgcataaagaaaaaagtaaaaaaagcagaaaagaaacaaaaagaaacgaaaaaggcaggagttgtacgtcagcctaatattatttttattcagttagagtctttttttgacgcaacaacagtaaagaatttaaatatttcagaagatccgattcctacatttcataagattcagaaagaatatacatcaggatatttaaaagttccggtttatggagcaggaacaatcaatacagaatttgaagtcattacaggaatgaatatcgattatttcggtacaggagaatacccatatcgaagtattcttcacaaaacaacctgtgacagtatagcttattggttaaaagagaagaagtatgcatcaagtgtgattcataacaataatgcatctttttatgatagggatgccgttttttccaatcttggatttgataattttatcagtattgaaaatatggatatcgaaagcagaaacgaagctggatgggcgaaagattctgttttaaccagatatatcatggatactttacagcagacagagaagaaagatgttatttatacgatatctgtacaggggcatggagattatcctacagatgatcagagtaattctccaattaccgtttccggggaaggcttgagtcagagctatcttaatcagtttacatactatgtgaatcaaacaagagaaatggatgattttattaaagcactgacagaaaaactttccgactacccagaagatgtgatggtaattgcctatggcgatcatttgccgggaatgaatcttgaaaataaagatctcaagaatgattcaaagtacgagacaccgtattttatctgggataattttggatataacaaggcaaacaaaaagaaagaatcctgtaaagtagaagcctggcagcttgcatcgaaagtacttggcgaggtaggaatctataatggatttttaaataaatatcatcagacgatgcagtctagtgaaaaataccgtaaaaatctaaaacttttacagtatgatatgctttatggaagtgattttgtacgagaaggcaaaaggcctttggaaccgaccaaggtaaattacagcttagatcctgtagaaattacagaaataaaagaatgtgaagatagctatttattaattggaaataattttacagatgcaagccgggtttttgtaaacggagtgaaagtagcttcagaaaaacaaagcagtggtgtgttaaaaatttctaaaaaggctgtaaaggaaggtgacaagattacggttcatcaggtaagtgtgacaaatgaaaatattacactgaatcagtctgaagaatatgaattccgtaaagataaagtaagattgttatacaaaaatttgtatgatgaataaattaaagcagctgtttataataaagttatagaacgtggacttgccacgtatggacaactgcaaataagagaaaacaggaggataaagtatgtcaacaacaaccgcaatattatgcgcctttggcgtgtacttgctgctgatgattggaattggtgtctggtgtatgaaaaagacaacgggagccgatgactatttcttaggaggaagaggtctttccggtccggtagctgcattatctgcacaagcatccgatatgagtggatggctgcttatgggacttccaggttctgtatatgcattaggtacaggacaggcatggatcgctgtcggtcttggacttggaacaatcgcaaactggttaattattgcaaagccacttcgtgcgtatacgattgtggcaaataattccatgactcttccggaatttttcggaaatcgttaccatgataagaagaagattcttttaggaatttcttcagttatcatcgttgtatttttcttagtatacacagcctctgcgctggcatcaggaggaaagctttttaatacggtatttggtattgattatcatgtagcattatttattggagcagccgttattttaatttatacatttatgggcggtttccttgcagtatgtacaaccgactttgtgcagggaaccttaatgcttatcgcattattagttgttccgattgttgcatggggatttgtaagcggagatttctctgcattattaacacagagtggagtgaattcagaacactatatgagtcttatgtataatggagatcatccgattacaccgattgagattatatctaatctcgcatggggacttggatactgcggaatgcctcatattttggttcgattcatggcaatcaagaatgaaaaagaacttcgtaaatcatctgtcattgcaattgtgtgggttattatctctcttacacttgccgtagcaatcggtgtgatcggtcgtgcgtatcttcttccagcaattcttggagaaacagcaggagccccatcagcagaatccgtatttattcagatgattcaggaaacatttacaaataagattaatcttccatttatcggaggaatctttatctgtggtattttagcagcaatcatgtctacggcagattcccagcttcttgtatgttcctcttctgtatccgccgatatttatcaggatatttttaaaccagaagcaactgataaagaagtattaaatgtaggacgaattacgacaattgttgtcgcagcacttgcatttattattgcatggaatccaaacagctctgttatggcccttgtatctgatgcatgggcaggacttggttctgctttcggaccattagtagtaatgagtcttttctggaagagaacaaaccttccaggagcaatcgcaggactcctttctggagcgttaactgtaattatctgggattatatcccactgatcggtggacagactccgtatgtcgcaactggattatattcattggttgttggatttatcatcagcttgctcttcatcattgtagtaagccttataacaaaagcaccggaagaatccattgttgaagaatttgaaacctataaagcatataaagaacagtaatttgctggggacacagacgccgctttagtagaagatattgagctaaattgtagttagccttctaaagaaaaaagaattgtgataagtttgattttgttccgttgcgctaagcattccattctgcccggaaaaacaggaacttgggaaaaacgagtcccaagttcctatggtcagaattccatagcgcaaagtctcaaaatgcaatacttatcacaattcttttttctttaccatagtttccttacaattcagcaagaaattttgtttcagcggctgtctgtttttaatagcaaatagcaaattagtgatttctgttggaaagagagggggattgcccagaagattatgctttttaatcagagaactgtttcgccataagaaaatagtagtgctggtcaaagtcttctgattgcttcgtttcttttactgtaatatccctataattttgaaagaagatatcttcatctggagattttcattccaatgaaaaccatagacttctggccaagtccctttttccccctccaacgaaaaaacgaatttctatctggagccaaagaacagaaaaacagaaatatgctatagaagaaaatgtgatgtcggagcaagtaaaaatgccgatcaggcattttctgcgccgcgactatcttcacattttcttctatagcatatttctgtttttcgtttctttagtctattagtatttattttattcttgaaagtaccgctcttgcggctttaattccggaagctcctgcctgtgcaagtcctcttgttgtgccggcaccgtctccaatcgcgaagaatccaggaagctttgtttcaagttcgtggcttaactctaaacgagaagagtaaaatttaacttccgcaccgtataaaagagtgtcataatttgcagtacctggagcgactttatcaagagcgtagatcatttcgataatatcatcaagctgacgttttggaagtgctaaagataagtcacctggaatagccgctgtcagtgtcggttttacgaaagactgacttaaacgatgttcatttgtgcggactccttttacaagatcaccgaaacgctgtacaaggacaccacctgctaacatattagaaagagaagcgatgtgtttaccatagcgatatggttcatcaaatggttctgtaaagcggttagaaacaagaagggcaaagtttgtattctcactgcgaagagaagcatcagagtaagaatgtccatttacagtgttgataccttctacgttttcagcaacaacgtgaccgtaaggattcatacagaaagtacgaacactgtcgccatattgtttggtacggtaaacaagctttgattcatatacaacatctgtaatgtgttcgaatactctggcaggaagttcaacacgaaccccgatatctacctgattattaataagtttaattccaagattcttgcactgatttgcaaaccattcggcaccactgcggccgggagcggcaatcagatactgacaacgtgcaatatctcccttttctgttacaagctcatatccttcagaacaagttttgatctcagaaatagctgtattaaaatgaaaatccattttatcttttaaatcttcataaatatttgtaagaatcataagatttttttcagtaccaagatgtttgcactgtgcctgcagaagatgaaggtcaaattcaagagctttctttgcaagagcctgtgcctccggagtagttgtagagaaataatttgtagtagccccatgagctacatttacatcatctacataatggatcaattccataacttcgttatgatccatgtagtctgtcagccagccgccaaattccgtagtgaagttaaacttaccatcagaaaatgcaccagctccaccaaaaccacacatagtatcacagactttacagttaatacactgtttcactttctttgctacaatcgggcagcttcttttataaatatctcttccctgctcaaaaaccccaatttttaaggaaggattttttaaactaagctcataaccggcatagataccagcctcaccacagccaataataataacatcatacatctgattcatgcgtacctccaaaatcaatagtttatatttggtgtaatgtaaagataagtgacatcctcccccaccttagaggtcggagtcttcttgctagaaaaggataaaaaatctttacatattataaaatattataaaataaaaacatgtcaaatgcaattcggtcattcactttttcttatgtattctatgttcactatagcaaatgaaaaatagtatgagttgttttcgctgtgttctcatgttatgatgaatgggacaatcttgaaaggagctgaacgaaatggaattttgggatatttatgatgaaaataaacagcttacaggacgtaagatgaagagaaatgactggtgtttaaaagagggagaatatcacctgactgttcttggcgtgattgcaagaccggatggtactttcttaattacaaagcgtgttatgacaaaggcatgggcacctggatggtgggaagtttccggtggcggagtacaggcaggagaatcttccgaggaagcagtaagaagagaagtgaaggaagaaacgggtcttgatgtgcgtaatgcagaaggcggatatgcatttacttataaaagagtgaatcctgatgagggagataattattttgtagatgtctatcgttttgtgatggatattgatgagaaggatgtatcttttcaggaagcagagattgacggtcatatgtttgcaacaagagaacagattgaaagttttgctaaagaaggcaagtttcttcactatgacagtatcaaacaggtattttcttttgactgaaaatctttgcggtgaaagctccatctgaactatggctcaggtggagatgtttacaggtagtgtagtataagtaaagcagaggtattatctttgtaaaaaggggaaaaacgcttgcttttataagtatattatagtagaatgtcaacggtttaagtttgattttgattaggaaaagaggtgaaattcatggacagttgtgatagtacggggcagagtataatttgcggtggtatgtgttataaagaagagtttaaaaatttggatgtgactggatatggatttcgtcagagaagtagtttaagaagcatctgattttttatgtttttattgtatagtatgtagaactactatttttagatagttaccattatacattgatcgataacattgatttctattccaccgcgtggattcctatacttcacagttagtaattgcttgatatactgctgaaaagttttggaaacttgatgtggtggattttttatgcccttttaagggccgaagggagatgtatgatggagaaaatattaaaaaaaccagattatgcgaaagagattctggagattatgcatggctctttttcagaagaggatatgctggaaagaatttcagattaccatgagaatgatatcgcagaagcctttgaattactgtcagaagtggagcgaaaaagatggtatcggatgtttggtccagaacagattgcagagattttttcttatattgatgatccggattcctatttgaaggaattaccgttagatgaggctgcaaaggtactttcttatatggattcggatgatgcagctgatattttagatgaaatggatgattccacccaggaaaaactggtgggattacttgatgaagaatcaggacatgatattaagatgattctttcctatgaggatgatgaaatgggtagcagaatgactacgaatttcattgtgattcataataatctgacaattcgtcaggcaatgcgtgaactggtgcagcaggcgggagagaatgataatatttctacagtgtatgttcttgatgagaatgacaagttttacggtgcgattgatttaaaggatttgatcgtagcaagacagcaggataacttagaggatatcatcagtacttcttatccgtatgtaaatgatcatgaaaaagttgacgaatgtattgaaagaattaaagattatgcggaagattctattccggttcttacgcaggaacatctcctgatcggtgtcatcacagctgtggatattgtagaagctgttgatgaagagatgggagatgactatgcaaagttagccggtttaactgcggaagaagatttaaaagagacgacagcacaaagtatgaaaaaaagactgccatggctgattattcttttatttttaggaatgggtgtatcttctgttgtcggcgtgtttgagacagttgttgctgtacttccagttgttatgtgtttccagtccttaattcttgatatggcaggaaatgtcggaacacagtctttggctgtgacaattcgtgtactgatggatgaaacattaagtacaaagcagaaatttggtcttgtagtaaaagaaatgcgagttggattttgcaatggtcttttccttggaattcttgcttttgtatttatcggatgttatatctggctgctaaagagtaatccgataacacatgcctttgtaatttccggctgcgttggattttctttgatgacagcgatggttatttcaagcatggtcggaacactcgtaccgatgtttttccataaaattaaaatagacccggcggttgcatccggaccattgattacaacaattaatgacctggttgcagtaattacttattacggactggcatggcttttgttaatccatgtcctacaaatagttatgttgtaaattttgttggggtagggtatactattatactgacacaaaagaaggtgtttcatttgttttttttctgggaattttaatagtagaagactgttttcagaaagtgttgcaggagacatctgaagaaaggaagcgtatggcaggtgaaagatgacgagatgaaaaaatatttaaaaataggaattaccggcgcagcgatactggcatcaggtattttatgtgcatttgtattgtttaaaatgagggttattattgaactgttaaaaggtattacaggaattttgaaaccatttttatatggggcagtaattgcatatctgcttgcgccattatgtaataaaatagaagaaaagctgtttcagacttttccaaaggccaatagaaaagcaaaacgttttatctgttttatagcgattgtcatatcgttatgtgtggcattggcaatcgtgtggatggtaattatgcttattattccacaggtatgggacagtgtaatgaagatcattgatatggtaccgcaaaaaattacgatactgaataactggattgaacatatgctggaaaatcagccggaacttcaggcatattttgaagaatttgcaaatcaggcagagagccatattaacagtcttttaaatgtggatacgatacaaaaagtacagagtattatcaatagcctcagtgtacaggtttttggtgtgcttggcgttttaaaaaatatttcgcttggatttttgatttcggcatatcttctcggaagcaggaagctgtttggagcacaggcaggattgattttacatggtgtatttcctgataaatgggcaggaattattgaagaagagattcgttatacagataagatgtttaatggatttttagtaggaaagattattgactctgcgatcatcggattattatgctttgcaggactctctttcatgggatttgaagcgccggcatttatcggtgtgatcataggaattaccaatattattccgtttttcggaccgtttatcggggcaattccatgcggactgctgttacttttagaaaacccaatgcactgtctatatttcattatttttatttttgtattacagcagcttgatggtaatgtgatcggaccgaagattcttggtaatacgacaggcgtttcaagcttctgggtattattttccattcttttatttggaggaatgtggggagttgtcggtatggttatcggagtaccgttatttgcggttatttatgacattataaggaaactggtttaccgcggacttcgcaaacataagagagaatccatgataacggattacgaagaaaaatatcataaatcttgatttgtagatttaatgtagacgaaaaaagaaaaactaccctatcccatctgctctgtagtcgcggcatttaagatgctcatccgcatcttaaatacgctccgaagccgcatctgggatagggtagtttttcttttttctgactaatataaatccatagttggtaagaatggggattcttcagcaggttgtggcttcccagaaaattaaatttgaaaggattgacattcaaattgttgtaggttgtctactctttctattcaaatggaaacttccagaggaaatgtgtcagacctttagaagttaaattcccgaaaagtcatatccttctggtgcattccatgttgcccaactgtggatttagcatagtcagaaaaaagggaaaaatactatatcccagatgcggcttgggagcgtgtttaagatgcgataagcatcttaaatatagcgactacagagcagatgggatatagtattttttccttttttcgtctataccaaatctacaaatcagaattgcattttttcttccgaaggtgtataaatattttatattatgcgatttgaattaggaggtgttggtatgacatatgaagaggtaattaagaaagcaaaatcagaaataggaccatattgtaaggtttgtccgcagtgtaacggaagagcctgtaaaaaccagatgccaggaccgggggctaaaggtgtgggcgatgttgctatgagaaattatgatgcgtggaaagaaatccgtattaatatggataccatttgtgagaatgtaacaccggatacaagtattgagttgtttggagagaagtttgcctatccgttttttgcaggaccggtaggtgcgatgaagcttcattatggagagaaatatgatgatcttgaatataatgatattttagtatctgcctgtgcggcaaacggaattgcagcatttacgggagatggtacgaatccggatgtatttaaaggggcagcggcagcaatcaagaagaatcatggacagggaattccaacagtgaagccatggaatattgagacgattcgtgaaaagatggatatggtacaggaggcaggtgctaagatggttgcgatggatattgatgcagccggtcttccatttcttaagaatctgaatccgccggcaggaagtaagacagtagagcagcttagtgagattgttaacgcagctggaattccttttattgtaaagggaattatgactgtggcaggtgcaaagaaggcatttgatgcaggtgcgagtgcaattatcgtgtcgaatcatggaggaagggtgcttgaccagacaccggcaacagcggaagtgttagagcggatcgtagaatggaatcagggaagaatgaagatatttgtagatggcggtatccgtcagggaacagatattttcaaggcgctggcgatgggagccgatgctgtcctgatcgcaagaccatttgtacaggcggtgtacggtggagcagaagaaggagtaaagctttatattgagaagcttgcagcagaacttgcggatacgatggcgatgtgtggagcagcttcgatcaaagatattaatcgaagcatgctgtaccgtccaatgtaaattttagatgtgggagtcatctcacatctgatataaaaagagaaagacaggaaacaggaaaatgaataaaaaagacactgtggtatttgatttagacggaacattacttgacacattagaagatttaaaaaacagtgtaaattatgcaatgcgtcattttgattatccggaacgtacgttagatgaagttcgaagatttgtcggaaatggaattgtgctacttatccagagggcgattccgggaggaaaagatgatccgaactttgaagaggcatttgccttatttaaagagcattacggaaagcactgtaatgatacgacaaagccatatgaaggaatcatggagcttttgcatattttaaaagaacataacattaagattgcgattgtttctaataaggcagattttgcagtaaaagaattaaatgaaatatattttaaagggatgatttctgtcgcgatcggtgaaaaagaaagtgaaggaattcgcaagaaaccagcgccggatacagtgagagaagcattaaaagagcttggaagtgtggcagaaagtgctgtttatgttggtgattccgatgtagatatcgaaacggcacgaaacagtggtatggatgagattttatgtgactggggatttcgtggcgaagaatttttaaaagaacatggagcgaagatcataatcaaaaagccaggggaaatcctgactattatcggagtgaagtagagaagtcggacagtaagagtgggaatttttttgaaaaaacttacctttatttgccattatatttcttttgaatctgcacacaataggattacggtattccaatcgaagactcattacggaggtagagacaatggcaagtaataaaaattcttcatccaacagaacagaagtaccagaagcaagagatgcaatggatcgttttaaaatggaagtagctgatgagctcggtgtgaatttaaaacagggttataacggcaatattactgcaaaagaagccggctccattggaggagaaatggttcgtaagatgattaagaaacaggaagaggagatggctggtcagagccgttaagtcttgttgattctttagcgattctttagagaaagtcccttactgaaatcagaa

SEQ ID NO: 404 - DNA, 57760 bp, Eubacterium hallii
agaagatattgagctgaattgtatggagtcttctaaagaaaaaagaatggttataagtttgattttgttccgttgcgctaagcattccattctgcccagaaaaacaggaacttgggaaaaacgaatcccaagttcctatggtcagaattccatagcgcaaagtcacaaaacgcaatacttataaccattcttttttctttaccatagtttccttacaattcagcaggaaattttgtttcagaggctgtcaggttttgataacaaatagcaaattagtgatttctgttggaaagagaaggaaattctccagaagattatgatttttaatcaaagaactattttgccataagaaaatatttctcgtctggagcttctatttggatgaaatccatagtcttctggacaatccccttattcttcctcaagcgaaaatactaatttccttctggagccaaaaagcagaaaaccaaaaatttgagatagaagaaaatgtgatgtcggagccagtaaaaatgccaaacaggcattttctacgccgcgactatcttcacattttcttctatctcaaattttgggttttcgtttctttagcccctcaaataaattagtatataatcccccattctcaccaactgtggatttagagtagtcagaaaaaagaaaaaataccatattccagatgcggcttcggagcgtgtttaagatgcgaatgagcattttaaacacagcgactacagagcagatgggatatggtattatttcttttttcgtctacaccaaatctacaaattcctatttaatgccttcctccggctccgccatgtcctccagttcctccgacttttcctccgccaccgctgcttttactcggtcgtttcgttctggtcacatgggaatgcaggaagatatcctgcttttcattcatttgcactccaccttttgcgtaggtagaccttagaacagtgtcttttcctccatgtccgattaactggacacctacaaaaatggctccaatgactgctgctgcaagaaagacaataatcgggttaatctgcacataagaggaacggcctgtccgaatcatggttgctgcattatttacaatagatgtgtaagcctcatatggattatcatttacgatttcgttggcactatccacaatctgttctgtgtccgtatcatcgagtctcgtttttgcaagaccagttgtacacatccaggtgtatcccgttgcccagtcatccacataaatgataccgtctccattggtcttattccagccaaatttgttatcctcataatatgcctgtgcatagtctcggatttcatcataactatcaagccccggctcatttattgtaaggataacgatatcacagccaattagctgttctttttctgcaatcagagcttcaagatctttcttctgtttatcagtcattttgcccgcttcatccaatactctctgcgtgattgtacattctgtattttgacgaggttttgtattggtgtattcttccggctcaagcaattttgccacgatgcctataatcgcggcgagtataacgattcctattaaaattcgtctccagattttccccatttatgccacctccagaaaatacagaatcatttccgcaagaaagaacagtgaacacgtaactgctgcaaaccatgagaacattctcgccttgctggtcggcggcgttcctattgcttttcccgtctgaccattaacaaaaaactcataatttgttccctgataacggtatacataacgccataccggtaaaaatgtatagtaggagttcatttctttactatctacttttttaatagcaggtttcacactgctataactattgttatactcatcaaggtaaccctctgtatatttctttgcttttttctgtgccctcggcaaaagttcttctttattttcatcataaatttctgcctgaaatccagacaaatatcttgagcggaacttccctagtgcagtatatttataaggctccactaaatccattttctcatctggcatatttttcgatgcatcaacaggaatcttatcatagttcacatcaaaatctcttacaagacgatatatactcgtctccgtacaatcatagtctccttctgtccacgttctgatttttcttccttctccttcaaaatgcacatgggtctccatatcatacatccaaaatggaacatatcttccctgaagggattccagacttgaagtcgaacaaaaatctttaggaataaacattttcttcgcaaaattcttccttataatctctatcgcttcttttctatctatcacaaatggcaatgccagatcaggcttatacgcatctttcatcctgtcctcaaaaatgacatacgtcccacagtatggacatttcagagcaagatctgtctttttggattcaatctctgctccacagttattacatatatgaagcttctcctgtagtattttttcctgtgtctcctcattgccacagctttcacataccatcttctttttctttgggtcgtaaacagcattaccaccacaatctttacaacggtaaaacatgggattcctcctttgtttttatcttgccaaattcttagtgagaaccgccactgccgccaaagtcatctgttccgctgcagctgcttccactgtcatcatctgactttctctttgtttttgttacatgagaatgtaagaaaatatcctgtttatcattcatctgtacaccatctttcttcacataggtagacttctttactgtatcttttcctacctgcccggaaagctgcgccactacaaaaatgagggataccacaagacaaccaagcagcacccagattgggctgatgtttatatggaacatcggactcttttgtgtctcttctgctatcaggtttatcaaccttgtatatgctttataagggtccttattcacaatatcattcgtttcatccacaatatagtctgtattatccttagataatctgtcttttactataccgcgagtggcaagccaggtatatctggtctcccagtcatctacataaattgctccgcttccgataggctgatcccagccaagcttattctctttataataattctgtgcataatcacgaagcttctccatcgtatcaagacttgcatcattcgttgtaataagaacaagatctccaccgatcaattcttctttttctgcaattaacgcctccagattcttctcctcttcatcggtaagaacatctgcatcatcaaacactctctttgtcagggtacactctgtattctttcgaggttctgtattcacatattgattccccgcaaattttttcccaagcagccccattaaaacaccgagtataacaataaaaattaatattctacgatatgtctttgccatttacatcacccccaataaataaagaagcatttctactgtaaagaagagggaaccgaaaactgctacaaaccacacaagcgctttacttaagctagtcggggcctcccctactgccttccctgtctggccattcacatagaattcataattctttcctccgtaacgatacacataccgccataaaggaagaaacgaataaaaagatgctttttctgtgctctttttatcatttacagtcggtcttaccgcatcatattctacgttatagccgccaagatacttctggctgtatttatctgcctttttctttgctcttgggaaaagagtgtctttatcttcatcataaatttctgcctgaaaaccagaaagaaacttcgcatcaaactctcccaatgcttcgtatttatatggttctactaaatccatcatggcatccggcatcgcctttgatgcatccacaggaatcttgtcatagtccacatcaaaatctcttacaatacgatatgtactggtctccgtacaatcataatctccctcttcccaggttctgatcttatctgcttctccttcaaaatgcacgtgcgtatgcaggtcatacatccagaatggcacatacagtccttccattgactctattgtagaagatgaacagaaattccccggaagaaacagttgctttgcaaacttttctttcagaagatccagcgccttatgcttatcaattgcaaaaggcaacaccagattcggctcgtattcgttctccatccggtcctcaaaaatcacataggtaccacaatatggacacttcagcgataaatcaatctgatctgcttcaatctccgcaccacagttattacatacgtgtttcttgtcctgagaaatcagttccggctccccttcattcccacagctctcacatatcattttcttcttgtctgggttgtaggttacattcccaccacagcttttacaacgataaaacatagactccctccttttctttctgaatgtactctcggaataaaggaaaaaacagtataactatagttcctgtgacctcatcccgatcattacaaactctttattatttcgtatttctcctacttttactatatgggttttttcaacaaaatgcaacgaaatatttatgatttgattgattattttttatagattatccactataaactgaaagttttatttatgatagaaaatttcatctgccttatccttcttattctagttttaattatacgtctatatatattattttgtagcgtttttgtttactacaatcaacatatacgtctcaacttttaacagataaattatattttaaaccacgttatgattcctttataaacaaatagatttaaggagattttgaatggatattttaaaaagaattgtcgatctaagaaaagaaaggaactggacagaataccagcttgcggaacagtccgggcttacccagtctacgatttcttcatggtaccgtaaaaatatgcttcccactattccttcattaacgaaactttgcgatgcttttgggattacattatcgcagttttttctggaagatgaatgcaaaactacaacattgaatgaacaacagcttcgattaatgtattatgcagctaagctcaattcagagcaatatgaagctcttctccattttttagaattactttgatgaattggcaaagctaacgaaccataagaaatctctctcctggctctgacagctttgcctgctgcaaattcctacttattcctacttagcatattttctcgttttcttacatagttattaaaacccaccattctaaaaaggatgtgcttttttgaacgattattctggttgtcgaaaacatatttttaaatataacatctatactttttttctgctttttgctatctcaatcttctttttatctttttttgtttcctgtgacataaacgctcatacttttttaaaaacagaaagtactattcccaatgaactttcctcgcttcatgcaaaagcagcgattcttatggatggggataaccaaagaattctatttggcaaggaagaagaaaaagaacttccaatggcaagtacgacgaaaatcatgacctgtctctatgcaatcgaacatggaaatctttcagataaagtcgtattctcaaaacgcgctgcttctgctcctaaagtaaaactcggagctaaaagtggctcacaattcttactatccgatttactttatgcattaatgctcgaatcttataatgatgctgccgttgcaattgcagaacatatcggaggttccgtagaacaattttgtgcagatatgacacaggaagccagaaattatggctgctatcacacctcttttgaaaccccaaacggactcgatagcgctaaccattatacgacctgccatgaccttgccttactgacctgccttgccttaaaaaatgataacttctgcaaaatcattaaagaaccatctttttctatcaaagaattaaaaaccgggcaatcttactctttaaataacaaaaatctgtttttaacttcctataacggtgcaatcggtgtaaaaaccgggtacacaaacaatgccggatattgttttgtcggcgcagtaaaaaaagacgatcgttatttgatttctgttgttttaggaagtggttggtacccaaaccgccgttataaatgggaagatacaaaaaaactgatggattacgggatgaacaattatagcaaaaaagaaattcctttaaacaagggggttccttccaaactccctgtaaaaagaggacataaatctaactgcactctttctgctccaaaacctgtcagcttatatgtctcatctaacgaaaaaacaaaatgtattataactcttcctgcatccttaactgctccggttcaaaaaggcactgctgtcggctctgttgttctttatattgattctaagccctatcgcagctatcctatatacactaaacaaactattaaaaaacggaccttctcctggtgttacaaaaaattattttactatttcattcattaggggaaacagacgaaaaaagaaatactaccatatcccatctgctctgtagtcgctgtgtttaagatgctcatctgcatcttaaacacgctccgaagccgcatctgggatatggtagtatttcttttttctgtgttttggctccagaaggaatgaatgcaatagtctttggggagggatggaggagaaatcagaagactactgcttactcggaaggtatatcgtcagaagattattttctttctttaatgagcagtaaagagaaagggcttgtcatttcctgagaaattaaagtagtcacctttagagttatcttgctacgagatgtgcgtcatataacacatggcacacgtcaagaaaaacgatatattgcgacaagataatgataaatatatcatgtacagcgatagcttgcagtatcatcttatcatcagtgaaacttgaaaagaggtttagcatagcagagagagtaagtagtagacttctgacctctcccccttatccctcccaaagactattgaattcatttcttctggagccaacaagcagaaaataaaactattagcccatagccaatgtaatgtgagagcaagtaaaaatgccgaacaggcattttctacgcagtgatatctttacagtggctatgggctaatagttttattttcgtctgtttcctctaatgaatcaaatagtaagttcctttttgcatagtcttcttttctatgctagaataaggtcattctaaattgcaacgccatttgttcgtctatgacctgcaatttggtaagcacaacacgaaaggactttatttatgaaatgtaacgcattaaaatatgctttcccatataccctgccaatttgtgccgggtttttattttttggaatatcttatggtttctttgcaagcagcaaagggttttcttttatttatccactcttgatgagtatgtttatttttgccggttctatggaatttgtaactataagtctacttctggcttcctttaacccagtttattcttttttactggcattaatggtaaatgcaagacatctcttttatggaatttccatgctggatacttataaagattataagggaattaaaaagttctacctaatctatggaatgtgtgatgaaactttctctgtaaattgttctatcactccgccaccagaaatcgaccgggaatggtttatgatatgggtaactcttttaaaccagatttactgggtctttggagctacaatgggggctgtacttggttcagtcattcattttgacacaacaggtatagaatttgttatgactgctcttttctttgttatgtttcttgaccaatgggatacagcaagccgacaccttcctgctttaatcggagttatatgttctctcgcctgcctgctcctctttggaaaaagtaacttcatgatcccagctatggcattgattattttaagtttctttttatgtcggaacagattagatgatccaaagaaaattgtaaaaaattcacacgaaagcgaggaaaatgtacgatgactaccacacaacagattatcaccattaccgcagtcgtactcggcacaatggctacacgttttctgccatttatcattttctccgcagacagcacacctgacttcgtaagatttctaggacgagttctccctaatgcagtcattggacttcttgtcatttattccttaaaagattctattggtggaacaaatcactgtatacctgaactcatcgcactggtatttattttcatcctgcataaatggaagaagcatacactgctcagcattgccggaggaacaatcctctatatgttcctaatacaaatggtattttaaccaaatactaattttaggtactaaagaaacgaaaagcagaaatttgagatagaagaaaaagtgaagatagtcgcttcgtagaaaatgcttgttcggcatttttactcgctccgacatcactttttcttctatctcaaatttctgcttttctgctttttggctccagaaggaaattagtatttggatttgaggaagaataaggggattgcccagaaggctatgagagttaaccagagagaaattctccataaggtaggaatagataaatataatttttatacaatcgagtaagaaagtatccccttttggagatgttcattctaatgaaaattatagacttctgaagaaactgagatttatataaggatttctatttcttttgtcggtatcccctgctattttcttgtggcaaaatagttctttgattaaaaatcattatcttctggagaatccccttctcttttcaacaaaaatcactaatttgctatttgttatcaaaaccagacagccgctgaaataaaattttatgctgaattgtaagaagactatgataaagaaaaaagaatggttataagtattgcattttgtgactttgcgctatggaattctgaccataggaacttgggactcgtttttcccaagttcctgtttttctgggcagaatggaatgcttagcgcaacggaacaaaatcaaacttataaccattcttttttttaaaggctaactacaattcagctcaatatcttctactaaagcggcgtctgtgtccccagcaaattagtatttagtatgcttttccaaagtatacttcacattttgctggttttccgcaatgtacgcatacatcagaatgttttgcctgtacaaatggaatacaacgtgttgttgcaccattctcgtctttgatggcttcttcacattctctttctccacaccacattgcgcggatgaatccctgctgattctcaaggatatcattaaactcttcccagttatgtgcaatatgtgtattcttctcaagatgtgcttttgccttgttatacatatcgttctgcattgtctccagaacttctgctaaagtttcttcaatcttttcgatcggtgtgacaatcttttctcttgtatcacgacgaacgatcactgcctgacctttttcgatgtccttaggtccaatttcgatacgtgtaggaattccctggatttcctgttcgctgaacttccatcccggagatttatcggaatcatctacttttacagagaagttggacttgagcatatcacgaatttcaaatgctttgtctaatacgccttctttcttctgctgaattgggatgatcattgtctgtaccggagcgattcttggaggtaatacaagtccactgtcatctccatgtaccatgatgatcgcaccaataatacgtgtagacattccccatgatgtctcatatacaggagaaagcttattctctttattggtatattcaatgccaaatgcttttgcgaatccgttaccaaagttatggcttgtaccggactgtaaagctttacaatcatgcattaatgcttcaattgtataagtagcttctgcacctgcaaatttttctttgtctgtcttttttccttttactaatggaatcgctaaaacgttctcacagaaatctgcatatacattaagcatctgctctgttctttcttttgcttcttctgctgttgcatggaaagtatgtccttcctgccataagaattcagaagaacgaaggaatggacgagtcgtcttttcccaacgaagtacggaacaccactgattgtatacaactggaaggtcacggtaagaatgaacgatatcctttacatgatcgcagaataaagtttctgatgtaggacgaatgcaaagtctttcggaaagtttctcttctccaccatgagttacccaggctacctctggtgcaaaaccttctacatgatctttttctttctgtaaaaggctttcaggaattaacattggaagatatacattatctactcctgtctctttaaatcttgcatctaactgcttctgaatgttctcccagattgcatatcctcttggacgaatgatcatacatcctcttacgttagaataagagattaattctgcctttgttactacgtctgtataccactgggcaaaatctttatccattggtgtaattgcttctacaagcttcttttccttagccataatatttcctttctatgaatacctgctgaatacctcaggcaaatataaaggattgctgcttaaatttccgcaacaatccacgctgtcagtctgttttttattgtaaaataagtcctctgatttgtcaagaatatggagacttaaaaagcctccacgtccatcttttcaaacgcttctccacatggttctgtcttaaatgtcattctttctcccgtaaccggatgaaggaaggataatcttgtagagtataatccaatctctgtatacttcttcttcgttttctggaaagccgaattgtactttgtatcaccataaaggcccagtccacgagaagcaaactgtgctcgaatctgatgatgacggcctgtatgaagaataacaagcacccatgtgagtataccttctttggtctcaatacagtcaatcaattcataatcaagttctgccttctttgcatcaggagttcctgcttttacaacttctgtcttattcgtttttccattttttaaaagataatcttcaaaagttccaaaatcctctttaagattaccgcatactactgcttgataatttttttcaaattcaaactcttgaatctgtttacttaaacttgccgctgcctcttttgtcttggctaaaaccatcaatcctcctactggtctatctaagcgatgtacaacagtaaggtaaggttcttcttcgcctgcctgttcttcaaaaatatggtgttttaatgtggtaaggacatccagatctcttgtatgatcgctctgtaccggcataccggcaggtttctcacatacgataatcgcatcatcttcaaatataatcggaactctctttttctttaccatgtttttctattactcctcttttctttctgtctttttgtccttcttattatacttatttaaaacatcaaaatcaaattgcgttaataacactttccttttcttcgtctactttcccattcagaacacgaaaacgatagcctgccccccatacagtctcaatataacctgtttttacattactattctctgttttctttcgtatttttttaatatgaactgtcaccgttgcaatctcacccatggaatccattccccatacggcactgaataactcgtctttagaaaatacatgattcggatgcgtagcaagataagtaagtagatcaaactcctttgttgtgaagcatctttcttccccatcaacaaaaacccgacgagcagtccgatcaatcttcaagccaggatattcgatatattcattttcatcactacgttttctagtcagccttatgtaacgattcaaatgtgcctttactcttgctaccagctcatttggactaaatggcttggtaatataatcatctgctcctatacccaatccccttatcttatcaatatcacttttcttctcagacacaataagaataggtatatctgttcttcgacgtatctttctgcagacttcaaatccatccatatctggaagcatcagatccagaattatcagatcaatatcattctttaatattctttttaatcccccttcacccgtttcttcaattgatactttcaaagaattgatttccaaataatctctttctagttctgcaacggttctctcatcctctattatcaaaatattcttcataaacacctctccattctttgctggcttccctgtaacttttatgtgaaggaaagtccgcctgcaacaggagtacttttcgcccacacagtattgtggtcttctataatttttgacaatagaaaatcccaattatgctgccttccccgacaatactcttttcatttatttttctgatataattataacataaattgttttttaaaacacaacttttcaataagtaaaccatatttcttaaatattttataaattttttattttttaggtaaaacaaaacataaagcttatatgatagaaattataccaataaatgcaagcattgctttaacaagaacatgaaaatattttatataatatctactccatattgtcaaaagcaaaaatcgaagaaaatcactatgtaataatttcttcttagagtgagaaacaaatacagagagtatttgtcacacaatccgtaaaacaattttacataatcatcttcttcgattttatgtattctttatttcacctgattcatctgaagaatatagtctaaaatctcatctgccacttcttcctttgacataagttccagacttttttcttccttttctgaaataagtgtaaccctgttggtgtctgttccaaaacctgcacctttttcttttaaattattcgctacgattaaatcaagatgttttttctttaatttctttcgggaattttcaagcatattttgtgtttccatggaaaatccacaaataatctgttccggctttttattctctcctacatgaccaagaatatcggttgttcgttcaagagcgattgccatatcgccatctttcttttttaccttctcatcgctgacaacagccgggcgataatctgcaactgccgccgacttgatcagaatatcctgttcagaaaaactgttactcactgcctcaaacatatcctgtgctgtaactacagaaaccatcttcacgaacggaactggatttaatgcaaccggaccggagataagtgttacatccgcgccacgcagcattgccctttttgcaatcgcatatcccatctttcctgtggaatgattggtgatataacgtactggatcaatcgcctcctgtgttggtcctgcagtcaccatgattttcttaccttttaaatctttttcgcaggcaatttctcttagaatatattcaaataaaacttccgggtccggcatctttcctgcaccggtatctccacatgcaagatagcctactgctggctctaccacttccatatcgtactttttcaatatgtttaaattgtcctgtacaattggattttcaaacatatggacattcattgccggagatatgatcttctttgcactacaagccagagctgttgtacttaacatatcatccgcaatcccatgtgccagtttcgcaataatattagcagatgccggggcgatcatcatcacgtcagccttttgcgctaacgaaacatgcgctacatgaaactgaaagtttctatcaaatgtatctaccagacatttattatttgttaatgtctcgaatgcgattggattgataaagttcgttgcgttctttgtcataattacatgaacatcgcagtgctgttttacgagcatacttgcaagacttgcaattttatatgctgcaatacttccagttacccctaaaacgacagtttttccttttaacatttttatcctaacctctccatgtcgaataaacgaccgtgtttttcgtaatttgtaacacgactgattttattctcatcatctacaaatacaacattcggcttattttctttggcttcttctggagtcatctgtgcgtatgccataagaataatcttatcatgcacactgacacatcttgctgctgcaccatttaaacacataactccactgcctctttcaccggcaattgtataagtctcaaaacgatttccattatttacatccacaatctgaaccaactgatattctttaattccggctgcatcaagtaaatcctcatctactgtgatactgcctacataatcaagctctgcctgtgtaacagttgctctgtgaatctttccctgtaacattgtaatctgcatatttattcctccgaaataatctcacataaactctgataaaatctttagccacacacagcgataactattcttctacgataaagttatcgatgagtctcgtttttccgatataaacagccatagctaccagtgccggtgctttgatttcttctactggctgcatggacaatccatctaccgcttctacataatcaatcttagccattggctcagactcgattttcttaatcatcgcttcttttactactgcagcggatgtctctccatctgctaccattttctttccaagcgcaactgacttacttaaaattaaagcagcttttctttcttcttcatttaaataagtatttctggagctttttgctaatccatcttcttcgcggacaatcggacatcctactatttcaatatccatatttaagtctcttaccatacgacggataatggccagctgctgcgcatctttttgtccaaaatatgcgcgatccggtgtcacaatattaaagagcttacttacaactgtgcatactcctctgaaatgaatcggtctgctttttccacacaatgttttagacagaacatccatatctacccaagtgcagaaatcggatgcatacatttcagatggttccggatgaaatactaaagctgctccaatggactcacagagtttacagtccgcttcaaaatctcttggataagcctctaaatcctctgttggtccaaactgtgtaggatttaaaaatacactgactacaactttgtcattctgttctactgctttttgaatcaggctggcatgtccttcatgaaggtatcccattgtaggtaccaatccaacactcagaccttcttttttccatgcttttacttgttctcttacttcttttattgtatatactttttccatgatcttattatccttctttttatcaaaaaatacctcggtatttagtaaagtttatctaacacttcttcatctatcttaaatgtatgttcctgtgccgggaaagaactgtcttttactgcagcatcataatctttaaatgcctgtgacataatctctcctacatttgcaaaacttcttacaaactttggtgaaaaatcagaaaacatagataacatatctgcatagacaagaatctgtccatcgcagcctgctcctgctccaattccaatcgtaggaatatgaattgcctctgttactttacgggcaagcttttccggaacacactctaaaacaaccgcaaatgccccggcttcttctactgctttcgcatcttcgatcaactgctgtgcagcttctaatgttttcccctgtactttaaatccaccaaatgcattgacagactgtggagtcagtccaatatgtgccattactggaatagaagcatctgtaatcgccttaatctgtggacatacgctctttccaccttctaatttcacacagtcacattgtgtctctttcataatctttccggcatttacaatcgcatcataaacggaagtctgataagaaaggaatggcatatctactacaactaaagaattctttgcacctcttgcaactgcagctccatgatggatcatatcctctactgttacagggattgttgtgtcatatcctaaaacaacattaccaagagaatcccccactaagattccattaattccggcagcatcttctaattttgctgtagaataatcatatgctgtcagcatggaaattttttcgcctttatctttcattgcctgaaaagttgttactgtgttcttcattaatacccctcctgatttactgttcatcaatattacagtactgcttattatcaagaatgtcttttagctttccgtaatctctttccggatttttcttttcccctatagaaatgagaatctctgacaaaagacaatagagcatctgctgacttttattaagacagtttaaatgtttctctacggtctttacatcggctctttctactggtccggtcagactgtttaccgttccgttctccacgatatgctgcatatttccaagcataatcggagctaatgctttaagcgcactctcttcgtcaaatccgcactccttcatcaagttcaagctttcctgtataagcgcaaccacatgattactgcatacggcggcagcacaatgatattttactttatcttcggctgcaatataacacacctcatttccaagatttctaaaaatcccggcaacgtcttcccgatgtctctcatcgccttctattacaaaatacgcatgtgatagctctttgtaagaattgtacttatcgctgactgcaaagagcggatggacagaatatccgaaagcaccacacttatcaattcccggaaatgcatctccggatgataaggcaccactgcaatgacatataaactttccctcaagggacatatccttaatctgattccatacaatcgtaatcagatcatcaggaacagtaagaaacagagtatcactttcttttacaattgtgtctaaatcttttataaaagctatcgctgtaaaatctgccgcttcttttgcaagattctcgttcacatcgtaatatcctgttacttccagatcattcaatctgaaatacttaccaagggaacacccaactttccctgcacctataattcctgttctcatatttatcaccctgcctttcgcatggtgatactccgagtcttattcctaaaggatataagctcaatacctgtcagttacacgcggtatggtttcgctaacgaataccatccatagttacctacacactataccattttaaaatacattcgtaaataaactttttgaaaaaaattgtttattttttaacacaaaaaaattccacaatactatattgccatttgcagcctctgatcaaatggagaagtgaagaaacactccccacgcattcagacagcgcaaacgtaatatagtattgcagaactctcgtctgtgttaaacacgatacattttataaatacttcttcagagtttctactttatcaagtctttcccatggaagatccagatcattacgtccaaaatgaccataagctgcagtctgtttgtagattggtcttcttaagtcaagcattttaataattcctgctggtcttaagtcaaagttttcgcggatcatatctacaagtttttcttctgcaatctttcctgtttcaaaagtatctaccatgatagatgtaggctgcgctacaccaatagcataagataactgaatctcacacttatctgcgagtccagctgcaacaatattctttgccacatatcttgcagcgtatgcagcagaacggtctacctttgtacaatctttaccggagaaagctccaccgccatgacgtgcatatccgccataagtatctacgataatctttcgtcctgttaaaccactgtctccatgtggtccaccgattacaaatcttcctgttgggttaatgaagaactttgtattatcatcaaccatattttgtggaagaatcggatcaaacacatactttttaatatcttcatgaatctgttcctgtgttacatcaggatcatgctgtgtagaaagaacaacagcatctaaacgatctggcttaccattctcgtcatattctacagtaacctgtgtctttccatctggtcttaaataagataatgtgccatccttacgaacctttgtaagctgtctggataacttatgtgctaatgcgataggatatggcatatattcttctgtttcattgctggcataaccaaacatcataccctgatcaccggcaccaattgcctctaattcttcatcactcatcttattctctcttgcttcaagtgccttatcaacacccatagcaatatcggaagactgctcatctaaggctaccataacaccgcatgtatctgcgtcaaaaccgtatttacctcttgtatatccaatctctttgatcgtatcacgagcgattttctgaatgtctacataagcattcgttgtcacctcacccatgacaagtacaagacctgttgtcatagctgtctcacaggcaacacgactcattgggtctttttccattaatgcatcaagtattgcgtcagaaacctgatcgcacatcttatccggatgtccttctgttacagattctgatgtaaataatcttctttccattgtactattcatctccaattcttaatttacagtacctgttttataaataaacttattggtttctttctcagaattaacttcttcaattaatcctccgagagcacgaagcttctcatcaaatcgctcataccctctcttaatataaccaatctgagttaccgttgtatatccttctgccgcaagccctgcgataacaagcgctgctccggcgcggagatccggcgctgccaccgtagctcctgtatatttttcaacaccatgaataatcgcagtgttaccttctaccatctttatattggcacccatacggcgaagttcttctacgtaacggaaacgattctcaaaaatactttctgtaatcgtacttgttccggtagaaagccccagagtaattgccatctgcggctgcatatccgtagggaatccaggatatggaagggtcttgatctgtgtattgcaaagtcgctgtgttgccacaactctgaccgcatcatcagactcttcaatctgtgctccaatctcagacagctttgcggaaatcgtctctaaatgcttaggaatgacgttcttaatcagaacatctccccttgtagccgccgctgccatcataaatgttcctgcttcaatctgatccggaatcacagaatattctgtatcgtggaacttctccacccctttaatacgaatcacatctgttccagcaccacgaatatctgcgcccatactgtttaagaagttcgctacatctacgatatgtggttccttagctgcattctcgataacggtattcccctgtgccaatgctgctgccatcataatattgatcgttgctccaacagaaacaacgtctaaataaatacgactacctacaagctgttctgcctgtgcgataatcatcccatgctcaatctttacttctgctccaagcgcacgaaatcccttaatatgctgatcgatcggacggcttccgatatcacatcctcctggaagaacaacctgcgcctttttatatttaccaagaagagcaccgatcagataataagatgctctaatctttctgatatattcattatctacaatcagatcaccggcagaatcaatatcctttccgctgatcactacttcgttatcccctttacgttcaatacgggctccgattccttccattgcctgtaaaagaacattcgtatctctgacatttggcatattatcaattaaacattctccatctgtcataattgctgctgccagaattccaagcgctgcattctttgctccaccaattacaacttcaccaactaacggattaccacctttaataatatactgttccattttgcacctctataatctatcctaaacgttattactcttaacactaattttcaaactaaagtaaaatcaaataaaattccaggtaaaatatctctaccaaaaaaatggaattcctattccaaagattactctttatattttatacaaaaaataaattaaaaataaaattatcgtaatcctgtttcaaaaattcctgtcatgatattttatatctcaaacaatatgtacttttcttcacaattcaaactaaacctagaatcattttattatatcatattctctcgtttattgtaaatcaaaaattgttacaaaataaacatcttagtttatttattttttctcttttttttctttttgcgaacagaatatccaaatgtccccaaagattctcccaatccaaaatatgttccatgagaatatacaatcggcgccgccttctccaaatgaaacgtgcccttctcatccatataggtatcatctactgtcacatgtacaacgtctgctataaacattgtatgcgaaccaagtgccacttcttctctgacacgacactcaatattcaccggactatcttcaatcacaggcgcattgattttctttgcctctccctttttcagatcggtctgctcaaacttatccatatcccgtccggaacgaacaccacaaaaatccgtagccttcgcaagcttttctgtggtaagattcaccacaaactctcccgtttcatgcagcgctttatgagaatgtctctccggacgaacagaaatatagagcatgggcggattggtacataccgttcctgtccaggcaactgttataatattatcattcccttctttatcccttaccgataccatgaccgccggaagaggatataacatattacccggcttaaaatctaacttacccatactctttcccttctatttctatttgtatttctatttgtatttcttttctgtttctattcttatttctgttttctgtttcttttatttttattatttacttttgtttccaaagtattcttctacccgtattgttagattgactttttaatagactgtctgatctcttctaactgttctcctgaaatctcctgctgtggccagttaagattcagtccatcaccctcataacgaggaatcaggtgaagatgaaaatgatttaccgtctgtcccgcaacttctccattattctgaacaagattcaaaccgtcgcattttaatgcatccttcattgctcttgcaatacaagtagccagtgcaaataactttccggctgtctcgccatccagatcataaatattatcaaaatgttcctttggtataatcagacaatgtccctttgttgccggattcacatcaagaattactgtgaaatggctgtcttcataaactgtagcagagtgaatctctccttttgctatcttacagaataaacaatcttcttttatcattattacaaacacacctttctttttctttactaataatgtatatattaaaaccctttaaaacttaaaaatcaacgttgccagaggcggtacggatattttaatcgaatacggtcttaaatcccaacattccgaaacggctttcacttcctgatgctctccgcggccttcgccaccaaattctactgcatcactattagaaatcaaagtatatttaccatttttcggaatgcctacccgataatgcttcttctcctcttcactaaaattacatacaaacagcagattatctcttccggatggcgacttccttataaaacttaaaatgaaagattctgcatccatcccattaatccactcaaaaggagcacgcattgggtcatactcataaagggcaggatattcctgataaatccgaagcagtgacttcacatattcctgtgaagaaatattctcatgtgaatgcaagtcccatgcctttcttcctggaactcccatcaaataaccataagacatcctgactcctgttaacttatcataatcacaagaagccttcttgtcaatgaaagattctttaaaaagattatttttctctatactaatttctttattaagtaataataacgcacgagaaaaatccccgttcatcagtggctgtgacaactgaaaatattctttcttcctgctatgaatatctgcctttaaatacttatctactcctgcctttatttccagattccattcaaaatcaaagaaacttttcaaatctttatccgttgtctgctctccgataaataaaatattactgtcttcttttttaattacttctttggccttttttaaaaaatcagcagcaccttcacttaatcctcgaaatacaaatccatccatatgatattcccgaatccaaaaaagaatatttgcaagaagataatttatggcctgtgggtttttcttttcaaaaaggttcaccgccctccttaaatattccggtgatatttctaacaaaaccccgatatttcttttatgagaacggttaacaaaaaaacgcattgtatcgggtgtattcccataaaaagccggttcaaaaaagcctttatgcgccccaagtttttctccttctgacgttccacgaagcaaaatatgtgtatgtcccatatcctgtacagtttcctgtaccttctcatccggagaatccaattcactgatccggacttcacaaacagacataggtctttttaaaacatttcctcgatatctttcagaaagccatctcatatcctcccagtgaaatcgcttaagatcaaacattcttgaggcaccgttctctttttcctcattcataacggcataaggatcaaccatctgtgtgatctccccctgtgcatttttcacttcaaatttataaaactgcccacaggaaagtcccggaataaacaactcaaaaatatcagaattcttcatcttgtgcatcggatacagcattccattccagaaattaaaatctccaacgacactgacacgtttagcgcccggtacccatactgcaaaatacattccctcggtatctctaagcttcactttatgacaccccatcttatgatatacctcagtccagattccctttgaaaacattttttcctcttcttcggtaatcagcccttcataactatagggatcattacagatatacgtattaccatcatggaatgtcatatgtatctgataataaaaaggtcttttatgcggaagaaacaaggaaaataccggctgtctttctacggtgtccatcggatagtgtttcccatcttctgaaataacttccatctttaccgcatcgggatgataggcagagataacttgtccttccataataaaatgccgccccagtaaatctttaggtttactgcaattaccaaaaaccaattccataacctggtctttttttataacttcgctgatttcatatctcatgccgttccctcctcttttcagtttcttttcaaaacaggcatctatatatcaatatattcaaatatgcctactgtaattcctgtttgagtaactctatatcatgaatcattcatcattccataatcattcagaacctcattcgcacaatcaccgtctgattgctttggctttacattcctatgcatagctatagttatattataatttttttgcgcaaggaagtcaataaatggcaaaaaagaagaaaccctgaatacaaaaaccgcatccaggatttcttcttttattcatttatagcaactaaatttaggaaattaactttgaacaacatacgacgtaattacttactttctaccggttttcttaaaagtccgagcatgattgctccaacgatagcaccgattaataaagctacgatatacattaatgcatgtcctactacagggaatacgaagattccaccatgaggtgccatcaatgtacacttaaacgccatagataacgctccggctactgcagaaccgattacacaggaaggaataacgtggaggggatctcctgctgcgtatgggattgctgcttctgagataaagcaaagacccatgatcgcattaactggtgctgtttttctatcattgtctgtaaatttatttttaaatacccaggaggaaattgcaatggcaattggaggaaccattccacctaccataacggctgccataatcatataacctgcctctgtctgatatgctaaggaagctgtaccaaatacatatgctgccttgttaaatggaccacccatatcaatagacatcataccaccaacaataactccaagtaagatactatttgctcctgataaggaatttaacgcatcagcaagcaactgatttaaccaggagaagaatggattgattgcgaacataatcacactgaccaataataatccaactaccgggtaaattaacatcggacgaagaccatccatggaatctggcattttctctgtaatcttttctaaagctaatacaagataacctgctaagaatcctgcaaataatgcgccaaggaaaccaccggaaattactgtaacatccggattaaaacaagaagcaaatgttgttcctgcacttgcaacagaaccacctacaaaaccaaccattaaacctgggcggtctgcgatactcattgcaataaatcctgcaaggattggaagcataaagttaaatgccacaccacctgctgtcttaaagaatgccgctgccggtgtgttcataccaaagttagaaggatcaatagaataatcatctaacagaaaagcaatcgcaataagaataccaccaccgattacgaatggtaacatatgagaaactccattcatcagatgtttataaatctgacggccaaagctttcatctccatctgaagatgtgcttgctacttttccaccttcatgatgataaatcggtccgtcaccttttactgctctctcaattaattcctgagatttatgaataccatcggaaacctttactttaataactggtttaccgtcaaaacgagccatttctacatttttatctgccgcaataataattccatcgcaggcatcgatttcttcctgtgtcagaatattttttgctcctccggaaccgtttgtttctactttaatagaaattcctaattccttacctttttcttcaagtgcttctgctgccatataagtatgcgcaataccggtaggacatgctgttactgcaagtacctgatatccagatttctttgccgggacttccgctgctgcttcttctacctgagctgctttatcttcgtccccgtacttttctgtttctttttcatcaattgctgcaaggaaagcttctacgtcttttgcagataataacttttcacgaaaagccggatccattaaaatcgtagataatctggataacgcttctaagtgaacatccgatccttctgccggagctgcgatcataaagaagagattggatggttccccatcaagtgcctcgcaatctacaccacctggcactgtgattgctgcgatacccggcttaataactgcatcattttttgagtgtggaatacagataccttctgcgattgcagtaggtccttctgattctcttttcatgattcctgctttaaaagcttctttgtcttcaatgttgccaacttttttatgaaggtcaacgagtaaatcaagcatctgttctttttcgcttacatctgcattaagaacaactgcctctttttttaacaaatcgacaattctcataatcttttcctctctaaaaaattaaaactattcgctgatctgtttcagcatcttttcgtacatttcaagagatgcaagtccctctgaaaaagcagtggcgcttcctgctgctgtaccgctctttaatgcttcttcatagcttccgccacgaagataacctgcgacaaatcctgccaccatagaatctcctgcaccaacggagtttactactttgcccttcggtgttcccatcttaatattctgtccatcttctgtgataagaatggctccgtctcctgccatggaaatcaatacattaactgctcccatttcctgaagcttctttgcgtaatgtacgatatcctcatctgttttacagactgtcccgaacatttccccaagttcatggttatttggcttaattaaaaacggatgatattttaaaacattaagaagtaagtcttttgtcgcatccacaacgatacggattccttttgattcaagtcttgcaagaatcttttcatagatatcctctggtaatgtgtttggaatacttcctgctaacacaagaatatcctcttttgtaagagtatccagttttgcaaaaagtccattaattgcttcgtcagtaattaccggtccctgcccgttaatctctgtttcatcaccatgttttactttcacattaattctggaattgccttctggaagatgaataaaatctgtatgaattccctgtgatgccaatccatcttcaattgcctttcctgtaaaacctgcgataaaaccaagagcggttgtttcaagaccaagcgtattcaaaatcgtagatacgttgattccttttcctccatagaaaatagattctcttgtggaacgattcacatctcctaatttcagatcatcaagaaatacaacataatctaaagccggattaaaagttaccgtataaatcattacttttgctcctcctctcgctttgccctttctctcttttttaatggcttgctttgtttgtgattaaagtataacaaaatgataaattttatacatctaacgaatgtcattgatatcgatttgtatttgtcatatctttatatgacatttgtcacttttttagaatttcatcgatttgattcttcatttggaataaaaacgtactgctgtcgtccttctcattcacataaccttttataagattatctgttttttcatatgcttctgtatattctttaaagcgatagggaatcacacctgtatcaatcactgtatcaagaagagacatatctattatactgtctcccggagtatctttattcagcagattcattgtactctttgaagtatttactgattttaataccgatgctgcagaagtatcttcatagataagtttttgaatatcttcatctgttgtgagcatcttaataaaatcccaggctgcctgtttctttccagttcttgaactcattcctgccatcagcgcactcatttccgaacgattatctcccgatgggccggcaggcattctaatacaggtccattcgaaactggaatattttttaatccgccatggatatggcatatatgtgcgatagtcagaaaatgtaaatggtctgaacgccacttttcctaaatcaaaatcattcgatgtaacctgataattccgatttgtctcttccagacgttttacaaattcaagtgactgcgaaaatctttcatctaagaaatttgacgatgttccttttttgttgaatggacttattccatttgaatacaccgcctgaagccatgtataatcataatatccaaattgttcaatctgtccatcaccatcagaatccttcgccattttctcgcagatacgataaaaatcatcccaggtccaatcattatccggaacctttattccttctttttgtaaaagggtcttatttacaaacattaacgttggattacattccatcgggagtgcgtattggctgcctccatactgaccagccttatatacagaagaataaaacgcttcctttttaaattctttatctacattaattacaccatccagatttttcaaagctccaaatgatgccagcgtatgaaagtcttcatcgagaacaaaatatacatccggttcttctcccttcaaaatctgttcagataaccattctgaataatcatcagaaagtattcccttttcatattctactttcatatttggatattttgatttaaactttttaattgctttatcaagtatttcataatgcactgttcccggaacttcccagttacttccgtagaagatacctacccggagaacatcctgatcccaatagcgtaaatataacagactgctgataaaaagcaccgccattataaaaagaattcccgtcccttttttcagttttatatctcccattgtcttgctcctatatgtatctgttgaccgcaccggtctgcactgcccagatggcaagctgtgttctgtctcttaattcaagcttgcttaaaacggaacttaaataatttctgactgtcccttctgaaagtgccagttcggatgcgatttctttattagacattccacagccgattttctggataaccttccattctgtttttgtaagttcttctgtcagtgcattatctacctgaatagaataactgccttgcgccatatgattaaacagttttactaccttatctgtaatatccggattaatcatagcctttccactcacaactgttctaatcgcctcagcaagatttttcatggaaatcccttttaaaagataaccgctggctccatattttaaggcaccaaagatatattcatcatcatcgaatgttgtaagaacaataatataaatattcggatatttttcctttacaagacgggtacattctactccgtcaattccgggcatgcggatatccatcaaaataacgtccggcttctcctttttaatttgagaaagtacttcttcaccattctctgctataccagttacttccatatcctcattcgccccaagaacaattttcaaactttctcgaattaattcctgatcgtctgctattaatactttaatcatattctttcctttcctctgtttgtgttttcgtgtcctgttctatcattatcttatttcgaatcggaatctttgctatcattgtaaatccgatcaatccctgataattcacttcgccatttaacagttctactctttctcttatatgttttaatccaaaaccttccttgatatcttcacatccgcagccattatcactgataataatcgtcagttcctcttctttttcgctgatacgaatccatatctctgttgcttttccatgtcgtatcgcattggttgtgctttcctgaataatgcggtaaatgacctcttcttcatcggcttcaaatttcagttcttccatataggacacaaaatagattttcgtatttgttacctttgacatatcttctatcatctgatgaatcgcattatttaatgacattctctctaacgcatccggctttagctttcggacagaacgtcgtacatcctgaagacctcttcttgcagtatctccgattccttctaactgttcttttgctttatccggcgcaatatccatgagaacaagtaccgcatcgattcctacggatattcctgttaaaatatgacctaatgtatcgtgaatctctctggcaagacgatttctctccttcgtctctcccatcagctccttctcctgtgcaaattcatgaagctgttcatttgccttttgaagctgtgcatttaaaagctgtatcctctcccgttctctcctgtctttcatcataagaatcacgatgtatacaagaaataatatcatattcaatatctcacatatggtctttactccaagaaaaagactttctgtctctccatcataaaaagccacccatgtctcaaatgaatttaaaggaataaacattgtaactagattataactacataccatataacaaaggaaagaaataaacagaaaaatcaatttgttcttcctgtcttccacataagtaagcatgtctgctactataaggaagattactccattatatgtcatatccaactctttcaatacgaaaatcagaaaaataatttcaaatatattccacagtaaaactttctcttttccttcttcttcatttcttcttttatagtaaataatcccgcataaaaaacataatgagaatacgaccatgataattttttgttccggtctttccggcattaccttaagtgtttcaataaactgctgtgcttcctgcgccgcggctactctgtactgggtcagtacaatagtaaaagcaaggaacaaaacaataatacagttaagtaataccatcatcgtaaaacactgattcagatatctggcattctcttttcttttttccattccaccacttcctccttttactgccatcctgataagctgtactcttctacattgtcccttgttatgagcctgaccggaacaatatactggctttccaccggctttccggcaagaattttataaagcatttccactgttttctttcccgttattctcggagactgtgccgctgtcgccgtcattcgatttttataaatcatcgttttcgcctccggggatccatcagcgccatatacaagaacatctgacaacatatgttctgcatcaagtgctgccatcgcacccatcgcacttggatcatttaatgccactactacatctatatcttttgttttagttaaaacattttctaccaaaggctgtgaaacttctaactgccccttacattctatgtccccgatattttcatagttccatcctgctttttctaatgtttctttaaacccttttattctgtcgatcgctgatttattttccgactgtacaaggaataaaatctttcccttttttttacgtttcattaaatctttagcacactgtgctcctgctttatagttatctgagacaacaataccatcgacaaggctctggtcataaacaagagtatccactgcaataacaggaatacctgcttttttagctttcttcaaggagctgccgattgccttccagtctactgcattaattaaaatacaatctaccttttcatcaataaagccttctacctgctctgcctgcacctctgcatccatagcggaatctcttgtctctaatacatcccctttattctccacaaccgcttttatttcctcgttaatcacctcaaaatacggattgttcattgtcatataggatgcgccaatcgttctttttgcttttccagtttcatttttgtttctgctataaaacaaaagcatgatacttatggcaaatacgactgctacactaacatagcccacatataaaattatcttcttcacttgcaccttgcttcctcccattttttaatatgtaccctcaggtcttcacttaatttcgtatgatttcctcttatttgttattattataattgtaactttttcagcaatttttgtctatctatacacgaaaaaatcgaaaaacgcaaaaaacggcttaccttgacacagttactaaaaatacatatacttttaaataccataacccttatggaatcttgatgtactctcaaaatttttaagacttgattttgtaagagtacatactaatatactcccggaatctttttgtgcttgattttgcgagtacatcatactataacgaaggagggcgaattatgaattgtccaaactgtggcacatattacaccgagaatgaaaagatatgtaaaaaatgtcatactcctttaagcaatgccatttataatccggtagaacacgtagaggataaccagaatacatcgaataaaaagaaacgcttcgctccgattatcgctgtcttattgattttttgcatcatcacagcaggaatcggtggatacttttactacatttcccgcgtcaagcagggatgtcgggatgcgacaaaacagatttttacttatgcaaaaaatatggatttttccgatgtcgcaccatctgacttacctgaacctttaaaatccgaaccaaatgtacgtgaacttgtaaagaagcagctaaaaacttatattggtgacagtcagcttggttccctcgtagatgttgacagtattgatgttgatacattatgtaatgaaatggtcgaacaagcttcctacaagatcactgatatctccgcaacctataattcctgcactgttacagtcacaacaaaaaatattgacttttacagtttaccggaaacgatttacgatgagatcaaatcagagattaccgatggaacttcctccttatggacatccattaagaattctatttcttctcttttaggaggcagtgatcagacaacgattgaaaagattgatatttctcagaatctaaagaactggtacaaagaaacgaaaaagaacggaccacaaagaaaaacaaccggaaagattgtttttggaatcaaagatggtaagtggacactcatttcctttgatgaacgactcatttacggatattacggtctgcgtccaatacaataattttcaaaagttttcaaaaacaaaagaaggatagaaccacaaatatagctgtgattctatccttcttttattcttttctgtcaaacaattattgttcctgttcgttatttaaatactttcctatatgttcaattgcttttgtctcatcgtttccttctgcaactacattaacttttccgcctgcaggaacacctaaagtcatcattcccataatgctcttggcattcacctttttgtttttcacctccacatatacgctgctgtcatactgactggcaatctgaataaataatgcaatggtgcttggatctaatcccgaagggatcttaatctccatctcttttgaaatcatattaacctcctgctttgctataaatgaattttatcttagtattttcagacttgctaaagcaaatactgaaaaaaattacaaataccctttttcccgaatatcctgagctatctgactcagctttcttaatctgtgatttacacctgatttacctaccggagaatttaacttctcaccaagttctttcaatgtcgcatccggctcttctaatcttgcatacgcaatatctcgaagattctctgataatcgttctaaaccaactgtattttttatatattcaatatcttcaatctgttttctcgccgcggaaacggtcttatttatgtttgctgcttcgcagtttactcttcgattcactgagttacgtacatctttaagaatacgtacattttcaaacttcatcaaagagatatgtgcttctattatattcaatgcgtccgaaatcatagcaccttctttaagatatactacatagtatttcttccgcaatacaatcttcgcttccaatccaaaaaattcaaataattctcttaattgctctgctttctcttttgaaacacaggcaatctcaaaatgataattcttttccgggtctgtaatggaaccagcagaaagaaatgctccccgtaaaaaagctctgcggcagcaggttctctgcagcaccggattatcttttacaaaaaattcttcatccatctgacccagatcatttataagctgtactgtctttaaaatcttcaatgcctgagcagaatctttgatcgagatcatgtaaaagcgattcttttttaagtagtcatgctgtgtagtggaaacttccggctgaaaatgaaaaacttctttaatcagggaataaaatcttctggctaccgctacattttctgtgtgaagaatcagcgaatatcttccctcttcacactgcaatcttccacataaaccaatgatcgcagcaagttctgcaatcttgcaatgaatttcatgaccgtccacatgagaaagttcttcttttacttcagaagaaaatgacatattctatctccttccattcgttactttccttttgtccgggcatctttttcaatatccctgtgttccatacgaacagtatatggaagcttctttaatcttgcatacaatccattcgttatggtaacagaccgatgctttccacctgtacatccaataccgatcacaaggctgttctttccctcgtcaagataacgcggaataagaaactgcattaaatcttccagcttatcaagaaatcttcttccatctccattcttcatgacatattcctgaatagaacgatcattccctgtgagtggacgtaatgcctgctcataataaggattcggaaggaagcggacatcaaatacaagatctgcatcagacggtattccatatttaaaaccaaaagaaagtacagtaataataaagttgccgtaactttccgttccgacaaaaattttctccacttcctgacgtaattctctagtaagaagagttgtcgtatcgataatataatccgcactatcccgaataaaggaaatcatctccctttctcttgcaatgcctgtttctatgcggtcttcttttgcaagaggatgtgtccttcttgtttccttatatcttttaacaagtgtctcatcatctgcatccagaaataagatttcatattcaataccaagttcacacaatgtatctagctgactgttcagcttcgaaagctgttctccgttacggatatctactccaacggcaactttatctacttctgtctgcctgtcagacgcaatctccccgaaattcggaagcaatgctactggcagattatctacacaaaagaacccaaaatcttcaagaaccttcagcgcagtactctttccggcacctgacataccggaaactattacaaatctcactctctcacctctgtatccgtaaatccgataaaacggacttccggctgcatcataacattaaactgtttcattacttttttctgtacctgcttgatcagaaaaactacttcttctgctgtggcacctccacgattgattacaaaaccactgtgcttttcagatacctgtgcaccgcctacggtatatccctttaatccggcatcctgaatcaactttccagcaaaatatccttccggtcttttaaaagtgcttcccgcactcggaaattccagaggctgcttctcccttctggctttggccagttcatccattcttccccggatctgatctgcatctcctttttcaaatgcaaaacgtgcagatactacaacatagtttttctcaaaaatacaactgtgacggtaagataattctaattcttcagccgtcaaagtaaggaactctccatcctgcgttaacacctgcgcatcaagaagaacatcctttatctctccaccgtatgctcccgcattcatagcgacagctccacctgtggttcccgggattcccgctgcaaattcaaaaccggtaagtccggcattccatgcagctctcgcagtcctgctaaggagtgctcctgcctgtacttctattactgtatcctgcacagaaatctcctggaagttctttcctatctggatgatcattccccgaaaaccttcatcggataccaacaggttactaccgttacccataacaaaaaaaggaacccctgcttctttggcacaaaaaatcgcattcttgatttcttcctttgttgccggctgaacaaaaacgtctgccggaccgccaatagaaaaactcgtatgcctgctcatcggctcctgttctgtaactgttcctgatttaatctgttctctcaaactctgaaggaattccttattcataatatctcctatatctcctatctaaaacatatatgacaacgatatagttgcatccaatatttagatacatactatatgatactctaaaatgtgtggaagtacaatgtggaaaaaacacaaaataaaagggagcttttcttctccctttagataaaacgccaaaaaaatctaacatttttgccatctttcagaacatttactggacaaaaaagttctatatacaattttgcccagaattttctaaacaaaaaattactcgtccttctctgtttctgtattattagaaagacttcctgttacgcggttgtacagttcctgtgccgcattatatcccattttctttgctcgataattaattgctgcagactcaacgataaccgccagattacgacccggacgaattggaatcgaatagcagacaactttgttgccaaggaactcgatatattcttcatctaaaccaagtctgtcataattcgcttctctgttccagtcttccagacgaatcaccatatcaattgtctggttatacattacgctctccacaccaaacagtgtcttcacatcaacaataccaataccgcgaagctcaataaaatgtcttgtaatatccggtgaagttccaagtagagtatcatcactgatcttacggatctcaacaacatcatctgatacaagacgatgaccacgatggatcagttcaagggctgcctcactctttccgattccgctctcacccataatgagtacaccttcaccatatacatcaactaaaacaccatgaatagaaatacgtggagcgagttcctcactcagccaacgtacagaattcgcaataaagtctgatgtcgtcatctctgttgtaaagatcggaacaccgtttttctctgctgtatcaagcatctgtggtattggctctaagccacgacaaaatacaagacatggaatattaaaactgaaaatcttctcacacagctgggtgatggattcttctggaatctgctttatatatgctgcctcaacattaccgataacctgtattctctctgaatcaaaatgttcaaaaaaacctgcaagctgtaatgcaagacgattaacgcctgactgttcgatcataatactgtctgtatcaatatccggtaacaggctttttaagttcatcttttttacaaattctgtaagttttactttatacataatctcctccgtatcattcctgatatactcccggagtctttttatacattcaagtcgaacagcaccggggatacatctctgtttttcacaatgttagtatctacactcgtatgtctactataccacatccccattttttttagaagtagccgtatgaaaaaagcgataaatttcttctgctgttttttcagtaattccatctgccttacaaagttcttctactgaagcctctttgatttttcctatatctttaaaatacttcataagactcttccttcttgccggaccgattcctttgatatcatcgagaacggaatgtacctgttctttgccgcgaagagctttatgatacgtaatagcaaaacgatgtgcctcatcctgaagacgggttaccatgcggaacgcttcagaattctttggaaaatcaataatctcattctgataataaagacctcttgtccgatggaaatcatcctttaccatgccacagaccggaatgtttaaccccattttttcaagaacttttactgcaatatttacctgtccttttcctccatccatcatgagaatatcgggaaaacgagtaaaacttccaagcgacatatcctgccctttttcttctcgttctttttgctctctgataccatgagaaaatcttctctctaacgcttcctccatacagcggtaatcatccggtcccgctactgtccgtattttaaacttccggtaatcacttctttttgctttgcctttttcaaaaacaaccatagatgcgacattctcataaccatttgtattagaaatatcgaatgcttccatacgatttaagttttcaattccaagaagctgctctaattcatgaactgctccaatcgtccgatgctcttctcttttcagtttttcgctatcctgaatcagcacgttctgtgcattttttctggcaagttccatcatctgatgcttacttcctcttttcggcatcgcaaagtttacctttgaccctctcttatctgaaagccatttttcaagaatttctttatccaaaacatcttcctgcgttaatatttcttttgggataaatggtgttccaacataaaactgtttaataaaatccgttaaaatctcctgtttttcgctatccccaattcctgtcatatggaaatgatccctgccaaggagctttccgcttcggataaaaaatattgccacaaccgcttcgtctcctgttttagcaagtgcgataatgtctctgtcatccccaccggtatcattaatcttttgtttttccccgattcgctttacattttcaatcagatcgcggtactctgctgcctgttcaaattccagttctgctgccgctttcttcattttatcttcaagattatttatgatttccttctcatctccatttaaaaactttagggctttatccacatatttccgatactcttctcttgaaatataattttgacatggtgcatcacactgatttatctgatgataaagacagggccggcccttccctatctctttaggcaaagaccggctgcagctccgtattttgtatacttttctcattagttcaattgtatctttcaccgcccccgcacttgtatacggaccaaaatatttcgatttatctctcttgacctgtcggcaaaataaaattcttggataatcttcctgcaccgtaacacgaatgtatggataacttttatcatctttcaacatcgtgttataatgcgggcggtgttctttaatcagattgcattccaaaaccagagcctctaactccgagtctgtaatgatatattcaaaataagcaatatgagaaaccatgtgctggatttttacactcttattataactgctctgaaaatactgacgcacacgatttttaagaattcgtgctttgccaacatagataatttcatccttagcattatgcatcagataaactcctggctttgccggaagttttttcagttcttcctgaatatcaaacataatttactcttcctgttttacttcctcactgtctttcttttcggtaactttctgtgcatcctgactttccgcatcttttaatgaagattcttctgataccgtttctacttcggataactttgttttctccttatcctcttcaacactttccgtttcatctttctttaaagatttattgtaaatttccataaattctttaccggtaattgtctctctttcaatcaggaattctgcgatctcatccataacttctctgtggtcttcaataatcttcttcgccttatcgtatgccactttcagcatttcttttacttcttcatcgatgagtgcacctgttgcatcggaacagttcattaccgcccgtccgtcaagataacgattctgaatggattccagacccataagaccaaacttctcagacataccgtactgtgtcaccatcgctcttgcaatctgtgttgctctttcgatatcattagaagctcctgttgtaacagaatggaatacaacttcctctgctgcacgtcctccaaaaagtgttacaagttctccaagcatctgctctttgctcataaggtacttttcttcttccggaacctgcatcgtataaccaagcgctcccattgttcttggaacaatcgtaatcttttgaaccggttctgtattcttctgtacagcgattgccatcgcatgccccacctcgtggtaagcaacgattttcttttcttcttcgccaagaatacgatccttcttttctttacctgcaataactacttccacagcttctaaaagatctttctgagataccgcttccctgccggcttttactgccgcaagcgctgcctcattgatcatattcgcaagatcggaaccaaccgctcctgaagttgccagagcaatctcatcaaagttcactgtctcatccatcttaacattctttgcatgtacctttaatgtctcaacacgtcccttaagatccggtcgttctacaataactcgccggtcaaaacgtcccggtcgaagaagtgctttatccagtacttccggtcggtttgtcgctgctaaaataacaagaccctttgaagaatcaaagccatccatctctgcaagtaaagcattcagcgtctgttcacgttcatcgttaccgccaccgtaacggctgtcacgactcttaccgattgcatcaatctcatcgataaaaataatacatggtgccatggactgtgcctgtttaaacagatcacgaaccctagaagcaccaacaccaacgaacatctctacaaagtctgaaccacttaatgagaaaaatggtacatttgcttctccggctactgcctttgccagtaaagttttacctgttcccggaggtcccactaataatgctccctttggcaatcttgcaccaatttcaatatatttacctggattatggaggaagtctaccatttcagtaagactttcctttgcctcatcctgaccggcaacatctgcaaaagtaacccctgtctttttctcgacatatactttggcattactctttcctacgctgcccatcataccgccgcccttgccgattccacgcataacgaaatacatcattccatagatcagcacaaacggaagtacataactaaccataacagaaagaatcgcattcgatccactgctgtcctgctgttcataagagctgatcttattctgatcttctgcttcttttaaacgattgacgagcaatgcatcattcattgaaaccgtataatacgttgtcttcattaatggattctgctgtgttttcggttcaatataaatcttgcgatctgcgacctgtacttttttaatctctcccttatccagcatcgtaaggaacttactatacgaaatcttcttctgggagccgtttttataacggctcatcacagaagtaaagagagcagtaattccaagacaaacgaccagcaggataatcgcagattttatgttcttctttttgtttggattatcgttttgattatttttattgtccatttacgcctccatgacgttttataatttctttaatacctcaatggcatctttcatataattattttcaacgtactcaatctttcctgcatcacaggctgcagcaagtgttggatccattggaatcttagccagaacaggaactgcatactctgctgcaatttcatcgatatggctttctccaaataccttgatctgcttgccacagtcaggacactctacataactcatattctctactaaaccaagaataggaacattcatcattcttgccatgttaacagccttctctacgatcattccaactaattcctgtggagatgatacgataacgataccatctaaaggaacagactggaaaatagtcagtggaacatcaccggttcctggaggcatatcgataaacatataatcaacgttatgccataatgtttctccccagaactgcttgatcacaccgccaagtaccggacctctccagataacaggatctgtttcgttcgcaagcatcaggttcacagatacaatatcaattccgcaagttgttgtcgctggcagaatcagtccatctgcattacctacaagatttatggaaagtccaaaagcctttggaatagatggacctgtaatatctccgtctaagatagctgtcttaaatccttctctcatagaagctgctgcaagaagagaagttaccatagacttacctacgccacctttaccggatacaacaccgataaccttcttaacagaacttccctgacttaactttacaagaaaatcttccggtttcatctctctttctgcacaattttctccacagctgctgcaatcatgtgtacactcactcatagtatttacctctcatttacttaagtttttaataaaattttacccctgttttacttgttcatctgtttcaaaatttctttgacattcttctgaatatctccctcaaatacagcagaaccacatacaaatatattggcgccacattctgcgatttccgctatattagaagctttcactccaccatcaacctgaatatcaacatcaaggttcttctcggtgatcatctgacgaagtgctctgactttctctccacagtaagggatatatttctgtcccccaaatccaggattcacagtcatcaccaataccatgtcaagctccggcagaacatactcaattgcagaaagcggagtggcaggattaacagctacagctgccttctttccacaatccttaatctgatgcacaactctgtcaagatgtgtgcaggtttccgcatgtactgtaataatatctgcgcctgctttcgcaaagtcttcaatatatcttccgggatcctctatcatcaaatgtgcatcaaaaatagcatctgtcaacggacgaagtgccttgattacaggatttccaaaagaaatctgcggaacatacattccatccataacatcgatatgcacgtattctgctccagcatcaattgcagccagaacgtccctgcctaaattggcaaaatccgcagataaaatagacggtgctaatatcttcttcattggtacctccttaatttttaaaaatttcatcagtatcctctgacactttataatttaaaataactgtccagaattcaaaatcaaacatatctatatgatctatatgactctgtgtagttacattttaaatgacgagacaaagtctcacagtatatcttaacataatcatcaaatactgcaagctgaaaatatgaaaaaagcttgaaaatttgcaatccttcttcctcttatgctacaattcagtcataagtcacccgttcgacttcgattaaaaaatcatacttgtaattattttaaccgcgaaaggagtttatcatgcgtttttttgatccaacaaacacttatgcagaaagaaactgtatacaaaaccacaaaaaagatttactggctttggggacacgtgcttttgtcattaccggccacagttcttctaaaaaaaatggctcattagatgatgtcattgctgttttagaagaggcttccgttccgtataaagtttttaatgaaatcgaggaaaatccatccgttgaaactgtcgtaaaagctgcagaaatcggcaaagaatttaaagcagatttcgttatcggtatcggtggaggttccccactagatgcatcgaaagcaatcgctttgttaattgctaatccggaagaaagcggagactgcttctatgtcgaaaaagatttaaaagctcttccgatcgctgctgttccgacaacttgcggtacgggttctgaaattacaccagctgctgttctgacccgccacgatacacagacaaagaaaagtatttcctacaaactttttcctgatcttgcactcgttgacggtaaatatttactttccgcaagtaaaaatcttttaatcaatacatgtgtagatgcacttgcacatgcagttgaaagtcgtgtaaatattcaaaccaacatatataatcaaatgttttcaaactacgctttaaagctctggggagaaatcattcctttccttcgttcagaggatgaacttacagaggaacttgccgataagctgatgcttacctccacaattgcaggaatggcaatcgcacagaccggaacttctattcctcatgcattaagctatgatgtaacatatcataatggagtggcacatggaaaagcctgcggtattttccttgctgcttatcttcgcatatatgcaaagcacaaaccagaagatgttgacgtaatcctttccctcttaggatttgaaacactcgatgactttgctgccttcctaaaagaaattttaggtattgtaactcttacagaaaaagaagttttattttacgttgagcgcatgatggaaaacacatcaaagcttgcaacatgtccttttgaattaacaagggaggatatcgagaagatttatcgagaatctatcgtggttgaataaaaacagacgaaactgagagaaaggtatttggcaaaatgcttcgtatcactgcacttaaactgctcacccgcagtttaagtttgctctaaggcgcatttttgccaaatacctttctctcaatttctgtgttttgcaagtcaataaatatatccgcaggagaaatcttttgatttctcgcggagttgttaattcaggggggcgggatgaatcccccttcgcctccacaaatcgctcaatttttagcaggcatctgcataaagccagttcaaatcttgccaacaagcagaagaaccccgtatatccaagaagaaattttgtgactttgcgttgtggaattctgactgtaaccttgcgagctcgttttcgagcaaggttgttttatcaggcagaatggaacgtttaacgcaacggaacaaaattccttcttggatatacggggttcttcgtctgtctaccaagttctactcggctttatattatcgtcctaaaatctgagcaatctcaaactcatactggtcaacatctttagccattccgagtgcatcttcaatatcgtaatcgatatactgaccgttacggtatcctactactcggtttgttgcaccactgcaaagaagatctactgctaaagctcccatgtaagaagcatatactctgtcttttgcagttgggtttccacctctttgcatatgaccaaggatacttgctcttgtctctacaccagttgcctgttcaattctcttagccattccgtaagaatgtccaacaccttctgcgttgatgattaggtgatgtttcttaccaagtgctttcttctcaagaatactttcaattaactcattctcaagctttggtctattaccatcgaaacgttctgggattaagatatcctcagcaccggaagcgataccacaccataatgcgatataaccagcgtttcttcccattacctcgatgatcgaacatctttcatgagatgtagatgagtcacgaatcttatcaattgcctgcatcgctgtgttcactgcagtatcgaaaccgattgtatattctgtacatgcaatatctaagtcaattgttccaggaagagctactgtgttaattccctgtgcagataacttctgtgctccacgaaaagatccgtcaccaccgataacaacaagtccgtcaatgttatgacttcttaaaatctctgctgccttttcctgatactctaactgtttaaattcttcacatcttgcagtaaataaagctgtaccaccacgtgaaatgatatcacatgtgaattctttctccatgtcaaaaatctcatcgtttaacagtccgctgtaaccacgataaattccttttacatcaatacctcttgcccatgcggttctggctactgctcttaatgcggcattcatgcccggagcatctccaccacttgttaaaattccaattgtctgaactgcgctagtcttgttcatctaacgttacctccatttcataattccctaagtatactccctaacgattacatatattatctctttttttcagatttttcaatactcttctcgcgaacctttacatttttttcaccaaaaagtgattttaactcgctaaatacgtcattttttgcggaaatattttcgtatgatggaagtctttttattgccttttcttttttggaaaaaataacaatttcatcttttccaggatgttttctgataattccatatagtttttgttgtttttctgtgaattcttcaatattctctgtctgaatccagacttccttcggaatctgttcaatcggaacaatatattctgcgatcagctttccgctttcttcagaaacagaggctcttcctttcacataaataccctgatcttcaataagatatggctttacattttgatatatcgtcgggaagacaataatctctacggtaccgtataaatcttcaagcgtgacaaaagccatattctgattattttttgtaagctttgcagtgacgttactaataagaccaccaacaacataatgctgtccatccctcacgactgcacgtccactttcttcatctggctcaaaatctgttgatttcgctgttgtctgtttttcaagagaatccatatatttttgtaatggatgcccacttacataaataccaagaacttctttttccagcgcaagtttttgtgcatcatcatactctccgacatcaggatattgcatctcatattcttttttctcttcttccgagaaaaagtcaaataatgacatctgtccactgattgattctttccgttcccgatttacctcctcaagcaccaccggatacacgagcatctgctgctttcttgtttttccaaaactgtctaacgctccggacttaataagattttcgatcgtacgtttattaatttctttggaagtgagtctttccataaaatctttcaaatctttatattttccgttttcatttctttcctgcgtcattacatcgatgacgctttttccaagacttttaatcgctgcaagcccatatcgaatcgaatcaccagcaacagagaatcctgcttccccttcattgatatccggtggcaaaatagaaatacccattacccggcaggtattaatatattctgtgattttctttgggttcgtaataacagaagtaagcaatgccgccataaattctaccggatagtaacagcgcagccatgctgtctggtaagaaacaactgcataggcagccgcatgtgatttattaaatgcatatttggcaaaatcaatcatttcatcaaaaatcttatttgctgtttcttccggaattccccgccggatgcacccttcgacgccttcttcctcattaccgtaaacaaagttctgacgttctcttgccatgacttcacccttttttttggacattgctcggcgcacaagatcgcttcgtccaagcgtgtatccggcaaggcgcattacaatctgcataacctgttcctgataaacgatacagccgtaagtcggtgcaaggatttcttccaattccggacaggtatattgaatagaatcctgattctgctttcccttgatatactttggaataaaatccattggacctggacgatacaaagaaataccggcaattacatcttccagatttgtcggttttaattctttcatgaaagacttcattcctgcactttctaactggaacacaccctccgtctttccctgcccgatcatctcatatactttggcatcatcataatcaattgtatcaatgctaaaatcctgcctcagcttctgtccgatcattcgggcagcatcctgaataaccgttaaggtacgtaatcctaagaagtccattttcagaagacctaactcctcaatcgttgtcatcgtaaactgtgtcgttatgacattatctgctcctcttgacaacggaacaaattcatccaaaggcttagaaccgattaccactcctgctgcatgaatcgatgtatgccgcggcaatccttctaaacgcattgacatatcaacaagattttttactacctcatcactctcatatgcctgccttaattccggattagatttcaatgctttttcaatcgtaataccaagttccatcggtatcattttagcaacattatctacctgtgcataaggaatatccagtacacgaccaacatcacgcactgccatacgtgcagccatcgtaccaaaagttacaatctgtactactttatcttttccgtatttttcataaacataatcaataacttcctgtcttctctcgtagcaaaaatcgatatcaatatccggcatagatacacgctccggatttaaaaaacgctcaaaaataagctggtatctgattggatcgatattcgtaatttcaaggcagtaagaaacaatacttcccgccgcacttccacgtcctggtccaacagcaatcccttgactttttgcaaaacgtataaaatcccatacaattagaaaataatcaacatatcccatatttctgatcgtactaagctcataggaaagtctttcctgtaactctttcggcggcggatccccatatcttttcaccaatcctgtctcacaaagctcctttaagtaagaaaatgcatcatatccttccggaacatcaaactttggtaccttttgttcgccaaaaacaatttccacattacatcgctcggcaatcttatgggtattatccatcgcttccctggcatacggaaacactttctgcatttcttcttcggatttcagataatattgcccaccttcgtaacgcattcggtctttgtccgaaaccttttttccggtctgtatacaaagaagcagatcatgtggaatcgcatcctcttctctgatataatgcacatcatttgtgacaaccatcggaatccccagttcttttgaaagccgtataagactggtatttacctgcgtctgttcacgaataccatgatcttgcagctcaaggaaaaaattattctctccaaaaatatcacgcatttttctggcagcggctcttgccccatcaaaatcctcttttaaaatcttattcggaatctctcctgcaaggcaggcactcaatgcaataataccttcatgatatttctccagcacttcatagtctaccctcggtttataataatatccctcagtaaatcctctggttacgatcttcatcagattcttatagccctgattattctctgcaagcaaaacaagatgataatatctgtcctctcctcttgcctgttctctatcaaatctcgaacccggtgccacataaatctcacatccaagtatcggttttatccctacttcttttgcttttttataaaaatcaatcacaccatacatgactccatgatctgtaatagcgatgctatccattccaagttcttttgctcttggcaaaagctctttaatcttactagatccatccaacagactgtattccgtatgcacatgtaaatgtgtaaatgccataggtgtctcttcctcctcttacaacatttcgacaaatgctgtcattctcgtattgagctgtccaatatcctcctgtgaataatcggtctccacatgaatatacggaacgccctttccttttacaaacttttcaatactctttgcctccacattatatgtgtggcatgcctgcaatgtcatttccacaacaccatcaatctgatattcttctattaatcttccgatcaattcataacgattcttattcggtgtcataacagaacagccaatctgaagatatctttccgcaatcgcctcataaatatcctctgccgattcatctattaaacggtcaaccgactttgtaccgccacaattttcataagcaacaacaaccgcaccattctcctcaagcgctttaacaactttcataggtgctccgctgcttgggcatccggttaaaagaatcctcttctttttcggcattttttcgttctcttcatactctttcataatcttttcacgaagcacattgatttcttctggaaccttttctttatcaaaacggaactgacttccatataatacattaaacaattcctgtccattcatcggtgccgggtcatttttcataacttcataaagatttttaagcgcaattctattttcattcatcatatgaactgccttacgaacgttctcctctgtaatcaccactttgaaagtctgctccaaataagatttgaacttaagaatctcttctttccaaagctttaatgccgtttcactctgactgtttggaagttccataacgtaaacatttttaaactctcccatcagttcatacatctttttctttccatcacaggtcatctctccaactaccacatctgaaaaataaaagaagggacacttatctgatactgcaaagccataacttgcctttaccataggacataaatttcttggtaaatctctctccgccaccggaatcgtctcatcagatgtagaacaaagtcctactgtaaccgctcccatagccatcgcaatctcctgcggaaaatatgtacaatatgctcctataaccggaacattcttatccttaagctccttcatcgttaaaaaagaattctttctctgttccgcaaaatcttcaaaaatctccggcagtgctttaattaattccataatacttatccctttctcaataattgcaatctatgccttattataataatactatcaaaaaataatccctgtcaaattatacataagaagatttccacacgatattttatcatattacagcttcacaatccatactttcaaatcaagcacccacgatacttgatacacgattctaccagtgccagctgaatgagtttctacattattataatgggttttataataccctgttaaataatactcttggaatcagacagaatccttttcatcctctcgccattcctgcatttatgaaaagccacaacaagaacgatatttttataacaatttctctatattttctttctctttttcctatttcttccttgaatttttgccaagtagtatgttatactttttttagaaagaaagaggtgtttcaaatgacagaacgtcagtccaaactcattaaattggtaaatctttatcaaaaaatcgaagtgagtcgtttagctgaacttttagatgtgtctcaggtaaccatccgtaaagaccttgaccatcttgaagaagagggacttttatcaagagaacatggctacgctttaattaagaatgccaatgatattaatactcgtttaactataaattatgacaaaaagatcgagattgccacaaaggctgccgaaatggtttccaacggcgaaactgtcatgctagaatctggttctacctgtactttacttgcagaacagcttgcaaaattaaaaaaggatattaccattataacaaattcggcatacatagctatccgcattcgtgatcttcctattcgtaaagtcattcttcttggtggtgaataccaaaaagaatatcagggaatggtaggaccacttgtccgcaaatgtgcaaaagaattctatgtagataaattctttgtaggtacagacggattcattccggatgccggtttcacctgcgatgacttgatgcgtgtagaaacaatgaaatatatggaagactctgccaatcgtatgattattcttgcagactccagtaaattcagccagaagggtgttgtaattcagacaaccttctctgagattgatactgtttgtaccgatgctgatattccagaagatgcattagagaacttaaagagacataatattaacgtagagattgtggaataactactaattcatagatttcgtatagacgaaaaaagaaataatatcctatcccatctgctctgtagtcgctgtgtttaaaatgatcatccgcatcttaaacgcgctccgaagccgcctctgggataggatattatttctttttttctgactatctaaatctacagttttatttttctttctgcagccaggaaatagcttgagaatgcttcccatgctctgtctatttcaaactgggaagaatctgcacagtccttctgccacataattggacttggattaacaccaggtggcgatgattttctctgtggtgttctggctggaattattttttcgaatcaccttagtgttgtaatagtataaccttttctacaggcaattctactgtctctggtactgtttctccaatttctttccattcttttttagtgactttccaccatagcggactcgtactttttccgcttttattttctaagataagatacatctcaaatggtgcttcggatatgcgtttcaactggcaatctaccatattcaactttatagatgtattattatctatgtctgaaaactttactggacggatttcgtgtgcgcggattcctacatgggtaagattagacgggatttttatgtgttctggaaatgtgagttttatatcccactccaaagcataaacttccgattcactgagtttttcggctttagaaatatttttgcagcctgtgagccttgccgcattgacggttcccggattatcgaaaatctcttttgtttttccgacagtttctaagattccctgatgcatgattgctgtgtcagtacacatctgatacacttcatctctactgtgggataccatgataaccccttttttaaactgactaagataggtcatcatttcctgcattaatttttctttcaaataggtatctaatgctgaaaatggttcgtctaataacagaaactttggctctgctgccatcatacgggccagtgccgccctctgttgctgccctcctgaaatacgaaccggatacgaattttctaattcttttatatgaaactgttctagaaggcgttctacgatatcttttttttcctgttttgactttcccgatgcttccagtcctgcttcaatattctgtcgtactgtcatatgcggaaatagtgcataattttgaaatagatatccgactttacgtttttgtggtgaaagatcaatccctgctttcttatcaaataacacttcaccatcaaggacaatacttccttcatcaggtatttctattccggcaatacattttaaagtcatactcttcccacacccggaagaaccaagaaatccaacaattccttcctccatatcaaagtcaaccgctaattcaaaatcttttaacttcttttttatgtgaacagataatgccatagttctagcctttcttctccatagaaaaataattcatacatatgactacaataaaggaaatacatacaagaaccgctacatacttccctgcttccttcatgttacctgatgcgacagcggaatataccgcaagtggcagtgttcttgtctttcccttgatattaccggcaatcattgctgttgccccaaactctcctaatcctctggcaaaggcgagtaccgccccggagataactcctggccaggcaatcggaagctgtactttccagaagatcttccattcactcattccaattgtccttcctgcagaaagtacatctggatctacctgttcaaaagcccctcttgctgcccggtacattagcggaaacgagataacaactgcagctaaaacagttgctccccatgaaaaggcaaccttgacagcaaaatattcaataaaaaacttaccgattggtcttcgcatcccgaaaatatatagtaaaaaaaatcctgccactgttggcggaaacacgagcggcagggtaaatagcccatctaatattgttttcatcgtcttactcttcagacggtaaacaagctgggctgcagctactcccagaaaaaatgtaacaataatactgagtgtagctgtccttaaagatataataagtggtgataaatctattgtcatatataccagcctgtctttttattacttatgatatattacttacgtgttacttattgattgtgaatcctgctttttctaaaataactttcgcttcatctgtctgaaggaaatcttcaaaagctttcgcttcatctttatgtgtagaagcagatacgacacctaccggataaactacctgtgtctgcatcatagaatcttccgccgttgctaccacttctacttctttatcatcgccattggtattctcagtctgtgcatctgttgcatatacaatacctgcatctgcactgccttctgctacccagcttaaaacttctgttacactggctccaagacttgccttcttctctacctcattataaacgccaaggttggtaagaatctcttttgcgtatttacctgccggtacactctccggatcaccaattgcaatcgtgtcagcctttgtaatatctttaaaactcttgattcccaacttagaatctttcggtgtaatcagcacaacatcgttctttaacagatcaactactgtatcttcatcgataagtttctcctctgctaatgtatccatattagatgttgctgcagaaaagaatacatcggcatctaatccagattcaatctgatgctgtaaatctccagaacttgcatatgttccttctaccgttatttctggattctctttctcgaataacggaatcagttcattatcaaatgtagcctgaagacttgccgctgctgccacaagaatcttgctatttcctccttcggttgtaacttctgttgtttcttctgatgctcccttattcgatgagcctccacatcctgcacaggataaaaccatacataccgccaacactacaacaccaattctcttcgcgaacttcatgttcctcataactttctccttgttttataatgttttatattgttttgtgtcgttcttttacattatatttcatatgccatattttgtcaataaatatgcagcaagaatctaacatttttttagtattgctaataatttttaatttactaattcaagaatgccccgaaagttgatgccagcgaagagagtctatcattggtcactgaattaaatcagaataaataatttttcccatattttctacattatacccaccaagtccggctacttctttttgatattcagaagaacgaataatttctatcattttctgatatggctttttcaaaaaatcttctttacggataaccatatcataactttcttcctgtataaaaagaaaatctatccccggcacagacaaactatgcttctcgcttcctaccgccacatccgcatcccctctgtttactgccgcagccgcttcaagatgagaactcactatatcctgatatccatttacttcctgtgtaggaatccctgcctgtcgcagcttttcatcaataagaactcttacaccacttcccggttcccgattcacgattgttatatctggtctttttaaatcctcaaaagactggatatttttaggatttcctttctgcacataaaaaccctgctttctttttaaaagatgtaaaacaacaaggtcggttcccggtagcatactgctgatgtacggaatattgtaactgttcgtttttccatgccataaatgcgctgttgcaacattcacctctccctgatacattacgtataatgcattataacttcctttataagaacgaaatacattctccccgatacattgattcaaacgattcgccaataaatcaagaaccatatcctgcccacagataataatctgatcacacatgccagcctgaccaaaacccggatttgccattacatttttctctgttctattctgcgcattcctttcaaattcaactttttcgatattatttttctgctctgaatttccctcttgataaacttttgcctgacttccatactgaatataaaattccagatctccctgacgaattctcagctgttttccaagctttgaagctttcaaatctccacgcttaatcatatcatacactgtattctttcttacctttaatatttcagccgcttctttggcagtcagtaacttttcactcatcaatcatatatcctttcctgtactctttataagcttcctacaaatcgttctgtttctcaccacctgaaagaggtgggagtcttctcgattgagataaaataaatctccaaactgggtaattctattttacaccagtttggagattcacacaaactgagaaaattctagctttctccagccaaaaaacagcccactgaaaggtcttccaagaaaacagaaccgtgaaaaattccaatatagaaaatggactatcggagcagcaaaaatgcaacggagcattttctgcatccgcgactatttgtccattttctatattggaatttttcacggttcgtctgtcttaatcaaccctttcagtgggcgtctcgtttgcctgcgcaaactagaatttaaaaatcaaagccttcaattgttgcgaagtaatcttccggtgtctccgcacgacggatcattcttgtacttccatcttcctgtaaaagaatctccgcactctttaaacgtccattataattatatcccattgcaaatccatgtgctcccgtatcatgaagtacgagtaaatctcccatatcaatcttcggaagctttctgtcgattgcaaatttatcattgttctcacaaagggaaccgacaacatcataagtatgatcacatggttcattctccttacccataactgtaatatgatgataagctccatacatagcagggcgcatgaggtttgctgcacatgcatcaacaccaatatactctttatatgtgtgtttctcatgaattgcctttactacgagatgtccatgtggtgcaagcatgaaacgtccaagttctgtaaagatctttacatctcccattcctgctggaactaaaatctcttcgtaagctttacgaacaccttcaccgattgcaaaaatatcatttggctctttatctggtgtataagggattccaacaccaccggataagttgataaatccgatatgaacaccaagattctcttttaattctactgcaagattaaataagatggatgctaatgcaggatagtattcgttagatactgtgttacttgctaagaaagaatgaataccaaattcttttactccttctctcttaagtcgtttgaatgcctcaaaaatctgtggctttgtcattccatacttggcatctcctgggttatccatgatgtctgttccaagagagaaatatccgcctggattgtaacggcagcagattctttccggaataccacaggcatcctttaagaaatcaatatgtgtaatatcatctaagttaataattgctcctaacttctttgcaaggataaattcttctgccggtgtttcattagatgagaacataatggaattaccatcagcaaatccacaacggtcgctcatcattaactctgttaaagaagaacagtctgttccacatccttcttcctttaaaatcttaagaattgcaggagtaggtgttgctttcactgcaaaatactctttaaatccttcattccatgaaaatgccttatataaatcgcgtgctgtctgtctaatccccttttcatcgtataaatgaaatggtgtaggatatttctctacgattttctctaactgttcctttgtaacaaatggtttcttttccatctctattatccttccttatctatatctttactttttccttctatctcaatgagtttaatctcattcgccagtgcatcctttaacagccttaccagattaggattcgctgaataaaggcaggcagaagtctcttcatcctggagttctccggtaagtgcataacttgaatctgtaataagacgaatctgcccatccacagtctcctcgcatcctgcattcccagatgcaaaacttttctttcctgcgtaataaataatcgctccatccaatatatactgttcatcagttaaaagaactacctttttattctgtgccgtcagttctgctaattcttctctaaacaaatctgccacagaagcagctactgagagatatactcgttctttcacttccttaagcatatttcgaaacttatcttctatatgtcttcttccccgtatcgtaagatactttgcatcttcctgcttctgcttcggaatctggcgttccagtgtttctgacagttcttccatataatgaagcttgttcgaacagaactccttaatagaaaccgcatgatactgcactgcctgttcttctgccacataagctgctcccttatctactaaacctgccagtgccgcatatgcattcgaacgggaaataccaagccgcttcgctgcctcatagccgctaagtgcaccttctcctaaaagaagaatatatactctagcttcctgtctcgtaaggccaaaactcatgagtaattctacgttatccataaggtcctcacattctgtctttgactgtaaataacaacaatttatcaataagtagtatcattcagtaccactataattcatatccataaatttgtcaagctaaattggaaatacgaatttgatggactaaagagacgaaaaccagaaatttaatatagaagaaaatgtgatgtcggagcgagtaaaaatgcctgctcggcatttttactgtctcttagacacagcggacgcggccgacgacc

SEQ ID NO: 405 - DNA, 57486 bp, Eubacterium hallii
gtcggagcgagtaaaaatgcctgctcggcatttttactcgctccgacatcacattttcttctatattaaatttctggttttctgctttctggctccagatggaaattagtatttaaatcttggatgggagagaggggattgtccagaagtctgtggtttttatttggaatgaaaatctccagaagaggggtatcttcttacaattcagcatagaattttgttttagcggctgtctggttttgataacaaattagtgatttatgttggaaagataacaatttgagtgtcattcctttagaatttaatttttcggaagaccatagccttctggcacattccatgctgttaaaccacagatttagatagtcaaaaaaaagaaataataccatatcccagatgcgcttctataagattcaatacataaatattatcaaatcgattataaatagattctccgcccagtccggtgagacaaattaattgtgtattcgttttttcggcaagattcattaatgcttttaaaagatgttctgcattagtctgggcgaatggattatccatcaagagtacttttccttcatgcatatccatgaatatatcagaatcatctttcctcatataatccagcagacttgagagaatgacaaatgccgacaggaatccttctcctcctgaatttcttgccacctgattccagcttatctgtcgttctctctgttcttcaattttataaagttgaatctgtacatttccaatccctactacagtatcatataagtttttacttgtaacttttcttccaatatattcctgcgcattttcattgttttcaaataagcgtattccttcttctgtgatttcatctacaaaatcactgagacgaagattatataatttttcgttatcttcccagacaggcaaagttatttttaacattttcaaggatttttctctgatttttattgtagagttactgcctatccgcgcaagatttttatggatattttgaatataatcctgcaaaagttctgtgagatttttcttttctgattcaaccatcgaaatatctacttccagttgtttcattaaagagtcgtaggatgctatcgtaacattgagctgttgtaaaactttatctgcatcatcacagattttcagcatattttctaatggtgttttatagcttgcatcttgaaaagcttcctgcattgctcatatgaaatatctttctgcatatactgcacattaatcgtatctatatatgttgctatatcatccatcgtacacttttcttcttttaatgactgttccataatataaagtaatacgataaataaaagatttatctgctcatcgaactttgtaaatccatactgtttccacgataatttctgaacactgttttgaacaatgactgcatacaaacctacatttttcattctccgggggaaattcttcaaaaattcatactgcatattttttctccatctaactaaaaatctgaaatatttaaaatttcctgtggaacatatcttcccttttccaaaatttctttcatctgctttattcgttctgttgaaaaataagaaaagaaaatattttttatatttctattttgcctgtctttggtctctggaatactgacagccttcacagctttatctaacagcttctcatatccggccataaacggaatgattttccactcttcattaaaaagctcagctaaattctcataaattccaataccttcatagtccagatctccaaaataaaatatttggtttccttccgcctgcatataaggttccacacacaagtcaaaatcttcaaagcttcgaaaaatcccctttccagctccataaatcaacgtatcaatctttattccaagtatctcctcatttccttccaaaagatgacgacgcatactaaaaaaagtatctttattttctaatattaacaaattctgcggaatatttcttgtacgtgaataatatgcaagcggttctgtcgtctcgtaaatattaaaaaaagacagctccagtccacaccgattcaaaacacgctttccctgtcctctagataagaacttctcctgtccccagatttcaaaactgcgttcatttaccgatactttaaactgaagtgtcttttttttatttttcaaatattgatttaactcaagcacccatgtcctgtctgcttcataactttctaaatgtcttaaataataatctacagaaatatccggaacaatctcatatcttaattcttcaatataagtgctatagtccttcttttcttccaatacccagtactcacgataaagagccggactctttccattcaatctggaagccttcaccggcttaatcttctgttcctccagtagattcataatgtactcatactgtttttgataagtttgttctctgcatttttctaaaagtttttccaataaaatttttttcatattcaaatttctctataagatatttcctacagaaacctcccctgtctacataggtactctcagaatctttttgtacttgattttaatacttgattttagtatttcgtttcacaaaaaaactccaagaatacctatatgttagatatgttcatgtggacgccattgagaatcatatttctctgccatctctcttaaaagcttattatattcttttacatgttcttccggtgtgatctcgccattcataagtttctgtccaagttttttaaatgcattctctgaattcatttttaactctccttttattttgtctaaaatttttacgcatagttttttattctatcacaaaatataaggaatgataagtagaatttttaatactttgaatgtttgaatgctcttcaaaaataatacactgatacttttttaattatagcagtttctaatgcctttaaccataactttcaggaataccccggtaaaaagataaacaaagcatagattccacacattgcaggacaaaatatctcatgatatacttttaaaaacacaccaaactaaggagatgctatttatgaaaaaagatggtttttattcatccggagaatttgcaaaaatggctcatatcaccaagaaaaccttacggtattatgatgcccacaatattttaaagccttcttatctgactccttatggggcgcgcttctattccgatgaagattttgcccgcctgcaacagattcttctattaaaatatctgggattttcacttgatgatatccgggaaatgacgatcaacgattctgactatcattttatggcagatgctttgaaattacaaagaaaacttgttcaggataaaatagagcagctccagctggtagaacgtgcgattcaggatacctccaaagcaattgaagaagaacacagtgtaaactggagtcagatgcttaagctgattcatcttaccggtatggaaaaaagtatgaaaaaccagtatcagaatgcatccaatatttccgcacgtattcagcttcataataaatacagcacgaacacacaaggctggtttccctggatctttgatcaatgccacatggcagaacattcgaccgttcttgagattggctgcggtgatggttctttatggcttgaaaataaagaaaaaattccaaaacagctccatgtcgttctttcagatatttcagaaggaatgcttcgtgatacccggcgtgccattcatgcaaatgtaaaaacatcccgctttgatttccaggtttttgactgcgagcggattccatatcctgataacagctttgatcttgtcattgccaatcatattttattttactgcaaaaatctcacctctgtttttgaagaaatttcccgcgtactaaaaacaggaggcacctttgtatgcagtacctacggtgcaactcacatgaaagaaatcaatgagcttgtctcagaattcgatgaccgcattgttctttcagcagaccggctttttgaacgttttggaaaagaaaacggtgcagatcttcttgctccatattttcaaaatataaaatggttatcctatgaggactccctccatgttacagaaccggaaaccttaatatcttacgttctgtcctgccatggcaatcaaaaccagtatatcattgaccactacaaagaatttcgaaattatgtaagaaaaaaaacagaagacggcttcactattacaaaagacgccgggatttttattactatttaattcattgagagaaaacagacgaaaataaaaagaatagactatagcaaatgtaaagatatcactgcgtagaaaatgcctgttcggcatttttacttgctctcacattacatttgctatagtctattctttttattttctgtgtgttggctccagaaggaatgaattcaatagtctttgggggagataaggggaagagggcagaagtctactacttgttcggaagatatttctgtcatggaattttatttacccgctctcacattatacagttgcgatggtctattctttttattttctgtgttttggcttcagaaggaatgaatgcaatagtctttggggagagaaagaggaaaaatcagaagactactgcttgctcggaagatctatcatccagaagattattttctttaacgagcggtaaaaagaaagggcctgtcatcagtgaaacttgaaaaaaggttcagcatagtggagagagtaagtagcaggcttctgtcccctcccccttttccctcccaaagactattgaattcattccttttggagccaaaacacagaaaaaagaaatcataccatatcccatatgcggcttcggagcgtgattaggatgcggatgagcatcttaaccacagcgactacagagcagatgggatatgatatgatttcttttttcgtctgtttcccccaatgaatgaaatagcaaaaaaaaacacttgaaggtgcccttagggcatcttttataattatggtatcgtataacacaagagaaggagaatgtataatgaaaggtattattttagcaggaggttctggcacacgcctctatcctcttaccatggtaacttctaaacaattacttcctatttatgataaaccgatgatttattatccgatgtctgttttaatgaatgcggggattcgagatatcttaattatttccacaccacaggatacccctcgttttaaagaattattaaaagacggaagtcagttcggagtaaatctgtcttatgctgtacagccaagccctgatggactggcacaggcatttattatcggagaggagtttattggaaatgatactgtagctatggttctcggtgataatatttttgccggacatggtttaaaaaagcgtctttgtgccgctgtcaaaaatgcagaacagggtaatggggcaactgtttttggttattatgttgatgatccggaacgtttcggtattgttgaatttgaccgtaatggaaaggctgtttctattgaagaaaaaccggaacatccaaagagtaattactgtgtgactggcctgtatttctatgacaatcgtgttgtagaatatgcaaagaatctgaaaccaagtgccagaggtgaattagaaattacagatttaaatcgtatttatttagaaaatcactcattaaatgttgaacttttaggacagggatttacctggcttgatactggaacacatgaaagtcttgttgatgctacaaactttgtaaaaacaatggagcagcatcagcatcgtaagattgcctgtcttgaagaaatcgcttatttaaatggttggatttctaaagatgaagttctcaaagtttatgaggtattaaaaaagaatgaatacggtcagtatttaaaagatgttttagatggaaaatatcaggaaaatttatattaaatacagcagattttgatgtttcagaattacgggagcatcgttagctatggagtaattcgtaacatcaagttaggggcaatcccttttgactctaacatcatttatttaaaaggagtatttatttatgactattattgtaaccggcggtgccggatttattggaagcaactttatttttcatatgttaaacaaatatcctgattaccggatcatttgtttagactgtctgacttatgcagggaatctctctacattagaaccggtaatggataatccaaacttccgctttgtaaaagagagcattactgacagagaagcggtatacaagctgtttgaggaagagcatcctgacatggtagtaaactttgcggctgaaagccatgttgatcgttctatcgaagatcctgaagttttcttagataccaatattaaaggaactgccgtccttatggatgcctgccgcaaatacggcatcaaacgatatcatcaggtaagtaccgatgaagtttatggcgatcttcctttagaccgcccggatcttttcttcacagaagaaacaccgattcataccagctctccatacagtagctctaaagcaggagcagacttattagttcttgcttatcatagaacttacggactgcctgtgacaatcagccgctgctcaaacaattacggaccttatcattttcctgaaaagctgattccgcttatgatcgctaatgcgctaaatgacaaacctcttcctgtttacggaaaaggggaaaatgtacgagactggctctatgtagaagaccactgtcgtgcaattgatttaattatccataaaggacgtgtcggagaagtttataatgtcggtggacataacgaaatgaaaaatatcgatattgtaaaaattatttgtaaagaacttggaaaaccagaaagcctcatcacttatgttgcagacagaaaaggccatgatatgcgttacgctattgatcctacaaaaattcataatgaacttggctggcttccggaaactaagtttgccgatggtataaaaaagacaattcagtggtatcttgataataaagaatggtgggaaactattatttccggtgaatatcaggactactatgaaaaaatgtacaaaaaccgttaattcatttttcacgcgcatttacaaacagttatttttatcatattcaactttataaatataagaaagaggaattatatatgaaatttttcgtaacaggcgtttgcggtcagttggggcatgatgtcatgaacgaacttgcatcccgcggttatgaaggtattggctctgatatcgcaccggaatattctggtgtgcaggacaataccgctgtaacaaaaatgccttacatttcattagatattacgaataaagaagccgtaaatcaaatcttagaaacaacttgccctgatgttgttattcactgcgctgcctggaccgctgttgatcttgcagaagatacagataaacaggacaccgttaaaaaaatcaatgttgatggcacgcagtacattgcttctgcctgcaaaaaacttgactgtaaaatgatttatttaagtactgactatgtttttgacggacaggggacaactccgtggcagcctgactgcaagaattatagaccattaaacatatatggtcagtcaaaacttcttggagaacaggcagtcgcaaacactttagacaaatattttattgtccgcattgcatgggtattcggtcgaaatggcaaaaactttattaagaccatgctcactgtcggcaaaaatcatgacaaacttaccgtcgttaatgaccagattggaacaccaacctacacctttgacctggcaagacttcttattgatatggccgaaagcgaaaaatacggctactaccatgtcaccaatgaaggaggctatattagctggtatgattttacaaaagaaatctttcgtcaggcagtcgcgctcggtcatacagaatatgatgaagatcacattactgtaacacccgttacaaccgctgaatacggtgcatctaaagccgcccgcccatttaacagccggctcgataaaagcaaacttatacaagcaggatttacacctcttcctgactggaaagatgcgctgcaaagatatttaactgagattttaaatgaagaattttaataattaaaataaccaaataattaaaatacagtaacaaaaattaaaggaggtctctctcttgggacagattaaagtaaaaaagaacgttggaggaatcgaaggtttatgtattattgaacctaccgtacatggtgattctcgtggctattttatggaaacatataataaaaatgatatgacagaagcaggactgacaatggagtttgttcaggataatcagtcttcttcttctaaaggtgttcttcgtggattacattttcaaaaacaacatccacagggtaagcttgttcgtgtgattaagggtaccgtttttgatgtcgttgttgacctgcgaagtcactctgaaacatatggaaaatggttcggagaaatcctttctgcagaaaacaataaacaattctatatcccggaaggatttgcccatggctttcttgttctatctgacactgcagaattttgttataaatgtacggacttctaccgtccaggtgatgaaggtggtttagcgtggaacgaccctgaaatcgatattaaatggccaaaactcgtcggagaatatcctggttccccaatcggagaaagctatcatttagaagatggaactccacttactttaagtgataaagatcagaaatggctcggaataaaagaaacatttaaattctaatttgtagatttcgtgtagacgaaatccacaaatcaaatcgttatgattcgcaaaagatttttctttgccagtcgaatggaaacaatattttccttttcaattctggtaatgacttctgtaaaacggagatattctttttcgaagtgaagcagggcgggcagagcttctgatgcaaatccctgtctttgccattcttttaatatagaatatccaatttcaacataataatcctccgtattttccaacggtgaaaaaccggcgatgccaagaaaggtgccgtcggtttttttgaaaataccatagattccgtagccataaaaactatattgattttttatataatctaaaagaaaagtttctgcagcaacagttgtgcagcaattttgtggaaagaagcagccagatggattatttttattttctttctgtaacaataaaagttcaggcagttgtttgacggtaagttcacgaatagtgcagcgggaggttgtagttatcatcaggggaatatgatgatgtctgcaatatacttctcttagaaaaaacggactgagtgcatctgcatctaaaatcatccagggcgttcccatcagagtttcctgcttattattttcgtgagaaaatgcgatggctggaagattatatttttttgcaagttctatattttgatcaagatcacacaagacaagagaaaaatccgggaaatcagagaaggaaggaaactctttagaaattataaaatttatggtatagttaagatactctgaggaaaaatgcctggcgatagtatttcccaggttttcgtccataataataaaaaaattaaacataacagagtcctttctaacatattagtgtttcttattgtatttatcatacaaaagaaaggaatacttgtaaagaagttctgttttggagggtaatgatgcgaaaggaagagaatacagaaaaggaaaatctgtgcagtaaactacaggttcatttcatagagaatacagaggcggaaaagttggaagagaataccgcatcgacagatcagatttcaactgattcttctgtaaagccagaagaatgttctaagagaatgaatgaaaacaacagtgagaatgatgcacaggaggcagcaaacgaaagcaaacgcaaacatagacatgaaaatataacaagccagaacgcagaagctgttgaagaaacattttataaagtgacaggagaagcagagccggaacgtaagtcgcatccgattcgtaatgtgatactgggattgctggtattgattcttgtggcaggtgccgctatatcttatccgataggtaaagaatattttcaggaaaagtctgtagcaggaaaagatattgaagtaacgatcaaaaaaggaagcacctcaaaagatgtgggagcgattcttaagaaaaaaggtgttgtccgctataaaacagcctttttattaaagttatacttctccgattataaaggcaagcttcgttatggaacatttgatttaaacgatggaatgagtcttagcaaagtaattaaagaattagctactcagaatggtcagaaggaaaataaatttactattccggaaggatatacgattgagatgacagccgataaacttgaaaaagaaggaattatgactgcacaggaattccttacagctgtaacaaaagcggcggatacatcaaggtataaaaatattcttccagacaaaacaaaagtattttatcaattacagggttatatttatccggatacgtattatttgtcaaagaatattacaggggatcagctcgtagctaagatactcgaagagtttgataaaaagtttgatacgacaagacagcagaaagcaactcagcttggtatgtctgtagaagaagtattaattcgtgcatctctgttacagaaggagacagagttaccagaggaatatccaatcattgcaggagttattcaaaatcgtctcgataaaaagatgaaactgcaattcgattctacagcagtatacgcaatcacaaaaggtcagtatggcattgcaagagttatgtataaagacttagaagtagattctccatataacacttacaaatataaggggttgccggttggcccaatctgcagtccaagcttagaagctattgacggtgtcttgaatccgcagaagaatgattatttatatttccagatgaatacagtgaaaaatgatggctccaatatcttcactaagacatatgaagaacataaagcagcatcagcaacaacagaacagtagaatactaacattctgtcttttgctatttcacttcaacaaacgatttttttatatatcaatgatgtagggtcaaaaagtattttgcccagaacttgatatcaatgggacaatgtacttgtatattgtctcatttttttcgctttttccgcatttgtctcacttttacgaccgcatggtattatcaaattttgtaaaataaaaccatataatgcgcttacgcataacaaaatttgaaaggaaggtaagaaattatgccaaagccagttgcggaaacaggcaacaagaatttaatcggctctaacttaattgctttaagaaaaaaacaccatttatcacaaagagcacttgcacatgaactacagctcaaaggttatgatattgacaaaaatgtaattacaagaatcgaaacacaacaacgttttgtaacagatatcgaaatccaagcattttgtgaactcttccacatcacatttgaagaactaataaatccaaatatgaatttgatggactaaagagacgaaaaccagaaatttaatatagaagaaaatgtgaagatagtcgcttcgtagaaaatgcctgctcggcatttttattcgctccgacatcacattttcttttatatccaatttttgcttttctgctctttggctccagaaggaaattagtatttaaatcttggacgggagagaggggattgtccagaagtctgtggtttttatttggaatgaaaatctccagaagaggggtatcttcttacaattcagcatagaattttgtttcagcggctgtctgtttttaataacaaatagcaaattagtgatttgtgttgaaaagataacaatttgagtgtcaatcctttagaatttaattttccggaagaccatagccttctggcacattccatgttgtgaaaccatagatttagatagtcagaaaaaagaaataatgccctatcccagatgcggcttcggagcgtgtttaagatgcgaatgagcattttgaacacagcgactacagagcagatgggatagggcattatttcttttttcgtctacacgaaatctacaaactagtattttttaaaatctttgttctagtaaagtattatatatatttatctttccatagccccattctcggtttggatattcatatggtccatcttttaccgctccctgaataagataggttctcatgtcttgcccattcataaacgggtcgtagccggcaataaatgcccattcctgcatcaaagctcctattcctgcaccaaaggctgctgctatactgcttccgcttcgtactctttcttttccggctttttctccgtttctgtcaattcttgaaatcccagggatttttacagagactcctggggcagcaaggtccggtacaattcttccgtctcttgtatatcctttgcttgctcttatatataatcctccggttgtcacatcatatggcgtatatgttatggcgtactgagcatttcctggtgaagtgatggtctgttcggagtctggattaatgaatactgtttcttcttttaagaaattgctgatcggcatccagatatcatactgtttttcaccgtttcctgttccgtaaataaaaagcttccatatgccgggaacgagatttttaaaattcatccggattacctgcgaacctcctattgttgctcccggaaaagaacgtatttccaataatgtattttcgggaaaaaagcgaatgcttcgaaattctcccattttaagctgcatacgctcaatattttctcctccgggagacagaatccctactgtatacacatttggctcgtcaccccaaagctccatgatgaagccattttctccttctgctacattaaaatcaactgtctgatattgttcctctctccgtattattccatgaaaatgatgaccgctgattccttcgtttcctcctgcgatgtgaaaagaaattctgggaagtagcgatagataggaaatatatcttgccagaccattggctccattgtgtcctccaagattagttccgattccaagacagattgataccggtcttcccaatttatttgccacactgatgacataacgtactgccagcataacgtcatcctcctgacaggaccagatcccatccggaatagaataaaattcacgcaaatattttttactttgttttaattttacaacaacaagttccgcatccggtgctacacccgaaaatcccttatcgatatcttctcgtccggctgcaacggccgcgagaaatgttccatgtccattctcatctccggggagctttttatctttcttttttatcccttcactaatttcttctctcgtccattccgttccgtaaagaaatccttccggccttattccactctgattgctctgatcccacagtgagacaactttggaacttccgtcttcatataagaaaagggattcctctaatcgaatgcctgtatcaataatcccgatcaaaatcccacttcccctgtaaccaagctgaggagatcgcctgactttcagaattcccgtttcttctaattcttctgaagccatcagcccatagcattttggaacggtatcatatcgaaatcttctatcatcccctgtcaggggattcttcgactttatataaacaatagactgattatatcctataggaaacacacaatagtctgccagttcattttcaaaaaaattttcatcaagtaaataatcaacaagatattcctgatattcttcatttgccggaaccccaacacaatccttttcctgaagcaatgcctttaatccatcttgattactttccataaaatctccttctttaaaatctctttctttttttatatgaaaatcattacatcacacattaattatttgaaatattttctggaatattttcttttatgtatatgcattttcaggaaaaatgcttctatatttttgctattaactttttttgctatgccacaacaacgaattgtctatttttcataagaaatgtttaaatatctaccctcaaatttcttttccttctattgaaaactgtcctttcaaatgttaacatatttataatattaggattaaaaagtcaaacttcttatcgtgctgaccttttgactctgatatcacatttattaaataaagaccataatttagagcgtttctgcctttttctacatttggcaccgctccgaatcattctaaccagttacattcattaattttagcgttgaaagttttggaggcatttccagtgatcacaaaaaccattaacattaattctatggataagattaaaacttttgtagacataattaataaatttaacggacgttttgatttagtgtctggctgcagtattgtcaatgcaaagtccatcatggccattttcagtcttgatatttcccgcccggtttatctctacatctataacgaagattccgctgattatgttgcaaaagcattaaaagattttgaagtgaatgcattgcagatacaggaacagcttttagcataatgatattatccatttgacttaattgacgaacacaagaacatcaattttatctcagtcgagaagactcccacctctttcaggtggtgagtgacagcaaatttgtctcagtgggagtccaatctctgactgagataaacgctccgcgaggatgcgcagtgattctgtaaagaatatgtcagcttacgctgaccagaatcacgcgccaagtctcgcggctgctcgacttgaatttaatttaacaaaaaatgaaccagaaaaagtacagatacgatgcctgtactttttctggttcggtcaatttcttctattgaaagtcaaacacagaatgtttatttttctattttttctggttctggatattcttctccctgtgtatctacagttacggatgccattacctgtttttcgtatggggaatccataaatgtcttcacagatgcaatcttatctacaacatccattccttcaattactttaccaaatgcggcatattctccatcaagatgtggagctgccttatgcatgataaagaactgggagcctgcagagtttggcatcatggaacgagccatggaaagtacacctgcttcgtgctttaactgatttgtaaatccgttattagagaattctcctttaatactgtatcccggattgccggttccgtttccaagagggcatcctccctgaatcataaatcctttaataacacgatggaaaatcagtccatcataaaatcccttattaattaatgaaataaagttattcactgtgtttggagcaatctgtggatataattccgctttgattacatctccattttccatcgtaattgtaacaattgggtttgccattgtacttcatcctttctcatagttctatctatttctatttttaacatgataacatatttttttatattttccaactaaatcaatctccaactttctctcatttcccttctgataaaatatatgctataattattttcgttcgttttcagaaaattaattctgaatgcttttaatttcatgatgtttgggtcaaaagttcaaagctccgttcattcttgcacgataaggtatttgactttgggtcccgcgaaatataagaaaggattttttatgaatagaaaacttttattttttgatattgacggtacactgcttgccggaggcattcccggatatattcctgacagcgctatggaagctttaacgcaggcacaggcaaatggacattatattttcatcaacagtggacgcacatacggatttatgccagaagcaattaaggaatttccttttgatggctatgtatgcggttgtggtacagaagtaatctttcatggagaaactctttatcattatgatcttgatgattctttaaaacgcagtttagatgatattttaacagaatgtaaaattcaggccgtatgcgaaggtcgaaattcttgctattttcaggcaaaaaatgatgcagaagtctttgcaccaattatcactattcgtaattcttatgcaaagacaaatcttgaacatcccattcgttttcttgacgaccctgttttagcttttgacaagttcattattttaacagacacaaacagtgatattgatttatttcacacaaagctaaaagataactttgactttataataagagaggaaatgcatccttacggattcgaagagattgttcctaaaggatgttccaaggcaagtggtatcgatttcattgtaaagcatcttaaagcatctttagatgactgctatgtatttggtgatagtacaaatgatctttctatgctcactcatgtaaagaatagtattgctatgggaaatgcctatcctgaagtgcttagaaacacctcctatgttacaaccccgattgacagggatggaatcaggaatgccttaaagcattttaaattaatttaatattggtcggttttgattttctattcctaaacataattagatataccttccaaagattagcttgcagtttttttcataaactgttatagtggagtaaatattacagttacagctagggggatatttatgacagattttcttgtaaacaaatttataaaagacagtaccaatattgaaagtacagaagtccggactcgctatggtatgcttgccagcgttgttgggattttttgtaatgttttgttgttttccgtaaagcttacgatcggacttattctaagttctcttgctgttaccgcagatgcttttaataacttatccgatgctgcttcgtctattatcagctttatcggggtgaaaatggccgggaagcccgcagatgcggagcatccttttgggcatggaagaattgagtatattgcggctttaattgtttcatttcttgttattgaagttggatttactttctttaaaagttcgatttctaagatactgcatccagaagaaatcagttttgatcttgtaccatttgttatccttattttatcaatccttgtaaagttatggatggcattttttaataataaacttggtaaaagaattgattctaaagttatgcttgcaactgcagcagattctctcggagatgttatcacaacgagtgctactgtactttcgattattatctgccactttacatccattaatgtcgatgcgattgccggcctcattgtatctgctattgttatctggtccggtatctctattgcaaaggatacgttagaacctttaatcggtgagcgtgtccctgcggaactttatcagaagattacagatatcgtagaatcttatgatggaattgtcggaacgcacgatctgatcgtccataactatggtccgaatcgaagcatggctaccattcatgccgaagttccgaatgatattaatattgaagtatcgcatgaaattattgataagattgaacgcgatgtaaaaaaagatttgaatattcttcttgtgatccatatggatcctgtcgaaatgcgtgatgaagaagttctttctcttcgagagaagacttcccgcattgttcatgcgcttgatcctaaattgaattttcatgattttcgtgttttaaaagaaaatgaacaacgaaatctcatttttgatctggtgattcctgattcttattctgaaaaagatgcaaaccgcgtgatgcatcagcttgtatctcttcttcacgaaatggatgaaaatgtagaatgtattattacattagatagaagttttgaagcaccggaaagctaagccgtcacaacttttagtttttcttcctattcaataagccgaggcacagatttccaatgtctgtgcctcatttcatttactattctatattccctgcatcggatttttacaacttgtaaaatcaccattctctagctatatctatccttataaagcctcttttcataagcaatatacttctctgtttctactttataattctcctgtttcatcgttacaagataaacctcaagcatataaaaaatttccccattatgctttatcggcttacagatcaattctggaaaatctacatatcggaacacacttgccggtgtcacaccgacaaaatccttcgtatatactgtatgaagtattaaggaataaggaatttcttctaatcttaattctattccagccttctcttttgcattctttaaaacattcttttttgtaatagcatttcatcttggaaaaagcagcgtatatggaatcagatcttccaaataaatctcttctttatccgctagtagatgatctcgattcataaaagcacatagcggttcttttcctacaagggcatgcgattttaagtctttataacttctcttcccattctttttctttaaacccgaccaaaacaaaatcttcgcctacaacgattggtcgtttcacaagcataccatctgttgccagtaacgcatactgctcttcttcactcattccaggcagtttatcctttattccattattacgataaacctgtccacttgtattgaagaaacgctttaatggaagaccacttttcgcatgccattcctttaactcttccgcagttggattctcttctacaatatgtctgtcatcaaactccacatcatgatctttcagccacttacctgctttcttacatgtggaacactttggatactctacaaataaaactttcatccttatcctctccccttcttatctttctttaaaaagttttaaaatacttttataccttccgagaatctaaatattctctatctgccaatcgattggttcaagctcatgaaaacgcaggaattcatttgcctgactaaaatgcctgcatccaaaaaatccgcgataagcagacaatggacttggatgtggtgcctctaaaatcaaatgatttggatttgtaagcatcggctttttattctgtgctggccttccccaaagtaaaaatacaattggccgatcctgtgcattaagtacacgtatcgctgcatccgtaaactcttcccatccgattcctctatgagaattcgcctgatgcgcccgaacagtaagaaccgtatttaataaaaggacaccttgctctgcccactttaccaaatacccattattcggaatataacaaccaaggtcatcatgaagttccttataaatattaaccaatgatggcggaatatctacccccggctttacagaaaagcttaatccatgtgcctgcccgttattatggtacggatcttgtccaaggatcacaaccttaacatcctttaacggtgtcaaatgaaatgcactgaatatctcatcagacggaggaaaaatttcatgcgtctgatattcctcattcacctttttataaagttccctgtaatacggtttcttatattcttctttgagcgcctccgcccaatcattattaatcgctgccatattttatcctctatttccttcactgttttatctatattgctattatagcctatactcatgaacagtgcaataactactaatttgcgggactaaagaaacgaaaaccaaaaatttgagatagaagaaaaagtgaagatagtcgcttcgtagaaaatgcctattcggcatttttactcgctccgacatcactttttcttctatctcaaatttctggttttctgcttttaggctccagaaggaaattagtatttttgtttgaggaagaataaggggattgtccagaagtctatggctttccagggaatcaaattccaagaaactgacatttatataaggagttctatttcttttgccggtattccttgctattttcttatcgcgaaatagttctttgattaaaagtcagaatcttctggagaatccccttctctttccaacacaaatcactaatttgctatttgttatcaaaaacagacagccgctgaaacaaaattttatgctgaattgtaagaagactataataaagaaaaaagaattgtgataagttagattttgtgactttgcgctgtggaattttgactctgaaaacttcggactcgtttttccgaagttttcgttttttgaggcaaaatgaagcgtttagcgcaacggaacaaaatcaaacttatcacaattcttttttctttagaagactccatacaattcagctcaatatcttctactaaagcggcgtctgtgtccctagcaaattagtagtttatgatatattttgctgattggcagccctacgacgttataataatctcctttgattccagagataaataccgctgccggtccctgaataccatatgcaccggccttatctaacggatcaccggaagcgacataatctgcgatttcctgttctgacattgacaccatcgtgacatccgtacactcatgaaatgtttctcttttttctacagtacctttttttacgtaaaataatgcaactcctgtatatacctgatgagttcggccggaaagggaagccagcattgtctttgcatcttcttcatctacaggttttcccagaacttttccttcgagtactactatggtatctgccccaatcacaagacagttatcttctgctttattatgaagtctaactaccgcctctgcttttctcgcagcaagttcttccaccatttgttctggtgactcttctataacattctcatctgcattacttacttctactttaaattcaaaaccggcctgcgccaaaagttctctccttcttggggaaccggatgctaatatgatattcatgattttacttgctcctcttgcgttcttattttctcccgaattaataccatcttgtcatcggcagatcattatttactccattcgtaaatagaatctgatgtaaatcaataataccattcataaatgttgcagcgcaagcacaaagatataattcccacatacgaacaaatcgttcaccaaacatttctcttacttcatctttatgcttctggaagttttgattccagcaaagtaatgtcttattataatgtcttcttaaactttctacatccaatgtataaaattgatgatcccctgcgatatgaataatctcacgcaaagatggtataactcctcctgggaaaatgtatttctttacccatgcatctcccggatgctcctgcagtgcactgatataatgaagcaggaaaagcccaccgggattcataatgctttttacacatttcataaacagttcataattatctcttccaacgtgttcaagcattccgacactgacaacacgatcaaattttaagccggattcaggtaaatctctgtaatccatcagacgtacttctaactggctttccagatgattttccttaattcgctcctcaaacttcttcttttgctctttacttaaagtaattcctacacctttaattccgtactttttcgccgcttcaatcagtaaatacccccatccgcagcctatatcacagagtgtcatcccctctttcaaatacagtttcttgagaattctttctaccttctgcacctgtgcctgatataacgtatcctctggatgcttaaaatatccacaggaatagctcatcgtctcatcaagccacatcttgtaaaaatcattcccaatatcataatgagaagacacttccttctgctgattcttctttgtaagtgaagaaaaaattaatttcttcaatgcttttttatccgtagaaaacttgcccatctgtcccaaaaacatattcaaagcatggtacaggtcaccttctatttcaagctttccatccatgtaagcttcgccaagcgcaattgatgtactcgtcagtaattctttcatcgacggaatctcatgaaaaataactttaaattccggttctcccttacctatatggcttacctcatctccaattttcacatcaaatggatgttcatcaaacttgcttaaaaactttacaaattctttttctgtcaaattcatctctgtcactccaatcttttgctcaatcaatcggatgtctcctcgataaaggtgtaaaatcgccttgtctctacgaaacattcttccataaaataactattttattcagttttattacagaatatattctgccataggggattatagcactttttgacacttttcataagaaaaaaatgacaaggtttttgtaaattctgattctgtttgttggcagcagcttggaaaattagtttgagggattggggaaaagcatttatttagaagttacaaaatcccttctttattcataattttcagtaatttctttctgctgcgatacaaatttgacttcacatttgtttctgtaacttgatgacgctgtgcaatctctcgaatagaatctatataccagtaacgtcttacaaaaatgtctcggtcttttcttgaaagggttccaagaaaatcattcagaatttcccgtatctggtagctgtctatttctttttccatgctatactctccgcagagttccgcaacctcttcctcaatagaaatcatatgtgtatccattcgttttgcagcattcttccggcgataacggtcaatggcaagtcctctggctatttttcctgtaaatgcagacagacattttggtctgtccggtggaatacgtgaccagagtgtaaaccagacatcattgagacattcatcgcagtcttctttattataaaggacgttccagacaattttagagcaataggcagaatactttctacttacttcttcaatcgcttcctcatcccgttgaaaaaacaactgaataatcctcgaatcctccatattcttcctcctgtacattttataatttcaagtattaaaaaactgtattatgcatatttcccgatagctatgcttagatttttatcgtaaattttattataaatctttttacctgtccgcttattttcatttaaaataaacggcaaatttctttccagatggctttactgtatgctttgtcggatatggataggtaaagctttctgtgccatcctcatctttttctaattctattgcatcaagaaaataaaattgcagttccattgagttagcatccgtatccggcagcggaatgctataggaagcatttcccttctcaaattcattttcttcctccgggtcaaaaccttcactgttactgtagagataaacgccaccggcatctttatcgtactccaaatcaccaccgtaacatacaaggtttcctttgctgtcttttcctttcatatataccttggattttccccagaacttcttatcacattttacaaaaatactgcttgccactttactgacacgaaccttttgaacctgaacttctgtattatttctaagcttaacctttatgtctgtctctacactttttgcggaagcttgcagttcctttcttgatgctgaaaatgtaaattctacatcgccaagtacagttgcatctggagcctcatattcccgagttatataacgtatgattttaaacggtatctttaatttttctatcttctcaggaaatgtatatccatcaaatacatactttataagaacctctgtccctttttccccaagactgtgacttatctctgtactccggtttcccataacatcatccatgctttttccattgatgcatatgcttccactcggcgcaatgtccacctgatcctcatcttcgtttacactttctcttttgtcgttaacatccagcaaaacataaagagtatcttcatctaatataacattttctagcgtaacatccacatccgctaccgtttttgttgtattgagtatctgcgcatacgaagtcagatcttcacgacttcccaatattctgtctatctttattctgatattttctgccattactcttgccgtcgggttaaatgacacaccagaaagcagcaatgacacaataattgcaaaacacgccgctatctttacaagaatctgctgtacatttcttataggctgtatccactctcctgcagcttcttcaataaaacggtcatcgatatccgtcacttcctttaagaaatcccactttttactcataatgctctcctccttctctataaaatatataataaattctgccataagtcttgtagcagatttatatctcacactgcatagtaatgaaattactttttcctttactatatatgccgaaaaaataagtacttctgttgcatggaattactatttgattcatttagaagaaaacagacgaaaaaagaaacaataccctatcccatctgctctgtagtcgcatctgggatagggtattgtttcttttttctgactatctaaatccacagttgatgagaatggggattgcccagaaggctatggttttcattaggatgaatatctccagaagaggatattttcttgctcgattgtataaaaattacatttgcctactcctaccttatggagaatttttctctggttaactctcataatcttctggacaatcccctctctcccatccaagatttaaatactaatttccatctggagccaaaaagcagaaaaccagaaatttaatatagaagaaaatgtgatgtcggagcgagtaaaaatgccgagcaggcattttctgcgaagcgactatcttcacattttcttctatattaaatttctggttttcgtctctttagtccatcaaattcgtatttataaattggaatatcccatcagggcggtatctacttctcttgcacagtcacgaccttcgcgaattgcccatacaacgagtgactgtcctcgatgcatatcacctgcggtaaagactttatctacgtttgtcttgaagtgtcctgcctctgtctttacattcgtgcgttctgtgagatctaagccaaaagctttcgttacatatggctggcttcctaagaatcctgctgcgattaatactaaatcaacaggtacttcgtactcgcttccagcgacttctgccatgatgtttcttccggcttttttgtcgaatttacttttgagtgtgacaagttttgccttgcacacttcgcctttttcattggcaatgaattcttttacggttgtctgatatactcgtgggtctttgccaaataaagcgattgcctcttcctgaccgtagtctgtcttgcagacttttggccattctggccatgggttgtctgcctgacgttcatctgggagttttggcatcatttctaactgaatcaggctcttacatcctaaacggattgaagttcctacgcagtcatttccagtatcaccaccaccaatgaccataacatttttacctttagcatcgatgtattttttatcagcaaaattggagtctaaaaggctctttgttgctgcttttaaataatctactgcaaaatagattcctttgctttttctgcctggagctttgatgtctcttggattagatgctccacagcaaagtacaactgcatcatactgtttctttaattcctgtgcttttatgtctacgccgacatttacacctgtcttgaatacaacgccttctttttccatgagctttacttttctctggatatatgttttctcaagcttcatatttggaattccatacatgagcaatccgccgacgcggtcagaacgctcatatactgttacagaatgtccacgacggtttaagtattctgctacgcagagtccggatggtccggaacctacgatagcgactgtttttcctgtgcgtatttctggtggttctggtttaatgagaccactttcataagctcgctctatgatacttaattctttttctttgatattaaccggatccccgcctaaattacaggtacatccaacctcacaaggatgtggacatacacgacctgtaaattcagggaatggatttgtttttttcaggcgattgtaagcctcatcccagttacctgtataagtagcatcattccattcaggaatcaggttgttaagagggcatccggtaaccattcctttaattaaaattccggactggcaaaatggaactccacagttcatacatcttgcaccctgtctctcctgttcttttttggacaggggagtatgaaattcgttaaaatgtttgattcgttttaacggcgcttcacctacgctttcttttcgttcatattctaaaaatccagttggttttcccacagcgctctcctcctatcctcttttaatttcataaaatgcttcaatctgtgcctgttctgcgctaagaccttttccttccatttcggaaatcttctgaagcatcttcttgtaatcgtgtggaatgattttcttaaacttcggcagatatttgctgaagttatttaaaatttctttacctttttcagagtttgtatatgccacatgggcagtaatcatatccttgatttccataacatcatatttagaaacaactggttcggaagaaaccatttctttgttaaggcttaaatacagatcattatcctcatcaagaacataggcaacaccgccactcattccggctgcaaagttctttcctgtcttaccgatgatcagaaccttaccacctgtcatgtactcgcatccatgatcgccaacgccttcgacaactgcggttgcaccagagttacgaacacagaaacgttcacctgcgacaccattaatataaactttaccgcttgttgcaccgtacagtgctacgttaccaacgatgatattttcttctgctttaaagcggattccttttggaggataaacaatcagcttaccaccagataatcccttaccaaaatagtcattactatcaccgacaagctccaaagtaagaccatttggaataaatgctccaaagctctgtccgccggcgcctgtacattgtatagtaaatgtatcgtcttctaatgtatcatagtatttctttgtaatttcagaaccaaagattgtaccaaaggatctgtctgtatttccaacatcgatagaaatacttctcttctgctttttatcgagtgctgtctttaacttcgtaagaagaactttttcatctaatgtcttttctaattcgaagttgtattcattcttcttgttgtagtagattggatgtttcttatctatatatggattgttcaaaatagctgataaatctaagtgatactcttttgcttctggaagttcctttaacaaatctgtacgtcctaccagctcatctactgtacgaacaccaagcttagccatatattcacgcatttcctgtgcgatgaatttcatatagtttacaacatattctggtttacctttaaaacgctttctaagttctggattctgtgttgcaatacctaccggacaggtatctaaattacaaactctcatcataacacagcccattgtgatcagcggaccagttgcaaatccgaattcttctgctccaagtgctgccgccattgctacgtcacgaccactcataagcttaccgtctgtctcgataattactttattacgaaggtcatttttaattaatgtctggtgtgtttctgcaagtccaagctcccaaggaagtccggcattatgaatggaagaattacgaggtgctgcacctgtacctccgtcatgtccggaaataaggattacctgtgcaccagcttttgctacacctgctgcgactgttccgacacctgcttcggataccagttttacagaaatacgagcatccctgttcgcatttttcaagtcataaattaactgtgctaaatcttcgatactgtaaatatcgtgatgaggtggtggtgaaataagtcctacaccaggtgttgaatgtcttgtctttgcaatccaaggatatacttttcctgctggcaaatgtccaccttcaccaggttttgctccctgtgccatcttgatctggatttcctgtgcgcttaccaagtaacggcttgttacaccgaaacgtccagaagccacctgcttaattgcggaacatttattcagtccatccggtccaaccgtcagacgttctaaatcctctccaccttcaccagtgtttgacttaccatgaatcatgttcatcgcaattgccagagtctcatgtgcttctttggaaatagaaccgtaactcatagcacctgtcttaaatcgtttcacaatagaatctacagattcaacttcttcgataggaactcctttggatggataattaaaatccattaatccacgaaggcttactggagaagtttctttattaatcatggaagtatactgtttgaacaggtcataattatttgtccatgctgctgtctgtaatgtatggatcgtaagtggattataaagatgttcttctttaccgcttctatatttatgatctccttcactatcaagactcagatcgtttttcagacctaacatatcaaatgcttttgaatgatggaaatctacgtcttctgcgatatcctctaatgtaattccttctacgcggcttactgtattcgtaaagtattcatcaatcactttcttgctgataccaactgcctcaaaaatctgagaaccctgataagactgcagagtggaaatacccatcttagatgcaatctttacgataccatgaagaacagcgttattataatcatttactgctgcatagtaatctttctttaataagccatcctgaatcagcttcttaatactaaactgtgccagatatggattgatcgcacatgcaccgtaacctaacaatgttgcgaaatgatgtacttctcttggttcaccactctctaagataatgcttacagatgtactcttctttgtctcgatcaaatgatgatgtaccgcagatactgctaataacgatgggatggccacatgattctcatccactcctctatctgtaaggataacaatatttgcaccatttttatgtgcctgatctactgcgatatataaatgattgattgccttatcaagcggtgttcctttgtagtaagtaatcggcacatcttttacattaatattctttacctttgcatgacggatctttaataaatctgtatttgttaaaataggattatgtatcttaagtacatgacagttttctgctttttcttctaaaacattaccctctccaccaacatagattgatgtagatgtaacgatttcttcacgaatcgcatcaataggaggatttgttacctgtgcaaaaagctgtttaaaataatcaaataatggatgatgtcttttagaaagtaccgctaatggtgtatcaacacccatcgctccgattgcttcacttccatttaatgccatcggtaaaacagaatcttttacttcttcataagagtaaccgaacgctttcatcaggcggttgctctcttcatagttgtactcttctactgcaacgttcggaatctttaagtcttttaagaatacaagattatcagataaccattcaccataaggctgtttctttacataagaatctttaagaatatcatcatcaatcagctcaccttttacagtatctacaagaagcatcttgcccggatgaagtctctctttctttacgatatgtgttgtgtcaaagtctaagacacctacttcagaagaaagaatcagctgatcatcgtctgtaatatagtaacgggaaggtctaagaccattacggtcaagtactgctcccatgatatctccatctgtaaaaagaatggatgccggtccatcccaaggctccatcatggttgcataatactgatagaagtctctcttctctctgctcattccttcgttattttcccaaggctccggaattgtaatcatcattgccagcggaagtggcattccactcatcagaaggaactctaatgtattatctaatcttgcagagtcggaaccatttggatcaacaactggtgtcagcttgatcatttcatctttcagataatcagattccatgttttcttcacgcgctaacattttatcagcgttaccacgaatcgtattaatctcaccattatgaacaatgtatcgataaggatgtgctttctcccaacttggtacggtgttggtagagaaacgagaatgaactaatgcaattgcagattcataatctttatcctgaagatcattgtaaaataatcttaactgtccaactaagaacatacctttatatacaatcgttctgctgcttaaagaaacaacataagtagaatcgctggactgttcaaatactcgtcttacaatataaagacgacggtcgaagtcaagtcctcttggaacatcaaatggtctctttacaaacccctgcatgatacatggcatacaatctgccgctttctttccaagaatgcccggttgaatcggaacttctctccagccaaggaagtttaacccttccttctcaacaataatctcaaacattttctttgcacgatttctctgcagttcatcttgtggcataaagaacataccaataccgtagtcacgttccttgccaatagaaaaaccgagagtactacaggtcttttcgaagaatttatgggatatctgcactaagatacctactccgtcccctgttttaccctcggcgtccttgccggctctatgttcaagattttcaacaattttcaaggcattcgatactgtctcatggctcttaagacccttgatgtttactacagcaccaataccacagttatcatgctccagacttggatcatatagaccctgtcgcatattgtcctgatacatggtctcaccctttcttgcatcactataaaatagtaaatattcatcagttgtaaattatatttttgtaattagtaattgccagaaactcttcatcaatcctcatgatttcataatctcatcctcttatgattttatgattctgaaaaagtatttataaatatctggagaattacatatttaaaaaagtaacaaattcattttcagaagtagttacgataacttcctgcatttctttttgttgttatcatattacaacattttgggtgggttgtaaatataaacattaaggagaattatctaataatttgattatttatttttaaatacatcattttctgattatttctcttattttgcaggctattgtagttagtttatttggtttttatttctttttaggtcgtattgttcttataaaagcacaattttgtttgtgatttttcctctttattcatcattatttttatatttaaatacaattcacacaattataaatgtaatttttaaatataaatcctgcattttgttaacattgtatacaaaataacttaaaaaaattaagtgatgaaagttctctttataaagggaatttcatcccatcatacaacccagaaaagctatataaagtgaattttgattcattaagttaggagcaaaatatcttttgaccttaacatcattaaatatcaaaacaatattttcctttaccttgtcctctcacagctttaattaactcaaattcctgtatcttctcaatcaagaaccccgccttgctgtccttatacccaagcctttctttaatttcttttcgcccaaagacttcttctcctgaaaaactttcaataactgtctttatatttaatgcagtaacatggcttatcattgtaatttccggatcaattattggagtgcagctgtcaaatatcatatttgaaatatcatctgttaatctaaagggattcttctctccaatcccaataacttcattcgtcttatcttcaattccaataaaaattttgcctcccgtagaattagtaatacaattcccttctttttttcaacatgcaagaagaagccatgcatcggcatagctgacacatggcttctcttttgtattttataaagttttatcttttgtataactaatctgactgaccagttcaggctttattatttataaagctcaacgagtctctgcaggtgctcgtaacgttctttagcaaccttctcagattcgttgaagagtctttcagctctttctgggaatggcttaatcagacgagtataacgggattcgttattcaggaattcctgatatgttccgtcgccttctttagatgttaatgtaaatggattctttccttctgctttcttagctgggtcgaaggagaagaggttccagtaaccagccttaacggctttcttcatctcatcctggcaatggttcattccacccttagcgataccatgaagttcacatggagcgtatccgatgatcagggatggtccgtcataagcttctgcttctgcaagacatttaactgcctggttagggttagcaccaagagcgatctgtgcaacgtatacgtatccgtagctcattgcgatttctgcaaggctcttcttgctcatttctttaccagcagctgcgaactgacaaacctcaccgatgttagaagctttagaagcctgtccacctgtgttggagtacatctcagtatcgaataccatgatatttacgttttcaccggaagctaatacgtggtctaatccaccgaaaccgatatcataagcccatccgtcaccaccgaagatccatacagacttcttagcaagatactgtttcttctctaatacgtctgctgcatctgggcatcctgctgctgcagctttttctacctcagcgattaatgccttagcatctggtgtattttcttttgtattttcttttgtttccatgaatttagcaaaagctgccttaaattcatctgttgctttatcggaagctgccatcttctctaatttagcgatagcctggttacgtaaagtcttctgtccaagatacataccaaatccatgctctgcgttgtcctcgaataaggagttagcccaagctggtccctgtttggaatctttgtttactgtatatggagctgttgctgcaggaccaccccagatagaggaacatcctgttgcgttggagatgtacatctgctctccaaataactgagtgatcagacgagcgtaagatgtctctgcacatcctgcacaagatcctgagaactcaagtaatggctggttgaactgagatcccttaactgtagtatctgcaggagcgcctggttttcttccaacagttgcaactaagtaatcgaatactggctgttctgctgcctggctttcctgtggaaccatctttaatgcacccttagctgctgcaggacaaactgtgatacactcaccacatcccatacagtctaatggagatacactcattgtaaatttatattcgcttgcttttggctttgtatctgcaactttcatgttgtcaggagctgccttaatttcgtcttcgcttactaagaaaggacggattgtagcatgagaacatacaaatgcacactggttacactggatacaagcttctggattccattctggaacagatacagcagtaccacgtttttcgtatgcggaagcaccaagttcgaactgtccgtcagcgttatctacgaatgtagatactggcaggctgtcaccatccatgattccgataggttccatcatttctttaaccatcttaactgtctctggacgtcctacaagttctttagcaggagcatctggagctggattagaccaagaagctggaatctctactttatgaacagcgtctacaccagcatcgattgctttgtagttcatctctacaacagcgtcacccttcttgctgtaagacttcttagctgctgctttcatgaattctactgcttcatcgataggcatgatgttcgctaatttgaagaatgcggactgtaagattgtgttagtacgtttacccataccaatctcgatagctttatcaatcgcgttgattgtgtataactgaatgttgttgtctgcaatatacttcttagctgctgcaggcatatgatgatctaattcttcatcagaccactggcagttaatcatgaagattccgcctggtttaacatcctgaaccatcttgtaacctttaactacataagatgggttatgacatgctacgaagtcagcctggttaatgtagtatgggcttctgattgggttgtcaccaaaacgaaggtgagaaattgtgataccacctgtcttcttggagtcatactggaagtatgcctggatgtatttatctgtgtggtcaccgataatctttgtagagttcttgttagcacctacagtaccgtctccaccaagaccccagaacttacactctactgtaccaggagcagatgtgataggagctggtttaacttctggtaaggataagtttgtaacatcatccacgataccgattgtgaaacggctctttggagcatctttttcaagttctttataaatagcaaatacagatgaaggaggagtatctttagaacctaatccataacggccagctgtaagaacgatgtcgttaagacctgcttctctaagagttgtagcaacatcaagatataaaggatctcctaatgctccaggctcttttgtacggtcaagaacagcaatcttcttagctgtcttaggaataacgtctaataatgcagaagatacccaaggacgatataaacgaactttgattaaaccaaccttttcaccttttgctgttaagtaatcaattacttcttctgctacgtcacagatagatcccatagcgatgattacgcggtctgcatcttctgcaccatagtagttgaataaatcgtagttagttcccagtttttcgttaatcttgcccatgtatttcttaacaacagctggaagagcttcgtaaacagagttacaagcttctctgtgctggaagaatacgtcaccattttcatgagaaccacgcattgctggatgttctgggttaagagcatgctcacggaaagctttaactgcatccatgttgcacatttcttttaagtctgcataatcccacttttcgatcttctgaatctcatgagatgtacggaaaccatcgaagaagttaatgaatggaactttaccttcgattgcagcaagatgtgctacagggcttaagtccataacttcctgtgggtttgtttctgccagcatagcaaatcctgtctgacgacatgcatatacgtcactgtggtcaccgaaaatgttcagggactgtgtagcaactgtacgtgcagatacatcaaatacacatggaagctgctcagctgcgatcttatacatgttagggatcataagaagaagaccctgggatgctgtaaatgttgttgtgatagcaccagctgcaagagaaccatgaacagtacctgctgcacctgcctcagactgcatctcactaacaactacctggttaccaaaaatattctcctgtcctgctgctgaccactggtcaacggaatctgccattggactggatggtgtaataggatagatagctgcaacatctgtatacgcatatgctacgtgagctgctgcggtatttccatccatagactgttttgctctaggcattgattattcctccttgtcaaaagttgtggtttattttaaattcgacataatattatcattttttcgaggcaatgtaaagcttattcggaactgttccttctaaaatacaaaatcttgtccgaaacagcctttttatgccaaaatttccccttgacagcgtattttttcgagtacaattttatgttaatttcgtctcgaaactaacaatgtattataccgacttcttatctcttaatttgtctatttttatcaataagatattggagggtcaaaaggtattttgcagctatcattttttcacttaaatcaacaactcagagaaaattatacagtaacatcaccgtaaaaaatttatctgaaaaaatacaatcgcaattcccagacacaaaaaaggtcccagcgcaaaacactccttatacccaatacgttttgtgagcaaaagaaacactccacaaaaacctcctaacaacagaccaaaacaggcagcaaaaacattccctgtcactcctaacagcactccacttgccgccattagtttaatatctcctccacccagcccaccggaagacagtacggcaataataaaaaatggaatgctcactacaaaaatcccaaatactcttcctgttattgtaatcttctgaaatacaaaactgctccatattcctgccaaaaataataacatattcaactgatccggaatcatgtgaattttaaaatccacgattgaaataagcagcaagattccaaaaataacaattactgtaactaatctcaatatccgctcctccctctcaagaataccgcagcattcttgcttgactttgttgttcttattcttatcctatcctttcttatccttatcttgccttatctttctttatatttctttatagaaagacttcgaaagttctttgtgtttttcattccttctaattccaattaagtattttatttctatttatatatttattttacattttattccatttttcatattctgtcaactatttatttacaaaacagacgagaaattatatactatttttaggaggatataaacgaatatggtcaaaataattgaaacagtctacaattttttatggggagatttgctcacactgcctctacctggcggcggaactctctccctttctcttttagtcattttactaattcctaccggattttatttcacgatccggacaagatttctaccaatacgtctttttaaagatatggtaggagctctttttgaaaaaaaaggagatgagaaaagtgcactttctgtcatacagacactaatcgtttctacggcaacacgtgttggaatgggaaatctggtcggtgtcgttgccgcaatttctgccggaggtgccggtgcggttttctggatgtggctcacagctcttatcggatcatccacagcattcatcgaggcaaccttagcacagatctataacgaaaaggatcctctttacggaggataccgcggtggtccggcttattacattcaccgttatttcgaagaaaaaacaggaaaacaaaaacgttacgttcttgtttccgtactttttgccatctccggtttaatatgctggtgtggcatcagccaggtagtaagtaattctgtagcatctgcatttaaaaatgcatttcatattccaccgctttacaccactattgttctcgtagcacttgccgcgattattgttcttcgaaaaaatgcaacggtaaaggttttagatatcatcgttccgattatggcaggattttatttattgattacattgtttatcattatcacaaatatcacacagcttcccggagtattttcacgtattttttctgaagcttttggactccgtcaggtagccggtggcggctttggcgccgttctcatgaacggaatcaaacgaggacttttctctaatgaagccggttcaggttcggccccttgtgcggcagccgctgctgtttctgataatcctgttaaagtgggattaacacaggcattaggagtttttattgatacacttatgatctgtagttgtactgctatgatcatgcttcttacaccaactagtcttacaaaaggacttgttggaatggatttgttacaaaaagcaatggaataccatttaggtacatttggagtaatctttattgccatcactttatggttattcagtttttccacttttatcggcattctcttttatgcccgctctaatgtagcttatctattcggagacaactggttctctcagactgcttacaaagttctcgcacttgtaatgctctttgtcggaggacttgctacttatactattgtatgggatttaggtgatgtaggcatcggattgatgacgatttttaatatcataatgctgtacccactatcaagaaaagccttaatagccttaaaaaattatgaaaaagctcattaaagataaatagccgaaaagcagaaaaccagaaattctatatggaatttctggttttctgcttttcggctccagatggaaattcgtatttattcttctaaatcttttgctaatatttctttcattgcttctaatgcttctttttcatccggtccgtcacacacacattgtataacatctccctgtcggaatgttccactaatcaagttaataatacttttggcattcacatccatatattctgtcttgaaatggatctgacaatcataacgatccgccaaattggcaatcttattcgctggtccaaggtggattccctgctcatttataatagtcaattccgcgtgtaccatatgtttctactcctcctccatacttatacctgatatgtttaactttccccttctcaattaagaaaaaagctatttctattagttttattttatcacatttcagagtagtcttcaattatcaaagcatcggcaattctagctgaaatccaacaaaaaatctctttatataaattgaggtgcggtaaaattatctgtctttgattgcagtcacttcaacttcaattaacagatcttttggaagtcttgctacttctacacaagaacgtgccggaaatgcacctgtaaaataggtggaataaatttcatttacttttccaaaatcgtccatatttttaatgaaaacggttgtcttaatagcctgatccaggctacttccggcatctgcaagaagtccttttaagttttcaaaaacctgtgttgtctgttcttcgatcgtagctccgacttcacctgttgccggattcacaccaataactcctgatgtatatataagaccattatactctattgcctgtgaatatggtccaattgcagcgggggacttttctgatacgataactttcttttccataattaaattcttcctttctgttcttcctgatatagtaattgttatctttatattaccatatcactgttgtctttttcattgtattatttcttttaggactttttaacaggcaaaacttactccaggataaactgctgttcctgccctgtaatatctataatttgtcctgtaagaaacttcctgtcattatttctcttgtatctttcaataatatcatactgttcccaacaatgcatcggaaaaataaaacgtgctccgacattttttataaagtaatctattccaagagtttctgattcttcctgtcttggatcgagaacaacaaatgcataatcgatactttcttttttcaaagattctaattcttctttatattgccgttccatcattttattatcttcttccggctctcccggccaatcccaccaatgaagatctcctgcatgataaattgtctttccttctgtttttacaagaaatgcaactccttcatctgtagattttagtgtagacactgtacatgcatctatgactttttcttcatgaggcttcataaatagaacattctctgcttttttccaaaaactacttgctcttttaatatccgaagataaaacataaacaacttttttacatttattttctaatttaaaaatatctttcgtataatgatcatgatgcgcatgactggaaaaaacataaagttctttatcgtattgcagttctgggagctttccttcccaataatcaaataataaataactttcttttgtttccacaagaaagccactatgtttaatatacgtaactgttactttgtccattttatttttcctccaaaattttttcttttaaatcggcttgaaatataccttcttttaacatggcaatttcatatttatatggagcatatgctctctttttcgtttctggattcggtatatagggagtttccagtattttaggtacttgttcaaactctttattataaacgattttttgcagacattcataaccaagctcgccaaatcctatattctcatgacggtctttgtgagctccctgaggattcttactatcatttatatgaaaaaccgcgatctgctcttttccaataatcttatcaaatgtctctataacataatcaaaatcttcttttactgcataaccggcatcacttgtatggcaggtatcaaaacagactctcaatcgttctgcatgctctacgccctcataaatagcagcgatttcttcaaagcttctcccaatctctgtccctttcccagccattgtctccagtgcaatatttactgttccgtctttatctgcatcaaatactttatttaaccctttaataatctgttttattcctgcatctgctcccgcacctacatgcgcacccggatgtaaaaccagtgtcctgcatcccaaagcctgtgttctctcaagttctaactgcaaaaagtctacagccagttcaaatgtttccggctttaccgtattcgccagattaataatatatggcgcatgcactacaaactcatcaatcgcatttttcttcattaattcccagccttcttctattcgaagctcttctattggctttctacgcgtattctgcggtgcaccggtataaatcataaatgtatttgcattataagaaagagcttctttcacagatccgagaaacatctctttcccactcatgccaacatggcaacctaactttatcataataatctccatatcttttcattgtattttctatctattttctgtggctttataataccaaaccaaaagttgatgcgcaagaaaatagtaatttctgattatctgttttttaatgcatgacgcgcatctcgcagcaagactgctggggcattcttgaatttttaaaaattacataatttatcttgacattatcgtaagaaaatggtattttaacaagcaagcacttacatgctttaaagtgttaatttttaaagtattgtagtgtggtttaatattatatttatggaggaattattatggatacaagaatttcaggcaaaacaagattattaggtgtattcggcaccccgatcaagcactccggctcaccgattatgtacaacttctgctttgattattacggaattgattgtgcttatcttgcctttgatactgatgcatcccaggtaaaagattccttagctgccatgagacgactgaatatgcgtggtgccaacgttactatgccatgtaaacaggaagtatgccgcaatatggataaattatctgatgctgcaagattcgttggggctgttaatactattgtcaacgataacggcgttttaacaggccatatcacagatggtatgggtgttgttttagatttaaaagatcataacgtatcaattatagataaagatattgttttatttggtgcaggtggagccgcaactgccattatggtacagtgtgccttagatggagcgaagtccatcactgtatttaacagaagcaatgaaggtcttgagcacgttgcttctatcggacagaagatgatggaagatggtgtgaagtgtaaattggaattccattcactgagtgacacagattttatgcatgaaaaagtacgcagctgcgatattctcattaatggaacctgtgtaggaatggctccggctcttgatgggcagtctcttattactgatatgagtgtatttcatgaagatatggttgtgtacgatgttatttaccatccactagtaactaagcttatggcagatgctgttgcaaatggatgtaaagaagagaatgtcattggtggaaaaggtatgcttttatggcagggagccggtgcatttaagttatataccggacttgatatgcctgctcaggaattaaaggctttcctcgctaaacgagaagaagagggtgttgaaccacttgcagacgttgcagaaaatgttcctttctagtatactacattgttagggtcaaaagatattttgcccttaacagcattttatactggaaggagaatatattttatgccaattggaattattgtgaactgtcttggaattatcatcggaggaattttaggtacctttatcggaccacgattaagtgaatctttcaagacaaatctcaatttagtttttggtgcctgtgcgatgaccatgggcattagttccattgccctgatgaaaaatatgcctgctgttatcctttctgttattttaggaacagtaataggacttgctattcatcttggtacaataatacaaaacatggggatgggaatggaaaagattatttctaaaattattcccggtcagggaacaaaggatgcagaatatcagagtgtactggtaaccgctatcgtattattttgtgcaagcggtactggaatctacggaagtatcacagccggaatgactggtgatcacagcattcttttagccaagacaattcttgatcttccaaccgctttaatctttgcctgcgttcttggatttgtaacctgtgtaattgcaatccctcagtttatcgtattcatgctgctttttttacttgccggggcgatttatccattctgcacagaaactatgatctgtgatttcaaagcttgtggcggagtacttcttgtagcaactggcttccgaatgatgaaagtgaaagaatttcctgtagcagatatgataccggcaatgatactcgccatgccattaagccacctctgggtaacatatgtacttccttttgtttcttaaaaagatttcatgaattgctaatttgctatcaaaactatccagccgctgaaacaaaactttatgctgaattgtaagagaactacaataaagaaaaaagaattgttatacgtattgcattttgcgactttgcgctatggaattctgaccataggaacttgggactcgtttttcccaagttcctgtttttctgggcagaatggaatgtttagcgcaacggaacaaaatcaaacttataacaattcttttttctttagaagactgaatacaattcggctcaaagcattcctcttcagcggcgtctgtgtcccagcgaattagcaaataaacatcgcatccccgaaggagaagaacctgtatctttcttttaccgcttcctcatacgctgccataatatgatcctttcctgctaatgcagatacaagcattaaaagggtagattccggcagatggaagtttgtaataagacagtcaattgccttaaatttataacctgggtaaatgaatatttctgtattaccgcatcccggatgaatcactccgttgtcatccgcaaccgattccagagttcttgtactggttgtacctactgcgataattcttccaccattctttttcgtatcattgatcaactttgctgcggtttctgttacgttatagtattcagaatgcatatggtgttcgagtacattttccacttttacaggccggaaggttccaagacctacatggagtgttacgcgggcaatgtttacacccatatcttcaatctgttttaacagttcttttgtaaaatgaagtccagctgtcggtgcggctgcggatccttcatactttgcgtaaacggtctgataacggtttttatcctgtaatttatgtgtgatgtatgggggtaaaggcatctggccaagacggtctaatacttcctcaaagattccttcatattcaaaatgtacaagacggtttccatcttctaatacatcaacgatttcagctttcagttctccatttccaaagactactcttgcacctggacggcatttcttgcccggttttacaagtgtttcccagacatcattttcttttctttttaataacagaatttcaatgtgggctccggtatcttcttttgttccgataagacgggctgggataacttttgtgtcgttgataaccagacaatctcccggatgaagatactctgtaatgtcatggaaaatacggtgagctatctcaccgctttccttgttaagcaccatcaatcttgatgaggaacggtcttccagcgggtcctgggcgatcagttcctgtggaagatcaaaattaaaatcacttgttttcatcatgctcttaattcaactcccattttttcaagttctttaagaatcttatctacgatcttgttgatttcagcagcttctaagcttcgttctggggaacggaatacaaggctgaatgcaacggatttatatccttcttcaatctgagaaccttcgtaaacgtcaaataactggatgctctctaataacttgccgcctttttctttcattactttttcaagacttcctacgaaaacttcttttttcataacaaggcttaagtctctgtttacagcaggatactttgctacaccttcatactttctgtcaaaggttgctttttctgtgataaccggaagatcgattcccgctacgtatgcttcacacttcatatcgtagttttcacacacttcagggtgtacctgtccgataaatccagcataagttccacccacataaatgagtgcctgtcttcccggatgtaagaaaggtttttcctgagatggctcaaaatcaactttgccttccagaccaagttttaagaacatttcttcaagaacaccttttaacaggaagaaatcacattctccgtacattccaagagtcagacgctttctttcctctggaagttctgtcagtggcagtgcctttggaagatatacgttaccaatctcgtaaagacgtacatttttatttctatggttataatttcctgctaaagaagttaaaataccatttaactcaactgttctcatgatactgtaatcttctccaagtggatttgcaattacgattgcctggcgtaatgggtcgttatcaggaagaagtaatttatcaaataccttagggctttcaaaagagtagcacattccaccacagaatccgttctgttctgcaatattcataacaacgtcttctactcttgcactaaaagacttcttaccagcagttgcttctccatgaggaagtgttgtaggaatattatcatatccaaagaatcttgccacttcttctgcgatatctgcagaacatcttaaatcctgacggaaagatgggataagtaacatatttgtttctttatcatagccaatctccaggcgggtaaagtattccatcatcttttcttcggatacatctgttccaagaagcttattatattttgctggttcaaaaggaatctttacttcttctacaggatttggatatacatctacaacaccaccaacaacttcaccggcacctaactcttctactaactggcaggcgcggttgattgcttctaatgcattctcaggatcaagacctttttcaaacttaccggaagcatctgttctaagaccgattctcttagaagaaagacgaatatttgttccatcaaaagtagcagcttcaaaaagcattgtctgaatgtcatctgtaaccatggagttttctccacccatgataccggcaattccaacaggaccttctgcatcgttaatcattaatacatctttatcaagctttctttcctgtccatcaagtgttgtgtatacatcaccatcattggcacgttttacaacgattttatgacctctgatcttatctaagtcataggcatgcattggctgtccatactcttccataacatagtttgtaatatctacaatattgttgatcggacgaatgcccattgccgcaagtcttctctgcatccattccggtgacggagctaatttaatattctttacgattcttgctgtatatcttggacacagttctgtatcctctacctctacagaaatataatcctttgttctttcatcgtttccaactacttttacttccggggcataaaatggcttttcaaatgtagctgctgcttctcttgccataccgatcatgctgaagcaatctacacggttagatgtaatttcaaattctactactgcatcacgaagtcctaaggctgctactgcatcatcccctggttttactcctctgctttcatcaaaaatgtaaatgccatcttccggtgattccggatacatatcgcgtgtgcttcctaattcttcaatagaacacatcataccgtaagaaggtactccacgaagcttaccttttttaatcttgattccattctcaggattaggacttccatcatgtccgcctgcaacacgtccgccatctaaaacaaccggaactaatgctcccttaaatacattggatgctcctgttacgatctgtacttcctcagcacctacatttacctgacagattactaacttatcagcatctggatgcttttcaatcttttcaattcgtccaacaacgatcttctccagatttttatcaagatatactgcattctctacatgggaaccagacagagtcatcttgtctacatattcctgtacagtacaatccaaatctggaacatatgctttaatccatgaaattggtgtattcattttcgtctccttttatatctataaatttaaatattagttatttttaatcctttccacttcaagaatatctcaacatccttgaagcagaatacacgctctagaactgttttaaaaatcttgcatcgttttcgtataagaggcgcatatcatcgatttcgtattttaaaagagtgattctttcaagtccgattccaaatgcaaagcctgagtatacttccggatcaataccgcagtcacttaatactttagggtgtaccattccacatccaagaatctcaatccagccgcttcccttacacatacggcatccttttcctccacatttgaagcaggatacatctacctcagcacttggctctgtgaatgggaaatgatgtggacggaacttaacctttgtatctggtccaaagaattcctctgcccactgctgtaatgttccttttaaatcagcaaatgtgattcctttatctacgacaagtccctctacctgatggaaagatggggaatgtgttgcatctacttcgtcagaacggaatactcgtccaggagcgataacgcggattggcatacgtcctgtttccatgatacgtgcctgtactggtgatgtctgtgtacgaagaaggatatcttttgtaatgtagaaagtatcctgctcgtcctttgccggatgatttgccggaatatttaacaattcgaaattgtagtgatcatactctacttccggtccctctaccacttcatatcccataccgataaatactctttcaagatcatctaatgcaatctggtttggatgacgatgtccgactgctacttttttacctggtaaagttacgtcaataacttccttcttcatcttttcttcacgaagctttttctggatggctgttctcttttcttccatcttttcttcgataccagcacgtgcttcatttaccatctgacctacctttggtctgtcttccggtgctacatctttcattccttttaacaggctcgataactgtccctttttaccaaggaaagcaactttaacatcattaagcttgtccatacccgctgcatcttcaattgccgcaagtgcctgctgacgaatctgctcgattttctctttcatgataaactcctttattatttaaattaatttactttggttgtctggcagctgcttttcgttattcaatagggaattccaacagatttgtctattgaatctattaaataaaaaaagcccctttttaatataaattaaaaagggacgaataaatccgcgataccaccctgattcccgaatataccaaatatattaagcgtattcaggctctcattaacgcgtaacgtgcgtagacgacattccttatctaaatatatagtctccggaatgcagctccagtgtggaaattcaaaatataacggagccttgaagaacttacagccgatgattctccctctctactggtacattatacttctactgtgggcagaatgcccgcactttcaacgctttttcaatgaataacattgtaacgcagggaaaaattaatgtcaagaggtatttcgtgctttattcccattgaattcgtccttccatcatcaaaagctgctgtccaactctggagaactctccaagtactatctttcttccttcttctgttttataccagtcctctgaggaaatatgatctacaacaacgggatgtatgagaatctccacctctggaaataccatagaataataaaggaacgaacgtctggcatggtgtgctttacaacataatatcgctttttttaaatgaattcctcgcttttgaagcaatagttttgtcttttccgcattctccaaagtataggttgcctcacactcttttaaaattgcggaagccggaactccattctgaagtaaaactgcctctaaaaagtccgcctcacaggcaaaatctgttccgtatttctgcccttcttttgaaacaccctggaaacttccctgtacctttgtatacccacccgatggcaataacaagggggcatatccttctttatatactcttgccgcttcttccgtatgctccggtcttgcacagcctggtataaatatcgcatctgccctttccagtctatcttctaaaaatatataatctgtaatctcctgaatctgttttttatccaaatgatacattttaattccttctgtcattcactattttctaaaattatctgttttagagttttttatttttctatttcgagttgttgtcttctcccatcgatacgtctttatcatttttattattatttttattattctttctgtcagctctctcacttttagatttctgacgcatcttctctgtctgtgccctctgctgcctgcgccagtttggtctaagagtacgaataagaagatgataattatctttattctctaaaaaataattcacttccgctccataaaaaaccatggacatacaaaaatacaaccataaaagcagtatcatgattcccgccatacttccgtaaatatacgaaaaattcgtaaaattatccatatagatcgaacagcctacagaaactgccacccagctaagtgtcgcaatcaaagctcccggaaactgccctcgaaaactagacgttctgtttggaatccatttataaattatcataaataataatgtcagaaagactagggaaaataaaatcctctgatgcataaaatatcccaagatcggaatcacaaacgggaacttccaacatacataacgatataaactatttccaaatacccacataacaagcataacgcttatcataagtgcaaacaataatgtatacactaaactaaataagcgtattacaaaataatttctgttctcatcaatatcatatacagaattcaatccgataacaatcgaatacacaccccttgaagatgaccacaatgctgcaataatagaaatcgcagatactgtcgttcctgtcttatgataaatttcatttacaatatttttgatcaatgatccttcctcaaaagaaatcatccttgtcaatatcactataatgtcatcttttgaaaaaggaatatatctggtcagtgtcaacaggaagatcataaacggaaaaatggaaaggagtataaaaaaggcggacatcgccccaaatgctcccacatgatcatcactgcatttctttagaaaatccataaccagttcgtataaatctttcaccctttttcttgctggcatactttccatcctcattatattttacataagaaaagccgcctcattcacatgagacggctataaagcatacacccaaaatgccgtagcctgcgattttgagtcctagccaaagccaggtgggtaacttcaattaaatatctgacgtcctctcaaaatggtgaggcatgccatcccttcaatgatttagtttcccaagttcaaaaatgtaggttcaaaatagcagggggtctcgaacactccaggctagtatatacatactataacttaattatctctaaatttcaagataaaattatccactttactgtaaaaatattactctgcaatcatgtgctctgtgcagacttcctttcaattccagttcagtccagctcagatactgcacttttaatgggatttcacttaatctaaatacaactttccatcccgcacatgataatcacgatttttatgtcgaagcagcgtatgcctcatataatgcaatagatattcttctcctttcatatcgagcattgtaagaagatatcttgacagataatctgtctcgtcatctataagcatcatatgctttccgtttaaatagtatgccaatgcacttccatcattatactgatcttttaaataatttttactcgcactgatacgatcaataaccatttccgctacatatttttttggcatcttcattccgacaagctttcctcctgttggattaatgctataatcaatccaatattcaaaatgatgaagattccttcccttatgatgaagccagcctcgtgaacaggtcttcaattccttttccctattgatcggacttctgtctccctgataataaataactcccggaataaactctataggtgtatattttgacaaatcatgaagaagtccctgtttatataaccccaccttaaaacaggttttcattaccagcatcttgtggtgggtgatggtactaaaatgtccttttaaatttttaaatatcctcattctctttttcctgatctttttcaaagtttaccgcatcccttactaagtaaattggtctctttcttatttctgataaaataactgccagatattctccaataatccccaacaagaagaataatactgtaaacataaaacaaattactacaactgttgtcgtataacctcctggtgcgccaacacgaatcttcatataaatagagtaaataatcaacagtacacaggcaattcctgcaaacgtgccacacaatgaagcaatcttcaacggcaggtccgaataacttaacattgcctgtactgaaaacttaaacaatcctttgatactgtacttactttctcctgctgctctatcatgtgcttcgtattctatggttgtctttttaaatccaatactttgcacataggcacgaagaaaacgtgaagtttcccgaaaatgcttttttaaaacttccgctggcttctttgtgatggcaaaaaaatcggaggcattttcctcaaaatgtacctctgaaatcttattcagtattttatagaacaagcctgatgtaagattcttaacaaatccagcactcttatttgctgtacgaaccatgctgattacttcatatccctgattaaacgtatctaaaatctgcgggatacattctacaggatgctgcaaatctgcatccatacatacaattccatcgcctgaactataatcaattcccgcaatcattgctgcctcatgtccataatttctcgaaaaatgtattacctttacctttttcgaatccatagctaatctatctaagatagcaggggatgcatctctacttccgtcattaacaaaaatcaactcataatcactatcaatttcctctaaaataggaagaatcgtttcataaaacttatccaaaactgcctcttcattatatacagacactacaatggataacttatttattaatttcatacactatcctttctcctcgtatattattttcatttataatagcatttcatgaaaaacttcgcaacctgtcgtataaatttgctgtcactcaccacctgaaagaagtgggagtcttctctactgagataaaatctctatgaaatctctttacaaaactctcatttcgtgctagactcgattagatacgacagttcatttgtaccatcctgtcgctaaataaaaccaggacagcattttatttttaccaaaagattttacaaacagatgatttcaagatgctgtatatttgcagcatcttttttattgtttttaatatgtaccatcagaatcttttaatgattttgatcgtatgtataaatttagaggaggattttttaatgtatattttagaaacagagcaatcctttgactccgctcattttctaagtggttacaaaggtaagtgcagtaatctccatggacatcgctggagagttgtagcacgtattgctatggatgaattaaataaagaggggcaaaccagagatatggtaattgattttggagattttaaagatgctctaaaaaaactcacagatgctttagaccattcttttatctttgaaacaggctctttaaaagaaacaacgctaacagctcttaaggaagaaggatttttacttcatgaagttcctttccgtccaaccgccgagcagttttcccgctatttttatgaacaattacaagaactggacttccctgtatataacatttctgtatatgaaactccaacaaactgttctacttatcaggaggcatctttatgattacctatcctgtagttgaaaagtttatcagtattaacggagaaggtcaaaaagccggcgaacttgctgcattcattcgaatgcgtggctgtaatctttcctgtaattactgtgatacatcctgggcaaatacaatggactgtccttgtgaatttttatccacagaggaactgatcacatggctcactgaacataaaattaaaaatgtaactcttaccggtggagaacctttgcttacaacaggaattgacacattcatcgaggcactcggttcttctggattttctgtagagattgaaacaaatggaagtgtagctttagattgctttcataatcttttacatcgtccggcctttactatggattataaatgtccggacagcggaatggagcaggcgatgtgtacagataatttttctctactgctttctaaagataccgttaaattcgttgtcagtagcattgctgatctggaaaaagcaagaacaatctgtacgcaatacaaaattgctgaccattgtcctatttttttaagtccggtattcggacgaattgacccaaaagaaattgtagaatatatgatagaacatcattggaacgaagcccgtctccagctccagatgcataaatttatctggccgccggaacaacgcggagtataaaaggaggtaaaactatggctatagataaagatgccattcgtgaacatatcaggggaattcttgctgctcttggcgatgaccccgatcgtgaaggattgaaagaaacacccgatcgcgtagctcgtatgtacgaagaagtttttgaaggaatgaattataccaatcatgaaattgccatgatgtttaataaatctttcaaagacgatctatgtgtcggcgctgataaaaaagatattgttttagttcgagatattccaatcttcagctattgtgaacaccacattgctcttatgtacgatatgtctgtatccgttgcgtatatcccaaaagacaaagttcttggtctaagtaaaatagcaagaatctgcgacatggcctccaaacgtcttcagcttcaggaacgcatcggctctgatattgcagaaatcatgtgcgaagctgccgaaacagaggatgttgccgttattattcatggaacacacagctgcatgagcgcaaggggcatcaaaaaagatgcagcatctactgtaactacaactttccgaggacgtttcgaaacagattcttctattcagagtcagcttacaatgatgcttcacgcataaacatatgccatatgtaagatgcgaatagaattatgtcatgcattgcataatgcgcatgaaaaaattatttaaaaaacacttaatagatacctaaaaacctatagaaagaaggaattatttatgcaggaactcaaaaataaagaagctgctgttgtcgttttcagtggtggacaggatagcacaacctgccttttctgggctttaaaacgttacaaaaaagtaattgcattatcttttgactatcatcaaaaacatgtaaaagaattagaatgtgcaaagaaaatctgtcgtgaccatgaggttgaacaccatatcatggacatgagtcttttaaatcaacttgcaccgaactctcttacacgcgtagatattaaagtagatgaaaacgctccggaagagggaacaccaaatagcttcgttgacggaagaaatcttctctttctgtcctatgctgccgtttttgcaaaacaaagaggcatcacagacattatcaccggtgtatctcagagcgatttctccggatatcctgactgccgcgatatctttatcaaatcattaaatacaaccctctgccttgccatgaattatcagtttgatatcattacccctcttatgtggcttgataaaaaagaaacctgggctctggcagacgaactcggtgcctttgatattataaaaaatgaaactcttacctgctataacggggttattggagatggctgtggtcattgtccatcatgtaaactccgtaaaaaaggattagatgcatatttagcttcaaaaaactaattgaatcagcttaaaaaaatgaaaaccagaaatttaatttctggttttctgcttttgtcactaaaaaattcaagtcgagctgtcacccaccacctgaaagaggtgggagtcttctcgattgagattaacttttattatattctcagtgtatgcttttcgctctcgcccggtccaaatccaagcttgtcatattctgccttagctacttcccatggaagtttatctaccggttcctttaagtaacttaatatctctgcaataccttcgcctgtataggaactggtaaaaaagatcttcttacaacctgcaaggcgcagccattcggctgctaattccggattcgctgcccagtgatcgcacttcgtaactacaccaacaacttcacgattacttactgacacaatattcggtggatatagagaaaacggttctatcgcactcatcaaaagtccaataacatctgcctcacatccataaacagctaatgctccagataactgcttcgtctccgcatactctcccggtgtatcaataattacgtcaaagttgtttacatactgcgtcttatggtaagtaatcggcttacccttcatcgcctgcatgatcgtagtcttacctgattcgctacgacccacaaacattatcttacgcattataaccaccctgtcttcctgcttcgcatctgctgtatgctatcaccactttttgtctatcgacttatttctatcgacttatttctttgtaacaggacatgtagcatatcctaaatcattctggaaataatggattacagccttaacagcagattctactgccgaaatacgtcctgtcagaattaaagttccgctgaaacggtctacgaatccaagataaacatctccgctcttaatagcaatatctgctccaattacagcagattcactcggagtaactgtgataataccgattgcagaacgatcaaaatcgatatctggattcaatcctaacttacgatatacgattggcttaggacttgtaataacatgagccagtgtaatctgtcttcctggcacagtttcctgaataatacgtaatcttccttctgtgtcctttggtaataattctttgatatccataacttcagctcctttaatttatattcatcattacactcatgataatgacattacaccaaaatgggcgtaaatgtactcctatgtgaacattatatcatacccattttgaacattctatgaaaaaattggacacttcatgggattagttggcactttcttgataattcgcacaaaaaagggtaaaatatcaacgaaaaaaagcaacagattgcaatatactgtgaatgactttgaaaatgaaaattaggttatcatttcatcattctgacaaattcatatcttcctttgttgttactgcagttttccattttccttttatcagacaatatatatacgatatttgttactgccgtactaattggataagctatccctattcccaatgtcccccatcctaatatattagaaaggaaataagcaagaggtattcttgaagctaatgcccctactgtgtttccaacagccacataagaagtatggcctgaaccaataaatataccagaaaggcagtatgctaatggcattacgatgacataatcccagcaatgtcccttaaaataatttgctccaacaagtaatgtctgtgcatcatttgtaaagatacttaataattccttagaaaaacaccacatgataatacagataaacaaactatataaagaagaaataatcaactctactatcgctgttttttcgacccgttttaactttcctgctcccacattttgtccaacgattgctgacagagctgcatgcaatgctattactggcaaaataaaaattacatttatcttcgctgcaattccaactgcagcagatgcatatactcccagaagatttgctactgcaatcaaaacaaccaatgaaaaattcaacataaaattctgaaaagcagaaggaattcctatttgaaacataattttaattttttcttgatcaatatgaaaacttgaaagtttaaaatcaaacggaaagtctattttacgcaaataaattatagatactaacacgctgcacatttgagcaattaccgttgccagtgctgcacccccagcacccatatgcattttcccgacaaatataatatcaagaataatattaattcctgtagagataataacaaaatacaacggatttttggaatctcccattcctctcaaaatattagcaatagcattatacataaaagtaaataaaattccacttataacaactctgtaataattagaagcctcttgataactttctaatggagtttgtaaaatatgtaagattggattcataaatatttgcattcctattgtcattataactgccagaattattactagagtaaatgtagtctcaatagttttatgtatttctttctcttttccagccccaacatattgagcaatcattaccgttgcagctgacaacaaccctattgcaattccaagaaccaggtctgtaatctgtgccacaatattaagacctgaaatactatatgttcctgcataatgactcacaataaacaaatctactgtactatatagagactgtaatacaaaagaacccacaaatggcagactgaataaaataagattttttataacagagccttctgtcagattatgttctaaatttcccatatatctttcccccacctctttttcttgttttattacttaggatatgctttttaagcattctccaaagttatactacataaaaaaagagacagcagagtgaatttcacttgctgtctctttttttatatatcatataccttcaaaaccacacacaaatcatcttttctatttccaatcgctttttaaggtcaagctttcgaccgattagtaacagtcaactccacacatcactgtgcttccatctctgccctatctacctcatcgtctctaaggggtctctcactctttcgagtctggatatctcatcttg

SEQ ID NO: 406 - DNA, 57096 bp, Eubacterium hallii
acagtattttagttattgaaagagataatcagcttggtggtattttaaatcagtgtatccataacggatttggtcttcatacatttaaagaagagttaaccggtccggaatatgcagctcgttttattgatcaggcagctgagttaaatatcgagtataagttacatacaatggtatgtgatatttctaaagataaagtagtaaccgtaatgaaccgcgaagaaggtatcgttatgtatcaggcaaaggcagtgatcttagcgatgggatgtcgtgaacgtcctcgtggagccctgaacattcctggatatcgtccagcaggtatctactctgcaggtaccgcacagagacttgttaacatggaaggtttcatgcctggtaaaaaggttgtaatcttaggttctggtgatatcggactgatcatggcaagacgtatgacatttgaaggagcagaagttaaggtcgtagcagaagttatgccttactctggcggcttaaagagaaatatcgtacagtgtcttgatgattatgacattccactgttattaagccataccgtaatcgatatcgaaggaaaagacagactgacaggcgtagtgatcgcagaagttggtccggacagaaaaccaatccctggaacagaagtacattacgattgtgatacacttcttctttcctgtggtcttattcctgagaacgaattatcaaaacaggctgacgtagcaatgaaccctgtaacaaatggtccgttagtagacgaaagccttgagacaaacatcgacggtgtatttgcctgtggtaacgtactgcatgtacatgaccttgttgattacgtttcagaagaagcagcaacagcaggtaagaatgcagcactttatgtaaagaacaactgtggcaaagatgcacagaaatctgataaagtagtagaaattaaagcaatcgatggtgttcgttacacagtaccaagcacgatccatgtagataacatggcagaccttctgacagtacgtttccgtgtaggcggcgtatttaagaacagctatatcagcgtatacttaaatgatgaaagagtacagcatcgtagaaaacaggttatggctccaggcgagatggaacaggttatcttaaagaagaaagatctcgaagcatatgaaggtcttgagaccatcactgtaaagattgaggaggagtagtatcatggaaaaaagagacttaacatgtattggatgtcctcttggatgccagattacagttacaatggaaaacggtgaagtaacagatgtaaaaggtaatacttgtcctcgtggagataaatatgcaagagaagaagtaacaaacccaacacgtgtagttacatcaatcgttaaggtagaaggtggaaaccttgccgctgtatccgtaaagacaaaagacgttattccaaaaggaaagatctttgatattctcgatgagattaaaccagttgtagtaaaagcaccagttaagattggtgatgtcatcgttccgaacgtagcaggaacaggtgttgatgtaatcgcaacaaagaatatccaggcagtataaaagggtaagcttctgatttgccacaggcaaaggagacgcaccctaaaaaagaagagaacctatgtttgtgactctatcactgcgggttgaatattcgcttaaaggctcatattcaatcctcgctctaaggccacaaatataggttttcttattttttagggtgctgtctttggctggtggagacaaatcagaattcatgttggaagatttggggattcttcagaaggttgtttttttattttgtgggattctcattttatctcgtatatataggtagaagcagtgatggcttcaataaagattatcttagaaaggatgagtaaaatgagaaagacagaaagaaattttacaaacaaggttttagaaagtaagcgaggagatgtacaggcagtaaagagtaaaatcaaaagctctgtaatggcaacagcttttttgtttgccgcaacaataccaattggtttgtctgttccagcaggaaatgtgcaggctgctgccgcccagcaaaaacaggttaagaaagtaaatcagaaagtaaaaacaaatacctcaaaagcaatccaaacaatagaatctagaaaagtaacatcatcaactatgataaaggcatataaaaaatatttaaggaaaaatgtaagtaataaaaaatattatgccatcgtaaatattggggacaataatgcccctgtacttttaagaggaacacaaggagcaggaaacgataaaacgggaagacattacacaggatgccagatttattattataaaaatggcaaagtagtaaagatggatacatttaaagatggaggcagatggcttttactctcaaaaaaagatggacagaattaccttacaaacggcggttcagatttctctatccgaatttgtgttaaaaatggaaacttatacagatatcaatattataacaatcataactggaaaaagaatcctgaaaataaatgggcaacatccattgtaaaaatgaacggtaaagttactaaaaatatgggatatttggatgggacattatacagaagacatactggttattatacttatttaaagaatccagaaatcagctttacaaagaatgtgaaataacttctgcttgttcctattttacaaatttattgggggatttggaaatgggagcaggaagaataggaaatctgtttttacttcagtagccaaagaacagcctccagaaagagaaataagctatatttgtggcctgggagcaaaggttggatgtgagtggttaagcgaacattcaacctgcagcgacgaaagtcacaaatatagcttatttctctttctggaggcgtctcctttgttgcataagtcaaaatttttcttgtatttcctgcaaaatagggttagaataaaatcgtatatgtttaaatatatgatgatgttaaatctggaggttaataaataatgaagattattatgttaggcgctcctggcgcaggtaaaggaactcaggcaaagaaactttcagagaaatatggtattccacatatttccacaggtgatattttccgcgctaatattaagaataatacagaacttggaaagaaagcaaaaggatacatggatgcaggacagcttgtaccagacgaactggttgttgatcttgtagtagaccgtattaaagaacaggattgttttaaaggatttatccttgatggttttccacgtaccattccacaggcagaagctcttgactatgctttgaataatcagaatgaaaagattgattatgcaattaatgtagatgtccctgatgagaatatcatcaacagaatgggcggaagaagagcatgtgttggttgtggtgctacatatcacgtagtaaatatgccacctaagaaagaggggatctgtgaccattgcggagagaagttagttcttcgtgaagatgataagccggaaaccgttaagaagagactgcaggtttatcatgatcagaccaagcctttaattgagtattacgataagaagggttctcttttaacagtagacggaactttagatatcaatgtagtatttgaaaagattacaaaagttcttggatagagtgtgtttgaaatgaaaagggttgtcgcggtatcactcttatagtgcgatagccttttttattataaagtattataaatgagagggtgtctcatggagcatacaggaataaaaccaaaagtaatagaagagatacgaacttttgcaagaaagaaataatgtggcacattcttataatgaaagaattgcattaggtattgttatgcaggcaaaagaatcattttatgatatgttttgtcagttgaaaaatgagattgataaaaactggctataggagaaaacaatggcaattacaataaagaacgagcatgagatagcattgatgcgtgagtcaggacgtttactggcactggttcacgaagagatgcgtaaggaattaaaagaggggatgacaacaaaggatattgatcggatttgtgagacaatgatcagagactttggctgcattcctaattttttgaattatcagggatttccggcttctgtatgtgtgtcgattaatgatgaagttgtacatggaatcccttcaaaaaaaagatacattgagaacggagatatcgtaagccttgatgcagggcttatttataaaggatatcattccgatgctgcgagaacacatggtgtaggagaaatcagtccggaagcacagaggattattgatgttacaaaacaatccttttttgaaggtattaaatttgcaaaacctggcaatcatttagttgacattgcaagaggtattcagacttatgcggaaagtaacggatattctgttgtgcgtgatctgacaggccatggaattggaacgaggcttcatgaagcaccggagattccgaactttgtgcagagaagaagaggcgctaagatgcaaaagggaatggcacttgcgatcgagccgatgatcaatgaaggaacctatgatgtttactggcttgataatgactggacagtagcaacggtagacggaaagctttctgcacattatgagaatacgattgctattacagatgagggatgcgagattctcacaatgcttccggaagaaaaagaagctttgcatagtgaacaaaaagaaaagtgatttttttataaatttttacttggtaatggagaagatttatgctagaatataaattaggttattttgccacatccctttgcggtcacgataaaggaagaatttacatgattgtaaaacaggaaggtgagatgattggattgtcggatggagtaagaagaaccattgataatccgaagtggaaaaagaagaaacatattcagatgatacgctctgagagaatggcagaagcttttccgtccctgatttcttcggaggatgccaatcagaggatctatgatgagatcgctggaatggaagggcgtaaagtaagaaagcaggaggattaaatatgtcaaaatcagatgttattgaagtagaaggaaaggtagtcgagaagcttcctaacgctatgtttaaggtagagttagagaatggtcatcaggtactgggacatatcagcggaaagttacgtatgaactttattaagattttaccaggagataaagtgacaattgaactttccccatacgatttaacaaaaggcagaattatctggagagataaatagattaaaaggttttgtatgatttgactgaagaatggctagaattttgtcgtttttcggaagaattgtgcttgcttttaatatagaaagatgatataataattgccgaacgttttggaaaggagagaaaatcgtgaaggttagagcatcagttaagcctatctgcgaaaaatgcaaagtcattaaacgcaaaggcgcaatcagaatcatttgcgaaaatccaaaacataaacagagacagggataagaccttgcttccgggttcagcagaatttgggagtggagagtatattcttgattttgttgtgtcattggtatgatatcctttcaatctgagtatttacgtcagatgcaagagaaactattgagttttgcggatatcatcaattattgccaccgtcatggcaattaagcaattttacgaaaagcggctgtggtgagtaatcgccaatatattttcgtaaaaagacagtgcgggaagacagcactgccatgcagcgcgaaagagtttacagtttgtctgtaacgataagacggtcacgctgtagtctgggaatactgtgtatttcacgacataaaacaatactataattaaggaaaacaagacgaatccaaacttaagacacgctgaacatttcaccgtacgcggcagcgatggattttgttggatgaatatttagtggaggtgcacacatggctcgtatttcaggtgttgatttacctagagaaaaacgtgtagaaatcggtcttacttatatttatggaattggaaaaacaagtgcagatcagattttaaaagcagcagacgttaatcctgacacacgtgtacgcgatttaactgatgacgaggttcgtcgtcttagcgaaatcatcaatgcagattatactgtagaaggtgatttacgtcgtgagatcgctatgaacatcaaacgtttacaggaaattggttgctacagaggaatccgtcatagaaaaggattacctgttcgtggacagaagacaaagacaaacgctagaacacgtaaaggtcctaagaaaactgttgcaaacaagaagaaataagtaatttagagataagtattaatatagattaatcctataggagggtttcgtcaatggcaaagaaagtgaccaaaaaggtgacgaagaaacgtgttaaaaagaatgtacagcacggtcaggctcatattcagtcatcttttaataatacaattgtaacattaactgactctgaaggtaacgctctttcttgggcaagtgctggagaaatgggcttcagaggctccaaaaaatctactccatatgcagcacagatggcagctgaaacagcagctaaagcagcagtggtacacggattaaagactgttgaagttatggttaaaggaccaggttcaggaagagaagcagcaattcgtgcacttcaggcatgtggtctggaagtaacaagcattaaagatgttacaccagtacctcataacggatgtcgtccaccaaaacgtagaagagtctaataggaggtaagtaagaatggcaattgatagaactccagtcctgaagagatgcagatccttagacatggatcctgtatatttaggagtgaataagaaatcaaacagaaagttagttcgttccagcagaaagatcagcgagtatggtcttcagcttcgtgaaaaacagaaagcaaaattcatctacggtgttttagaaaaacctttcagaaactactatgctacagcagagagaatgaaaggacttacaggtcctaacttaatggttcttcttgagtccagactggacaacgtagtattccgtatgggatttgcaagaacaagaaaagaagctagacagatcgttggacataagcatgtattagttaacggtaagtgcgttaacattccatcttacagaattaaagctggcgatgtagttgaaattaaagaaaacaaaaagacaatgcagagatacaaagatatcgttgaggcaactggcggtgttcttgtaccagcatggttagatgctgatatcgaagagttaaaaggaacagttaaagaacttccttctcgcgatatgatcgatgttccagttaatgaaacactcattgtcgagttatattctaaataataaatgattcttctaattgaatgcctgctatcatacaggcattcaattatagtatatggaagctggtaaacctggaattgattttccaattaattacccaaaaggagggtcccattcgtgtttgaattcgaaaaaccgagaattgaaatagcagagatttcagaagacaataaatatggtcgttttgtggtggaaccactggaaagagggtacggcacaactttaggtaactccttaagaagaatcatgttatcttccttaccaggtgcagcagtaagtgcagtgaagattaaaggcgttcttcatgaatttagttctattcctggtgtaaaagaagatgtcactgaaataattatgaatatcaaagagctgtccatcaagaataacagttcttctaacgaaccaaaacgcgcttttattgagttcagcggagagggtgtagttacagcagcagacatccaggttgacagtgatattgaaatcattaatccggatttagttattgcaactttaagtggcggtgcagacagccattttgaagcagagctgactattacaaaaggccgtggatatgtaggcgctgataagaataaatcggaagatcagtccattgatgtaattgcagtagattctatttatacacctgtagagcgtgttaatcttactgtagagaatactcgtgtaggtcagattacagactttgataaactgactttagatgtatttacaaatggaacactggcaccggacgaagcagtgagccttgctgctaaagttctgagtgaacatcttaacctctttatcgacttatctgagaatgctcagaaggctgaggttatggtagaaacagctcaggacccggttgacaaagttttagagatgaacattgacgaattagaattatctgttcgttcatataactgcttaaagagagcaggtatcaatactgttgaggaacttacaaacaagacacctgaagatatgatgaaggttcgtaaccttggacgtaagtctcttgaagaagtattagctaaattaaaagaattaggtctttccttaaataatagcgaagagtaattcttaccataaacaaagtaatatagacccgcttaggctgaaggtattagtaggcatagcgaaaaataaacaggaggtccattaaaatggcaaaatacagaaaattaggaagaacatctaaccagagaaaagctttattacgtaaccaggttacacagcttttatatcatggaaagattcgtactacagaagcaaaagctaaagaaatccgtaaaatcgcagaaggtttaatcgctcttggcgttaaagaaaaagacaacttcgaagttgttaaagttcaggctaaagtagctaagaaagacgcagaaggcaagagagttaaagaagtagttgacggaaagaaagtaactgtttatgaaacagttgaaaaagaaatcaaaaaagatttaccatccagacttcatgcaagacgtcagatgttaaaggtattataccctgtaactgaagttcctgcagaaggaaaaggaagaaaagcaaatacaaagaaaattgatcttgctcagaaaatttttgatgagtacgctcctaaatatgctgaacgtaacggtggttacacaagaatcgttaaaattgctcagcgtaaaggtgatgctgcattagaagttatcattgaattagtttaattttacgtgtgttgactttcatttagttcaatagacaaaataaaaatcttataattgcaaatgtatccttagtacgagagtttaatgcagttaagcatcgaatttttaacaactaaagatacaaacgcaattataagatttttttgtttttaataaatagatatttaatgttataaaaaaatagggtataatgggtgttagctttgtcgaactaagattgataattaatggagaataaaatcagatgaatttgatcgatgtgaaaaatcttttatttaactataaaatatattccggggaaaaagaagaagtcattgaacatacagcgattgatcatgtttctttgtcaattaagaaaggtgattttgtcggaattcttggtcataacggatcgggaaagtcaacacttgcaaaacagcttgctgctttactaaagccatctgatggaataatttatgttaatggaatggatacggcgaaggatgaactacttcttcctattaggaagacagcgggaatggtatttcagaacccagataatcagttgattggaaatatcgtggaagaagatatcgcttttggtcctgagaatatggggattcccagagaagaaattgaggaaagaattacgagagcattagaagctacgggaatgagtgaatatcgggaacattctccaaatgcactttccggtggacaaaaacaaaaaatcgcgatatccggggtgctttcgatggaaccggaatgtattatttttgatgagccaacggcgatgattgatccagaaggccgaaaagaggtattgaaagctatttatgatttgaatcgtttaaaacatattacgattatttatataacacatttccttgatgaagtcagtaaggcagattatctgtatgtgatgaagcaaggagccattacgttagaaggttctccggaaacattatttaagatgccagatcaattaacagaaaataatctagaacttccgtttgagatttcgcttattgcagaattaagaaaaaaaggtctgaatataccgaaagaaatatatacaaagaagcaactacttgagttttttaaatatctgcagcaagaagaaggtttcttgttttctgaaaagaaagtagagaatcaacagaagaaatgtattgcagaaacagagaaagaaaaaggcattgttctgaaaaatatcagttatcagtataaaaaaagaagtgctgaggaagcaaaagatgcgttacaagacgtttcattatctataaaacctggagaatttgtagcaatcgtaggaaagactggatcaggaaagtcaacattgattcaacatttaaatggacttttgcagccacaaagtggacaatatttttttgaaggccaggatatatggtcgaaaaagtatgatttaaaaaaactcagacagaaagtagcactttgtttccagtatccggaatatcagctttttgaggaaactatattaaaggatatcgcatttggaccgaaaaatcttggttttgataaaaagaaatgtgaagaaaaggctcggtatgcaatgaagcttgtgggcctgccagcagaacttgaaaaggtttctccgttttcattatccggaggacaaaaaaggagagtggctttggccggaattttagctatggaaccagaatatcttattttagatgaaccagtagccggaatggatgctcctggtaaaaggatgttatttcagcttttgcatcatcttaacaaggacaaaggaattacaattgtacttgtttctcataacatggatgatgttgcggcacatgcagatcgcgtattaattatggaagatggaactctgaaaatggatggaacgaccagagaaatatttgcaaggaaagatgatcttacaacgacgggacttgggcttcctcaaacagtagaattttacctggaattaaggaaaatgcagatacaggaaagcatagattctaacagacaaacattgcaaaatgagaatgccattcctcttaccatagaagaactggcagaatgtattacaggaggcagcaaatgattcgggaaatgacattaggacaatattataaagcagattccgtacttcataaactggatgctcgtgtaaaacttttagggacattgctttttgttattactttattttttccgaaaagtttattaagtcttggaattgcaacagtatttcttgctttcacaataaagctgtcaaaagtaccattttctatgatgattcgaggtgtaaagccactgtttgttattatttgtttttcagcgattattaatatgatcagtgtaggaggagaagtattaataaaacttggaccggtatccattacgaagcagggcttatggatggcattttatcttgttatacgtttagtgtaccttgtcatcggttcgtcagttatgacatttacgacaacaccgaatcagcttacggatggacttgaaaaaggatttcaatttctcaaaaaagtgcatattcctgtacatgaaattgctatgatgatgtcgattgctcttcgctttattccaattttaacagaagaacttgataagatcatgaaagcacagatgtcacgaggcgttgattttgaaagtggaaatattttagaacgagggaaaaagctgattcctgttttagtaccactctttatcgcagcaatcagaagagcctctgatcttgcaatggcaatggatgcgagatgttataatggcggggaaggaaagacaagattacatccccttgtttataaaaaacaagattatgccgcatatggaatcatgcttttatatgtagcaattatgattttttgtagttttattttaatataagaaatatatgatgttggtatcaaaagttctctttcaggcaagcctgcatcggctttttgaccttttgaccctgatattaatatatgttactatataaaagatgttagaataatcagtgctacatactgataaacataggagaataaaacttatgaaacgatttaaattagtagtggcttatgatgggacaaactattgcggctggcagattcaaccgaatgggattacgatagaagaagtactgaataaaacattgagtgattttttaaaagaagagatacacataatcggagcaagcagaacagattctggagtacattcttttggaaatgtagcagtatttgattcagagacaacgattcccgcagaaaaactttgtttcgcactaaacccacagcttccagaagatatacgaattatgtcttctgcacaggtggcggattatttccacccaagatattgtgatacaaggaaaacatatgaatatcatattcaaaatggaaagattcctctgccaacagagaggctttattctcatcttgtcatctttccattagatgtagaagcgatgcaggaagccggacaatatcttgttggaacacatgattttaaaagtttttgcgcttcaaaaacacaggcacagacaacggtaagaactgtgacaggaatagaagtggaaactcactcactttcagaaggagaatatccatctcagaaagtaataatccgcgtaacaggagaaggttttctctataacatggtccgcattatcagtggaacactaattaaagtaggattaggagtctatccaccagagtatgtaaaagagatacttgcagcctgcgatcgttcaaaagcaggagaaaccgttccggcaaaagggctttttttgaaaaagattgaatatttgtaaattacagggcgtaaaaaattaaaaaaccccatattttgtggtaaaaatattgttgacacactgaaaagagtgttatataatatgaaattgtggtatgcatataaaatgtaatctcaaaagccccgagatgcattttgtcatatacctgcgtaagcaggattgatatgatggagggtccggacagccaggaagtcatatctgaaccgttgattttttttagaataaacaggaggagaactactcatgaaaagttttatggctagcccatctaccatcactagagactggtatgtagttgatgctacaggacatacattaggacgtcttgcatctgaagttgcaagtgttttaagaggaaagaacaaaccgatcttcacacctcatatggattgcggtgactatgtaatcatcgttaacgctgacaagatcaaagtatccggtaagaagttagatcagaagatctactatcaccacagtgattatgttggtggaatgaaagaaacaacattaagagaaaaattaaacaagaaaccagaagaagttatcgaacttgccgtaaaaggtatgcttcctaaaggacctcttggaagacagatgtatacaaagcttttcgtatacgctggacctgatcacaaacatgctgcacagcagcctaaggaattagcaatctagtattaatttaaggaggaaaagtaagtggctactacaagatattacggaactggtagaagaaaaagcagtgttgcaagagtatatctcgtaccaggaacaggtaaagtaacaatcaataaaaaagacatggatgaatattttggatatgacacattaaaagtaatcgctcgtcagccattagaattaacatccacagcagataaatttgacgtattagttaacgtacatggtggcggatacacaggacaggctggtgcgatcagacacggtattgcaagagcattactggaagctgacccagaattccgtccagcattaaagaaagctggatacttaactcgtgacccacgtatgaaagaaagaaagaaatacggtctcaaaaaagctcgtagagcacctcagttcagcaagcgttaatttcgtttactcgaactacaaatttcaaacagcagcgcaagaacctctcaggggagcaatcctttgggaggtttttttgtggaatgtagtatcgaagtatttttgcacttgcctttgcggctaattttcctccagctgcacccaaatttcatcaacgtacgttccgcgtacgcctcaaaaatttgtgcacaactgacgaaaaattttctcgcaaaaacaagtacaaaaatactccgatactacattcagcaggaattggataagctttagtttattatagtttgagagtacatttagttgagatgagtttagaaagttggagagagtttgattgacgagagcgtcttgttatagtaaagtcattatagtaaatttgataataaatagaattttaaggagaatatatgagtattttaaatgtagaacatttgacccatggttttggagacagagcaatatttaacgatgtgtctttccgcttattaaaaggggaacatatcggtcttgtcggagcaaacggtgaaggaaagtccacatttatgagtattgttaccggaaaaatgatgccggatgaaggaaaagtagagtgggcgaaaaatgtaaatgttggatatcttgaccagcatgcagtattagaagccggaatgacaattcaggatgcattaaaatctgcttttgatcctttattacaaaaagaagagcgaatgaatgaaatctgtgatctactcggttctgctgatgagaaagaaatggagcttctcatggaggaattaggactgattcaggatgaccttactcttcatgatttttatactattgatgcaaaggtagaagaagtagcaagagcgcttggccttttagatcttggattagatcgtgatgttacagatttgagtggcggacagagaacaaaagtacttctgggaaagcttttattagaaaagccagatattcttttgttagatgagcctaccaattatcttgatgaggaacatatcgcctggcttaaaagataccttcttgactatgaaaacgcatttatcttaatatctcacgacatcccatttttaaatgaagttgtaaatatcatttatcatatggagaatcaggagctgaaccgttatgtcggggattacgaccatttccaggaagtttacgcggtaaagaaagcacagcttgaagcggcatatcgccgtcaacagcaggaaatcaatgaattaaaagatttcgttgcgagaaataaagctcgcgtttccacaagaaatatggcaatgtcccgtcagaaaaaacttgataaaatggaccttatcgaattagccgcagaaaagccgaagccagaatttaatttccggtacggccgcacaccaggaaaaatgcttttcgagacgaaaaagcttgttatcggttataacgaaccattatctaaaccattggacttttatatggaaagaggacagaaaatcgccctcatcggaacaaatggtatcggaaagaccacccttttaaaaagcttattaggattaatccctccgctttccggaagctgtgaacagggcgaaaatcttcagattggctactttgaacaggaagtaaaaggcgagaatcccaatagctgtatcgaagaaatctgggaagaatttcctggatttacccagtacgaagtacgttccgcccttgcaaaatgtggccttaccacaaaacatatcgaaagcaaagttcgtgtattaagcggaggagaacaggctaaagtccgtctctgtaaactcatcaatagagacaccaatgtacttttgttagatgagcctacgaaccatcttgatgttgatgcaaaggacgaattaaaacgcgctttgctcgattatcggggaagtgtcttgctcatttgccatgaaccagagttctataaagacgtggtgaatgaagtttgggacatgagcaaatggaccacgaaaatattataaactcctgattggtagagtgaaacagacaaaaagcagaaattttatatacaatagaatgtgaagatagtcgcggcatagaaaatgcctgtccggcatttttatttgctccgacatcacattctattgtatataaaatttctgcttttttgtttgttggtaccagatggaatcaggattttgttccgttgcgctaaacgctccgcgagacttgaatttgtctcaaaaaacaaaaactccagaaggaatgcgtcaattctttagactttaatttcctggaaagtcatatccttctgctacattccacgttgcccaactgtggatttagagtaatcagaaattttcttgaaggaattttaaatatcgggtaaaatgttttgtaaataaaacactaggaagggtatatttatgtcacttattgtaataaagaaaattatagagatgttcatgatactgcttgtaggcataataatctacaaagggaagattattgatgatgttagtacgaagcatctctcaaatgtactgctgttgttagtttccccgttattgattgttcagtcgtatcagattgattttaataagaagcttttgtatggattactctgggcgttactggcttcttttcttacctttttgtttatgatcattgtatcggagttcctttttcatgggaataagaaccgtagttctgtggaaaaaatcgcagtatcctattcgaattctggttttattgggattcctttaattagtggagtacttggagataagggtgtcttttatatgacggcctatatcacagtctttaacgtattgctttggacacatggcgttgttttaatgggagacagtaaggatttaaaaggagcatggaagaatttcttaagtccggcgattattgcggttatcgtaggaattatattatttttatttcagcttcgactgcctcaatttattgaaaatcctttagagatgattgcttcaatgaatacaccgcttggaatgattgttgcaggagccaatcttgcccaggggaatattttaaagagcctaaagaacaaacgcctatattatttaagttttataaaacttattgtatatccactggcggggattattatcctatggctgctgccgcttgagtttgaggtagcatttaccgtatttattgcattagcctgtccggcaggagcttcggttgtaatgtttgcacagcggtatgatagagatgcatattacggctcagagatatttgtgattacaactttgttgtcagcgataacactgcccttattatcaattattgcgataggggtattaaaatagacatacagttactatttgattcattaagaagaaaaacagacgaaaaaagaatagatcataccaaatgtaatgtgagagcaggtaaaaatgccgtcaggcatactttctgggtagcagtagacttctgacctctcccccttaattcctctcaaaaactattgaattcattccttctggagccaaaacacagaaaataaaaagaataaaccataccaaatgtaatgtgagagcaagtaaaaatgccgaacaggcattttctacgcagtgatatctttacatttggtatggtttattctttttattttcgtctgttttctctcaatgaattaaatagaaaaatagtgtattatagagtatagtatattttaagaaagaaggacgagttatgaaatacataatcatcggagcaggtggaacaggcggaattctcggattctatatgacaaaagcaggaaaagacgtaacactgatcgcaagaaatgcacatttagaagccatgaagaaacagggactttctgtccaaaaaatgtggacaaacgaaacagaaaccatacctgtcagtgcagaaagtatggaatcttatgaggcaaaaggagaaaaagcagatgtaatcctcgtctgtgttaaaaaatattctctcgattcctgcattccatttattcaaaacatttcccatgaaaatacgatagttcttccagtattaaatgtttatggaacgggcgcatatcttcaggagaaacttccaaaggttcttgtgacggatggatgtatctacgtttctgctaatattaaacaggcaggagtattattgcagcatggagaaatattaagagtatttttcggtgtaagggaaaaggaagatttgaagaaattaaatggacagtcagatggtgaatataaagcagaaagattattgaaaaagattgcacaagattttaaagatagtggaattgatggcgttttgtcagataatataaaacgggatgcattgactaagttttcctatgtgtctccaatcggaaccgcaggactttacttacatgctgttgcaggagatttccaacgagaaggagaagccagagaactttttaagacattaattcgagaaattgttacactagctaacgcaatgggaattactttcgaagaagaccttgtagaacgtaacttaaagattctttctaatttgccggaagaagcaacgacatctatgcaaagagatgttatggaaggaaaacagtcagagattgatgggctggtatatgaagtcgttcgtattgcaaaaaagtatggggtagaagtgccagtgtatgagagagcggcagaaaagtttcgggagatggaggtgaagtagtatagaaaatgacatagcttagttgacagattggaatatatacagtatcattaattaacgcaatgcgttttgtgattgaatggagagaggttgtgggtagaggaagagaaataaaagaactgcgagaaaaaatgggaatgaaccgcagagaattcagtgattactatggaataccatatcgtacggttcaggactgggaagcagaaaaacgccaattgccagactatctgttacgtttgattaaatatcgagcagagatggagggaatggtgaaaaaagatgagtcgtaagacttatttttttaccacttaattaacgcaatgcgtatatttaagtgaagcagaaggaggtagacgtggaaagaaaagtaaatgtaatcgaggatataatgtttttaatgtaataatggttattcgacatgcaaaagatggtaaaatgtatctatatgatataatgaacataaaaaaagaaacgagcacccttttccagtctgaagacattactcagtaaaaaacccatttcttggctataattatacccccgtagtagcaaaaagtcaataaaaagaaacgaaataaaaaagtcagtattctgctttagtaatagttgcgtaagaattgggatgaggaaatatgatgaataatattggtgcatttaagaaaaagtggatagagaatccatcggatgaaaaaggtgttttactctatctcccagtcagtgaggtatttatttctgcaaagtttggaactggagaaaatcttttaaaggaagatattacaagaggctttgatgattatatttatgtgagaaagttgatatttgatgaagatgagatggtagaattagatactgcacagttagattttagtagtgagagggaagactattatttaaatctaaaccatttttgtgaggagtctattgaaatgcttgggaattcttcagaggaagaatattggattctgcagatgatttgataaagcagatgagatataattgtacttgatgaaggctaatgaaatagtgtataaaaaagaaacgagcaccccgcttgagcaatagctgtacggtaacaaacccatttcttgattatatgatacattgaacagtattaaatgtcaacgaaaaaagcataagaacatattttggaaatgatttcacaattaaataagccactccaataaaaaattggtccagctatttatcggaaagatcaatgaaaaggcaggttcagatacactcattaaattcagtgcgtccggatctgctttttgttgctatcgtttcgttcagttgcctttgctatgtttgcttcctggggatttcaatgacaaactctctcccataaggtataatactaatcagagtattttgttttactcattacgaaatgagagggagatttttcaatggatgcgaatgtgatcaaggaattgcaaaatggcttaaatgccgcttatataaatggttctgtggcggtaaatctggcgtacaagccagcatttgtgtcgaataatccggaagaggggaagaaagttatttcatctgtagaggacgaattgttgcgctgtgatcagttccagatcagtgttgcgtttatcacgatgggtggtgtgacaccgcttctgcagactttaaaagagcttgagaaaaagggcgttaaaggacagattcttacgaccaattatctgaatttcagcgagccgagagcacttgagaaactcaatggattgaaaaatattacgttgaaaatgtatgacgtggaagctgccggaaatggtttacatacgaagggatatattttcaagaaagaagagatttatcgaatcatcatcggaagttctaatatgacaagtgcggcgctgacggttaataaggagtggaatacgaaactgatttctacagaaaatggtgaggtagcagaagagattgtggaagaatttcataatctctggaacagtgagtatgcattgccttatgatgatttttatgaaatttacagagaacgttacaatatcataaaacatcagcgtgagatagcgaaatgcgaagagattccgtcactcgaaaaataccgattaaaaccgaattctatgcaggagagatttattgcgaatcttaggaagattctggagcagggagaagagagggcacttttgatatcagccactggtaccggtaaaacattcgcctctgcatttgctatgcgagaacttggtttcaaaagagtgttgtttttagtacatcgtgtaactttggcgaaacaggctaagaaatcttttgaaaaagtctttggtaagaaagtgacgatgggagtggttggtgctggtttctatgaatatgagaaagagtatgtgtttgctacagtagaaaccttaaatcgagatactcatttatttcaatatcaaccggatacgtttgactgcattattctagatgaagcgcatcatagttccaacaacatttacaccaaagtcattaattatttcaaaccaaagctgttcttaggaatgacggcaactccggacaaaagggatgataatcaacaaggaaaaaatatttatgagatttttcattatcagattgcttatgaaatccgtttgcagcaagctatggaagaggatcttctttgtccatttcattattttggcattagtgagattatttctttggatgacaaaatgttacaggctacaaaattgacagatgcagcgttcaatcagcttaccagcgatgagcgtgtaagacatatcattgagcaatcagagtattacggatatagtggtaatcgtgtaaaaggactcattttttgcagtcgtgtaaaggaatgcgaggagttatcgaaaaaattcaatgaactgggatatcgcacagttactcttagtggaaatgataatgaagacaaacgccaggaagcctttgaaagactggcaatggatgaagaagatgctacggaagatcgtcaacctttagattatattttttcccgcgatatattgaacgaaggtgttgatattgttgaagtgaatcaggttatcatgcttagaccgacacagtctccgattgtattcattcagcagttaggacgaggattaagaaaagcgccgggaaaagaatatgttgttattctggattttattgggaattataataataattttatgattccggtggcgttatctggagaccgttcttacaatgctgatgtgattcgtaagtatgtgatcagtggaaatagtacgataccaggtgcatcaactgtacattttgatgaaatctctaaggacaaaattttcaaatctattgataagattaagggaatgaaagctctgattaaagaaagttatatttcactgaagaatcgtttggggagaattccgtttttatatgatttttatgagaatcaagaaattgatccattagtaattattcgagaatataaaacgtactatgcttttatgcaggtaatggaaaaggataaatacacaaataatttaagtgaacaggaaaagttaacactggagtatttatctaaaactgttctttcaggtgtacgacccgatgaacttgcaattttaagtcaattgcttcataaagattatatcggtattacagagtttaaaacggaatatcaaaagacatttggatttgaaatcagtgtagcacaggtaaaggaagcaattcaggtattacagggacattttgtaagtaaagaggctgagtataagaagttctgtcagattgacattttagaaaatgatcggtcaggaatgattcgaagagtacaaagttatgcggacagacttaagcatatacaattctacaaacaggtggaagatattataaaagttggacttactagatatcaggaaaaatatcttccatggaaaaatatagatagtccatttgtgttgtatgaaaaatattccagaagagatgttagtttgcttatgaattgtggcaaggatttatcttctgttatgtatggtatgaaacgaattgatgatgatgtatttatttttattacttatcacaaggaagagagccaggatgaaaaaaattatgtagctggaaaaccggactatgcggatgcatttgaagataacttgatttttaagtgggattctcagattggtaaaggattggaaagctcttatatgcaagatgtactgggagctacaagaaagcatttgcttgtaaaaaaatcagatgcagaaacgaatttttattatatgggagaatttgatgtaatggaagctaaaaatgcacagaaagaagataatcgtggacgcatgcagccgattacgaaagtcactatgagaatgcaccatgcagtaagagaggatttattaagatatttacagtctaatattacagcataaaaagatagagggatgatagaggagaaacagatgaaaacggtaaaagtagttgcagcaattatttgcgatgatataaaagaaaaaaataagatattcgcaacggcgagaggctatggcgaactgaaaggtggctgggaatttccaggaggaaaagtggagccgggagaaacatcgcagcaggcacttataagagaaatcatagaagaactggatacggaaatcaaggtcggagaactgattgatatggtagaatatgattatccaactttccatctttctatggattgtttttgggctgaagttaaagcagggcatttggagctgaaagaggcagaagcggcaaagtggcttacgaaagatcaattagatagtgttacctggcttccggcagatattctgttgatagaccaaattagaaagtgtatgaaataatagaataaaggatttagtatgaaagttacagtaatcagatcaaacaggaaaacggtggctattcaggtgaattcagatctaagtgtcactgtaagggctccgcgtagtgtttcagagaaagacattgaagagattcttaaaaagaaggaagcctggataagtaaacatattgaaaaaattaaggaaaccaaggaaaggtttgaggcggaacctacagaaaagttgacgcgtgagaaagttatagcgcttgcggatgaggcgcttaaggtgattccggagagagtagaatattttgcaaaagtaatcggagttacttatggaaagataactgttagaaatcagaagacaagatggggaagctgtagtagtaaaggaaatttgaattttaactgtcttttaatgctggcgcctccggaagtgttagattatgttgtagttcatgaattgtgtcacagaaaacaaatgaatcattctaaggcgttttggttagaggtagagaaggtgcttcctaattataaagaagtaaggaagtggctaaaagaagaaggaagccagatgattacattatttctataattaccgtcttgtcgcatgctttctcttattgtataataatcattgataaaatttttggaggcgctaagatgaagatacgaatcgctacgccggaggatgcttctgctattcagagtatttatcggtattatgtagaacatacagcgataacttttgaattggaagttccatcggtggaggagtttcagggaagaattaagaagaccttggagcggtatccttatttggtggctgaagaggatcgtgtgattattggatatgcgtatgcaggaattttttatgacagaagggcatatgactggtcagcggagatgtcggtttatgtgcagagggggattcacgggaaaggtgttggtacggctctttatgagaagatggaagagttgttgaaaaagcagcatatcgtgaatttgtttgcatgcattacccatccgaatgcagagagtgaagcgttccatgcagcacgtggatatgagaggaaagcacattttgagaaatgtggatataagatggggcagtggtgggatattgtgtggatgcagaaggtaattgcgccgcatgatgaagcaccggaaccttttcgaagatttacaggaggattttaaagatgaagaagaatttgttagtagcacagtcaggaggaccaacagcagcgattaatgcaacgttagcaggtgtgatcggacaggcaatgaaggaagagcagattgatcaggtttatggtgcctgttatggaattcagggtgtgttggaacagaagtttgtgaatcttacagagaaggttgacacagaggaaaagctggagaagttaaagagaactccggcggcagcgcttggttcttgtcgttttaagcttaatgatatcaaggaagatgacagtcagtatcaggagattgttgatattcttcataagatgaatattggatattttgtttatatcggtgggaatgattctatggatacggtagcgaagctttctgcatactgtaaggagaaaggtgtagaggatattaaggttattggcggaccaaagacgattgataatgacctttgcggaatagatcactgtccgggatttggttcagcagctaagtatatttctacagttttctgcgagcttgaacaggagattactgtatatgaaccgaagaatgtaattattgttgagatgatgggacgtcatgccggatggcttactgcggctgctgcattagcggaaggtaagaatggtaatgtaccatatcttgtttatttagaagaaaaaccattttcattggatcgttttattgatgatgtgaaggaaaagctggcctcaacgaatgctgtgcttgttgcggttagtgaaggtgtacatgatacagagggtcgtttcttatgtgaacaggaaggatctagagagttagatgtatttggacatacgaagttatctggtactggaaagattttagaggaagcggttcgagcaaagatcggatgtaaggttcgttcgatagaattgaatctgttacagcgctgtgcagggcatattttaagtaagacggatattgaggagtccggtaatcttggcgcgaatgcagttaagcttgcagtagcaggagagagtggattaatgtcttctcttacaagggtgtctgatgctccatatacggtagagtacagtggcgttgatattcgtgaggttgcgaataaagagaagaagattcctgtagagtggattaatgaggctggcaatggtgtgaaagaagagttgattacttacttaaccccattggttcagggagaagtttccagtatctatgaggatggtatgccaagttatattgttttaaaataataaaattaaattcgactctgacagtaaggttttccgcgctggaatagttaggaacatagtgagaatagcaggagaaaactcttctattctatctttctgtcagccggtcggtaagggtagagtagaggagttttttatgttaaagatagcagtttatgggaagggtggtatcggaaagtccacagtgaccagtaatttagcggcggcgtttgccagtatgggaaagaaggttatccagattggatgtgatcctaaggcggattctacgattaatcttctcggaggaataacgccgattccggtgatgaattatatgcgtgagtatgatgaggacccagaacggattgaggatatttcaaagattggttatggcggggttttatgtattgagacagggggaccgacaccgggtcttggctgtgccggaagaggtattatagcgacgtttagcttgctggaggatttggagttgtttgaaacatatgagccggatgtggtgttatatgatgtgcttggtgatgtagtatgtggtggatttgcagcaccgattcgtgagggatatgcgagcaaggtactgatcgtgacttccggggagaagatggctctttatgcagcgaataatattaataatgcagtgaagaattttgaggacagaagttatgcgaaggtgtatggtattgtgttgaatcacaggaatgtcgaaaaggagacagagaaagttgctgaatttgcggatttagtcggtcttccgattgtgggaaagattccgagaagtgatgagattactcgatgtgaagataagggaatgactgttattgagggagagccggattctccggcagcacaggcatttttgaagcttgcgaaggaacttcttgaaaatgcacaggatactgcggaggaagaagtatggtagagaatgtaaagagtacaataacagagacagaaagagcggaaaaagcctatttcattacaacaaaagaacttgcagaagcagggagagacaatattccggatgagctgatttcttcaaagcacctgatctatagttcgccggcgacacttgcgtacaattcaccgggagcgcaggggtttggtgtgaagagagcgggactggcgattccgggttcggtcatgcttcttttagctccgggatgctgcggaaggaatacaactattttaagtgagcttggcgggtacagtgaacgatttttttatctgatgatggatgagacagatattgtaacagggagacatttaaagaaggtaccgcaggcagtagaagagatttatgattgtctggagacgaagccatcggttgttatgatctgtcttacctgtgtggatgctttgttgggaacggatatggaacgtatttgtaagaaggcgcagaagagtgtaggtattcctgttttaccatgctatatgtatgcacttacaagagagggaagaaagcctccgatggtacatgtcagacagtcgatctattctttgttagaaccaagaaagaagaagagtacttctgtgaatctattagggcattttgctccgttagaagatgactgtgagctttatgatctgctaaagcagcttggagttaagacgattcgggagatttcacgctgtgagaattatgaagaatatcttgatatggcggaagcgaattttaatcttgtgttagatgcagaggcgcgttttgcggcggcagatatgcagaagcgtttaggaattccgtatattgagctgacaaggttatatcagcttgacaaaataaagaatcaatatgcgttgtttgcagcggcgcttggaagtaagtttgatgatgaggtatattttaaagaagcgtttgcggcgaaggaggcttttaagaaaaagtatccgcatgtagtgtttgcgattggagaaggctgtaatgccaatgcatttgaacttgcatttgctctgatctgctatggatttgaggttgcggaagtatttggtaatctttcaaaagaggattttgtttatattgagaagatggcgaaggtaagtccaaagacaaagatttattcgaatttagagccaacgatgatttattatgaaccgggggagaatccggtagatatcgtaattggaaaggatgcttcctattatcatccggaagctgcaaagcttgagtggagtgatgatatacagccatttggttaccgaggagtaaagcatttctttgaagaatgtgaacgtgtactggaattggaaagggggcagatttaaatgaagggacttagaaagtatctctcaccgtttgctccggatcagtccggtgcagcagcggtactttgtgaatttcatggattgattattattttagatgctggtggctgtgccggaaatatctgcggatttgatgagccgagatggtttgacagccgtagtgcgatttttagtgcgggacttcgtgatatggatgcgattcttggaagagatgatcgtctggtggagaagattggcaaggcttgtgagaagctttcggcagattttattgcagtgatcgggactccggttccggcagttattggaacagactataaagcactttctcgaatgattgaaaagaaaacaggaattccggcattgacgattgatacagatggaacgaagctttatgatatcggagagaaaaagacatggaaggagctatttaaaaagtttgctgtaaaacaggaagtagaaccggggcgtgtaggtattatcggagcgacaccgctttcatttggtggcatttatgaaaagaactttttaaaagagtattttagcgaaaaaggtttttccaaagtgctttgttacggtatgggtgatggtttagaagcagtgaaagaggcagcagcggtagagaagaatatcgttatatcaccgtctggaattgcggcagcgaagtatttaaaacagaagtttggaacgccgtatgaagtattttgcccaccagagattattccggaatggaaagaacgaaaagagcaacttgaacatagtgagcaaatagaacaaactacagcaaagccaaacaggaaagaacgctcagataagaaagttttgatcgtacatcagcaggtattggcgaacacattaagagaagaattgcttactcttgctatggaacagaagatagaaacggattttgcaaagattacggttgcttcttggtttatgttagacgatgcactaaagaaggaaggggatattctttttaaggaagaagatgactggatttcttatatcaaagaaaatgaatatgacatcattattgccgacccactactgaaaaaagcagtgccattttataagggagaatggtatgacctgccgcactttgcaatctccgggaagaagaggcagactgtatgagagtctgtatcagggtattcgggattgttcagggcgttggatttcgaccgacggtaaaacgccatgcagatgtctgccggattgaaggcagtgtgagtaacaaaggaccttatgtggaaatctttgcacagggcagtgaagaatgtgtgaatcactttataaagaggattcaggagcagccgccgaaacgggcagttatcttaaagatggatgtggaaagtctggaatctgcaatagagtctgacacagaatttgaagtgaaattggaagcaaatgctgaagcagatagtaaagaacgattccgcatcatagagagtgaaaaagaagagggagagatttttgtttctccagatattgcgatttgtccggaatgtaagaaggaactttatgataagaaggacagaaggtatctccatccatttattaactgtacctgctgtggaccgcgtcttactattttagattccatgccgtatgacagagtacgaacgagcatgggagagtttccaatgtgtgaaaagtgtgaatgggaatatacgcatgcaaagacaagaagatttgatgcccagccggtttgctgtaatgaatgtggaccggaggtgtatttgcttggcagaccggaacgaggagcagatgcgattcgttacacaagaaaggtgattagcgaaggcggaattgtagcggtaaaaggcatcggaggatttcatctttgctgcgatgcgttaaaagaagaagcagttgcagcacttcgcactagaaaaaagagaccgatgaagccatttgcggtgatgatgaaagatttgtcagtagtaaagagggaatgtgaagtggcaccgtatgtagaagagattcttgacggacaccaaaagccgattattttgcttccgaaaaaggcaggagggcgtctctgtgagagtgttgcaccggataatccaaagattggtgtgatgcttccgtatgcaccgatacagcttctgctatttgattatcaggatgatgtagaagtttctgattgtctcgtaatgacaagtgcgaatacatcaggtgcaccgatctgccgggacgatgaagatgcactgcgtgaacttaccgggctttgtgacgtaattctttcccatgatcggaaaatacggattcgggcagatgatacagtcatggatttttacaagggagagccgtatatgattcgtcgttccagaggctatgctccgcttccatttatgatgggcaatgaatttaaagggcaggtgcttgccgttggcggtgaactgaagaatgccttttgtatcggaaaggatcagttattttatccatctccgtatattggagatatgggagatgtgcgaacggtaaaggcgttaaaagaatctgtgaagcgaatggaagaattgttagaggtaaagccagagattgtcgcctgcgatatgcatccgtcttataatacaagggcggcagcagaagagatgggactgccggtatttccggtacagcatcattacgcccatatcctttcttgtatggcagagaatgagtggacaacaaagaaaaaggttattggtgtttcttttgacgggaccgggtacggaacggatggaacaatctggggaggagaaatccttctggcggattatgattcttttaaacgctggggctgtattgagccatttgctcagaccggtggagatgcttctgctaaagaaggatggagaattgcagtttctcttcttggaaagatttacggaaaggaaatcgctctttcgattattgaaacattaggactttgtgagtcgaagctggcaaagcttcagtttactatggaagggcgtggaatcaataccgtaaagtccacaagtgccgggcggctgtttgatgcggtcagtgcgattctggagattagaaagtcatcgacatttgaaggtgaggcttcgacttccttacagtttgcagcagaaaaatggctggatagtcaggaagaaaaaatagcagaatatgaggactttgtagaatctggagtaattacagaatatagagaagaacaaaaagaaacacttgtaaaagatgagttatattatttaccgaccctggctcttgtcaaagaagtagtagagagaaaactgtcaggagaaaacagcaatcagcttgccttacattttcataaagggttagcctgtatgattgtttctgcttgcgaaaaagcaagggaagaaaccgggattgataccgttgctctaagcggcggtgtttaccagaatagattactgcttgattatagcgtaaccatgttagaaaaaagaggatttcatgtgctgcgtcaccatttacttccgccaaatgacggaggaatcagtcttggacaggcggtggcagcaatgagaagtatgtgtgtacaaaaaggggaataaattatgtgcgtaggattaccagcaaaagttatgacaatgaaagacggaatggcagttgtagatgcatccggagcaaagagagaagtttcagcagaacttattgagaatcttgagccgggcgattatgtaatggtccatgccggtattgcgattgcaaagattacagaagaagatgaggatgaagcagaagatcttctggaggaattactatgaaagaacagttaaaaaaagcaaaagctatcattgagggatacgatggacctccggtccgcgttatggaagtgtgcggaactcacacgcatgagatctttcatcttggtgtgcgaaagattctgccacagcaagtagaacttatttccggtccgggctgtccggtttgtgtcacaccagcagacttcattgatgaggcggtgtggcttgctttagaaaaaaatgtgacaatctgtacatttggggatctggttcgtgtgccgggaagtacaaagagtcttgcagatgccagaagtcttggcggaaagattcagatggtctattctccaatggatgcgtttgaatatgccaaagagcataaagaggagcaggttgtatttctttctgttggatttgagacaacgactccggcaagctgtctttccgtaaagatggcaaaagaagcaggacttacgaattatgcacttcttactgcgaataaaacaatgccaggagcctatgaaatgttaaaaaacagtgcggatgttttcctgtatccgggacacgtcaatgcgattaccggaaatgcattaaacaaaaagctttgtgaggaagaaggaatcagcggtatagtaactggatttactgccagtgagattttaactgcatttgctgtattattaaagaagttcccggaaggcaagccgttttttgttaatgcttatccaagagttgttacagaagagggaagtattccggcgcagaaactgatcaaagaatggatggaaccatgtgattctcagtggagaggacttggtatgattaaaaattccggacttcgtttaagaaaagaagcgcaggattttgatgcaagagtgaagttttcgattccgaagatggaagggagaacaagtccggcctgtcgctgtggagatgtgttacagggcaaatgtcttccaacagattgtaaagtatttggaaaaggatgcacaccacttcatccgatcggggcatgtatggtgtcgaacgaaggggcctgttccgcatattaccagtataatagtcgaggagaataaatatatcagatgtgagatgactcccacctctgtaggtggcgagcagcaagaatgccggggcattcttgaaaagaaagaggaaaaacaatggataacttaaaaggaaaaacagtttctcttgcccatggtgcaggaggaaagcagacaagcgaattaattgaccaggtatttaaagcacattttgccaatccagaactgacaagtgatgatgcggcagtattaaaaatgaaagaaggaaagattgcatttacaacggatggatttatcgtatctccgtcagaatttccgggaggaaatatcggaaaattaagtatttgcggtacggtgaatgatttgtcctgtatgggagcaaaaccgctgtatctttcctgtgcctttgttattgaagagggatttccaatggaaaaactcgaagcaattgcagccgcaatggaaaaaacagcaaaggaagccggtgtaaagattgttgcaggtgatacaaaggttgctggtaagggacaggttgatggcgtatttattacaacaacaggtatcggtgagattcaggaaggtgttgagacttctggatttatggcaaaaccaggtgatgcggtgattgtcagtggagatatcggaagacatggatgcaccattcttcttgcaagagaggattttggaattgatgccgatgtgacaagtgactgcgcaccactttggggaaccgtgcaggacattttatcagtgacaaaggatgtacatgtaattcgtgacgcaacacgaggtggtgtaggaaccgttttatacgagatcgcagagcagagtcatacaggaatacggctgaatgcagaggcaattccagtacaagaaagcgtaaaaggtgtgtgcggaatgcttggattagagccactttatcttgcctgtgaaggtcgtcttgtcatttttgcgccaaaagaaaatgcagaagcgatcgttgcaaagttacatgaaggaaaatattcaacagaggcagcgattatcggtgaagttaccgaagaaatgccgggaagagttgtagtaacaacggaaatcggagcagaaacattactgccaccgccggggggagaacttttaccaagaatctgttaagttagagaaaggaaaaacatggagaatacaagaatcgctgttctctccattatcgtagaggacagtgaaagtacggcaaagttaaatgaaatgattcacgattatgcagagtatgttgtaggcaggatgggtattccttatcgagagaaaaatatcagtattatcagtttggtaatcgatgctcctcagacaaagatcagtgagctgtctggaaaaatagggcgcctttccggtgtgacagcaaaagctgcttacgcaaaagtgtaatcagtgtacggataaaaggaaaagaagatatgattaagatagcggtatatggaaagggtggaatcggaaagtctacaacagtttctaatatagcagcagtatttgccagcgagggacttcgagtgatgcagattggctgtgatccaaaggcagattcaacggtgttactgcgtcatggtgagaaagtagaaacggttcttgaccttgtacgaacgaaaaaagataatttcacattagaagatatcgttaaagaaggctttgccggtgtctgttgtgtagaagccggcggaccatctcccggactgggctgtgccggaagaggaattattgcggcgttagaaacattagaaaaaaagggagcttacgagaaatactgtccggatgttgtaatttacgatgttcttggcgatgttgtctgtggcggattttccatgccgatgcgtcgtggatatgccgataaagtatttgtcattacttctggtgagaatatggcaattcatgcagcggcgaatatcgccatggcagtagaaaactttaaggatagaggatacgcacagctgggaggccttattttaaatcgcagaaatgtaaaaaatgaagaggaaaaagttgcggaacttgcagaagatattcacagtaaggtaattggaacattatcaagaagtgaacttgttacagatgcagaagaacagcagaagacagtaatggaagcatatccgaattcgccgatggcagaagaataccgggtacttgcaaaacagatcaggaagctgtgtggaatctgatgagaatataagagtaagctaaaataaattttttggaattttttgaaaaagtgatacaagctgtagaacattttacagaggaggtgcggattttgcttgaaatgttacatggaaaagcaaaggatgaagcatggaataatcaggtaaaagaaaaattatctccggcattacaggaagaagtttcttttaaagatgcagcctggccatcgccctttgttccgggattagaatataacagtccggcacatggaccatggaatatcgtacatatgggaatgcttttaccaggtgcccatcagatttatgtatgtggtgcaaactgtaacagaggtgtaatccttactgcggcagaaatgaatgctggagatagattttcctttgtagaaataaaagaagaagatttatttaacggacaaatggaagaacttgttatcgaaggagtaagtgatattcttcataaattaccggaaaaaccatcggtagttcttttattcactgtttgtgttcatcattttatgggatgtgatctcacgtatatttatgatacattaagaggacgattccccgagcagtgttttgtagattgttacatggatccaattatgcaaaaagaagggctgaccccggatcagaagttaagagccggtttatataagccgcttccaatgcgtgaaaagaatttaaaacagataaatattattggcaatgattttccgacaagagaggaaacagaattaaaacggattgcaaaagaggcaggttatacagtaaaagacattacagaatgtaaaacctatgatgaatatctatccatggcagaaagttatttaaatattgcctgttatccaccggcaaagtatggagcagagcagttatccaaacgacttggaatgaagtttctctatctttcgttctcctttgattacaatgagatagatgcccagctaaaaagtctggtaaaagaaatgccgggatgtgagatgccagataccagtttacttcagaaaaaatgtgagcgtatgttaaaagaaacgaaaaaacttgtcggtaatacgccgattacaatagatgctacagcagttccccggtttttagggctgacaaagttgctgatcacacatgggttttctgttgtaaaagtatttgcggatggatttttggcagaagaaaaagcagattacctgtggttaaagaaaaatactcctgatcttaaaataggtgcaacaatacatccgaacatgagagtgtgtccaaggaattcacaggaaaaagtacttgcaatcggacaaaaagccgcttatttttccgggacagagcatttcgtaaatatggtagaaggcggaggtttgcatggttatgatggaatctgcgagctttgtttaaaaatacaggaggcctatcagacaaaaaaagatacaagagatctgattgtccgtaaaggattaggatgtgaaagctgtgtctaaactgtcctattgtatattaactaacacctatataacaaaagacatttcaagtcgagcagttcctgtcactcaccacctgaaagagatgggagtcttctcgactgagataaacaaaacatttttgccggaaaggatgtagttatgaaacaagtatcagtaacattatcaacttatacggcagacgtctccggagtatgttctgccctctatgagcttgggggcatggtagtaatccatgatccgtccggctgtaattctacttataatactcacgatgagccacgatggtatgagatggacagccttgtatttatctccggtctttcacagatggatgccattatggggaatgatgataaatttattcacgatatcgtgcgggcggcaaaagaacttcagcctcgctttattgccttagtgcgaacaccgattcctctgatgacaggaacagactttgaggggatatcacgtgtcatagaaaaacaaacaggaattcctgtattctactttccgacaagtggaatgcatacctatgtaaagggagcaggaatggcaatggaaacaatcgcaagagaacttgtgccagcaggtgggaaatctgtgaaagaaagaaaaaacaagcaggagaatccactgaaaatcaatattctaggagcaactccgcttgatttttccataaactctaccttagattctataaaagaatttctaagccggcattttgagattatcagtacttttgctatgggaagctctatagaagacatacaaagagcaggagaagcagacataaatcttgtcatctcatctgttggagttttggcggcaaaagcattagaagaacgttttcataccccatatgttattggtacaccaatcattgggtttgaaaatgtattagctgaaaaattaatagaatccgcctggacaaaaaagtcacagacagcctattttagtgttttacaaaaagcacacaaaaaagatacagctaattttacaacaatgcaaaatgcagaagctgtttctaatttaaaaaaaataagaagtctaacagaaacaatagaaaaaaataaagtcagcggtaacatttatattatcggtgaatctgttatatcccagtcattaaaagcggcgctggcattacgatacggaatagaagccactgtaatctgtccacttgagacagaaccggaatatacagagaaagatgtcttgctcctttcttccgaggaggacatcaaaaaagcaataacggatgccgacaccgtaattgccgacccaatctataaaacaatctgttccgaaaaagtgaattttgtggcaatgccacatgaagcatactcaggaagaatctacagaaaagaagtttgtgattttattcattgagagaaacagacgaaaataaaaagaatagaccattgcaaatgtaaagatatcactgcgtagaaaatgcctgttcggcatttttacttgctcccacattacatttgcaatggtctattctttttattttctgtgttttggctccggaaggaatgaatgcaatagtctttggggaaagagatggggaaggggatagaaggttgtggcttattctaatgtcattttcactatgctgtcaatgatgataagacgatatcgccagctatcattgtatacaataaattcaccactattacttttcttttagacgatataccttccgagcaagtagaagtcttctgacctctcccccttatccctcccaaagactgttggattcattccttctggagccaaaacacagaaaaaagaaatactgccatatcccacatgcggatgagcatcttaaacgcagcgactacagagcagatgggatatggcagtatttcttttttcgtctgttttcttctaatgaatcaaatagtaaatcatcacttggaaaaagctttaaaatattatatactagggagagatgaatttcgaaatatttagagcatgaggaggatgaaaatgaagaagaatattatcgcgatcagccgagagtttggtagtggaggaagaacgattggaaagcttgttgcagagaaacttggtattgaattttatgataaggatattattaaaaaagtagcagaagagtcaggtcttacaagaaagtatgttgagcattacggagagtttgctccatcttctgatcagcgttttgcgtattcttttgtaggtcttgatgaagattccaattcaccgcttgttcagctatggaagacaagagaaaaggtaattacagatttcgcaacggcgaagccatgtgttattgtcggtagttgtgcagactacattttaagagacagggaagattgtctgaaagtatttttatatgcggattcagatacgaaggaaaagcgtattcaggaaatctatggtgaagttgggttaaagcttaaaaaccgggtaaaagatatggatattcgaagaagcctgaattataagtattttacaggtcaggattggggtaaggcacagaattacgatatggctcttaacagaggaagcctgggtgttgagaagtgcgcacaacttatcgtagaagctgcattaggagaataagattaaagacgttacatctatgagattcgatcacagattacaaaaaattacagaaaaatagtatgggagtaatttgagaatgaaacgggaactggaattattaagggtgaaaatgaaagaaacaggtgtagatgcctgcctgattcctacaagtgattttcatggttcagaatatgtaggagattattttaaatgcagagaatatatatccggatttaccggttctgcaggcaccttagttgttactttggatgaagcgggactttggacagatggaagatattttttgcaggcagcaaaacagttatctggttctggtatcactttgatgagagaacgtcagccaggagttccttcaatagaggaatatttaaagacaacattaaagaaaggtgagaccttaggctttgatggcagatgcattatggcagaatatgcagataccttgatcacacagctgaatgcactgggagtggcggttcgtacagacattgatcttcctggtgctgtgtgggagaagcgtccaccgttatcagcgcaggcagtatggccgcttcctgtagagtatgccggggaaagcagtgaaagtaagatcaaacgtgttcgggaattcctttctgaaaagaaggcacagtacttattgttaacttctttagaagatatcgcatggcttttaaatatgcgtggtaacgatgtggaatcgacaccggttattttaagttatcttttattaggacagcaggaaataatctggtatgtacaggaggaatgtctttccgaaaagatcaagatccttctagagatgcagggaataaaaaatgctccgtatgcacagatttatgaggatgtgaagaagcttccggaagaagcatcggtatattatgataaagcggcagtaaataccgcattagtttctgcattgccggaaaaggtgaagaagatagaaggtgtcaatccgactcttttgttcaaagcaaaaaagaatcctgtagaagtggaaaatgaacgaaaagctcatataaaagacggtgtcgcagttacaaagtttatttactggttaaagaaaaatgtaggaaaacagaaagtaacagagcgtactgcagctgcaaagttagaagagttcagaatggcacaggagaattatatagaaccaagctttgcaccaatcattgcatataaagaacatggagctatcgtacactacagcgcaacaaaagaatctgatgccgagatacagccggaaagcttcgtgttagcagataccggtggacattacttggaaggtacgactgatattacaagaacaatcgcactgggtacattgactcaggaagaaaaagaaatgtacacaactgtattaaaaggacatattcagctggaaaccgcccgctttttacagggctgcagcggtcagagtctggatatacttgcaagaacaccattgtgggaaaaaggacttgattataatcatggaaccggtcatggagtaggttatcttttaagtgttcatgaaggaccaaacagcttccgctaccgtccatctgtcaatggacgaaatgactgtattttagaagaaggaatgataacatcagatgaaccgggaatttatttagaaggaaagtttggaatccgtctggaaaacatgatcgtatgccaaaaagatgtagaaaacgaatatggcagttttctgtgttttgattccctcacccttgtaccatttgatctttctgcgattattcttgaagaactaagtacaaaagaaagaagatggcttgaacaatatcataagaaagtatttgaaacaattgctccctatctgacagaagaagaaacagagtggttaaaagaaactttaatttaaactttaatttagactttgttttaaattttgctttattgggaaaaacattcaagtcgagcagccgcgagacttggcgcgtgattctggtcagcgtaagctgacatattctttacagcataacagcgcatttgtaaagacagtcttaggtagaaaatacttcgttgtatttttatttactctgacgttacacatacgctgctatgctgtttttgtttcattttttaaatccagccgccatcgaatcttatgatctgtccggttagatattcaggagattcggtaatctggtagcagaaagcagcagcttcttccggggatgcaaaacgtccgtaagggatttcttcagaaagagcagctcgttcctcctcgtcaaaacagcggttcatgtcagtatcaatgacaccaaagcttattccgttaacagaaatatgagaaggagccagttcttttgcaagggcttttgtaagggcatttatggcaccttttgaagcagaataggcagcttcacaagaagcaccgacttctccccatacagaggatatatttaaaatttttccgctgtgccggtgaagcatatgagggattacggcttttgacatataaaatacagagtcaagattcgtccccataagggtatgccattcctcagaagtcatatctgacaaaagaccgatatgggaaataccggcattattaattaaaaggtcgatctgtccaaaagtatccatcgctttttgtgtcattgtgatggctgttttctcttcagcgacagagccaaagcaggaaatgactcttgtttttttggaaagttctttttctacagctgctaaggcatctttatcgtgaccaccgtttaatgtaagacaacagcccttatctgcataaaaacgggcaagagcaaggccgattcctctggtagcacccgtaataagtattgatttcatatataaaactccttgtatgattttgtagcaatattatatagtctgataatcagaactacaagataaaatttatttcaatatttagaaattatttccattcagacaaaaacacagaaacgaaaacttgcaatagaaaaagaactttgatatacttaacagatgaaatgcggaataatccgtaagatcacgacaatatggagtaaaacaggatgtactttcggagaaagattttttcacaagatcaagcacaaaagattccgggagtacatgaggtaaaacaggagggcaagatgaaaaagccaagttttataaaaagatttttctccttccttttaagagtatgtgttgtgctcgccttgatggctgtgattgccgttggttcttttgagggagtaacatattatctgacaggaagttttacgagtgtaaagaaggccgtaaaagaagagacagatcagcaggaagtgcaggaagacacgacagacattgttaagaataataagaatatggagaatacattggtatttgttcatgataagaataccaataaagattatacaagcctgaatatgtatgataagaagacgaaggcatttgatgtattattgatgccatgtgatgcacaggtgtctgtaagtgagagtcttgtgaaagaacttcgtgagacgatatcagatataagcagtacagtaagcatgtcagatgtggcacgtgcttttggtgataagaagtatgagacatatgtaaagattatggaagatatcagtggcgtgaagatttcaggctataatgtaatgtcttctaatgattttaagaagcttttgaatgcaggcaatacagtaacatatcatcttgatcatgcagtttcttatcgtgatgcagataatgtattacagagtattgaggcgggagatgtagaacttgatggcgataccgcttatgctcttatgacttatatggatggaacagatgatgaggagaccagaagattagaaagagcgaatgattatcttacaaagtacatggaagaaatctttacaaagaataataattcaacgtttgctaaaaagtatgacagccttgtaaaagtggagaatacagatgatctgacatcaacagaagatattcttaaagggctgacagaggatggattcactcttcgtattatgcagggaagcgagacaaaaggagtattttctttagattctcagaaagtaaaacttcaggttgccgcgcttacaaagaaagcagaatcttacacaaagaatggttcatcaaaggcttcttcaagtaccgcttcttctagcagcacagaaagttctaagaagtattcgattgaagtttataatgcagcgtatgtttccggtctggcaaaagaatgggagacgtatcttgaaggcgaaggatacacgatcagtcttatcgattcttatcaggaagagggaccgatttcccagacaagaattaatgttactgaagaaggaatgggagaagatttactgaattacttcccggatgcagagattaatgtagtagattccatttcaacaggcggagatattcagatttatgtcggaacagacagtacaaaggtaccggaaggaagcggagagtccacaacagcagaggaagatgttgatgatgagagtgatgacagtacctctgatgatgatacagaggaatctcaatctgtagacaatacagaagacacagatacatctgacggatatgattttagctccggagaatagtaaatagaaacgttgcttgaattatagactggaaagatatttaaaggatatttaatagaaagatatttaaaggataaaagaaaggaaccttaacatgaaagatcgttaccacaaaaaagcgaatgtactcggtatagatgtatcaatgatgcgggtggacaaggcggtcaatgtatcaatggaactgatgcgtggaaaggggcttcctgttatctattttttatcagcagtcagttcattattgtgccagaataatgcaggagcagcagagtatgttgcttcctgtaatctggtgctttcaggagatcgtcatatggagcttgcagtacgccatcagcaagaggatggggaagttccgcaaggtataggagaatttgcagataattatcttaagagattatttgtaaagctaaacagagagggacgaagcatttatacgattatggatcaggaggaacatcttacttccttagaagaatatatggaggaatcttatcgcagtatagaagtccatggaggcattattggaaagaatgtgaaaggtgaggcagaccgtattgtgaatgagatcaatgcctgtattccagacatcgtatttgtctgccttccggcagaaagacagattaaattcatggaaaagtatgcagcgatgatgaatacccgtctttgtattcttatagaatctgtacagccattgattcggaaggaaaccgaagagattccattgtgggtacagaagctccacctggagggaatttattcctggtttaaaaaggaacagaagattcggaatacgattgttggttctgtttttaaaaagaaggtaatgagagaagtgccggaagacatttccttaacggagccggaagaaaactctcaggaaagtattttggaaaaacaggaagaattatgtaatgacaaagcggatgagagcaaaaataataaaaacgtacaatgaatttgtcataagaataacaaaataagaaagaaataaggacacttttcacaaaaataaaatagaaaggtgtcttttttttaaaattgctttaagaaatgtacaatatctcagttgttttttgcccagagcgtaggaaaaatggtaaaaatgtctaataaataaaatatgcttaacaatttagatgaaatagcaggcatattttcgtgagttttctcctagaattatttacaaattttaggtatgatagatagggacaaaatgtttatagcataatgtactctcggagtctttcttgtacttgattttgtgagtacatcatatttttaggaggttatttatggctagtttatcacttagacatcttagcaaaacatatgataacggagtcaatgcaatcaaggacgttacccttgaagttgatgataaagaatttatggtacttgccggtccggtgggatgcggcatttctacggtattaagaatgatcgcaggagtagaagatattacggacggagaacttcttgttgatggagaacgaatgaatgagactccttctattgatcgggatatggcaatgatttttaagaatggaaagttatatccgcagatgaatatttatgataatcttgcatttgggcttaagttaaaggaattaccaattggagagattgatgcgagaatcgcagaagttacacaggtacttaatattggacatcttcttgataagatgacggaagatttagatgaaaaagaacgtgcgttagttgttcttgggcgtgctattgtaaagaaaccaaaagtatttcttttagatgaaccgttttcaagtctgagtaaggagctgaaaaaggagatgcaggagctgttgtggagtctttatgagaagatgcagattacagtcgtttatgtgacacataatagtgaagatattcgacacacagatacaagagtcgctgttatgaatgatggaagtgtacagcaaattggaacgatcggagaactttatgataagccggcaacgccatatgtttcggagtttttaggagttcctgctgaagaagtatgttaataaatcataggcgatttttacatagacaccgggcttttgtagcttttatacatgaatgaacataaaaaataataaattttcacaagaggaaatatatttttcgtatatttcctcttttttttttgtcaattttgtattaaaataaagaaagattgttgcgtacaacagaaaagatgcgatgagagggaaagacaggagtgatacgatgatttcaaatcagattttacaggacaccattgatggtattaaggcaattacaagaattgacttgtgcgtcatggatacggaaggaaaaccgcttgcctccacattagatgcagttgaagaatataaagaggcggtgctggtatttgcagagtctttggcagagagtcaggcgttacagggataccagttttttaaagtttttgatgagaaccagttagagtacatcattctcgtcaaaggtgagactgatgatgtgtatatggttggaaagatggctgctttccaggtacagaatctgttaattgcctataaggaacgttttgataaagataattttatcaagaatttgttattagataacttactgctggttgatatttataaccgggctaagaagcttcatattgagaccgatgtaagaagatgtgtatttattgttgagacaaagaatgacagagataataatgcgtttgaaactgtccgtaatattttttctgctaagacaagagactttatcactgcggttgatgagaagaacattattctcgtaaaagaagtgaaaaacggagaaggatacgacgagcttacgaagaccgcacaggttattgtagatatgcttaacacagaagcgatgacaaaggttcatgttgcctttggtacgattgtgaatgagattaaagaagtatcccgctcttataaagaagcgaagatggcgatggatgtcggaaagattttctatccggataagaatgttatcgcatacagccgtcttggtatcggacgtttgatctatcagcttccgttaccactctgtaagatgtttatcaaagagatttttgatggacgttctccggatgagtttgacgaagaaacattgcagacgatcaacaagttctttgagaataatctgaatgtatcagagacatccagacagctttatattcatcgaaatacattagtatatcgtctggataagctgcagaagagcacagggcttgatcttagagtatttgaagatgcaattacttttaagattgctcttatggtagtaaagtacatgaagtacatggaaagtatcgaatattaataataaagcctcctgtcggtatcgtcaggaggctttgttattaatagtgtactgtagaatagaatgcaagacactgatacagtacactacattgttgcggtgaagagaaaggcagatgaaatggacgtaaaggacaaagaaatgactatcgaattagaaaatgtttcagaagaagaatcgaaagagcagacggaggagcgttctgataaaaaacagcagcataagcgaaagggcggctgttttaaaacggtaatgctggcgtttgcgatggttatcgtggttggagtcagcttttttgcaggaagacagagcgtgatgacatcttccggatttgggacaggacttaataatggaacgattcttagaaagctaagtttattagaagcttatacaggcaaatattatcttaataaaatagatgcagataatgtggagcaaaatatttataagggatttgcaaaagggttacaggatccttatgcagaatactatacaaaggaagaattcaaacagctgaccgaagaagattccggagaatatgaaggaatcggtatttctgtagcaaaagataccgatactggatatgcagaaatcgtatcggtatttaaagaccagccagcgtataaagcagggcttaaaacgggagatctgattattgctgtcaataaaaaaagtacaatgaatatggaattacaggaagtcgtttcagaaatcaaaaagaaagaaaataaaaaggttgttcttacgatctacagagataaaaagtcaaaagattatacagtaaagaagtcttctgtacagttagataccgtctcttataaaatgaaggagaaaaagattggttatattgcggtaagccagttccttgagaatactggtgatcaatttgataaagcagttactgctcttgagaaaaaaggaatgaagagtctgatcattgatcttcgagacaacggtggaggactgttaaatacttgtacacagatggtatcacgcgtgatagataaagataaattgattgtgtatacgaaagacaaagaaggaaataaagaagaatttaagagtgattctggtaaaactttagatattccgattattattttagtcaatggaaatacggccagcgcttcagagattatgacaggatgtctgaaggattatggcaaggcaaccgttgtaggaacgacaacatacggaaaaggaatcgtccagaatattatgccgcttacggatggttcagcgattaagtttacaatcgcaaagtattatacgccaaacggtacggatattcataaaaagggaattaaaccggatgttaaagtaaaaatgagtgatgcacagtggaagaaagcacagacagatgaaaaggcagacaaacaactgaaaaaggcaatagaattgcttgaaaaataaaaaacagaaaaataaaaacaggaactttggggtaaggatccagaagttcctgtcgttagatgtacagtgaaaagtcagcgatgctaaagcgcagccttctcttttagaaactttgccagatattcatcaaaggcatattctaacgatttgtcgagagaaaagttcttataggaaataccggtggttatgagcaaggtttttgggtcatataaaatattcacataaatgccttcaatatcatcttcacgaaatgtgctgttactatgtgagatcaggtaagaaaccgattgttttgggagaccgagaacaattttacaggaaaggggaagacgttttcctttgataatatcaaaaatacggttacgaacttctttccagtaacaaaagtcgcggtttagtgtctgttctacgcttgtatcatagaacccttcattgattcgtccctgaatctggtaactgacccccatcttgatggaagcttcgataaaataaaagtgatcgaatgtatttccagataagagatgggacataaagtttttggtatcggaaacttgtattgatagcataaatgactccctccaaatagaattttgatttagaatataaaatgccttggtattcttgacttagtaaaagatgatttttcatgtcttgcaatagataatagcatagattattttttttgaaaaggagtataaaaatgaatgttttaacagaatgtttaagccagggaacatcaccggcaagtgtcatttcttttgcaaaagaatatttaaaacaggaaggttttgaagaattatattatgataagatgctttcaccgaaggagaatggaaagttttttattacgccatttccagatgtattatttgcatttacgacgggaaacgcaaaggcaaagattcagtcgcttcggatggcatttgcccatgtagaccagccctgttttaaagtaaagggaaagccggattttaaaagtatgggatgtgcgatgcttaatgtggaagtatacggaggaatgatggatcatacgtggtttgaccgtcctcttggtatagcaggaacaatcatgttaaggggagaggatgtttttaagccggaagaagtgctctatgacagtaagagaccgattgctgttattccaggacttgcgattcacatgcagcgtgaggcaaataatggatggaagattgatcgccaaaaagaactgataccgttgatggggattgcgaatgggcgctggacagaaggtgcatttttacatttcctttcagaggaactttccgtagatgaaagtgagattttaagttatgatcttaatttatataattatgatcagccacagctttgtggagtaaaagaagaaatcttatgcagccctcgaattgataatctggcatccgtcagtgcattattggagtcaattactgatggagaaagagaaagtggaatcaatctgatcggactttttaaccatgaggaagtgggaagtttcacgaagtcaggtgcagattcgaccttgctgggatccatcttgaatcggattttatcgggaatgggatgctcgaaagaacagatagagatttcccttgcacaaagttattatctttctgtggacggcgcgcatgcagcacatccaaattatacggatcgttgtgatacaacaacgagggcatatatcggtcagggagcaacgataaaagtaagtggtacgcaaaagtatgcatccgattgtcgtatgtatgcgatacttcttgggcttgctgaaaaatacgacattttattacaggagatcaatgacaggaatacgattcgtggcgggacaacattaggaccgatgattggttctcatttgccaatgatgggatgtgatctcggaatccctatgcttgcaatgcattctgcaagagagacaatggcaatggaagattatatcagcctatgtcgattagtgacagctttttttacagagtaaattagtctatttttctaatccttcgcatatactggaatagtattggggagggattttcatggaaaaacaaaatatatatcaggatatttctgccagaacaggcggagagatttaccttggtgtggttggaccggtccgaagcggcaaatcaacttttattaagcgatttatggaactgctcgtacttcctgcaataaaagatgaaaatgaacgaaaaagaacgatggatgagcttccacaaagtgggaccggaaagattgttatgacaacggaaccaaaattcattccaaaagaagcagcggaactgccgatggaagatatgaaaataaaaatccgtttgattgattgtgtgggatttatgattcccggagccggaggaaatctggagaacggacaggaacgccttgtaaaaaccccttggtttgattatgaagttccatttacaaaagcagcggaatacggtacgagaaaagtaatcagagatcattcaacaataggaattcttgtaacggcagatggttctttcggagaaattccaagagattcctatgtagaagcagagaaaaaaacagtagcagaattaaatgaaatcggtaaaccgtttttagtgcttgtaaatagtgagcggccgtattcaaaagcaacgcaggcattgacagaaaagcttgccaaagaatacggcacaagtgttatggcagtgaattgtgatcagctcagacaggaagatattttagaaatactgaaaaatgtattgctagagtttccattatcgtctgtgggattttatttgccgaaatgggtagaaacattaagagatgaccattggatgaagaagtctattcttgatcttgtgaaagaatttatggcagataaggggaagatgaaagatctttatcaggaagtttttccatcgaacgattacatagagtctggtaaaatagaaaaaatccatatggataccggaaaagtcgatgttaaaatacagattagagattcttattattatgatattttatctgatctgacaggacttccgataaaaagtgaatatcacctgatccggctgatgaaggaattatcggaaaagaagaaggaatttgaagaagtatcgcaggcactaaaagatgcaagagaacgaggatatggtgttatgaaacctgtcctgtcagaaatcacactttctgagccagaagttgtgaaacatggaaacaagtacggagttaaaatccgggcagaggcaccgtcaattcatctgattcgggcaaatcttacgaccgaagtagcaccgattgttggaacacagcttcaggcagaagatttgattacgtatataaaagagcaggccggtgaggaacctgacgaaatctggaatgtaaatatttttggaaaaacattagaacaattggtagatgacggtatatccggaaaagttacaaaaattaatgatgacagccaggaaaaactgcaaaatgccatggaaaaaatcgtaaacgaaagcagtggcggattaatctgtattattatataataatagggtcaaaatacttttgaccctgacatcatcatagatattcaagtcgagccgccgcgagcctgaaaaggtggaataaagcatacattttacttgcacaaaatggaaaaatatggtataataatttgggggtgatcacatggagatacagctttggagagaactgcttgacccataccagctggcagtcgatgaactgactgttaagtttcatcatattatagaagaacatcgtaatcagggcttatattcaccgatagagtctgtcgatggacgagtgaagagtattgtcagtattttagataagatgcagcgtaagaatgtatcgatgaatgatattgagaaaaagatagaagacctggcaggaattcgtattatctgtcagttcgtggaggatatagaccgggttgtgaatcttataaagaatcgcacagatatgaaggtgaagtgtgagaaagattatgtaagtcatatgaagaccagtggatatcgtagttatcatatgattattttatatacagtgaatacgattcatggtccaaaggagctgagtgcggagattcagatccggacgatggcgatgaacttctgggcaacgatcgagcattctttgcagtataagtataaggagaatattccggaatatattcagcagaagcttttagatgcatcagaggcgatcattgaggtggatcatgagatgtctgatgtaagagatgagattatggatgcgcagaattctcacagaaagaaagagacattagttaaggatattttgaataatattcagaatttatataaggttgctaatcagagagaagtaaccaagattcaggatgagttttataaagtatatgtgcttgatgatatgctgcaactaaagcattttgcaagacagcttgatatcatttcagaaggatatcgtgcacagagcttgtaaagaggtttggtgtatacattatggattcagtacaggaggaagtggatgaatttaccaaaggattatcaaagtaagatgcaggagatgcttggagaagagtatttacagtatctagatagttttcattatagttatggacagacgcttcgggtgaatcagttaaagatggaaccggcggattttatccgccggttccttttaagcggacaggtttcctggtgtaatacaggattttattatgagggagaacagaaattatccgcacacccgtattattatgcaggagtctattatttgcaggagccgagtgcgatggcgccggcagcgtttttaccggtagaaccgggagacagggtgcttgatctttgtgcggccccagggggaaagtctacggcacttgcggcaaagcttcagggagaaggaattttgatatcgaatgatatcagtgcttcccggtgtaagccgcttcttaaaaatatggagatggcaggcgtttcgaatgcggtgataacctgtgaatcaccggaaaagcttgcagaccggttttttggatactttgacaaagtgcttgtggatgccccatgttccggggaaggaatgtttcgacgggaaccatcgatggtaaagagctggtcacttgaagaagtgaaccggtatgcagaattacaaagagagattctttctcatgcagcacaaatggtaaaaccaggaggatatctcttgtattcgacctgtacttttgcaaaggaagaggatgaacaaaccgtagaatattttttagaacagaatgctgatttttctctgcaggaacttccgatttgtgatggtattgaagaaggcagaccggaatggacggtaagtggaagagaagatgtaaagaactgccggcgatttttaccgtataaggtaagaggagaagggcattttgcggcattatttaagaagcgtgaagaaacagattgtttagataaggtttttgaaaaggcagatagaaagcagatagtaaaggaacagacgatatcgaaagaaaagattccggatgcgatggaggactttatgcgtgatattccggaatggaaacagtggaaaaagcggttattttttataaaagaaagagcgtttctcctgccggaacattgtccagatcttagagggttacgtatcgtgcgttccggactctatcttggagattgtctaaagaagcgttttgaaccaagtcaggcactggcaatggcattacatctatctggatataaaaaaagtatttcattcccggcggaagatattcgtgtggaaaagtatcttcgtggcgagacggtggatatggatgatagcgaactttctggttggacacttttttgtgtagatgagtttccacttggctggggaaagtgtaacagaggaagattgaagaataaatataatccgggctggcgtaaattataaatacagaagaacagttatatataagcagagataaagtactccgccagagactataacaggaaaggaataagaatatgccggaaaatgcaaagaaagtcagactggataagtttttaacacaggctgcggagcttaccagaagcgaggcaaagcaaaagattaaaaagggcagtgtgacaattaacgaagaacttattaagaaaccggaagtaaagatctctttgcaggatcgtgtatgcattgatggagaagaggtactatatgaacagtaccgttatattatgctgcataaaccagcaggagtgatcagtgccacagaggatgccgaagacagaacagttcttgacctgatagcagaaggaaagaagggactttttccggttggaaggttggataaagatacagagggattgttactgcttacgaatgatggtgtgctggcacataatcttttgtcaccaaaaaagcatatagataaaacatattttgcaattcttgatggtccggtgggaacaaaggaacaggaactatttttacaggggcttgatatcggagatgagaagctggcacttccagcgaagttagaattgacagagaataagaatgaggtttttattactgtacaggaaggacgttttcatcaggtcaagagaatggcgcaggcagtaggaaggaatgtcacgtacttaaaaaggatttctatggggaacctggttcttgatccgaacctgaaaaaaggggaatacagatcactgaccgagaaagaacttaccagtttaaagaaaaaataaacggaaaggaattactttatggcaaaagaaaacggctttttgcccatcaataaaaaagaaatgagagaacgaggctggaagcaggcagattttgtttatgtttgtggagatgcttatgtagatcatccttcgtttggagcagcaatcattacgaggcttttagaagatgcaggatataaggtcgcatttatcgcacagccggattggaacgatgagaacagcattgcggtttgtggagaaccaagactggcatttatcgtgtcggcaggcaatatggattccatggtgaatcattatacttcgtttaaaaagagaaggcatcaggatgcatatacaccgggaggcggtttttccggaagaccgaaccgaccaaccattgtatacagcaatctgattcgaaagacgtataaaaagacaccgattttgctaggagggattgaagcgtccttaagaagaatggcgcattatgattattggagtgataaagtaaagcgttctgttttattggattctggtgcagatctgcttatgtacggaatgggagaacattcgattcttgaaatagcggaggcattggattcaggaatagatgtacatgatattacgtatgtcagaggaaccgtttttaaatgtaaagacttagaagaactttcctgcgaatatgaattactgccatcttatgaggaaatcacagaatcaaaagaaacatttgccagaagttattatcagcaatatattaacacagatgcgattactgcaaagacattagtagaaccttacaagaaaaaagaatatcttgtgcagaatccgccgtcactgcctcttacggtagaggagatggatcatgtatacgaactgccgtatatgagaaagtggcatccttcgtatgataagcttggcggggttcccgcattgaaggagattaagttctctcttacaagtaacaggggctgctttggaggctgcagtttttgtgcattaactttccatcagggaagaagaattcagataagaagccaggaatctattttaaaagaagcagagattttgatcaaagatccggaatttaaaggttatattcatgatgtaggaggaccaacggcagattttcgtcatacggcttgtgaaaaacagttgaaatatggagtctgtacgaataaacaatgtctgtttccaaagccatgtgcgaacatgaacgcagatcatggagactatattacacttcttcgtcgtttgcgggcactgccaggagtaaagaaggtatttattcgttcaggaatccgttttgattatgtgctggcagataaaaaggatcattttttagaagaactttgtaaatatcatgtcagcgggcagctaaaagttgctccggagcatatttgtgacagtgttttacgacttatgggcaagccttcaaatcacgtgtatgagcagttcgcaaaagaatatcgaaatatgaataaaaagctgggaaagaagcagtatatggttccgtatttaatgtcttcccatccgggatctcatttaaaagaagcgattgctttagcagaatatattcgtgatcttggatatatgccggaacaggtacaggatttttatccgacaccgggaacaatttctacatgtatgtattatacaggtttcgatccacgaacgatggagaaagtctatgttccggtaagtttaaaagaaaaacagatgcagagggcattaattcagtatcggaatccggaaaattatgatattgtaaaagcagcattgattcagggcggcagagaagatctgattggctttgatgagcactgtctgattccaccaagaaagatgggaaagaactatcatccggcacagaaacattctgtggagaaaaagaatgattttaagacagaaaaatttaaaacagacaggtttaaaacagaaaaatctaaaatagaaagagctaaagcagacagatttaaaacagatagagtttctgggagggaagaaggcagaggaaaggcaaagaagaagacgatccgtaacgttcataaaaagaagaaacgtggataggaggttacca

SEQ ID NO: 407 - DNA, 55937 bp, Eubacterium hallii
ttttacaatgatatattcttcctcttccattttaacattcgttcctgcatatttagaataaattactttctgtccaacggttacttccatcttaacatcgtctgttccaggacctacagctactacttctgcttcctgtggtttttcctgtgcggagctagtaagaataataccagtctttgtttttgtttctgcctccagctgttttaatacaactctgtctgctaatggtactaacttcataatataatgcctcctaatcaaaattaattgtaaatctgttatctttcttatttttatgttgttagcactcattacgtttgagtgctaatcgctaatacctataatatgttttttcttttataattgcaagtttaaaaattctttatttctttgtaatttgttttatatctatatttatctctcttttcctcttgttttctgattatatctctttttttctttagtttttctcttcccagtatgtttcttctcaagattcttcattcgaaaccgcccattttcataaataccggtaatctgcttatatcctctttttgtttttataatgtctcccaccttagcatctggaggtaattgatactttccatacactcttcgaattctgtttcgattcttttttctcccatatatcttatgcggaacactatacattctttccatagccaaaggagactcctctccttttctatcatattcctctgcattcactgctatggaacacaataggattcctataagtactccaaatcccagtattcttatcttcatcattctcctcctcagcgcaatcaagtcgttccctcatcgcaatgatctcgatcatctgtaccttattttactttatatatagacgcagtttttatataaaatgtttcattctcttgaaaaaaaaagtgcactatctatatagcacactttatcatttcttttatttaattacaaactgttacctttcttcgttttttctattatgaattcaagaatgccccggcattcttgctgcgagatgcgcgtcatctcacatctaatataaaaaatcaggaattgttctttatcgctttaatctgtgagagcagttcctgctcatccacatccgtaatcgcatcatcacctgtcagcgccgcaataaaatggctgatctttccatcgtaggactctttaagaatcgcccttgctttattctgcttaaactgcgcctttgttatcttcatctgataacaggtctttgttccttctttttctttctttaacagtcccttttcaatgagacggcttaaaaaagtattcaatgtctgtttcttccagtttttatccagattctcattaaaatacttcattaattccccaaaagtatacttatcccccattccccagaaatactccattatctcgtattctgttttactcaagtgactactcatatacttcatcctcctgtgtacttgccttgcattttataatatatagactatactatggcttaattattcttgcaagcactttctatatttctttcattgacattagttagggttaaaaggtatcttgacattttttttaatatattatactgtactctcagatttttttgatttttatctataacaaatgaaaggattttttatgaaaaaagcaggtcgttaccataatgattacagtccaagatatacagaagcatttgatatttacgagaaagcaaaaaatcatgtaaaagctcaaaaaaagaaagaaagattacgctctctttcgattattgaacaagaacatggcaacagaagctgcgatgataattccgtatccgacaaagctccacaaatcaggaatctgtctaaggaacagaaaaccaaggactgtggagaaaataatctgtgaataatcatagattgaaatctcgcctgccggtgcgcaggtatatgctgcagtaatagtaaactgccctccacttgcaaataatccggcaaggagcagacagccaaactgagcaagtgtcattggatgaaagtcaaatataagatatggcaatgtcacgatacaggagaatgcggagaaaaagaggacgataaacggacctttcacaccgtttgttccaaggattcgaacatacgtatatgcgattcctgctcccattccaccaagaagtccaataaaagccgggagtgcagttactgaggcaaaacctggtttaataacaaataaacttccgataaaagcgatacatacacaacttgccgcaaatggatgtattttttcttttagaagcagaaatgaaaacaaaatggcaaagaacggagatagtttatttaaaatagatgcatctgcaagcatcagatgatcgatcgcatagtaattacataaaataccaagcgtaccacagattgaacgcatcaacaaatttttaagctgtccttttggtatatgcactggtgtatgcgattttttcaaagcaataagcgcaaaaaatactgcaacaaaattacggaaaaagcttttctcaatagacggcagatctccggcaagccgaaccatcatattcataagtgcaaagaaaaaagctgacgtaataatcaagataatccctttatttttctgactcatacaaattcctctttctataattaattatagttaaaaattctagttaaaactttttaatgccgaacttgaaagaagaagcataattcattaaagtattgattttataactttaataaatcatgcttcttttaaatagtagctgtagcagtttcgttctacctttgggctgcaggcatcttactctgaagcagcggtagttcctgttgctgcatcggtagaatctgcaggtgttgtctctgtcactgcctgtgttgtaggatctgtacgataatgaacagttcccgcatcaagagattctcctcttgctttatagagttcaggtacggttactaactggaatccctgtgcgatcaaatccggaacaaatcgttttactgcatctacattatattcgtggatgtcatgaagaagtacaacatctccatcctgtgctttcatcacttcattataggtcgcatctgcattctttgttttccagtcctctgtatcaagagaccagttcatacagcaaagattatatccacctactgcagataatactgttttgtttactgctccataaggaggacgcattaaggctggcttcacaccaatggcatcttcaatcgcgttaacagacttgctgatctcactgtcaagtgtagatgcgtcaagacttgtgagaactttatggctgtacgtatgtgttccaacttccataccaagattatgttctctctgtacagtttccggataatatcccgcattctgtcctaaacagaagaaagttgcctttgcatagttttcttccaaagtatcaagcattggggttgttgtatctgggttaggaccatcatcaaaagtaatcgctaccattggtttacttgggtcgattgccggataaattctaagatcaaaagatgcgcttaacttcgaaccatctgttgctgtagcagttaccttcactgtattcttacctgcattcttgcctggttttaacacgccatcttttgtaactgttaccattccatctttatcacaagtccacttcagctttgtatttgtcgcattcgatggctcatgcgtaatctttaactgcattgtctcgccaacacgaatcgttgttgccggtgcactaacctttaagtctgtcatcggtacactattatccgctttttcagttgatgcttctgttgcttttcctgaatccattcccttattccctgctttattatctgctgaaccaggagaaaaaagattccttataatagcaaaaataccacataataatatcacaacaactacgattgctgcgatcatcttaacggcacctgatttcttttttcttttcatgactgcctcctgtaaaatgtctactttcatgtactcttaaaaacctgttacatctattcaaaaatatctctcaaaaatgtctcacattcttgctgcgagatacgcgcttacctgcagagtaaacgttatctctcatctgacataaaatataaaaggcgaaaaccaaagtatgatttccgcctgcttttaacttattgcatagtttcaaaatgtcataaagatattctgaaatgaacaaaaattatactctggataagtattctcctgttctggtatcaatctttaacttatcgccaagatttacaaataaaggtacgtatacaactgctcctgtctcaactgtacaaggctttgttgctcctgttgctgtattacctttctcacctggttcacattctgttacttctaactctgcaaacattggtggttcaacagcaaagatatctccgttatgagaaatcatcttaaccatatcattctcacgaacaaacttaagagagtcaccgatcatatcttcattcaatgcaatctgatcgaatgtctctacatccatgaagtaatataagtcaccatctgtgtataaatactgcatatctgtacgctcgatatgtgctggtgggaacttctctgttggacggaatgtcttctcaacaacaccaccgttcttaatattcttcatcttcgttcttacgaaagctgcaccctttcctggttttacatgctggaaatctacgatctgaaatacatttccctcaagttcgatagttaagccatttttaaaatcgcctgcagaaatcatatctgaaaatcctccttaatcactagtaaatcattcattaatctattctataataaatacctctatttttcaacactttttttccttatgcttcggaaatagaaaaacagaacgattctttccagatatcgtttgagaacaatctgaatctcttcttttgggtgaatcggcttaaccatgatcgtgtaaagaccggctctctttgcccctaatacgtctgtaaaaatctgatctcctataaacagggtattttcttttgttgttttcattttacggattccttcttcatatcctcccggcagaggttttcctgctttaaaaatatagtcagaatctactttatcgcaaaaactttttactctcggttctttattgttcgatataagacaggttgtaaaacctatctgttttaattttttaaacaaagcaatcgcccgctcatccgcaggagctccgtgaggaactaaagtgttgtcgatgtcgaacaatattcctctgtatccgtcattatataactttttaaaatcaattgcataagtagaatccatatactcatccgggtataacatgtgccgcatatattttcctttctcattcttcgcattttcgtaagttacatatattcttcataactgtttctaagcttttctaacgcttttttctcaatacggcttacatacgatctggaaatccccatcattgccgctacttctttttgcgtgtgtggtttatttccacataatccatatcgtttcaaaataatcgtccgttccctgctgtcttctaacaaaaagacttcctgctcaagatgactgagataatatttgtgaagatactgatccaccagcgccgcctcatccgtagaaataatatcaagaagactgatgtggtttccttcctgatcggtaccaattggttcatataaagatacttctcttagaatcttcttttcctgacgaagcatcatcaaaagttcattctctatacatctggcagcgtaggttaccagccttccacccttatccagatcaaatgtatttactgctttgatcaatccgatcgtgccgatggaaatcagatcatccaggtctcggtctggtgagttatatttctttacaatatgggcaaccagcctgagattatgctcaatcaatttctctttcgccttctcatctccgttacggtacattttaagataatatctttcttcttccatctttaatggcttcttaaatgaccgcatacaacgctccgaaacccgttttccttacattatatgcatgacaggatggacactgttcctactcttttcttcgaagcagataccccttctctaacgcttccccaaagttgatccagatttcctgttttggatgtggtgcagattctactgcatgacgatcttcatcttccataccaagtactttgagatttctgttacttccgtctggaatcatcacttcaattgtttctcctactgagaatttatttctctggtaaatcttgcaccagccattctcatcaacatcctgcacgattccgatatacgtatattccttaatataagtatttgcatcatagatctgggaattctcgtctgtctttccgtaataaaatcctgtagtaaactgacgatacgtgcattttgcgatttctttacggtaataatccaaattcttttcaaataattctggagaagtcttataatcgtcgatcgctcttcgatacgttctggtaacagctgccacataaagtgctgtcttcatacgtccttcaatcttcagactatccactccagcctcaagcagatccggaatgtgttcgatcatacaaagatcttttgaattaaaaatataagtgcctctttcattctcttccacaggaagatattcgcccggacggctttcttccataacataatatttccagcggcatggatgtgtgcatgctcccatgtttgcatttcttccggtaaaatagttactaagcagacatcttccagaatgagaaatacacattgctccatgaacaaaggcttcgatttccatattttccggaatattagcacgaatctctgaaagctcttttaacgataactcgcgggctgccacaacacgacttgctccctgtgcataccagaaattatatgttgcatagtttgtactatttgcctgtgtactgatatgtctttcaatatccggacattcttcttttgctatcataaacacgcccgggtcagaaatgatcagcgcatccggtcccatttcctttaattctctaaaatactctcgtattccttctaaatcttcattatgtgccacaatattagctgttacgtatacttttactccattttcatgagcaaactttatacctgcttccatatcttctcttgagaagttacgggcttttgcacgaagaccgtacatttctccaccaatatatactgcatccgcgccataaagtactgctgtctttaatacttctaaactacttgccggtataagtaattctgtatttctcattatatccctttctttctgttttgcttatagacgatcattatggtatcgcctgtattatcatttttattttaattttaatcttcttttttaacactgattgccatgccatctccggtttcaagaataacggtatcgattgcttcatcatgggtcagtgcatataaatactctctcattcgattatgaatcgtgtgattccgtcgtttaatgccatagcgggactcaaaaatgtctccgtcctgaagcacgttatctgacactaagattcctcccggagctaaaagtctcatcacttccggcataaaatgaatgtattgtccctttgccgcatccatgaaaataaagtcccagcttccggacaattcttttaaaacttctgccgcatctcctgcaattaatgtaatcttatcttccatgcctgcaagggcgatgtttgccttcgcccgttcaatacgcggcggataattctctattgttgttatgtgtgtatttttcccggtattttcacccataaaaaccgaagaaaatcctatggcagcacctacctcaagaattttctccggttttttaatttgcagtagtattcgaagaagctcgcctgtctctttacggataatcggcacatcatccctgactgcctctttctcaatcatatgcaaagcctcagaccctctgtctactccaaaggaacgaatgaaatccagaactctctcttctgtgatcactgtagcttttcctcctcatgggttaactgttttaatatatctgacggcttcgtggaagaagaaacccgatattctcccggacggatattctcatatccgttcatacatcgaagagatatggcaaacagatatgcattatctacgatcccctgttctgccagatccttagagatatccagaagggattccttctcctccacaaccagtacagtctctattgcttcctgtggcttgttctttgccttgtcttcaaaaatagcacgaccaaacccactcattcgcacaaagagcagaacaaaaagaagcagaataaaaatatatgctaatgtctttataatgatgtgcattactctttccaacatgattcctaccccttatccttactccttttattcttaatatatcccagaatcctatgtgcctgattttataaagcgcataagtatctgccagtatttatctgtcttttattaaacttcatccatataggacagatccagcttgatatcctctgcgataccatcatatactattcgcatcagcttgcacatccgctgttctgcggaaaggaaatctaccaccactggttctgtcagcacatctttatattccgaatgaagcgactccattctttcaaagtactgttcctgttctctttccagctgtaaatgcaggctttttccacgaaattctttaaacttatgatacagctcctcctgtgctttcagaactgccagatccttttgataacacttgtaatcttctgtatggcagatcatattcgtcagctgcttcgtgctctgacaaatatcttctgtatcaggaaagaacggtattgataactttccttcattcatcatgttctacacttccataatgattggaagaatcatcggacttctcttcatcttcttccatatataatctccgagatcatcgcggataactcccttaatacgaccccagtctgtaatcttcttcgcattgcaatgctctaacgtattcgtaacaacactcttcgcctcttccatgagcttctcgctctctctcacataaacaaagcctcttgaaacgatatcaggtcccgctaaaagtactccattataacggtcaagtgtaactactacgataaataatccgttctgcgacaaatgctgacgatcacgaagaacgatattaccgacatctccaacaccgagaccatctactaagattccctgtgccggcacatgaccagttaccttcgcctgctctttagaaatggtcagtacatcaccagactgcagaatcataacattctcttttggaattcccatctcaactgcaagatctttatgtctcttcaaatgacgatactctccatgtatcggtatagcatactgtggctttgtcagcgtgtagataagcttaatctcttcctgacaggcatgtccggaaacgtgtgtatcctggaaaataacactcgctcccttcttggcaagctcattcatgacttttgatactgccttttcattaccaggaatcggatgagaactgaaaataatcacatcacccggcttaatagaaaccttacgatgtgtggaagctgccatacggcttaatgctgccattgtctctccctgacttcctgttgtgataagcacaagctgctcatccacgtaattcttcatctgttctatgtcaatcagcgtattatctggaatcttaatatagccaagctctgccgccgtagaaattgtgctgaccatacttcttccttcgattactactttctttccacaactatatgcacagtctatgatctgctgcacacgatctacattggaagcgaacgttgccacgataatacgatgatccttattctcatcaaaaagatggcgaagcgttcgcccaacggttctttctgaaggagtatatccttctctctctacgtttgtactctcgcacatcagtgcaagaacacctttctttccaagttctgcaaaacgtcccagatcgatcgcatctccaaataccggtgtgtaatcaatcttaaagtcaccggtgtgtacgataattcctgccggtgtataaatagcaagagctgccgcatcactgatactgtggttcgttttgataaattctatacgaaatcttcccagattaatagactggccatgtttaatgacctttcttctggttgttcttaaaagattatgctcttttaacttattctcaataagtcccattgtaagctttgttgcataaataggcatattcagttctttaagagcatagggaatcgcaccgatatgatcttcgtgtccatgggtaattacaagtccctttaccttagatgcattctctttcaaataggtaatatctggtataactaaatcgattcccaacatctcatcgtccggaaaagccagaccacagtctactacaataatactgtcttcatattcaaacgcagtaatattcataccgatctgctctaatccgccgagaggtattatctttactgattgatttcctgttgttttcaaattataacctccgttctactattcacttgtccatagcagaaagtacggctgcatagaataaaacggacaatccctttctgcaaaagtatccgccgctttatcctcacacaaacgtctgcctgctactctacttcaaaatcagtatcctccatcagctgttcaaatacttttgatactgatatcagttcctcctcatcttcaaccatctcataggctgccatctcttcttcgtcctctgagccagcggctcccttcataatatagacaacaacatcctcttcttccggatctgcacttccgtcttctactaacagatagtgaaacccattaagggttgtctgttcaaggacatagaattccacttcttctccgtcttcggtcacaaatggaatgctttcataatcattcataaaaaacctctttcttccgtacttacgtccgttctttgcttacttttccggaatgggatatgcatccatataactttgcaggatcagagtcgccgccatccagtcaatacgttctttcctgttctcacgacgtactccaccctcctgtaaaattctttcagactccatcgtagtcagtctttcatcccataagactacttccaatccggttcttcgctgcagcatctcctgaaactctttcgtttcttctgctctttctcccagcgtattattcatattctttggcaatccaagcacaattctgctcacttcgtattcttctgccaatgcttcgattcttgccagggtctggcgcagcttcttgttcgactttcttgtgatcgtctccactccctgcgcagtaatacccaaagcatcactgactgccacgcctactgtctttgtcccgtaatcaagacccatccatctttctttcataattacttcaactgagtatcaatataattttcgaataaaacttcaagaatctcatcacgttccaccttcataatcaggcttcttgcattcttatgactggtaatatacgtcggatctccagacataatataacctacgatctgattcacaggattatatcctttttccgttaatgcttcgtacacatctttcaaaatagatgccacatcgtattcctgttctttaaccacatgaaaaaactgtgtattatttctacccatgtctacctccttctagcagatttacaatcaataaatattttactatgagtgacattaaaattcaatcgaaacttttccgtacagtaaattttcatcaataaatccttgaatatctactacaattacttcattttgtcttaattttgtatcattttccgacaattctaccgcaactttcacataatgagcagtatatccctggaaatattttttaccattcttctctatgatttcttctaaaagtactttttcttttcttccaacataccacttttcaaattccgatttatgacgctttgccatcgcaagaagtatatcggaacgctctgtctttacctgctccggcacatgaccggacatcttctgcgctcttgttccctctcttacagaatacttgaaaatatgcatttcgtaaagattaatcttttcaagatatgctcttgttttttcaaactcctcttctgtctccccgacaaaaccggcgataacatcagtagtcagcgctggatgctcgtaatatgttctaagaacatttaaggccgtctcatattcctccgttgtatatttacgattcatacgctttaacgtttcatcacaaccgctctgtaaagaaagatggaagtgtggacagactttatcacacgctcttaattcctttacaaattgttctgtaataattcgtggttctaaagaaccaagacgaatcctttcaatatcctctatctgctgtattctctgaatcacatcaagaagcgttatatcccccagatctttaccataagaacttaaatgaattccggtaagcacgatttccttatatccctgtgctgccagattctttacctcttcaataacttcttcggggtttttactgcggattcttcctcttgtataaggaatgatgcaataagagcaaaactgattacatccatcctgtattttaatatatgctcgtgtatgctcatttactttatgaattgtcaaatcttcatattcttttgtatggttaatatcaattacttcagaaactaacggaaccttctgttcttcttcttttactgcaaaatattcctcaaggatctgtgcaatatccttctttttattattaccgacaaggatatctgccatatttttctccgccatttctttttctgcagcctgtacataacatcctgccgccacgatcactgcatccggattattcttcttggcccggtggatcatctgacggctctttctgtctgccatattagtaacagaacaagtatttataatatagacatccgctgtccctttaaaactgacaatatcatatccattcttttcaagaatttcttccatcgcatcagtctcatactgatttaccttacagcccagtgtaagaaatgccgctcttcttttgctcatatataaaatctcctttttccgtttctccttttctgctctaatacactctcggaaccttttatcattttattctcacacgttaccttctttaatcatataaacatatataaaaaaaatcaacagaaagaaaggacaataaattaccctttattattagataatattttccaaattctccttaagtctattgacttttttacactaaaaaggtactatattattaaaaatatatagacattttaaggaggaacgtatacatgaaaacgattaaaatctctttaaattccatcgacaaggtaaaaacatttgttaatgttatcaatcgctttgatgcagaatttgatttagtttccggtcgttacgttattgatgcaaaatctatcatgggaattttcagtttagatatttctaaacctattgatctgaatatccataacgctgataatctcgatgagatcatggaacagttacagccatatttagtaactgaataattttattgcacagttacataatgtatgaaatcaaccgaggaaaatactttattttccccggtttttttaatacatttttcaattaatgtgcatgaatcttaatctcttctgttgtctcgatcgctgttttcatcaattcatcaatacagtcatcaagatttctctcagaacgtttgatcacatctaatcttggctttgttaccggatgttttgccacaaaaatagtacagcagtcttcgtatggtaaaatagatgtctcatatgttccaatcttttctgccacttttacgatttcatttttatcaagtccgatacatggacggaataccggcatctgacaaacttcattcgttacatacagactgtgcatcgtctgactggcaacctgtccgatactttctcctgtaacaagagaaagacagttatcctgattagcaaaatgttctgcaatcttcatcatataacgacgcataatgatcgtaagttcatcatgtggacacttctcatagatcgccatctgaatatctgtaaagttaacgacatgcagagtgatcggtcctgtatactttgcgatttctttcgctaaatctacaaccttctgctttgctctctcacttgtgtaaggaggtgcatggaagtaagttgcatcaatacttacccctctcttagaaatcatataacctgccacagggctgtcgataccaccggaaagaagaagcattgctcttccgtttgtaccaaccggcattccccccggtcctgcgatttctctggaataaatatataccttatcacgaatctccactgtaagcataacatccggattgtgtacatcaacacttaagtcctcaaacttctctaacaatctctctccaagacgggctgccgcttccatagaaggaatcggatactttttatctgctcttcttacatgtactttaaaagaaaaatgcttatctgcataatcttcatcaacatatttttctactacttctgcaatcttttcaaaatctttatcttcttccactacgatcggacagattcctgcaataccaaatacatggcttaaactttccactgcctcatcaaaatcatattcttctaatgcatgtacaaaaatacgtccggattcttttcggatagcaaactctccaaccggctttaatgcatacttcatctgacgaacaagggcatcttcaaaaaagcggcggttatttcccttgattcctatttccgcatatttaatcaaaaatgctttaaattccataaatatctcctttttatatgttctaattgttttatcgtcttgtaaatctccgaagcatcggtaataactcctttaatgcctccacacaaatatctgcttcttctactgtattaaaaatagagaatgaaaaacgaagcgtcgattcatagtattcctttgtaagaccaatgcccttcaaagtaccgctgacttccggtttattagatgaacaggcagaacctgctgatacataaatctcacgttcttctaatgcgtgaagaagcacttcacttcttactcctaaaaagctgatactcgccacatgcggagcatctccggaattatccttcacatctggaatctcttccatcactctttttataaaatgatcctttatctctctgatatgtgcaatcttgtcctcatgattctcgtaaatcaactctgctgccttgccaagtcctgcaattcccggtacattttctgttccagaacgcattcccttttgttgatttccaccccagatgatcggctttatctttgttccattcttaatataaataaatccgattccctttgggccatgaatcttatgcccacttacagaaatcatatctgctttccatttcttagggtaacaattcaatttaccatatgcctgaatacaatcggtatggaataaaatctttggatcaaaagactttacaatctttccaatctcctcaaccggttcgatggcaccaatctcattattcacgcacataatagaaaccatcaatgtatctttacgaagcgccttctttaatgcctctaaatctacgattccatgttcatcgacaggaagataggtcacttcaaatccctcatcttccaaaaaagataatggattatatacagaagcatgttcaatacagcttgtaataatgtgctttctctctcttttatttgcaaatgcagtaccgatcaatgcaagattattcgcctctgtaccaccagaagtaaaataaatctcctttggatcaactttcaggctctttgcaataatctctttcgcatgattaacatacttctctgcatcaaatcctttcatatgcatagaagaaggattcccatactctttctcaagtacttcatccataatctcacgcacctgcggcagcgctcttgtggtcgctccattgtcaaaataaatctctgacattctcgtttacaactccttcaaaaaatatattatgtcttattgttttttcattccattctctatactcaaaaaagcagccataaaaaatggcataatcgtatataaacataacataaaatgagagagaagtaaaatggattttgcggataaacaaacgaaaatgaaaaaggatattaccctcaagctgtaaagatagtcgttcgagcaaaatgctcagtcgcattttcactcactccgacattacatcttgagggtaatatcctttttcattttctgtttattggctctccaaagtcattttactggctgttagagaagatgtagttaaaaaataataactttaagctttatgattattttatcttatatgactactttaccttgactttaaaggttgctttttttccgcttccatcggttgccatagcgataatttttatagtttttcttttggcggtctttttagttttgactacgccttcggcattaacagtggcatattttgtgttggaggatgtccactgtaactttttatttgctttctttgtagcggttacgttcgcttttaatttcaggctttttcctgctttaacggttttagttcctgtaatttttactttctttacgattcctttcatggaagttactttccaggatgcggaaacctttatcttatcgtttgatgctgttattgtaactttctttcctccggttttctttttcactgttacaacaccatttgcattaacggttgctacctttgtattgcttgacttccagattaactgttttgttatactgtctggcaatccaatttccgcctttaagttcacttttttgcctgcggcaatctgttttggcttgccggttgctttaaaaggttttatagatggagcttttgttgcgttaccagatggttttgttgtgttgctggacggtttctgggttccttgatttgcattttttgaaaaatgtgctgacaggtttctgttattctgaacacagaagcggtattctttttcttttgaaatcagattatcattttcataccatcctgcaaatgtataattagtttctggctctgcagttacctttgcatattcgctgatcgtatagtttccgccacctgtaacacttccacctgactgcgcagtaacatttacctgttttttaatatcttcggaagcacctttttctatcgaaggctgtacttcatctccactgacattcttaagcgtttctgtagaactttctgtacctgtttcaaatgtacttttgtaaacttctcctttttttatcggaatatcaacataactttttacctgactacattcattggtttccagattctgattcataacagtatatgtcatcgttccgttgtctgttgcttttaaatccactttgtagtcagcatcttcagggatacatacgattttctgaccattttcatcaatgtatgcttctaatccctcttcattgtctgtaactttatcattcttaatctctgccacactattattatctgcatcatataccgtcacatcaattggacagtttacagcaatttttttatactttgtttttgagctttgtgcgatggcatctccagaaatcgaatcaagccatgaaagacataattccgcataatgtgctcgtccaacaggttccaaatgtgttagcaaatatgcagtatcaagtggatgttttgtagcaagtcccggtatcactcttgcaattgtcactgcaagggctccggtatccaatccactgttctttcctaatactcctgccattccactaatcatatttgcctgtagcctcatataataattgtctctattccctgcaacatcacataaatcattcatcagattatccatcatagaagcttgagctatcccttcccaagtcatatgcattgtcgctgtatctgatgtcactgtcggatctttaccaattacatctgtatctattatgttatcccaaactgctccaggtgatataccattatactgaatgagcattttatattgtgccatcattctgagttttgcaaccgcatagccagaagatgctcttacatttggcaactgataaacggttccatatcttcgaaatccaaatttactcattgctacttttgtcacaatatcaattggattaactacactcactatatttttatacttatcaccttttacataagtttccggtcttgtcgtgttctgcggacattcaaaacaaaaagcatagatattatctcttgtaagaccttctacctctccatcatctaacattttggctacaaggtttgttgtagccgctcctctgctatagccggaaatccatacttttaattcatatggcagcttgtctttatatttttctacatactttttaatgccatctctaacctgcagagctgcctcattaaaaccttgatgttcatcttttgttccaagatcaaagtttcctccccattcatccatatatccgccgccgcgaactgtaaccataagaagagagcatgttttaccagcaccgtttttaatatttttactgctaatcgcatagccaatcgtatttgttttaggatcgggataagaactttcataattcgtaaattctaacgaattcttatcagtcccggccatcagatactttatattcgtgtctatagaatgtggatcatccatcaccccatatccggccattgccgcacgaatcgacatctttgtaagcccatgctgataagtcgtacttggagtaaagaaccagttttcatcgtaatcataggtatattttgctgttttcttatctcctcctgatgtattaacaatcttatgtaaacttgtttcaaacttaaattcaccggatttttgtagagggcttgctatattgtctgtctcttcttttccctcgcttactgtgccatcagagcatacggttcctgcataaagttttgtaacatctactgaagaaagatttagatgcatggctggacgaatacttgtatctcttgatgtcgcgccattcccccgatcataaaccgccccctgctggtctactcccattctcatattgccctgacgtcccggggaacgaagccaccagtttatattttcatctgagtaataactcttagttctatatgcccccatcgcataagcgtaggtactgcaataacttcttcttgcctcatcatatgcatcccgttctttcaaaaatccattattctgcgcctcttccgtatcatacacatcagattttgatagtaaaaagatttgatcctttgtattatattcatcaccaaactcattcgttactagatttgtagtcttaattgccgtctgctcagctttcgaaaacgctgaatgaataaaattctttgacgtgtaatctttttccattttattttttgatgcatcatatccatttagccagcttcgcactgtactattttcccatcttaaaatcagccatccctcagtatcatattgctgggtatctaaggcaacatcagcaagtagaaataaatcatttccattcttattcaacacccgccacttaatcggttcatatttaaaataatgatatgtagtatagtcgtctttccaatcataacaagacgtacttccactcatatgaaataatgtatcttctccctttaatcggcgatattttattcctcctatctcaatatcattattactattccactgactttcagaagcacttcttaactgattgtaaatatttccatctgcatatgtaatctcactttgcggataacttccaaaataaatacaatcccaagtaactttctgtttagcaaacatagaatcatctggaacaagttgtggatttttaagcgttgtcgctgctttcacttccggcacagtcaactgcatatccttaaaacttatcccctgcgggcaaaaacctgcaagcatcgctacggtaagtacaaatgacaatatccgataccaacatttccttttcttcatatttttctttctcctctcatatggtgtctttattttatcataggttattgctatggactacaaaaataggaaaaaggagaatctttttcaatggaatctgtagaagattaacctctttggacaatgctacttgctatcaaatatatcttttagaatttttacttacattttctatttgtttttacatttatttcttgctatatttttccatatatggtatatttcatactgtcagaactaaattagatttattttcatacacattgacttggtacgcataacatattattataatattgcagggaggtacggatttatgccaaaaaagccacgagaaatggaaaaaattatccttgctgatggctggatatttcaagcgcaggtcggttcccaccgccactatatccacccatcaaaatccggcaaagttacaattccttttcattgtaaagacataccgaaagggaccgaaaattctattttaaagcaggccggattaaaatagtttcatctgttttccaaatttaaggaggtatttattatgttgtctgcttatccagcttgtttcatcaaagaagactccggatattctgttatttttcccgatcttgacatcgctacatgtggggatacgcttgatgatgctttttctatggcagttgactgtctggcaggttttttatattctgctaaccttgatggtgaacatatttctcctgcatcctcacttaacgatatcaatattgacaaagtcatgcaggaacttggtgtaacttctgatgaagcctttgtaaatatcgttactgtagatgttgccgaatacgccaaatctcactttacaaagtccgtccgtaagaatctcacaattccttcctggctcaatgacgctgccataaaacagaacattaacttctcccaggttctgcaggaagcccttttaagtaaaatccaatctcactgaacaatcccttttcattttctatacaacacatcatctctgaaacaagcgatcatcctcgcatctccaccatcaatttatcaaaaaacagacccccggaagggaaagtaatagcagatgtgatgtcggagcaagtaaaagttacatctccttacgagatgtagctttctacgccgcgattatcttcacatctgctattactttccctttcgggggttgtctctttaataaatgaaacctttataccggatatgctccattctttacatcggcttttgcaggatcaatcttattctcctgtgccgctctgtatttaaagaattcggttgctacctgtgggaacaatgcataagtaagaatatcttcgtcctgttctttccactggctcatctctgcctcgatcttagataattccggttcaagaaggtcggctggacggcaggtaattggcttttcatcgccgattgcctttttctgtacttctttattcattggttttacagtctggccgtattctccacgaagaagagcttttgactcgtttgtaatcattttataacgctctccggtaagtacatttaacacagcctgtgttccgacaatctgactggacggtgtaactaatggtggttcaccgaagtctttacgtacttttggcacttcctccaatacctcatagaacttatcggatgctccctgctgctctaactgagatacaaggttagaaagcattccacccggtacctgatacattaacgtcttgatatttacgccaagtacctttggactcattaaaccatttgccagatatttctcacgtattgggcggaaatagtctgcaatctcgcctaaaagcttctggtcaaatcctgtatcaaattctgtaccgcggaatgtttcagccataacttctgttgccggctggcttgttcccattgcaaatggagacatggctgtatcaatgatatcgactcctgcttctactgcttttaagtaagtcattccgccgacaccacttgtatagtgtgtatgaagttcgataggaatatttgttgcctgctttaatgcagttacaaggtgagttgcttcattcggcactaaaagtcctgccatatctttgatacaaagggaatctgcacccatttcttcgatatttttcgctgtctttttccaataatctaatgtataggcatcaccaattgtataagaaagggcaatctgtgcgtgtcctccctctttctttgttgcatttacagcagtctgtaagtttctaaggtcatttaaacagtcaaaaatacggataacatcaattccgtttgcgatagacttctgtacgaaatattctacaacatcatccggatatggcttatatcctaaaatgttctgtccgcggaataacatctgtaactttgtatttttgaagccgtctcttaatttacgaagtctctcccatgggtcttcctttaagaaacgcaggcaggcatcaaatgttgcgcctccccagcattctactgcatgataaccaacctgatccatcttatctacgattggcagcatctcctctgttgtcattcttgtagcaatcagagactgatgtgcgtcacggagaacagtttcaacgattttaactggttttttcttaatttcagccataatttctcctcttttatttcaaatcacgtaatgaattactcttataaactcatcatcaaatctaacgattctttatacaccaaaaattgccataaaagttccggctgctacagccgtaccgataactccggcaacgtttggtcccatcgcatgcatcagcaggaagttcgatggatcggcatccgctccaaccttctgggatacacgagctgccataggaacggcagatactccggcagaaccgattaatggatttacctttcctccggtaaccttacacataagctttccgaaaagaacaccggctgctgtaccaactgcaaaagctacaagacctaatactacgattttaattgtgttgacatttaagaatgcttctgcacttgttgtcgcaccaacggatgtaccaagaataataactacaatatacataagagcgttagatgctgtctctgaaagctgttttactacaccggattctctgaaaagattaccaagcatcagcataccaactaatggtgctgttgtaggaaggatcagacatacaacaactgttacgacaatcgggaacataatcttctctgtctttgtgaccgttcttaactgttccatcttgatctgacgttctttttctgttgtaagaagcttcatgatcggtggctgaataatcggaacaagtgacatataagaatatgccgctactgcgatcgggcccattaagtctgtctgtccaagctttccggcaaggaagatagaggtcggaccatccgctccaccgataatggaaattgctgctgctgcctttccgttaaatcccataagcattgcgaggaaatacgcactgtaaataccaaactgtgccgccgcaccaagcagaaaacttgccgggttggcaatcagtgggccaaagtctgttagtgctccaactcctaagaaaatcaatgaagggagaatactccattcatctaataagtaaaaataatgtaataatccgccttcttccataatggacggatataagttaaccagcagcataccaaaagaaatcggcactaacaaaagtggctcatatcctttggcgatggccagatataagaagactaaagcaaccagtatcataatgaagttacctggctttaagaatgcaaatccggtctgtgctgcgagattcgtcattgtctctacaacataactcataaatcttcctccgttttattttgcaaatatgctctagttcattgtagccagtacatctccgccttctaccatatctccaactgctacttccacacttgcgataacaccatcctgtgctgcacagatctcattctccatcttcatagcctctaatacaagaacagcgtcgcccttctttacagaagcacctgcctgtgcctttactgctacgatcttacctggcattggtgctgtgatttttacggcaccggcacttccggaagtctttggagcagctttcttagctggagccggagcggctgctgatgtacttaccggcgctgcacttgcttctcctgcacctaattcttctactgctacatcataagcaacaccattaactgtaattctataatttttcattgtaaatcctcctgaatgattttatgtacttttaaaatctttctatatctgactttttaagactttttaaggctttataaaaagattccaagaatacatttttgctatcttctcttcactctcttgattgaacgaacgaccaacttatctgcactgactgctgctcctccattcgctgccatgattgccgctgtgattactgcgacaagttcaccatcatccacaagttcctcttcttccacaacttcttcaagaatcggacgctttggagccggtctttcttcctgcgcagcctttttctctttcttagaagaacgattctttaacgctctttcaatagatgggatatatacaaaaagagaaatcagtaaagaaatgaaaatcagtactgcaaatacagttcccatacccatcaaagtatttaataaggcttgttcaaatacgttcatactctcacctcactatactgccgtatgcttctttgtcactggagttactttctttccgtaaagcatttcataagcagcgataagacgctttcttgttgcgtccggctcgatgatgtcatctatatatcctctctttgcagctgctaatgcactgctctgtccttctgcatattccgcagttttctctgcgataagtgctgtcttattcttatctgtattgatttcctctgcatacatgatacgaactgcctgttctgcatccatcattcctacagatgcctgtggccatgccagaacaaagtcagctccgatagctttagaattcattacttccgctgcagttccataagcctcgcctgcaatgagattaatacgaggtacactaacctgtgcaagtgttgtcgtaaactttgctaatgcaagcgcctgctttctctcttcatgtgcgttggcacgaagtcctgtcacgttcgttacagtaagaagaggaatcgaaaatgcatcacagaacttaataaatctttctgctttttcaagaccatttcttgttaaaacggactcaccatctactggctggtttgcaaccgcacctactgtctctccattcagacggataaatgcagttaccatctctttggcataggctgcctttgtctctatgtacatattgttgtcagaaatagattttaaaatgtaagcggcatcatatgcggcatcatttaactcaggaataaccctatttaaatcatcatcgttatcaaagtaaacatcttctgcttcataatcagaaggaagtacatcaacaagaatacgaagctggtcaagaagtgcttcttctgtctcacatacaaaatctacgttaccagcctgctcagactggaactgtgctcctgccgtattctgacgggattcttcattccccgctaatgcattcggactgttgataaagagactgccgttctccttctccatcaatgtaaaatcagacatagcggacattacggcacttcctcctccacacattccaaatactgcagaaatctgtggaatcattccagatgcctgtgcctgcttattaaaaatcgttccaaaagcgtgaagggcatctgtcgcttcctgtaatctaagtcctgcacaatccagcattccaatgattggcgcgcctgttttcatcgccagatcataaagggaagcaattttcttcgcatgcatctcacctacggaacctccaagtgcggaagcatcctgactgtaaatataaaccatgcggtcattaataactccgtatccagtaataacaccatcaccttctactttctttgcaccgagattataatcggtattacgagcggaaacatatccaccaacttccacaaaactgtggtcatcaaacagataatcaatgcgctctctggcattcatttttgaattacccatattctttcctccataaaaatgctatattgtataccttgttgctctttcattctatgtaataataacaaattattatcatgttagcaaccattttctgttagttatttaacatttattttattttgaccattccactaaacaaaatgaacattctgcctatttgcaaattttttaacaattctttcaattttctttctgaatctcctgtttttttcaggaatgcttgtgtatttttcctgtttttctctattttatctttaaaattctatttttattttatgtatccatttttatttcgttatatttttaacgcattttgacattcaattactagttggtttttctattttttcgtcattttatacaaaatattctcattctatcaaatatcttccgtttttcttcataatatcactcatatttccatcattcttcttctctcgcttatattctcctcctgtcttttttaaatcaaagatatagtatccaaaatcaattttggactatttttgtcaaacttttttcacaaactaatagcactccctttcattttatacaactgtatatgcataccacgaagtattttcaaaaaatcagaaagaaattataaactgtcaagaaaagcctgtaattttgcacaaatactcctttattttttcacgtaaaaaaggtataataaacaaaataaacaattctttcacaataaaggaggaggacatcttatggaaaaccgcaaaattcaatttcgttcaaaagcctgtaatctacatctttctgcctatccgggacatttcgcaacaaagcattctcatgtcaactactttttagatatgacaacattaaaagtacgtcagtctaatgcagaagaagctgcaagagcgttagttccactttataaacataataccgtcgtcgataccatcgtatgtcttgacggaacagaagtaattggtgcatttttagcagaaaagcttacagagagcggattcttctcttacaaccagcataaatctatctatattgttactccagaaatagattcagatggtcagatgttcttccgcaaaaacatccagccaatgattaaagatagaaatatcattattttaatggcatctgtcacaactggaatcacaatcaaccgaagctgggaatgtatcgagtactatggtggcaaactgcagggaatttcagcaatatttagtacgctttctgaatatggtaatcttcctgttaatgcgctgtttactccaaatgatattccttcctatcatacatatagcaaacacgactgcccatattgcaaaaatggacaaaaaatcgatgcgcttgtaaacggacatggatattccgaattattataactactaattttgtagatttcgtatagacgaaaaaagaaaccatgccatatcccagatgcggcttcggagcgggtttaagatgcggatgagcatcttaaacacagcgactacagagcagatgagatatggcatggtttcttttttcgtctgttttcccctaatgaatcgtaatccatttcaaaattttgctttgggtttctacgaattgttcatattcttcccggctgttttgctgatattccagcgtgatatactttggtgctacgcgctctacaaattcccggacaccttctccgataaaaggctgatgcagatcaatatgacaggcatggtcatatgcaaggcgaaatagttcataaaatggaatcttatcaaagtctatcggatgttctctccattcttttcgctgttttcttacataatcccctccaagtgacagctgcaggtgcattcctttgaaccagtggagcatctgtgctttttcgtatttgtctatcattttattcagatatgctacggcatcttccggagtctttagctgtgttgttgtattcatataatgcccggtatcgagcatgattccctttttttgtgtatgcattccttctataagccgacgggtaaggcggacatttttcaaggtaagaccgctccaccagagattctctacaagaaagtcgaatggatattctttttcatcaaggagggtattgatgacctctaagcttgcatcaatcacttctttatctgtatagcggtatttataaatatagctctcccggagtgtcacttctgaaacatggaaaactacatactttgctccaacttgttctgcataggcaagatcgtcccgcaaactgttcagataagattccctgctcattcctccaaagtattccagccactgctctcttgaatcaaattcctgatctaggcgttcataattccccttccaccagtccatccagaaaatatgaaaatacagatgtaccccattcaccatatccggcagaatctttccttcatctggctcgcctgcccgaatcacttccagtccatttaatcctcgtgacacataagactttctaatatcttcactatctttataacgatttagcatcccttcataaattgaaaaattcatggaacgacattctggtattttctgcatagtttcccccttcaatctcgtatactctcagaatctttctaagaatacattttatctatacttatcatccatacttatcatctatgcttatttcaaaaatgccccatcattctggcaatctttctgaaattcaaaaacgtcccagctattcatctcatcagatcatattttatttttatccgctgcagcttttccaacaatggctttgctccaatccacagaaaaataaatgtagaactggcatgaacaagatctaccggaatacctgaaatatagattgcaagcagtccttcccatgtaaaatcatacacactcataaagagagccgctggattcatgattcctccataaatgaacaccgtcacaaggaatccatatatacaaaggctgagccgtttggtcggaagcagtcctattcggtaaaggattcctgacaaaaatccgataaaacccatcgcaaacatctgccatggggtccatggtccctgcccaaataagaaattgctgactaccatcgtcatggcaccaactaagaatcctgcctcgccgccaaatgcgattgcactgatgatcacgattgctataatcggcttaaagctcggtatcataaaaaatgctgcccggccggcggttgccaatgctaccattgttgcaagaacaactagctctctcacctgaggttttcgtccctcaaataccataaaaaacggtaataacgagtatataatgattaccaggctaataaaataatactttcttggaccaaaaatcttttcaaatactgtgccaacggcggcaacatccataacataaaatccgacagcaattgtgaggggaatcgctacaagcaagagaaagagacttactctggtacgaacagaaagcctgcgtttttcctgctttttccagatttcggtatccatctcaaacatatcattatctaaaatgacatctcccgccctgccttctcctgacaaatctcctgctaattcttttaaagcagaagctttcctgctttttggtaaaaagatacgctttatctttgcagaaatcgtatcttcattcacgattggagaagcgtaaaattctttcaagaactcctgacttgatttccagtctgccattgttcacactccttttttaagacattccacaacgtcctccccggtaaccgccatgggaaaataccttctagccattcggtttgccgctgttgtataaaaattatttccggcaaagaattctcccggagttccacatgccacaatatttccatcaaaaaataaaccacatcggtctgcataagaagcgcagaactcaatatcatgagaaatcataaaaacagttacgccctgctctttgagtaatgccagtattccggcaaattcttttttaaaatagctgtcaagtcctttggtcggttcatccatcaacaaaagctttggccgcaataacaaaatcttagccagggcaagcctctgctgctctcccccgcttaagtcatacggatgacgatgcagtaattcttccaaatgtgttactttaatgattccttccaccgcatcctttttatccatggcaagctgatattcttcatcctttttctcttttacaccgcctaccatttcaaacagttctaattccacacttttctttacaaaaagagactgcgggttttgcggcagtactccaagaaaattgcggaacagttctttatcgctgtaacgacggatatccttaccttctaaaagtacttttccacgatatggctttctcaaacggctcaaaagtgaaagtgttgttgtcttcccggttccatttcctccaagcaatgcaaagaattctcctctttttaaggaaaagcttagtccctttacgacatccggcagttctttatcatagcggaaccacagatcatcacacgctaagatgatatcttcttttttctctttaaacttttctgtaatcttagaaaaagaagattttcctttttgggaatcactctcttttctatatgaagaagatgcatttgctggtgaaatgccttttttcttacaaactatatccagccactttcgcccgtcacgaacagtaatcgggcagggctgctctgactctactttggcataaacctgcatcggtaccggcatagctaaaaacatctcatgattgcgtttctttaattcttctccgatttccggcggtgtgccaacacataaaatctgcccttcatccatgaccactaccctgtcagcagaaggaaatacttcctctaaacgatgttccgtaagaataattgtcgttccaagatcacgattaatcttctttactgtttccaaaaaatcagaagctgcaatcggatcaagctgagaggtcggctcatcaagaatcagcatatccggatgcatggccatgatagatgccagattcaaaagctgtttctgtcctccggaaagttccgatacatttttataaaaccagtcctgaatcccaaaataacttgccatttccgctacccggatacggatatctgcgttactgtatccaaggctttccaaaccaaatgccagctcatgccacactttatctgtcacgatctgattatccggattctgtaatacatagccaatcctctgactctgctcccggttactcatctccccgattggtactccctgaaaaagaatctctccttttcgctttccatgtggcgttaggggagtctttaaatgtgtcagaagtgtactctttccacatccactctttccgcaaagaacaaggaattccccatcctccacatacaaagaaacatgatttagcgccctctttttttcttctggataagcaaaacacaaatcattgatttctaatatactatttttcttttctgacaaagcattcgctgtcaccctgcacctccaaacttgctttttatctcctgtatatacggctattcaacttcccacaaacggtacccagccggtgctgcactttctacctgtcctcttctcgccttccacatccttcggtctaaaatctccatcgctgctggcatgatactaaacaataaaaaagcggcaaagacaagcaggctgcctgctgtaaagggtactccctttacaacgatccgaggattataagaacaaaatgcatacccctttgaaaagccccacatcgctgctccgaatgtaatgatcataaaaataaggcacaaaaaatcccttttatcgaaatgatataaggaaaaggcggttctgcccttctctccatatccccggcacttcattgaatccgatgtttcaatcgcattctccaaagaccaggtaaccagaatcgaaaaaattgtaattccatgctttgctctcttaataaggctcccattctctacacttcgcccgacacacttttgcccatcagaaataacagatgcttctttgataaacttcggtacaaagcgaaggcacatggaaagtactaaagaaagtgccgggatgatccttccaaaaagataaataaacttatctgatgtcataacaactgtgtagcaggaaaaccatacaagagtacataccagcatcactgccatcacaagaccgtacacacaactttctaatgtaaacggatttccattatgaagatatcctataatcgttactccataatgattaaacatcggattgatcagggcaacaatgatcatcatcggtaatgagaagagtagattaaactttactgtctttttccatccttttaaaacaacggaatacgcaacagcgcatataaatgaaattgccagaatcacaggatgaacaacaaacatcgtcaccccgatcgtcccgcaaaaatacagcatatttaaaacaggatgatatgtcgaaaatgtatctttcatctaaatcaaatctccattacatcaaatttctattatattaaatctttattatatcaaatctctatttcatacatccttaatacatcgaattatctccaacatccttaccaagattacatgtataaacccagttgatcacatcgccgtcctgtaccgtatacttactgcatccgtagttaggaaaccagccatttacgttatacatccatccggaaagctgtccgcagtcgaattcatacagattattaattccttccacataagctgaattataagccggtgtaaaagaagactccatctggattcctgcatccttacatacacgctgtaatacgtcatgtacagactctccttccgtaaattctacctcggaagctgccagaatccatccatcagaaggaacaaattcttccttgccactttttaaatcactcatgttattaagaatcgtcgcacagctgattgaaatcgtacacgtatgggaagaacctgaaacttcttcatcgtttgcaacatcctgcttgccggaagaaccagaagaagaagctcctccatcagaaacatctccacttcctgaacctccttcttcgttataagaattctctcctgaattccccgattcatcatttccttccaattcactgttcgttgttccgttttccgccttattcgccgatgccgcacctttattctgctgttctgtaatacctccgataatataacaatctccatccagtgaagtaacactcatttttaaagatgtcgttccttcttttggcttcgtatctttctttgcctgtgttgtactttttgcggttttgtccgaagaatctttctcttctgtctttgtatcctgcttctttttattctcttccttcacctgtgctgttaccacaacatcgctcatccttgcaagctttccagactgctcttttacaagatatgcagaattggactgccacgcttccggaagctgtacctcaagatccggtacacagatcagccctttcccgtacattgtcatcttcaatgcatcattggcattgttcgcctgcttctttaaatcatcaagatctttctctgaaaaatcaatctttaaattctgatctgccggattctgaatctttgaacagtcatacgtccagatatatgtaattccatcatctgttgtccccttaaactgtacctttttattttctccggcaaccgttttaaactgctcctttgtaataaccccatcttccggaatggtattcacatctgcaagtgtctctgtcttatccatctttttatctgaagaactgtctccactcccggactttccacagcccgttgaaacaatcagcagcatactcataagtaatgccagaataacatgtaccagtcctctttttcttttcatagtaacaccttcctttttctttttctgtactctgcaaaagtctctactctgcttttccacctttcatcactttctttaataatcctgcaataccacgacgctttttatataaaacaaatcccaacgcttccactgccacaagtcccgcagcacctccggctacaggtaatgccaccgaacggattccatctgctttagaacgatcaccctcatcagacatccctgtatcttcctgtactgtatctgtctcgctttctgcactgttcgtttccggcacataattatctccactaaaactccagccacccgttgttgcttccgctgcagtattctttttctttgcggtagtagtttcactgcttcctgaagaaagcttcttcgtcgttcccgatgtggcaggaacagaagtacgggaacttcctgtacttgaagctgccggtatcgtgatttgccttgtctggcttgttgccgccgttgatgctattgtagtctttttatctgttgtttctggagctgttacgacaaccttacaggctgccttctttccgcttccatccgtcgcctttactgtaatcgtcacagtccctgctttctttcctgtcacctttccctttgcatttaccgttacaatctttttattagaagaagaccatttcactgacttcttcgtggcatttgacggagaaaccgtcgcttttaacgttttgctctttccttttgtaagataaatcgtactataatttaatcccacttttattacctttactttagaaactgccggttttgtttctgtcttttttgctgtcgttgaagaagaatttcctccactattactccccgtatcaatcgtcggactgactaccggcttcgttcctgccgaaatagccacatcactcatatcataaagaaatgtctctccatccaaaaatctacggtaagcaactgttgcatacaatccctgttccgttgccattccatcgataatgccaccggcaccgccaccattattcccggcatcagcagctacatgcataaatcccccttctggcatataatactggaataatcctgtcatcggccatttcccattcttaataaaacgggcatcttccccacaatctattcccacgccgcaaagagctgtgataatctgtgccacactttccgaagtttctgtattcatcgtgccaaaaccaccactggaaagctgattcttttctatccatgcaagtcccttgtcaattgccgccgtaacatcctcatatccatctttattataataagaagccagcgcctgcatcgccattcctgtcatatcggaatctccggttgttcccatcaatgtccagccaccatcctgacactgcattcctacaaccttcttaacaagtaactcctctgagttttgctgcactgcagaagggtcttctggaatctcatatgccggattactctttaatgcgatcaacgcccaaatcgtgccgttattcccctgtctgcttacattctcataatctgacagatacgctaacagattatgtcccatcacatttcttgcatcgacaccaatcgctgttaatgcaagaataagctttgaataatccgaatactttgctcttgtaatctgccagtccttactctcacagtatgcgatcacattactgtaaaaaagatttatataagattccggcacatacagcccactcctttttaaaccaataacattccatatgctactgtaatccggcttcgtatctttacttaagatatagcttcttaccttagataaaaccgtatcaatatccggacttaagacttccgcctctgcttccgtctgcactgccactcctgattcatcagactgtccctgtgccgcatcttcctctgcaccccaagcataaaaaccataacttcttccaagctgcaaattcttacggacaatctttctctctttttttgttaatgtctgctcttgtgtactttcctgtacatctgcctctgtacttgctgatgcatctgcatcttccctggtctgctgctcctcctcttccgaagactccgtctcctccctttctgatgtctcactttctgacgtctcactttctgacatagaaaaatcgcctgtactctctgcagcagaagctgccgcggccggttctgccccattatctgccgcatatgcatagtatggaactataaatgccacaagcagagcaaaaagtacaagcgatatacattttctttttaacctttgatacatcttgttcattctaccctctccttcactcattttacaaaatatccaagagaaattgagagttttccgtagaaaagaaaggcccatgcattatgtgcacaggccaaatacttttataaaactgttacattctccagcccagatatttgttttcattctaaaatcaaatggctggcaattcagaatgaaaataaggagagtcccctaagtgagcctgagaagcaagccatgtacatattataacatagacttttaaaaaaatatgccaaccagacgggtgtatttgcttcattttaggaaattaagcgggtgaaattgtcctacaattacttcaccttcattttctttacatttgagtaattaccgtaataagttgttcctcctgctttacgataagtacgaatcttgaagtaataagttttctttttctttagctttccggctttataagtcactgtcttatttttggtaattgtcttcactttcttatagccgctgtttttcttcatggactggtatacttcgtaaccagttgcattttttattttcttccatgtaagcttcgcctgattctttttcagcttcttaatggattttatagatgttttagatggggtgtatttctttttcagagcttcctgctgagctttctttttcgcggcttcttctgcctttttctttgcctcatcctgggttttcttttcagctttcagactgacaattttcttctcagcatcagttaatacttttaatgtatctgcagaaataagttccttttgttcactggttaacgcattataagactttcttgcctctgctatctgagattctttagataaatctactataccgatagcgttaattttctgttttaccttatttatttcttcaatttgagctatggtaagattattcttattcataatctgttccaattgctccaaagcatcatctactttccattgctttgaatccaacttttcaagtacttccattgcatagttatatctatcagaggcactatatatattaagccattttcctttttgttcattaaattgtgctactttttttgtcaatttttctttgtttgcaatatttaaagctcttacaccaccctctttatattgactgcctaagtctgctcctaatccatatactgtaaattgtactcggattacatccccatcttttggtatccacgctgccattcctacattaggaaactctccatttacagaatacatccatcctgcattcctatgataagaaaactcactcaaatctggatatgctacattcttggctgtatcatctggcggataaataatatcctctccatttacttgcgtatccatatttttaatcacatctggtatttttgtttttccattatctgcatttttaattcctgacaaataccaaccatttgaagtagttggtgcctcaatttcataattattattcttcaaaatatcttttaccaagtttgcacaagtatctccttcatgcagaacaacctgcgttggttcaatcaaatatccttgacctattgtgaatttttctatagataatgtaaccgttcctattttttcagaagcattcgatataactactgatttccaccaacatattgttatcatcattaataaaatcattttaaaaaacactgtatttttctttttcatggcacacctccctcttcacaaaacaggaagagaatctctcttcctgtcctgtattattattttattcttacttttttaacatttgattttttactcaaaacatttaaattagctgcttttttataagaatataccttaacaaaataagtttttccttttttcagaccagaaataactatttttgttttattggatttatttacctgctttgcaagtctgtattttgattttttaccttcttttatgtaaatcttatatcctgttgttcgtcttatttttttccaagatattttaatcttattgcgagatactccatctacttttaaagaagtcttcatcggactagttacagcagtaataacttctgattgtttataaattctctttccattttccatattaaaagaacacagatttaatttataaacggttccatccgccagtgatttacctttctttccttttaatttcttaaaagtatacgtattctgattctttttcaaatccgttactacaacatatttcttcttgctcttatcatatctgcggagttgatatccatctgcaacagaaattttattccattttaaagtaatagatgcagtagtctgctttttaatctgaatctgcagtttttgtacagttgtttcattagatggcttttgatcgttgtttgcctcttttaatttttgcaacgtaacttctgcattttgtaacactgttaatacctcttttgttacaaaagatttctgagaatctgttaatgactcataggtctttcttgcttctttgataagttcttctttagaaagatctacattaccaatagccttaaccttttcttcccatttctgtgccttatttttatcttctttcaatccagaaattttatctgatgcatcagatatttttttctttatctcgtctgaaatcttaagctgcaattcttcagacatattattatagaatgtttgtactacctctacattagactccttgtctaaagtaatgtctcctaatgcttcaaccatatctgttaacttcttaacctgattatctggactatcaatatttaatgcagctttcaaatcactatcaattaacctgccgtcattgctaaatttaattgttattgaatattctcctgcatttaatttttcaagatattctttctttaaagttaaagtttctttttctgaatcaacttcatagcttgtatcttctaaagtatcttctccattcataacagatgcaatagtatttccattcaatttaaggtttaatgtaaaatcagcatcgtttccaattattgttttaggttcaatactaaattgtgactttttaacaatttttacagtactaattgtttcatttcctgccacatcaataacttttacatgcattacggaagctttttcatctactggtattttaatatttttttcactcaatccgcatttattatctacatcaatattgtcatcttttgctgcatcataaactgttgtccattctccatcatctgactgatacagaatattacaaataccactcgttgcatcctttcccttaacataaatttctttattatcaggcttcaacaaaagagtagtgttgttttctaaattctcattatcatttcctaagtataattcaggtttaacattatctgcctttacaggtccatattcaacaagtgcatcggcagttcttttgtttacctcatctccctgtataaccgtattactaatcaaaagtaaaatatatactttatcctgatacttattacgatatactactgacttacttgcaatattatttcctttcatagccgcataagtatattggctataatcaacatctgatgaatctacaattttcaaggctccctgtgtattttctggagtaagctttttatctctaaccataaatcgaactctattataccaaccatgtgtcggattattcactgaattaggaaattctgttatagcataatgttttcctatttctggctcgcttattttaggactctcaaaataaacttttttcttttttgaattatctttctcacttactttttcgtacaaagaataataagtttgtccatttcccgtatattctttttcttcttttattttatttgctttttctaaaatattttttaaatcaggatctggctgttgtttataaatatcttctgcatcagatattaatttatcccatttactttcatctaaatcatatctttgccatacattagagccttggataacatctcccattgcaataacaatatcttttaatgttacaccatcgttcttttttacagcttctgctattgcttcttggtaatttttctcttgacatatatccaaaataccttttccattatatttcaggtaatccatatttactccagcaccaacaaatcctgtaataacacaacctgttgtattgatatttccccaagtgccatcttcagtttgtgcacccttcaaagcaatgattcccgcaatatattcttcatctagaatcaatccttttaattcagccagtgcccagcctcgcatatctacactctgagaattatacaaatctactttctttacataatccactaatgcatctggaatctcttctccacaaactttcaatgccattaatgcccattcattatttgcataaccaccaaaaagtccttctttatttttaaaagaaagtaaaccttctacaagattcatatgagaatcaccaaaatcatatggattatatccaagcattactaactgaagaatctgtcttgcataaacagtcgcctgagtgtaattttctttttcaggagaatgaacatatccttcatctacattcacatctgctgccatattcataaatacagaccaacaagaattatcccacatattttttaatttcaacctgctctgtcctaaatatggttttaaaatttcctgtgccttctttatctcttcttcattttcagaagaatttttaaacattggaacgcttccatctttattctgataaataaaataatatttctttgatttaattccatcttgtgcagtaatctttacttctgccaaaaaatcatctacattaatagtcactgactgtatttctttcttgttgatatttgccactgcctcagatgatatttcttttattataagttctgcattttctacatcagttggctgtaaaagatataccgtcttttctgatgaaaatcctgtttctttttttgtcttataatcttttaatattgcattttttaattcaatctgtttcaagtcacaatcggcacttgctcttacaatagaaatagtatatattttgattgctccattcgcagctgttactttaaccgtaattttatctaaactatctccaacagctattgccgcatacataccaacctgatcaccttttattgcctgcgtatccatgtattcaatctttgcttgtggatctacaggagcaattcctaagataatcttatccaaaggtaactttttaggtatcgcaatcgcccactgtccattatcattcttcactccataagaagtagattttacagttgcagaacctaactgggttgcctctacatacttaatatccgtatcagaaccttttttaacttccgcttctgttccattggaatatacaaggtataccgcacaagaatagccttttagattagtctttttcagtccttctggcatagtttcagaggcagtatcaagagcagacacattccattctgctgtatacatttcaattatattcaaaccttttttcagacttaatacaggactttgaaaggtatcagagtaagaagctgaactttcaaaacgttggaaattctctccattaattctcacatagttttctccattgctaagccattccattgcatttgctgaatatgattctgttttcttatgatttgtccaccgaaaaacagaacattgttttacctgatctttcacagtaacttctcgataagaagtatctgctgaagaacttccctgtattactgtatcattatcaaaatagtttatttcatcatttgtagtatctgcaatatatgtttctttaatattatcccaattacttaaaccactaataagaactttatatttttcgcttacagttcctttctttactgttatatagcaaacagatgttccattaatattataagatttcgtttcttctttttcaatattaaaatctgttccatttctttttactgaaaattcttttccttcaaaatccgttgcagaaatctgtgcatcggcatccgcctttccacttattatatatccatcaccgatacttctttcgtcaacttgtgcagtataaacagaatcatcttttgtattcttagtaactgtcgcttctttttgaccgatagttacattactaattgcgaatgttgcagtttctgctgcagaaagtttttttgaacaagcaagtgcaatcaatatggcaaatataaaaagtataattttactgtttaaataaacttttgattttcccatgtttttcctcctttagaaactctgctatttagatagcattctttggttttgtctacatgttactaatgggtcgcgactcccattgccaacggatagctcctttagcaatatattgatttaaaacaacttctatacgatttatctgcttatatgctttctctactgaacctttttttattgtggtctcaactactctcacattattatctgcatatgaaataactgtatattgttgttttacctcctttgatattacctgtttgaaaattacagatatttataattttcaaacgctgtgtcaggattttatgtgtgggactttcggatagaaatcattagataaaaacaaagaaactgagacttgcttttcgacttctgtaaagatttctctaaacatatcgaatgaatatactcagcactcccacccaaagtcctgttcattagaattctattttaaatatcctgacttaagcttcttctgctttttcacaccttcccggaagatccagtggtatttgtgagggcatctgctttcacagtaggggtaagcctgtgtggtttgtaccaactttcttaaaatagaatgtatttttttgtacatttattataacatagcttttctgaaaagtattccaaccagacggatgtcttttcgtcattttggaacctttttagatttttttcaaaaaacgcttgacattttttgcagaaaaaaatcccgtcagaccgaatgatctgacggggcatttttctttttttgcttattatagataacacaacttttgttttatcttcattattttacgcttatcggaacgtatatatacacttttttattgatgtatctttcaaaagtaaagttctgtaaagagaccatatcgcggtgttcttttatccagccataaaaaacacaccgggaaaacatacggatggtatctgcgagattatccacatcgctttcgcggtctgtttcaaatacggcaaatcgtccggcggctatctctattttcacagcatcttccggcacattcgtaaagttgtttacaaccggtccaaggatatattgaatattgatacattccgggtcatgataccacatggcaatcttatcatttccattcgcacttccggctacagagttcattttcttgaagtacggtgaatcctcatcgagccagaatgctacctgcgccggtatatctacttcccgtccacgatttgggatgatcgtccagccaaccattttgatatcatcaacgtccataaaggataccttcattttatctttatattctgagtaaaactgatttaagtcaacaacttctgtgtttgctctggcatatttggaaggactggtacaaaaggctttgcggaaggctttatcaaatccatttctcgacttaaaaccatatttttttgctaaactggccactttgacaccctgacgtaattctctggctgctttttgtattttcctctgactgatatatgcactaagtcccattccaaagtcatcctgaaaggctttgcgaaaatagtctctggaatagttaaaatgttccgccatcatctctggtgtgatatcttctgtaatatgctcatcaatgtaattgatccatgcaatattctgaaattccattcggtaatactttgccggaacaacgccgtattctttgcgaaatgcattagaaaaaacgctataacttgcaaattgatatttggcacatactttttccggattctttccttcttttaattcttctgcagcaaagtacagctttctctgttttatgtaatcggtgattctcgtttcataataaagctggaaaatattttttaaatgtttctcggaataatgaaacagctttgcaaggccttttgctgtcagattctccgtaatatgctcatcaatataactaatccactcgtcaactccataaatctttttctcctcttttttatttttcattacataatccgaatgcattctttttttaagaggaagatatactgagtacagtccgttttcaaaagaaataaaatacattttccgattgtcatagtgcatttcactttgctttatccagtcacataacgcatattttatcaacatttttataatatccggtgcctgtttatcccaatattgctcttttaacgtaaaaactgcataatccgatgccccaatatcaattctcttcttttcactttcctttccggcatcttttggaacttcctgcccaatcatataaaagaaatggtatgaatcatcatgccaccaaaactgcatatactctccggcacgctccctctccttccacttttcctttacatccttctcgatatattccattccgttttgaaaaatatcgccttctaaaggcagcatatctgcctctactgtctgtgccattcttctcacaactttatattctatcatagaactatcaggaatccgttcaaatggaaggacctgatttgtataatcctcttcaatatttaatccctgcacctgttccctgattgtatcaagagaattgtcaaagaaaatgtcagccagataaaggaattcctgcgtagagtatgccagtctgcttgccagatcttttaccgaaatgctgttatctgtctgaaggcacaaaagagtgtctctcatacgttcccataaagctgattcttcctccggaagtgaggaaaatgtttttgtctcattcactgtgttcattttctctatccttctattatttctatttctttttctttcattttctctgttattttatctcagtcgagaagactcccacctccttcaggtggtgagtgacagcaaatttgtctcagtgggagtccaatctccgactgagataaacgctccgcgaggatgcgcagtgattctgtaaagaatatgtcaacttatgctgaccagaatcacgcgccaagtctcgcggttgctcgacttgaatattattttttaatatccacatattttttagttatattgtaaatcaccactaacattctgtcaatttacaactcccactacggacaatctctcttcttcaaataaacttcgcaactctggaaaagtcttttttcttttctctgatacaatatttataaaacataacctgtgtattggtgtatgatatttatattcaagtcgagcagtcgcaccgactgcactcatagaaactgcggaaaggagagatcgtgaataaaaataattctttagaagtaataaaagattgtaccacatacataaaaaatcaccttcaagacacattaacagcagaagctctggcttcccgctatggttactctctttatcatttctgccacatttttaaaatctgctgtgatatgtcaccaggaaaatacatacgccttctccgtttggaaaaagcaaaaaaggatattttatctggaatgagtatcacacaggccggatttgataatggctttgaaaccagttccggtttttctaaagcatttcgcaaagaatatggtattagcgcacgagaatatttaaaacaaaataaagaaagtgaggttcttattatgctacacgttgaaattaaaacattgcagtcacagacagcacttgggtacgagattcccggcgaatatgacagtgattacagcaaatccggtgcttactggaatcacattaattttaaagaataccctgcctatccagaaggaatccatgattatggcgaagttggactatggacccatcccgaccatatcagcggtgaattacactatttctttggctttttaactgactctacagaaattccggaaggcttccacaaggtggatattcctgccggacgatacgcagtttttacaattaaatcacaggaaactcctgaaaaaatggcggatgctgtacgggatggctggcgttacgtctttaccgaatggctctgtacgcaaaaagagtataaaatatcacatcaggggatgtgttttgaatgctatcagggagaagaagcatatctttatctaccagtgattgatttgtagatttggtaatagacgaaaaaagaaaaaataatacatcccatctgctctgtagtcgctgtatttatgatgctcgtccgcatctgggatatattattttttcttttttctgactattctaaatccacagttggtgaaatagagttttccagaaggttatgactttccgggaaattaatttatcccttcttctctgtagtcgctgtgtttatgatgcttgtccgcatcttaaacacgctcccagccgcatctgggatggattgttttttcttttttctgactatctaaatccacagttgatgagaagggggctccagaaggttaaggctttccgggaaattaatttatcccttcttctctgtagttgctgtgtttatgatgcttgtccgcatcttaaacacgctcccaagccgcatctgggaggtattattttttctacacaaaaatcctgacttcatctggcgccaaagaacagaaaaccggaaacttgacatcacattttatgctatattaagtttctggtttttgtttctttagtccatcaaatcaggattcaccaattcgttcactttatctgcactcatctttataattccagctatctgctctatcgaaagaccagactcatacatcatgcaaattgcctctgcataaccattctgttttccttccgcatagccactttctcgtccttcctcctgtcccatcaagtatccaccttcaaatgctttttccttgattccctgacttaagttacacatctcttccacttcctctcttatatcatcttttattggaatatcgtattctttttctattatgtctaatttttcttctgcctctaaactggaggataacaatgctgataataaacgatgtaattcatagttttcttctttttctggtaagttttctgctattcctatcattataatattcagaagcttcaaatcacctttccaatcatgcgatcctataatattcttttttgtcaaataaatctgagtcagactattttccttcatgttcatacaaatccagatggaatagactctcttcatcttattatattctgattttacaaaatctcttcccttttgggatgatactattctacctatatagaaaatagctctgtttaatatatagtacttacccggttcttctttctgggcttctatattgacgataatctgggttaacccatctttcatacgaacataaaatataatatcaaagcgtatcattccttcattgagctcactattttctgtatttaaacctctaatctgctctggtatctctgtttcttttatggattcttcttttctttctttggtatttgtcattccggggtcaagtggaactgtactgatatacggttctccttctatatattttaccacatcttttggattcattccccgaaattcttctacagtattcactaatatgtacgccagtatgattttatgtcctaaaagcttcttggctttctcatcatactgcgcttctttatctgacgctttcactgattctttgatcgatgcgtccaataatacctccttgtttttgtaattagtttctcttgaattccataattttactgtttttattatatattaacctttgatattatgcaagaggaaaataggattttgtagatttagcagtagacgaaaaaagaaaaaatgccctatcccttctgctctgtagtcgctgtatttatgatgctcgtccgcatcttaaacacgctcccaagccgcatctgggatatattattttttcttttttctggctattctaaatctacagtttggtgaaaatggaattctccagatggttatggcttttcgggaaattaatttatcctttcttctctatagccactataatagaacttcttgctgaattgcaaggaaactatgataaataaaatcaaacttataaaaattctctttttcttagaaagctcaatgcaattctgcagaaagatactcacttttgggggaaccccttatttttcccacacaaaatcctgacttcatctggcgccaaagaacaattatattcaagtcgagccgccacaagacttggcgcgtgattctggtcagcgtaagctgacatattctttacagaatcactgcgcatcctcgcggagcgtttatctcagtcggagattggactcacactgagacaaatttgctgtcactcaccacctgaaagaggtgggagtcttctcgactgagataaaacataacaaatagtcaaaaatatgatatactaccaatataaatgttcatagggaggaggaacaacatgggggtttattttaatccaggaaatggaagttttacagaagataagaatagccaaatttatgttgataaaacggagctcttgaaatttttaaataaaagactgaaaacaaatggtaaatgtatcgctgtcagtcatgccagacgttttggtaagtcccatgctgccggaatgattgatgcttactacagtcttggcagtgattcctcaaaactgtttgaggataccaagattgcatctgaccctgattatgaaaaataccgcaataaatataatgtcattcatttagatatttcatctttttttgatgattacaaaatcaatctgatagaaaagattgtggaatatatttatgatgatatcacagacgaacttggagatactctggattataaaaagaagttaagttatgtattaatgaagatttatgaaaagacggaaattccttttgttattattattgatgaatgggattgtgttatccgaaacagtaacgaccaggctttagtgcataaatatttgcagttcttgcattcactttttaaatcagaagaatcgaaatcgtttttggctctggggtatatcacaggcattttaccaattaagaagataaaagatgagtctgctttaaataattttcaagaatatactatgctggattcctatccaatcacagaatactatggctttaccgaaaaagaagtgaaagatttatgcgaagatcaggctatggattttgagacaataaaggcatggtataacggatatttgatcgatggtatgcatatgtataatccgaattctgtatcgagggcattagaaagacataaagtagattcttattggcgaaacacttctgcctttggtacaatcaatacctttatttcaatgaattatgccggactaaaggaagatgtgcttgccatgttagctggcgaaaaagtgatggttgacactgaatgtttccagaacgattttacagaaatccactcaaaagacgatgctctgactgccttgatccatcttggttatcttggttacgataaagacatgttaagtgcctatattccaaattatgaagtgtctaaggcatttcagtcggctttaaaatcaggttcctggaaggagatcgccgcatctatttccagatgtgatgagctactcatcgccacgataaataaaaatgcagaaaaggtagctgaactcattgagcttgctcatgaaacctacacttctgtattaaaatataacgatgaaaattccctaagctgtgtacttaccatggcttactttacagcaccggcttattataatatcatccgggagatgccttccggaaagggatttgctgattttgtttttctcccaagagcaaatgctggcaatcgccctgcaatgatcgtggaactaaaacacaacaagacagcagatgcagcaatcactcaaatcaaagagaaaagataccagggtgctttgtctggatataaaggaaagattttattggttggaattaattacgatacagaaaaacatcgtacatgtgtaatcgaagaatactgatctgtggatttggtaatagacgaaaaaagaaaaaaataatccatcccatctgctctgtagtcgctgtatttaagatgctcatccgcatcttaaacacgctcccaagccgcatctgggatggattatttttttcttttttctggctattctaaatctacagtttggtgagaaaggggttctccagagggttggggattcttaggaaattaatttattccttcttctctgtagtcgctgtatttaagatgctcgtccgcatcttaaacacgctcccaagccgcatctgggatggattatttttttcttttttctggctattctaaatctacagtttggtgagaatggagttttccagaaggttgttgggtgatgttagacagccgctgtaatagaacttcttgctgaattgcaaggaaactatagtaatgaaaagagaatttttataagtattgcattttgtgactttgcgctgcggaattttgactctgaaaacttcggactcgtttttccgaagtttttgttttttgaggcaaaatgaagcgtttagcgcaaccaagcaaaatcaaacttataaaaattctcttttcattagaaacatcaatgcaattcagcggtagaataaaatatgccgcgactatcttcacattttattccatatcaagtttctggttttcgtttctttagtccatctgatcaggatttaaattaagtttatgattccttctataataaacactgctgcacaggctccaatcgctaccacgatcaggctttttctctggtaagcgagtataacagcgactacgagtcctgcaatagcagaaatcaggcttcctgttgctgtaaagattgccgggatcgtcatggctgctaatacggtatatggaatataatataaaaaggaattaaaaaatttgttttttattttgtgttttacaagtacgagtggaatagctctgattaaataggttacgattgccattacgaaaagatagggtaaaaatattttaaagctcatcttcgtttacctccactgggaataatattgccgcaataagtgatgcggctacggtacagatgatgattgcgaaaccaccggagagattcgcaaatactggagtgtatttcagtactgtactgatcgcgattgcgatacataccgcaatgaagacatggctgtcttctcttgtctttggtacgacaacggcgataaacattccataaagagcgacacctaaagcgtttgtgataatggctggtaaaatatttcccatcaaagcgccgcctaaggttcctatcgtccatccgataatcggaactatcgtaagtcccgcaaagtaatttcgtttaatttttcctggattctggattgctacagcaaagatttcatcggtaatagcaaagccgagtatccatctccagattcctgaaaaatcatcatccactttctgggaaagtgaaattgccatcagcatatatcttaagttgatgatgaactgggaaagtgccgtctcaactaatgttccaagttctgcaataatcgtaagtcctgcaaactgccctgcagatgttaagtttgtgaatgaaataagtactgcctcgctgacagttaagtctttatctactgcgagaatcccaaaggcaaaggaaacggcagcataaccgagtccgatggggattccatctctgattccctgtttaaagttcatgtttcccccaacaatgacagagactgccagctttattcacttgcagtctctgttcctactgtatctttttattgttcttttattgttctatgatcatcagttactttttacgctgctacattgttaatgacttttatgcttctacatcatcaattgcttttccgatatcatgacgcatatatttattttcaaaagttacccattctgttgctgcgtaggcgttctttcttgcctcttttaggtttgctcctttggcagttacaccaagtacacgtccgccatttgtaacgattcctttatctgtgctctttgttccggcatggaagcaataatagccatcgtgtttcttaaattcttcaaggccattaatcacataacctttttcgtaagaaactggataaccgtcagaagcaaggacaacgcaaacggctgcattatcttcaaactgcagattgatttcatctaaacgtccgtcgatacaagcttccataacatcaataatgtcgttcttcatacgaggaagtactacctgtgcttctggatctccgaaacgggcattgtattcgagaactttcggtccatcttccgtcagcatcagaccggtaaagaggataccgacaaacggtcttccttctgctgccatagcatccatagtaggctgataaacgtatttttcacagaattcttctacttcttttgtgtagaatggacttggggagaatgttcccattccaccggtatttaagccctggtccccatctttggcacgtttgtgatcctgcgcacttgtcatacatttgattgtctttccatcacagaatgcaagaacagaaacttcacgaccagtcataaattcttcgattaccatacgatttccggcatctccgaacttcttatcttccatgatcgtctttacgccttctttcgcttcttctaaagtattgcagattaatacaccttttccaagtgccagtccgtctgcttttaatacgattgggaactttgcagtttcaaggtaagcaagtgcttcctcatcagaatcaaagttctcatatccagctgttggaatgttatatttcttcattaaatctttggaaaatgctttggaaccttcaatgatcgctgcattctttcttggaccgaatacacgaagaccttctgcctcaaatgcatctacaacaccacctaccagtgggtcgtccataccaataatggtaaggtcaatttctttttcttttgcaaaagcaaccagtttatcaaattccattgcaccgatgttcacgcactctgcatattcttcgattcctgcatttcccggtgcacagtaaattttatctgcctttgcactttgagaaactgcccatgcgatcgcgtgttctcttccgccactgcctacgattaatactttcatcggaattcctccattttataactaatatgctcccggaatcttcccgcaaagcataaagccagtgcaggaataattccagaaatgcataactatttatcaattgtaacaactctgccgtctacatgaacctttccattcgcaatcagattgattgtttccggtaaaattttccattctgcctgttccataatacggcgctgtaaaacttccggtgtatctccctgttcaaccataaccggcttctgcataatgatcggaccggtatcggttccttcatcgacaaaatgaaccgtcgctccggaaacttttacgcctctttccagtgctttttcgtgaacatgaaggccataacagccttttccacaaaaagatggaatcaaagatgggtgaatgttaataatccggttctcatattcctggataacacatggaggtacaacaacaaggtatcctgcaagaacaacaagatcaatttctctttcttttaaagcttctaaaagcttctgattaaattcttctcttgtctcaaaactctttggagaaagaagtaaaccttctgttccataattctttgcacgttctaatgcgtaagcaccttcattgttactgattacgacacgaatttctgtattggtaatctttccgctgtctatcgcatcaagaatcgcctgcagattcgtaccgccgccggatactaaaactgcaacttttagcataatgttactcccttttctcctgcttcgatggaaccaacgacatatgcttcctcaccaacagcttttaatgcttcgattgctttttctgcatcttttggatcaagggcgagcatcataccgattcccatgttgtatgtattgtacatcatctcttcggcaatatctccttcttttgcaagaagacggaagatagctggtacttcgtaactgtctttctttacgacagcgcgagcaccgtctgggagcattcttggaatattctcatagaatccgccaccagtgatatggctgcagcctttgatcgtaatgccggcttcttttactgcctttaatgcttttacatcatctcttcggcaatatctccttcttttgcaagaagacggaagatagctggtacttcgtaactgtctttctttacgacagcgcgagcaccgtctgggagcattcttggaatattctcatagaatccgccaccagtgatatggctgcagcctttgatcgtaatgccggcttcttttactgcctttaatgcttttacataaatctttgtaggagtaaggagtgcttctcctaatgtctttccgagttcttctctgtattcgtttaatgcttctttttccatagggaatactttacgaacaagagaatatccgttactgtgaattccggaggaggcaattcctatgaggacgtcccctgccttaatgtcttttcctgtaatcaggtctttttcatcaacgattccaactgcgaagccagccagatcgtactcatcttccggataaaatcctggcatttctgctgtctctccaccgatgagagcagcctcagactgcttacatccatctgcaacgccgcttacgatagaagcaatcttttctgggaagttcttgccacatgcaatataatcgaggaagaataatggctctccacctgcacatgcaatatcattcacacacatggcaacacagtcgatacctacggtatcatgcttatccataaggaacgcaacttttaactttgttccaacaccatctgtacctgaaaccagtgtagggttttccattgtcataaacttctttaatgaaaatgcacctgaaaatccaccaaggtttgtaagtacctcaggtctcattgttccctgtacatatttcttcattaattctactgatttgtatccagcttcaatatcaactccggctttcttatagtccatgacagactcctttctcttatcatgtactctcggagtctttcttgcacttgcttttgtgactaagcacaaaaagattccgagaatacattatcttgttataaatacttaattatagtttccccttttacaaatttacaaaccttcttatcacctctgagctatgtcattacatttgttttaagtacgcttcgtacccaatctcatcaagcttgtctgccttggctactacctgattctttaacttttcagagtaagcttttaatctttctaacagtgcagggtcggatgttgcaagcatctttgctgcaagaattccggcgttggctgcaccgttgatcgctactgtcgctacaggaatacctgttggcatctgcacgatagagtacagggaatctactcctccaagatctgatgtcttcattggaataccgataaccggcattgggaaaatagctgcgcacattcccggaagatgtgctgccttaccggctcctgcgataatcacttta

SEQ ID NO: 408 - DNA, 55904 bp, Eubacterium hallii
  modified_base (31421)..(31517): a, c, t, g, unknown or other
  misc_feature (31421)..(31517): n is a, c, g, or t
cgcgcggatgattgctccttccagaccactttcaataagccattccatatcacccatcgtattttttgtgcccggaagaaggatcagatctggatcaccaagttcctttttatcggtaacataacgaagagatactccatcaattaattcaaaaacactgaaatcagtaaagttagatatgtgaggaagacgaataaccgctacatcaattccctctgtgatcgttttctgattcaggcggtcagaaagactgtcctcatcgtccacatcgattttttccattggaactacaccgagtaccggtttaccggttaattcttctaacatcgccagtcccggttttaagatatccacatcacccctgaatttattgatgacaattccacaaaaacgttcctgttcgtccacagggagaagtttgatcgttccataagcagaagcaaatactccccctctgtcaatatctgccactaagatgactggcgcatccgccatttttgccattcccatatttacgatatcattttccgcaagattgatttctgcaggagaaccagcaccttcaattacaataatgtcattttcttcagaaagatggcgaaatgccttcatgacttccggtgcaagattatctttcattttatagtaatcctgtgcacttaaattatcataaacttctccgtttacaataacctgagaacccatattgctcgttggctttaacaaaatcggattcatccagtgtgtcggctcaatcatagcagcttctgcctgcattgcctgtgcacgtccaatctccaacccttcttttgtaatataggaattcagtgccatattctgtgatttaaaaggagctactttatatccatcctgtttaaatactctgcaaagtcccgctgtaacaaaggttttgcctgaatttgacatcgttccctgtaccataattgcttttgccattattcttctcctttcaaaatcatccgtaatgcttttataagttttttattctcttcatgtgcctttactgctacccgccagtaatctctgccaagatttacatagttactgcaatttcggatcataattccatgaccttctaattgtttatctaaatctgtaatttccggtgtccggaaaaacagataatttgctgctccatcatacaaaacaactggtaatttaaaaaattctttcttcatataagccagctcttctgctacggtatcaatgaccttttctttataaatattatcagcaagagccgccacccctgcacactgtgcgatgtgacttacagaccatgcctgtccggcacgatttactctttcaattaccttctcgcttcctgcaaggatatatccaagacgaactcccggaatcgcatatagctttgtaaatgattttaaaataataagatgttcgtatttttctataaaaggctttactgtatattctttttcatttttacagatttccaggaaacattcatcgaccatcacaaatgtctttgttttttctgcccgatcaagaattcggagaatccgttctctttctgtaagaatacctgtcggattattcggattacagataacaacaaagtctgtatcttctgtaatcttctctaaaatatcttctttgataataaaatcctctgtcatccgataatattctatctgtgcgcctgccgctgataatgcttcctcatattctacaaatgcaggtgccggaagcagtactttttttggctgtaaaccaaatgccagacggtacaaaaggtctgccccaccattaccacaggcgatttttgtttcagaaactgcatcctctttgctgatggcttcttttaaacggctgcaatccggatcaggataatttatcgtttggtcaatcgccttcaccattgcctgtcgtatgtgctccggcagtccaagcggactgatattggcagaaaaatccagaatatcttcctcccggattcccatttccttcgcctttttgtaaatgtttcccccatgtgaaatcttcttcataattttagcctcaattttctaaatcattagttatcaatcgcaaatcacgccaagcatgtcaatcctactaatcctatagtatattcttcgcatatgatctacacagtactatccttatcttgtgaaatagcattacataaatttaaatagctgtgaataaagtaaaaaagtaatcaaagtacatactgccattgataaaaatgcactgacatacaacaattgatttgttctttttatatcttcgtattctaccgggcggatagcatcaccgatcgtcggtttcaccactgcttttccaaagtaattatgtgttcctccaagctgaatctgtaatgctcctgctgccactgcttctgtctgtgcactgttcggacttaaatgtgcaaaacgatccctcttaaaaattcttactgctcctttaaaatcaaagcgcagaaaaaatgctgcgagcatcatcattaccgctgcaaatcttgccggtacaaaattacagatatcatccattttcgcagaaaaaaaaccgatatgtatcagttcgtcatttctataggcaaccatagaatcaagcgtatttactgccttataggcaaagccgagcggcgcgcctccaagcgcgataaacagcatcggagcaattaccccatctgccgtattttcggcgatcgtctccacatccgcttttgccacttcactctcgtcaagattctccgtatcacgccctaccagataggatacttcctttcttgcaccgagcaggtccccttcttttaactttttatacactttcatagattctttcttcagacttttcgtcgcaagaatctgataaatgaaaaatgtttccaaacaaaaacgaagcagcggatgaatcattccagccacatacaaaataccgtaaataacagcatatgttcctgctacaatacacagcatcagaaaaaatccggctgctttttccattcccgcttttctttctattcctttttctttgacttcctcataactacagccataaatcagatgctgcattcctttttttaatttatcgataaaccacccgatgatctgtaccggatgaaccaatccatgaggatctccaaaaattaaatccagtacaaatccaagcagcatcgcacaaaccagtttcattccttgtctctccctttatgcatattcaagaatgcctcagcatctttttgtacttgcttcttctgccatgtctacgaaacgtttggcaacctctttgcaattatgaaaataaaaatgtgggtatcctgccataattttatcctttacataaagaccattccagcatttaccggaatacttcgtaatctcacaggcatcgccccttttatccgcttttgaataatgaaattcatgaacgcgaatctttgtatcttttttaaaaaatgcagtgtcataaagtgctttcatcgtcacataaccaaactgcatggacagacgttttgtcatacgcacatctgtattgattagaccgagcatttcctccaagctgtcatctgtctctaccagatgatcgcagacatacatgaatccaccgcactctgcaataatcggcttgccagactgcgccgcctcacagattgattgcttcatggaaatattatctgccagctcttttcggtaagtttccggatatcctccgccaagatagattccatctgtatcttccggaagatgcgtgtcatttacaggactgaaataacaaatttcagcccctaactgctctaaaatttccagattttctttataataaaaacaaaaagctttatccttcgctacagcgattctcgcccgtttcctctccggaacctccggtcttttcactttaggaagttcttctgctctttgtccgattttcaaaagtaaatcaatatctatacattcttctgctgtttcaccaagaagatttaaaatctcatcaaggttatcaatctctgctgcagtcatcaaacctaaatgtctgcttccaatatagattccttctttttgaggaaaatatcccacaacagaaataccaagcttttcttcaatttccggcttcatcaactgatacatccctttgctgcatcgatttaagataacaccggtaaccggattctcctgatattctatcattccttttatcagcggaatcatcgtatgtgacattccctttacattaaatattaatatcgtcggtgttcctgtctcttttgaaacagtccacgtactcttttcacaactgatcccgaccccatcataatatcccatgacaccttctgtcacagagaaatctacgtcctgactatcctttcctacaagatatcgcaaatcttgtcccgttgagaaaaaaggatcaagattgcgacaatctcttccggtaatatgactatgtaacataggatctatgtaatccggtccacatttataagattgaatatgaagtcctctgttcacaagagccttcaaaataccacaggtaatgcttgttttaccacatccactgtttgcaccggcaagcaatacccgcggcatccgctttacactttccatatattcatacacctccatattacctgggacgatcaataagaatcatctttattccagtttgccgacaggcttctacttttatatccactccgcctgtcttgccactatcttttgaaacaagaacttccgctttcgtctctttaataagcttcacattatcttcaacagtaaatggtggcattttcccaaaaacatggtctttttggtatccggcttccgcacatccttccaaagaagaaatattatcaagtacacgaataaaaagacgatcggcaccaccttttactccagccatatatgctgccgctgtatttactcccgttgtaagaaaaatattgccttctaattcatttaaaagagaaattgcttcctgcacatcttttacatgaacaattccttcataattatactgaagatttcttctctcgtatcgttcatacaaaataccggctgtctgtgctgccttctttactgtctccgaaacaattctggcaaacggatgcgaggcatcaataatctttctacagggattttcctcaaaaagtgtaagaaaaccatcatagtcaagccttcctacatgaatatcaattccgtattccagaagcatctcttttccaagctctgttgccacgctggcaagaatccgctcctttggattcgccctaagcagcttctcgatcacctgtcttgattctgttgtcccggcaatgaccaaaacatcatacttcataaataaatcctttcgctttccgccaatttctcaaatacaaactacagtgagctacatctcactcttaataatcattgttgtaaaatatccgtatgcacgatcaggaatcagtggaccgacatactcgccttccattccaacattactgatgattatcgcattattctccatgcctctctccaccagcagatcataaacttcttttacatgacttccgaccttcatgataaccagattgtcaaatacgccaagtgttttctccacctgatcgatacccttcaatgacggaatcacaccaaagccttcatttccttccacgatagaaatgccagccttgctcgcacccgcacaaaaagaaggaataccggaaaccatctccacatcgtatccagcttttaaaaggcgcttatgcacatacgcataggtactgtaaattccaatatcgccaagcgcaagcatcgcaatagactttccttcatcaagaagttccataatttcttctgctgctgcctgacggcaggcttcacgctttgccttatcttttaccatcgtaaaaacgatttcccgaatctttccttcaggaatatctaccgcaccttttgcgatatttaaagcgacactatcctcgccttcttttttcaccggcactgccacgatgtcacattcttcaattaatctttttgctttcagagttaaaagctccggatcaccaggaccaactccgataccatataatttgcctttcataatcttcctttccagacggattttgagaaagaaaaagcaatcgtttgagttattatgtttggacccaattttcaaatgaatataaaagaagttatttttgttccgttgtgctaaacgtttcattttgcctgatagtacagactcgctcgaaaacaagctcgcgagtctacagtcaaaattccacagcacaaagtcacaaaatatcttcttttatattcatttgaaaattttactacaggtaatccaactcaaactcctttctttttcttcgtcaaaaatcctgtctatgtaaatctattggtgggtatagttaatcattgtctactcttcccttctggtgctagagcatgtttgggaagattttgatacagaaaagaagattgaactttatgactttgtgctacggaattttgaccataggaacttcgagctcgttctcgagaagttcctgctttactgggcaaaatgaagtgtttagcacaacggaataaagtcaacttcttttcgttatcaaaatcgtcttacaaagactccgccttcttcaggtgttttacaaacatttctgctattgcgtcaatttcccctaagcctttcatgatgacttctgtttcaaatccatctgcttttaagatagagtcccaggagtcggcttcggctccagcaaggtcatttcgggcatgatcgcctgctacgatcataaggggcataacatatacttttttaatctctcttatttttaatcggcggataacgtaatcaagactagggaatccttctacggttccgacatatgtgctttcatgtccaaggtctctgagcatgttttcaaactggctgtatgcgctgttggcaaagtgttctgttccatgtcccatgaatacaaaagcttcgtctttcgctaatggcttttctaattcctgcataacaatctcgcaggcttctttgtaatcttcctcttcggtaagaaggggagttccaaccttaattgttggaatctgatctttatatgccagaagcatattcatcattttgtcatattccagtccatttataatatgtgttggctgacagattacttcttcgtaaccttctgctaccagtcgtttcattacttcatccggattatggataatgacattttttgttcttgcccatttacggataatcattccggaagtaaatgctcgataaaagtcatagtctggaaatgcttttttgcaggtttcttcaatgttaacgattgccggaagtgcttcttcaaagcttgttccaaagcttactactaataatgcttttttccccatttttcttttctccttatcttaaatgtgtgctgtaaatatcattaccggattattggtatccataatatgataactgccgattttacgtccccgtcctactgttgcctgaatcacatcaaagtctgcgtcatattttcctaagagttcattcgcttctgcgattgtttcaatcgttaccgcagaaataactacttttatcttcttaggaaatgctgcaattgtctctaatatctgagataattcttttccacttccaccgataaatactttatccggttccggtagagtacatgctgtcttagctgcatccccttcataaataaacaggttatctgctgaaaatttttctttatttttataaatcaactttaccgcagtttcattccgttccacactgtgaaccgttccaaatggtacctgtcttgcacattcgatcgatactgatccagttccggctccgatatcccagacaatatcatctggatgtaacttcattttatgaagaataagtacacgaatttcttctttagtcattggcgttttatcccgctcaaaatcttcatctgataaaaagcatggacgcacaatctgatgtggctctggatttttaatcatggctacgcaaagagatggaaattctttttgtaccatctcttcaggtgtgcctgactcaagtaattcgtcttcataagaaagatttgcgccggcacagacggtaacatgatccatatgatagtcgagcatgatctgtgagagccatgccggtccctgttccttactgcaaaggaaaaatactttaggattctccgctactgcaagggcaatagaacctgctgtttttgctcttccatgtacactgataatcaatgcctcttccatcgtttctccaaatgctgctccaagcatttggagcgaaccaacacccggaataagatcctcttcccagccttcgctgatcggatcattgcaaatggtacgataaagactgtacataagcggatcaccgctaactgccatcacaacatcctgtcctttggaaagtatttctccaatctgctctaatgtatctttaatctttcccatcgcgagaaagactggcttactattttcagaatctgcctcactattgacatcctgacacagctcttttaaaaccggtaagattctttttgccgcaattacggtatgggcttttttcatttttttaattactgccggtaaaatgtaatcggcttcgcccggtccgattccggctactgttaatctgctcattctgccctccgcagttattttgatttttctgccctttatagttcaactatcgtttataattcaagttgctttgcatcactattttttacaggctgagagtacttcttctacatttttactagctgccagaacttcattttgtccatccaggaaaataattcccactctagccatcttatgagcggtcttctcacaatactcagacgctttttgtgccatatccggccagatatccataagtccctcttcttccacaatcttcattgccgccttcgttgtaaggcaggaatacagcttttgtatgactaaaagaggggcgccatgaagagctgcatgtgtacagattgtttcgatacggccatctgccacatgactgtgtgtattcattgtaccggatgctacttttacaagctttccgacaaacccaccaatcaaaatatcagtaaatcctctctcgaccgcttcttctatcataaagccgatataattgcttacctgtaaaatgcactgaaattcgccgtactgctcttttaacaccgtctctccggttcctccaagcacaaaaagaatcgatttatgtccctgtttcgcatacatatcaagctctgcgatcagagaatctttcattgcttcttcgctcatcggccggacgatccccgtcgttccaagaatcgaaagaccatttacaatgccaagccgcgggttaaatgtctttttggcaagttcttctccaccaggaatacttacggttatatttgcctttttattgccgataattttgcggattgctttctctgccatctgacgtggaaccgggttgattgccggctgtccgggaggaatttttaatccttcctgtgtaatggttccgactccgtcaccaccaaaaaaggaaatatctccctcttcctcaaaaagctccacctttgtaataatctcgcttccgtttgttacatccggatcgtctccggcatcttttactacaccacagactccaaattcttttgggataatatccagataaagcgtttttccaatcggcgtttctactttcaccacagaaggacatttaccggttgtctgccagataaccgaagcctccgcgccacctgtcatacaagagccggtggaaactccttcccttaattctttcataaatttaattccaacacagttttataactgatataacattgcattacagatggttgccgcaatattgcttccgccctttcgtcccttcggaacgataaacggtactccggcctccatgatcagttctttggattctactacatttacaaaaccaaccggggcaccaataatcagtgcagggtttaatttgccttctttaatgagttcgtataagcggatcaatgctgtcggtgcatttccaatagcaaaaataacgttttctttttctgcaagagcggctcctctttccatgcagattgcagctcttgtacatccacgctcttttgcctcttttgctacatcttcatcggacataaagcagtgtgcttctccgccaaaagatgccagcttctttttattgattcctgaccatgccattcttgtatcggttacgatatgtgctccattttttaaagcttctacaccgatattcgcagcattttcagaaaaacataaattatctgcataatcaaaatctgccgaagtgtggatacatctttttacaatggaaaactccggttccggccaggttctcccatttaattcacttgtgatgatctccatgcttcttttttcgatttcagcaggttttacgatttgaatcttatctaacataatgtcctcctgcggtttaattcaattcttcataagtaccaaagtttgtctgttcaaagctaggtaattcccagtacgctttaaatgcataatctgcgatcgtaaatcccataaccgctccggttccctctccaagacacatattggcaagtatatatggttctttgccaatcgcatcaaggattaaatttccggctggctcattcgaacagtgggatgggaaaagatatggtgcacattccggtaccaaacgaatagcgatcagagctgctacggaagaaataaatccatcgataaataccggcacttgtaatgccgctccaccgatataacagccaaccataccagcaatgtcaagaccacctactttagaaagaacatcaatcggatcattcgcatccacctgatttaaagcaatactctgcttgatcacttctattttatgttctaaatctttattcgtaagaccggcaccttttccggttactttttctacactctgatctaataaaacagaacagacggcactacttgttgttgtattaccgattcccatttctccggtagcaaacacattatatcctttttcttttaactcagctactgtatcaatgccaacttcgattgctttaattgcttcctctcttgacattgccggtccttttgccatgttgtcggttccgtatttaatctttcttgaaaggactcccggattatcacaatcagttgcaattccgatatcaacaggatacacatctgctccactcatggaagacataatacagattgtcgcattatgctttgtcatattttctgttactgtttttgttacttcctgtcctgtctgggtaactccctctgctacaacaccattatcagccgccataacaataactgctttttttcctaaatgcggttttttatcccggtaaattccggcaaactgtgttaccatttcttcgagccttcccagactgtgaagaggctttccaagtgtattccatcttgctcgtgtatattccatcgcctcttcatctaaaggttgaatctttttaatcgcttcctccagagtcataatcatctccccttctgctgatatctctctgcatttatattttaaaaaacaaacaaggataacggtaccattcctgtatactttgtaagcgttatcactacgagaagtaataatacttctgcaagttcactcccggctcccataacatctccggtaattccaccaatctttcctgtgatatacacccggaaaagataagcaaatccaaaaaggatagcaaagatgagaattccccagtatgaaaatgccagtaccattgctatcagtcctaaaatcaccgttccgattacggttcccagactaacggttcctacataaataccgatccctttttcacgtgggtaaatggctttatatacgattgctccctgtaccatcttaccggcaatcggcataagaagaatcatcaaccagcggatatcactgtaatagatgccggcaaatttcagtgccagatcaaaacacatcgccaccgcaccgtttgttccgatacggctgtccttcataatttcaagcatcctctctctcgttctcgccgaatagattccatcggcagtatccgaaagaccatctaaatgaaatgcacctgtcaggcaaagatttgccagcattgcaaaaagtattccaaatacttccggcaaaataaggctgacgagcaaaaatactgccatatcacaaagtccaagaatcagaccaataaccggataatatagaaatcctttatgcatatcttcatcttttacttctccaagatctacattaacagggattcttgtcataaaaccaagagttaacaaaaaacgctttatttgtgtcttcatttattttcgaccttcttccgctacatcctgaatcattgtttccaccatacctctggcagtgtatacaacagcggttttctcgatggagagaccattctcttccgctgtctttgtcgtaactggcccaatactgatatatttgccttttacatcatcaagattgtctaccatggatacaaaggcacgaacagcacttgagcttgcaaatgtcacgtaatcaaccattttgatcagacgattcagctcctctgcctttctctcatcatttactgtatggtaaagggaaatacaggtatgaggaattcctgcttcctttaatgcatccggaagtactctgtttgcttcctctgcacgaaggagaagaacacgttcatctcttccgatatgaggaaccatcgcctctgccatatcttttgaagaatatgctgtcggaataaaatcacagaaaattccatgatcttccaatgcctttttcgttccgtctccaataacagcaaagcgaatatgcgctaaatctctaatatcttttcggatttcctgcatttcttcaaagaaacattccacaccattggcactggtaaatacaatccatttatacttatctatttctttcaatgcaagatctaactcaggaagtctcatcctttcggtacgaatcagactaaaagaaattgcttctgctccttcttctttcaaaatcggagaaagtcggtctaccatagaagtggttcctgttacaaggacgctcttacctgataatggtttatgcccataccagtcaagtacctgacgtaaacttacgacatcaccgacaaccgtaatcgcaggagtcttaattccctcgcgctctacaacctctacaatatccgcaagtgttcctgtcgcaacacgctgtcttgccgttgttccttcctgaagtacaccaaccggtgttgcaggatcttttccattctccataagagaagctacgatatttggaagatttttaagtcccataaggaaaatcaacgtaccttcctctttggcaagtgtttcataattcagtacactcacaccatttttatgattcccttcatgtcctgtaatcacatggaaagaagaagcaaaatcacgatgtgttaccggtataccgcagtatgcaggaacagaataggaagaagaaattcccggtacgatttcaaaatcaactccagcctctctaagttcctgaccttcctcaccgcctcgtccaaagatatatgggtcaccaccctttaagcggacaacattcttgccttctaaggcaagctttactaaaagttcatttgtttcatactgttttaaatggtgattggaagaacgctttccggcataaataagttctgcatcatctctcacttcatttaaaagagaactggatgcaagattatcataaacaacaacatctgcctctcttaaaagcttaagtccttttcttgtcatcagatcttcatcaccaggacctgcaccaaccagatataccatgcctttgtttacttcgtgggcaacgctgatacccaattctgttgctatttctactttgctttttcttgctgcagtttcttctacggaaactgttactgctgctgtcgccccagctattggcttgctgtctgcctctttttccgctaaagcatctttaatatttaccgtcctatatgtttttctactatgaattccatctttcacatacatggcacgcatggaaaattctccattttcctcacgacaaagtgcagcagccggtgcgttacagcttccgccgattgtctttaagaaagctctttctgccattaaaagacactctgctttttcactatgaattgccgcaagtatttcttccatctcggcatcttctgtacgactctctactgcaagaattccctgacctgctgccggaagaaatacatccgggtcaagatactggtaatgcaatccttcttctttttcatatccaagtctttcgataccagctgccgcaagaataattccgtcatactgcccgtcacgaagcttatttaaacgtgtctgtacattcccacgaagaagcttgatcgttacatatggattgatttctttaattaataattctcttcgtaaagaacttgttccaacaatacttcccggttctaattcttctaaagttttaccagttgtcgttacaaacgtatctctgacatccgctctgtcaagaacagcgccgattcctaaaccttccgggaaatccatcggcatatccttcgcactgtgaaccgcaatatcgatttctccggaaagaagttctgcttcaagttccgcagtaaatactcctttaccgccaaaggatgtaagagacttatcaagaatctggtctccctttgtatcaatctttacaatctccacttcaagttcaggaaatgcctgttttattttatcttttacaatatcggtctgtatcagagccagtttgctctttcttgttccgattttgatgatatttttcatcttgttcctccacctattctacgttcgcgaatccgtatttatcttcatatcctcttggtgtgatcatctttccatcgcgtacatatgtattggaatttccgacaataacaatactaaacatatcgatcggtgcatcttttaccgcatctaatgttgtaatataagaagattcttcttctcttcctgcatggcggacaatgccgacaggagtctttccatcacgatatttcataagaatctcagctgccttttccacatagtctgctctctttttactctttggattatagagacatacaataaaatcgccctgtcctgcacaatccactctcttcataataagagaatatggtgtcatcagatcactcaaactgatgattgtaaaatcatgcatcagtggcgcaccaagaaccgatgctgccgcacttgccgctgtcacacccggaactgtttctatttctacatctgctttcttttcatttgcaatttctaaaagaattcctgccattccataaattccactgtctccggaacttaccattgctaccgttttcccttctgcagcaagatcaactgccatacggcagcgatccatctcctttgtcatcggggttgctacatattccttatctgggaaaaactttttcagcatctctacatatgtagtatatcctgtaatcacatctgcatttttaattacatcaattgcttttgctgtcatatgttcgtatccaccaggaccaaacccaactgcatataacttacccatcatttcctcctgctaaaaccagtattttcgtgtactgatctgctaatatacttgtctgtttttaatgatttaagcaatggaaaaaggtttctaaatcttctggggtattattctcacgtacccagtaaaagaaatgatcaaatgccttttccacgcctttatgctctgctacttttacaaaattgtctctgacctttcccatgacggacagtgacttctggaataccatccactgttcaaactgaagctcatactcatcaagaattcccgatgcagcttctgcttctcttagcttcttctggttattctcctttgcgattcttgtgaaatcatcaatattatagtagcaagtgtcatccaccgcactgatcttcgcttcgatatccattggcacagccagatcgacaaatactcttcttttcgctgtcaccagctgcttcttcatcttgctgtatgtcagtgtataatgtggactggatgtcgcactgatcacaacatccatctgatctaaatagttatatctgtcctcataatcaatcgttgtaaaatcatcatttccatgctttgtattaatcagcttattctttcttgtcgtaacatagatatctgcctgatgaagcgattccagattcatcagcacgattcctccgattttacctgttgcaccgataatgagaactttcttatcttttaatgtgccaagctcttcctctgccactttaagcgcaagtgtcgctgtcgatacagaagtctttgaaagttctgtttctgtctttacttttttagctcctgtaaccgccatacggaaaaatgtattcagatacactcccgttgtcccggcttctcttgcctgcttatgtgctgtctttacctgaccaagaatctggtcttccccaattaccatcgaatcaagacctgcagtcacctggaaaagatggtggattgccttttctccatgatagaacaaaagataatttccaatatcttcttcctcctgtgcacctgcttcctcaagcagagtatcctccatcagattaaatatacatcccttgctttccgaatcagaatacacatacatttctgtccggttacatgtagataacacgatacattccgaaacttcaagatgttctgttatcttctgcatcatatgtttttgctgctcctcggtaaatgcaaacatttctcttacatgaagaggggctattttatgactgatactaattatctgtatacccattttttattttctgcctccagcaaaatcatgcggcttactcttttgcctgtctgaattcatgtgtaaatgtcttatcgtaaagtttggaaagttcgtactcatctccaaggaaatcgcctacaacggtaagcgctgtctttgtgattcctgcctcttttactttctgtgcgatatttgtcaggttaccgatcacgatcttctggtcttcccaggaagctttgtatacaacagcaaccggtgtatcctctctgtactcttctttcagagtatctgcaagctgctcgatcattcctacactgaggaaaatgatcatcgtagaattatgttttgccagatctcttaacttttcctttggaggcattggagttcttccttccattcttgtaagaatgactgtctgagatactcccggtaaggtatattctttctttaatgccgctgcagttgcaaggaaggaactaactcccggaataacatcatagtcgattccaagacgggaaagttcatccatctgctctctgtgcgcaccaaaaacagctggatctcccgtatgaacacgagctgtcatctttccttctgcctctgcctttttcatcacctcaataacttcttccaaagtcattgttgcactgttataaatctctgcaccctcttttgctccggcaagcacttctttatttaccagagaaccggcatagataattacatctgcctgatcaatcagcttctttcctttaattgtaagtaattccgggtctccaggacctgctccaataaaatgtaccattattttctcctttgactttctgtctcatttattatatttataattattttatttcgtaagcacatcaattgttctctgaatatcctcatcactatgtgcagcagaaataaacattgcctcaaactgtgatggtgctacatagataccattttctaacatatagttaaagtaatctgcgtaagccttcgtatcggaagaagttgctcccgcataatccttcacattctctcctgtaaagaaagcactcataagggaaccaatctgatttacatgaatagcaataccctgtttctctgctcttaccttataagcttcggcaagcttctttgtatttgcctcaatctttgtataaagttccggatgatctcttaaaatctctaatgtcttaattccggctgttgtcgcaatcggattaccggataacgtacctgcctgataaacctttcctgttggggaaatgttcttcataatatctctacgtcctccgtagatagccattggcattccaccaccaacaatctttccgaaagtagacagatccggcttaatgccaaaccattcctgagcaccaccaacaccaagacggaatccggtgataacttcatcaaatataagaattgttccattctcctctgtaatctcacgaaggaaaggaagaaaatcatcatctggaataacaacgcccatatttgctgcaaccggctccacgataagcgctgcgatctgatctttattattctcgaataactctctgacagaatctttatcattataaagagcaactaaagtctgctctgcaaaagaagcaggaactccactgctgtccggtacagactgtgttaatgctgcagaaccagcctgcactaataatccgtcggaatgtccatgataacatcccttaaacttaatgatcttatctcttccggtaaatcctctggcagcacgaatcgcactcatcgtagcctctgttccggaacttaccatacgcatcatttccatggatggcacacattcctgcacaagctgtgcaagctgattctccttacctgtcggtgctccaaaagtcagaccgtcaaagcaggcttttactacttcttcaagtacttccggatgagaatgtccaagaattccaggtccccaggaacaaacataatcaataaacttattcccatctacatcataaacataggaaccctttgcatggtcaataaataaaggattccttcctactgcaccaaatgctctgaccggtgagtttacaccacctggcatcaaatcaagtgcaattttatataactcttctgattttactgtgttcaacactttctcctccttattaaaaaaatgagattatatttacttattttttatacttttcgtaaccttcagaacaagatctcctatactgtctcattctgcctcgttcgattataccatgaatctctttttcactaaagatagttttcgtaaaaagaagacaaaaaaacactatttgcataggaaactttttgctaatagtgctttttttcatgaggatatatcgaaatatgattattatttgtatggaattttacaagtagtatgaaaaattcctgttttgctgatttagtatagacgaaaaaagaaaacatgatatatcccatctgctctgtagtcgctgtgtttaaaatgctcattcgcatcttaaacacgctccgaagacgcatctgggatatatcatgttttcttttttctgtataatctaaattcacaatttaataggatgaaaatatgccagaaggctatagttttccaagaagttaaattctaaaagactgccattcaaatcgctttattacttaaacttttatttcatcctataacttccagatatctctgttgtattcttcaatcgttctatcagaagagaaatatcctgcctttgcgatattcacaagcatcttctgtacccattcttctctgttttcatagtcagcatatgcctgctctcttgtctttacatactcatcgaaatcagggaaggtcataaaccagtctttagaaacaagttcattaaataatctctctaatctgtctttatcaccaattgcttttaattcttctcctgttatgaagtctacagcttctttgatcgctgcattttcattataatattttgccgcatgatagcttccctgcgcgtatctttcaacaaccgtatcactcgaatctccaaaaatataaatattatcatcacctacgagttcatgaatctcaacattcgctccatcttctgttcctaatgtaagcgcaccgttaagcataaacttcatattacctgtaccacttgcttctttagaagcaagagaaatctgttctgaaatatcgcaggctggaattaatttttctgcccatgttacattataattttccaccatcacaacattaagatacggacttacttccggatcattattaataagctgctgcagacagaggataagatgaatgatatcctgagcgattatgtatgccggcgctgccttcgctccaaaaataacggttatcggtgtagatggtttctttcctgccttaatctccaaatatttatggataacatacaacgcattcaactgctgtctcttgtactcatgcagtcgcttaatctgaatatcaaaaatagaattttcattaatcgtaacattctgtttttccatcaatgccttctttaattccattttcttagcagactttatctcaagaatctgttttaatactttttcatcatttttataatctaacagcttttctaactgcattgcatcttttttaaatccatccccgataagagaagtgataagttctgtcaactgtggattgcagtgcaacaaccatcttctaaaagtaataccatttgtcttattattaaacttctccggataaatttcataaaaatgatgcagctcattgtttttaagaatctctgtatgtaaagatgccactccattaacgctagaagaataatgaatatcaatatgagccatatgtactctttcttctccgtcaataatatatactgcctgattatgatattttcttcttactttatcatctaaaacttcgatgattgacataagctgtggcactgcttttttcaggtaataaatcggccatttttccaacgcttctgcaagtattgtatgatttgtgtaagcacagctctttgttaccacttcaatcgcttcatccatctcaagacctctctccacaagcagacggataagctctggaataatcattgtcggatgcgtatcattaatctgaattaccacataatccgaaaggtcatgtaagttgcagcccttcgcaacacattcatcaagaatcaactgtgccgcactagaaaccataaaatactgctgataaattctaagaatacgacctgcctcatcactgtcatctggataaaggaaaagagtaagattctttttaatatcttccttattaaaattaattccatcctctacaatactttcatccacactctctatatcaaataaatgtaacttatttgacgtattattatatccaataacatcgatatcatacattcttgatttcactgtcatccctttaaacttaatgtcatatgtcacatccgtttttgtaagccagcttttctctgtaagccatggatccggcactgttgtctgcatattattttcaaaaacctgtctaaacaatccaaaatgataattcaatccaacaccatcgccgtttaatcctaaagtcgcaatagaatcaataaagcatgctgctaatcgtccaagtcctccattaccaagagatggctccttttcaaactcttcgatctcacaaatattttttccattctgtgcaagctcttcctttacctcgtcataaattccaagattgataagattattagataataactttccgattaggaattctgcggatatataatataattttttcttagaattaccatgctgcttaccagaagctattttctttgttaatgtaagcaatgcataataaagctcctcatttgtacactctgaaattgatttaccgtactctgtttttacaaattctgaaagtttcatattgtaatacctcccttgaaaaaataatgtttctcgtgcatttatactgtgattatattataatactgtcagagcttaatttattgcagtacaatcttatatttttgcacaatactatcttttttaacatttggctttgtcgatatgtaaagtagtattacagatttcaagtcgagcagactcccacctctttcaggtggtgagtcttctcgactgagataaaacatatatgataccaaacgctcctgcatacatattacatatatttaagaaagaaaattctcgaatttatctttagatttaatacgtaaatttaacgcatgaatttaacatctaaatttaatggataaattcaatacaggaatatatatggataaacttcaatacaaaatatatcacgaaaataaaaaccatactccagacgactttccatacaatacttacttatgttccattcccctagactttcagtcggtaaaccttcactggcacgatgaagtcgaaattattgttataaaaaaaggaatcggtattgtcagtgtagacttaaccacctattctgtcagtgccggagacattatctttgttctccccggacagcttcattccatcagccaaaaagacaatgagattatggaatatgaaaatatcctgttcaaatccagtctcttaaaatcatctggttacgacttatgcaatgataaattcattcagccacttttttcaggcagccttcatatctgcccggtaatcaataaccagactccatattatcctccagtcatcaacgccatcaacgaaatcgatcacctgtgtgatttacgcccctatgcttaccagctatctgtcaaagcacatttatttcagatactatatactctggtttcaaattgcgggcaaaataaaatcaaaccaatcaaccaaaaatctctcaaaaaaataaagacgatattatcctatatcgccgacaattttcaggaaaacattacaattgaagacatcgcaaattattgcttttacagcaagtcctactttatgaaatttttcaaagaaactatgggaataagctttattcagtaccttaacgattatcgcctggaaattgccgccgagttactcaccacaacaactgatactattttggatattgcaatcgctaccggatttaataatatttcttactttaacagatgcttcaaaaagaaatatggcgtttcgccaagaaagtatcgatgttaaagacagacgaaaaaagaaatactaccatatcccatctgctctgtagtcgctgtgtttaagatgctcatccgcatcttaaacacgctccgaagccgcatctgggatatgatagtatttcttttttctgtgttttggctccagaagggggagaaagcagaagactactgcttgctcggaagatgtattatccaaaagattattttctctctttaacaaacagtaaagagaaaggccattatcatcttatcattttgacagcattacggagacagtatcagaataagccacgaccttctgatctgttccctttatccctcccaagactattgaattcattccttctggagccaacacacagaaaataaaaagaatagaccattgcaaatataatatgagagcaagtaaataaaaatgcctgacaggcatacttcctgagtagtagcagactcctgacttctcccccttctctccactcaagactattgaattcattctttctggagccaacacacagaaaataaaaagaatagaccattgcaaatataatgtgagagcaagtaaaaatgccgaaaaggcattttctacgcagtgatatctttatatttgcaatggtctattctttttattttcgtctgttttccccaaatgaattaaatagtaaaatcctgttgcgttacgataaatgtccgattataattgtagggtaacatttttactggaaagatataaagaactctatgaatataaatttttaaggaggaaaattatgagtgacgtattaaataaaatgaaaacaagaagaagtatccgtaaatttaaatcggatatggttccgcaggaagttttagatcagattattgaagcagggctttatgctgcaagcggaatgggcgagcagtctcctattatcattcaggttactaagaaagaattacgtgatgaaatttctaaaatgaactgcgatattggtggttggaaagaaggttttgacccattttacggtgcgcctgccatgttgattgttcttgctaaaaagagccgtccaacctatgtatatgacggcagtcttgtaatgggcaacctcatgcttgcagctcacgaacttggaatcggaagctgctggattcaccgcgcgaaagaagaatttgaatctgattggggtaaaaatttcctgaaatctttaggcgttgaaggagaatatgagggaatcggtcactgcgcgttaggttatgttgatggagagtatcctgctgctccagcaagaaaagaaaatcgtgttttctatgttaagtaacccattaaaaacattgacaaaaaaggaatggctgctctggcttgcttccctcgccgctgtaatcatttcaaatcttgcaacgaatgatttagatttgcttacattaatgtcggcactccttggtgtcacttcactgatttttgctgcaaagggaaatgtctgggcacagtttctgatgattgttttctgcattttatatggtatcatttctttccgttttcactactggggagaaatgattacctatcttggaatgactctgccgatggctgcctggtcagcgatcacatggcttcaaaacccatccgaagaaaatgaaaatgaagtagcaattcaaacattaaataaaaaacatatcattggattaattatcagcacaattatcgttacgagtattttttattatatccttatgtggctggatacaccaaatattatattcagtaccttgtctattgtaacaagttttgttgcagcatcacttactatgctacgttcttcatactacgctatgggatatgccgcaaacgatatcgtgttaattgtactctgggtgcttgcctcacttgaaaaccctgcctacatccctgttgtagtaaattttgcgatttttcttttaaatgatatgtacggatttgtgagctggaaaaagagagagttagaacacgctctaatacaatagaaaaaacactaatatataaaaattgagcaggaggattctctattatgaataaacaggacatttataagtatttaaaagaaaataatatctggcacgaaattacggagcataaagcagtttataacatggcggaacttgcagaagttgatattccatatccggaggctgatgcaaagaatcttttcgtacgtgatgataaaaagaaaaacttttatcttatcactgttcgtggagacaagcgtgtcaatttaaaagaatttcgtaaagccaatggaactcgtcctctaagttttgcttctgaagaaaatcttatggacattatggggcttattcctggtgctgtaacacctcttggcatcttaaatgatacggaaaaaaaagtacatttttatttagataagcattttcttgaagagccgggtcttgttggagttcatccaaatgataatactgctactgtatggctcaaaacagaggatttaatccgtattatcgaagaacatgagcatgatgtgacactggtatctttagattaacaacaactattgtataatagttacccccattgccaaaccgtagtgggggtatatttatagcaaacgaaaggatttatttatgaacaccgcttatttttacctcaccgatgaaggcggaaaacttgctcacaaactggctgccgctcatcctggtgatatttataataaagaaaattttaaagaaaatctgcgagcaggctttggcagatacgattcgcttgtctgcatcatggcaacaggaatcgttgtgcgtattcttgccccgctaattgtacacaagacgagtgacccggcggttgttgttttagatcagaaaggaaaatatgccatcagtctcctttccggacatcttggaggagcgaacgacctcgctcgtgaaatggctgtcatttccggtggcgaagctgtcatcactaccgcaaccgatgtagcgggcgaactttcttttgacacttttgcaaaaaaacacgatatggcaattgagaacatcggacagttaaaacatatcagcggtgcgttactttccgggaaaaaagtaaacgtctttaccgataaaaatgctgcggaactttatccggaattagccaaagagcagaaacgaggaatgattgctattttacctctctccgagtttttcaaaacttatgctattgaatccaacattccagctgtggtaattgatgaaaggctttttgtgtccaactccactgttccacaggcagctccagttctctatctccgcccacgcactatctgtgccggcattggctgcaagagaaacatggaacaaaagccgattgaggaagcacttttacagacattaaaagaagagggaattcaccccttttctctaaaatgtattgcaaccatcccactgaaatccgatgaacccggaattattggaaccgccgcaaatttaaatgtaccattacagattatacctaccgaagaaatcgaaaatctggatatcagtcagctcggtatccagacttccgaattcgttgccaaccagacgggagtcctatctgtttccacagcctgttcttatctggcatccagcaagggaactattttgcgagacaaagcgaagtacaaaggaatcacaattgctctatcaaaagaacgctcttgatttgtagatttggaacagacgaaaaaagtaataatgccctatcccatctgctctgtagtcgctgtatttaagatgctcacccgcatcttaaacacgctccgaagccgcatctgggatagggcattatttcttttttctgtgttttgataccagaaggacagaataagccatgatcttcttcccctcccctctttctcccaaagattattgaatacattccttgtgaagccaaagcacagaaaataaaaaaatagaccatcgcaaatgtaatgtgggagcaagtaaaaatgccgaacaggcattttctacgcagcgatatctttacagttgcgatggtctattatttttattttcgtctctttcgcctcacaaattagtatttaatctcttctaacactttggagaacggcatcttcccgccaaataagtcgagtgcacttccaatagttacatccactttatttttcccaagttcttttaactttcttaaatcttcaaaggaacttactcctcctgcgtaggttaccgggattccatcccaattgccaagtaatgcagcgatatcttcttcgattccacctgcttttccttctacatctactgcatgtacaagaaattcatcacaatactctgcaagttcagataatacattttctgtaagtttcacatcggtaaacttctgccaacggtctgtgacgatataataatcttcacctttctttcgacagcttaagtcaagaacaagatgttcttttccagttactgcgacaatttttttaaggttttcataattaatctttccatctttaaaaacataggaagtcacgatgatgtgggatgctcctttttccagaaaaaatgccgcattatccgctgtcatcccacctccgatttgaagtcctcccggataagccgaaagcgccagacaggcttgtctgacatcttcctcataatattggcttcctgccggatttaaaagaataatatgccccccttttagtccggcatctttgtataatccggcataaaaatctccatctttttctgaaacgaagttatcttttgcataatctcccttatctaaaaggctgccaccgacaatctgtttcacttttccattatgtatatcgatacatggtctgaatttcataaactgtccctttcattttttcaagaatgctgaaacattcttatcgcaagatacgttgatgcaacgcatgacatatttctaatgagcaattcttttatctgcatttccagaaaaattattttaactcaatcatttctctgtcatacggtacatagacatttcctttataatatttcctggcttcttttttataaagggattttctctttcgaatatttttatcttccgtatgccataataacagattctttacttctaacttctgcgccagttctgcgctgtcttttaccgtaccatgatgtttttcatatggcttaaattcatccttttctttatctaagcaaaaagcttcatgtagaaagtagtctgtctggtacgcatattcaaaacaatgttcctgatatggctcatcaccacaaaatgtcaaacgctttccattatttaaagttgtcacaaagccaaactgccttgcttttgtagatcttatatcgaaaaacttgactttataatctaaaatctgtttttcttctccatcctgtactggacaaagaataattctgtctcctattagcttcgtaatctttttaaccaatgtcagctcacaaatagttttaagtacatttaccaggccatcatgacaataaatcgtacagtttccttcatattttcccttttgaattgcctgaccaatcacacgaatcatccagatcattcctaaaagatgatccgtatgttcatgcgtaaggaaaatatcatgaatctctgcaaccggaatattcattttttcaagctgagtaagtataccattcccacctccggcatctatcataaagtatcttccctttttgtcctgaataatagagcaggtattataacattttgtaacggatgcatttcctgttccaagtacgattaatttctccataatgtttcctttctataactctatttttatttcttatttattttatgtttttctactttttagcgagtgaacttttattgaataaatctatccccgataaatttgtttccgataacattcaaatgctgacggaattgcatatttttcttctaaatcttctcttgatacggcaatccattcttccttttctaaaagtttctctgaaatatctctcatttgaagacgatatcccctcatctgccattccacatgagaaaaaatatgctttccttcacccaatggctctatcatataatctccgattccccattttttcatctgttcagataactcttttgcagaaagctcgccatcaacattaggcaattcccataatccacttaaaagccctttctctggccttttatgtaaaataatcttatcagatacttctattaagaatacagcctttttttcaatttttctctgtttcttttttgcttttactggaaaatctgtttcccgtccatatttatgtgcctgacaaatagattcccatgggcaattctcacaaaatggttctccatttggaatacaaatcgaagaacccaaatccatcaatgcctgattaaaatcccccggacgttccttcggcaatacccgtcgcacttcctgacttgttttctttttaaccgaagctttattgatttcaccatcttcagcaagaattcttgaaaaaattcgaagagcgttcccgtctactgccggttccggaattccaaatgcaatcgatgcaatcgcacctgctgtatattctcctacgcctttaagagataatagttttgaataatctgccggaatttccccatcaaactcctgcatcacctggagtgcagcaacctttaaatttcttgctcgattataataaccaagcccttcccacaacttcataagttcttcatctggaacttcagataatgccttcacatccggcagtacttccatccaacggtcataatattttttcaccgcttctactctggtctgttgcaacataatctctgaaatccacacatgatatggcgttggctcacttctccatggtaaaattcttgcattataatcataccaatccagtaaaacctcgccaattcctgtcggtgctacctgcaacggaacacaaatttccttccacgctcttgtaagtttctctatagaaaaagctgcattagccggactggttgaaggcagctttattgcctttctacccgtttccttctcctgatactttctatagtactcatacgactttgcaccattacaaaatatttgtttaatatctgcattctctaatatttcagataaatcattcggaaccacgttacgaatactgctatccgatgaaccgataatatcacaactgtggataacatcccatacagctatatgatttttatgaagaaattctcttttctcctctatcgtttccggtttattctcagaaaaaatacctgctaaaagcttccagaaacgattctgcggatgcccgtaaaaaaatgcctcttctctggattttaccgatggaaaacttcccaatatcaaaatctttgaatctttatcatacagaggcggtatcggatgtacaatcttttgtctctttgtctcatctagtttcataataaaatactttccttttctctagcaacaactcataatcttaccttcgttagtataccataaaactcgaatctcatatatctattatgtagcttatatattcaagaatgccccactgatactgatttgttgctcgccatatacaaagatgggagtcatctcacatctgatataatctgcaatcaaaaaaacagaaaaagaactatcgcatcaagattcttttatataaaatacagaaataacttttcattaaaaaatctatattctatataaaatcatccgattgcaatagctccttttctattttaatctatccaatatctcttaatctacctttatctattcttatgtattttatctattcttctataatcctctgtattcttctttatccttccttatcctcttttatttcggtacctctatactttattttcttcttttataacactttttattctctacagacatatcaaacatatcctgactaaaaaatctcatactcttttccatgcttttcaagccaggtacgacattctctatattctggcataaccttttccatctcattccagaacttacctgaatgattcataacctttaaatgtgtcaactcatgtacaataatatattctataatttccatcgggagcatcgccagcttccagtcaaatttaagattatgctttctattacagcttccccataaagtcagctgatttttaatttcgatattctgataagaaagtcttggtcttcgaagtgccgactgccgattctgaccagttatcatcacctgattatactcaagccccatcttcgcagcaaactcttccacttttttcttaacaataaccgctgcacactttttataataacgaactatacaatatcttaaaaactcctgactatcattatccgtcttaataatcaaatgttttccctgttccttcttatcttccatataaatcttcgtctcttctctgtcaaaatccgacagatactttattctcagaagagcatccgtctttccaagaaatggaagatacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaataatcaaatgttttccctgttccttcttatcttccatataaatcttcgtctcttctctgtcaaaatccgacagatactttattctcagaagagcatccgtctttccaagaaatggaagatacaaacctgctctataaactattcttccttcttctaaatcaagtgtaattggaagcatctgatgatttcggactttcttcttctcatactcctgaaaaataatcgtctcattcagacgaacatatctctcaatcatctctcgactcattccgaccggaaccttcatatctacagatagatcattgtgaatgatgaagtctacatatcttgaattcacactgataacatttacatataaatctcctgagtcctgatgaattctaattttagacacgagactccccctttcttccgacaactacaaatatttttcctgttatttaatagtatagcgcgtttttttatctctttcaactactttaaccaaaatataaatcttttaatgtttttgtaatttatctcagtcgagaagactcccacctctttcaggtggtgagtaacagcaaatttgtctcagtggtagtccaatctccgactgagataaacgccccgcgaggatgcgcagtggctcgacctgaataaaaaataaaaagcccagacccaaacaaatattttatatttgctatggtctggactttttattttatctgtcacgcctgatggcagtatcttattctactgtgtaaggcattaaggatacgtgtcttgctctcttgattgctactgtaagagcacgctgatgttttgcacagtttcctgtgattcttctaggtaagatcttacctctttcagatacgtatctttttaatttatttacatctttataatcgattactgcatttttatctgcacagaaaatgcagactttctttcttctgcggccacctcttcttctcattggagcatcgccacgatctttgctatatgccattgatattacctcctaaaattccttaactctaaataaaaggcagttcttcttcaattccttctggaattgtcataaatccatcgcttactgcctcacttggggctggacggcttgttggtgcaggtgcagcctgtggctctggagcattcgcatatcctccctgctgctgatatccacctgtgtagctggatgcagctgccttactctctgcaaaatcctgttcttcaacaacaacatctgttgtataaaccttaacaccgtcacgattagtataactacctgtctgaattcttccggaaatgacaatctttgtaccctgttttaagtacttctcagcaaattctccctgtctgccaaaagcaacacaattgataaaatctgcatcctgttcaccatctctgcggaatcttctgtttacggccaaagtatatcttgctacgcacgttgccttctcaccctgagaatatctgacatccgggtttctggttaaacgtcccatcaaaactactttattcatggaattcctcctattcgttatgcatcctgtttaacgcataagtatctcataactggttccatgatacgaacacgacgttcaatctctgctggacactcagctgatgcatcgaattggatgaaatagtaatatccttctctcatcttctgaatttcgtaagctaatttcttcttaccccattcatcaacgttagtaatctctccgccaaatttttcgattaaagctttaatcttttcaatggcatctgttctagcgtcatcttcgatttttgcattaataaccagagctaattcatacttattcatggtcatttgcacctccttttggtctttctggctctcttaaatacttaagagaacaaggatttttacacattacagttgtccattatatcacagaacctttacaaactcaagtttcattttaaaattttactgtacaaaatctcttctgatattgctctttttttattcatttttaccatcagacagattagacatattagacatcctggctgatatatcctcgaaaattcttttctacaagctttcttggaaccattacttctcttccacacttcatacattgcagccgaaaatccattccaactctaagtaacttccattcattcgcaccgcaaggatgcttctttttcattttgataacttctcccactttaaaatccatacgcttttgtactcctgttttccataattaagttcactatagcagaaaaattttttcacgtcaaaggcttcccttcccgtatttttacctatatttttatctatattattatttatgcttttttctattgtaaaaggctatgcacccacttgtaaatacggtagcagctattactatccccattattatctgtgatttaggattatttttataatattcttttacaggcttattcgtagttacaagacacttccttgtatccccattatcattagaatccagcttatttcctgctttatcccatgcaatataatgtatcgtttgatacgctgtatcttctgtaatcttctgattcaccatatgatttttatctaaatcttccggctttataataaatttgtgcacctttttcttatgcaaaggtatcgtacttttctctacatataatttcattttttcaaaggcataattatccattataccgattgtaaagttatgttcttcttcctcataaatatctttttctaaattactaatatgaactgctggtggtgttttatctataacaaaatgtattttcttctccttagaatcttcctgaattgtaacgagatattctccctcttctgcaaaattctctttttttatattataacttttctcgtaccatccgtatttttctgattttttatctgcgattatacattcttttacatattctcctttcaaagttcttctttcttcattatcttttaaaattatcactcttgattttgtctgttttacacatcgttcttttaatataatattgggttcttctcttaagtaatgtccatctatactctcttttatcttatgattcaaaataaaatctgcaccccaacgatttactcgaaaaacaaccttataattatcctttattttatttcctgctttatcatttgccttaataaacaattgataaataccgtcttttgacttattttgtcttaaattctcccattgaatctgtaccttccttttatcctctgttctttcataattccagtcttctttcgaaaccggttcaccacttgcttttaataaatacacctttacagaatccgcatctaaatatttatcttcacatattacctcaggcattattactctgtcttcatataccgcttcattcttgactccttttatcgtaatatttggaactgtcttgtctattataaactctattttctttttttcagatacatttccggctttatctgtacatcgcatctgaatgtaatagtgagcctcctcttttaaagtcagatacttataatgcttttctccatttctgacataggattctgtattatgtgcatctatctgctttctcttattcgccgcttttattgctcttatatcatattcaaccttatgttcatcaaaatttttatcttttatgcaaaataccactgttttatctgtcttaaaatataaaagctgattttctttttcataatccgtattattctctatggcaatagaaacttccggaagcgttttatcaatcgtaaaatactccctgtctttccattccgacttattccctgccctatctgtcacagaaagattaattgcataatcttctccatctttatcaaaatatatctcgcatgtatgtatatcttctgtcgttttccattcgcccatatgatattcctgattacttccctttatatcccacttcaccaactcaggtctaaagttccgctctttaactattactcttgcttttctttctgtattataatattctgtttgattatttctatcatactccacctttataaccggcttttcagtgtcaataatgattccctgttccaaaacctcctcacttatatgtcctgcattatctgtcatacttccttgaatcattattggatgatcagaatctgaatatctaaagcttttctcttctaatgtaagccgctgtctttttctatatactgtatcctcagcatcccaaaccactatgctgctatcatgcatttccttattatttactttttcacacagactggttttacaaattcccgactgttcatcctcaaagaccgcttcaacgaaaactgctttattataataatttagcttttctttctcatccgtaaaagctgcttccggtatttttaaagagattttacttacttgttcatgtaattgttcatcttcagaaaccattcctttactttttacaattcctccgacatttccactataatcttgtccataaacttttaaatagcctttaaaattttgctgcgcaggtaacacgattgttgtcagctcggatagattctgcttttctccttcattcttcaaaacagaccattcttctctgccatcatcacttccatatggtacaaacatataattcaagttttcaactccactgacttcatctcttacctgaatagatgcacatatgcgttttatactaaaatatcggaaaaatggatatctgcgaaatgtaaaaaaattcttttcctctttctgtatctctggtctaaaaaccaactgttccttttgattattctgccctgtataaataatctccggttttttttcatcatatgtaattttcagttctttttgatttcccttatgaaccgctccatctgtactttgaaacagtatagtataatttgcttctatagctactttcatccttgcttcattcatccttatcccatctttataataagatttccattgtagatgacctgcttgctcttttagtgttctccattctttttccatactctttccatctgcataaaacatcttcccatctactgaaaaattagctttattaaaattctcttcctgtatacgaataataatttcaggagcatttttaaagtactgtcggtcttctttttttcttaccggatattgatcgcaaaacacctctgttataatcggtgaaacggtatctactgtatatatcggactttcataccatccatcatgtatacatttatctgtctcactatttctttctgcttccattacatttcctgctttatccgtacaatgtatcttaactctataatgtccgtcttcaagatttttaatagcatagaaaaagattccttgggattgttgattttcttttaatcttattatttttttatttatatctgactccgatacttcttcttgttcccactgtccttttcttccgtatgacatacgatataattttatttcaatatcttcgggtacaatattatcttcttctatacatatagaaattccattctcctttccacaaaaaatctgattttgtgaagacgtcacttttccttcattgttatgtagcgtttcgtttatattccatattgcagaatctttatccataatattcaaaacaccttcataattaacagttaacttcggcgctgaattatctataataaactcttcactttccgccccctcctttcctgtttcagcagatatcgcatgattccctgccgtatcttcgttctccagcatcgatgccgcctttaccggacatccgtaagtattccatactaatcctgcgattcccaataaaataaatggaagtatccaaatactttttttctttctgaactcttttatacaaactattgatttatatacttttcccaccatcaaataaactatactactaagcaaaaaaatataaaataatatctcccccattaattgtccttttgtcaggtacgcaattcttcttaatagatctgcattaagttcctccctcatctccttcagccccctcatacttaaatccatcagccatctctactcttctttgagcatcttgtaaaagattctctaattctttcccgtttttctttgccctttcaaaatatcgcattcttccgtttatctttatcaattgtttttttaacatttctctgtttatctctttcatccttaaaaattcatctgcataattcgctatttctatcgcaacttctttagaaattagatatgcagcagaaatatccgaagttgaactcctttccgtaattttaaattgatttaatatacataactcattataaaaatctagaaaatccttattttcccgttctccactcttatcaactccattaatcaggaaagtgttgtaatattttgctatatttgcataagctattaccctctttttcttaccttcatcaaaagtctttttcttttttccattatccaatagatcaactacatcacaaaaccatttttctgatgcagattttcctgtaacaccgcccatatcatagaaatatcccagtcctacctcatagcaaaattccatatatccttctcgtttattttccttaaaaatatctaatacggtcctttccttacaggtggtcattacaacgcttgtcaaaattgaagcgtcttctacactaaaattgttcggatgaataaaatattttaccaggctttgataaattgctttttcatctggtataagaagcaacgcctgtttataatattgttctgcttttttcttatctatacttttctccgcggattctatataaacagcaattgctttttctttataaaaatgagctgcccccttacatcctaaactaaacatacctgatatttgtaacaatacaataaagactattaatttttttactttcctcttttctgtttttaaaaaattatgattcttataatctacttgtgaaaacgcataagaaagctctttacaattctgataccgcatatctggttctaattgtatacattttaaaataacttcttttatctcacaggatatattctctccccaatattgttgatgataaattttataaggcggtttttccggactgtaaccagtcagcatactatataaagtaactcccagacagtaaatatccgtcctctcatccgtctgccccattcctccgtactgctccggtgccgcatatcctctggttcctaaatatgtcgtatctgtactattcttttcataacaatattcacgtgctgttccaaaatcaatcagcaccagtcttcctgttttttttaatatgatattatctggctttaaatcacgataaataatcggcggagttctggaatgcagataagatagcacctcacatagctgttttccccaggataatacttccgtttcctgaatccttcctctttctttcagaacttcttttaatgtctttccttcaataaattccatgaccatccagataacatcctttttttctatgatatcaataatctttggtaaacccggatgatttaatttttttagaatatctgcttctaatactaattgtctgcttatcatttcataattttcacaatattctctgcttatttcttttattgcccattctttatttaaccgttggtgccttgccagatatactgtactcatccctccctgtccgattacagatattattttatatttaccatctaatacagatcccaatttcagcatttataaatcacacctgtcaaaaaagtattaatctatttccattgttcaccacacattcctctaaccgtacattgggattcagcacaaccttactctctatacatgccaaatataaattttcttcttttagcctctcttttcctctctctaaatttttttcttccagcttagtacaagttgtaaactctatattcatcaccgtatgatatatttcttttataatattcttcactatttccgtttcttcgcatctgaattcgtaccactttcctataccggcaacaaaaatatccacatatatcacactgccactctcctgtccaatatctgccttattttctcctgtctcctgtaatcattctgttctttcactgccaatgctgtctgaaattctaaaatccgctctccataataagcaattcccctccctggtatcccctttttaggtaagacaggaatctgtattatattaaacgcttctgcataggaataagtatccttcatataaaaacaaattctggtctttaaaagatctgacaatctcatagatatattcatacctgaaaaagattctactgttattatcattaatatcccaagcttttccccttctcttaatatttgatacaatatatcttcatatttttgatacgtcactgtgcaaaactcctcaaaaccatctaatacaatcaccataaggggaatgctctcttcttcccccattctatttttatattgattaaaatttcctcccgataacattttctttcttctttttaattcttctctgataccttcaaataggctatctgttttttcttcttcctcttcctttatcacttgctgtacctgcgatgcaaccgcataaatatccattcctccaccattaaaatctaaaatatacaaagtaatatctttttctgaatacttatttattacagaaaatataaaggtctgcaggaaagtacttttacccgaaacactccttcctccaatgccaacatgtccacattccataagattgaaataaaactttggctgttcctggttttccggatcatcaaatactcccagacaaatttgtattccctcattacaaaataacttctgtattcgttgctccttacctttcttatcttctctcttttctttcttttcttctttctcttctttgttctcttctataatatcttctaaatataaatatttcggcaaaggatccatccataattgcttacctgctctgtagttatatttctttgcaaagtaagctatatactttgttattgcctgcaactgcgttatttctttctcgtgttcaaacgtttcttttacaaaagtgttttttacagaacaaggagtaccatctagattaatcatctgtgctaccgcttttctacattcttccctatacggcgctccgctccaaccagcttgaaataaatcatagacctcattattcccaacctgtaaatacccccttccagtttgtgcaatctggcaggcatccatgttatgaagcatatccatactatcctctctttcctgtactttaagacaaatacgaaatcgtgaattgctccatattttatcatcaacaactcctcccggtttttgtgttgccaatataagatgaactcccaaacttctcccgacctgagccacgctaatcagttcctgcataaattccggttctgctttttttaattctgcaaattcatctataacaattaacaaatgcggaattgcttcgcttgtagctcccgcaataaaaagctttgtataatcattaatattattaaccttccactgcttaaatatcttttgccttcgtttattttcactttttatggatatcattgccctgtaagcctgtccatctgacaagtttgaaattcctccggaaatatgtggcagctcagaaaataatcctgacattccttctcctttataatctataagcaaaaaattaactgcttcgggactaaaattgatggccattgacagtatgaacgtctgaagtacttcacttttccctgaacctgtagtgcctgcaagtaagccatgcggtccatgataacgttcatggatatctaaataacaagattcacctcccgctttttttccaatcaaaacccggcagctcttataaatactgttctgtctccaacgactttctatatcaagttccttcactgtcataactccatacatttttaaaaagtcaattgtatccggaatgtccctcttttcttctatctccgctacccttattcctgaaatagttcttattaatcgttccgctgcttctttttttatataatcaaaatgtatctcttcccttttttggctatgccgttctatttcataccaccctgaaaactccttacttctttccaatactaatttacatgtattaggtagctgttctcttctttccacaagccatataactgttagaccgtaattctcttttttattaaaaatatatttggaaaacatttctccgtccagatatttttcttccgcaataaataaaatataatgaggcagtccttgctctgatcgacctggtgtagatattctttctctttctttaaatacctgaagcagcctgtaaaataattctcttgcttctgatagattttctgcaatattgcgctttcttctatcactgtcccatatatgtggcagccatcggcaaaatccccactgttcatattgcataactttatttttatcatatatacatgccagctttacctccgtataacaattacatagcgcaatctgtaatatcaggttccgcacaattagcattccatcatccatctctgcttctataaccccgacttgattatattgtgttatatctagcagcatcggaatctgatgcatgatattataatgttctcgtatcttttctgcttcctgccacagtataccttcttcctcataagacacttctcccacaaactttatctccataggaaatcgcatattcccggtacctactctatattttaaaaaatcttcatgatagggatttcggttccacaaatataagaataacaatgaattatccacatacctgtctgcacataaataacggctttgtaatactttataagttttttcatattgttctttaatctgcatactttttttattcaaatatcttctgtaagcattcttctttatatccgctcgttcctttcttttcctcttctcgtattgcctggaaatcataatccataaaagagaacacattaccgacataacaaccataaatattcctgaatatacataggtccctgcttgatttccttctgtcctcatcccatatattaaaaatacattcattcccaacatcgggaacatcatgctcaaaaccgcacctatatccataaatacagaacgttgttcttccattcccgacattcctaatatcggaggattctcaatctgtaatgtaagcttctctaaatgttccataattcttggtgccctgtgaaaactttcttttaacataggagctataatgcccttatcctgtataaattcattcactcttatttcttctaagcaaaatacacttatctcttcttctgtttgttctaccgcaataaaatcatcaaaaaacaaaaaaattcttccagaaaaatatataacatctccataactgagtttcttattctcttttatgaaatctccattaatgtataccggttccattccataattatttaaaaaccattgaccatttttatttaaaatattcacacaaggaatctgctctgaatcatcttccgtcaagaaaattttatttgactgctttattattctgcaaacttttaatctatatgttcgataggtactccaatcatatttacaacatatgcattgtatcgaaatatttttttcaccaatctttaaaatatatttccgtcctgtattcaacttataaaaaactgcttgattctcttccaccctttccgtttgaaaaaactgttttttgcttactttatagtaagctgtttccttaacataccattcctgcattatatattccaattccaaaaacatcgtctgttctatgaaaaactcatctttcgtaagtagtatcctgcacttttggttcgcatcttttgaaagtaaaaaacgtcttccatacttttctccatatataaaaatcaaaaatctcatagcttcttttcccctaaagtgatatactgtgatgttaggggcaaaaagtattttgtccctaacttgatgtcacgaattattccatagctaacgctactctcgtaattctggcacaaatgaagtttttaccttttaaccccgatcttatactatttaatcaattcaagtcgagccacctgaaagaggtgggagtcttctcgactgagataaaaacaaaggagctgcccctatgatagcaaaagatgatatcgttataagaaaagctattttacatattctagacacaaatcgcggagaatgtatattatctaatactctcttagatcccggtccggatttacatgactttattcgaaaccacatttataaaatcgtttccagcgatgataccaagaactgtgagtttaatccagaagcatcaccaatttactctatccttgaaacctgggatgaatctgatgaagcctcttttatagaaacaagccaggcaattgcaaacaaactttatattgctatgggagaaggattagatattcctgctgctgaccttctattcgtaactttccaggctgaaggaaccatctaccttgctctcttaaaaatgaattataaagaaagttatacccatgaaattactgcatcggattctgaaggtactaatcttaatagtaatgattctaacattcctgtcatcaatactggaattgttaaatcaagagcccttcttccctcagcaacttcaagaattcctgaagctgtaattattaatttgtcagattatcatataaaacttctggaaaaaagatatgaaatcaatggtgaaaaagcatattatttatctgaaaactttctcatctgccatactaatattccacctaaaaagaagttaaatatactgacacgtgttattaataatatttccaataaatatgacggtgccgatttaaaaacaaagatggatacaaaaagtgccttacaaaaagaatatgtagatcgaaaatcttttgatatagaagaaatcggaaataaactctttggaaaaagtcctgaaaaaaaatcagaatttgacgaaaaaatggaacaatatgatctccaatatgacaactttactgtcaccaatgaaaatactgtaaagaaattagaaaagcaggtcatggtaaccgatagtggaattgaaatatccattcctatggaaacttataacaaactggctaactttgaagttcaaacagatgtaaccggtaaatcaactattatcataagaaatatagataatcttgttttaaaataaccatttatctgcaatagatattaaaaatacaaaaacctcacacacaaagctactgcaaacttactgtttattatcctttgtatgtgaggttttatctcagtcgagaagactcccacctctttcaggtggtgagtgacagcaaatttgtctcagtgggactccaatctccgactgagataaacgctccgcgaggatgcgcagtgattctgtaaagaatatgtcagcttacgctgaccagaatcacgcgccaagtctcgcggctgctcaacttgaatatactttttaaaaatgcaatctatttattatttgttacttcttctccagatatgcatcttctctgcttctttaattaattcgtctctgaaatcaggatgagcaatactgattaatgcttccgctctctgccatgtagacattcctttaagacatactttaccaaactctgttactacataatgtgtattaggacgagtgtctgttactgtagaaccttctgccaaagtaggtctgattcttgtgtgttttacaccgtctcttgaagtaaatgtagaagaacagcagataaagctcttaccacctttagataaatatgctccctgaacaaaatcaagctgtccacctgctccactaatctgctttacacctgcactctctgcattaacctgaccatataagtcaatatcaactgcattattgatagaaataaagttatcaatctgtgcaattgttttcgcactgttagtatagtcaactggcgcactcatacattctggattatcatccagataatcgtacatcttctttgtaccagctccaaatgcatatacctgacgtcctctatcgatattcttctttaaaccgttaatctttcctgcctttgcaatatcaacaaatgcatctacgtacatctctgtatgtacacctaaatcctttaaatcagattctgcaatcatagaacctactgtattaggcattccgccaataccaagctggagacatgctccgtctggaatctcctctacaataagctgtgctaccgctctgtctacttctgttggcggtgcacctgctcctaattctccaatagcaggattctgaccttctacaatgtaatctacgcgggaaatatggattccttcttcaaatccacctaagcaacgaggcatattctcattaacttctacaatgataacatccgctgtctcacaaacagccatcatatgtgatgcattcggtccaaaattaaaaaatccatgcttatccattggtgctacctggaacattgcaacattaagatgtctgatgttctctctgtaataacgtggaagctctgaatactttaatggagaataaaaagcaaaacctttactgattgcttttctctctaatccacccatatgccaggaattccatgtgaaatggtctgctacattatctactttaaagatctcaggttctcttaataaaattcccccacgaacctttacatcttctaattcatctgctctggctgctaatgctgcatctaaggcaactggtgtacctgttgtccaaccataatccacccaatcatgtgattttactaccttaactgcttcttctgccgtaacaagcttctgtgcatattctttaataaaactcatgcttctcctcctaaccacttttgctcttgttaaaaaaaaatcatgagtctattttaccactgttacaaaccagggtcaacttaaatcagccttataatccccatgtttttgttttgattccctctttgatactgattaaattttagtaaatttcccctacttattgagactgaaacagaagattctctgtgttatttcgttgaaaaatttttactaacttcgctctgtatttttgagaaatcggaataactgtttttttatccaaataaaacacgctgttcattacatctgctttctgaataaacataaaatttacaatataacttcgatgacaacgcacaaaataatccggtagactactttctaacttctgtaatgaactataaaaagaaaactcctgcttctgtaaatgtaatataatctttttatctcttgcttctagataactaatatccgcataatcaaaataatagtactctcctcctgtcaaaacttgcaatatattattcataccctgccttctatatcgatccctgtacatccaggaaaagattttgtaaataactttgtatgctttagaatatatataaggctttagtaacaatatatccggtgaaatttccggaatcatatagtattccggcgaaatctgaatactacttaaaatcaaaagctttgcattaggggaacactttcgtatatggattaacttccttaaatcaacagaactcattacttccgctagaattaaatctgcaactggtattctctctatgttcaccttctcataatcttcatcactcacaatacaacactgtaaacgctcgttatttataactgccacacactggtcgcacaatttacaaaaaaaatccgcttcccttttatcatggcagaaaatcacaaccgataccatctcttatctatatcaactgtatcatcagctgataacattattctttaacgtcgccgcaacttgtttattctgttcttctgctaatatatattcctgtgcaatggaagttaaatgctgcgcttcttcttctatcatcttgcacattttattaatgtctgcttctaatccactaaacttgttaataaatgagctactcgcctcaccactccaaatagaactactgattcccctcaccaactgaagcatatctgaggtcgttcgcttaacattctgaccggtctgttgaaaagaaactgcggttgactttaacttctctggagttacattaattaaatctgccataaaatcctccttaacaattaacttaaagaatatctcggaatctttttatgcttaaattcatcagaagactccgagaacacattaacctaccctaacttactgcagttgcttcattcttcttctcagccttattatagatcataataatcttctcaagtatcagtataaattctaaaattgtcctaagtaaactctgcatctttacaatatctgctttcagttgtttcgaatacttctcttttgcagctccttcccacatggaattaagactactccccagggtttctaaatcagtaagttgtgttttcaatgaattactcaatgtcaccaatgcctgtttcttgttagatatctctttcgtagaagcaataatctgtgccataaatgcctcctctcatatctttgttaagtgctgcaagagtattataacatatttaaatctaatttccaccttttttgacgaattatgtaaacttagtgataagcggattgcttttatatttatttgaaattatatataaattacatagtgcctgtttcacaaggaccgaagtggaggaagttaatttcctgcaaaataaaaaagaccacagttataaactgcagtcttattatttcatctaaacagggaatctataaaaagatcccctgtttcaatacattttatagagttaagtaaaaaatcgcgtatacttttcttttaataatgaatcgccaataaacaaaacatctgagataaaatatatttaacttttacctaacatctaaagttaaattattatttaacctgtgccttgattgcttctgttaacttaggaacaatctttaatgcatcaccaacgataccgtaatcagctacatcaaagataggtgcatctggatctttattaatagcgatgatgatatcagattcttccataccagctacgtgctggatagctccggaaataccaattgcaaagtaaacattaggacgaactgtcttaccagtctgaccaacctgtaaatcttttggtttccatccgttatctacaactgcacgagagcaggaaactgttccgccaagtgcctctgctaaatcgtctaataatgcaaagttttcagcagaaccaactccacgtccgccagatacaagaatcttagcagcctggatatccactgtttctgtaacagattttacaatgtcaagaatctcaacatatttgtcatttggagtaaatcctggattatattcaataacttctgcctttgctcctgcaacaggctctttcttctgcataacaccaggacgaactgtagccatctgtggacgatggttaggacaagcgatcgtagcgattgtgttaccaccgaatgcaggacgagtcattaataactgaccctgacgaggttctttatctccacgagctttgaattcaccaatttcaagaacagtacagtctgctgtaagacccgttgcaactcttgcggaaacacgaggtcctaagtcacgaccgattgctgttgctccaaccagaagaatgtccggtttgtattcattgataacagatgccagtgcatgtgtatatggctctgttctgtattcttttaattcagggtcatcaactacgataactttatctgcgccgtattcagcaagttcatcaactaagccttttacgtcagaaccgattaaaactgctgttacgtctgttcctagatctgcagcaaggtcatttgcttttccaagtaattctaaagcaatggcatcaatcttattgtcaacctgctgagcatagataaatacacctttatattgttctaaattcattctattcaccacatttcctttacaattagataacatgctttgttaacagtttgtccatgatgtactcaacgccttcttctgctgtttcagctgtcatcatgacacctttacctttacgtaccttatcagaagcttttgcgatctgagttggagaacctgcaagacctaagttactgtcatcaacatctttaaggtcttttcttccccatgtagtaatctctgtatcatatgcatcaaagattccgcctggagtcatataacgtggctcatttaattcggaaagtgctgtgataacacatggtaatttagcttttaaaacatgatatctgtcatcgtactgtctctgaacgattacactgtctccttcgattttaatatcctgtgcataggaaattaaaggaaggtctaagtgttctgcaatctgaggtcctacctgtgcagtatcaccatcgatagcctgacgacctgtgatgattaaatcataatcaatatttctaagtgctccggcgattgttgtagatgttgcccatgtatcagctccacctaaaacacgatctgtgacaagaattcccttatcagcacccattgccatagcttcacgcagaacttcttctgcttttggaagacccatagtaactacagttacttctgcgcctgtttcatcttttattctaagggcagcttcaagacctgccttatcatccggattcatgatagtaagcatagctgctctatcaagagttccgtctggtttaaacttaactccaccttttgtatcaggtacctgtttaatacatactacgattttcacagtattttccctccttatcttaataagttaccagaaataaccatacgctgaacttctgatgttccttcgtagatttctgtgatcttagcatcacgcatcatacgttctacgtcgtactctctgatgtaaccataaccaccaagtaactgaacacacttagttgttacatccatagctgtttctgctgcaaataatttagcttttgcagcttctacggagtatactctctgtgttgcttttgccattgctgctttataaacaagtaacttagcagcttctacctgtgtagccatattagcaagctggaactgtgtattctgctgtgcagcaattgctctgccaaactgttttctttctttaacataagcaattgtagcatctaaagcaccttctgcgataccaagagcctgagctgcaataccgatacgtccaccatctaatgtgtgcatagcgattgcgaaacctttgcccataggtccaagaagattttctttaggaatacgacaatcctggaaaatcaattcatatgtagctgaaccacggatacccattttcttttcttttgtaccaaatgtaaatcctggagttcctttttctacgataaatgcggagaatttctttttctttcttcctcttgcatctgtatcaacacttgtgatagcgatgataatatagtaatcagcataagaaccattagtgatgaaacatttagatccatttaatacccattcgtcaccatctaaaacagcctttgtctgaacaccctgagcgtcagtaccagcacctggctctgtaagaccgaaagcacctaacttttcaccctttgcaagtggaacaagatatttctgtttctgttcttcagtaccataagtaagaattggatctgcacataatgatgtatgtgcggatacaataacacctgttgtaccacaaactttagataactcttcaacacacataatgtatgttaaaggatcacagccctgtccgccatattcttttggcacaggaattcccatgaaacctaatttttgcatttttgcaacggtttcttctggaaaatgttctgtctcgtcaacctcctgagcaagaggtttaacttcgttttcagcgaactctttaaagagctgtctagccatttcatgctttttgcttaatgtgaaatccattttcattcctccataataaattggttattggggtggagaaccaccttaaaagccgtggagacgcagagcatagtccccacggccgtattcacttttttaattatttgctgtaatcgtagaatccaataccagtcttctgacctaattttccaccacgaaccatctttcttaataatggatgtggacgatacttaggatctcctgtctcattgtataatacttccatgattgcaaggcagatatcaagaccaactaaatcgcctaaagcgagaggtcccattggatggttagcacctaacttcatagctgtgtcgataccttcaacagaagcaacaccatcagcataaatgccaactgcttcgttgatcattgggattaagattctgttaactacgaatcctgcagcttcttctacctgtacaggtgttttgccgatttctacggagatagctttaatcttttcaaccatttcatctggtgtattaagaccagcgataacttcaattaatttcataactggagctgggttgaagaaatgcattccgataactggtctgtcaagtcctgcaccgatctgtgtaatagataaagaagatgtatttgttgcaaacatacatgttgcaggaacgatatcctgtaattctttaaatgtctgctgtttaacttccataacctcaagagctgcctctactactaaatctgcatctgtacagatatcttttgtaccagtagtaatcttagcaaggattgcatcagctttagcctgatccatttttcctcttgctactctcttttcaaatcctttagcgattttctttttaccgtttgcggcaaattcatcgttaatatcacataagtatacttcgtatccttctgtctgtgcgaatgcctgagcaatacctgatcccattgtacctgcgccaataactccaactttcattgtctgaaacctcctataaaatgtattatcttctgacaattaatattatcaatatatgtaatagattaattagcagtttttaaatggttcttttaccttttctttgtttttatcaaggaagaatgccattccgtatttctggtcttctgtctcgaagcagctaccaaataacttctcttcgattacgatagcttcatccattcctacttctaaaccttcattgatggctttcttacatgcacgaactgcgataggtgcgttctttgcaataccttttgccatctttttagcctgaggcattaactcttcaagtggataaacttcgttaaccagtccgattctatatgcttctgctgctttaatattacgagcagtatagattaactgttttgcttttccaggtcctacgatacgagcaagtctctgtgttccaccaaaaccaggtgtaattccaagaccagcttccggctgtccaaatactgcgttctcagaacaaagtctaatatcacagctcatagaaatctcacagccaccgcctaatgcaaatccgttgattgctgcgataacaggaataggaagagtttcaatctttctaaatacatcattacctgctttaccaaaagcttcaccttctgcttttgtaagagtgctcatttctccgatatcagcaccagctacgaaagatttctctcctgcaccagtaatgataagacatctgattgcatctaaatctactgcatcaatagttgcatctaaatcttttaatacttcactgtttaaagcatttaaagcctttggacgattgatggtgataataccaacctgaccatctacttcataatcgataaatcccattgtatgtatctcctttcagattacattattataactgtctaaagctgtagaaatcagttataaactatgtaattgatataaccggattcgaaaaccgaacccggatatatgtaatcattctatacgtgattagtctctttcaacgattgttgagcagcccataccaccaccgatacacagtgtagcaagacccttcttagcatcacgtttctgcatctcatgtaataatgtaacaaggatacggcatcctgatgctccaactggatgtccaagagcaatagctccaccattaacatttaacttctctgggttgattcctaattctcttcctactgctaatgactgagctgcgaaagcttcgttagcttcaattaagtcaaagtcatcaatgctcatgcctgttttagcaagaactttcttagtagaagcaactggtccaacacccatgatagaaggatcaactccacctaatgctcctgctacccatgtagccattggagttacacctaattctttagctttttcttcgctcataacaacaacacaagcagcaccatcgttaatacctgaagagttagcagctgttacgataccatctttcttgaaagcaggacgtaatttagaaatactttctgctgttgttccaggacgtggtccctcatctgtatctacaacaactgttttctttttaagtttaacttctacaggaacgatctcatctttgaacttgccagcttcgatagctgctgtagctttctgctgtgaattagcggagaactcatctaactcttctcttgttaaatgccactgttctgcaacgttttcagctgtaatacccatatggtactgattgaaagcatctgttaatgcatcgttaaccatacagtcttttaatacgccattgttcattctgtatccaaaacgagctttgtctaagcagaatggagctaatgacatgttttccataccaccagcgataacgatatcagcctcacctgctaaaatctttgtagcagcaaggttaacacagttaagaccagaaccacaaactacgttaattgttacagcaggtacttcgattgggagtcccgcattaatggaagcctggcgagcaacgttctgtccaagaccagcctggataacacatcccattaatacttcgtctacctgatcagcaggtacgttagttctctttaatgcttctttgattacgatgcttcctaaatctgcagctggtactgtgcttaatccaccacccattgttccgattgcggtacgacaagcacctgctaatacaactttctttgccatagtttcattcctccatttaagttatcaatattatttgatatagttgctttgctagagcatttctagtacgatatgtgttaatgctatcacaatcttccgatatttgcaacaagattataaattattttttaattaatattctcatttatgagaatttcacaatttattcacttttatacgtaaaatcctttatatttttcgttcttttttcttatcattccactttcatttatggataatctctattgattattttttgaattttgcgaaaaaaggaaacaaaatacaaaaaaatgcctaaatatgtgaaaaaatagacactgttttttaattaaagatacaaaagttggaaatagcacatcaggaatttagaaaatcctaagcaaataaaccgtaactactcattttggaacaacgatatatctctagtttccattcaagaatgtcccggcatttttgccgctttatctttatccagatcagattgaaaatttatatactcttttatttttagtaactgcaaaaaattaggatgaatttcagctcgtactatttggctttctatttataattttcttgaatacaatgacaaaattttagcattatatgaatatttttttatcattatttagtctggcagttaaaataataatacaaaatatttggtatcacgttggtttgatttcatctatccacaaagatttaaaaaacgaaaaatatgacttagcatatcttcacagagcttttttgttttacaaaacaaagttttagtaaaacaaaaaaagcaccaatatctatatattgatgcttcagaaattgcgggggaaggatttgaaccaacgacctccgggttatgagcccgacgagctaccagactgctctaccccgcgatattcaattaaatataaatgccaaaaagagactaactacttagtctctttaagaggcgtcgaccagatttgaactggtgatgaaggtgttgcagacctctgccttaccacttggctacgacgccacaacatgactcctacgggatttgaacccatgttaccgccgtgaaagggcggtgtcttaaccacttgactaaggagccagactccccgagtaggacttgaacctacgacagcgcggttaacagccgcgtgctctaccgactgagctatcgaggaatattgatcagggtcataccctgaaaaccacacacattatatcatatctttctaatctttgcaagtactttttaaggtcaagctttcgaccgattagtaacagtcaactccacacatcactgtgcttccatctctgccctatctacctcatcgtctctaaggggtctctcactctttcgagtctggatatctca

SEQ ID NO: 409 - DNA, 51119 bp, Eubacterium hallii
tcgtattgcaacctcatatcttgtcaatgtacaaaagagtgtctttaatgagcagcacatctaacggttttctctttaagaactgctacggctattgtagcatattgggtaacagttaacaaggctcatcccaccacctaaaggtagtgggtttccgcctatggcaaacgaaaggattttatttatgaaatataaaaactttttaatccgtttatttgatcttattctcgttctggggcttttagcagggtatcaggctgtgatttacagtcgtgacaaagaagccacaattgcagaattaaaaagccaggtaaatcagcttcaaggagaaaaggaggatattcttgaagcagcaaaaaattccggaaagctgggagaaggtggtacatctgccggtcaagcaggaacgtataaagatggaacatatactggaagttcgcagggatttggcggagaaattaaagtaaaagtaacggtatccggggagaagatcagtgcaatagatattatagaagcaagtggagaagatgaggcttatttatcaatggcaaaagatattgtgaagacaatacttgataagcagacgacagatgttgatacaataagcggagcaacctattcatctacaggaataaagaatgcagtaggacaggcattagaaggagcagctaaataatgaagaaaaagaaaaaaatatcggtgcagacaatcatagaagtgatgatacgggcagtattttttattatctatccagcgttattttccactgcatttaccggaataaaattaattgtagaacaaattacacagcgtgcaagtctacagtggaattcctttgtacagacacttgttgtattactggtctttaccattgtatttggacgatttttctgtggttttgcctgtgcatttggaacatggggtgatttcgtttattttatttcatctatgattcgcaaaaaaagaaaaaagaaaccgttgaaatgttttgcaaaagcgggaaagatactccggtatttaaaatatgttgtactgcttgctgtcctgcttctttgcataaaaggttacagtagtgcagttgctgtacatagtccgttcagtgcattttcccgttttcatcagttaaagatggcagacagtctcataggaacaggcctctttttattggttacagcaggaatggcattggaaccaagatttttctgccgtttcttatgcccaatgggagcagtattttccctgatgccggtgttaccattttctgtaatcaaacgaaacagagaaaactgtattccaaactgtaaagcgtgtaatttagtatgtccggcaaaccttgagataccatcggataaagaaggggataatgcgacatccggtgaatgtttctcctgtggaaaatgtatcggaaaatgcccaaaacaaaacacacataatggtcttccaggaaggttatggttaccaatgcttgtaggaaaggctgtgatattattcgtgatatttagaatattgtattaaaaacttttccagattttgtctatcagataaattattatatcaaaaatcctttttcgtgttataatggacggtaattgctgtatattgctaccctcataagaaaggagtattttttgaataaagcaaatttaattatagaagaagtaaataaagtaattattggtaaagaaaaggtcatccgtaaggtgtggatgacgattctctctggtggacatgttttgcttgaggatgtacccggtgtgggaaagacaacgatggcgctggctttttcaaaggctttgggactttcctatcgaagaatacagtttacaccggacgttatgccatcggatgtggtcggtttctactattataataaggaaagtgggaagtttgaataccgtcagggagcagttatgacgaaccttctgttggcagatgaaattaaccgtacttcaagtagaacgcagtcagcacttttggaggttatggaagaaggacaggtaacggtagatggtgtgacaagaaatataccggaaccattttttgttattgcaacgcaaaatccgcttggttctgcgggtacgcagatgcttccagagtcacagatggatcgttttatggttcttttatctatgggatatccaacaataaaggaagaaatgattcttatgagtcagagaaaggtgagtgatcctttagatgatgtgaatgaagttatctcaaaggaagaattactttctatgcaaaaggaagtgaatgagattaaggtttcctcgttaatctatcagtatattgcaatgctttctgatgcgacacgaagacatgatatgattcagctgggtgtcagcccaagaggatccctggccttatgcagaatggcaaaagcaagtgcatttttggctggcagagattatgttgtgccggaagatgttcaggatgttgtaaaagatgttttccgtcatcgtctggtattaaagtcaagagcaaggttatcgagtaaagatgcggataagattatggatgaaatctgtgccactgtacatgtgccggatcgaagagcggcaggaggaagaagatgacccgaaaaagattatggatgaatcgaattagcgggattgtctgtctgttactgtggattgcattcattatttttctttctggaacaacagggaagattgccgggatggcattaggaattatgttgctggtggctgtcatttataatctttatcttccaaaagaagtttctactcatctgattattcctgcctacgcacaaaaggaagaaaaaattaccggacgactttgtatcagcaatacaggagtgttccctgttttatctgggaaagtttttttacaggtaaggaagacaatcagtggggaacaggaaatgttttctatgaatatcagggcagcgggacgaaaaaatggtgtggctgcctttgttatagattcggaatatatgggatttttgaaaatcacgattttaaaggtggagctgtacagcttttttggatgtatgaaaaaggtaacatatataaatcaggagaaggtggtaatggttctgccacaaacaacggaactgcattttccagtacaaaacagcggagttgcctgttctttttttgatgaggagcaaagtggtaaaaagggaaatggtccgggagaatattttggaatccgtccgtatgttgatggggatcctatgaaactgattcattggaaactgacaggaaaaacagatgaatatatggtaaaagaagtggaagtgccgatgatgcggatgcctcttatttttctggaaacaagggtagagaagcaggatgccgctatgattgatgggctgttagaagcatttttttctatttcacagcatatggcacaggagcggcagaagcattgcctttgctggtgggataaaaagaccgatgggtggaatttttacagtgtggaaaatgtagtgcagttggaagaagtgtatgcccatgtatttcaaagtatgtttttttctcaggggaatgcaacgatagattcttttgaaaaagaaagaaaagaacagttttcagaagtgatttatattacagagtattggaaagagaaagaggcagttttcgatgactggaacctgactttattattagaacgacgggaagcaagaaaagaagaaggggaagctttcgtaccgtatattttttcggtagaaaccctgggagaagatatcgatcggattttgacagcgtacaggagtgcagattatggagcataaaaattcatttcacattaaaaaattgaatcatcagagtggatttggctgggcagaaatgatgcgggccgggtatgtgtggcttgctgcgctgttatgttttatctggtatgctactggtcgttttgaaatgtatacagcaggtgttgttctttttattgggacagccttttttatattgttgtatttcgttgggatatctgttggaaaaggttttgcggtttttataaccgttttgtatttttttgttccatttttcattctttctatagaaaatattcgaagagctttattgattttctcacgaacggtctttgattatctggcagactatgggcagagcaaaaatatttttcatcgtatacttcaaaatacatcggtagatatgcagacaggaaatgtggagtttttgccatttgttgtcggaatattggggataactttgtggcttattctttttatggcattgttgtggaaagtccagccttgtattttattttttaccgtagcaatctgttttgcttttccattttttgtatggggagtccggccagaattgtttgcagtgttaagctttcttattttttgtttctttttctttgctccgtctttctggggaggggtacttggaacttcaattcttattattttgctttttttaggaactttctcaggaatgacaaataccggacagatgtcggcaattcaaaagaagtggaataaagaacgatataaagaagatgtatctgttcttccggaaggtcagcttacaaaggcaaagaagatgaagcggacagataaagaggctcttaaagtaaatatttataagaaaaacagttattatctgaaaggatttgttggaacaacttatgagaataattgttggaaagcaagtacaaataactggaatatttttggttcagacaggagtatgcttgcagcttctgaccgggaggcatacgaatctttattatggcttcataataaagaattttacggaaacacagtaatgtatcattttgtaaggcagaaaaagctttcggaaggaaaaacggacccgtctatttacagtttatctgtaaaaaatgtaggggcgaatcgaaagtatctttatcttccttatgagagtgctgttttaccaacgatatatgaagaggaagggaaggcagcggtcaataaaactgagaatatattcgcttccggaataaaaggagcaggagaatattcttttaaagcaatggaaacaatggctggaaagttgaaatcgtctaccaatattaagatggaggataagaatctttcctcaaaaaaaatgacggaaagctataaagaatatgtaaatgcaacgtgcctgttcttaaataaagaaacaaaaacattgatttcttctgcaacagaaggaagtcttcaaagtaatctgtcggtattagcaattataaacagggtaaaaagctttatgaagacatcgattacctataatgaaaatccaggaagtatcccggaagatgaagactttgcccaatggttttttgaagataaaaaaacaggatacgatgtgcagtatgcggcggcagcagtaatgatgtttcgttattatggaattccatcccgttatgtggaaggataccttcttacaccggaaacagtaaaagaggcaggaacggcagagacggtgacagtttcacaaaaatacgcgcatgcatggccggaaatttatctggatggaatgggatggattccggtagaagttactcccaaatatgaaaacgttatgggaacaccgtattacgagatacaggaaactgcggtaagtaattcaagttcgtcagatcaatctttagaaaatgacgataagaagaaacaagaaaaacagcaggaacaaaaaacgcaggaaaaagaacagacaacagaaaagaaatcagaaaagaaaacagtagaaacaccgcagcatattccgcaggatcactcaaagcaaggtaaaggtggaggaacggttcataaaattctgtatattctatgtttctttattttcatagcaggtcttctgctttttgtgtttagaaaacgactgcaaaaagtatatcgaaattataaaacagataaacttttaaaacagcaaaagtatagtcaggcagtcatgttctggtatgatattttgtgtaaaacaatatatggcaaagaaaaaataagagataatcgtgtaagaacctttgaaaaaagacttcgtacctttgacagagaagtggaaccgaaaaagttacatctttgtatgaagattcgtcagaaagcggtgtattcaccagaaggaatcacgagaaaagaagcagaagccacagtacattttctgaaaaaagagtgtgaaaaactgaaataaaggtattttaagtttcgtttctattgacagagaaaactatagcgattagaatattttcatagttagatttaaattaagtgaggataaaatatgtggttagcagataactggaaagaatatgaagtaatagattgcagcgagggagagaagttggagcgctggggtaaatacacccttcttcgtccggatcctcaggtaatctggaacacaaagaaggaagataagcattggaagcatttgaatgcacattatcacagaagtaagaaaggcggcggagagtgggagtttttcgatcttccaaaacagtgggatattcattacagaagtcttacttttcacttgaaaccatttagcttcaaacatacaggactgttcccggaacaggctgtgaactgggattggttttctaataagattaaaaaagcagaccgcccggtcaaggtactgaatttatttgcctatacaggtggagcgacattagcagctgcagcagcaggtgcttccgtcactcatgtagatgcctccaaaggaatggttacatgggcaaaagagaacgcagtggcatccggtcttggagatgcaccaattcgatggcttgtggatgattgtgtgaagtttgtagaaagagagattcgtcgaggcaatcattatgatggaatcattatggatccaccatcttatggaagaggtccgaagggagaaatctggaagattgaagagaagatttattctttagtatgtctttgtgagaagcttctttctaaagatccactcttctttttaattaattcttatacaacaggattacagcctgcggttctttcttatatgttaggaagtgccattgctaaaaagcatggcggaaaagttagtgcagatgaggtcgggcttcctgttagtgcaagtggacttgttcttccatgcggtgcttccggacgatgggaaaaggaatagatgggagatagcatatgagtgccaaaaagacagctttttatggaatgtttcttgcacttgccttagtagccggatatattgagcagcttatacctgttaatcttggagttccgggagtgaagctgggacttgccaacatcgttacaatgcttcttctttatatagcaggagtaccggcagcctgccttatttccgcacttagaatcctattatccgggttcctctttggaagcggattcgcaatggtatacagtgcggcaggagcggcgatgagtatgcttgttatggcatttttgaagaaaacaaagaagttttcttctgtaggagtgagcgtagcaggaggcatttttcataatgtaggccagatcatagtcgccatgcttgtattagaaacaaaggcattagcatattatctgccaattttaattctttcaggacttgcagcgggaatcttaatcggaatcttaagcgggatattaacaaagagattaaatccgataatcaagcagcattttgtataaacagacgaaaactctaaacatcttattttgacagctgctctatagtcgctacgtgttgaatgttcgctttcgcgctcacatccagcacttgctccgaagccgcatctgccaagataagatgtttagagttcttttgtttatagaaatactggagaatagtagatttaatttcttcgggagagaaaattgatttgtataatattctatataaggagatttatagtttttgttttggggatgctaaaggaatgtggagtaaattaaattacttttagagcaagtaggagatgaaaatacaaatcctctttcttcttcagagatagaaatcgaatatggaatattgccacttttgagcaataccgaatttttatcctctctggcatttccgaaaacagaaactaagctaatagatatatggcagatgtgactttggagcaagttcataatgcgggcgagcattatgagcgcagtgatacagaacagctgccatatatctattagcttagtttcgtctgttgaatgacgagataaaggaggaaacacaaatggaaattacatacgattactatcgcatattctattatgcggctaaatataagagcttttcaaaggcggcagagattctgatgagcaaccagccaaatattacgcattttatgaataatctggagaatcagcttggctgtcgtttgtttattcgttcaaatagaggagtaacacttacaagagaaggggagaagctatacaagcatgtaacaattgcatatcagcattttcaactggcagagttagaactggcgaatgataaaagtctgcagagtggaatcataaccgttggtgtaagtgagattgcattacatttgctgatcttacaggtaatggcagactttcgaaaagcatatccgggtattcgcatccgcctttccaatcattctacgccggagacgattcaggaagtaaaagatggtctggttgatctggcagtagtatctacaccggccgatatccctgctacattaaaatctacgtctttgatggatttttcagatgtaatggtagtgagcagctcgcataaagaattatgtgagaagccgatacatctttcaaagatgcaggattatccactcatttgtcttgggagaggaacaaagtcatatgagtttttcagtaatttttatcaaagatatggtttaaagttaaatccagatattgaagccggaacaattcatcagattcttccgatggttgtctatgatcttggagtaggttttttaccagaaaatgtaggtatagaagccttagaagatgggaaaataataaaagtaccccttatagagaagattcctcaaagacagatctgtctggtagaatcaaaaagaacaccgcttagtatcgcggcaaatgcattaaaacaattcataaataattatattgaaacgaaattgtaagacaatttgtaaatatattttctttttttcttaaatattctttagtaattccgactgttttctgaaaagatttctcatattcatacaaatcgttttgttaaattgaataaaaaaacagtatttatatgagaaatctttgtactatgtaaaaattacatgatgggtaaaaaaataaaacatttccacgataacaaaaagaggggtagaatgtgtagcaatggttcagggcgaacaatttcttcctattaaatagggttacaaagagtatgttcaccaatataagaatcaggaaggagtgtggcagatggatgctctggtcaatgaactgatgaaagagttgaattgcgacactgtctttacgattccggtactcggaggaatcccggttaaagaatctgtagtagtaacatggatcatcatggcggtcattctggtactttgtatagcgttaaccagaaatttaagcgtagaaaatccaggtcgtggacagatcatactggaaacaatcgtaagcggcggacacaatttcttcaaggacacactgggagaacatggagcggaatatattccatatcttatgacagtgaccctctacatcggtattgccaatcttatcggactgcttggttttaaaccaccgacaaaggacatgaacgtgacggcggcattagcatttatgagtattgtcttaattgaagtagccggcatcagacaaaaaggagcaaaaggatgggtaaagagctttgcggaaccaattccaattatcttgccgatcaatattatggagatttttattaaaccattatctctgtgcatgcgactttttggtaacgtacttggttctttcgttatcatggaattattaaagttaatcgttccggcagtattaccggcagtgtttagctgttactttgatatttttgatggtttgattcaggcctacgtatttgtattccttacatcgttgtttattaaggaagcgacagaataagaaaacaacaaaaaatttaaagagaaaagaaaaggagtgttgtaattatgtcatcagcattatttgtagcaattggagcaggagttgcagtattaacaggtattggagcaggtatcggtatcggtaaagctaccgcagccgcaacagatgcgatcgctagacagccggaagcagaaagtaagatcagtaaagcattattacttggttgtgcgttagcagaggcaacagctatttacggtttcgttatcgcgttattaatcatccttttccttaaataatagaatatataaacatcaggaaaaagaaaggcggacgaagaatatgcttaatatagatccatggaatatggtaatgattgtaataaatcttcttgtattatatgcgatttttcgaaagttcttatacaagccggttatgaatgtgattcatcagagagaagaattgattcagggacagtttgattctgcaaaaaagacacaggatgatgctcttgcgttaaaagctgattatgaagaaaagttagagcaagcaaatgtaaaagcagatcagatcattcttgcagcaagagatcaggcaaaagaagagcatgagaatgcgatacttgagacgcaggctaagacggacagaatgattgagaaagcaaaagcagatatcgaaaaagaacagaaacaggcacagcaggaagtgcagggtgagattgcgaagcttgcacttatcgccgcaagaaagattatagagacaggtgaggcccatgacgcagaaggcagtaaataatgcgaaagtattataccggctgaatgttttaagaagtgatgtggaacaagcccataaaattttcaagaaggtccctttccttcttgaaacactgacaaatccagttgtttccgaggaagtgaaggaggcagtgcttgacaagatagtaagacagtgtgaattgccggatcttcttggaaattttatgaagatgatgtgccggattggtgaaatcgggcagattacagatatttttaactgctattataaatactgggatgaaaggaatcacattctccatgcggaggttatttacgcagatgaggagacaaagaaagaaaaagcatccattttaaagcagttagaaagcatttatccgaaagaaaaaatcgttctttcagaaaagacagatgcttcccttcttggcggctatgtcgttcatgttggctatgaagagtacgaccacagttatgaaggaaaactcagacggttagaaagaaaattaacagggaggtgaatcttgtgggcgcaatcagtgcagaagatataatctctattatacagagtgaaatcgaaaattttgatgtggacaacacaagtgaagagacaggtacggtcatatatgtaggtgacggaatcgttacggtttacggtattgaccatgcgatgtacggtgaggttgtcgtttttgataatggagtaaaaggaatggttcaggatatccgtcagaatgagattggtgtaatcctttttggacgtgataccggaatcaaagaaggaacaaaagtagtaagaacaaagaaaaaagcaggtattcctgtaggtgatgagtatatcggaagagtaatcaatgcattaggtgagccgattgacggcggtgccgagattaaagcagatggctatcgcccgattgaagaagaagcacctggaattattgatagaaagtctgtaaatactccaatggaaacaggtattctttctatcgactctatgtttcctatcggacgtggacagcgtgagttaatcatcggtgaccgtcagacaggtaaaacttctattgcaacagatacgatccttaaccagaaaggaaaaggagttatctgtatttacgttgcaatcggacagaaggcatctagtgttgctaagattgtaaatactttagaaaaatacgatgcaatggattattctatcgtattatcttctacagccagtgaacctgcatctctgcagtacattgcaccatatgcaggtaccgcattagcagaatattttatgcatcagggaaaagatgtgctgatcgtatatgatgatttatcaaaacatgcggtagcatatcgtgcaatatctcttttgttagagcgttcaccgggacgtgaggcttatcctggagatgtattctacttacattccagactgttagagcgttccagtcgtcttagtgataaactgggaggaggttctattacagcacttccaatcattgagacacaggcaggtgatgtatctgcctacattcctacaaacgtaatttctattacagacggacagattttcttagagagtaatctgttcttcgaaggtatgcggccggcggtaaacgttggtttatccgtatcccgtgtaggtggagcagcacagacaaaagcaatgaagaaggcatgcggaagtattcgtattgatttggcacagtatcgagagatggaagtatttactcagttctcatcagatcttgatgatgcaacaaaggcacagttagcacatggtcgtgctattatggaactgttaaagcagccattatgtcatccgttatccttacatgaacaggttattacgttatgtctcgcaaataatggtatctttgatatcgttatgccaaaagaagtaaagaaatatcagaaggatattctctcttatcttgatctcaaacatccggaaatcggaaaagaaatcgaggaaaagaaagatttatctgacgaactggttaaaaagatcatagaagcagcaaaggaatacactgataaataacaggcaggtgttggtatggcaagtgcaaaagaaattcaggacaggatgcgaagcatcaaagatacattgaagattacaaatgcaatgtatatgatttcttcctccaaactgaaaaaatcaaaaaaaatgttagcggacacagagccgtatttctatacccttcagtctgaaatgagccgaatcttaagacatcttccagatatgaacagcatttattttaagacaaatgcagagattccggaaagaaaaagaaaagccggctatatcgtcattacagcagataagggactggctggttcttataatcataatattttaaaaattgcagaagaagaacttgcaaaaagagacgattataaactgtttgttctcggtgagttaggccggcattactttgaacagaaaggaattaatattgataagcagttccattttgttgttcaggatccatccttaagccgtgctagaagaattgctgaggatttattaaagctttaccatacaaatgaacttgatgaactttacattatatatacaactatggtaaatgcaatgcaggaggaggcacaggttgcacagctcctgccgctgaaaaaagcagattttaagattccggttccgattgatattccattagagggacttgcattaaaaccttctgctgaagaggttatggatcacatcgttccaaactatgtagtaggttttgtgtatggtgcattggtagaagcattttcctgtgagcaaaatgccagaatgatggcgatggaaggtgcgacaaacagtgcgaaacaaatgttaaaggaactggatattgaatataacagagccagacaggctgcgattacgcaggagattaccgaggtaatagccggagcgaagtcgcagaagaaaaagaaaaaatgaaaagcggaaataatataaggaggcttttttgatgaaaacaggaaaaattattcaggttcttggacctgtagtcgatgttgaatttgaaaatcaagaattgcctgcaatcagagatgctctcgaagtacaaaatggagataaaaaatgtgtgatggaagttgcacagcatatcggtaatcacgttgtaagatgtattatgctggcagcgagtgaaggtcttcacagagatatggaagttactgctgagggaagcggtatcaaagtacctgttggagagaaaacattaggccgtctctttaacgtactcggtgaaacgattgatgacggagagccgattaaagacgctccaaagatggtaattcacagagaacctccgacattcgaagaacagaacccggcagtagagattcttgaaaccggaattaaagttatcgaccttcttgcgccatatgcaaaaggtggtaagattggtctgttcggtggtgccggtgtaggtaagaccgtactgattcaggaattgatcagtaatatcgcaacagaacatggtggatattctatctttaccggtgtaggagagcgttctagagagggtaatgacctttggacagaaatgggagaatccggagttcttgcgaagacagccttagtatttggacagatgaatgaacccccgggagctcgtatgagagtagcagaaaccggactgactatggcagaatatttcagagatgaaaagaaacaggacgtgttattattcattgataacattttccgttttacacaggcaggttccgaggtatccgccttacttggacgtatgccttccgccgttggttatcagccaacattagcaacagaaatgggtgaattacaggagcgaatcgcttctacaaagaacggttccgtaacaagtgtgcaggccgtatatgtaccagccgatgacttaactgacccggctcctgcaacaacatttgctcacttagatgcaacaactgtactttcaagaaagattgtagaacagggtatttatcctgccgttgacccacttgaatcctcatcccgtatccttgaggcagatatcgtaggagaagaacactacgaagtagccagaaaagtacaggaagcattacagaaatacaaagaattacaggatatcatcgctattcttggtatggaagaattatctgacgaagataagacagtcgtattcagagcaagaaagattcagaaattcctttcccagccattccatgtagcagagaactttaccggtatcaaaggtgtttatgtaccagtaaaagaaactattcgtggattcaaggcaatccttgacggtgagatggacgaatatccggaaaatgcattcttcaacgtcggaacaatcgaggacgtaaagaaaaaagctgaggaaatgaaagcagcaaactaggaggggtagatatggcttcaaatacatttagtttaaaaatcatatccgccaatcgtgtattttttacaggaagatgccagtctattatcgttccgggatatgacggacaaaaagaagtactggcacatcatgaaaacatggttattgctgtcaatgaaggagagatgcgtttccttccagaagaggaaagcgaatggcagtatgccgtagtcggcatcggtttcatcgaaatcattaataaccgagtcacccttctcgtagaaagcgtggaacgcccagaagaaatcgacattgcaagagcacaggaagcaaaagagagagctttggaaaaaatacgtcagaaacagagtattcaggagtattatcatacacaggcttccctttcccgtgcgatggcgagacttcgggttggtcatagacagaaacatgtttaggatgctttagaaagctgacgaaagacagacgaaaatcgaataaagttcatatatcggtgcgataattcgcttcgttggtatgtaagagaaaaagattaaaagcaaaaaagaggtttgtatactcttgtgctgaacattccattctgcctcaaaaagcagaaacttcggagaaagcagtccgaagtttccagagtcagaattccatagcacaaaggcataaaacctcttttttgcttttaatctttttctatttataagtattgagcgaatcatctgcgtagagagttgggttcgattttctgtgtattttaaagtatttctggttatgttgggttatacagaaccactccttcttaaaataaagtttacaaaattcttgacaggatatagaaaaatagatattgtagaaatataatactgaataggatgatattttagatattcatagaggggtggttgcaaaatgaaaagaaggtatagttgtattgcgataattttaataatgtgtattttatcagcctgtcataataaaaaagaggaaagtgtttctacatccgtaaatgatacaggtgttactacagaagcctcaaatgatatttcggatgaaactagaaaattgttagaacttggagaatatgatgatatagaattaaaaggggatagtagggatgttgtttctatagtaaaaaatgatcaaagatttctttttccagagtgtaaggtgctttctgtaacatatagtactttttctgaagatgatacttttctgtctttaaataaaaaagaggttcttgaattgataaatctgattgaagaaagtcctattttaaaagatggcgattcgctcagcaattatggtgttaaggatgatacgcaggagaaatatgcaaaaatctgtattgtctataaaaatagtcgtggagaagtgcagaatgtatggctggatacttttaaaggaaatatactgcatttttatgattctcagggacaagattatcgaataggaccgaataagaaactcgtaaattttattataaagcacactggttatagagtattatctacaacagattttaataagattgagagaatcgtagtaaaatacaataatgaggaatatcagctttctgcaaagaaaacagaacagtttataaaggcagttaaaaaacttgataaaagacaagacgagttccacgattacaatcttacagcactggcttacacatcagatggggatgtgtatcatattaaagcaggactaggagaatattccgagaacgatattgctatagagggagcatgttatgaagaagcagaaaatgtgatatgcttattggagaaataggggtacctatctattatgaaaacgagagaacgttaggcttgcgctcgcttctatatgattgccaaacctaacggtctactattaatattactgataatactactgactcattctatttcttatttcttacagaaaaacgtcagtgatttctgttttgtcagattatcttcattctttgctcacaacctgttcacaaatctacagtatgataaaaccatcaaaaacaacaacagatttttgatagattttttcatactttcctctctttagaagccggcgttatgtcggtttctttttttaagattggaatggcttactcattctcaatgatttcctgtatctcatctagttccatatctaataaatcacttatctgcgctggttcatacccttttcggtacatcttaattatagtctcggcaattccttcttgttttccaatagtaattccttcttgttttccaatggcgattccattctcagtaccttccacatatgcctgttcttttattccctgactcagattacacatatcattcacatcctttctgatatcactttccaatggaatatcaaattcatttcctataatatctaatttcgtatttacatccagtttagcagataataatgctccaagtaaacgatgaagttcatatttttcttctttttctggaagatcttctgccaaaccaatcaaaacaatatttgcaaggtctatgtcacctttccattgataagtaccgacaacactttcctgtgtaaaatgaatataattcatacagttttgagacatattcatacaaagccatatggaatatactcgttttatatcattataattggactttataaactctctacccttctgcgaagaaatcatcctgctgacatagaacactgctctatttattatatcatatgccgatggttctgctttctgtgcttctatattcacaataacctgtgataaaccatctttcattcgtacatagaatataatatcaaaccgtaccagtccttcattaagctcgctgttttctgtatttaatccaattactttttctccgtcttgttctttttctacatttgtgcttcctgcatctaccggaactgtgctaatatatggttctccttcaatatactgcacgacatctttcggattcattcccttaaattcgccaatcgtctttacaagtatatgtgcaagtataattttatgccccaatagattctttgccttttcatcatattgtgcatctttatcggtcgctgatattgattttttaatatctttgtccacagatacgctcctttctgctacaatgaaaatatcttattttgtcactttcattatagctcatgctatatcttcatagcaaatactttttcttatttatttactaatattttccttctatagatatttttttgtatagtttcacaaatataggatatcttctttcttggggagcgtcagctttgcctggactaacttattatttaatgcaaaggactttacctgttattaaatcgagtatataatacaaaaaagtacagttggaattttgatttcctcacaaaatcagatagaaaaaacagggagaaaaatacaatgaaatggatgattgcatcagatatacatggttccgcattttactgcgagaagatgcttaaggcatttaaaagagaacaggcagataaattacttttgttaggggacattctctatcatggaccacgaaatgacctgccagaaggatatgcaccaaaaaaagtaatagagatgcttaataatataaaagaaaagattctttgtgttcgtggaaactgtgatgcggaagtagaccagatggtattagaattcccgattatggcagactatgcgatgattacagaaggagatttgaatatctttgcaactcatggtcatcattttaatgaaaagaagctgccgccgatgtttgaaaagacacaggagggtttgatattattgcatgggcatacccatgttccagtatgcagagtacatgaaagttatacttacatgaatccaggttccgtatctattccaaaggaaaattcggaacatagttatatgatactggagactggagcgttctggtggaagacattagacggtgagacttaccttaattttaaaggaagtaagccggaaagagggtattgcagagaggagtatagatagtaatatcagatgtgagatattaatacaggacaggaggtgtgctgtgaaaagaaccgatcaatatctttatcttgcgaatggaagactccatcgttcactatttggtgcaatcaatgaaaaaggagaagttaaaattgtaaaagataatcaggtgttaactatgaagaaacaaattttatctattattatggcaggttgcctcctcttatctatgacagcctgttcttctgataagggaaatatgaaaccggcattcgaacaaacaacagcagatgcttctatagaaacttcctcgcctcaggaatatagcaaaactgacttcgtcatgagtaccgtattaagtgaaaaaatatacggaacaaaagatgttacccaagatataaaggaagaacttgataaacttgaaaaagatcagctttcgtggagggaggatcacagcgttgtttcaaagattaatgcagatgcacaaaaagggataaagacaaaactggattctgatatgacttcatgggtagaggattctttagaacttgcaaagcgaagtaacggagcatttgacccgacaatcggcagacttacaagattatggaacatagaaggggacaacccgaaagttccctcaaaacaggaaataaagaatactttagaagatacggggtatactaagatacatctggagaaagtagaatctcagaatacagcaaatacgaaaaagaacgtagataaagatataaaagataatacagctaaaaataaagaaacatccgaagatacaagccaaaataccaatacaaatgaaagtgtttcttctatatatataggggataaatgcactcttgatcttggagcggtaggaaaagggattgcctgtgatgtagtgcaggattatttaaaaaagcaaaaagaagtaggtggagcggttatcgctgttggaggtagcatccttttatatggaagcaaagcagacggaagcgactggaacgttgccgtacaaaacccaagaggacaagacggagaagcgatgggtgttctttctctttctggtacaacgaatgtttccacgtccggagattacgaaaagtattttatgcaggatggaaaaagatatcatcacatccttgacccgtcaactggatatccggcagacagcggattgatttccgtaacaatcgtaagcgatagcggcttgctctccgatggtctatctacagcctgttttgtcctcggcaaagaaaaaggccaaaaacttttagaaacctacggagccgaaggcatcttcatcgaccagaataaaaaagtcaccgttaccaaaggactcaaagataaatttacaatactgaatgaagaatataaacaatagagaaaatcaaaacagatgggattgtccccgggtatttagaacgaaacttcatgattcccgcatatcatgaagttttgtctctatgataaaaataattctttcgtcaatctgcacaaaaaacttcttgatataacttcaaaagttttttaaaaaagtacttgatttctcgggaaaatcgtgtataataaaaagcgttgtgtgacatgatagcgatgaagcgagaggttgctgtgatggaaaaatccattgcaggttttccgtggagcgaatgtcaagtttagaaactggcgacaagtcactgtacaataattacaatctacaaattcagcgtagagacgcagtgtgatatcttagatgatacacacggaggagtgtacagtcaccgcttgtcgtactagattaagtgcgaaaaggaggcgactttttttatggcaagtcaaattatgagaatcacgttgaaggcgtatgatcatcagttaatcgatgcatccgcaaagagcattatcgaaactgtaaagaaaacaggatctaaggtgagcggtccagtaccgatgccaactaagaaagaggtagttacaattcttagagcggttcacaaatacaaagattccagagagcagttcgagcagagaacacataagagattaattgatatcattacaccaacacagaagacagttgatgcattatcaagactcgaaatgccagcaggtgtttacatcgacatcaagatgaaacagaaataattttatgtcctatagctagtatgattatccagacggtaacgtaagacattttgagagggtaatccgctgtagactagaatgattgcatcagatgtttgaagcaatccgctgtagaaaattaggaggaagacgaaatgaagaaggctattttagcaacaaagatcggtatgactcagatcttcgcagaagatggtgaattaattccggttacagtattacaggctggaccttgtgaagtaacacaggttaaaacagttgagaatgacggctacagtgccgtacaggttggcttccaggatatgagagaaaagttatccacaaagccaatgaaaggacatttcgaaaaagcaggagtatctgttaagagattcgtcaaagaatttaaattagacgatgcagagaattacgaattaggtcagaaaatcacagttgatgtttttgaagctggtgataaagttgatgcaactgctatttcaaaaggtaaaggttttcagggagctatcaagagacatggacagcatacaggtcctaagacacatggttctaaataccatcgtcatgcaggatcaaacggtatggcatctgacccatctaaggtaatgaaaggcaagaagatgcctggacagatgggacatgtacagatcactatccagaatcttgaagtagttaaaatagatgcagaaaataatgttattttagtaaaaggatccgttccaggacctaagaagtctttagtaacattaaaagcagcagttaaagcgtaggcgcttaaggaaggaggacttacaaatggcatcagtatctgtttataatatggaaggtgctcaggttggtacaatcgaattaagcgattctatctttgcagtgcctgtgaatgaacatttagtacatcaggctgttgtagcacagcttgcaaataaacgccagggtactcagaaagctaaaacacgttctgaagtaagaggcggcggaagaaaaccatggagacagaaaggaacaggtcatgcaagacagggatctatccgtgctccacagtggacaggcggcggagttgtatttgctccaacaccaagagattattccgtaaagatgaataagaaagaaaaacagctcgcaatgaaatctgttttaacatctaaagttaatgagagcaaattcatcgtattagatgagttaaaattagctgagattaaaacaaaacagatcaaagcagttttagataatctcaaagttgagaaggctttaatcgtaacaaaagaaaaagacgatgttgtggttaagtcagctaacaacttacctaaagtagcaactactgcattaaacaacatcaacgtatacgatattcttaaatacgatacagttgttgttacaagcgaggcagttgcagcaatcgaggaggtatacgcataatggcagatttaaaatattatgacgtcatcttaaagccagttgttactgaaaaaagtatgactgctatgggcgaaaagaaatacacattttacgtaaatccagatgcaactaagactcaggttaaagaagcagttgagagaatgttcgagggtgctaaagttgctaaagttaacacaatgaacttaaaaggtaaaaagaaaagaagaggcatggtttacggaagaactgctgccaagaaaaaagccattgttcagttaacacaggatagcgcagatattcagatttttgaaggtctgtaagatttaaagataacaggaaattatacgcataaaagcgtgatatcaaatattcggaaacgaaaggagtgaaagtaatgggaatcaaaacttataacccatatacaccttccagaagacatatgaccggatctgatttttcagagatcacaaagaaaagtcctgagaaatctctcacttattctttaaagaagaattccggccgtaacaaccagggtaaaatcacagttagacatcgtggcggcggtgctaagaagaaatatagattaatcgatttcaagagaaataaagatggtattccagcaaaagttgttgctatcgagtacgatccaaacagaacagcaaacattgctttaatctgttacgtagatggacagaagtcctacattattgcacctaataaattagaggttggcacaacaatcatgaacggtccagacgctgaaattcatattggaaactgccttccacttgagaacatcccagttggtacagaaattcacaacatcgagatgcatcctggaaaaggagctcagttagttcgttccgctggtaactccgcacagcttatggctaaggaaggaaaatatgcaacattaagacttccatccggagaaatgagaatggttcctctgaactgtcgtgctacaatcggccaggttggaaacattgaacatgacctgatcaacattggtaaagcaggacgtaaacgtcacatgggaatccgtcctacagttcgtggttctgttatgaaccctaacgaccatccacatggtggtggagaaggtaaagctagtatcggtcgtccaggtccatgtactccatggggtaaaccggcactcggcttaaagaccagaaagaaaaacaagcagtctaacaaattgattgtaagaacaagagacggaaagaacgttaaataattaaggaggtaactcatggctcgttcattaaaaaaaggaccatttgctgatgcaagtttattaaaaaaagtagatgcgatgaatcagtccggcgacaagagtgttattaaaacatggtcccgccgttctactatcttcccatccttcgtaggtcataccttcgcagttcatgatggaagaagacatgtacctgtatatgttacagaagatatggttggacataaattaggagaattcgttgcaaccagaacatacagaggacatggaaaagacgaaaagaagagtaaagttagatagataacagcctgaaaggagggttcatccatggcaaaaggacatagatcccagattaaaagagagagaaatgcaaataaagataccagaccatctgctaagctttcttacgctagatgttctgtaacaaaagcatgtttcgtacttgatgccatcagaggtaaagatgttgaaacagctttaggaattttagaatataatccaagatacgcttcagaaatcattggaaagttattaaaatctgccattgcaaacgcagagaacaataatggcatgaatagagagaacctttatgtagcagagtgttacgcagataaaggacctacaatgaagagaatacagcctagagcacagggccgtgcttacagaatcgaaaagagacagtgccatattactgttgttctggatgaaagataaggaggtttacaatgggacagaaagttaatcctcatggtttaagagtcggaatcatcaaggattgggattcaagatggtatgcagaaaaagatttcgcagataatcttgttgaagatgataaaatcagaaaatatattaaaaaacgtttatacagcgcaggaatttctagaacagaaatcgaacgtgcttccgatcgtgtaaagatcattattcatacagcaaaaccgggtatcgttattggacgtggcggttctgcaatcgatgagttaaagaaagagcttgaaaagcttacaggaaagaaactcatcatcgaaatcaaagaagttaagagatttgatgtagataaagatgctcagttagtagctgagaacatcgcacagcagttagagaatcgtatttccttccgtcgtgcaatgaaatcctgtatgcagagaactatgagaaacggtgcattaggtattaagacatcttgttccggacgtttaggtggagcagatatggcccgtacagagttctacagcgagggaacaattccactgcagacacttagagcaaatattgattatggtttcgctgaagctaacacaacttacggaaaagttggtgtaaaagtttgggtataccatggtgaagtacttcctacaaaggaaactaaggaagggagcgataaataatgttaatgcctaaaagagtaaaacgtcgtaaacagttccgtggttccatggctggaaaagctacaagaggaacaactatcacttatggtgatttcggactggtagcttgtgatccatgttggattaaatccaaccagatcgaagcagcccgtgtagccatgactcgttatatgaagcgtggtggtaaagtttggatcaaaattttcccagataaaccggttacagcaaagcctgcagaaactcgtatgggttctggtaaaggttcactggaatattgggtagcagtagttaaaccaggtcgtgtaatgttcgaagttgctggagtacctgaagaaacagcgagagaagctttacgtcttgcaatgcataaattgccagtaaaatgtaaaatcgtatctcgtgcagatttagaaggcggtgataacagtgaaaacaactaagtatgtagaagatttaagagcaaaatccatcgcagaacttaatgaagaattagtagctgctaaaaaggaattatttaatttgagattccagaacgcaacaaatcagttagataacaccagcagaattaaagaagtcagaagaaatattgccagaatccagggaatcattgctgaacagaatagtgctgagtaatcgggaaggaggaatttgttgtggaaagaaaccttagaaaaactcgtgtaggtctcgtaacaagcgataaaatggataaaacaatcgttgtaaacgtaacagacaacgtaaaacatcctttatataacaagatcgtaaaaagaacttataaattaaaagctcatgacgaaaacaatgagtgtagaattggtgacagagtaaaagtaatggaaacaagacctttatctaaagataaaagatggagacttgttgaaatcgttgagaaggctaaatagttagcacggaaggagatatagtatgatccaacaggaatctagacttaaagttgctgataatactggagcaaaagaacttctttgtatccgtgttatgggtggctcaacaagaagatatgctaatatcggtgatactatcgttgctacagttaaagatgcaacaccaggcggtgttgtaaaaaaaggtgacgtagtaaaagccgtagttgtacgtaccaaaaaaggcgctcgtcgtaaagatggttcttacatcaaatttgacgaaaatgctgcagttatcatcaaagatgacctgaatccaagaggaacccgtatttttggaccagttgctagagaacttcgtgagaagaaattcatgaagattgtttccttagcaccggaagtattataaggaggtaactactgtggctcagaaaattaaaagaaatgacatggtaaaagttattgccggtaaagatattgataaagaaggaaaagttctttccgttgacgctaagaatcataaagttgttgtagaaggcatcaacatggctacaaaacatacaaaaccaagcatgcagaatcaggctggtggtattgttcaggaagaagcagcaatcgacgtatctaacgttatgctgctccacaatggacagcctacaagagttggtttcaaatttgtagatggaaagaaagtacgtttcgcaaaatcaactggcgaagtaatcgactaattcaagagaggaggctgaccgaagttgagtagactgaaagaacagtatgacagccagattaaggctgccatgatgaaaaaatttggctataaaaatgaaatgcagattccaaagctcgttaagatcgttgtaaacatgggtgttggtgatgcaaaagaaaatcataaattattagattctgcaatcggtgatatggaaaagatcacaggtcagaaagctgtagtttgtaaagcaaagaaatccgttgctaacttcaagttaagagaaggaatgcctatcggatgtaaagtaactttaagaggcgacaagatgtacgaattcgctgatcgtcttattaaccttgctttaccacgtgtacgtgactttagaggtgttaaccctaacgcatttgacggaagaggaaactacgctcttggtattaaagagcagttaatcttccctgaaatcgagtacgatcaggtagacaaagttagaggtatggatgttatcttcgttacaacagctcatactgatgaagaagctcgtgaattacttactttatttggaatgccgtacgcaaaatagttaggaggatttctaatggctaagaaagcaatgaaagttaaacagcagcgtaatcagaaattctcatctagagaatattctcgttgcaaaatttgtggccgcccacatgcttatttaagaaaatacggaatctgcagaatctgcttccgtgaattagcatataaaggtcagattcctggagttaaaaaagcaagctggtagaaatattaggaaggaggcagctaataatgacaatgagcgatccaattgcagatatgcttactagaattcgtaatgcaaatactgcaaaacacgatacagtagatgttcctgcatctaaaatgaaaatttccatcgctgatatccttttaaaagaaggatacatcaaaggttatgacatcatcgaggatggtgcattcaaaacaatccgtattgcattaaaatacggtgctgataagaatgaaagaattatttctggattaaagagaatctctaaaccaggacttcgagtatatgcagacgttgagaacatgccaaaagtacttggtggtttaggcgtagcaattatttccacaaataaaggtgttgttacagacaaagaagctcgttctatgaacgtaggtggagaggtattagcatttgtatggtagttcttcaacagagctactttacatctgatattatagatattttatactactgaaaacagaaaagacgcagtcttttccgacaatttaaggaggtgcgatatgtcacgaattggtagattaccagttgaaattcctgcaggtgttgaaatcactgttgcagagaacaacgttgtgactgtaaagggtcctaaaggaacactcacagagagtcttcctgtagagatggacattaaagttgaaaataatcaggtagttgttacaagacctaacgatttaaagaaaatgaaatctttacatggtcttacaagaactctggttgcaaatatggtaacaggtgttacaaagggatacgaaaaagttcttgaaatcaacggtgttggttacagagctcagaaacagggcaagaaacttattctttctcttggatattctcatcctgtagaaatggaagatccagaaggtcttgagtctgtattagacggacagaacaagattactatcaagggaatcgacaaacagaaagttggacagtacgcagctgaaatcagagaaaagagaaaaccagaaccttacaagggaaaaggtatcaagtatgctgatgaagtaatcagacgtaaagtcggcaagacaggtaagaaataattaggaggaagtaagaatgattaataaaaaatcaagaagtgaagttcgtgctaaaaaacatagaagacttcgtaaccgcatcagcggaactgcttctactccacgtttagccgtattcagaagcaacaatcatatgtatgctcagattatcgatgataccgttggaaaaactcttgtttcagcttctacagtacagaaagaagttaaggcagagcttgaaaaaacgaatgacgttgcagcagcagctcatttaggaacagtaattgctaagagagcaattgaaaaaggtatcacaacagttgtcttcgacagaggaggtttcatttaccagggtaagattcaggcactggcagatgcagcccgtgaagctggtcttaatttctaaacaaggaggatataacatgaagcgcgaattaattgatgctagtcaattagaattagaagaaacagtagtatcaatcaaacgtgttactaaggtagtaaaaggtggacgtaatatgcgtttcgctgctttagtagtagttggtgataaaaacggtcatgttggagctggtttaggtaaagcgattgaaattcctgaagctatccgtaagggaaaagaagacgctatgaagaaactggttaaggttcctgtaaatgaagtaggttccatcccacatgatttcattggaaaatttggaagtgcagaagttttattaaaagcatctccagaaggtaccggtatcatcgccggaggtccttctcgtgcggttcttgaacttgcaggatataagaatatccgttccaaagcattaggttctaacaataaacagaacgtagtacttgctacaatcgctggtcttaaagaaatcaagactccagaagaagttgcaagacttcgtggcaaatcagttgacgaactgtaaaaggaggaaagaaagatggcagataaattaaaaatcacattagttaagtctcctatcggtgctattcctaaacagagagcaactgtagaagcattaggacttaaaaaagtcaacaaaacagttgaaatgcctgacaacgatgctgtacgcggaatgatttggcatgttagacacttggtaaaagttgaagaaatttaattgcagataaggaggtacccgtaaatgaatttatctaatttacatcctgctgcaggttccaaacatagcgatgctttccgtgtaggtcgtggacatggttcaggaaacggaaagactgcaggcagaggacagaaaggtcagaaatctcgttctggcggaaaagttcgtgtaggttttgaaggtggacagatgcctttatacagaagacttcctaagagaggcttcacttgcatcaactcaaagaaaattatcgcaatcaatgtttccgaacttgaaagattcgaagcagatagcgttgtaacaatcgacactttaattgaaagtggtttagtaaaaaatacctttgatggtgttaaaattcttggaaatggagaattaagcaagaagcttacagttcaggttaacgcattctctaagagtgctgtagctaagattgaagctgctggcggaaaagctgaggtgatttaatgttcgaaactctcagaaatgctctgaaagtgaaggatattagaaagagactcctatttacattagtagttttagttatctgccgattgggcagtcagcttccaataccgggaattgacactgatacaatcagccagtatttaaactcattgttaggagattctttcaaccttttgaattcctttactggcggatcatttgaatctatgtcattgttcgcgttaaacgtaacaccatacatcacagcatccatcatcattcagctgcttaccattgccattccggcattggaagagctgtatcgtgatggcgaggacggacgtaaaaagattaacaatatcacaagatttgttacgcttgcactttccgttcttgaaagtgctggtctggcaattggctttggaaaacagggacttttgtcaaactatggtccgctgatcgtaatagagatgattgtctgcttaacagcaggttccgtctttgttatgtggctcggtgaacagattacagataaaggtgtaggaaatggtatttccattatccttctttgtaacattgtttcccgtatgccaagtgatttatttaatctgtaccagaaatttatggaaggtaaacagattagcaatgtaattattgccggagtaatcattttccttgttattcttggaacaattatttttacaattgttttaaatgatgcagagagaagaattcctgtgcagtattcaagaaaaatccagggtggaagccagcttggaggattaggatcaacattacctgtaaaagtaaatacagcaaacgtaatgccaattatcttttcatcttccctgttacagttcccactggtgatcaagcagctcgttggagctaatccaaagggcactgctggatttattttcaacgcgttaaatcagtctaactggtgtaatccagatcattggaactggtcaattggtttaatcatttacctgcttcttaacgtagtatttgcatatttctatacatcgattacttttaatcctttagaaatatctaataatatgaagaaacagggtggttatattccaggtgtacgtcctggtaaagcaaccgttgattatttaaattcaattttaacttatattatttttatcggtgcgattggtctttgtatcgttgcagtaattccgattttctttaacggattctttggtgcaaatgtctcctttggaggaacatctatcatcattatcgctggtgtagtattagagacaatgaaacagattgaatcccagacattagtacgtcagtataccggatttttaacagaataatatttgtatttttatatttaaaaacctgtgttgtttaatccatgattaaacaacacaggttttttgtttggaaaacaaaaacagacttctgtttgttggcaatcgaagcttttttaatttggagattagtatataataaacaggatgatgtgaatataacacagataagtgaggaaaatagatgaataaaagtgataccagaaagcattataactcatattttgtaatgtatacgatattatttgcggcgttgagtatactgtttttttatggattttggaaggcaaagttatcttttgtatggaatgtagatgggcggacgcagcatattcatgcattacagttttattcagattggctacaacagatagcaaaaaatattctttttaagcataagttagagattccattatggagtttctctattggatacggaagtgacattattacaacgcttcattattatgtaataggagatccgctttgtttattatccatatttgttccagacagatatatggttcatttttatgatatcatgatattgttccgtgtgtatcttgctggattatccttttcagtctattgcttttacagaaaacaaaataataggatagcggtaattacaggagcattattatatgctttttcaatgtatatattagttatgggatttcatcatcctttctttataaatccactgatttattttccattattattaattggtatagaaagaattttggaagaaaaatccccgatattttttattttaatggtatttatatgcacaataagtaatttttattttatgtatatgattgcgttgaatgcagcaatttatctttttattcgtttatttagcatatatggagtaaaaaatatcaggatcttattaaaaaagcttggctgcatgataattggtgcgattgtcggtgtaatgatgggtgcatgcatattgcttcctgtaatcagtttatttatggaaaatagccgagatggttcagggcaaagatttcaactattatatgaagaagaattttacaaaaagttacccgaagtatttataacaggaacgcagggaatgcatcatacgatgttaggcatatgcggtatcgtattgtttagcgtttgtttattattcatgaagcgaaaggaaaatgcggaacttaaaattaattttataatattaacaatatttctgttcacaccaattgctggaaagatttttaatggatttgcctatccatcaaatcgatggatgttcagttatgttttgttgttaagctatattgttgtagttatgtgggatgaattgtctcatatgagctggaaaagttttattggaacttgtattgtttcagtagttatctgtacatataatttttataatttcagcgcagattttgaaggagaactgcgtgaatatatctatttactttgtgttggattaattatattggcaataggtaatattttattaaaaaaatacagaggattttcatatattatgcagatttctatgtttattctggctattataactgtgcagttaaatgtaaaaaaagtatttcataatacagatttagcaaatacagaatttgtggaaatggaaaaggcaagaaaggatttaaaaagttctgcggataaagcgatagaaaaagcaacggcagatgataaagacttctttcgctacgatgcaaaagcagaattgatagagagaaattctacattacaaagtagcttacattctactaatttttactggagtcttaccggtaagttaccatcacagctttttgaagagacaggattaaccaataaaggagcttacaattataagaatttagatggaagaacaactttaaatgctttggctgctacaaaatattatgtaacaaagacagaaaagaatggaaaatatagtgttccttttggctacaaaaaaatagcgaattataacattaaaatgacaaataaaataaagaaatgtacagtatttaaaaatgaatatgtccttccattgggatatacatatgacagttattataccagaactgattacgaacagatgaacgaaatggagagacaaaatgcattgctacagggaatattattagaaaaagagcaaaaaggttattccaaagcaggtttaaaaaagcattccggcaatgtatgttctaaaacagatataaagcaaacgtattcagaaattccttataagattgtacaacataataatgtggacaaaaaagcaaatatttttaaagtaaaaagtgatgacgcgagcattgttttagaaaccagtaaagcgataacgaacagtgaagtcagtttgttcataggcgatatatctggtccgaaagcgaatagagttgcggatgacgatagtataggttcaaaatatactgttattgtagaaaattcgacaggagagaagaacaaaaaagaattcttttattttcagccaggaaatatatattatgcaggtcgaaatcattttctcataaatctttcttattataaaaaaggaaaacagacgataactttaaagtttccacaaaaaggaaattataaaattgaagatttaaaagtgtatgctcagcctatggatcagtatttccaacaaatttccgcattaaaagaaaatgtgctaaaaaacataaaaatggacacaaatacgattcagggaaatattaacttgaagaaagacaagattctttgtttagctgttccatattcgaaaggctggaaagctactgtagatggaaaagaacaggagctactccaggctaatacaatgtatatggcattaccactttcagaaggtaatcatagtgttattttaaaatactgtactccaggattaaaagcaggaattgcgatatcctttgctgggctgatactttgtatcataataaagttactattgcattcattccttctggagctaaaacacagaaaaaagaaataaggccatatcccagatacggcttcggagcgtgtttaagatgcggatgagcatcttaaacacagcgactacagagcagatgtgatatggccttatttcttttttcgtctgttttcccctaatgaatcaaatagtaacaaactccattttgtgttttatgtagactgggatatgtttttttcgtaaagcccggataatgggataggtaatgagaagctctccttctatataaactgcatcaggtttatattttaaaatccctttcacataatcctttatataagatttaaagtcggctttttccattgcgatttcgccaaagtttccgtcatatgtgagttcgggtatttctggcaggtcaagttgaatgactgttgcatttttcatatgaggcatttctgtaaggaaagcatttatgttggaagaagcacccaaatttataatgcagaagttttcggtaaagtgttcaaggcttattttgcaggcggagattgcatcgtttaaatggtcggtagtcataatgaatccacctttatggcagaagttagcactgtttaagccagtttctgtctggagttcttttccttctaagccaagccagctttccgggaagctgcatttataatttagggaatgctttctttttagtggctggatacagtagccgccacgatttgatggaaagatgataaaagcaatttctgtgtcacgtaattgtttttgacatgggataaattctggaagagtaaggatttttgcttcaacaggtgactttttcccagataagacagaggattcttgtgtagttaaaatttcttcaatacgtttttctgctcgttcatttcccttatatttttcaaatgtattgacaaggatcatcccggcagtttgtacagcttttaaaaatgcttcattttcaccgtgttcgatatcccaggaaggattaaagttcccgattaatgtagcaagttcatttttttcgccggtgttatcgttgttatcaagtggctggatgaatgactcatcgaactttgcagcaagttcttcgccaagaatttctttgccaagttcttcccagagaagtccgaatgctgcataaggtattccattttcgcggatgcggctatctttttggtgatggtcgtattttcccctgccaatatcaaaaacgattccatcaaaatcttttggaactttatttcctcgggtaattgtgattgcaggatttaaatataacaacagtgcataggagaaaacatcgtctgcatgaaattttccactatgtgtaaaagcttttgcatttttctttttaatttgttctaatagagtattcataaaattcacctcagaattttttttgttttagtcaagaagctgcttaatcttcagtatcagtataatagtatagcataaagttatagcagaattatacaaaaaaatacaaaatatatcccccaggggagcttgtgagaaaaaatagaaaggtatatcctaggtttagaacataaaagctttataggaggaaagaaagatgcatatacctgaaaattatttgagtccttcgacttgtgcggtaatggccgcagcaatggttccggtatggacatactctgttaagaaagtaaaagaagaaattccgaaggtgaagatgccattgcttggaattggagcagcgttttcctttcttggaatgatgtttaatattccgctgcctggaggtacaaccggacatgcggtaggaggaacattgattgcgattcttacaggaagtccgtcggcaggctgtattgccgttacgatctcactgcttatccaggcattgttgtttggtgatggcggtattctcgcttttggagcaaactgttttaatatggctttcatattgccatttctcggatttgcaatttacaagcttatctgggaaaaaacaggaaaaagaaagttagcagcaggaattggttcctacatcggcattaatgcagcagcattttgtgcagcgattgagtttggaattcagccattgttgtttaccgatgcagcaggaaaggcactctattgtccatatccgcttactatttccattccggcaatgatgattggacatcttacgttatttggaattgcagaaatagttcttactacagcaatccttgcatttgtggaaaagatatcaccggaaacattagaagaaaaaccagcacagtctgcatttaagccattatatattcttatggcagttttgattatattcacaccattaggtcttctggcaagtggaaccgcctggggcgaatggggcgttgaagagatggcatcccttgtaagtaatggaaaagcacttggatatacaccggcaggaatggaaaagggctttagccttgcttcgcttttcccggattactctatggcaggaatgccggaatggataggatatattttatctgcagttgttggcgtagcaattattgttatcttctttaaacttttagctggaagtaaaaaagataaaatagatttttcaaaagggcagtcagtgtaatgcaaaatcaggaaaaaaataatggttttattccatcatggatgtgtgaaacggagcaatatgttccaagtattgataaagatggatttattacaaaaagtacgcaggcagttcttggcgtactgtcaaaattaaaatggaaagaagggaaggacaggtgcctaagcgccagtccttctttaaaactatgttatacattcctatatattttacttactgcctgttcaaaaaactatgtattttcattaaatatggcaggcggaactattcttgcacttgcaacttatccggcagaaacaatgaaacagatactttcgggaacatttggagcagtacttttttctgcactaatacttttaccggcagtgtttataggaaatccgcagattttactcattatcacaaccaaagtgtttgtatccgttacacttataggtattctgtcagcgggaacatcctggaataaattaacagcaagtctccgctcatttcatataccggatatctttatttttacattggatattacattaaaatatattgctgtacttggagaaatctgcatggaaatccttacctcacttcgcttacgatctgtaggacaaaacaggaaaaaagcacagtccttttctgggatattggggatttcctttttaaaatcaagagaaatggcagaggaaatgtatgcagcaatgtgctgtcgtggattcgttggagaatataaaacacaaaaaacatctacctttcgaaaacaggatatcttgagtattcttttgatgataggagtaacaggaatattcatttatttcgaggacctgtggaaatagcacaaagcaatctaatatcaaagaggacaaaataccttttgcccccaacatatagcagttttctatgagaacagaataaaaagtaaaatcaagaataacaaaaataaaaggaagattcaaaatgatagaattaaaaaatgtatgttatgcatatggaaatgaaattgcattacgatacattaatttaaatattcaaaaaggtgaatctgtaataatacagggaccaaatggatgtggtaaatctacattgataaaaatattgaacggaatcatatttccgatggaaggcagttatacctatgaaaatcacgaaataacagaaaaagcattaaaagattctcgctttgccaaatggtttcatcagcagatgggttatgtttttcaaaatgcagatacacagcttttttgtggaagtgtagaagaagaaatcgcatttggtccgatccagatgggactttccgaagaaaaagtcaaacaaagaacagaagattgtctccgtttattcggaatcgaaaaattaagagaacgcccaccgtatcatttaagcggtggagaaaaacgaaaagtatcgttagcttgtatcctgtccatgaatccggaggtacttattcttgatgaaccactggctgggcttgatgaaagtacgcagaaaatgctcatagactttctaaagaaatttcatgcggcgggaaagacactcatcattattacgcataataatcagcttgcgaaagaattaggaacccggtttattcaaataaatgaaaatcatgaattaactatttgattcattaggggaaacagacgaaaataaaaagaatagaccatagtaaatgtaaagatatcactgcgtagaaaatgcctgtccggcatttttacttgctctcacattacatttactatggtctattctttttattttctgcttgttggctccagaaggaatgaacgcaatagtctttttggggaaaagaagggggcgaggtcggaagattgtggcttattctgatactgcctccgctatgctgtcaatgatgataagatgatatcgccagctatcactgtacatgataaatttatcattatatataaaggtgactactttatttttttggaaaatgacaatgccctttcttttttcgtctgttttctctaatgaattaaatagttatttcttttgaaagttacttcaaaaactgataagatgggggtataaattttcgaaagaggaaactacttatggattatcttgatatttttataaaaaacgattatatagatttaaagcagattgcagaaagcggccaatgcttccgttggaagaaaatatgtccgggcagatattttgttatttctgatggacgggcggtatgcttttttcaggaaaagacaggaatccgtattttgtgtcatgagaaggatgaggaatattttagaaggtatctggatttagatacagattacgggaaaataatagaacggattgatccggaagatcgctttctttctggagcggcgcagatgggaagggggattcgtattcttcgtcagaatttgtgggagatgattatcagttttattatcagccagaggaacaatattccgcggattatgaagagtattgatgctttgtgtgaaaagcttggagagcagattgtttttgattatgaaggcgaacatcttgtgggatatacctttccttctccagaagtaattgttggagcggatttgtcagagtttaagtttggataccgggagaagtatataaggcagactgcggaggacattttagagggaaagtttgatttagaagaggtaaaagatgctgtggatgaaggaaaaactccagagcaggtaaaggaaatgttaaagcagctaaaaggagtgggagaaaaggtagcatcttgtattcagctttttggtttacatcagctttccttatttccggttgatacatggattgccaaagtagaagaaatatattataatgggcatttcccagtagaaagatatgaagggatagctggtgtgatgcaacagtatctttttttcagagttcgtgaggaagcagaaaaacgtgcctgcttggaagtaaaagcagataagaatcaaaaagaaaagtcagaagagatacgaaaaaatgtatcaaaaaaagttttaaaaaagcaggagaaggaagaatataatctttccggaaaaatgttatatgtatcagatttagatggtaccttattaaatagtgatgctttacttaacgaagatgtgcccaaacgattaaatgctctgattgagcagggactttgttttactgttgctacagcgagaacctatgcaactgtgaattctattatgaaagatgtcaatcttacctgtcctatgattttgatgaatggagtcatgatttacgatccggtgaaaaaaagctgtattcatgcggaaattattgaaagagattctgtggaatatattctaaaaggaagaaagaagtttggagtgacaggatttgcgtatgcattgtctcctgaaatttctgaggaatgttcaaaatctgaagaagtctctgctatagataatatcggagaagccagcagatccgggcgaaagatggcaacctattatgaaaaaattgcgacacagcatatggaaaagttttatacggaacgaagagatttataccataagccatttagtaaagtggaaaaattagaagatatttcaggtgaagatatcatttatttttctatttgttatgaagaagaagtgttacgaccattttatgaatatttgaaaaaagatgagcggctgaatctgaatttttataaggatgtttatggagatggtctgtggtatttagaaatctcgcataaaaatgcttcaaaatattatggaatacagaagctgcgaaagcttcttcatccggccgcgattaccggaatgggtgacaatctgaatgatattcctttatttgaagcttgtgattgctcctgtgcggtaggaaatgcacataaggaagtaaaagaaagggcagactatattttagataccaatctgaatgcgggagtggtaaaatttctggaaaaggaaatgaaataaattatcaaggcgggcatagaatctggaatttaccggagactatatagagaagatagttgacaaagagttttgataatattaaaatatagatatgaaaactacattacatggaaatgagaacacagattacactgcagtaagagagaatgcttcatttcgagtgatattttgcagtgtattaatttctgtgtatagtaatataataatgcatactggaggatgaaatggattacaagattattagtgatggctgttgtgatttagaaaaagagatcattgaacagtataatttacgtattatacctttttatatatcatttgatgaggcgacatattataaagagattgaagaaatcggaattcgtgaagtatatgagcgaatggtagggaatccagatgtatatcctaagacctctcttccatctgtacagaattatattgatgtttttacagaatatgtgaaagaagggacaccggtagtctgtatttgttttactccatctttgagtggttcttacaactgtgcatgtaatgccagagaaattgtttgtgaggattatccggatgccaaaattgcagtaatcaattctgaagcaggaacagtaagtcagggtcttatggttattgaagcaggaagaatgtgtcagaacggagttccgtatgaacaatgtgtagatattcttgagaagatgaaaaagaccaatagaatcttttttactgtcggtaacacagattatttaaaacatggcggacgaatcggaaagcttgcaggaatcgcaagcagcgcactttccttaaagcctctgattactttagtaaatggtgagatcgaagcttcaggaatcggacgaagccgtaagaagacagttgccaaaacgattgcgctaatggatgactattttaaagaaaccggagatgcgatggaagactattctttccgcgttggttttggttatgatatagaggaaggcaaggaatattataataccgttgcaaaccatatttatggagagagccatgtagatcaggtgggaatctgtcagattggggcaaccattgcggtacataccggaccatatgcgattggaatagggtgtgttaagaagtatgagaattatttaattcgttaggggaaacagacgaaaaaagaaataatcccctgtcccagatgcggcttcggagcgtgttaaagatgcggatgagcatctttaacacagcgattacagagcagatgggacaggggattatttcttttttcgtctgtttagcttaaataaaataccaattatataaaatgtttaagagaaacttattttgcttttacagtttttactttgctgtatgcaccataagtcttagtctttccaacctgtttgtaggagcgtacttttacaaagtatttctttttagatgttaatttctttactactttgcttgttgttttgttactttttactacaattgtcttctttcctttgaaagatttctttgtggaatatgtgatttcgtaaccggaagcatttttatcttttttccaggatacttttatctttttctttccatttgcttttacttttgcagtctgttttgtaagttttacctttgcggctgatgttgtgtttgttttctttgctgtagtagcaggctttgtagctggtttggcagcagttgttgtatttggtttagaagctgttgtactgtccggtatggatggtgttggtgcttctgtggattgatatggttttaataattcagtaagttcattgattaaatcagcagcatcggcactggtagaactttcgtttgctaagagttctgctgcttcatttttatgtgctaataatacactatcatcagcaccggcaccttttaatgcagtttcagcctgtttgataagttcctgtaactgtgctttttgttcttctgttacagggattgcgacatagatatcagcgtagtcatcacaagaaatagtaacgctgtaagttccaccctccgcatcagatgggatagcatttaagtcaagagaaacgctttttgcaatagttccggaatacagagtataaggagtcttcttatgacctgatccaacagtatatgttacagtcaatgttccatttgtaacagtaggaagctgatttaaagtaaatgatttcatatcgtcactgaaagtaccgctgatttcttcagagtaagccggttttataaagattccatcagcgaaagtataaacatagttaccttctggtgttacataagtaattttgttaattgttttattcacaagctttgcaaattcagccgtattatctgattttgcaattcccatagtagccgcttcattggtaacattaaaagataatttgtaaggctgtacccagatgtttgaaagatgttctagacctactttatatccttctgttgtttcaagaatgattccctgaatagtagagttgacagggaatccttcatcttgtcgggaatttcttaagtattttgtgcttgtttccaccacatcaatctcgtattcaccccaggtggatcctgttgttaatgttggtacggcatccgttacagtagtgactgttttgttattagaaacataagaaccgtctttctgaagtgttttatactgagaaggaacctgtgtaggattttcatttaatgtaatatcagaagcttcctcatatgctttgcttaattctttgtttgcatcttttaaaataatggattcaacataaaggtcagaatcaacagcaatatttacattcgcaacaccttttacatgatatcctcctgcagcttctgcactttcctcctcataatctgtccaggcattagataaaacagaatacttagaagtgctggcagtagtaacgacatcaaagctgtctgtgctgcttacatcaccagaataaaattctttgtaagttaaattagatgttccatatatcgttccggaaaaacctgtaccattagttaatttataatataatccactgtttccaatctgagtatagccttctaaagcttctgcagaatatgtgtaagtgctgtctgcgatagaaacggattttgttccttctgctgcaaatgcaggaacagaaagctggctgacagacataaatactgccatagaagctgccagagccttagttaataatttttgttttctcattaaatttgtagtctcccttcttctcttgtatacttttagaacttgattatgaaatcaaacataaaaaattccaaaaggacatatttgataagaaattcaagtcgagcgatcgcgagacttggcgcgtgattctggtcaacgtaagttgacatattctttacagaatcactgcgcatcctcgcggagcgtttatctcagtcgaagattggactcccactgagacaaatttgctgtcactcaccacctgaaagaggtgggagtcttctcgactgagataaatatataaaaatctgtgcactgatttttaaggcaaaaaattagagaactctccctagcgcgcatacggagtgcgttagtggagggtcccctaccaggttttcatgcatgaatatctaataaaaagatattaagcaccgaaaattcaattcaaatcttgtaagtctgagatagaaaatatatctcgcaattagaaaatactatataaaattagttgtgtcaaacaaaaatgtcaaatgaaaaaagttctcaaaaaagggaatgcttaaataataatttgttgggaacaagacagatgctcctacagggagaagacattcgtcagctcctagaatcgctataaattgaaatgcaatatatttacaaaaatgcaaaagtatgataaggtgtataaacaagaaaatgagagtatatttttccatctgaatcttgcgtagaaggatttttagaatgggaggtgaaatgaacttattatagtaattttgtaggaagatatagtataataataaaagggaaaggaaatacataatataggataggagaaatcatggaagtaaggaaacgatttgaaaatgataaattaaaaaaacttcagatttttaatggggcacagttaaaatatatagcatttatatccatgttgattgatcatgtaaataatgcgttgataactccttttctgaatggaaagggatttttattgcatttatctaatcttttttcaattctgggcaggattgcatttcctatttttgtgttttttattgtagaaggattttttaagaccagtaacaggaagaagtatcttataacgctcttgctatttggtgtgatatccgaagttccgtttgatatgtttacatcaaaagtattctttgatccatattggaataacatcatgtttactttagctttatgtcttattacaatttggattattgatgctgtaaaagcaaagatcagcaataaagttttgtggtatagtatctcaatcgttgttgtagggatttcgtgtgcagtagcgatggcgctcagtctggattatgattatcatgcgattattgttgcatacattttttatattttttatgataaaccaatacttggagcgggattgggatatctttcgattattaaagagttatattcttgcttgggatttgctatgacagtaacatataatggtgaaagaggaaagcaaaataagtggatcaattatcttttttatccggttcatattttaatattagggattctgcgtttttatttaaatatttaaaaatctttagaattatttagtatgaaagaaaacaggggtatgttatagttataactagtgttaagatttacacaaacaaaaagaggaacatttcacaagaataacaggcagattttacatgcatttcatttggagttacagggatagttattgggaaagatacataagaaacgcatatttatgaaagaaaaaagtataattcaacagaacttaaagaaaataattggtgttattgtggtttctgtttttgccataataacgatttatacggtgtttcgggggagcggcatctctttgaacgaattaacagcgagtttaaaagaggcatcctgggaaggtattctgctggcatcggtaagtatgcttggttttatttattttgaaggggaagcgttaagagttcttgtccggcatatgggatatccggcaaagagaagccatggttttgtttattcggcggcagatgtgtatttttctgcaattacgccatctgcttcgggaggacagccggcaagtgcatattttatgctgaaggatgggatagcaggaacagcggttatggctgcattgctactgaatcttattatgtatacccttgcgattctgacgatcgggctggtagatattttgatttttccggaagtttttctgaatttcagtatcgggtgccgggtgttgatcgtggcaggtggtttagctttagcagggcttgggattatcttttatcttctgctgagaaggcaggcattgattgaatctgtcggtgccttttttgtccggattttacggatgattcattgtgggaggcttgcagataagttagaaaagaaactggaagtttctatcgagaagtatagtagtcttgtggatgtgatttttgatggaaagagaatgttatggaaggtgtatatcctgaatctgttacagagattgtcgcagattatcgtaacacttttttcatttgcagcattgcatggagatttacgaaagcttccacagttattagcaacacagatttatgttgttatgggttcaaactgtgtcccgattccgggaggaatgggagtgacagattatctgatgttgaaaggctatcagcagcttatgagcagggaagccgcatttcagcttgaaatgcttagcagaggtctgtctttttatgtttgtatctttgtaagtctgaccgcagttttgataggatatgtaacgattaagagaaaaaagaaattggagaatgaaaatgataggattttatgattacacagtgatacttacttatttgtcactgatgtcgggaacaataggaattatgctttgtctaaatgggatggggcatccataccttggtatgttttttctgcttttttccggactgtgtgatacttttgacggtaaagttgcaagaacaaagaaggatcgtacaccgcagatgaaaaagtttggtattcagattgattctttatccgatttaattgcatttggaatacttccggcatgcattggaattgcgatgcttcgatatattatgtatattccggatttatcaggctttacaaagtatattcttacacattataacttacaggcacagattgtattgacagcgattgccgttttatatgtacttgctgcgatgattcgtctggcatattttaatgtaatggaagaagaagatcagaacagagatgagtccggtgctaagatttatacaggattaccggttacctctgctgcattgatctttccggcagtgttgctcgtacatctgttagtacgtgcagatctgacttttttatattttggagtgatgttaataaccggtatattatttgtttctaaaatacatattaaaaaaccgcagaataagggaatcgctactatgattttctttggtgcggtagagtgcgttgttttgatttttgcgttgaaatttttgaaaaagtaaagctttcatataaagatttaaactttgtagtattttatgagaatactatggggatttttgtacataaattttaagaattaagagattacagacaggagatttacatatgactatcctagaatttttatataatacagttccaggaagatttcttttaaaatcgttaaccggcccacggctttctcgtatctgtgggcattttttagattctgaattgtcgtcatttctcattcaaccatttgtaaagcaaaatgcaatccaattatcagattatgaaacaacagatataaaaagttttaatgattttttctcaaggaaaataaaacaggacaagcgtccgatagatatggaggaaaatcatttaatcgcaccatgtgacggtctattatctgtctggaaaataaaagagaataccgtttttcccgtaaagcagagccattatacaatttcctctctgttgcacagcaaaaagctggcacagcgttatcatgggggatactgccttgtataccgtttgtgtgtaaatcactatcatagatattgttatgtggattccgggcaaaagagtagaaacttttttattccaggacgtttacatacggtaagacctgttgccctccgggaagttcctgtatttactgagaatagcagagaatatacattaattcggacagaaaagtttggcacagtagtacagatggaagttggcgcaatgcttgttgggcggattgtcaatcatgaagaaaaaggaagcaccataagaggaaaagaaaaaggatattttcaatatggaggttctacaattatcgtactgattgagccagaacaagttcagatacgcgaggacattttacaaagttctgcactggcaaaagaagtgcccgtcaagatgggggaggtcattggtcatgcactcgaacataaaagaacgattcaataatttactgccaaagtatgcaatcctgccgattatcgcagctttactcataaataactgtatctacataggtgcggcacaacttcgaaatcacttatctttttactcactggcaatctcgctagatgaaaagattccactgttgacaccatttgtcatattttatgtactggcatatgtccagtgggcattgaattacatattaattggcagagacagcaaaaaactgtgctatcagtttgtacttggagatattctttccaaagtcatctgtctattcttctttatattgtttccaaccacattaacccggccggaaattacaggaacagatatattcagtcagcttgttcgctttatctactctgtagatgctcccgtcaacctatttccgtctattcactgtttagagagctggtgctgcatacgtgccgcctacaaaatgaatttcaaaacagaaaagagaaccaactattatcgagtggcaacgattcttatgtcactggggatatttgcatcaacattatttataaaacagcatgtaattgcagatgtatttgggggaattgcagctttcgaaattggaatgattttagcaaaaattctgatttgatggattaaagaaacgaaacccagaaacgttatatagaataaaatgtgaagatagtcgcggcgtagaaaatgcctgaccggcatttttacttgctccgacatcacattttattctatataacgtttttggatttctgtttattggcaccagatgaaatcaggattttgtgtggaaaaaataaggggtttctccagaagaaatgcgtcaatcctttaggctttaatttccagagaatccataaccttctgggaaatccccattctcgccaactgtagattgagaatagtcagaaaaaagaaacaaataatacatcccagatgcggcttgggagcgtatttaagatgcggatgagcatattaaatacagcgactacagagcagatgggatgtattatttgtttcttttttcgtctattaccaaatctacaaatcaggatttacaaatctatgcgttcaattgtttgttcttctatattatgtcgttttgtatatccagtaagaataagcgttaaagctccgtcgcctgttacattgcaggctgttccaaaactatcctgtaatgcaaagatagtaagcattaatgcagttccggaatctccgaatccaagaactcctgtaataagtcctaaggatgccataactgttccgccaggtacgccaggtgctccaatagcaaatactccaagaagtacgcagaaaagaatcattgttccaggtgttggtactgtgtcataaagaattttagaaactgtcatgcagaagaatacttctgtaagaacggaaccgcacagatgaatatttgcaaacagcgggataccgaactgtaccatatcttttctgagtggtttacatttctcagcgcactgcagggcaacagcaagagtagcagcagaagacatagttcctactgcagtcagataagcaggcccataattttttataatatctaatggattctcacctgaataaactccagcaagtacataaagcaaagtcatccagatgaaatgactaactaaaacaataacaataactttaaggaaaacaggaagctgttttgtaatagttccttcatatgcaagtgagcagaatgtcagaccgataaaaaatggaagaatcggaatgatgattctcgaaacgatagcaagaacagctttctgaaattcatctaaaaaagctgcaatcaaatctgctttcgtccatgctacagccagtccaagtaaaatagataaaacaagtgcactcataaccggcataatctgtggaatggaaagtttaaatacaacatcgggaagcgttttcagtttatctgctgccgaactgatagaaagatgtggaatcagtgcatatccggaaactgtagaaaatagtgcagcacctaatgaggaaacgtaagcaataacaatagcaaccccaagcatacgtgaagcatggccgccaagctttgtgatagaaggtgcgataaatccgatgataattaaaggaacacagaaattaatcaactgtcctaaaatatactttgcagttacaaccacatttaaaatggcccttatcgcagcattgccatcggcataattaagcacaagcccaatacagataccgagaaaaacacccattaagagtttgaaaggcaagctggtaaaaaaattattctttttcataaataaaatcctttcgtttgccataggcggaaacccactacctttaggtggtgggatgagccttgttatgttgtggtcaagcttttttataacactttgacctaattattgctacagggtttataccccgtagcgtgcctcaaaaggcgttttataattgttataagaatgcggtcgttcgtgattgtaatgaac

SEQ ID NO: 410 - DNA, 49446 bp, Eubacterium hallii
aaacagactgagccatttgcgatttaagaccaaacttttcccgtaaagtagaatacaaaaccttattaagtgaaaactgctttaagtcgtgagtatggaatacatagtctgaaacataattgcaggcattacgataaacagacatcgtttcatcaagcaaaactttatccgtttccgttgcgactatttgaattttagctgtaatagttatctgttccatagatgtactcctttcgtagatatttcactaaatatattatacaataacaattggtgaaaatcaatgttttgaggtgaattatggataatagatacaatcgtcataacaggcggaaatacaaccttaaagtacatatagttctagtaaccaaatatcgtaaacaattactcaaagattctatcgctgatgatgttaaacaaaagattttcgatattgctaatgcttatggctacgaaattattgctatagaaaccgacaaagatcatatacatttcttattaagttacgatacaacagataaagtttgcgatattgtcaaaattgtaaagcaagaaacaacgtattatttatggcacaaatatagttcccttctatctaaacagtattggaaaaagaagatattttggtcagacggatatttttcttgtagcattggagaaatatcttcaaccactatacaaaaatatattgagaatcagggttaacgactaaagatttacaaggctcctcccaccacctaaaggtagtgggtttccgcctatggcaaacaaaaggattttatttgtgaaaatttccagatctgtggatttaagatggtcagaaaaaaagaaaccatgccctatcccatctgctctttagtcgcagatgggatagggcatggtttcttttttcgtctatataaaatctagaaattctctgctttaatctggaaataagactgtggatgatcacataccggacatacgtctggcgctttctttccaacacagatatgtccacagtttgcacactgccaaatcgtatcaccatctctggagaaaacgatttctttctttacattatcaagaagttttaaatatcttgcttcatgttccttttcaatggcgccaacgccttcgaacttctccgcaatatcatcaaaaccttcttctcttgcttcttttgcaaaagttgcgtacatatctgtccactcatagttctcaccttctgctgctgcctgaagattctcgatcgtagagcggattgctcctccttcaaggagtttaaaccacatctttgcatgttctttctcattattagctgtttcttcaaaaatatttgcaatctgaacatatccttctttttttgccttacttgcaaaataagaatacttgtttcttgcctgagattctcctgcaaaagctgtcattaaattctgttctgtttttgttccttttaattctggcataataaacccctttcttatattaaatcatatttattaatcccattattacatgatgtcacgaattactccgtagctaacgctactcccgtaattctgaaacattatattatagtaactcataaaagatataactaccgctaaatcaataacagtaactcttactgtttatataatatcttattaataaataattgtcaagaagaaatgattattttttctcgtttttatcttttacgattcgatagataaacatataggcataaatcaataacggtaatgcaagcatcgtaaacaaagatgccataaaatacggactccctgtaatcgcacaatataatgtaataaaaaccatcgcgatcaaaaagattactatcaacaatgctactattctttttacttttttcataacaattcttttttaacgatcctctcttaaatgttttaagtgctcttttatatgattctcataaccattttctgtaggaatataaaatcgttcctcttttacctcatctggaagatactgttgttttacatagttttccggataatcatgcgcatatttataaccaattccatgtcctaatttttttgctcctccgtaatgagcatctcttaaatacggaggaacctgccctgtattctggctccgtaccatagataacgccttatctaccgccatgatacacgcattactttttggtgcacttgccacataggctgccgcctgcgacaacaaaattctagcttccggcataccaatcctctcgactccctgagaagctgctactgcaactactaacgcctgcggatctgcattgcccacatcttctgaggcgcatatcatgattctccgggcaataaactttggatcttcgcctgcatcaagcatgcgtgccagataaaacaccgctgcatccggatctgttcctctcatactttttataaatgcagaaattgtatcgtaatgattatcgccatccctgtcgtagttcactgcttttctttgaatacattcttccgctgctgccagatcaattaatatccttccattctcatcaggctctgtagtcaatataccaagctctaccgcattaagcgctcttcttgcatctccccctgccatctgtgcaataaactgtgccgcttcctctgtgactttcgcaccatatgctcccatccctctttcattatcttccactgcagttttcactaatttacaaatatcttcctgtgacaatggttccagatgaaaaatctgagaacgggaaagcagggcactattcacttcaaaatacggattctctgttgttgctccaatcaaaatgaccgtaccgtcttccacaaaaggcaaaagataatcctgctgtgccttattaaaacgatgaatctcatcgataaataatatcgttttcttaccatacataccaaatgcatctttagcctgagatactgcctgttccatatccttcttacccgaagtagttgcattcatctgcacaaaatctgcactcgtcgtattcgcgattacttttgctaatgttgtctttcctgttccaggaggaccataaaaaatcagtgagctaatcttatctgccttaatcgcacgatataaaagtttatcttttcctataatatgctgctgtcctacaacttcatcaagatttttaggacgcattctcaccgcaagaggcgattcttcctttttcctctgcatactcatatattcaaataagtccattcttttgcctctgtttatttatttccttccttgttgtcttctctagttacacaatcacttgtcctgtctctgctttttctacccttgttatttcacactttttacggatgccggttctccttcaaccaaaatgcttgcatttaactttcgtataattgcatagccatcttccagatcaactacactataacatccctgttcaaatacaaagttccagtatccatccagcggcagcttcagcatcgccgccaaaagatgtccaagtgtccccttatgtgccacaataagcatcttttctcccttagattctcttcctgacggaatgtcccttaaaaaatcttctgccctgctacgcacatctgcaaagctttctccttttggaatcctgtatgtagaaaattcttcgttccaggcatccaactcttttggataggtattctggatttctttataagtcatcccctcaaatataccaaaatcctgttccataaggcgtcgatcaccaaagatctcctgctctcgctcttccatcacaatctgtgctgtattatatgcacgaactaatggacttgctactatataatcaaaagaaacttcttttaagatttcttttaaatatcttgcttgggaaatccctttttcagaaagaacggcatctgttcttccataataacaccccttcacattcagtgcagtttctccatgtcgaatcaaataaagtctcattatcatttcctcaagtttctattttatattcatcttctattctttgtttattatacaaaaaaagccgttgcaaatcaattactgcaacggcatcatcccatgtatttttaaagcctcacaacatttgaagcctgcggtcctttctctccctgaacaatatcaaactctacttcattcccttcttctaatgatttaaagcctggcatattcagtcctgtataatgtacaaagatatctttgccactctcatcctgtataaacccataccccttctgattgttaaaccacttcactcttcccttaaacatcggaatacctccattatcaaactacctgccttctcccggtcaggatagcattattttagcacaatgctagatacaagtcaatatattttcagataattataattattctacataattatctgaacttttatcatattttacatttttcgagtaatattatcttcacaatgtctgtattcatacaacagtctgttcatcctctgaatctttcggtcaaataatcccagtttatataatgtgataataacaacccccataagtaacgccagaatcattcccttcatcccgtccaacttatacccactgtaaattaatacaagcgtcgtcattgaatctagtcccatgctatcagctatcatctttggctgcaggaactgtcttgcaaccagacacacaacatataaaatgataaggaacatcgcctgacgataatctctttgtaaaaaacagataagagtccatggtatcaatatcgttcccgtccctaaaataggcagcaggtccacaatggaaattactaacgcaagtaaaagcgcatatgggttaccaataattaaaaatcctatcagtaaaatcacaaaaacaatgcacattattttaacctgcgctacgaaaaatccacccagagcagtaaaaactttatccttaatatcccttgccgtctgtccaatatcttccggaactaccttccagaaaaatccccccagtctctctctatccgcaataaagaaatatgctgaaataatcatcacaatcgttccgataaatccattcgtcagatctgccgctgctgttcccatcatctccactccttttggagcaaacttattaatcactccgcccatctggctaagaagattattaaaaaagacctgtatctgattactaaaatcggccgaaattggcgaaactatatctgtaaggttcttactcaacagctttatggtcgtcttcacatatccataatatgccggcgctccagaaaaaagttccattaactcccttccaagcttcgttatcgcaatatatcctagccctgcaatcagcaccaaaaccaaaataataattacagccgaagaccactttttattcagcttaatatgcttttccagaaaatcacataacggtgtggctaataacgccaatatccaactggctacaaatggccagaaaaaccccatcaactttggaattccaaaaatcaaaatcattgccataccaaaaaacacaagcaattccataataatattcaacaatatcttccatttcttcactttgatgtcacctgctctctaaacaaaataaatgtaactacaagtatagcacagccctttatattttcaaccagatgctttcatcaacagaattttgaaagacttgcacaaatatattatgaaattctacacaattctcttttcctctgtaactggtacaatctgattcttttctctattataataatatacagaatctgataatatatctcctagggcaactactgttctattcgcatcctctaccatagtaaaaagatctgatggattatcaattctatctgacggcaccagaatcacttcatggatactgctcggcagaatataaaaatctgtcttctttttcaaggcaaatgtctgcaatacatcatcatataacagtacagatgccccattcacttcctgtctgttcgtcataatatacatagggatcgccgaacgatccattggcatacaaacccctgctctctgaatcatctcatccatatccaccatctgtgccggaaatagtctcggtgtattctctcttgccgctaacaaaagctcgttcatagaaatcccccacgcttccatctcctgattcgttacaagtgctgtagaaatccctatatcatcactatgtgctacccagcgaaatgtcagcgcgagatcatacaactttaaataaggacaatcttctaaaatctcttcattcttcttataattcacaagccgataaatgattctgtcctttacatactcaaacttctccaacttaaaatgataatccgcaactcgtgaaatcttccattcatattcttctcgaattctgcgaataatctcttccagactctccccttttaaataataactataatactcatccagatagattgccggagaaacattcatctccttactcttaatatacagtcctcttaactgtaccccattattcttcgttaccatagcaacatctaattccacatcacttttccagccttctaaaatatgctcctctatgtattcctgaaacatgtcaaatgtcatctttattcctcactttccataatatatgtttttttatttattatggaaatatcatagcatattttgtaatatttttccagtattttttctatttttttctatttattttattctatgacagattggaacatcattttacatcttgttccaatctgtcatcttttcaagaatgcccagatattcttaaattttaatactccgtaatcttattatcttctgtataaagatatactttaccagtatctttatctacgtaataatcccctgtttttttcccaccatcagcttcatatacgtggaactcatatccttctgctcctggattttcactgttataagcagtaagtttctcattttcctcacgaaattcgtacgaaatatcctgatgatctgtttctagtttatccttcagataatttttagcatcttcatacgtatcaaaagtgcctgcccctaaatgatccataataccatctcctgtatcctctgtatcatttgtatcttctgtcgttttattattttcctttgtattatcaggatcttccacactccatccagttgttgcttccatatcctctccatttgaatttttcattccacagccgacaagagcagacacaaccattaccgccagtaacattaccacatacatttttgattttttcatcaataaaactcctttctttattaatgtagtctctgattcttcattcaagaatgccccggcattcttgctgcaagctgcgcgtcatataatgcatgacatacttcttccgcgcatctgatatacttgcctttacaaaaaaattccgagagtacatatcgttttataaatattatctgcactttttcaaaaaatataatttatttattccgcttttttataattttatagaaaatggttatactgataaaaccaacacagaaaggagtatttatttatgaagtggattgattataccgctctaactttagctattattggcgcgattacctggggattaatcggcatattccaatttaatcttgtctcattcttttttggagaaaatagctggttttcccgtcttatctatgaccttgtcggcctgtccggtttatatttacttaccttatttggtcgaatcggacgcgacatgtaaccgtactctatcatttttttatattctgctaaaaaggcagtatagaagcgaaaatttgcataaacaaatttttctacagcttctttactgcctctttcctttttgttatactaatttcagaagaaatataaattgaaaattacacaatgcagggaggaattttaatgcatttcaaaaagaaattatggtattttctatccatcctttctacattattacttgtcgttcttccgatcagcggatgtaactcttcttttaatgtagaaagcactacagaaaccagaacatacacttcaacaattactaataattccgataaaaacacttcggacacctcacagtcggacaatgcaagcacagcttcttctaaaaagaaacaaatcgatgaaacggatgattatcttaacaaaaacggcagctacacatctaaagaagatgtgacaaactaccttatccagtacagacagcttccgatgaatttcattacaaaaaaagaagcaaaaaaactgggctggtccggcggaagcttagaagcttatgccccaggcaaatgtatcggtggagattatttcggcaattatgaacaacgattacctgttgtctccggaagaacctaccacgaatgcgatatcgacactttgaatgcaaaaagccgcggagctaaacgaattatctactcagatgacggccagatttattatacagatgatcactatgaaacttttactttactttatggggatgatatacaatgacaatcacaatcgatggattatccataaaaaagaaagaagatttttatgcgaacataaaaactgaactgaatgttccagaatattttggaaataatctggatgctctatatgatattttaacagaacatccagatcgtttacagattaaatttcttcattacgacagaatgtgcgcgcagctcggaactccattctgtcaaaaactgttaaaggtgctacaggatgccgacatcctcaccataataaatcagcattaatacaattgtaacgaattctaacacagggagtaccgtaagggtactctctttccatttatacagattcacagcaactctatttattccagtcagcatgatatgctcactgtttttaagaaacgtaagtggtacgccaaaaatttttaatgataatacaaacggaagcaccaccgcaatcgcaagataaatccatatccagccagatggaacctttttaataagctcatctgtcataccagaaaatgtaagtatatataacactaatcgatgccagaaataaatctgcagcgttcttttacctaccgttcccataaccggaatcttacgatttggcacaagacttataatcgcaattcccataagaaaggcaatcatatagaataccagacgatgcatcgccccacaatcttctacattaataaattcatacgcattccttcccgtaaaaagacgtatataagaatacttatcttcgattctcgctaacgtatataaaatcatatctgtaagaaaaatagcagaaagacacttaatccacagcttatctaaaaccccctgcactttctttatgtctaaatgatatcccacataataaaaaggaaaaaatacaataatccttgaaagataaagaaagcttccaatattcgtatcatatccagcaaggcatgcaaccataatactaatcggcataacaaaccacagcggtaattcacgcagcaaatatgtcataagcataaaagcagccatggcaaacatataccatggaattcctgtatcttcaaaccactgaaataccgcttcctgatgaaataataacttgattccataaatgcaaaacttcaacgcgtaaccaatcataatataatatataggtttatcccatcgaaacggatgccttgcatcccacttcttctgtaataatcctgacaaaaaaataaaaagcggcatatggaaggaataaataaaaagagaaaggcttttcattgtattcgatattggtgcatactgattcacaaaatgtcctataacaaccataacaattaaaaaacacttcagattgtcccacttataaatgcgctttgtgtttctgctcactgcttcactcatctcaatacctctttgtatcaaatatttgcatctgattataacaccgacaatcatttttttctatagtaaaatttaacactttggaaacttttccgtaacatttgttgtgaatttttcagccctcaatactaatttacataaaaaatagccgtcctgttctctgcaaagaaacggacgactactttttaaactaaatctttgccgggacaggtgaccgcacaccttccagctctcttgttaagtatattatattctatgctgctcctattgtcaaacaggcatttcacccattcccatactgctaatcgcctataagaaaagaatttgaccactttatagaaactttataaataaaatagtaccgttttattaccactacccaaaaacaaaagccggaaacctactaaaatagcggctctccggcttttactatgcggataacaggaatcgaacctgcactccgaagaactagatcctaagtctagcgcgtctgccagttccgccatatccgcatatcctgtaattcaattatcttttttcataggcgaaaaaagaaagcgggtgatgggaatcgaacccacgtatctagcttggaaggctagtgttctaccattgaactacacccgcagatatcggggtgacaggattcgaacctgcggcctcttgatcccaaatcaagcgctctagccaagctgagccacaccccggtataactataatgttttaaatcaaaaatcatctataagacgattctcaaatgagacatcggggattcgaaccccggacaacttgattaaaagtcaagtgctctaccaactgagctaatatcccatataaatattactgagccagcatatcgaatcactggtccaactggactagctggattcgaaccagcgaatgcaggagtcaaagtcctgtgccttaccgcttggcgatagcccattataaggtgggtagagggattcgaaccctcggcctccagagccacaatctggcgcgctaaccaactgcgccacacccaccatagccaggacaacctgacaaacgtgcccgaagggattcgaacccccgacccacggcttagaaggccgttgctctatccagctgagctacggacacgcataaaatagtagttacattatataactgtaaatactgctctcgcagaagcgggtgatgggaatcgaacccacgtatctagcttggaaggctagtgttctaccattgaactacacccgcagatatcggggtgacaggattcgaacctgcggcctcttgatcccaaatcaagcgctctagccaagctgagccacaccccgatattcaaataattcatgtcctcgccattctctcgcgctgacaatatgcattatatactaccccaaacaaaatgtcaacagttttttttaacttttcttaaaatttttaaaaatatatttttttcagacaattagcacaactgtacatttattttttgacatttccacctggcatttttttatatccttatagtgatatcttaaaatgtgaagcattttttactttataagaatatgctctccataaaacaaaaaaacagccggtataaacttttcttcattataccgactgtcctttaaacacttaagattttaattttcttctgccttttctgtttcttctactttttctgtttcttctgtctcttctgtctcttctgtctcttcctgctctggttcatcctcttcttcatcgaagaaatcatcgtcaaagtcgtcatcatagtcatcatcaatatcttctaaataatctggagaaagatacttataaactaaagctgcaattcctgcaactgctgctactgctccgataattgccagaacccataaaactttcttagattcatccttcttatcattgctcattaactctgataactttgcaacaccaagtaattcatcaatatttttcattatgcaagtcctccttactaatcttttctttagtatatcacgataaagcctgctttaccaacaatatttttttactatttaattcattaggggaaaacagacgaaaataaaaataatagaccattgcaaatataaagatatcactgcgtagaaaatgcctgttcggcatttttacttgctctcacattatatttgcaatggtctattatttttattttctgtgtgttggtaccacatggaatgaatgaaatagtttttggggagagaaagggggggagaggtcaggaggttgtggcttattccgatgctatttctactatgctgaaccttttttcaagtttcactgatgataagatgataccgaaacctatcactgtacataataattttatcattatattgtcgcaatatatcgtttttttcaaaacgtatgccatacgttatatataacgcacatctcgcagcaagaatgccaaggcgttcttgaattagaatgtacgataaatataaaggcgatttctgtacttttttgtaaaatgacaatctcctttctctttactactcgttaagagcgagaaaataatcttctggatgatacatcttccgagcaagcagtagtcttctgatttcttccccatctctctccaaagactattgcattcattccttctggaaccaaaacacagaaaaaagaaataataccatatcccagatgcggcttcggagcgtgtttaagatgcggatgagcatcttaaacacagcgactacagagcagatgggatatggtattatttcttttttcgtctgttttcttcttaatgaatcaaatagtaactttctttaattttgcgaaagatgcgaacattttttttcgtcctactctgtcaaagtctacggagacttcataatctcttccaccttttgtgatttcctgtacggttcccacgccaaacttgatatgcttcacgcggtctcccacctgataatttaattctccggctggttttattttaaaatcactcagattatacggttttcctgctcccgctccatattgatacttcaccgggcgatctgtctttttcacttcctgatgtgtggaattattcttctttatatcgagataagcggaagggatttcatcgataaagcgggaatgcctgttatattgtgtctgaccacgtaacattcttctctttgccgaacttaggaacagtctttcctttgctcttgtaatcccaacatagcaaagccggcgttcttcttctatttctgattcatcgcctgacatcatagcgccataacctggaaatacgccttcttccatgcctccaaggaaaacattattaaattccagaccttttgcattatgaagtgtcatcaacaacaccttattatcctcttcttctaagttatcaattcccgcatttagtgtatacatatctttttctgcaaggaaatctcgaagattcggattttcttcctcttcttcgtaatatgcaatatcgttaaaaagttcctctatatcttctaagcggctgatggattcatcggttccttctgtttctaattctgctctatattgtgttacgtcaagaatatgttctaacaattcactgatttcatgttccatactgtaatttcgaaaattttctatcatatctgcaaatttatgaagctttgcaagtgcccttgcaacttccggaatctcatctgcattaaatactgcatcaaggaaactcatctgattcatgatcgcaaactcctgcagacggttaattgttgtctgaccaattcctcttttcggaacattgataattctttttacggagagatcatccattccgctgtctaccactttcagatagctcatcaaatctttaatttcttttctatcgtaaaaactaattcctcgtacgatcgcatatggaatatttctttgttttaacttttcttcaaatatgcgagactgtgcattcgttctatataaaattgccatatccttatattctacccctcgcatggagaggaaattaatagtggatacaactccttctgcctcttcatattccgtatcatactgcctaaagtgaaccaattctcccttctggttttcggtccacaatttcttttcttttcttcctttattatttgcaataactccgtttgcagcattaagaatattctgcgtggaacgataattctgttctaaacggattacctgtgcatccggaaatactttctcaaaatttaaaatattataaatattggctccccggaatttataaatagactggtcgtcatctccgacaacacaaagattacgatatttctttgcaagaagacttaccaataggaactgtactgtattcgtatcctgatattcgtcaaccataatataccgaaaacgatcctgataatgctctaaaacttctggatttgcctgaaataaatctaccatttttacaagaagatcgtcaaaatcaagtgcattattctcctttagacgcttctgataacattcataaatatccgcaattctctgattacgataattacttccgtactcattacgataatcgagcggagatttatattcattcttggcagaagaaatttctgacataaccgagcgttctggaaactgcttcgtatcgattttcatctcttttaaaacttctttcataagagacttttgatcgcttgcatcataaatcgtaaaatttctgtcatatcctaacaaatcaatatgtcttcgcaaaatacggctgcaagtagcatgaaaggtgctgatccaaatatcttctgaaccgtatcctaccagagaatctacacgctctctcatctcctgcgccgccttgtttgtgaaagtgattgccagaatattccatggtgcaattcctttttcttctattaaatatgcaatacggtgtgttagtgatctggtctttcccgatcctgctcccgcaagcatcaaaagggggccttctgtacagaagaccgcctctctttgttctttatttaaagtatcgtaaatactcattatccaacctttctaaaacactgtgtcattatattgatacttcatttataggataaatccctttatcaatatgctaaggcaccagtttctgaccacagtttggacagaacttacttccttccgtcttctgaccacagtttggacaaaagtttggtactcctcctgccggctgctctgcctgtggctgaggctggctttgaggctgtacatttgaagctgtattctgaacctgtccctgtgcaatattctgattattctgtccctgcatggcattctgcatctgatttaccatctgctgtcccatcatcattcccatctgcatagatgccatatctgctgccatattgtttccgccgccattattgctagtatttgtcatcgcatcgatcatcgccatctgctgatatcgtcccatatcaccaaccatactctgaccagccaccttagttaccatttcctgaacttcttccggatagctgacagaatcaatctggaatccggttgcagcaagtccgattttctccagttctgtattcagttctcccatgattccctcagaaatctcgactgcgttcgcctgaatattaaacatatcctttccttcacgaacgatccatcgaagaagcagctgattaagaacagataatacacgttctcttacttcctctgttgtatattgtttctttattcctgctactttgtcgatcagcatctggtaacttccaactttaaactggaatgttccattcgcacgaatcggcattcctcctggaagagctggggtaggaagattgacagcctgtttggttccccacttcatagtaaattcctttgtattaatgaaaattacctctgcgcggattccactgttaaatccaaacttaaatccctttaatgtagaaagaaatggcatgatatctgattctatatcataattgccttctttttcaaaaacaccttccgtaacaccattatataaaaaaatagcatcctgtcccggacgaataattaaacgggatccctttttaatttcactgttattccatttgtaaaaaataacgtcatctctgtattcttcccactctactacattggcaagctgatttttaaataatcccataatatacctccttacacccatgtactacaaaatctgcaagtacatttattgtatatacatattttatattcactgtcaaaagacaggtacttatttttattatacattacttttatattcttgtcacttaggatatggattttatttttcacgatatttccacttgctatatagtaataaaaactatataatatagttacacaaacatttgtaaaacatatggaggtaccattttggataattataaagactggctgcgtaatttattaaaaacagaatctattccaccggaagacatcccggatatcggattatatatggatcaggtaaccactttaatggacaccagattagctggttccaagcgctatccggatgacaagattcttacgaaaacaatgatcaacaattatacaaagaataaacttcttcctccttctaacaaaaagaagtattcaagagagcatatttttcttttaattatgatctattacttgaagagtatattatctatttctgatattcaaagtcttttagagccactatcagaaaggtattttcctgaaaatactgagaatggactctcactttctgatatttaccagaagatcattaatgactacgcagtgaatgaaactgccatatccgaagatattataaaaacctgggaaaaaagccgtaattcttttgctgagtattctctttcggaagaagaagcaaaatatctggatgatttttcctttatctaccagctttgctatgatatctatatgagaaagcagattatcgagaagctcattgaccgtagacgcgaagaacaccccaaaaagaaaaagggctgattcattttattatcatttcagaataagattcaagaatgccccactgatactgatttgttgctcgccacctgcagaggggggagtcatctcacatctgatttaaatataaaaagaccaaagagattcatctgcactgtttgaatcctctctctggtctttttatattttctaacaagccaaatcagaatcaacatgcaacgtccacgcaaatcccaactcctgtcaaatctaatcttcttttttttctaatttttccattcggctaagtacaagctgatacccgtctgttccataattcaaacaacggttcactcgactaatcgttgccgtagatgcaccggttacttcggctacctcattataagttttatgattccgaagcatatttgccacctcgaagcgctgtcccaacgacaataattcattgaccgtacataaatcttcaaaaaaagcataacattcttctacagactgcagctttaaaataccctccattaactttcttgtctcttcattatgtacactttttcccataagtttcacctcttccttaaaaattcaaatctatgtatcttctaatctttatttatcctctttgtactttctgtgaatatattctttaaatacgtctacagaacgattcacgatcaactcttccggaaaattaatttcttctatcaatttttctgagaagtctcttcttgccacatcacaaaatacatgagaatcgctgttcattactaccggctgtttatattccttacacaattccaacattgcaatcagattctctctcgtatgctttcttgcacccatcggatttaaagagttattatttacttctaaaagagtattggtttcctttgctgcttctacgattggttcatattctaacggataaatcccatcatccgggtgtccgataatatccaccaaaggattatttatcgctcctaaaactgcctgtgtattctctttttttgtccctggctgaatacacacactatgtaaactggcaatcttaagatcgagctgtcgtaatgttctttcatccagatctacatgtccgtcataatctaaaatgttaagctcaacacccagcattacttcaataccacacattgtacgcggaacaacttttaaattatgaaaatataaactatggcatgttcccggcatcattggcgcatgctctgtaataccaagcaactttaaccctttatcaaatcctgcttttgccatctccatcatactgttataagcatgtccgctagcaatcgtatgcgtatgcacatctaataaataatccattattcctccgctctatcaaaatctgtcttatctgatctgtcacattttatgttgcatctattaaatcttatgttacatctgttaaaggttcccgtataaatgcgggaacctcacttatacattaacgtaatacatcatcacagtttcatagtatatcatatttttctgtttttttatagttaaatttcctgatacgtattttctaacatttcacacgaagaatgtaaacgctgtttttcttctcctccaagcggaagttccacgatccgctgaattcccatccgatttacaacacatggaattccaatataaattccactttctccatattccccctgtaaatacgcagatactgtaagcacgctatactcatttccaaagatagcctttgtaattcgagccattgccattcctatcccataatatgttgctttttttgcttcaataattttatatgctgccatccgcacttcttcttctaattcaagcagctcctgaaaatgacagccttttgtttctccacacagatcaaagatcggttttgtcgccatcatagcctgactccacggaacgaactcactatccccatgttctcccattacataggcatgcatatttctaggatctatcataaacttttctccaagaagatatcgaagccttgctgtatccagtgcggttcctgtaccaataactttttccggagaaaatccactaatttcatacacgattcttgtcataatgtctacaggattcgttgccacaagaaaaataccacaaaaaccactttgcaaaaccgaatgtagaatactttcaaatattttccggttttcttttaataaatccagacggctctgcctctctttttgtggcagtcctgctgtaagaactataagatcagcatccctgcaatcactatattctcctgcataaatttccatgttacccccgctaaaagccactccatgatttaaatccatggcctctccctcagcttttttcttattgatatcaatcaacacaagttcatcacataaattttgatttaatattgcgtaggcataactcattcccaccattccggtccctattaaaacaacctttcttttttctgcttttttcataaaaaaacacctccttaccggaggtattttctgctgttttaaaagaaattattcatatctgttaatttgcctcgtatggacgcacgcgaagctgaagaccatgtgtatcgcagactttctgacaagctgcaacttcttcggcaccaattacatcaacaactgtcatcactacattcggaacatagcgctgacatgcttttgcaaaacttaacatggcatcataagaggccagaccaaagcgatttcttgttacatcaaggtatttctgtgcggtagaagaatttaaactgatcgaaactgtatcaaaaattcctgcaagtcggcttgcagtcggttctccgaacaccaaatcggataaaccattcgtattgatacgtaacggaatatccggatgtatactctttaaccaccgagccacttccactacatcatcaaagcgcatggtcggttctccaaaaccacagaaaataatttctgctacatgagaccagtcatattttgaaaacaattcttttactaattctaccgatggttcttccttaagccataaactgttatgttcattaaattcttttaaacttcttaaacaaaatgtacaagaacaagagcatcgatttgtcatattaatataaatcttattcgggaatccattctctccaagatctgataaatcctctttaaaatcttctaaattataataaacaccattttttactgtatataaaatcatctctaaatctcctctaaatattcttcaaaacatattccgtaattccatggcaatcccatctgtgctgtgtaagcaatggctttgtcaagaaaagttactgctcttttcaccgcagttttaaaatcctgcccctgcactaaggctcccgttacaatagaagaaaaaacatcacctgttccagaacggtctccgccaatttttcttgtagacaacagctccgaagttttatctttctcaaaaatataattaaaaatcaaatccccctgctgcagtccggtaatcacaatcctgtccggtcccatttcacttaatgcctcacagattgcctccaaaccttcttctgacaaatccaccttatgataatccagatcaaggatacgacatgcttctgtaagatttggagtaagcacatccgcataaggaagaagtttcttcatctcctgacacatatcatccgtataagaagaatacaacttcccgtaatctcccattaccggatcaactacagccaatgtattctcttttttaaattttttaaaaaattcgacaactagtccgatctgttcttttgacccaataaatcctgtcgtaattccatcaaattcaataccggtttcttcccaactattcatatatgtctcaagatatggcgtataatcctgtaaaaaatagttcggaaatcctgtatgcacagacaaaattgctgtcggcattacacaacactgtatcttcatcgcagaaataatcggctgtgccacagcagcagaacatctgccaaatcctgtcacatcattaattaccgctacccttttctgtcgcttcatatttcctccaaacccctgctatatgtttcacttcatcatagccggtcattttaaaagtatctatttataacgtatataattccggtgtaagtcttccgtcatctgccagatcaataatcaaaaaagtcggacccgatggtgtcatctgtcttggtaacgcaatacttcccggattaaagactgtcacaccttcactttcatatacatgatatgccggacaatgcgtatgaccgtaaaaaacgacatctgctcccatctcctgcgctctgcttacaagttcttcttcaccccagctcacgccataaacatctccatgtgtcacaaacgccacatgatcgccaagttcaaaaacatcttctttatctctgctaaaattataatcacagtttccggctgccatataaactgggcacccagccagttcttctaacatttccggcggaatttccatatcaccacaatggataagtccttcaatctgaccatgaaatctgtcaattacatattccaaattcgccatacttccatgattatcactaaccactaaatatttctttcccatactcgctatcattccctctaatcttatttactgtttttgatcaatcgtttctatgagtattcttttattatctctatttatttcattaaaagcgatttaaatgataccacatccctcgcggcctttcaacgaaaatgtataaatcaattactgtttatgcacaattctcttgatttcaagaagaaaagaaactatactattttaaagactaaggaaaatttaatcaggaggaacataattaattatgaatcaactatctgatcctattgccgtatttgattccggcatgggtggcatcagtgttttaagagagatgacaaaactgatgccaaatgaagattttatttattacggggactccaaacacgccccttatggtacaaaaacacttgaagaagtccgtacacttacgattgaacatattacataccttatcaaagaaaaacatgcaaaagccattgctgttgcgtgtaacactgcaacaagtgctgctgtacgcatcttaagagacatgtatcccgatctgcctttagtcggggtggaacctgctattaagccagctgtgcttgcctgcgaacacgcaaaagttatcgttatggctactccaatgacattacgcgaagaaaaattccacaaactggaaagtatttacgataaacaggcggatatttatcccctcccctgtcccggtctgatggaatttgttgaacagggtattctctccggggaaaagcttgaaaactttcttcacaaccttcttgatccttataaagataaagatattaccggaatcgttcttggctgcacacactatccgtttttaaaagacaccatccaaaagattgtcggtccatctgtcacaatttttgatggtggatacggaactgccaaagaactgctccgccgccttaccgttgctaacctaagacagctcgaccaaacccacaaaggtaatgtcacctttttaaacagctccgatgacccggcattaattcaaagatcaaggaaattattacaatactaatttgtagatttcgtgtagacgaaaaaagaaatactaccatatcccatctactctgtagtcgctgtgtttaaaatgctcgttcgcatcttaaacacgctccgaagccgcatctgggatatggtagtatttcttttttctgactactctaaatccacagttggtgaaaatggggattgtccagaagtctatggtttttattggttagaatgaacatctccagaaagatatggctttccaggaaatcaaattccaagaaactgacatttatataaggagttttatttcttcggtcggcatctcttgctattaatagttctttgattaaaagtcataatcttctggagaatccccttctttttccaacataaattactaatttgctatttgttatcaaaaccagacagccgctaaaataaaattttatgctgaattgtaagaaaactatgataaagaaaaaaagaattgttataagcattgtattttgtgactttgcgctgtggaattttgactctgaaaacttcagactcgtttttccgaagttttcgttttttgaggcaaaatgaagcgtttagcgcaacggaacaaaatctaacttataacaattcttttttctttagaagactgaatacaattcagctcaatatcttctgctaaagcggcgtctgtgtccccagcaaattagtatttttctgaaaattctgttgtaactaatgtttcatattctacgcgtttttctagttctcctgcttcttctaagatatcctgaattaatacaaagctttctttttcaaattttgtattttctttataactatcttgttccgcatatctttttactattttttctattgtttttctatctgtatctttaaattgcggtgcaattacttttgcaacttctttcggtgtatgtgtattgacatattgctgtcctttttcgattgcccgggtaaatgcttccagtaattctttatgtgattcaagatagcttttctttacgctgtaagctgtatatggcacatatccgctctcttttcctacagaggcaactacataacctgccccctgttcttcaatcaatgtagctgacggttcaaattcaatagtataatctgtttttcctgaaacaaatgctccggatgtattcgcaaaatcaatattttgtacaagatcaatgtctttttgtggattcatcccatgttttttcaaaacatactcaaataccatttccggcatgccacctggccttccgccaataactttctttccttttaagttctcccattgaaaatcttcttctttgttccggcttacaacaaaattacctgctctttgagtaagctgggcaaaattgataagataatctgcattcccctcattgaattgataaatcgttgcctccggtcccataaaagcaatatctgcatctccactgataactgctgtcgccgttttatctgcgccaaacccagttgtaagttccaacttaatgccctctttctcaaaatagcctttttctatcgccacatattgtggggcataaaaaatagaatgagccacttcatttaaacgtacttttttcaaatgatgtttgcttccctcacagcctgccagacaacagataccaaacagcatcacgaaacatggcatcattaatattacaagatatcttctcatcatacctgataatactcctgtttgattctacaacaatatattcagtaaaaatgcagatgtgcaatataagcaaaaagatttaacttgtgaatttgaaaacttattctattattgtacctgttttacctaaatatccttctaaggctttatcaatagatgtaatgatcacctttcttccattgcctttttcaaggaaagataccccagcttcaatctttggaagcattgtatttggctcaaactgtcctgaattaatatactgctgtgcgtcttctacagaaatatgttctaatggaacttcctgatctgtattataacctacacatacatgctctacgcttgttaagatcataagagcatctgcattcaaaagttctgccattcttccgctcgcatagtctttttcaattactgcacttgcaccatgaagctctactccctgtgctaatacaggaattccaccaccgccgcaggcaatcactacctgaccctgatcagataaagctttgattgaatctatctcaataattccctgtggctttggcgctgctacgattcttcgatatccgccttctacttctgttacatagttaccatgtttctcttcctgttctgcttcctctttggaaaggagtcttccgatcacctttaccggttctgtgaatgcatcatcgtaaggatctaccattacctgtgtaatgattgtacatacaggacgatatacacctctttttaaaagttctgcacgaatagcattctgtaaatcatatccgacatacccctgactcatcgcagagcagacagacatcggtgcctgtgtataatcttctctctccttactaaattcattcatggctgtatgaatcattccaacctgtggtgcgttactatgagaaatgacaacatctgctcctgcttctactaaatcagcaatcgcttttgctgtctttcttgttgctttgtactgttctggcattgttgttccgagtgctctgtgtccaagagctactactacttttttcttgctcatgttttccaatcctttctacttattacttgtcttttagtctatcagaaaatgagaagaatttctactatttctcaaggtattctctcattgtttctatcatttgcccaccatcatgaaaaccttgtttataaagaacggtaagtttcgctttatctttctcaattcttccgacatcaaccttcacctgcggacgaatgatcaatatttttccttccttttcctgttcttctaaaaagtccagtgtttcattgtaacggatatgtctcgtttccattgcatgaagaaatgctttgtactttggataacgaagatgcatgagcggcattagtttatttggctctttacgatatcctttgtctcttgtaagaataactacattcttctcattaccgtcttctattgattttcgaatcggaatgctgtctgcgattcctccatcaagaagtttatgaccttttacaacgagtgtcttagatactaacgggagagagctagatgcgcggatcatccacatctgctttctcagatctcgtacccttaaataccttgcggctccagtatctacatccgtaacaacagcataaaacttacccggataatttaaaaaagcctgatgatcaaatggatctaatacatctggaatctgttcataaagcatctccggtccaaaaacattccctgtttttaaaaatgtttttgctccacaataatttggatcatccagataatccacattcacccgaaaggctcttcctctttgctttgaaagataactgcatgcatggcagcttcctgctgatacgccatatacacttgaaaattcaattcctgcatctaaaaaggcatctaatacgccggcggtatacaccccgcgcattcctcctccttctaaaatcaatcctgcattatacataaatcgacctctctttctatctctttttattttgtattctccttgctgtctactttatctcagtcgagaagactcccacctctttcaggtggtgagttccctcacattggatacgtaaattagtataacgcgattcaaaaaaattctccatatctattttaaattctgtctttggcactagtaaggtactctcgaataatgagaaagccataaaaaacgcacaaatttattttactatttgctggcgtgtatattctctaactggttttcttccggcttttcttgctgcaatctgctcataaaaatccgcactgcgaatatctacattataaatctgagcctgtggggaactggcagcatataactttttaccttcgattgggcgctgaataatatctatactggatttctttcgtatttcccgcaaaagcggggaggcttttttagaaaaacctaaaattcttgcatacggtaccggaatgtttttcgcttcttctaaaaatggataatattttatatggagtacgatatgcaaaagtactctccttaatgcggcatccgtaagctgctttgcgtgaagtctttctattaaagtttcaaaagaaagtcctggttcaactatattttgaaatcttcttgccagatcaaggttcattccaaagtattttccaatcaccctgtttttcaaaagaaaagtatattcaagatatggcatcatatcttcccatgtaacaaagtttccctgtaaaaacccttctataaaaggagaatattctccgcaaagtgcatttacaaatgcactctctttatattctttagcgacatagttttctttatccacagggtactctctatttacaaacattttttcattatttttattagaaaatattttattttccttattcctactataatattgatacagttcccttctgatggatgttgcagaagaatactcttcggcaagtattttttcatgataatggtttccttttcttttaacggtaattggttgaatggaagaatttctccgacgcagtgccttaatatattctaaacctaatatgtgattcggctctttcaaaaattctacagctgtttctggtttcgaatcaaaaagcagctttcctgctgtgaaagctcttgcttccggaaaactttttcctcgctttaattgttcttgtaaaatctgcctatattcttccggttcttcaagaaacaacgtcgcataagaagagtaatcttcaacatctgcccattcacttccaaaagaaagataatcaacacaacctaagcggtcaagtataccgatacctgcagttgcaaaatattctgcactggctgtcgcatatattaccggcatttcaatgacgagatctgcccctcctgacagagccatccgggttctcatatatttatctgcaattgctggttctcctctttgtacataatctccgctcattactgcaataacgtaatctgcccctgtctgctttcttgtttcttctatatgatattgatgtcctttgtgaaacggattatattctgcaatgattcctgctaccttcataacgaattccttttctattatttactctttacggttttcaagtcgagcaaccgcctatagtatacccgaaaacaaacaaaacagcaacttttctgtttcttgtgatttcttacatttttatacttgtataatcgcgtatttttgacatttttatctttttgtctaatcatgttaactttcaaacaaaaacatttattgtttattatgaaatacaattacctatcaaaacttaaaaaaaagtaccgaaataacaaaaaaactccatcacaagttgaataagtacatttccaacgtaaaaaaaaagttctataatatgcctaacagaataaaataagcgaaatttggcgtttcgtaataaattattatacaaaaggagatacaaaatgaaggtattagtaattaactgcggtagctcttctctcaaatatcaggttatcgattctgagacagaacacgttcttgcaaagggtttatgtgaaagaattggtattgatggtgtgttaacttaccagcctgctggtcaggataagattaaatatgaagctgctatgcctgcacatcgtcaggctgttgaacttgtattaaaacagttaacaaaccctgaaaatggtattttaaaatctatcgatgaaattgatgctgttggacaccgtatggtacatggtggtgagaagtttgcttgttccacacttcttacagatgatgtattaaagactgttgaatcctgtaatgacttagctccacttcacaaccctcctacattagttggtgttgctgcttgtagagagctccttcctacaactcctatggttggtgtatttgatacagcattccatcagacgatgccaccagaagcttatatttatggtcttccatacgagtattatgaaaaatatgctgttcgtcgttacggtttccatggaacatctcacaaatatgtttctttaagagcagctgaaatccttggtaaaaaaccagaagatttaaaaatcgttgtatgccaccttggtaatggttcttctatttccgcagttgacggtggaaagtgtgtagatacatctatgggtcttactccattagagggacttgtaatgggtacacgttccggtgatatcgatcctacttgtatcgaattcatcgctcataaagaaaacctttctctcgagcaggttatggatatcgtaaataagaaatctggtgttcttggtatttctggtgtttcttctgacttccgtgatcttgatgaagctgcaaaagcaggtaacaaacgtgctgatttagccttaagagtatttgctcactctgtagttaagtatatcggaagtttcattgccgttatgaacggtgttgatgctatcgtatttacagctggtatcggtgagaacgacgatatcatccgttcaagaattatcgaacacttcgattatcttgatacaacattagaccagaaagcaaacaagatgcatggagaagaacgtatcatctctactccagattccaaagtaaaagttatctgtatcccaacaaacgaagagcttgctatctgccgcgatacagttgagatcgttactaaaaaaatggtagaagatacagtgaaagacgttttaagcaataactaatcctttccatattttttatcatatcttcattacttaatataaagaatccctcagaaggttcctcatctgggggattcgctttttaacttatatattcactttacaagaaatgaatgtatacgtttattcgattcttttttattcaatttttcttattcaattctttcaaataccatcgtagcctgaatacggtctccgcctccaagtcccttacttccgcctgatgtggtactaattgtatgtaaccgatatcccttgtctgcctgtttgttaattacatcctccagttcacttaaattctaacgtcacagccccctgacaactgtatacgttagttatcagggggctgttttttattttttaattactttggtaatgtaatctttccataaactgcagatgttgccgcagttgcaggggaccccagataaattcctactttagacgttcccatacgtcccaggaaatttctattattcgttgcaagtactttttctccatcacaaaggattccgcccgcacgtccacagcataatccacagcctggctgagtaataattgctcctgcttttgctaaggtttccatataacctgcttttattgcctcaatgtaaatcttacggcttgccggagttatgatggtacgacatgctaccgtctttccttcaagaatttttgctgctactgctaaatcttctaatcgtccatttgtacaggaaccgatgaatacctgatcaatatctgttccgacaagttcgctcacaggatggatattatctacctgtgaagggcaggcacacaccggtacgagttcttccgcctgatacgtgattgtccggcaatatgtagcatcttcatcaccatataaccaatcgacatcttccatctttacttctgaatactcacaggttttctcatctggacggaacagacagcactttgctcctgcttcaatcgccatattagaaatcgtcattctagaagcaacagacatggcatctactgctgaacctgtaatctcaagtgctttgtatgtcgccccatcagcacgtaaatctccaattaaacgtaaaataacatcttttgctgttacatttgccggtaatgttccattaataactactttgattgtttctggaacacgaatccacatttctcctgtaccaagtatcgaagccatctctgtgtaaccgataccagaagaaaaacagccgacacatccatacgttgttgtatgggaatctgtaccaaaaacaatattacccggctttgcataacccgcttctgtcataagctgatgacagataccgtcacgtctgtgtacgtgtgttaagctgtatttatccgcaaaagcatctccaatcttaaaatggcgaatatcttctactgcacttgtcggaacaagatgatcatagatcaataccactttatctggatcccagagctttgtaaatcccatttcttcgaacttttctgcaacaaaaggaatgaaaatatcatgaatcattactctgtcaacatttactgtaacaatctggccaggagttactttagaaaggccagtatttttttcgataattttctcaattaatgtacttcccatgactgcctcctaaataattccgttacgtttctgcatcgcttttacaagaccacctgcattaataatgtccatcagattatctggcagcggatgaatcggatatgtctttccatcaaattctaaagattcccccatatgcactgtcagggtatcgccttctttaatcacatcctgaatatcactgttctcaataagtaaaagtccattattaatagagtttctaaagaaaatacgagcataagactttgcaatgacacacttgacctttaatgccttgataatttccggtgcctgttctctggaggatccacagccaaaattctttccagcaacaatgatatctccttcctgaatctgccctgcaagttctggtcttagcggagaaaatccatactgcttcatatcttcaacggtaggaagtgccagatactctgtcggaataataatatctgtatcaatatcatcaccgagtatccatacttttccagtaaactgttccatgatatactacctctttctataataaaatgctttacgcttccggttccgtaatgtatcctgcaagagcagaagctgctactgttgcagcacttgccagatatactttggaacttggcgcacctgcacgacctttaaagtttctcgttcctgtggaaatcagtacttcattctcaccgattacaccctgacagcttccccagcatacggaacagttacaattcataaccatcgcccctgcttccattaaagtagtgataattccttcttctaatgcctgaatgtaaacagcttttgaagccggtgcaacgatgaatcgaaccttaggatcaacctgttttcctttaacaatctcggcagccacacgaaggtcatcaatacgtccattattacaagaacctaagaaagcttcgtcaatagcgatccgctcttcttttacatctttaagcagagcaaaattatctacaaaatccgggcgtacaacaactggttcaatcttactcaagtcataatcatacacttcacaaaaatgtgcatcctcatcacttttaaacatatgtacagcctcacgaccatgcgctttacaatattctacaaccttttcatccggctcaacaataccagcctttgcaccagcctctacagtgagattacaaagaaccatacggtcatcaacagaaagcttgtgcgctccatctcccgcaaactccataatcttataattcgctccattcgctccgatatctccaataatcgtaagaattaaatctcttgggtaaaccccttcttttaattccccatgcagattaaaacggattgtttcaggaaccataacccaggatgttcctgttgtcatcgcatataaaaaatctgtacatccaacccctgtaccaaacgctcctaatgctccgtaagaagtggtatgtgaatctgcgccaaaaatcaactctccagggcagacataatcttccatcataatctggtgacagactccctgtccttcatataacttaatatcattctctattgcaaaatcacgcatctttttatgtgcctctgctgtcttcgggttctcagctggaacattgtgatccatgataaatactactttatctttatccgcaatttgaggatgttttaattgattatgatacatatccaccgtaagatgtgttgtaccatcattactcatcatacggtcaagtgttactgtatggatatcattcggttttacaaaatcaacaccggcagcacgagcgataatcttttctcctaaagtcattcccataatctacgcttcctccttatttaaagatgcaatcaatcctccggcattcaaaatattctgcatatattccggaagctttgtacaggaaaatacctgtccgttaacagtgactgtacctgcagaaagatcaagatctgcctctccaccgtcttctacatgatcgtacaattccttacatacaataactgggagtccgatattaatagaattacgataaaagattctggcaaatgacttggcaattaccgctttaattccaagagcttttaaaacactcggtgcctgttctctcgatgaaccacagccaaaattctctccggcaacgatcaaatcacccggctgcgctttttttgaaaaatcaggatctaaggattcaaatgtatattgtttcattgcttcaatatctggtaaaagtagatactgtgatgcaatgatctggtcggtatccacgtcattatggaatttccatactttattcataaatattacctccaataaaatttctatttattagaatactacaaattaaaaatgaagtccagaaaatcaacgtttttttccattatttttccactcaaaatttcttctaaagattcttcatattacatgctgtcaattcaaaatgttttctatttgtttttataaccccttctttttgtaattttgatatctctgtagacattgctgcacgatcaatgcaaaggtaatctgctaactgctgccggtcaaaaggaatatcaaaggataaagaagactgtctaattgattctgctgacagataagataacaatttatccctggtagaccgcttacctacatgcgtaatcttgtcgttaagaatcagtatcttgtttgcgaggacactgaccagattacgaatcagcttctgatgatgttcacatgcagttggacaagaagtcagaagtctttggacatgtaaaagaataatctcacaatcctcatccgctaccacactgatattcagaacagcccccggacttgctgcatatggttcaccaaaaaaatcaccagcatggcatttcgacaaaatatttcgatgtccccagagatcttcctgaataataagaacaccgccagacaccacaagtcccattacttcggtagagtctcccgctctgaaaatataagaatctcgttttctggaaattgttgtggcatttacacattgaagtatagataagatctctctatctgaaagacctttaaagaaaggactgttttttaaaataggtaaatattttttcaagattgatcctccctgttgaaattttacttgccatatttttcaatcatacacgtatgtttccgccccccgccagattttatatttcttattgtctttttcaaagccttcatctccactggttttgaaatatgtgcagtcataccggctgctagagaatgttgtatatcttctgagaacgcattggcggtcatggcaatgatcggaattgtctttgccagttcatgtgaacttctgcggattgcttttgttgcttcatagccgttcataacaggcatctgcacatccatcaaaatcatgtcataatcccccggagcagactgttcaaatgtctctaaaaccttttcgccgttttcacaaatcgtacactcggcatcctcaatctttaacagttccataaggatttctgcatttaacttattatcctcagcacaaagaaacctcattccttttaggatattgacatccggctcctctttttctacctgagatgctagtgaaacagacctttcttctgcgattttcaaatccataagcacttcaaaacagcttccctgtcccggctcactctccacatcaatggtacctcccatcgcttcaaccagatttctggtgatagccatgccaagaccggttccctgtatcttatttgtaagagagttttccgcgcgggtaaatgcatcaaaaatcttgtctttgaaatcagccgacattcctataccattatcactgactaaaaagcggtactttgcatagacaaaagaattggtctcacattcttctactaaaaactgaattgctccaccctcctgtgtatactttactgcattggaaagcaggttactgaaaatctgcattagatgaacctgatcactattcacccactcgtgccggatgttttctttcataaacgtaagcgtctgatttttttcatctatctgtgaatgaaatattgtattaagttcctccataaaatccaaaatagaaaaatcagtgtacttaaaaatagtttttcctgcctcaatcttgctcatatccaaaacatcattaatgattcccaacagatgctgtgatgatgtatctattttatctgcatactctattacctttgccttatcacccgcatcatgtcttagcaatgaagtaataccaataatcgcattcattggtgtacgaatatcatgtgacatattcgcaaggaaactgctctttgatctgttcgcttcctgtgccacctgaaaagcctcttctgccgccaggttcgccttcctcagttctgtatttacattttccagtttgatattattttctcgttccacaaggattgcttcctgctgatttctacgcataacaaaagaaattcccagtataacacagacagctacgataaccgtaaatataacgataaatagcatgataaaattgacaagttctaatgtattcgtagcaacatactctgccggaacaagaaaaatcagtgtccattcggcattttccattctttttagtgcataaaaatattctgttccatccagtactgcattagaataactacagcctttttcttccagttccgtctttgttttttcaaaagaagaattatggagatatttcatcttttgcaaaacagaaaatacattatgccccttaatcagttctactttattactgttgaacagtttaaatccattatcatctaaaacatatacactattattcctgtcatatgcatcgcagttaaaataaggatttaactgttccatgttctgagcaattccaaaataacgaatcgtcgttttcttttttccattttgaagctgtatcggttttgacagacgttttagaaacaccatctctgactgattatctgtcatagaatcaaaaacgaaactaatctgcttaggattatcttcaaaataatcgagatcacgaaaaagtcctctgtttccacgttctgtataatatctgccttctgaatccactgccatcaatgtaatcttctgctcttcatatgctgataattcatacttctttttcatatatttgcagagttcatctatcgtctgtacatttgcttctcgcagataattacattcttccattacccggttccagtgggaatcgatcacatcctccagattttgaaacatctgatgagtaacctcttccatctgattcaatcgttcctcatagataatattctgaatataagtttgatacaagaaaaagaatgccagaagcatcactataccagtcatacaacaacccaatattaagttccggtaatcgttttccttctgcattcttttcctccaatcatttccattcagcgtccgcttcacttaaagtcttaaactttccaaaaaactcttttgcggcatctatacctacaataccactgtctgttacttccatttctgattttagtttatcactgattccggaaatagcaacctgataggtcttatcttcttccagttttatcggacttactaatatataagagtaattatttcctgtgccaactgcatcgtatccctctttatataaatcttgaatctgttttcctgttaatctgaccgtctggattgtccgcgaccagcctgtaggaataatagtactgagatcatcaacagtaatatcttttgtatacaattttccactgacaccgtcattattctggtccaatccatttccactgatccatgttccgagagaaacaagcgccagatcactgtttgttgcctgtgcaaagcatctgcctaccaatttcgcacagtttttctgtgaaatatcttccgttgtcgtagtaataacttccggtttattatttaccacactttcctggtcatcttcaagctgctttactacatcttttattgttgctttgttctgcatatattccagcatctttgttcctgtagtaaccagtgtattttcccagcctgtgtaaataagcggtgctgtatttcctgcattgatcgcctctgcaatatcaccataataggtatcgtctgcttttgcatccttaaatggaagaagacttgcttttagtgattcctctggataaagggaagatgttccttccaccgtagacaacacttccatcacctttaacgcatcttcaagcttctgtgaatcgttctcaagctgtttattcagtccataataacgacccaccgataatatgtagacattcttacttccatcttctgaaagatacggcatcagcccgaattcatctgttgtagcatctgagtctgtaataccattctgtgagccaagcatgaacagcgtatttcctttgataaaattctctcttgttactgcatcatcaattggatcactgttactgccgtcgagcataccaagatttttccatttctcgatatattccatgctgtccatcatgccctttgtcgtactgacatttgcttttcctgacaaataatccttctgccactgtcttccatctagagaacttaaaaatcctgtgtctgcaatattgcataaatactgaaaaccatatcccggatactgaatctggggcaggcataactgaacccctgctttctctgcctcttttgcaagctgtttaagttccccaaaagactgcggaagtgtccatccatgtttctttaacaatgttttgttataagtaataccgaaacagttatacgcagacggaagcatatagattgccccgtcatctgatacctctttgagacgagactctacataattatccgtaaaagcatatcctgaaagatcaagcatcttgtcactgaggtcctgctgttccgggtcatagagcgtaagcgtacagatatccggcagatcattttcctccatgattgtatttaggtataccgttgtatttgccccactgtatggaactactttaagattaacctctggatatgttttatgcacttcttttataaagctatcaacatccatataaggggccatgaaggtaataggttcatgtttctttgaattcacatcttttttcccacatcccacaatcccagttactgctatacagagcagaacgagacatacccttcttatttttttgatttccatactttcttcctctcattttatcttccaaaaatctgatccagattctccagaattacatccgaactgattggttttgcaatatgaccattcatacctgctttgatcgcctttttacgatcctcctcaaaagcatttgccgtcatcgcgataatcggtatattcgcacatttggaattattcaatgtacgtatctccctagttgcagtatatccatccatctttggcatctgaatatccatgaagatcagatcatagttgttgcctctttcagatgacatgatattcacagcatccgtaccatcctcagcaacatccacatccagaccaatttcctccatgattgctgttgcgatttcacgattcagttcattatcctctacaagaagaactttcttccctgcatagcttgtctgactcgctgcctgaatcttctgattctcattctgaatgagttttctttgttccggactcatcagcacttcccgcaattcggaaagaaacagtggttttgatacgaacgcagtaactcccgcttcccttgcctcttgttcaacatctgaccagtcataagcagtcaaaataataatcggactctccggtccgactaccatgcggattcttcggacagtttcgattccattcatatccggcatcaaccagtcaatgatataaactttaaattcctgattctgttcataagcttctctcgcacgaagtactgcctcttttccggaagtagtccaatctgctgtcatctcgatctcacgcagcatcttgcttacactcatgcatgtttccgcatcatcgtccaccacaagtgctctggcacctttcagttccggaataggttccctttttaccgttactcctgatgtttcgcattcaagtataactgtaaactctgttccttttccaacttcactttcaacctgaatcgtacctcccatcatatccacgatatttttggtaatcgccatcccaagaccggttcctccgattccattctccgtaacagtatgttctcttgaaaatgagtcaaacacttgcttacaaaactccggtgacattccaattccgttatctttcacactaaagattactgttgtatatccctctcttctgcacggtttctccgaaacgcgaatgttaatcatcccgccgactggtgtgaacttcacagcattactgataatattcagaagtacctgcgtcaaacgcagcttgtcgataataatatcttcatgaaatacatcctgtgtatcaatataaagatcctgctgcttagaataaacagatccctgaatgattgttcttaaatcatgcagaatatctggcaaatgtaccgttgtatattcaatcctgacagagccactctcaattctgctcatatccagcacatcattgatcagactaagcagatgttgactggatgtttgaatttttttcagataatccaaaacaagctctgtactgccaatatgtgttgttgcaagtgcagtaaatccaataatcgcattcatcggcgtgcggatatcatgagacatattatttaaaaacgctgtcttcgcccggttcgcatgttcagcggctgcaagtgcatttctcagattcttatcctgttctatctcatgttctttttcttctgtcatatcacggttcgcaaccagaacagtattcaattttccatctttatcatatccttgcggtacaatgattatcgtcagccatctttcatctactgtctgcgctgtaaaactcaacgtttcgtgttcttccagacgctttgccaccgtactcatatcaacaaattcccaataggcttcctgaaatggttctgcaataacctgctgtatcagttcttccagatgtgctttagagagtatgtccccttgctgatccggcttcatatcttttgaagattttacgatttctatttcctctgtttttaaatttacaagagaaatagaggaataggcatgaccaagtgcattgatcacgcgaagtctcttttgatcctgaaggatacttctcttttctgttctgttccttagcactcgataaaataagaaaataagcagtgcaagcagcgcatagatcacgcatattgtattgcgtgtaatgtatacctgatgtttcggaaaaaaaacgtatgcattatagtcttttatcttctcctggcgcccgtaccaatttccattctttgaacgaagatggacgattccatttccacctgacttaaattcattttcatacaaagactttgcgccctctacagaactagaaacaaggttctgtttatttgtactgacaatcttatcctcatcacagattgcaacacatccattcatttcaaaaggaaaatttgaaaacaacgatgccatcgtcaggtctccgtttatctcatttacttcctctttctgctcatatgcaattaagatacctgacgcatcctgccttgccaccgctacaaaatcatagagttttccttcatttctcagacgggtcgtatacgttttttccggatgttcgacaatatcacgtacataatcactttcaatcagcttctgccacaacggcatcgcatctccatctctcgtagtctgttctatcaccttcagcttcttatctagcacaagtattcctgtcagacgctgttcttttgcatacttatctagcatttctgctctgaaatttccttcctgcgctatgacacggctcaattctgttgttttatccataagacgtaccagactcttcacctgatcattcgtattataaatctcataactttcgatccgcgtttttacaaagtcaaatgtctcattcagtgtacgatttagcttcttattatcacttgctgtcagcagagaaaagattaggattccgacaaaaatcagcgtaaacactagtaaacatgcatttctatcaaacttttttttctgtacctgaggcatctgcgacctcatctgtctactcattttgttctccttccggcaaaatttcgtccgcatccaatccatattttgtaactattttttctgtaattccttccctctgcaattttttaagtgtttctgtaagatctgctgcaacttcctcgtgcgttccttttttaaaagccactccaagttctgatttataaatactttcatccaacattcggtaagcatccttaccttctttcaccagactgccaagcattgcctcatgcccggcaatcgcatccacataactttttctaagtgccgcataaatttcattcgttgtagaaaaacagttcacctgctgcatctgtggaagatctgacttaatattatgaagaaaaagatcctctgcctttgtagttgcctgcactgcaatcctctttcctttcagatccgaaagtgtttggatttcgctctcattttttacaactaccatctggcggctgtacaggtatggacctgcccactgatatttgtcttctcttccattcatggaatagctgctccacagacagtctactgttccatctgccaaaagttcatccttatcttcccagactatattctcaaactttggccgatatcccagcctccgaaatgcttccttagcaagttccacatcaatacctttatattcgccatcacttgcctgataactgtaaggttcaaaataatccattccaataacaatcttcggcagttcactgtcagcctctttctctttctttactccacatcctcccagcataagactgcaagtcagaagaaatgcagcaatacaaattctgtttccccaggtacgggagttattctttcgattttttctcatatccagttccttaatttttaataattttgattacttttcataaaatgaattgttaaataaaatagcactgccagatagacagcgcatactttttctgcagctttgcatcgcagacttttgtttgttttgccaaaaaatgctgtttttattataacatttcattttttattatgtctacacttttctgcattattcaactcacgatcagtgagtttcttgttgcctgatcatttctgctaacatcgacaacagcttatcgacttggattggctttgcgatatgaccatccattccggctgcaatagcatctctcttatcttcttcaaatgcatttgccgtcattgcaatgacaggtatacttgccttatccttatctggcaaatgcctgatcacctgtgctgccttatagccatccatatttggcatctggatatccattagatgaaatgcgatcttctttttcttcgcttcatcatcaaatacttcaaataaatcctgccagatatcctcaacctgaatatagttctcatcaatctccatccttccgctctcaatccgggccatgtcaagtacattatttatgattgacaaaagaagattcccggactgctgcagtttttctaaatgttctgaagtttcagatagttcattttcttttagttcatccttcataagctgtgcatagcccagaactgcattcataggggggcgaatatcatgcgacatattgttaagaaaacgagtctttgcaagactggcatcctctgcttttttcagagcaatctccaacttgtcattgagccaatgaaccgacacgtatggtcctctgctccttcatctgcgtgtctgctttttttgtttcctgttgcgttgtatcatccactaccgattgttctgttgctgtcgctgcatttacaggaacacaaaccgataaagtcagacatactacaaatatgctaaaacagaaacagcgtattctttttaaaatatgattcacttgatttaaatttttttgctgcatattattcctttccacaatttaatttaccaatcatggttttattatgtaataaataacttttcaaaatcatcccttctgttggaaatcaaacatacaagatgaatttataatattataatcctaatagaaacaaaagttaaatattattgatggaggataaaaatgatacgaaagattattcgaattgataaagaaaaatgtaatggctgcggtgcctgtgcagatgcctgccatgaaggtgctattgatatcattcatggaaaagccgaattggtaagagagcatttctgtgacggactaggcgattgtctcccggaatgtcccacaggagccatttcctttgaagaaagagaagcaccagaatacgatgaaaaagctgtaaaagaagctcagaaaaaaatattagcaaaaaatcagacaatggctacacatgtcggctgtcccggatctaaaagtatgcagattcaacggaaggaaacatctgaaacaaaaaaattatcttcaaacgcagaccaggtatcaagccttcagaactggccggtacagattaaacttgcacctgtcaatgcaccatattttaacgatgcaaaacttctgattgcagccgattgtactgcttacgcttacgcaagtttccatcaggattttatccgaaacaagataacattaattggctgccctaaattagatcaggtagattatagtgagaaactgactgcgatcattcaaaataacaatattcaaagtgtgacgattgtaagaatggaagttccatgctgcggcggtcttgaaatggcagcaaaaaaagcacttcaaaatagtggaaaattcatcccatggcaagttgtaacgataagtattgacggaaaaatcttagaataattggatgttctgtaaattagcgatatcaaaacactgtaacgaaaacttcataaacaaaagatttaatttatgaagaagtttctttgaaatttctcttgcttttttctaaaatttcatatataatttaaatataaattagacatattattctaattttaaagagatgtcactactatactggttcttaaatatttattttatatatttatgtgtcgacatctctttttttgtgttcatttatctccaagaggatttcgataaaacttatgctattaaacatccaagaattccccagtgtatttatgattaatttctaagaaaggatacaaatatggaacgattacccaaagatccaattatgctttacagtgtcattaacacaaagctacgcgacttctactcttcattagaggctttatgcgaagatatgaatattgataagaatactcttaaagaaaaactatcttctgcaggctttgaatacaataaagagcgaaatcagtttatctaatactttgataagctgattgttaaccaccttccattccccccggatttaatccccgattatatcttctattctacatcttatcttctagatctgtttccgcacaatcttatactcatcatacatctgaaaatacggacaactatctgcagaaccagacaacattctcgccagatcatcctcatccagattcacctggcattctcctgtcccatcttcttcatcaatccagtaatatgcacataaatcacattgacttgtcataactaactcctttattgtaaaaatattacatttattttatcacaatcttttttttatttcaatattatttttcatattcttttttacataaatttaacttatatttctttcctttcttaccaatacttgttattataaactatagcgattttatcaggaggttaatatttatgaaatgtgctattgtcgatttaggttccaatacaattcgtctttctctttacaatacattagagaatgggagttttgaaaccttattctcaaaaaaatatatggccggtcttgccggatatgtctcccatggaattatgtctaatgatggtatcaatcaagcatgtgccgtactgcttgatttcaaagtccttttacagcagcttggtgtgaatgaaatgcatgtgtttgctaccgcttctttacgtaatatcaagaatacagaaaaagcacttgaaacaatcaagcgcagaactggtctttgtgttgatgtcattgccggcagcgaagaaggtatcttaggctactatggtgccctgtacacaaccgatttaaagaacggtattatgttcgatattggtggtggaagtaccgaattcgttcgtgtaaaaaatggaaaagtaaaaaaatcccaaagtatttctatcggttctttaaatcttttccacaatcacgtttccggtttatggccagataaaaaagaacaaaaagcgattgcaaaacgtatttcaaaacgacttgatgctgttgattttccaaaaaaagcaccagaaaaagtctgttgtgtcggcggtacatgtcgtgccatcttaaatattgtcaattaccattttaacaaagaggaaaataatcgaatcattacaaaagaagaattcaataaaattttaaaaatactattaaaacgtgatgctgcttcccgtaattatattttaaaactatgcccagatcgtgtccatacgatcatccccggtatgcttgttgtaaaagaaattatagaaagacttcactgtgagaagatatgggtatcccgctacggtgtgcgtgagggatatctttgtaaaaactttttaatgacaggttctacacaagaacttccacaataattctttctccaagacaccttgaagtattcgcaataaatgttataatggtttattgtgaagatttttaggaggagatatcatgacaatacttgaaaagagaaagttagcaccagaacgagatgaacatttaaaaaaaggagaattcaccgttttaaatggagaatattccaaaaactttaatgtatatgttgtaggaactaaacataaggaagccgttgattttatcaaagttgctttagaccgttccacagataatgtacttggctttggaatcaagatgggatgccagaaaaactttaatgttatcgtatgggatgaagaagatattccagaagaatacagagcagattaactactaatttgagagattaaagaaacgaaaaccagaaatttaatatagaagaaaatgtgaagataatcgcttcgcattttcttctatattaaatttctggttttctgctctttggttccagatggaaattagtatttaaatcttggctgggaataaagggattgtccagaagtctatggtttttatttggaatgaaaatctccagataaggatatcttctttatcgtagttctcttacaattcagtataaaaatgtgtttcagcggctggcagttttgatagcaaatagcaaactagtgatttgtgttggaaagagaaggggattctttggaaaattatgatttttaatcaaataactatttctccataagaaaatattccttgtctggagcctttatttggatgaaaaccatagccttctggacaatcccctcattctcaccgattgtggatttagataggcagaaaaaagaaatactgccctatcccagatgcggcttcggagcgtgtttaagatgcggacaagcattttaaacacagcgactacagagcagatgggatagggcagtatttcttttttcgtctctacaaaatctacaaactattattttctatgaagaatcctaatggaattcagaaggcagagtacggatactcctgtatctgcaaatactgcgatccacatatttgcaaatccgaaaagtcccatgatcataacaataattttaatcgcaagtgcaaatacaacgttttgccatgaaatgctgtttgtcatctttgcaatgctgactgcttccggaatcgctttcatttcagaattcataaatacgacatctgctgcttcaattgctgcatctgcgccgcttcccattgccgcaccaacatctgcgccagcgagtaccggtgcatcgttgataccatctccgacaaacataactgctccatgactttctctgattttcttcaactcggataacttatcctgtggaagcaattttgcatgtacttcgtcgattcctgtttcttttgcaacagcatctgcgctctcctgcgcatcgcctgtaagcattgcagtaatgattccctgcttctttaccgcagcgattgcttctttcgcatcttcctttactgtatcagaaataacaatgtttccaacaaatttaccgtttaatgcaacgaggacttctgtgccaaagtcttctttctgataggagctaagatcaacattctgttcatccataagctttctgttaccacaaagaaccacacctttactaagttctgcacgtataccatgtcctgcgatttcttctactttagaaggccgctcaatggaaagtcccttttcttttgctgcatctacaatactatttccgatcggatgtgtagaagacaattcacaacttgcactaattgctaataaatcatttgcagtcatcgcatttcctgccggatttgctttctgaactacaaagttaccttttgtgattgttcctgttttatccattacaattgctttgacatttttaagcccttcaatagcaattcctcctttaaagaggataccttttttagagcctgctccaattcctgaaaagaatgccagaggaacacttaatactaatgcacaagggcaactgataacaaggaatgtcaatgctgtataaattgatgctgttccgcttgttccatgaatggtatttactgttcctgtgtatgcactatctacaaaaagatgccagttcagagaatcaggtaaaataaatggaagaacaatcgctacaaataatgcaaaaaatacaacaaacggtgtatacactcttgcaaaacgagtaataaacttgtcaatattcggcttacttgctgctgcattttccaccgaatcaagaattcttgttaccatagattcctcaagaattttctcgacacgaatttttaactgtcctgatgtattgacacatccggaaacaatattatctcctgtttttgccataaccggtactggttcaccggtgacaggtgaagtatcaatacggctctctccatcaatgataacaccatctaatggaatacggtcaccgggacgtactaaaaggatatctcctacattagcttcttctgcatcaatgacacgaatatcttctccaacaataagattaacaacttccggtcttaagtcaactgcttccataatctgtgtacgactctgctccgttgctttttcttcaaaatattcaccgatacgatagaaaagcattacacctactgcttccggaaattcctgaatacagaacgcaccaattgttgcgatacacatcaggaagttttcatcaaatacctgacctttcatgatattctttccggctgtaactaatactttgccgccaagaactaaatatgcaatcaagaacagggcaaacattggaattgccggtacattcccaatatgttcaagtacctcaccaataataaatattactgcgccaataccgatacttactaatggattgttaaatgagaatttcttctcttctttttctgttgattttgctactttattatcttttggcacaattgtaattccatcttccatagaatcaattgtttctttaattaatggaatcatctgatccggattctttgcagaaagcttcatctgctttgtcgcataagtaattgtcagatcatctacaccattgagtgttcttaactttgcttcaatcttagctgcacagtttgcacagtcaagtccttccaaaatatatatctttgtattagaaatacctgttggtctctttctctgtcgtggaacaattgtcactccatcttcaatagaatctacgactgcctgcattttaggcaataactctgcctgattatttgctgaaacacgaagctgctttgttgcaaatgctaccgaagcaaatcctacttccggcatctgacggatttttgcctcaatcttagccgcacaattcgcacaatcaattccttctaaaatatatacctttttctctaaatcttcatccggcatatggcaagtacactttgcaagactttctccacatacatcacagtattctacataagaattacactgactgcaatcacagtgatccggatgtccggctacatgatgaaattctacttcaaaatgcgtatgtgatcgcgttgcctgtggtttggatggttcatgatgatgatcatgcccgcagccgcagccgtcttcatgaccatggtcatgatgatgctcgtgtccacatccacagctctcttcatggccatggtcgtggtcatgatgctcatggtgatgatcgtggccacatccacagctctcttcgtgaccatgctcgtgatcatgatgctcatgatgatggtcgtggccacatccacagctctcttcgtgaccatgctcgtgatcatgatggtcatgatgatggtcatgaccacatccacagccctcttcatgactatgctcgtgatcatggtgttcatgatgatggtcatggccacatccacagccctcttcatgactatgctcgtgatcatgatgttcatgatgatggtcgtggccacatccacagccctcttcatgactatgctcgtgatcatgatgttcatgatgatggtcatgac

SEQ ID NO: 411 - DNA, 48990 bp, Eubacterium hallii
  modified_base (31895)..(31994): a, c, t, g, unknown or other
  misc_feature (31895)..(31994): n is a, c, g, or t
ctctaagcccttcatattcttccgtatgtcttggataggatttacaggtatcacagagtgcatcgggtcctaatgctttataaagatcacacaaattttcctcatttaaaaacgcacaccgacggttattctgataaaagcactccttttcccaatcaattgaattacgcagatgtctcccaaattcacctgcttcttttccataacgttccaaagattcctcatcgatcataatctgccatcctgcacagcaggtatctgggcaatctcctgctgtgcagataaacttgtcataaaaatgtggttttaaatatttcatattttttccttttcttttcaaaattttcataaataattcgttttttctgtacaaatagaacagactatattatagcgcaaaaaaacaaattttgaaatccatatgatgttttatcttgatgaatccgaatctattaataatcattttatccaaaataaaaaggaactatctatttgatagcccctttttattattattctgttgcctgaatcgcatcatatccagtttctttcgtacgaatcttttgagcatgacgaatctcataagtaaatatcttgccatcgccaggttctcctgtataggcagctttttcaatcgcttcaatcgtttttgcttcccattcttctgaagaaacaacgatttcaaacttaattttaggctgcatctgcatatcaacctgcataccacgaacaatttctttatatcctcgctggataccgcatcccattacctgggatacagtaagaccatttacaccaatcgcatttaaagcggcttttacatcttcaaatttatcttctctgacataagcctcaacttttatcatcatatttctattcctcctgtttttctgaaattgcatatgaatagtatttatattactggtcaagtccgttaaaggatggataagcgctctctccatgttcagaaatatcaagaccaacctgttcttcacgaacacttacacgtaatggagtaaatattctgacaattgcaacacaaattaatgtaccgacaacagcaacggcaatcgtaagtataattccgataatctgtgcagcaaataaatgataatctccataaatcagaccatcccactttgcaacaggattaatagaagacttagtgaaaataccagttgcaatgccaccccagattccgccaataccatgacatccaaaagcatctaaagcatcatctatctttaatgttctcttgataaaccctacaccgaagtaacagattggactaactagcgcaccgataataaaggatgcccatattggaacaaatcccgctccaggtgtaatagcgacaagtcctacaactaatcctgtagaagcaccaactaatgtcgtttttttgctttttactacatcaataaacatccaggacagaagagctgctgctgcagaaatagccgaagtcataaatgcgtgcgctgccagtccgtcagcttttaatgcactgcctgcattaaaaccaaaccagccaaaccaaaggagcgttgctccaaggacaacagaagggatgttgtggattcgataagttgtatgttcatagcctcgtcttcttccgagaataatagcaagtactaaggcacttactccggagctgatatgaacaacatctccgccggcaaagtcaaccgaaccgattgccgcaagaaatcctccctcgccccacaccatatgtgccataggatagtagacaataactgaccatattgctacaaaaagaaataatgctttaaatttcatacgaccaactaaggaaccagtgatcaaagccggtgtaatcatagcaaacatcatctgaaatgcacaaaatacaagatgaggaatactatctgcataaggtcctgcgctcattccaacattatttaaaccaaaccagcggaaatcaccgataatccctgcatgatttcctccaaaagctaacgaataaccaaaaagcgtccacattacaacagaaagccccataatagcaatacatgccataattgtgttacaaacattttttcttcgaactaaaccaccataaaagaatgcaagccccggtgtcataaaaaagacaagcgctgcacatatcatcataaaagctgtatctcctgtattcataattatttatgtcctttcttctctttctttgatgattcatcattaattaaaaaatattccggaaaataaaaaaggcgcctaaagtataattattatacttcagacacccttgtcatgcttcgaatattatcatatatttaatcttttttcaagagaaaataattaaaaagctcatgtttggttaattttattaataaatagaaactattcacctaatttttcagacaatattttggcagcatcttcaatgcagccaggacaagaacgaagtaccttgcctgtatccattccttttaattcccggcaaattgtagaaccatttttcttacggaaactatcatttaattctcttacttttttataagtatctgctttagaaactggcgcttccaaatcaccacaactatttgccattcccataataagagacattcctgtcaccgccccacaagttccgtaagtatcactgacaccaagaccaagaccttctgataccttgaatgccgtttcctcatctagtcctactttgtcacaaaatgcacatacgattgcctgtgcgcaattatatccttttttatgatattctgcggctctttctgctctgttcatttgtaaaatcctccctttatacctcattcatgtattttatattaaaatctttcgttgttagtttaacacaatctcatatatcctgcatagtgaaaaatattctcataaaatattaattatacacctagctcttcgagaaacgcctcgcagccttcaatgagatcttcgtaagtttcatcaaaattacccgtataccatgggtctgcaatatcccttttcttccctgcaaattccagtaaaagatgcactttatgcttcggatcatgattaataatgcgttttacattattgatattccatttatccatgcataacagataatcataaacttcataatcctgtttcgtcagctgtcttgcctgcctctttgtatgaggaatttccattgcatcaagctttgccctcgcccccggatgcatcggatttccaatttcttcacgactagtagcacaagaagagatttggaaagaatcttctaatcctctttttttaaccatatcttttaaaataaattcacccatcggggaacgacatatatttccatggcatatgaataacactttaatcataacttttataacctcgcatttcttaatatttagtgatttttagttactttttgacacattgttaaaaaacttgtttgggatatctaagtataatatagcatattatgaccgcgaaaaggtgtaaaataagctgtatatttttatattttacatcttgctattttcaattaaaaattatcattatacaatccgaattcgggcaacttcttttccggcatctttaagatttacatgcgtatatgtatttagcgttacgctgatatctgagtggcccatcaaatattacaatgcttttggattcattccggattttgccatatttgaacaataggtgtgtcggcatacatacggtgtaatgacaggcatctgtactttgtaagtattattatacttctgaataatatgtttaaagtagtgctcccagtgcaatgaataacagatacttccatccttatcaaagtataagaatccactttttccatctaccataggttctgctttgggcggatttcgtttttctattattttctgaaagcattcctctacatctgcagtcataggtatctttctcgttccgctggttgtctttgtttcttgaatataatatccgatttttgattttttctgcgatacgtccatccttctttttctcttttacccacgcaaaataggcttccaccaatggctttacgctgtcctgccggcgctttttccgttcttctggtgtaagctcttttaaggtattgtccacgtgatatatcatatttatctattcgagggcctgccatgcaagactgctcttccggctctttgcaggcagggcttttacggcttcttcataccggcgtcttgcatgtgcctagcatccagctacggtcagatctcccttttcttttgccagtttatgatatacctgataaccatctgtcacacagactccttcataatccttcaggaacttttccggatggtctgcttttcttgttttctggtattcatagagaatgacggctttttcttctcccccgccggtacaatacacccacataaagcttttgctcccggcatctcttccgtcttttctcacaaggactgacgtctcatctgcatggatgaccatgctttgataaatatacctgtgcagataatcatagaatacggcaagataccgttctgcacattcgattgtccagtttgccatgttctgtcgggtaatggcaagcccatatctggaaaactctttttccagtctggcaaatggtactccgttgatatattttccattaagtacggctgcttcaagggaaggagaaacaagacttcctcttaaaaggcttaccggatgcggtgcttttgtcatgctgtccccatctttacttgcataaacaccaacatgatgttcttccacttctacttttgcagggacaaaacgataccgtgtatatatctcatctggaagctgcttccatccgttttttccaaaacgttcctgcagttcttcttctgccagataatgttccacttttatgacagggatcccggaaaggtctgtttcccgtttctcttttttctttacgggatgcttctttgaaacagtctcttcctcattttcatccagagaagccagtgcctcggcttcattaaacattaccagctctccgttcacatcggcaaatgccatctgctgtggcactggcatctgttccgtctttctcccatagcggttctggttcatgaccgcaagctgttccaataccagctgcagtttcttatcaatctctgaaagctgctcctgttgtgcgaggaacagctggatgagtgtttctttcgaaaacgtattcagtttttcttctgtatatctcatctgcataacagagaccttccttttctaaagattatctctattatatcagaaaacaggacagcaggcgaatcgcccctgttatccttttcgtcagtatcacaatgctttttccgcttatttctgtgcctgcaggcaaagaaaacagatgcccttcttccaaaaagaaatctgcgttatcttgtaaaaaaagaagaacaggcggcttatatataagaaaaaaatgtgaaagcccgcctgtttttttcgtccataaaaaagtttaaaaatttctacgttatgcacaaaactataccgtataatctggtgcctttttcaatcgtttcacctgctttttagggagtgtagtaagaccttccataagccatcggaactgttgggatgtaatggaacgtacttctgattctgttcttggccattgaaacttccctgcttctaatcttttataaagcagaagataaccgtcattttcccataccagacctttgatacggtctgttctccgtccacagaaaagatatagggtatctggttcgatggcatcttctccaagataagagcgcacagtatctgccagacggtcaatctctgaacggaggtctgtatatcctgttacaataaatatctttttaaaacaggtcgcatcatttaacatgtgagagtacccggactgtcttttccagtaaagcttccgagatatctccatgaacccggacgatacatccatttatctcgatagagatatcgggagtactttctggcagatgcataatgttttcagaaatctcaacaacctgctggcatggaagagaatcttccgggatatgctccagacaggctttgcggatacatcgtaaacgataatagtaattcgatttggagatgcccctggtatcgcaccattgttctaccgtcatatcggaaggacggttctggcattctttgaccaactgggcccattgctgcaaacgatagtcagcagcaactgctgtagtaatagaactcataggaaatgcctcctaaccagtcctaaaagttgagtactgaacttttaagacattcaataatcataggactattatggcactggttggaggtaaaatcgtaagcaggtaatcatccgtaccttgactaaaaaagccgtccctctgggcggctcaaaatttattttttcggtttagtttttgtctttatttcttccggcagttcttctgcccatggaagtaagctatccagttcctctggctttgggaatggtccaagctggcggagtctctctaatacatacgttaagtaaagatatggttttaatccatttaaaagggctgtctctactatgctgtaagtaatggcactggcatctgctccacgtatacttttcgcaaataaccagttccgtcgtcctactgcaaagttctttattgcacgttccgcactgttattatcaatactgagatgtccatcttccttgtactcccttcctgctctggttcaccaagtacctgtatccgggattcatcacagtggatgtaatggcttttcaggaatacttctttcatacgtccatagagcagtttcagataccggtctgcacagcagatgacccagttcgccattgtcttcgtcgaaaggttcaggttatatcttgcgaattcccgttcctgtcttgccagcggcaggccatttacatatttcgcgttcatgatcccagccactaaggatagggttgctatacttcccttgatcaatggcggtgtcttttccgggcgtttcatcactccgcattttgaacagctgtatacgtaggtgatctcctttactacttcaaagtggggcgggacaaacttcagacgttttacaatctcttttgcagcaactttatattttgtaccgcactctggacaatactgttcttcttcatccagtttatatctctttgtttctgtaacttcgaaattagaaagatctgcttccttctttcctttccgtttctttctcttataagaagccggctggatttcttcataggcagctgtatcctctacatctgcattcatctctgcttcattaaaaagacagagctgttcatatccgtcagcatacttctcacttgactttccgaaccgtcttctttgttccagagcgagacggtcagagagcatagcattcatgaattccagttctttttgtttatccttaagaagctagatctcgttttcatttttacttttctgttcctgcatgagcagcgttactttaatgagatcttcacgtttcatgttattgagttgttcttttgtaaacaatggatccatctgtctgctctcctgcctgtaatcttatggatagattataccatatggtatagggttttatccagaaaaaacagcagtcataaatgtaggaaatagcaggaaaaaccgcagatatttcgtgtttttgcggattgacaggaaaaaccgaagtctttcacacgataatcttgggatgccgttctttaaaagccccttgcggatttaaagacagcccgtcacataaccagtgcatctcttttaatgttactttctgcagctcatccggcgtgtctggccagtgaaaagaattcctgtccagctttttcataaggatccagaaaccggatccgtcccattgaagaatcttgacagaagtgcgcctgcggttgcaaaaagcaaacatacagcgggagtatgggtcgaggtggaatttcagcttgatgattgcagccagtccattgtaacttttcctgaggtcagtaactccacatgccagataaacggtagtgcctccagccaggtcaagcatgatatcttagctcttttataatagcagacaaaagttctgatgggcaggagggacagatctcaatacggatactgtcattaagaaagatatggatagaggatgaaggttgtgaggaaacaagctctttcctgcgtaattcctgttctgttggcatttttgcaaagacaggggcatcttcttttacagaaaccgtatccagattttttaatttgcggatccagtaagatatggtagaaacaggaatctgatgttcctggcaccatgtccggcaggtctgtccactggaataaaatttctgtacacgttcagaccagaataagattttctcttcttttttcataatggtatacttcctctcatattttgagaagattgtatcagaaaattaattgtggtaacaggtacggatgattacctgcttacgtaaaatccagatacggactatctaccacttacatttttagtgcaaaagaaaaacacccaaccgttgaagttggatgcttcctatcaattacattgaattctattatttttctgaaaacatacagtttttataaacgcccaaccgaaaccgaacagataatggctacttaggagatgatcgttgtttctttataaggcgctgcgtgatatctttatgcaccgtagaaaatccattgtatgattggcgaaccgcacatgccttgaacaatacctttatttcatcaacacagataatctatccttgaaatatttcggatacgaatcaagacaactaaagatttcttcactatgagctttcaacatattaagtatcttgtccgttccaatattcgcatcagataaaatttgagctaattctatagctaatagacgatcattaaaaatactctcacaaacagaaattgctgtcatatttggaacgccatattttactttcttttgtaacaatgtcaagaggttcctttgatcaacttgctcctcattttcttcgtcaacttctatcagatcacagatattgccgataagaaaattcatttcatatgagattcttttattacataatgattctacttctgcaattccaatagtttctttgttgttaatttccattggagtctggccatcaatccattttttacaaacgctttgtatatgctcttggtatctaaagtctccacagatttgcagatacaattctgcaataacagataacagttctgtttctgtatatatcttctctgtaagttcattctgaacaatccattcctctattagagaagacaaacctattcctgacattgcattagaatatctgctcaatttttcaacagaatattgttgaatattctcttctatcttctgaaaaactttaatcagtaattctttctctttttttgttgccatagcatacgccaatgtatttgtagaaatatccacagcacttttcttactatcattgaccaatgtttctgcggaacgtactaaacacaaataattttctatatttgatataatatcctgacgcaataatatttcctgcacaatcagattttgtgttcttttgggattggcttttaagtatgctttttctaacttctttgcgtaatcaagcaagaaatctctttcgtcaaggtgatctatcactatatcaataaatttctcaccacttacggtcacatcataatctatgttaaaatcctggactaacgaaagaatagaactgccacaaggttctgtcaattttgtatcaaatagctttacacaatcattccataaatatcctccaccatttttccagttggtacggttgtcgtatattttgcaatccgtaataataatacttccttctgtgtatatacctgctcgtgctgttcgacccatcaagttttgaaaatctcgagcttttactaattgcaatccatttcgaatgctggtaaccaataaatattttatcggaatattcacaccctgtgcaagcgtcgatgtacatactacgcaagaaacatatttattcttcaatgcatgttcaacaacaagcttaactccattttgaagattagatgaatgaggcaaaacacccaattccgctgctttcgtataatagtgctctgaaccataatagctttctataaatcccttgattttggaaagctctgcttgatttgtattatcttttaatgctttcaaatcatagtttcgcttatccaaatttataattctttcaaataccgttttcattgaacgttgctgcccaagatagatagcaacaccgccgttatgacacaactttattgcattataaatggccacatctgtagatgatgataaatctggaaaatatttattacttctttctcggggtaacttcttcaattgttcaactcgaaggattcggggaatataataatcttcatttgatttatcatcagaaaagaaatgaatatccctttgtgtcgatgaaaatcctattgatttaggtgttgatacaatactatcatctgtcgccaaacaacctctatcctcaaacaaccactgtgcaatatctcctgaatttggcaataccgcagatagcaaaacaaactgctgttcgctcgttatgttctgacgtatatgtgttactaataactcatatgttgcacctctacctccatcatcaaacatatgaccttcatcaaacacaaataaatctatagcacttaagaaaaacggatcatgatgtaatacataactcagtttctctggcgtacatattagtatctgccgtttaatatcttcagaaaaaaaattccaaaaatcattttgaagtacatcagaaaactgatttatcgtgacatcatttccaaaagctttgtacatatccattgttatttcgttgcacaatgctcttaatggtgccactataatagcaatattcgctcgttcagataaaaaagctgctctaataattagttcaatacttcttgtcttgcctacccctgtcggaagttgaacaatagagctttctccacgcaacaatcccttttcggctattaatctttgtgctggccataacatctttattgacatcttaccttgtagatatggctcccattcttcatccgggatacctgaactactcggcaaaagactccatggcgaattttcgcacgccacaataataactgccactaatatatctacataaaatatactatccggatctccattctcgtatatttcatttctatatacccataagtttgactttaatgcttctaaagacttaccctttccaaagtaatccaagaaaaaattatttattcgctcataagtatctataactctcaaatatggcaaatacactccacccagaagataattatagagattcgtcaacaatttctgcggagatcgctcctcatcaattaaatcaactactcttgctgccaacactttagcactaccaaaatcctttcttaggaagtaggcagatgctccagatagcaaaaaatcccaatcatattctggtctatctttggacttaaaagctgaatcataatattctgcagttgtaatcaaaagtaactccagctcttttaattcgtcatgattattttctataatgcattctgaatatcgtgacagcacataagttgttggatacgataattcattagaattcagcggaaaatgtggatactcctgctttgaaacatcgtattctaccattttggcctttgctttttgatattttaacattaagcctgcatttttcccaaaaatcatttacaacacctctggtaaatgttatgagccaattccatcaactttttaccatgtacataaaaaatcagttcattttttctaatttcaagttcttcaccagaaaaatctaattctatggcatcatctacgttttcacgactactaactcctgcagccacatatgtaatacgataattattatctggtttaaataagaatctctttacctcttctgcctcttctattttgcccagttcttttaatcgctttctgcagtagtttactgatcttgctaatcgatgttcatcttttctggaatcgataattgcatttttgattggtgtgtactccgtattagagagggtagctttaacttctgctgctaccaattcatctttatcatttgaagttttatcttcatttttgtacttatatgcaatgacatcagttccttgttgtgaattgttttttccggatctgttcttcaatttatatctcggaacagaatactgatgaacaaactctaataaatcggaaattaaaatttctgttatgtctgcagaacgtaccgtagctcccaattcttctcctttttgtggaattacataatcatacaaatactgttcaatagtcattgcattgtcatctgcgtcttctttaagttcagtatcttctatgtaatttcttcgaatgtgcaatgcccagtcatcaagaatactttcatcatctttataatcaattttatagcattttagcggtatgtcatctttaattacaataccagtttcttcaactatccaatcgatgtattgtggcttttccatgtagtattcctttcctaacttttaaactttatacagccttcaacaacatccggattattcttagatgtgattttatatggtatctcatcaatctcatttttcacaaaaaggattgtcgggaaagcaacagttgtattatgttttatgtaatctactttaagctttacaatatacttatcttcacttgaatagaatccataacaaaacacatcttttatctcatcagtgaaatcatcactataattcggaacatatcctgacaaaccatatggacgtgctccatacggagttcttccattttgctttgattctgaatattcaatatattcagatgtgccttcaattccgaacaaaatactcatatcacaatctgtaagcaaatatcccatctctgcattattaaacttagggaattcacctaatgtaagcaaggattcttttggaacttcaaacgtaatttcagcatcttcgtcgatggccttaccacaattctgaattgctaatttaatacaattcattccagaaaacgctttctcaaccggagcccattccaaagctttagaaatagtttcatgcaatcttttgattttccaatatttctgcttttcttcggacgttccattcaacttaggaccactgagtggatttgatgttaaagtatctttgtttaaatttccaagttcaaaaaaggaatcggacaactcacactccaactgttcagccgcaacagtaataaactctttctcatcttcatctatgtcaacagggcttgtaaatccagcaaaaaaagtattagttgtaacagatctaccacctacattcatattagaaatctcctgatacatattcttaatcgaagtaatgtattctttcatggtaatctctgcatttaacacgaatgggcatacaaccgcttcttcagtcaatcttccagtttcgtcaatacctaataactttaacttagaacgatattcattggctgtttcacttaccctcttttctgtcaaaaaatgcatggaaagatgggcaaaaaacatctttttaaattcttcgtcggatgaataagtgaaatatattcctttgtctttatatttgtcacggaatgcttgtattttctcatagccgtcaccatttatttttgatggtgggataggcttatccgaaaaatacataaacacttgttttccagactgaagcataatttcaatttcttcttctgttccagaaccatactcatcagtaggtgagccaaatcttgtccagaaaatcgcaactgctgcatcacatttatttacaaactgctcgttaagtaatgcctgtggttttcctccagaccgagcataagaactcttactccaatggcgagtttttattgtgattcctaaagtttcagcatataattcattaaactcatctactgcagattcaatcaatgtaacttcttccttaatatcacctggacaagaaatcaaaaggttatataatgtcacattttgagccattgattacacctcccaaacagtttcatccccacaaatgttacgaattttaagtcggagaggtttctttgtgctgcgtatgtaaccatcccagaactccttggttttattgccgtctacgataacatagccatttttatcaatcttgatttcactatcagaatgccactcaccaccgttcgcagtgcaatccaggctaaggaattcaataagttccaagccttcttcactgatttcaatcgatttatacggtttcttcgtagaagaattaaggaatgctttctgattgaattctgcaattttaaacaacacacgatcactcataaatttatcaatagcaacagcatatccgcctgcaatttcttctgcatggaattctgcataatcaccaatgacaacatcatcaagaattgatttaagatcacgcaattcaatttctacagtcgtactgtcatcttctttgatgaaattcataatctccacttcatcagtaatgtcgatatagtaaacaataacctttttaatgtcattatccaattctggaatcgcctgatgaataatacggttcatggtcactttatcaagaagtttggatgcgctgtccattaaatttggcacgtaaacaggaattgtaccaagcttgctatcagagatagcaccttcccagaaagaatccagagaatcttcatttttcaagccaggaatcaaagctttaattttatccattgtctgaaccggattacgataaagttgaactccatctttaatttccagcacatcgaattcagccccatctgcgacaagacgatcacgggttgtctgaacagaattcaatccaatatcacaatgaataaattttctgccaagtttatttgcgcagactgcagttgttccgctgcctccaaaaaagtctgcaactattaaatttatatccgaagaagcttgaattgccctttcaatcaatgactctggtttttgcgtagcatatccaaccggttcttttttatctgcaggttgaagcatagacattctccagacatcatcaatagtcttttctgatgattcctggtaaattactctaccattttcatcttttgcattcacaagcttttgagtttcagaatcccaaacccttttaatttgtttaatagtttcatctctcttttccttaatgggcgagaaaatatatatatcgctttttgtatacagaaaaattacatcatgattagatgcaaatctgtttacattcccctgcattttattgtagtaatgccaaacaatttcattcagaaaatgtgattctccaaatacttcatccaataagatttttacataatgacctatatgccaatcaagatgaacataaatagatgccgtttcgctcattatagacttaatcgccataaggttttcatacatccagttcagatatttttctttatcccatacatcaccatacatcttttcttcaaaagctttcaattcatctacatccagctcttgttcagcctgtgcaataacttctgctactttcggatttcgacgaatatatactttctttgcgtaatcggcaccacttgcaaatggtgggtcaatgtaaacaaggtcaacttgaatgccttgctctttaagataagcacaggcagaaacacattctccacgaataaccatattaccatcggagttttcgcctacagtttcctgtttttccatttcatataaaggcatgccacgttgcaatgtcatagaaacatcgtcagcgcctttgtatctcaatattctattaaaattaccaagcacagcctgtccttccaccggctccggtataaacggtacatatttaattggcattatttgattcctccgtttttcatataacttacaaattgttcaaaagaatttgccatactatatgatgttataaattcttgtgccaattttgctttttgtatgtcatccaactcgtctaatgccttaataaaatcaagcaatttattttttgcattagtatatttatcatcaaactctatgcctacagtaggtctaattccattcattacgctttctccttaaaaaactcacagattttttgatgtgtctgtgtcaatctatctttctctggcatcgtatcttccaaatacaggtaatcaaaacgttcataaccatacgcagcattattctgttttgaaaactccgtttccataaaattcttcttatctttaaagactggatctttggcataaatcagccccttggtttccactacaataaccttatggataacgccatcttttcgtttaatgataaggaagtccggtgtgtaaataccaatgtaattccattttccactggttttcttatagcacttgatcttaaactccgtcatagcacggtcaccattgtaatacacttccagacctaattcttcgataatatcgaaggacaatacttctcttaaaaatgtttgttcaaaaccactgtctgtacgatatggcaagtagtggaacgaacgattcttatttgggtgagatgatacacgctgttgcaattccaaaacgattctatcgtttccagtttctatagcgagatcaattaactgctgtgtctttttatcaactttcaattttcccttatcgtcagccattatgttttcaacaacattctgttttggatagtagtcatccagattatctgcatatatctcagaagtaaaattcgcaatgttcaacaaattagcttcttctggtatcagttcttctgttgtattgaaatccgttttgtcacaaaaagctttgcgaatattggcttctaccaactttttattgtacttcgaactgaaatatcgtgatccacctttttcgtatgtgattttttcatatattacttttaactgctctgtatatgcatttaattctgccatggaaggtgttccaaatccacttctcataatgccataaatccaagaattaaaggttgcatattctgtaccatattcagcatcatccacctggatactgatattatttacattcatagaaagatctgttgttttgataatattacctgcaatttgcgctgaatcaacagatttttcaatagaaacttcaggatttgccttttcaacagtaagtgtatcatagctgattttcagctgataaaactctactttaggcaactttaaataagccgtacgattataacgtttcaaagtagtcttaatgttgtctgcagaagaaaattctttgagcgaaatatggtgctgccgctcaagctgcatatttaatttttcggcattgctttcattcaaatatatcagcgccgtttcctgaccgtttttaatcacctgacgcaagcatcgacaagatgtctgtaataccatcttggttgggcaatctccttcttgagaaagaataatacctgtaagacttcgacagtcccaaccttctttaccaatctgcacaagcaaaacaatacgaactttagaaatagatttatccaagatatcaaactgcatctgactatcagccgacatcttatactgtttatttcctttgtggaatttaagtataacatcagtaccaaggccatattcagctacaatacgggatacctgtggatatactgtttcttctaatttttcgatagtaccgcaataaatacccaatttagctgttaaaccatctgcataaacagtgtctttataagtatcaagaaattctctgacacccttttcaataataatgctactatctgcaatatctgcaatttttacaactggacgttttaagaaatttcctacaccgtctataagtggatagtaatacacaatatttgtgatttcagctgtaccaatggacaatgaatctacaacttttattttttcaactttgtctaaatatggagtaccagaaaaaccaattacagaattgactgtatgattctgcgcccatcttgtaactacagcacgaagcttaatttcatcacttactgcatgatgaacttcatcaataaagatagacaatgatggtaacttaccaattaaattacgaagttcatttgcctgtcggtctttatcgtcctcgctttcttcaaacatatttatctgtccctgtttttcctgaatacggtcaagaattactttttccgcattagtaacagcaacaagaccaaacaactcagaaagcggctgatgattagcgattttctgaacatttggattttttgtcttatttgatttttttgcagttttgctttgatccaacacttcaaaagaaatcatcctcttgatgtctgttgctgccggctccggaagaatccatgatggattaaagttttgtattgttttaagacttggaaccactgatgatttcaaacctgatggtgcaaatatgataaagttatgtgcaaatgacggatttgttggctcgttataagcaaaatataaatccaagtaaataaatgccgccatcaaatatgttttacctgcacccataggaagactaaacagataatccgtataggaaacaccataaaacgcattacgaaagaattcattataatcaattcccgctggatctttctttatctgtttttccagtttttcagatacctgttcacctttatcatttgtcaaacatacatattcaaacaatgccgcagccgctggattctgaaacaaatattcacgagtggattttgacaattctatctcattcaaatcaatagaattaaagaatccctgtctaaacagctgtgtcaacggcttacattcacaggcaatttttagaaacagatataccttaatagcctcaatctgagcatcacgcatctgccctgttttctctatatactcaattaagtttttaaccgtacaccgttctgattcataccattgtgtacacttattttctatcattttatagaacatgtatttactcccgtctttaaaatgtatattattattttttctcaaagcgcaaatttttcactttgaatcacgtttaatatgcaattctaaaataatccaaatacgctttatacttgtcctgtgcgctcaggcaggtatctgtcagatatcctttttcgttgtcccattccttcaatccacgataatagaacatcttcagattgtcctcaataatgaacggaacaatattgtatttcagacactccttaaacataatcaatctgcccacacgaccgttgccgtcctggaacggatgaatccgctcaaatttcacatggaagtccagaatatcttcaaaggtcttttcttccttagcgctatattccgtcagcaaggccttcattttatcggcaacttcttctggaagggctgtatccctgccactgacttcattcggaagtttcttataattaccaacagtaaaccaattttttctggaatcgctggtgccattcttcaaaaccaaatgaagttctttgatgaatttctccgtcaaagttgctttcgcatgatcaataattatgtcgatacaacggaagtgatttgccgtttcaatcacatcatccacattcagcacttctttttctacaccaatagtattagtttcaaagatatatctggtttgagcgtgtgtcaggcggcttccctccatatggttagagttataggtcaaatcaatctgtgtcttatgataaatcccaccggagtatttacttgccttctgctctttcagaatatccaacagagtaatcggttcttcttttcttttgttggtgcgctctggtttctctgcgttttctggaatattccatgtcttaccagtaagaaacgcaccgttcacacgtccttgggcacagtaatttctaacactgcgctctgacatattccatttttttgctatatcagcaactaaaaggtatctcatctacaatcctccgtcataaatcaaatcccaaaaacgtaccaatctactaattagtatatcacaccatcggcaaaaacgccattctttttggccactgtgctattttttagccgatatggcaattatatcatctattaaattttactttcattttcgtacatgatcatgaggctttttccgttcaaattgtgcaatcaaatgtaaaaggaggatgttctttatcaaaataaaaatggcgaagtgcttatcgtaacactcctccgaaagcctaaccggtttgagcaaaatgattggttaggtctgctttattattttatgcaattccactgcatttatacacttaaatgttctttccaatccgcaggaaaattcattactgcgagactgactacaccatgattatgatgttactgtcaagatttcttttgtaaaatgctttcaacatgttccttaaacactgcagaatagacaaatattttttcaaaatcttttcttctgttggaaatcaaacatacaagttatatttatcatattatacttctaacagaaacaaaagttacatgctactaatgaagggtaaaaatgataagaaagactatagagtaaaaggagaatacgagaatgaataaaaaaatgttttgttaccagtgcgagcagaccgtaagttgtgccggctgtacaggaaatgccggtgtctgtggaaaaaaggcagatacagcaaaattacaggatgaactgacaggtgcattgatcggtcttgcaagatctatggatgacacaacaatgatatcccaaaatacctggcgtatcatcatagaaggattgtttactaccgttacaaatgtaagttttgataatacagccatcgaaaatatgatacaaaaagtcagagctgagaaagaaagactggttcctaactgcagcaactgtcaggctccttgtggcagaacagaggaatacgatatgcaaaaactttggaatgacgatgaagatatccgctctttgaagtcgcttatcctctttggtattcgtggaatggctgcctatgcctatcatgcaaatgttctaaattatgaagatactgaagtaaatcagttcttccgcgaagccctgtttaagattggttatgaagaaagtgtggaaagactgcttcctactgtactgaaagtaggagaaattaatctgaagtgtatggcacttcttgataaggctaatacagaaacctatggaacaccagaaccgaccgatgttacactcacagtagaaaagggtccttttattgtcgtaaccggacatgatctgaaagacctgcagcttttgcttgaacagacagaaggaaaaggaatcaacatctatactcatggtgaaatgctccctgcccatgcctatccattcttaaaaaaattctcacacttaaaaggaaattttggaactgcatggcagaatcagcagaaagagtttgatcatcttccggctccgattctttacactaccaactgtttgatgccgccaaaaagtagttatgctgacagagtatttacaacagaagtggttgctttcccaggagctgttcatatcgatgagaaaaaagatttcacgccagttattgaaaaagctctggaactgggtggttacaaagaaaatcagatattttctggtatcaacggcggaacaaaagtgacaaccggatttggtcatgcagctatcctatctcatgcaaatactgtagtagatgccgtaaaatcaggtgcaatccgccatttcttcctggttgccggctgtgatggggctaagccaggtcgaaactattacacagaatttgtgaaacagacaccttctgatagtatcgtcctcactcttgcttgtggcaagttccgattcaatgatctcaatctgggagaaatcggcgggttgccacgactgatggacatggggcaatgtaacgatgcttatggtgcaatccaagttgccgtagcacttgcagatgcatttggatgttctgtaaatgagcttccgctttccttcgttctctcctggtatgaacaaaaagcagtctgtatcctgttaacacttttacatctgggtatcaaaaacattcgtcttggtccttctcttccagcgtttttgtctcctaatattctgaactttctggtagaaaattatggcatttcacctattaccacaccagaagaagacatcaaaacgctactgaaccataacaaataatttttattctaaaatccaaatgaatacaaacaatcaactcaaaatgccagaaaaaccgaggactattccccggtttttcttctttgcttaactatttataatccttttacaaactcaactgcattctttatatcttcttcatccggatgcccttttgcaattccaccaaccagtttaaatggaccaaatgtatcatagcccttacatccgaattttcctattactttagaatgtttcttatttaaaatctgctctatagatctgtaattcgcacttccaccataagtacaaatcagaaatatctttttgtcgtctggtagattcttctctgcaaatttcaacattgactgatgaaattttgaaaaatagatccctgatgcaaacccaatcatatcataactacccagatctgcatctggctgttttacagcatcaatcaagtcaacctgacactcttctgctatgctttttactaatttttctgtatttccatgatgtacagatgcatatacgattgcttttctcatttgttttcctttctgcctgttccatcaatcaggtcataactcatattttttcatttcttctacaattctatccagcatctgttcaaactgactttttgctttcgtcttattcgctgctccatcatacaggctataatagaaaaacatatttgcataaaatttaactgcattctcttctggatgattcattttcatatttttgaacagatctttcacgtattctgccggtccagatacgagatattgctgatacaaattctgcatctcttcactgcgaaactgctctattgtcagcatcttccgaaatgatgatgcaaaatcatcctctgtccagtattcaaacatagacttgctgtattctacaaaatcatccaatgatacatccctatactcttcaggcatattctctttttcatcttccggcatatcataatctgatgcctgttcgccatcctgctgctccatgcgcttaacaatactgtcaaaaatatctctcttacttttgtagtgtcggtataatgccccttttgtcatgtcaagctctcctgctatctgactgactgagacagcctcataaccatctcgggcaaacagatgcagtgccacaattaatatttcctctttcctattacccatgtacatttcctccaaaaaataaacgactgtttacttttgataatagtaaacagtcgtttatttgtcaaggcttttcttttttcctatattatcttttccccactcacttaattatatattttgttcctttgctttttccttcaactgcaactacacctttttttcccatcgttttcaataactgtattgttttcgatttaccaaatgggacatatggtgcaatttcacttatcggttttagcattattttacttaagattttgtaaattactttttcatcttcggttaaattagcattggtttcaaataccggcaacacaatttttatagtattttctgacacttcaaaatctggttttaccaaactctctgcatacaaatgtgcaaaaaatcaatcataaaaatttacgattgattttaattcttatttccatgttttccagatatcaggatgatatccaagcgtagattgttttccatttcgaaccaccggtgttttaattacctggggattatcaagtatctttctaagtttatcttcgtctgcaatatatttaatgagtgcaagcaaatccttatctttcccctcccagttaaccatattttccaatccaccatttacctgggcaacagaattaaattcacctttgctcattcctttgtccttcatatcaacaaactgatacttaataccacgttctttgaaaaatctttcagctttctttgtgtcattgcacttcttcgtgccaaaaatttgtatattcaaattactttcctccaaattatataatgccagcgccactattggatagtgaatcctctttcatattctcatttcactttttcttcatttccatcagtgcaattaacttcttagcggcagatattgcaaatacttcctcattaatatgtgcatccacatcaattatctcaacaagaggattgtttatcactttctttaatgtaataaataatgcctgatcttcctttggaccataatatttactgcctgccttatcattcattgaaattcctcgaatcggaagtaataatgctgcgttactcttacactgattcagtttttcaccaactttaataccaaatgcaatattttcctctatattactttttacaaccgtaatagccggattatgcatatagacaactctattcttatatttttccgggagactgcttctttctccaaatgtaatcatgtcagcagcacctacggataccacctgaggaatcccattcaacgccgctgcatctaagcgttctggaccagcggccataatacctccggcaatttcatcgatccattctgttgttgtcagatctaatacaccatccacaattccactgttgattaaagactccatcatcttaccaccagttccagaagcatggaaaataatcacttcgtagccttcctgctccagatattcttttgctctcataacgcatggagtcgttaccccatacatcgtagctgctatcagcggcttttttactggaatatccgtattctcatgttccaccataccgacaatcgcatgaactgcatgtgttaatacctgagaagaaatacggttaattcccgcaacatcgacaatagaaggcatcattaaaatatcacttgtccccacatatcttgatacatccccggatgccatcgtagataccataattttaggaacgcctagaggcaataatctcatacagggagtcacaagagaagttccgcctgtgccgcctaacgcaagaaccgcatcaaacagcccttcttcatataactttggaattaatgtacaaagtcccttagacatcacttccatagcatatccccggtcttttttctcctgtaattctacaatacttccctctcctaaaacagcgactgaatcatgatcaatatccggtgaaaaagcagcctcaaaaataccggcatgaatcgttaacgttcgtactcccaaatcctctattttatttttcacataaagatactcttctccctttgtatcaaaagtaccaattaaagctatcgttttcattttttccttctccaagaaatcaacttctttctataaaaatatcttaaatgatgtttaaaagcgaatggaaaagtatgcaaattgccttttgatttttcaaacatactttaagttcattatattataatttctttgcaatcactgggaataactcatagtaatattaggagaaaaaacagtttgcatgacatacttttaatgcacattctggtaatcctgccgaagtcctctcatatctgatatatcaaaaacttctccatcctccggaacccacacatttccctcataaaattgtttggcttctgcactgtatcgttcttttcgctttatccctgtctgatcttctgtatgccagatcagtagattctttacttttaaatcttgcgcaatcatacttgcttcttttactgtctgatgctgatattgatacgcatgaaatttcggttcttcattaaataaacaaaatgcttctgataatagccaatctacctctttgctatattttttaccattttcctttaacggttcatctccggcaaatactagcttcttcccattatcatattccatcagaaagccatattgttttgctttcgtagaaccaatattaaaaaatgtaaaatcataatttaaaatatgcctcttttcatgatcttttaccacaacaaacttgattcttgtctccaaaaaagcctgactgcgcttcttaagaatcatgcggcatacctgcaatgccttccccaagacttcatcatttccataaagataaaaatccccttcatactcctcaagttctaataattctgcaatcgtgcggattacccaaatcatccctaaaaaatgatccgtatgttcatgggaaagaaaggcatgatgcagatgtttccagtcaagattcataatatcaaatgcccgcaagatatcactacctcctgttccatccacaagaaataactgattgtcttcttcaaagacacaggatgtattaatatatttacttaccgttgctgttccggtaccgatgatgtgcattttcattgaaaaatctccttttttcgcaaggcgcttcctaaatcttataaaactcccatcaaacctttgccccgaggtcacaaatatagatcggctctttctcggggttctgactgtggttactgggataaaatttttatatcaattggtttcgttatgtgtgcattcatacctgctttaaatgacttttctttatcttcttcaaaagcatttgcagtcatggcaacgattggtatattggctttcttgttgttctttagagtacaaatttccctggttgtcatatagccatccattttaggcatctgaatatccatgaaaatcagatcatacctgtcatcatccacttcattcatccgttcaacagcatccgttccgtcctccacgcaatctaccgatattccaatctcttccaacagggcagtagcgatttcacgattcagctcattgtcctctacaagaagaacttttttaccagaataacgattctctctttctgttttttgcaatgtttcctcttttatgtccataggctttgtcagaacttcccttaattccgacatggagattggctcctccagtgttttaaaattcagggtaacatcaaaagatgctggctcaatattccgatttttgtcagataatcctttaccagatccggctgatccatatgtgctgctgcaagggctgtgaaacccaatgatcgcattcataggagtccggatatcatgtgacatattatttaaaaatgctgtttttgccttatttgcatgttcagcagaggcgagagcaagccgaagggcatcttcctgctgcagttccctttctctctggtctgtcacatcatgtgtcagaaacagaatatctgtcaccctgccatccttatcacgattctgaacaatggcacttacttctatccactgtctgtccatgttacgataaatataccgaagaatcttatgtttttcaaaccgttcactgatcgtgtcaagatctgtaaattcaagatagtcattctggcattccggcagcatataattatcatggatcagtttccttatctcacagacattctggcattgtttcaggacattttccttatccgcctggatttttaaccattctactttctgatcttccagatgaactaaaaatatattggtaaataccattccaagtgccttcaatgcttttgtaagcttctcatcccgtttctggctataatgaagtgcatttgacaattcttcattcttctgcaaggcactgacatcctgataggtcacatagatatattttttctttccaacgatgagataggaaaggtctgactgtatataaaaccattttccctgcggatttctttttctgtaaaaaatcctccttgttttctcatgtactattaataatccaagtttgtttcaaaataaaaacactgccaaagaggcaatgactgctttttctgcaactggctgccatttcactccactagtttatgaattacttttatcagtaattccacatcaacaggcttagcaacatgttcattcattcctgcttcttttactcttattctgtcctccgcaaaagcatttgctgtcattgcaataatcggtacctcctttgcatccgctctgtccagagacctgatcatctttgtggctttataaccattcatgaccggcatcataatgtccataagaatgacatcaaattcaccagatctgcttttttcgaatatctcaacagcttcctgtccattccatgctttggtcacctcagcaccttcattctgaatcgcaaattcagcaatttccatattcagctcattatcttctgccagaagaatatgcagtccctttatagatttttctgatacgtccttctgttcttctcgtttatccgcatccagatctattttgaatggaatccggatcacaaatgtcgtccctacgcctttttcactttcaaaagtaatggctccacccattttttcaaccagttttttggtaataggcattcccaggcctgttcctgcaaattttgtgcggcttcctggctgttcctgtgcaaatggttcaaaaatatgtttctggaactcctcagtcattccaattcctgtatcccggcagacaaattccattgttgtcatttccggctgtttggatggaatctccctgtagctgatataaatatatccgttttctttgttatatttcaccgcatttgacaggatattcatcatcacacgtttcacatactctgagcttccaataaaatccctgtgtatgatttcttttttctcccacacgatctggatattctcttctgctgccatctgctcgatcacaacaaatacttccctggaaatactgctcagattaaacgggatctcttccagaacgatttcatcagactccatcttactcatatccagaacatcatttaccagttccagtaatagattagatgcctctttcacctttatcctgtattctgtctgcttctccatatcatctgcataatggtctgccatattgaccatgccgcagattccattgatcggagtccggatatcatggctcatccgctggagaaactctgtttttgcctcattggcggcttctgccttttttgctgctatcagaagttctgctttatatttttcatctttttcctgttcctgtttccgatgcaccagattggttctgtatgtccagaaccagaatatactgaacatcagacaataaagaaaaataacgcttgtcacacttaatggaaggttatgaaacacttctttgtctggaagatacgcatagatataataatccctctgcttcagcatgattccgtaacatccggctccttcattcttcatatgaaaaatgtgctgactgtctgtatgctttttcattgcctgaacggcttcgctaccggctgtactctgccccagcagtttctcatcgttgctggcaacaacgattccctcgtctgcaacaataatcgttccatctttctgagtactatagccatttaaaagcccctgtatcgtcagagtatagtttctggcaaattcaggagatgtgtaataatagattgcaacgatacccggtgcatcttttctggcacaggctgcaatgtcgatatgcgacccgtcttccctggtaaaccgttccgaatagcttctttcttcatattcggaaaaatccatgataatttctttttgcagatactctgtaatctcatttgccagagattcatccgtactgtattcacagtccgtctttccttctgtatccagtacaatgatgccatccacccagagagtctgcagattttctttcaggaaatcctcgcttagctgtccgccgttttctgtttctatagcgatatttgtactcatctgtctggcactttcaatcgcacgtaggagacttttggattccgaagattcattataatgggtgtaggtggaacactgcactttcacatagtttacaatctccaccattcttttctctgcttccgttttttccacatgaaaaaaataaaacaaagagactacagccacacagattccaatcagacctccgatcagctggattcgtttttcttttttctttctcttaatatccaagatcatccacctccagatacttttccggattatccagatatttttcaatgattttcagagatgtgccatcctgacgcatcacttccagcatctggttcatctgctcgcagattcctctgtcatcatcttttgcaaaagcaactcctatccccacgaccatcagtggttcttccaggatacggaaacttgtatcataatccttcatgtactggacaacagattcctcatgtgcgccaaccgcatctacatagcctttccccagaaacgtatagattagttcccggtgtccgagactgatcagatttcccagtttgggaattctttcatctgtccgtttcagaaagatgccttctggtttggttgtagactggacagccaggttctttccctccaggtcactcagtttataaatatcactattctcatttacagcaaccacctgacggcttgctatatatggtcctgcccagcgataatcgtcaaggcgtccttccatggaaaaacagcccatgatacagtcaatctctccgctctccaccagttcttttttcttctcccagttgatctggacaacctccacctgatatcccattcttttaaatgcttctgtagccagttctacatctatgcccgtcggtacaccatcctcattcagataattgtatggtggatagttgtcgctgccgagggtaatgactggcttttctgtttcttttttaccattgtctgtgtttttacaccctgtaagggtgactgctaaaattcccgcaagcaatatgcctgcaatcactctttttcctttcatttttcttccatccctgcacttttcttgtactttcctgttttccatttattatagttaattgccccgaaattacataacaattagtgtacatatctcaaaattgtttttataacttcatcgatcacaatcggttttgacaaatgtgcgttcattcctgcttccatacatctttttgcatcttccctaaatgcatttgcagtcatagcaatgatagggattgtttttgcatcctgccgttccagggatcttattgtttttgtggcagtaagcccatccatcaccggcatcatgacatccattaaaataacatcgtatgttcctgattcgcaggcttcaaagtgctgaacagcttctaacccatttttcactgtttctactttagccccattttctgtcagcataaattctgctatttccgcattcagctcattatcttcaaccaataatatccggacacctgatatatctgcattgaaatcttctttttcttccggtcgtgcattcgtatcaatttcaaatggaagtactacagtaaaacagcttccttcacccagcttgctttcaactgttatggttccacccatcttttctacaagttgtttcacaataggcattccaagacctgtcccactataattggaacgtgcggaattgtctgcctgtacaaatggagtaaataatttattttttataaattcttcggacattccaatcccattatctcttattttaaattcacatgtcatatgatcttttgatttttcaatcgttctcatactcatgtaaatagaaccattcaccttattgtacttcatactgtttgtaaacaagttcatcaatatttttttcaggtgaactgcattgctccagacatatacacctctataatcatcatgttctcccataacatgaagtccttcttcttctgcctgaaagtatagcgactccgtgatttctttacatacctgatccagattgatggattcatcactaaaaaccacggtatccgattctaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatgttctcccataacatgaagtccttcttcttctgcctgaaagtatagcgactccgtgatttctttacatacctgatccagattgatggattcatcactaaaaaccacggtatccgattctaactttgccatatccaaaacatcatttaccaatgataatagcagtttcgaagactcatttattttattcatgcaatcttttgcccgctcaccatcatttccgcttttttcaagaattgtaagcatgccaataatgccattgatcggtgtcctgatgtcatgagacatgttatttaaaaaggaagtcttagccttattggcactctgtgcttctacaagtgcattatgtaattcctgctgtttttcttcaagctcctgattcagcttcaatgcctgctcagcagacttcttggatttttcttccgcacgttttgattttttcaaagaatcaagaattatacacaggacaacaaaaataaagattccaactatgagtgaaaacatcagtaaattgtcctgaataaaatccttcgctgtaacttttcgtgaagaatcattatacgaaactactgcacctgaaaattgagttgtaggcatagatgtcagtgttttattcagaatggacaaaagaaccggttctctctgctgaacagcaaatgaaacatcagcttcttttgtcaggaaaacactatgaagcttattatttttcaaatagtctgaaacagtacctgaattgcttacaatacaatccgtctcccctttctgcattgcttttactgctacacctgatgtctcatattccacaacctcccattgcggataattgtatgaaagatatgctttcaatgcaaaattatctttttcaacggcaactatattctctttattttcatcaaaagaatcctttgccgtaattgctgccatattgagagtcaatagcgtatccgacaaagcaaatccatttgtttctgcaaagtatggattctggtttgcatgaaaaatcaggtctatttttccatcctgcaatgcctgaagcagttcacttcttgtatcatatccatttaattcaaattccagagtctgaccttgcagacaattttctgcaagattcacataatctgtgataacgcctgtcaatttgcctgttgatggatctacactactgatacctccatcatgattcagataccctatcctgattgctccatgctgcccgatccactccctttcttcttttgaaaggaacgagccgctctgtgcagaaagataacgcctgtagagatcatcagtgtaaaatggattgtcatccttgattctgcgcatagcactatccagtgcttttttgatatccagacgtttgggatttatggcaaaatagatttctgcctctccaatacttgtaacaggcgaaatatcagattcttcccaacgggattcttctactgaaacgaagcagtcaatttcatgtttcgacagtttgtccataacttctgcggtattagaagcattgacatgctgcgtatgcagaccatactttaactcccattcgttaagcagatcctccggtatatgatctttcaacacaccaatattttttccctcaaaagaatccagatttcctgctgtaagatccatattggatgcatccgtatagatgtaatatttctcttcccccataggcatatcggaaaaaagcatattttcagcacgttcgtctgtataggaaataccgccaagaatgtcaatttctccattttccaactgtgtaaagcagtttttccaatcacttgttatgtatttatatgtccatcctgcataacctgctatatcttgaagatactcataaccatatcctcttctttcccccttttcattgacggtattataagtttcttcaaaaaatcctacccggataacattgtcagagttttctttggcaaatgtcgaaacaggtaaagcaattaaacatgtaattatgccaaatataaggtaacaaaatttgaagttttttatatcctgtattaatttgcactttttcatctttttcccactctcctggccgcagtcgcttgcttgtttgcatctttgctaataacttctgtattttttattctagtattctgccacaaaaaatcatgtattacagtgctataccataatacatgatcatatatatttattaatcttgcaactggctgccatcttacaagccctatagctttgcgtctcagtctttcggctgatttgttaataacgatattttcttttattatacattttatgcaaaaaattgtccataaaatttctattatttttatttatttccttctttttcatattttaatagataaattatcattctatatattttgtaatgacagatattaaaatacccatatcaatcggctttgccacatgatcatccatcccagcattcaaagcgacctgtacatcctctgcaaatgcatttgctgtcatggcaatgattggaattgtctttgcccgtttatgtgtacttctgcggattgcttttgttgcctcatagccgttcatgacaggcatctgcacatccattaagatcatatcatactctcccggagcagactgttcaaatgtattaagaattctttctccattttcacagatggtacactcagcaccctcaatctttaatagttctatcaaaatttctgcattcagctcattatcttctgcacacagaaagtgcattccttttaggatattttcatccaactcctctttttctacctgtggctccaaagaaactgatcggttttctgcaactttcagattcataataacttcaaaacaacttccctgccccggttcactttccacttcaattgttccgcccatcgactcaaccagatttttggtgatagccattccaagaccggttccctgtatcttgtttgtaagagaaccttctgcacgggtaaatgcatcaaagatcgtatctttgaaatctgccgacattcccataccattatcacagactaaaaaacgatactttgcatagacagaggaatttgtttcacattcttctactaaaaactgaattgctccacccttctgtgtgtacttcactgcattagaaagcaagttactgaaaatctgcatcagatgcacctgatccccattcacccactcgtgcaggatgttttcttttgtaaactgaagggtctgatttctttcttctgcctgtatcttaaacatatgatcaatttcctgtataaaatccagaatagaaaaatccgtgtatttaaaaacagttttccctgcttcaatcttgctcatatccaaaacatcattaataattcctaacaaaagctgtgatgatgtatctattttatctgcatactctattactttcgccttatcacctgcatcatgtctgatcagtgacgtaataccaatgattgcattcataggtgtacgaatatcatgtgacatattcgacagaaaatctgttttcgccttatttgcattttcggctgtctgtaaagcttctgttgcaatattctttgcctttttcagttttttatttgccgcttccatttccttcattgcctgtaattgaagctcactatttcttttttcacattctgctttttggtctgcaatattaagttttgaaatactgtaaaacaatccggcaaagagcaaaatgataaaacttcccatcagtattgttgtaaaaagcactgttttctggtaatttctcatcacattatcaacaacactttttttcacaatacagatcaacatggagttattactttctataggacagtaccccagatagaaaggcttatcttttccaaaaagctctactccctgttcttttttatccatctttttttggagcagagcagcctctttttctgttatagccttatctgcctttaaatgcttcaacaatgaataatttcgaaaaaatttatcttcactttggttcgtataggtaatattttcttcctcatctaacagaaagagatacgcattctcattatagctcttcagttttaacatggaatctaattttgaatgatcatacacggttccaactgctgtataaacttccccattcatatgatattcctgacatggaattgcaaccagataacctccactttgtgtttcttcataattccaggcaaccagctttgcaatattatggccattccttaaagccagtaaaagcttacctggtatgtcaatccgcatcttcgttccatctgctgtcattgcttttccattttcctgaagaaatactagcctgcttccagcttctttttcccatgcctcaaaaaagttttgatttgcatctgtttcaggcgatacttctttctccttaagaatataatcttcaactaaatgtaactggctataatatccatttacctgaagctcataggtttgctgtatctgttcaacaacagctcccatgctgctttttccattttcatcaatatacctgttcatcctgttcaaaagaagcttcataaataatatgcttgaaaaaatgaacaggattataagcattggtattataattctctttctttttattaccttttgtcttatctgcacttttatttttcaacctctatatagtcttccggtgctgacggctgctgcccttttgacatagctgcagcccatgcacttgataacgttgtatcattaagttgggtaatctcacattctggatataattttttcaaaatggacatagtaatatccgtaagcagaatggaatactccttctctttatctatttttttctcattaactgctatgctttttaatgagaatccattttctttatctttaacaataattttcataccagatgctatcggtaattcatatttattagttacataaaaatccgaatcaaaatccgcaagataatttcccacaagttcatatacctgtttaccatttatctttgcaaggtataatggcgtatccgaattctttgctgtcattagagcaacacgattactgctacattcgccttcataaatagaagaagtgaaataatagtatggtgccagagccaattgtatattattctcatttctaaccgtagttagtatagatgatgccgcatcacgaccatttttatcattcagtgaaatggaatacccatgctcaaaattcacagtcgttttttctcctgtagctttactattcattacactacacaaagtatcataagccttttcttcatccatttctcctgacagcaatccatgaacaactttcaggctggctgcaaaagacttttgagcggaatatctgatataaacagaattatcttgaatttccttttccagtccagacacatctttcatcattgtcggaacatcagtattcaatgagatcacaccacttccatccgcaatacgcttttgcccttcttctgaaatcatacagtccagtatatctagtgctatatccaatttctcaggatttttttctaaatctttgttaaatgcaatgtttaaggacggagtcatatttataaaagcttcatctgaagtctgtgagaaaaaaggaatacggattaattctgcatccatctgtttctggaattcctgcataagtgccggatatccatgaaacattgctgcttttccctcaagaaatgtttctgttgcagtagtaatatcaacgctgatgtcatctttcgtaaaatgtgagtcttttaaaaacgtactggtttgtgaaaggatacgtttccacaatgtagcatcaaactttatattatctaccgaactttctgccgagcttcgccatttgattccatcaagacttgtgaactcaccgattgctccggcctgaatcacttcttgagtagaccagtcttctgcaagatcaagtatataaggttttataccattatcataaaattgctggcaagcctgtgcatattccttataatttttcggaatcttgattccatactgatcaaacaatgtcttgttggcaatgagtgtctgtgggataccgcagataggcagccactgaatctcatcttctgaatttttataatactgcaatgcataagaataatacttagagacaacatcatatgaacaaaaatccataagatacggctgtagatcctgtgcatctgcctccgaaaatcgacgtaccgttatgatatccggcagttccccatgttcttcaaaatagctgtataaatcggtattattgttaccggtaataaactcaatatcctgatctggaaactgcttctggatatatggagcaatatttttcattaaacgattttcccatagatacacggtaagatgattatctttttgggatacttcttttttagactgtccacagccggataaaacagtagttgttaaaaatacacctaacagtaatgctatcagatattgttttgccttttccatactcgtattttcctcattctttcctgataaaatcattaattcaataatttcatctcagattttcatctgatttaccgattatcctattacatcttttcaaattatgcaaaaatattgatgctattatatatctctctacttttccaggatttttcccacacacttggaaatcaattacagccagtttttcaggacatcattcagcttattcatatccagaggttttgcgatatgtccattcatacctgtatttttggcaagctgtacgtcttctgcaaaagcattggcagtcatggcaacaataggcagttttccctttgcacccggaagactcctgattgccgctgttgcctcataaccattcataacaggcatttggatatccataaaaataagatcatacgaacctttcggagaagcttccactttctcaactgcaattttcccattttctgccgtttccacttttgtacctgtcatctgcaaaatttcaccagcaatttctctgttcaactcattatcctcaactagcagaatcctttttcccgtgtagtctgattctgacaattcctccaaataatttcttgctgttttttcttttcttcctgaagtaaactgccgcagtgtagccgtcagccgggaacggaacagcggttttgcaacaaaagcatctatgcccgccgcctttgcttcttcttcaatctcgctgaattcataagatgtcagtacaatgatagtaatctcgttccctatccgtttccgaatctgtctggcagtttctatgccatccatctctggcatcttccagtctaaaataacagcaaagtaatcattttttagttcatgacgtgcataacagcactcaacggcttctctgccggagagaacccagtcacctgtaataccgatttccttcagtgtggcaactgtactttcacagcatgtcctatcatcatccacaaccagaaccggcagattcatcagatctctgtcctgttctttttctttttcctgaagcttcagataaatcgtaaccgtaattctggttcccttgtgtaaggtgctgtccactttaatattaccattcatcaggttcacaatatttctgctgattgccattccaagaccagttccctgaaccctagttgtccggtggtcatctgcacggctgaaaggatcaaacatgattttctggaattccggtgacataccgattccatcatcctcgatcgtaaattcatagcatccaagttctgaaaatccattgggtttttcctctatcgaaaaagtaatatttccaccatccggtgtatacttgattgcattactcatcagattcacaaacacctgctggatcctcaggctgtcaccacagacatcctcatgttcaatgtgattaatgtgtatatcaaaattatgtttatgttcatcaagcatcggtttcgtaagcgtaataagattatccaccagctctgacagattgaaatcttcctgtgccagcgtcatttttccgctttcaatacgtgccatatccagcacttcattgatcagtctcagcagatgacggcttgattccgtaatcttgctgagacattcaataactctgtcctgactctcaatatttgctcctgcgattgccgtcagaccgacaatcgcattcatcggggtcctgatatcatgggacatattggaaaggaattctgttttcgcacgattagcattttctgcggaccggtaagcctctttcagtgcctgacgggattcaatctctgctttcttctcctgtgtcacgtccagggatgccagcaataccttttccagctttccattcttccattccaagggaatataagaagcgattttataagtcttttcatccaggctgcaatactcaaacttataaatatcattttcacttttcagttttttccgaatattatctggggctatcaggatatctatagcttccaatggttccagtgtcttatatttttcaagaacctgcatctgaaaatcatgataaaatcccagaggtttatatatcatctgtccattcagattgtagaattcatatctgtcattttccagatcacagacaacaaagcggtcaaccagacgcacaatactctgaatcagctgctccatggaagcattatccgctgccatctgcagatgccgtgcactctctacctttgcctctgtgatatcacgcagaaagatcatggcatattctgaatcctctatttcgccacgtatgaccaacattgcggacccatcgttcttctccattcagagtgatacggcactccaaagccaattcggtttccagacccttcagcctttctgcaatataaccacggtcgtaaaaagaggataccgccttcttatctgtctccacaacataggaatccacaaaatgccggatcaattcatcccacgtatgactctgttcaaagacggtcatcagggacggttcaaccttaaaggtatcaaaagtattcgcttccagattcacataatactcgcacagatctgctttcgtaaaagcccggtggaaagcagcagatttttgtgcttgcatgatttcttttttctccgcatcaatgttaataaaaatcccggcaatcctgctggcagaaccatccagacggcgtattacttctgccgatacccgaaaccactggtattgatcatccttcattctcatacgatactctacctggtattttatctggttcgtcttatccttaattgccgcctgaagctgcaccattactctttctttatcctgtggatgcagaagatctgaccaggattccagtttattcggaaagtccagagtgtcatgataaccaagcatttttcggaattcatgactccagtttgcattcacaatctcactgttttcgtcacagtcaaaataccagaagccggaacagatggcctcattgagcagtgccagatttacatgatcccagttgacctgtacggacataacccagatctgtctgcccgcctcatctgtcgcatcctctttacaaagccgtacatttttcactgttccgtgaagctgcaaaaaacggtctcgctccagtatatcttcctcgtcataaaagaaatttttcaatgagccttttgtctgcttcataaaagagtcgaatgtatatcctgtactatgtaacagcagattgctcacagataatacagacaggttttggtcataatatcctgtcattatgcctaccccaccattattttccagtgttttctgtactgcctgtgacatagcctgtgtctgtcctgttacagtctcacctaaagaatatattttttcttcataatttcgcattttataaaaattctctcttcgttttataccttcttcatcctgcttttatctgtatacagaaaacctgtccctgccagttttcttactcattttttgcatacaaaaagggcatctgtctaaatccgccagtgcccctgctacatttctttaaaatcacacattcatatcgtataaaatttatcgaaatctcttctgttttcacatcttttccatatatgatatggaaacagtggcaactggctgacctggttaatctttctgactttagccccttctagctttgcgtctctgcctttcagcaggtttgcctttaaataatttccatttttatcaaaaataaaataccatgaagttatttatacgtcaataatatcggataaaaaatctgtattttttaatttggagtttggttatttaacatttttactttagaagtatcatatcatgatggaaaatgctactaatctactataactttattaaaaatctctccatgtaatttctttatataatgaaatcgaattattgtatcatctttcataatatttgatacaaggaaacgattgcaccccctaatgcaccccctaaatacaggagatgcatcaccctccatccgggcattggatcaggctactcttcattttatggacaattgcagagtagtcttttctttcacgaaaaaagagatatcaacgcgccagggtcaatatctcttccttttttttataattcaattatcaggttcacggtctttccctctcacaagctgtgctttctccgctcttttcctgtcacgatgtagtattgcttcttgttttcatacatttccgcatctgcggctttcagaagcaactcaaaatccgtgtcctttgtgccgcttatcgtcgtaccgagggacgcggtagcacccagttggctttttgccgtttccagtagtttctgaaacgccggatgtgtgatgtttggcagaaccgcaatgaactcatctccgccaagccgatacacatgacgcttttcgaacacagatttcagcgtctgtgcggtctgcacaatgaatttatcaccggcgtcatgtcccttttggtcatttatttcctttaggccatttatgtcgcacatgacaaccgccaggggaaagtacttctccagcttttctgtgtacgcccaatccagtgcttttctgtttttacaatctgtgagctggtcatataatgcactgtgctccagtgcatctgcattattgcgcagtcttatcataaaagagatcataaactcgatcatatctatcagattcgagatctcatgcagtttctcttcgggaggattgtccacaccgtagaatccgaccatcttgccgttgattttgattggccctgtcacaagggtattgacaccctgaggtttcagctgttcatagatggcttcgcttgtttttttgcattcttcaatgtcatggatgatgacattgttggattcttgatattgtgcaaaccatgtttcaatgatgccttcatacggcacatcctgcaagttatctttttctttggatacacccgctttacaccactcgtaggtgttgtcaaacgttccgcggtcattctgttcaaagatgtacgctcgatcggcggtcacacgctgtccgatatactccaccagttgattcagtactttgtccggagtttcttctgaagcggcataccgaaccatatccgtgaggaatctctcgtaattcaggattcgttcctgcgattcgcgcttgctgacttccaacgtttccttttccttatggtacaggattctctggagcttgcttcgcatcatcgtggcagtcagaagcatactcagcaccccgtacagaataacattcactaggtttttggatagaattgggttgtgctgcgcaaagaaagcaagtccgatatagagcagcatactgctcagaatcagcccgttcatgaccgccgttctggcggtaaacagcagcggtgctgtcatcatgaacacaatgtagttgacagtgagctcctccggtataatcagcgttcccgtaataatgccgaacagcagcagcgcggcaaaaaagctgtatacaaccagtttttccccaagaagcttctaagttgacaacgagaaatgcaaaaatagaccaaagaaaggaacgtatagaccagatacacccatttatattttccgatactcagagaaaacacactcaccagcgttatgactccaaaggcaacaagcgccacaacagaatacagccgcatggctttccagttttcttcccatacatcctgttttactttctcataatcaccacaactaaacataaacaacgaaacaatttgattcatacgttttttctctccaaactctgttcaattaccgctttgcccatctcataaggagcacagattcaacggtactttcattatcccaatcaagttcatataattcctgttcattgaaaaatacaggaaaacggaacttgagacttcttaaaatcctgccatcctctaggctacaattgcttgcttccagattttaattttacattcattaattgtcaataacctccccgctatttttcacaatatttttccaaacagcttctgtattacttattcaagtgctctaccataaaaaagcactgccaaacagacagtgcacctcatttcatgcaactggctgccattttacaggccctgtagctttgcgtcccagactttcatctggtttgccgatttccttaatatttttaaacttttgcaaaaaaactggttttattatactatggttctgtactgtatacaagaaaaacattaccgttttaacacccgaaaatcaaaaaaaacagccgatacatatactcgaactgttcttctactttcgaagtccacgaagcattgacattactgtttcctgctcccgtctttgacagtttgtaaaagaaaaaatcgctgcaacccttgtatttactgagctgtggcgatttttctcattgtcacaaagtatggtaatttattcttttcttttactttttttctggattgttttcattctgcttttcgttataaattgatagtccgttcgaaagccgcaggcttcatgaagatcatcagtaatggcttcccgtttgtataaagctataaatccttgttcctgaatctctgcaaaattcattgcttttaatgtatctaataattcctcacaagtatatttatagttcaattttctctcaaggaaacgatagatcattaatgccagaaaacagatcagaaaggatcgcattgatatcgtatttaaatttatatttttgttttaatttcctacagactttattcatctgcagttgataataaacagactgtggaaagagataacctccacggaaaaagacctgtttatcatagtccagcggcctgcgactattttttgcgatatgtaactgtcaaactcccgattgtatgttataatatttttgaagtagaaaaattagcaaagtaataggaggctactatggttattgagaataatcccaaagaacttgctgctatgaagaaatttcatgaaggaaacagagcagaaggattaaaactgcaggaggagtttgcttcagagtttcgtgaagaatataaagataaagatcattgtccctgtaagaaagcctgtcgttatcatggaaattgtaaggaatgcgtggcgattcacagggctcatcaggaacatgttccaaactgtatgcggccgatgttgaataggaagattaagatactttctgagttaacggaacatactcttgctaatgagatagaacctcctaaagaacatttgagaaaagagtttctctagaatgtgtttgaaaagtaattagaactccttggtgatttaattgttaggtgttttaaaaagtatttaaagagtaaaagttcatggacatcaagcttgcagaattgtcataattagtcagaaaaaggaaataaagttatgtttcgaaagatgagaagatttaaacagcagttagaacaaaaagagtgtatagaggtgttaaaaagtcagccaagaggtgttctttcaatattaggtgaggacggttatccttatggtattccaattgattactggtactgtgaggaggagaatcgaatttattttcatggagcgaaggaaggacataagattgatgcaataaaagaatgtgataaagcatctttttgcgtttatgacgagggataccgagaagaaggggaatgggaattaaatataaaaagtgttattatttttggaagaattcgtttggttgaagaacaggaaaaatctctgtctatttgtagagaactttgctttaagtttacagatgatgaagaatatattcaaaaagaaatagaaaatgctggtaaaagagtacaatgcttagagttaataccagagcacatgacaggaaagctggtaaaagaatcataattttttcttttgtttaaaaagtattgtttgccaatcgcttgataaaaaactcaattagtgtattttaaaaggaaaagcagttgatgaaagagggggttaaacaatgaaagagaagaaatatgttgctgagaaaatagagaatttctaggcagaaattcctgtagaagaatatatattatctcccctccctacaataaaattatactgaataatattaatatagtcaataaaaataaaaaaatatatataatatataataatttcttataatttattttcaaaaagagatttcagaaaatattttgcataaaataaaagggaactatcgtcatgctccccctttgtaatactgatttattcattttcatttttatccacataaagctggcatttgttcggattagagtgtatttgaaaaatattctggcttcatgtaatgttttcacttttcataattgaaagaaaaaaatcaccctgtatttcttttatatgtttaaatgcaatttcatttccatctatcatcataagcttctcatttattacatctatcttttttacacatcctgttgttttattataatgtccaccttgttttcgggcatctggtgcaaactgagctgccctgtctgcaataggcatctgggggtgtttttttgatacatgatgcggaagattgataatatcgtcatactttcccattatgctttatgccctcctatctgtccatttcttgttcttgttgttgcaccttcttcgtaacttaaccctcgcaaaactgcattttttccgtattttttcttaatatcaagaatagatttttgtaatctacgttccttttcctgttctttctttaatgcttcataatcagtaaacagatctaactgctgatatacctgtccctcttttggcataactttagtagcagataatgtgagccgccggataaggagttccttatcaattatcctatcataaagactagaaacagcagttgtaatttcttttagtgaagaagttggtatatccagattaatcgtaccatgtgcgtgtttggggatttttcttccataacggtctgttgcaacctccccactgtattcctgtccttgtagattatccctatcataacctattgtaaggacaaattgctttgaaaaaagcttctgttcaaaaagatcaaatgcaatctgttccgccatttctaaaactacaatctttgctttttctaacgaataagcagaagataatacctgtccggaaccgatactttttgcttctggtttatatacttttatatctgcaatcgtacaaggttcatatccccatgcatggtcaatcaataactcggcattaatgccaaatagtttataaagtaattcctcattatgatattccttttcttttccaacagagcatctggcaacgtctcccatcgtgtaaatctgatatgcagcaagctttttggcatagcctttccctactctccaaaaatctgtaatcggctgatattcccataatttctttcgatatattatctcatcaagataagcaattctcaccccatactcatctgctggcacatgctttgccataatgtccattgcaatctttgcaagatatagattcgtaccaatccctgcagtagctgtgatctctgtttcttttaatacatcctgtatcaccttggaaattaattcttttgcccccatccgataatttgtcaaatatcctgtcaaatcaataaaaacctcatcaatcgaatatacatgaatatcttctggagcaaaataccgaaggtagatctgatatatttgtgtactatatttcatatacaatgacattctcggaggtgctgtaatatatgccagtgcaaccgaaggatcacttaatttatctgaatgaaaggattgtcctataaatttatgccccggagcagattcctgtctttccttattaatcctcttccctttctgtattacttcaaataagcgaggacgtcctggaataccatatttttttaaagaaggagaaacggcaagacatatggtcttttcagtacggctcttatcggcaacaacaagatttgttgtgagaggatctaagcctttttccacacattccactgatgcataaaatgattttaagtcaatcgcagcatatatcttatccaaatctatccccctccttaaaataataacattatttaatccatacgatttatgttgttatattattggaatcattatctattgtgaaataaaaaaattataataaattatatagatatttctgagaaagcattagatttaatagaaatactttctcgattttctattactttattttccagtaaacctgttaacttgcattccacaatttttcttttgaaattatttctcactccaatcaattttcatcttgcatattttttaaaattctctgcctgctcaagaacttccttgtaaacatcatcaatggttactggcggatagccgaactcatcaagcaacaatattaaatccacttgcagatttgctttaatatcatcacgggcagaccaatccgtatagcgtgacttatcatcaacaatcagctttgcattcttttgtccaggttactttaaaatccacatatttctcattttcgacaccttcaccgaaaacaagagccaggtcctgtgtcccagatcctgttgtgatcttataggctgaatattcctt

SEQ ID NO: 412 - DNA, 47618 bp, Eubacterium hallii
ccgaagccgcatctgggatgtattatttttttcttttttctggctattctaaatctacagttggcgagaatgggggattctccagaaggttgtggtttcccaggaaattaaattcgaaaggattgacgcatttcatctgggtattttcattccaaataaaaaccataaacttctggggaaattcctcgttttttgaggcaaaatggagcatttggcgcaacggaacaaaatcaaacttataaacattctctttttgtcagaagattaaatacaattccgtcacatacaacaaattgaatgtcaatcctttcgaatttaatttcccggaacgccataagcttctggtgcagtccatgttattaaactgtagatttagatagccagaaaaaagaaagaataccatatcccagatgcggcttgggagcgtatttaagatgcggaagagcattttaaacacagcgactacagagcagatgggatatggtattctttcttttttcgtctacattaaatctacaaatcaggatttttttctatgtgatatgcgttcttttcggcgtttttctaattcatgtctatgaatcatgtgcatgattaaaataataagaatgacagcaatgaggattcttaaagagaaagagattcctttatgtattgcctcttttcttttggatgctacaggagcagttttcaggttatcatccagggtttttccttcaaggtaagctttgccctgcttagaagttatgtcataggttacttctgtacggccgagttctttatcatcgcaggagataatgatatatccaagacggcctgtttttttatcttcatctagtttaaaagcggttttcaatgtagattcatcgaagtctttttttacaaggacagaaaaattagtatcataagagctgtttaataactgaatctggtcaagctttgctgagtcgattgaagagttttctgtcatggcagtttttaaactgaagttggttagtggtgtgactgcttttacctgattaaatgcccatttgaataagtttgcggtgtcggtgtagcttttgtctgctccatgatcttttaagataacacagattaattcaacattatcttttttagcataggttactaatgtattgagggctacttgagtaaagccggttttagctccttttgcatattcataatagtagtcactgttttgtcttaaaattttagcgtgattccagagttcgagtgtatcggttaaagaatcgctcttttttaaggtataggaaatggttccggcaattttgcggaattccggatgcttcattgcctctttgagaatgagtcccatatcgtaggcagttgtgtaatgttcttcatcgggaagtccatgaggatttttaaactgtgtatttttacagcctaattcttttgcgcgttttgtcataagctttgcaaattctgtggtagaaccggaaatgtgttcagcgatagcagcagcggcttcattagcggacaccagcattaatgcatataagctgtcttcgacagtaagttttgcgccgacattgattccggcggtactgcttccggcttcgattccattaacagcggcgttggagtatgtgatgatatcgctcatgttacagttttcaacggcgagtaaagcagtcatgactttcgtgatgctggccgggtatctttttgtgctggcttcttttccataaagaactgttccagtaccagcatccattacaacagcggattctgctacaatgtcaggtgctccgcttagctttgaggttccataggaagcgcctgttgcctgggtgttagatgtgtcagccgatgtttctgttgttgcagcagtagtcgcagtagtttctgtagctgtagtagtggtcgcagctgccgcaagggaatttacacaaaagctgaaggccattgccagtgtcaatataaacgtaaataatcgtttcattgggattctccttttgattctgcccagttgggccatgttttagagttttgccaggtcatttttagaccttgcttttcattgtatcctacttctatagaaaaagcaaaaattaattgcaaaaataatgtgcagcgattagaataatactgtatgtctaaaaatatcagataggaaaaatgtacgcgaaaagtttcaggcggaaaatcagccacaaaagcaagtgcaagaacgactccgagagtacattaaatgcagtggaaagcaaagtgcgtattaaagtagaaaagtagataggagagtttgatgagattaagaaatgtaaaaggttcaagagaacagattgcagcgaatgaatatacaattaaagatgcagagcagatcaagggtcagtggaaagattattttcaggacggtaagccgattcagttagagatcgggatgggaaagggaaagtttcttatgcggttagcagagaaaaatcctcatattcattatattggaattgaaaagtattccagtgttttagtcagagcattagaaaagatggaagaaactcctttagataatattcattttattcgaatggatgcagaaaatattgtgaatgtatttgaaaaaggagaggtagatcagatttatctgaatttctcagatccatggccaaaggaccgccatgcaaagagaagacttacttccagacagtttttagagcgttatcataatattttaaaagaagaaggaagagttatttttaagacagataacagaccattatttgatttttctttagaagaagtagaggaagcaggatggacattggagaaatgtacatttgatcttcatcatagtgaatacttagaaggcaatattatgacagaatatgaagagaagtttgtggcaaaaggtaattcaatctgtatgcttcaggttttttataaagaaaataagtaatctgtacgggcatatgtagtaattgactgggtgataagagaaggttggaatttgataaatcaggcgcacatctttagtaatgttcatagaataaatcaggggtgatattttatgaattttaaagaaaagatgtgctggaatattcaaagaaaaagtttttgtgacaggggaatctggcgatgtttatttaacttttgccggagtatttcagaagtgtgcaatattctgaatggaaaataacagagatcaggtcttatgtgtattttgcttgaagaaatcagtatatttctgagggattacagataataaaacatatttataatagatgaaaggatttacaaatgaaaatcgtagcaatagatttagacggaacattattacattctgactgtacgatttcttcttattcaaaagaagtgattgctgaggcagggaaaaatgggattatggtagtaccgacttcaggaagaagctttcgaagcattaagaatcaggtaaaggatattgaaggtgtgaagtactgtatctgtgctaacggaactttggttggaaatattcagacagaagaactgattcataattataagataccgcagcattttgtgtatgacatttataaagaagtgaaggaaagacatggatttatagagttatattgtgacaatgatgcgtatgtagaaaaagaggatattcctgtcttttacaatacaaaaatgggaaaggatttttgtgacagtttactttctaccgatgtaaaagcgctgtcttatgatctgctgttacgtcggggaacaatgaggattaataaaatccatgttgcatttccagatccgcaggaattgagagaatttgcggctaaaaccgcgaaaaatgagaatcttgttgtgacatttccaagtgaatataatatggagattttcccaaagggatgtaataaagatgtagggattcgtattcttgctgaaaaatataatattgcacatgaagataccgtagcgattggagatagtgataatgacgtggcgatgatcgaatatgcacatattggaattgcagtagcaaatgcgatggaagtattaaaagagaaggcggattatattacgaaatcaaatgatgaagatggtccggcgattgtactgaaaaaaatacttaaaaaataaaaaataatgcttgcaatctatgaaaggttgttatataatagtccttgtcgttgagagaaacgaaaacaaaacacaaggatatgcgcttttagctcagttggtagagcagcggactcttaatccgcgtgtccagggttcgagcccctgaaggcgcattacaaagcatcgtttttaggatttaggcctggggatggtgtttttttgttgccaataaaaggaggaacaacaatgaacctgatttttgacttagatgataccctttatgacctcatgggaccttttgaactggttcataaaaagttatatgcagataaaaccgatgcggattgtacggaactgtttataaaatcacgagattattcggatgagatcatggaagcagagataaaaggagacattccacatgaggattgtttttatgagagaattaaaagaacgtatcatgatgtgggaattgagatgaacagagaagatacagaagagtttgaacgattatacagagcttatcagaaagaaatatctcttagcgagggagtggaagagttccttgattattgtaaagctcataatattttcattgccattcttacgaacgggagaccgaaatctcagtatgcgaaggtaattgctttagatttacatagatggtttgacgatgaccatatctttatttccggtgggatcggctatcagaagccagatccgatggcatttcaatatatcgaaaagatgttttcacttaatccggaagaaacatggtatattggagatacttatgaggcagatgttgttggggcagacggtgcaggctggcatacagtctggtttaatcaccgcaaccgagaacgtctggaaaactgtgctgatgtgacagtaaaaagtatagaggaattaagtagattcataaaagaaagaagttaaaagtatgaaatcagtaatatctatatggaaaccaggattttaaatctagtagaaagagtaagggtttctaagtgaaattttttatctcagtcgagaagacttccacctctttcaggcggctcgacttgaatgatattactgatttcattagagaataataagataatcagaatagaataatattgattacttcgtgtttaattttaacaatttgtggtattcaagaacatcattatcccactgtttatatttttgatctccgcggcggtcaggaagaccatattcgtttttgaggtattcaccgagataggctgtagtcttttgggctcctttgatattaagatgatcgccgccgtctacagtatcttttttccagttgatattcttttttaattcaaggttcaaatcgataaagttgattttgttcttgtcagcaatctgctgcaatgcattatgctttctgtagttccatccattgtaattcggaacggagatcagtacaggaatagaaccctgacgtttgcaatagtgaatacatttttcaaaggtagatgcactgatatcgttgattttccaggtttttctggtgaacttcattcggtgcttttttttatggactttgtgcgttgatttacggtaatagtaacctttcataacggaatatcggtttccccaaatgttcttaaatttatgtgggtttaagtttctgtggaagctgataaccggaaaaaaggttgcgagttttgcttttgtgatagagtcgagattggcgatatcggttttatcacgaaaaagattattgccgtcaatcagtacgatagaaggcttttggtgtttataaatctgctttaaatattcataagtctcaggaatacgctggcttgcctgtccccaggtatatccggtgaatccgtcctgttcccaccatatgagaggaaaaattccgctgtatacattactgtctcctattgctaatacatcaacactgttgtccggttcctgaaaaatgctatagccggagtaattaaatagcggattggcattgtaccccatggcaatggataaggaagaaaagattttcagtgcaaatgttaaaatcagcaggaaaataatgcttcgtgctgctattgatttttttgacattttagttcctcctgtaaagtgaatgtactatcggagtctttcttgtgcttgattttgtgagtacatatgaaagtgttcgatagtaaatcatattaaaacttcttaaaacttcgcataaataaaatcggcaacgccccatccaggtccataggcaccggcaatgatgatcagtataataggaatcatatatagtccccagcgaattggtaaggactgttttgatatgagttcgcggatagaatgtccctcttcctggctcttcccgatgagatagagaagaataatactaaagacgattaacaggaaatccagtttaaataatcctccttgatcaaaagccatctgccagaaagagactttgctgttccatggacgaaatacagaacagagcatagtgatagcaacgtttaagtttcgtgcccggaaaatgagcataccaatatttacaagaataaatgtacgggctgtctgcattttgtgataccaggatgcatttcgatcaatgttacatttcctgcaaaaagcagcaaaaacaggttcgaaaagcataccaaggaccatgatgacatagtaataaagaccgtaaataatgtatttccattctgctccatgccagattccattaccgaaccaaacggcgaacagagcaaaaataccgggaatcgtggcagcataataacgattcatatgggctcggcacttttggctgaacttctgaaaatgtgttccaagagaaatcgggtaaaaaatgtaatctttaaaccaggctcccagagtaatatgccatctgcgccagaaatcattaacggaagtggcgaaaaatggacgtttgaagttctcttctaaagtgatgccgaaaagctgggcgcttcctcttgcaatgttaatacatccggcaaagtccatgtaaagctggaaagtatacaaaagaattgccatgataacaggtaaaccggagtatcgttcgtgatttgcaaaaatagcacgaacatacatatttacgcggtcagaaagaagtactttttgaaaaagtccccatgtaataagctgggcaccaaaacaaaactgtttataatcaaagcgatgctctgcttttaattcttcaccaagctgtccatagcgggagattggtccctcggtgatgactgggaaaaagattaaaaacagaagcaggcgcaggtagtttctttcgatcttacatacgccgcgggcaacatctgtcacgtaactaatggcagacagtgtgtaaaaagagattccgagaggaagaaagatatttaaaaacggaatctgggcggggatatgtaaagcattaaaaagcgcattaatattttcaccaaaaaagttaaaatactttgtaacaaataaaataccgaagtttataaagcataagaatgcgataacgtagcggattttttttgtggtcttattctttagttcttttcttgcagcgcggtctaattctttcttttttaatttaaatgtttcgttgaactgctcgataactcttgcaccaagataaatggctgccgttgtaaacaggacaacgacaaccagacttttcattgtgagaatatagaacagcaggctcgaaaagagcagtccaatccagcggcgctttatgggaagtaaataataaaggatcagactgccgccaagaaatggaaaaagatagagccatgaattatactgcatattctcacctactcatcttctaaaatttcctgaaccatgtggtaaatactttctacagatttaaagttctccggcttaatataagggagtgtaatgttgatatcaaattcatcattaagctcagagacaagctgaagaatttccatagattctaaaaggtgttcttcaataaaatctgttgatgccgcaaagttagcgccaggtttaatagtttctaaaatttcaagaatagtgtccataattaatctcctttgtgtattattcaagaatgaattaacattcctgatagctttcttttaatagttttctgtcaatctttccgtttgcattgtaaggcatctgtttgattcggatgaacttattcggccgcatatacgcaggcagtttggaggctgctgtaacggaaagagcatctggttttgtctttccctgataaaaaacaaggatttgatcagttgtttctaagtaaatacatacgcaggcatgaatttccggtaaagctccaatagaagcttcgatttcaccgggttcaatgcggtatcccatatgtttgatctggaaatcttttcgtccctgatatcttaaaagtccatcttcccctcgatatacaagatctcctgtgcgatatacaacttccggataagcatcattcaacggattttgtacgaaagcttcggaagtttttgatggattatgataataaccatctgcaagaaacggaccgctgacaagaagttccccgcttgcagcttctttcccgttctcatctacgatgatcaggtcacaattgtcacaggcaacgccgataggaagtgtttcctcatcggaaaaagtgtgattaacaacatagtaactgcaaatatcggttgtctctgtcggaccgaaaagatttgcgtaaaaaatatcaggaagtgcctggcgccagtaattcaactgctttacaggcataacttctccggcaaacaatactttcttaagatattccggtttaatataagaaaatgtatcccagttcgctacaatattaagcgcagaaggaacccagtagatggtatttactttataagtattcagatattccataagctgcatcgggaatgaaaaatacttctttggaataatctgataagttgccccggtacgaagtgctgcataaaagtcagagacagacatactaaagtacaatggggtctggcttccaaaaatagttgcttgatcaatatcaaatgcatggataaaccagcttccataagaaatcaatgcacgatggctgatcacagtaccctttggctgaccggtagaaccggaagtatagagaatatatgccggatcacgttccgtcatctggtcacgtactctgtcaagaagcttgttatctattcctgccaaagcactatcttctattaaaaatgtcttaattgtctttgagaacggttcactctggtcctcttcaaaagaagaaggcatatcagaacggctagtgtgaaatgcattcactttatcaatgtatgagctgtctgtaagaatcccagccggctgtaatgtttcaaaaatacggtgtacacgttctacaggcatctgtgtgtcaagtacgacataaaaattaccactgtaaagaacaccgagcattgcttctgccagagcagggctcttatccatataaatagcaacaggaatgcggtgtttcttcaaagcagaagcaagcatggtacctgtctgctggctctttcttttcagatcatggaaagtaaccgaagcaaggtcgtctgcaacggctatatgatcaggaaaacgctcacaggttttctcgaaatattgtaatatatttttcatatgtagtatctccttagtgctgttagcgactattgattcatagttatacatacaacataacaaagaaatcttaagtaataaccaaagagaatctaaaacattcttaagaaataattctggatttatttccttgcgctgtttgtttcttttgcttgatcaatgaaaacttacatatattttacaagacaatctcttttgattttacatctttgtgttagagttatgcacataaaggaaaggacagatgggtgatgaaagtgaaagaaatatataaaatatcagaggttgttcatagagcagcagggggaaaaatagaaaatattttcctgtttttaaatacggtgttctgggcattgcttgcacttattgttggcgcggcaggattttccctggcaacgggaagtgtgattggacatggaattacattattttgtattgtaggatatactggaatgatcataggattttttggtggaagttattatttatatagaagagatgagaaataaagtaagcaagaagctatcgcagtaacagtgttacaactgtaactgtggatagctttttttatctcagtcgagaagactcctacctctttcaggtggtgagtgatagctcaacttgaatttacaggaaaaaatgctgcgaaaatgccggggtccgtttgaatgtatttatgtgcctaccgtcattatatttacaaaagtaaaaataataataaaaaagtgcccaaaaatagagtgaaatatttggttatattgaaagaatgtaaaaatatgcgtcatgtttttgttgacaatatagagggaaaattttataatataggtagttacgggagggggaaatatgaggaaggtaattgatgatccacgcctgatggttcgggtatgcgatttgtattataatcagggtatcagccagcagcagattgccaaggacctgaatttatccagacctacggtatctagagtgttggcgcttgctaaggagcagggaattgtaaagattagtatttccaatgtgaatgcagtagagcattgggagcttgagagaagacttgagaaagaatttggtcttcgggaagtaatcattgtaggagagaattcctcagaggatgggatgaaggagtcgcttggagaagcggccgccagatatttggaatatacgattaaagatgggaatatagtaggtgtttctatgggttccactttatttgaagtcgtgtcccacgttgtacatcctgccgcacagaaagttacatttgttccgttagtcggtggagttggaagagttcgtatggagcttcatgcgaacagtctggcggaatcactgtctcgtatatataatggtaagtttgtaccgctgcatgcaccggcccgcgtttctagcaggaatatccgagatgagcttttgaaagaagatagtttattaccggcgatttatctgacacagaaattagacattgcagtagttggtatcggatatccgaatgagaagtcagcgatcatggcgacgggatattttaaggagaatgagatagaatctcttattgaccgtaaggtagccggagagctatgtatgcagttttatgatatttacggagatactgctccgtataaagatgataataatgttattggaatggatatcagtatgcttcgttctgttccacgttctatcggtattgccggaggtgttgagaagcttcgggcagtcagaggagcgattaatggacattatattaatacgttgattacagatattgaatgtgcagaggcattgatatctgaataataaatcatggtgcagcagtaataaatactgccgatgcagtagatgcagcatcagaatatatccagttcatagttttgatcaagggggtaaatatcatggatgaaattctaaacctgtcaattaatgagatgccacaaactgagtttgattgttcttgtggaaagcaccacaattttagcgtacacgatatgtctatccgtaaaggagcaatcgaagatttaccaaagatggcagaaccatttaaagatggtaagattcttgtagtatttgataatcatacttacaaagtagcaggtaaaagagctgtagaacttctaaaagagaatggatttaatgtaaaagaactgttatttgatacaggcgatgatatcttgattccagatgagaagaccttaggaagaattgtacaggaacaggatttagatacaagccttatggtagcagttggatctggtgttattaatgactccgttaagttcgtaacttcccgttccggactgccatatatcattgttgcgacagcaccatctatggatggatatgtagcagatggagccccgattttctcacagggatataagtattctccggtagctcatcttacatacggactcgttggagataccgatattttaaagactgctccgcaggacctgattcaggcaggttacggtgatgttgttggtaagattactgcaatcgcagattgggatttatcagttaaggccaataacgattatcgttgcgatacttgtgttacattagttaacagagcattagataagtgttttgcaaaagcagaaggattaaaggaaagagatcctgagtcacttggagcattattagaagcattaactttaacaggtgttgcgatggcattagttaatatttcccgtccagcatcaggtgcagagcatatgttatctcatttctgggaaatggattacattgcacgtggattgaatccaaatcatcatggaattcaggttggtgtagcaacgccgattattgctcgtttctttgaagaattagcagatatccttccagaaggaaccggagcactttgccctcctcatgaggagattgaagcacttttagcaaaaggtggagcaccaacaagtccaaaggatattggcatcagcaaagaactgttccataacagtttactgaaaggatacacagtacgtcctcgttactctatcatgcagtttgcaaaagataatggacgtttagaagaaatcgcagataagattacagaagaggtttacggctaaagaacgcctgggtattcttgaagaattctcagaatttcagacgacaatgatagacatgatcaggaatatataaacaggtaagaggtatattttatgcagaaaaaggaagacgcattaaaaggtgtgaaactatttgtccttgatatggatggaacagtatatttaggtgatcagctgatcgaaggtgcattagatttcattcgtgaggtagatgcatcagaagacagagatttcattttctttacgaacaatgcttctcgtgtccctgcagtttatgttgaaaagcttcataagctgggacttgatgtagaggaaagtaaagttgtaacagctggagatgtctgtgcagaatttttgaaggtgaattatccgggagcaagagtttatctcaatggtactcctgttctggaagagaactggaaggaaaaaggaattaatcttgtagaagaagatccagatgttgcagtacagagttttgatacaacattaacttatcataaactagatcgaatctgtcactacgtaagaaatggtgttccgtttattgcaacacatatggatacgaactgcccgacagagtatggatttatgcctgattgtggagcaatgtgtagtcttattacagattctacaggagtgaagcctcgtttccttggaaagccatggaaagaaacagtagatatggttgcagagattacaggttataaggcagaagagatggcttttgttggcgatcgcttatatacagatgtagcaacaggcgtgaataacggagcgaaaggatttcttgttttaactggagaagcagatatgcagaccgtagctgaatcggatgtagagccaacttgtatctatgattctttaaatgaaatgagaaaatatctgtagttttaaagtataaatcaaaagggattttttaccactcaaataaagaaggagattaaaaaatgaaagtagtatttggatgtgatcctaacgcaacacagtttaaattagacttaatggaatatgtaaagagtcttggacatgaagtagcagacttaggaagtgatgatccgatttatgcgaatacagccattgaagtagcaaaagctgtagctgctaaagaatatgacagaggtatcatcgtttgtggaacaggtattggtgtttctattgcagcaaacaaagtaaaaggagcttatgctgcatgtatccatgatgtatatcaggctcagagagcacagctttctaatcatgcaaacattattactatgggttcacaggttatcggaatcgagcttgcaaaacagcttgttaaagaatatctttctgtagaatgggatcctaactgcagatctgttgaaaaagtacagagaatcattgactttgaaaatgaagaatagtctatcagatcttacatacgtttgattgggaatatatgaaataaaagtgggtattgggtaaaacaatatagcatagaaagtatgctttgatgatgaaaggagttacaaaatggcagaatatttaatgggtattgatgcaggaaccggtagtgtacgagtagcgttatttgattttagaggacagaatcgtgcatacgctgttgcagagtatggaacaacttatcctaaaaatggatgggcagagcagagcgactacgaatggtttgaggcattaaagaaagcaattcctgagtgtatcaagaaggctggtatcgcagcagataatatcgcagcgattacctgtgatgctacaacaaacacattagtgtacttagatgagaatgatacttctgtacgtccaccgattctctggatggatgttcgtgcgacagaagaagcatccttcatcgatactattcgcgaagaatatgatgcaacgaagttctataaaccaggatttagagcagacactatggttccaaagtgtatgtgggttaagaagaacgagcctgaaaactgggcaaaaacgaagacgatcatggaatttgaagactggctgaactggaagcttacaggaagaaaaacagtaagtatgtctgttgcagcattccgttggaattatgatgataaaaatggcggatatccagtagacttctataatgcagtaggacttgatgatgttgttgacaagttcccagaaccagtattaaaggtaggagaagttgttggtaatatcagtgcagaagctgcagaaatctttggtcttagcaaaaagacagttgtagtagaaggtacagcagactgtaatgcatgtatgtttggtgttggtggtgtaagaccaaacggtatgacattaattggtggaacatctacctgtctgttaggtctttccgaagaagaattccacgtagacggcgtaaatggaacatatccaaactgtatgtatgacggaaccagcctgttagaaggtggacagacagcagcaggttctattctgacatggttcaagaataaccttcttccggcagcatggatgcaggaagctgtaaaccgtaacatgaatatctatgatctcatcacagaaaaagcatctgctgttccgatcggatgtgacggtctcgttatgatggactacttccagggtaacagagctccttatgcagactcaaaagcaagaggaatgttctggggattatctatcggtacaacaccggctcatcttgcaagagcggtatatgaaggtgttgcttatggtgcaaaccattgtatcgtcagcatgaaaaaggctggatacgatgtaaaagaaatttacgcatgtggtggtttagcacagtctgacttctggatgcagatgcatgccgatattatcggagtaccaatgtatacaacagtagagagccagagtgcaggatgtcttggtgactgtatcatcgcagctgttggtgttggaatctatcctaacttctgggaagcagcagacagtatgattcgtgtggataaagagtacattcctaatatggaagcacataaagaatatcagttctatatggaaagatatatggaaacatggccacagatgaaagaaatcgtacataaaacagtagaccacaacaacaaaaaatagtattatattaatattgtaaataactgataagcccgcggaggatacgctactggtatgcttcgcgggtatattagattttaacttggaggattaattatgtcagaagtaaaagtaatcggaattggtaatgaccatgcggcagtagatcttaagaatgagattaaagcataccttgaggaaaaaggttataaagtggtaaattatggaacagattcttccgaaagctgcgactatccaatctatggagcaaaagtaggacatgcagttgcaagtggagaggtagatgccggtgttttaatctgtggaacaggaattggtatatctattgcagctaataaagtaaaaggtgttcgtgcagccgttgtaagcgagccggtatccgcaagattaacaaaagaacataataatgcaaatattattgcatttggtgcaagaattgttggaagtgagatggctaaagcaatcgtagatgcatggcttgatgcaaaatatatcggaagcggccgtcacgagagacgtgtaaacatgattgaagaggaagcagcaaagtataataaataaagtatatggttacggaggaagaagatgagtcgttttatggaaataaaatcaaaggatatagagaaagcctttgaagatgagagaagacagtatttcgttggaaacttaaagaaaccacaacatatcccttttgttaagtcagataatgcggaaatgggattaactgcttatgataaattcactggtgagccggctcatcgtcattctgtggcaaaagaatatgcttatgttatttccggtagaacacagtatatggaccttgacacaagagaaatatatgagtatcatgcgggagatttttttgcgacctttccaggaacaacttatgttcagaaatccgaagctggaacaaagatgatctttgtaaaagaaccatcgattaatgataaagagcttgtaccgatggacgaagaagctaaaaaatggatggaaacggaattctgatttgtagatttggtaatagacgaaaaaagaaaaaaataatacatcccatctgctctgtagttgctgtatttaagatgctcatccgcatcttaaatacgctccgaagccacatctgggatgtattatttttttcttttttctggttatctaaatctacagttgggcaacgtggaatgtaccagaaggatatgactttccgagaaattaaattcgaaggggttaacattcaaattgttgtgtatacttagaatttagaattataaagaattcttaagaaacggcgataaaattgacgataatatatatgggaagtataatataacatattttggaaggaaactcttcttaaggagcagattgaaacggagtagaaaggtagcttaaagatgaatattttaataaaaccaagaaagaatagatatattatttatgctataattatcgctcttttttctacgattggaatgcagatttcgttattacataccaatataggaaaagtactggaaaaaatagaatatgattccgtatggaatcatatgatgagtgttttaagaataagtataacaagaaaaagtgatgtattgttgttttatcaaatagcagcggcagttatttttattatatttcttatggttttttcatacaagttttctgttagagaagtagtaagtgcagggatattatcaatattgtttggatttaccatgtggttccgggctgtattttcacataaagaatcatggaactattttgtacggaacagttatgtcaaagtattgaatggatggtatatacttggatatgcattgctggcctttggaattttccttttagttggcaaggctgtaacagggcattgtataaagcaagaaagttcaaaagatccccttagaagtagaggaaaaggaaagaattataataccaaaacagtatttttaatatgtatggctgtattaattgttttttggttaccatattacattgttttctggccgggatttcagcatacagatttgccaacacagatgttgcagttttttcatatccgtacgagatttcaggggagagttgtaacagatggaatcaatatattttatagtaatgatcatccttttttacaaacaatgttagttggctgggcaattaaactgggatttggagttcataatatcaattttggatatgcagtatatagttttattcaaatgatcttatttattgtagctttcagtagtattttagctacgttatatcatttcaaagtaagtgtatttatattaaagataagcttgtgtttatatgccatagttcttgtttttccactatatgctttattaataggtggcgatagctttttttctgttttttatctgttttatatggtaggaattttatggattttttatacaaagggtgacattctgaaaaataataaatttataattgcaatgataatagaaataatccttatgtctacatctaaaaatcaaggagtatatgttgcggcagcagtttttgtactttgtttaatctactttaaaagatatagaataaggatatccgtatgtatgttaataccaatattattatttcagtttgtatattgtggttcattttttaaaattgccagagttggtactacgggaaaacaggaagctttatccgtttgttttcagcagacagccagatatataaaatatcatggagatgaagttacatcccaggaaaaagaagcgattaataaagttttaaattatgatgtgattggaaaaagatatgacccgaatctatccgatcctgtaaaaaggacatttaagttagaagcgacaggagaggatttaaaaaattattttgttgtctggcttcaaatggggttaaaacatcccggcgaatatatacaatcatttatagccaatacatatggttattatactattagttttggtaatcataagggagtatattttaaaccagaaattatggatttttatattggtaaacgtgattgggtaaaaaaagataaacatattgtggaattattaagaaaaattcaagtaaatataccggaaaaacggaaaattattagggaaaagggagtacaaataataaaagtaattcaaaaaattccgatttttaattgcttttttaatccgggaacgctcacctggcttatggtaatgggattttttgtattatggacaaaaaggaaatataattctatgcttgcctttttgccagtatttttgatttttggcgtatgtttgctttcacctaaaaataataatcttcgatatatttatccactctgttgtatgataccggcgatgctggcagcggcatttggagagaaaaatactgatttgatggactaaagagacgaaacccggaaacgttatatagaataaaatgtgaagatagtcgcggagtagaaaatgcctgaccggcatttttacttgctccgacatcacattttattctatataacgtttctgggtttctgtttattggcaccagatgaaattaggattttgtgtggaaaaaataaggggtttctccagaagaaatgtgtcaatcctttagactttaatttcccggaatgtcataagcttctggtgtaatccatgttattaaactgtagatttaggatagtcagaaaaaagaaacaaataatacatcccagatgcggcttgggagcgtatttaagatgtggatgagcatcttaaatacagagactacagagcagatgggatgtattatttgtttcttttttcgtctattaccaaatctacaaatcagtatttgtaaaattccacacaataagaggtaatattcggctatttatttaccaaaataaaaggtgtgattttttagaaaaatgaaagattttattcataaaaaaataagaatgtgcagaaaaatacatttacaagaagaaaaattgtgatataataaatgaagtttgagcgcattgataattaaaatcaataatgcttataaagtattcgtatatctattttaggaaatcaacacagtttttaacagagttttcttatttacagagtaacaattatggttatattctggtgaatacagagttttctgtccaactagtgttaaagttctatccatcctgttatctaggtttatgtaacaggttcttttaacttttattttctattatctattatacattttaccaattgaaaattgaatattttagtacatgaaaagaagcgtaaagaataaagaaagagtgtaaaaagcaggggcttgtaatagagtaagtcctgttttgttatggagatttttatgaaagagaagaaaagaaagttcaggcatgagcatggaggaagcttttcggtagattattatgcatatgcttctcgaatgagaagctggaatgcaggttttaaagtcctgttttcgattattagtttacttttatgtattgcgtgtaataatctgtttgtttcactagcagttattttttttatgggatttttgacagtggctgttggcggtttgaacctgcatcattatatttcgatgctccttgttccaatcatatttttgatttttggaacaattgccatagcgattgggttttcaatgcatccagtgggacagtatcatgttcattttttgaatttgttttacatttattgctcaaaggcaagtttgcttaaagcagggaatcttgtgtttaaggcattaggcgctgtcagtgcactttatatgatgacattgacgacaccgttaagcgaaattattgctgttttgaggaaggctcatgttccaaagctgattatagagcttatgaatatgatttaccgatatattttcattatgattgatacgcacagccgtatgaagaattcagcggaatcccggcttggttattgtgattttaaaacatcttgttattcctttggacaggttgccagcaatctgctggttgtttcactgaaaagaggaaataattattacaatgccttggaagcacgttgttataacggggatttacagttccttgaggaggaaaagcaggtaaaagcaggccaggttgtaatggcagttatttttattattattttattgcttatatgtttttttacaaagtaatttagaagatagtgtgcagatatcctgtatgtgttatttgcgatttgaaaaattttaaatagttacaagatagatgtatgacctgtggaggtatttatgcaggaaaaagaaccaatattaaaggtagaagatttacattatgcatataatggcgaaaaagcagcgttgaatggaattgaccttaatatttatgaaggtgaaaaaattgcggtgcttggctctaacggagccggaaagtctacattttttctgaacattaacggagttttgaagtctcatcatggagaaatatattatcgtggggagaaaattacgaaaaagaatctgaataatcttagaaagaatgtaggaattgtttttcaggatgcagataatcagattattgcatccacagtaatggcagaagtttcttttggaccgatgaatttaaagctgccaagagaagaagtgatttccagagtggataaagctcttgaatatatgaatatctcaggatttaaagatcgtccgccacattatttaagcggtggtgagaaaaagagagtcagtattgcagatattattgcaatggagtcagaagttattatttttgatgagcctacagcggcacttgatccgctgaatgcagcaatgcttgaagaggttcttcaaaaaatgggtgatgagggccggacaatgctcatatctacacatgatgtagatttcgcttatcgatgggcagagagagttatcgtattctgccatggaaagatcattgcggatgatacaccacttgctgtatttaagcaggaggatatcttaaagcaggcgaacctgaagcatccgatgatgtttgatgtctatgacattttaaaagagaaaggtatcgttcctaaaggggacgtttatcctaaaaatattgccgaatttcaggcaatggtaaaaggtttataaatgaaaaattaaaaggaggagagacaaatgtctaaaaaacaaaagagtcttgcagttcttgcgagcgtatttttaatgcttttcacaatcgcaccagtttctaatgcgatgcacatcatggagggattccttccagtgaaatactgtatcttatggggagtaatctgtgtaccatttttagtaatcggttttatgaatattaaaaaggtgcttgggaatgacagaagaactcttacagtacttgctttaacaggtgctttcgtgttcgtactttcatctttaaagattccatcagtaacaggaagctgttcccatatgacaggtacaggtcttggagcaatcttatttggaccatgtgtaacaagtattttaggtatcatcgtattaatcttccaggcaatcttacttgcacatggtggattaacaacattaggagctaactgcttctctatggcaattgctggaccaatcatttcctgggtattatataaattacttcagaaagcaaatgtaaataagagagtagctatattcgttgcagcattcttaggtgatttatttacatattgtgtaacaagcttccagcttgcacttgcttatccttcagaagttggcggtgtaggagcatccatcgtaaaattccttggaatcttcgctacaacacagcttccattagcagttattgaaggtattcttactgtagttatcgttattgcacttgagacatatgcaaaagacgaattaagcagtctggaattttaataggaggaaagaaaatgacaaaaaatacaaaaacagtagttattttattagtaattgcagcattgatcgcaattgttccactgtttgcgcttaaaggtgcagaatttggtggatctgatgatgccggtagcgaaatgatttctgaaattcagggaaaagaatatgaaccatggttcacaccagtacttgaaacagcacttggtggagaacttcctggagaaatcgaaagcttaatcttctgtcttcagacaggaatcggagtaggaatcgtagcattcgtacttggacgatttgtagaaagaaagaagtggcaggataaagataacaattctacttcttcgaaataatcgatagacagacgaaaaccgaagaatcctattcttatatttgtgaaagtatcactgtgggttgaatattcgcttaacagctcacattcaatcctcgctctaatatcgcaaatataaggataggattctttggttttctgttacttttttctgttactttacaatggtctatcagaatgggtcagtcctttacaaatgctattccacagaagtcctgtatcttctgtcttattccccatcttacccaacataattgcggatctgagataattatagcattacaacaaacagaaccccgccaccccttattatgtaaaatgcgccttagagcaaactcttaatgcgggcgagcattaagagtgcagtgatacgaagcatttttacataataaggggtggcggggttcgtctgtttatccgcacaatttaaaacctattgacttgttaaccattcaacggcattaagtacttcttccggtgtttcgcatacagagaagagcgactttacggattcgcggatgaatcccatgccaataagtttatcaatatttgcaatggtgtcatcatagaaaccggccacattatatacaatgatcggctttgcgcttcggccaagttcggtcaaagtaagtatctggaagaattcatcaaaagttccgattccaccaggggcgataacgaatgcatctgcattctcttccatgacttcttttcgaagactcatagtttctgtgcgtacaatttcagtgcattcacttttaatcggttcaaacttgttcatgaaggtcggaacaacgcctgttacctctccaccgttttctaatacaccgcttgcacaggctcccatcagtccgctggcacccccgccatagatgagtttatggtgtcgttttgcaatttcctttcccaattcgttcgctgcatttatatagatggaattgatgcggtcgcttgctgcgccatacatacatattgtaagtctggtcataatagcaccccctcgtttttatttgtagagtttaattttaacattttattcgacgaaaaacaacaaaatattaagggaaaatagataatagatacgaattgtctatatatttcgacaaaaagaaaaaattatctaaagattatgttatgaaaaaagtataagctgtgaataaagaaaaagtacattttttttattgtatgaataaggaagacagaaggtgtataaagacagaaaaattgtgaaatatgcttgtttttttgcataaatattgctacaatataaacaaagatatgcataattatctatgtcgatagtgtgtcttagggatgtactcacaaaggtaagtgcaataaagactccgagagtacatagtattaaaaggggtgatttttatgaagaaggttataacaatcagcagagaatttggaagtggcggtcatgatataggaatggaagtagcaaagcgtttgaatattccgttttatgatcaggagattgtggataaagccgttgcagagagtggatttacgaaagagtttatagaagaacatggcgaatacagtacactttcttctgtattacttggaacttccgcaccttttgacagctattattatgcagaggatcctcaggataagatttttaagattcagcgcaggatcattaagaagtttgcacaggaaggtccatgtgttattgtaggaagatgttcaaactatattttagagcaggcagatattgatagttttgatgtatttatcaaggcagatattgaaaagagagcggagaatgtagcggacagagttgaactgaagggagacgaattgattaagttccttcagagaagagatcataagagaagggtatattatcgtttctatactaggagaaaatggggcgattatcacgactataatatgatgctggacagtggaatgattggcaaggataaatgtgttgacatgattattagtgcgattggtgaatgatagcatataataatatgaaaggaacttgataaggtaagatgagtttaaaagcaggacatttcagaagaagagatgccctgctttttccgattagccttcggtgggattgaaaggaattagaaaatgaagattacacaatgtaaatatgggcattattatgataaagcgtattttgccaaatgcccacattgttacagaaaaaatggcggcagggatgaggacatcataatcaaagacgtaaaattaactgccaatttatcagatacaaatcaggtaacaaaaacgcaagataaaagagaaagtaaccgaaagaatgtgaaacgttggattggagaagcgtgggatgaattagaggaaatcttagcggatgaagaaagtgagcctgaagaaaaagaaagctatatgctttttgctgcgatgcctcttaaagtaatcaaaaatcaggaattctgcatggatttttgcttttttccagaaaaggaatgggagacaggtgcgaagatgctcgcttttaaaagccaggaaagtatacgggatttaaagccggtgcagatgatattaccggctactgtagtattgcatattttgtacaaagaagaagagattttctgtaaagagattgaaatcagcacagaaaagaaaaatgaattttttacatttcctgttacggtaacggatacaagggaccgtcgttttcatatggtgaaggttgtttttgaggtaaaggaacaaaatattgaaattccactgtatttaatgcctaatccgtagaaaaaaccgggaagttatggaaaacattcgtggaactttattattgcgattttagagaaatacttatataataagatataatgtaacagttttgtaataaattcagtctgtataagttgcaaatgaaccaaataagagtaaagttctgatgtagataaagattgaattgtttataatatatctgaagagataaaatataattataaaggagaagtataatgagtgatatgacccatcttgatgagttggaagcagaagcgatatacattatgcgagaagttgtagcagaatgtgagaagccggtaatgctttattctattggtaaagattcttctgtaatgcttcatttagcattaaaggctttttatccagaaaagccaccgtttccatttttacatgtaaacactacatggaagtttaaggaaatgattgaattcagggataaaatagctgagaaatatggacttgatatgatcgagtatattaatgaagaaggggttaagaaggggattaatccatttgaccatggttcttcttacacagatattatgaagacgcaggctttgaagcaggcgcttgataaatatggttttacagcagccttcggtggcggaagaagagacgaggagaaatccagagcgaaggagcgaattttctccttccgtaattccagtcatgcatgggatccgaagaatcagcgcccggagatgtggaagctttataatacaacaatccatcagggcgaggagatgcgtgtattccctatttctaactggacagaaaaggatatctggcagtatatcaagcgtgagaagattgatatcgtgccattatattttgcggcagaaagaccttttgtcagaagaaacggcaatattatcatggttgatgatgatcgtatgagattagaaccgggagaaaagattgaacatggaaagattcgtttccgtacacttggatgttacccattaactggtggaattgaaagtgatgcagatactttagatgctattattgatgagacattaagtgcagtatcttcggagagaaccagtcgtgttattgacagtgacggtggagcagccagtatggagaagagaaaaagggagggttatttctaatatgaacagtcttcttaagtttattacgtgcggcagtgtagatgatggaaagtctaccttgattggacatatgctttatgatgcaaagttactttttgcagatcagaaaagagcattagaacttgatagtaaagtaggttcccgtggtggagcaattgattattcgcttcttcttgacggtttaatggcagaaagagaacaggggattacgattgatgtcgcatatcgttattttacaacagaacatcgttcctttattgtagcggatacaccggggcatgaagaatatacaagaaatatggcagtaggagcttcttttgcagagcttgcagttattcttgtagatgctacacagggcgttcttgtacagacaagacgtcatacaagaatctgttcgttaatgggaatcgagcattttgtatttgcggtaaataagatggatttaattaattatgatgcaaatcgttttgagaagattgagcgcgagatcaagatgatggcagcagagtatgattataaatcgattaagattcttccagtttctgcaacagagggagataatgttactgtgaagtcaacaaagatgccatggtacaaaggagagtctcttctcacatatcttgaaaacgttcaggtacatgatgattctcttgaaaaaggatttacgatgccggtgcagagagtgtgtcgtcctgaccgaactttccgcggattccagggtcagattgaatcaggccagatcaaggttggagatgagattatagccctgccatctaatgagaaggcagaagtaaaaggtattcttgatgcaggtaaagaagtaacagaaagcagtcgtggacatgcagtaaccatttctcttgacagagaagttgatgtatcaagaggttgtgttcttgttcataatgcaaaaccaaagacgggtaatctgtttacagcaaagattttatggatggatgatacacatcttgttgccggtaagaactatcttttaaaacttggaacaaagatgattccggctgttgttatgaacattaagtataagattgatgttaatacagggaatgaagtacatgcagatgctatttataagaatgaaatcgcagcctgtgatattgcagtttctgataagattgtttttgagaaattcaaagacaatcatgcattaggttccatgattcttattgacagaattacgaatatgacttctgcctgtggtgttatcatgcatgccttaagacgtacagataatcttacatggcatgagatggatattacaagagaattccgcgcacagcaaaaaggacagacacctaagaccatctggcttaccggtctttccggttccggcaagtccactcttgcaaatgagctggagaagcgtcttgtggctcttggtaagcatacaatgcttttagatggggacaatgtacgtatgggattgaacaagaaccttggctttaaagaggcagatcgtatcgagaatattcgtcgtattgcagaagtggctaagttgatgaatgatgccgggcttattgtaattacatcgtttatttccccatatgtacgtgacagacgtaacgcaagagagattattggagaagacagctttattgaagtatacgtaagtacaccggtagaagagtgcgaaaagcgtgatgttaagggcctttataagaaggcaagaacaggagaaattccgaactttacaggcatatccagcccatatgaagcaccggaacatccggaagttacgattgatacgacaggaaagagccttgaagatagtgtagattatgttatggcacagttggaagaaaagttaggttaagtatcaggtaacattgggatataaattataagaggaaataaaaatgcgcacactttatgtacacattggaacacctaaaacggcaacgacatcaattcagatgttttgtgtcgaaaatcaggatatattaaatgaacagggctacagctatcctcttttagagtttacttatccgcatgtagctaatcgacggaacggtcacttccttgtaggatggctttataagctgaatggtgaagaggatgtagaaaaagagcaggaattgtgggacgaaggtcttgcaatgattcataaagaatttgaaaaatatgataatgtaatactttccgatgaaaatatctggcatgcatcaaacggaagaaagtttcctttctggtctaaacttatggaggatgcaaaggagtatgactatcaggtcaaaatagtcgtttatataagacggcaggacacattagctaattcgtggcttagtcagcaggtaaaagaaggatggaataccaattctacaattaaatgggattcttttcagcagaagacaagaaaagttgtatttaattattatcttttacttgaaaagattgctgaagtaacaggaagagagaatatcattgtccgcatttttgacagaggtaagtttaaaggtaaagatcatactattttttcagattttttggaggcaattggcgtggattatacagatgagtttaaaataacagaagaagaggcaaatcgttctctgacaggaaatagtcaggaaattttgcgaattatcaatacaattcttccagatgatgtaaacgtgagaactctggttagagaatcagcacaggactgtgagaattataaagatcctcagaataactttgttatgttttcagaagaagaatttaataagtttatggggcgttacgaaaagtggaataaagctctggcaaaagattatttaaatcaggaagagcctctttttaacatgaagagaaaagaaggagaaagatggacgccgaataatcgttttatgtatgaggatatggtacgtttttttggtggggttgttatcagacagcaacgtcatatcgaagagttagaaaaagaaattaccactttaaaagatagtcacttagagacgatagaaagattgtcggataaagagcttgatgagactgcaaaaaatgttttacaggtacttgctgaacaggttactaaacagcagaaagacattcagagagctcttgagaattctgataagattgatgcagtaaaagatagaagccaagaggtaaaagtacagagtcttactattgggaatgaattaattgacgtgcgccaggatcaagataaacttgaaaaagtaatgaagaaagattatgagaatctaaaagaacgtgacaaagagttaaaagcaatgattcgggagctggaacagacttctctctggttccgtcttcgtagaaaatggagacatcttactggaaaagatgcgcagtagaaggatatcatgtattgtatgatgcgtatcctgtaacaagaatatctcgacattcttgaatattaaaaatgcaaaaagaccaagggtatagttcaaatggtgtaaatccatacccttggtcttttatattgcctggtaaaagtggattcaaaaatatttcatatatttcctattgaaataatatgaaatatgcggtaatataaaaaaatcaaaaagatacatgtaaggcaaatgatgtttagcagatttttacattgcagttttttgaatatccatatataatgaaaggcaatataatattatgaatataacagcaatacagatatcagaaaaaagacaaaaagtaaaaacaagtgatgagagtataaagatgagaaagtttatttccatgactgcgactatgttaaaaattggatttatcggttttggtggaggaagtgccctgattccggtaattgaagaagaagtcgtagagaaggataagattgtatcagaagaagaatttaatgacgatgtaatgatcgcaagtataacaccgggagcgcttcctgtggaagtcgcaacaggaattggaagacagtcctccggtttaaaaggaatggcggcagcggcgacagcgatggcgttaccgggtgcattgttaacagtattattacaggcggttatctccagtgccggaagtatggtaaagtcacagattaactatctttcggttggaatttctgcatttattatattaactttattagcctattctttaggaacggtccgtcaggctgttaacaagagagaaggacagttgtatagcctgattattttaggagtatttttgctttccggtgaaaagagtatttatcagttatttggattgaacataaaaccaatatttgcactctcaacaattcaggtacttggtgctgcgttttttgtaatcttatttacaaagggacatctccgctgtttaaggagatcgataccggcggtgatcattacaggatgttatctgttatgtgtaggaagtgcacatattataccgctggaagcgaaaccatttatattggcacttatggcagtattagcagtacttggtttggcgcagtccgtattagaaagcccacagaaaaaggcttttccggtaaagagacttgtaacatctgtaggtttttggcttatatttgtggcaatgttttctataccggcaatgttcttaactgcaaaggctttgagatttattggaatgggatggttatcttctgttatgtcttttggtggaggagatgcttatctttctgtagcacagggattatttgtggaaggcggagtaattaataatgcagatttctatggaaatgtagtatcagtagcgaacgcacttccaggctctattctttgtaagatacttaccggtatcgcatatgatgtagggtataatctgaatggttctatcattgagggattgtttgtagcactttcgggatttgcctgcagtgtagcagcatccggagcaatctttgaattagtattctgtgtgtatgagaagtacgaaagtcttcagatatttgctgtagtaaaacatttcattcgtccgattatttcaggtttgctgcttacagtagctgtatcattgtatacatctggaatttgcggacagattcaggaggcagcaggaggaaatagtagcattgtagcatttgtgattacttttttagtaattatagcgaatcttgtattaatgataatgcagagaaggggaaagaatatccatctgatttggaagatcgtgatatctgctggaatctccagcattggatgtaatttattattctgatttaacaatagatgaaaaccggaaaagggtatgacaggaggataaaatgaaaacacttggatttattggaatgggaaatatggcaggggcaatcgccgccggaattatacaaaaaggtctgatgaagaaagatgaggtatttgcgtatgccccacattatgataagcttgtaaaaaatgcagaaaagataggatttacagcctgcaaagaattaaaagaacttgttgcaaaaaccgatactttaattatggcatgtaaaccatatcaaatcgaagatgttctttctgaaattaaagaagatttaaaaggaaaggcattaatttctattgcggcaggatggaattatgataaatatcaggcatatcttgatgagagtactcgttttcaatttattatgccaaatacaccgtctatggtcggagaaggagttcttttatttgaggaaaagaattcattgttagatgaagaacatgaggaagtaaagaatctttttaaagcattaggaattgtcattgaactgccagttcatctgatgggaatcggaggagcgcttacaggctgtggtcctgcatttatcgatttgattattgaagcattaggagatgcgggagtaaaatatggtgtgccaagaaaacaggcttatgaaatggtttcgcagatgattcttggaagtgcaaagttacagcttgaaacaggagagcatccgggagtgttaaaagataatgtatgttcaccggcaggaacaacgatctgtggagtggatgcgctagaacatgcgggagttcgtgcggcatttattgatgcaattgatgcagttatgaataaataatcaatcaggaataagaatcaaccaggaataagaataaacgaggtatggaaacaaaatgagatatggaaagtttttgcccgaaaaggggacaataggatttgttgcgccatcattcggctgtaacattgagccttatagaagtgcgtttataaatgcacagaaaatatgggaacaacaaggctatggatttagttttggtccgaatgcttatgagggttgtggaattggaatcagtaacactccgcaaaagtgtgcagaagaatttaatgactggtatgctaaggaagatgtagatgttcttatatcctgtggcggtggagagttaatgtgtgaaattcttccatatatagattttgaaaagattcgaaacagtgagccaaagtggttccttggatattctgacaatacaaatcttatttttcttttagcaaccctctgtgatactgcggcaatttacggaccatgtgcggcagcatttgggatggaaccatggcatgactcattaaaggatgcgatgggaatattaaaaggaaatataaagagtgtgcacaattatgaacaatgggaaaaagaaggattaaaaacagaagacaatccattagaaccatataatgtgacagagaagtttcagctacgcacctggacggcagaaaaaggattatctatgcctgatgatatatcgaaaaaaacagatgagattattcaaatggagggacgtcttttgggcggctgtcttgactgtctgtcaatcttgtgcggaacgaagttcgatcaggtagaacagtttaatgaaaaatataaagaagatgggattctctggtttttagagtcctgtgatcttaatcctatggggatacgcagagccttatggcagcttgatgaagcaggatggctcaaatatacaaaaggttttttaatcggacgtccttattgttacggagaagatttctttggcatggatcaatatacggcagtccttggtattttatctaaatataacgtcccggttattatggatgtggatatcggacatctgcctccgatgatgccgttagtctgtggcagtaaagcgaaagtaaaggtagagggcaattcgataaaaatagatatggcgtatatataataaaaacatttagcaggagtaaataatgaaattaatatcatggaatgtgaacgggcttcgagcttgtgtaaaaaaaggatttgaggacttttttaaagaagcagatgcagatatcttctgcgtgcaggaaacaaaacttcaggaaggacaaatcgattttgcaccggaaggttatgaatgttactggaattatgcggagaaaaaaggttattcagggacagcagtgttcacgaaaaaacatccaataaaagtgtggaatggaatcggaatagaagaacacgatcaggaaggaagagtaattactttagaatttgaagactttttctttgttacagtctatacaccaaactcccagtcagaattaaaacgtttagaataccgtatgaagtgggaagatgacttcagggagtatttacaggaacttgatagagagaagcctgttattatgacaggagatctcaatgtggcacatgaagagattgaccttaaaaatccaaaaacaaataaaaagaatgccggttttacgcaggaagaaagagataaatttacggaacttttaaatgcaggatttgttgacagcttccgttatcttaatccggaacttgccggtgcctatacatggtggtcttatcgtttcaaagcaagagaaaaagatgcgggctggcgtattgattattttgtagtatctgaatgttggaaagagaaaattcaggatgcagtaatctataaaacagtgatgggatcggatcattgtccaatcggattagaaatataaagtatgccggggcattcttgaatcttaagagataggatatgaaggaatagaggaggtttaagagaaggttatggaaaagatattgattgtcgtagatatgcaaaaagattttgtggatggttctcttggaacgaaggaagcacagtctattgttccagccgttaaagataagatcgagaattttgagggggatattatctttacaaaagatacacatgaagaagattatttaaatacacaggaaggacagaatctcccggtagttcattgtatcaggggaacggctggacatgagattatagaggaacttcagccctatacaaaaagagcattagctatatttgaaaaagaaactttcggttcacgtaaattggcaggctttttaaaagaactttataaagaaaagaaaatagagtctatagagcttattggattatgtacagacatttgtgttgtttcgaatgccttgcttataaaagcatttctgccggaagtaccgatatctgtaacggctggctgctgcgcaggagttacaccggaaaaacataaaagtgcattagaaacaatgaaatcttgccaaatagaggtgagatagacgaaagtgaagaaaccactatatatatcaaatgactccgtagtcgcggcgaggaaaatgcattggtcggcattttctcttgctccgagtcgcatttgatatatatggtggtttcttcgctttctgtctttggggagcgaggggattcggtcaggaatcttctacttgctctaaagagtagtatgggtcggacttttttgtttttagattatgaatactttttaatcaaattcattataataggaatggctctgttgagtttactttcttttaaggtctgaatatattcttcacgttcatcataaacatactgcactgcttttaacaaagtgttgcttgtgagttcttcttcctgaagtacgtagctgtatccggacttttcgaaggaagcagcatttaaaagctgatctcctcgactctgggaggcaggaagcggaatcagaatattaggcttcttaagagcaagaagctcacagatcgcattcgccccagctctggagataattaaatctgtagctgcaaataaatgtgttaattctttttttgcatattcgaattgcttatagccctttgtaccatcgagggaagcatcatagtgtccccgtccgcataaatgaataatctggaactgttttaataattcatttagattctcacgaatggaattattaattgcaacagcaccgagacttccacccattacaagaagaaccggtttggaatcatcaaatccacagagacgcagcccctcctctttattgccggaaaataactcctgacgaattggagaaccggttaaaacagccttgctttccgggaggtgttttagtgtctcagggaagttacagcaaacctttgttgctgcaggaatacaaatcttgttggcaagtcccggagtaagatcagattcgtgaataataacaggtacatgccgtctttttgctgcaagaacaacgggaacagatacaaatccacccttagaaaagacaatgtccggttttaatttatgaataatatgggaagcttctaaataacccttcataactttaaatggatcagaaaagttcttagggtcaaagtaacggcggagcttaccggaagagattccatgataaggaattcccatttcctcgattaatcttttttcgataccgttataggagccgatatactgaatatcatatccggcttcttttaagcttggaaccagtgccatatttggcgtaacatgaccggctgttccaccaccggttaaaacgattcgtttcatacttttaaaaccctcctgaggtaaattaaaatctagaagtctatgcctgctgctgtttgtatgcaagaagagcaagggcaagctgatctggacaggatgtgcctcttccaccacagtcaattccctttaatgtgctgatgatatcatcaatattacgtcctttgcaaagtgcggcaacaccctgagtgtttcccatgcatccgccgataaaacggatttctttcacaatattgttttctacgtcaaactgaatctcacgagaacaggttccctttgtcttgtaactatacatatcgtgtttcctcctgtatgtaaaaaatatttttcaaaaatttaatgtcagtatatcatcttttcatttaaaagaatagagaaaaaatgcctaatttggggtacttgacgaaacggagaaaaggcaatatgtaaaaaatgtgctttttctctgttcccgtctttgacatcttaagtcaggcggtaataatggggtagtcagcatttagatatctctgtctccctcttcgtcaaattcctaatgacgtggaggggcaaaatgtgttataatgagtctacttgttttgatggcagttaaaattcaagtcgagcagccgcgagacttggcgcgtgattctggtcagcgtaaataaaacattaagtattggaatagtatatggaggaagatttatggtttgtattggtgtaatcggagcaatggaagaagaggtttcctctctcattaatcagatggaagatgccgagtctaaaacgatggcaggcatgactttttataagggaacgctttggaatcaggataccgtagttgttcagagtggaatcggtaaggtaaatatggcaatctgtacacagattcttgtgaatatttatggtgtggatatgcttatcaacacaggcgttgcaggtggtctttacaaagatattaatgttggcgatatcgttatttcaagcgatgcacttcagcatgactttgatgtaacgggtcttggatataaaaagagtgttataccaggaatggaaacctctgtattcacagcagatacggaactcgtggagatggcgaaggaagcatgcgagatcgtgaatccggagatccagtgttttgttggaagagtggtaacaggagatcagtttatctctgataatgatacaaaggcagcacttgtaaaggattatgatgggtactgtgcagagatggaaggcgcttccatggcacaggttgcaacactgaataaagttccgtttgttatcattcgtgcaatttccgataaggcagataacagtgcaccggttgcttacgagacttttgaagaacaggcgattgttcacacagtgaagctgctggcagctatgtttcttaagatgtccaaataagtcagtttcataaagaagtattcgaatcccttctctttttgacagagaggggattttttttacgaacgaatcccccttttcaaatggattttcattttgtataattggggcacaatccagacagagcaaagtgatttcacaaggcagaacgggaataggtgagtcatggcagacaagataccgattcgcagattgtttcggctggggcccggcaatgaaacgtccgtacataattctgaccggaaaaagagtctgcgctggactgtattatttctcatgtatttgtcattaaaattatgaaaatgtttgaaatatctgggagggaagaaaatgtttgattttattcttggtaataccgtttttacaaaaacaattatgacctgctgttttattggaatattaagctggtcggtgttaacgatatcatacagaagcatgatacgtgcgacatcgaggatagggcagacgaagaaaaagtggcttgtttctctgaaaaagaagtatgaagattatcatgaaatggatatcaaagtgaataacgtggaaacatttgtggacaagtattttcgcaaaaaaagagtttgtggatttacttgtgctttttggagaaccttatatcgcctggcgatagcatcatgcgcgatcacaggggcggcaggagcgctggctgtctcacagggaggaggtgaacttaccagcgtaattattacttaccttaccggggtgattgctgcatttagtcttatattccttgatatcctgctccgcgcagatgcaaaagaacaccgcatcatcatgaatataaatgattacctgcaaaatgttcttgagaacagtattgcaggtcaggaagtcgatttggaaaatggaacgacaagagaacagcgtcgtcgtcttcttcgttatgccagagaaaataccaaaaagaaagcaaaggatgagccggtatctttagaagaaaagaaagtgttagaagatgttttgcaggagttctttgcctgaaatatttttaaccctttttcagatcagataaagagtggaaggtatatccctcttgctctaaatttgtaagaaccgtatctaaagcttcagcgtttgattttgatatattatgtatcaatggaatggcaccgggatggatatatttttcaaagtggttgatgacataatcactgcccggttgattatctacatcataatcaagatatgccatactccaaaaaacagtggtataaccgacatcctttgtaatctgaagggtacgttcgctatattctccttttggcggccggaaaaaacgatccatttcgtatccggtcgcttctttcatataatttgcattatctgtaatttcttcacgaacttttcttgaatctgtttcaggcatacaaacatgatgggaagtgtgatttccgacaatatgcccttcttttttcattctcttaacgagttcaggctgatcctcaatataatgccggcacaggaagaatgccccgggtgctttatgcttctttaacacatcaagaatagatgcggtatagccgttctcatatccacagtcaaaagtaagaaagactggcttttcagcgccctttagatttgtttttacataccaggcatcataacgggaaaggtctacttcctcctgtgcagaaggggtcatatggttttcttctcgtttaatccaccatgccatttttttattaggaagcgtatcaggattaatagaagaaacagctttatttggctgcgtggaagtacctgcttccttttgaacagattccatggaggaacgagtggaagaagaccgttttgaagaaaaattgttttgagaatttggatttttattatgggcaaaaggatgacagccacacattatgaaacaggggaaaatataaagaaaaagaagaaattttttcataaaaagctcccgaaaagaaaatctttttataatatatttcttcaaaaaataaatatgaatatttaattagctgacaaatatttcaattccgatggcgatcaggataattccaccgagaatttgcgctttgttggataattttgttccaaatttttttccgataattaatccaccaatgcagataaaaaaggtaacgatagcaatgatcagggaagcagcaagagccatgatccagtgatattctgcgatagtaaaaccaacagacaacgcatcaatagaagtggcaattccctgaacaaacagtgccccagggctgatggcggacacttcttcttcacagtcgttttttataccttcgatcagcatttttccaccgataaaaagaagaagaatcaatgcaatccatggaataaacttttcaaatacatgaaaatactccgcgatcgtgtgtacgcagaaccagccaatcagtggcataagtgcctgaaatccaccaaatactccggcaattgtgcatatacgccctttgttcatatgtggctcattcagaccgtttgccatggaaacagaaaaagcatccattgccagaccaatcccaagaaaaatgttcgtagtaaaaaatagtaagctccaagtcattagaaatccctcctgtttgtaatatgtactcttaaagtcttttctgcatgtgcttttgcaactgacaaaaaatctcaaaaccaagcacaaaaagattacgagagtgcactaatcataataacgcaaaaaaataagcatagcggtaagctatgctcaggtaattatcataaaaatataaaaagacccctgtatagcttatcacagttatacatgagtctcgcaatttaaaacaagccaggtgaattacaccagtatgttgacttgctacgttccaacgtataaaagaacgctcgctactccctcacggaataatatctgagtggaagtatagcatatgggggagaaattatcaataactttttctcaataaggataacaatatttaggaaattatatttaccagtatttgtaaatcaaaatcatactataggttatgcatatagagaaaaagcgttaataatcttcttcaataacctgaaaatcaagatagtcaaaatcaatgtgttcaataaagttatcctgataaaaacgagtccttgcatggctgataaattcacgtttattcttatcaagccacattggtttttcaaggtcaaactcataacaggcacgttctaaacaatcatatactttggcagtgcgggacatggatatatcatagttttccataacagtatctttaagaatatgatttttttcaaaaagtttacaccagattctcataaaagctcctttctggatatataacatagtagaaatcagtatttctgccagtgtaacgaatttgaaagcgtttgtcaatttctaagtggaactgcagctaaagcgagaggaggttgaattaagggggaaatattcaaaaaattcgtgaaagttgttaattttgaagggttacaaagtgaaaattgcaaaaaaatgccgatattaaaaaaacactgttaacaattcgtcaaagtgtgttataattcgtaagtataacgcagtaacgcgataaacatttattttaatttttaataaatagtacaaggaggatatgttaaaaatgggaagagtatataatttctcagcaggtccggccgtattgccggaagaggtattaagagaagcagcagatgaaatgttggattataaaggctgtggaatgtctgttatggagatgagtcatcgttctaaagtcttcgatgatattatcaaagaagcagagcaggatttaagagacctcatgaacattccagataactacaaagttttattcttacagggcggagcttcacagcagttttcagcaattcctatgaatcttatgaagaacggtgttgcagattatattgttacaggacagtgggcaaaaaaagcatatcaggaagcaagccgttatggaaaagcagtaaaaattgcatcttctgaagataaaactttctcctatattccagactgctccgatcttccaattgatgaagacgcagattacgtttatatttgtgagaataatactatttatggaacaaagtataaaaagttaccaaacacaaaaggtaaaacattagttgctgacgtatcctcctgtttcttatccgaaccacacgatgtagaaaaatatggtgtaatctacggtggagtacaaaagaacgtaggtccagccggtgttgtaatcgtaattatccgcgaagacttaatccgcgatgacgtaatggaaggaacacctaccatgctcaaatacaaaacacaggcagataaagattctctttacaacacaccaccatgctatggtatctatatttgtggtaaagtattcaaatggctgaaaaaacagggtggacttcaggcaatgaaagaatacaacgaaaagaaagccaaaatcctttatgatttcttagacgagagcgaaatgttcaaaggaacagtagtaaaagaagaccgttccctcatgaatgtacctttcgtaacaggtgataaagaattagatgctaaatttgtagcagaagcagaggcaaacggttttgtaaacctcaagggacacagaacagttggcggtatgcgtgcatctatctataatgcaatgccaattgaaggcgtagaaaaattagtagaattcatgaagaagttcgaagcggaaaataaataataatttaattggttaaacagacgccgctgaagaggaagatattgagctgaattgtagtcagtcttctaaagaaaaaagaattgttataagttagattttgttccgttgcgctgaacattccattctgcccagaaaaacaggaacttgggaaaaacgagtcccaagttcctatggtcagaattccatagcgcaaagtcacaaaatgcaatacttataacaattctttttttctttactatagtttttttacaattcagcataaaattttgtctctgcggctgactgttttaataacaaattagtcatttgttttggaaagagaaggggattgtccagaagagtatgatgaatccccattcttatcaactgtggatttaggataaccagaaaaaagaactaccaccctatcccagatgcggcttgggagcgtgtttaagatgcggatgagcattttaaacactgcgattacagagcagatgggatagggtggtagttctttttttgtctatacaaaatctacaacttactatgttattgtcattaatattccgttgcagatataggttgccaggcaatctacaaggtagaggctggtatagggaagcaagatttcgcttgaagaaaattcgttaatgattcctgtgatagaaatatttccgataggagaaagtgagcgtgaaaccccttttccagggaaaagaggctggcaggatagagaaacaaggccgatgtgattccgggaacctacagcggcatcaatggcaagtgtgcaggcattaggatgcgctgtagatatttccgagagctgcctggtcagatttccagcatggagaggtttttctaaagttccatataaaggatgcgggaaattttgctgcattagtttcgaaccgacaagcggaccaagacaatcaccggttattttatctgtaccaatgcagagaagaacaaggtcttcatattttttatttaaataagcaatgtgtttattaagtgcattagaaaaaagtgcagtagaagcgttgtcaggagaaaaatactggcagcgtttttctttttttatgttgaacttcatgttaaaatcctctctttgttatttatgtactctcggagtctttcttggcacaaaaagattccgagaatacatatttttcttattttatgatgttaatgctgtaaaatatctgtagcgctaaaagtttctttctatatttagaagtagacaaagagaaagaactttaaacaacattttgctgtgctaaagatgtgcttcaagtcctacgtgtatttgaattgcaactaaatagaacatttacttgaaaaatgaaagaaaaatgcgaaagcatatgacaaaaactgccatagaccaaaataggaaaatgctatgattgagccatcttaaaaatgtaaaacagggaaggtgggaaattcatggcagaggaaaagcggagcgttcaaaagaaaataggagaattaacaagaagtctgccgagaaattacagacagattggagagccgggtgcaaaaaaaatatatatagaagattatgtgtatacatatttaaataaattggcgcagccggaaaatctttatgcaagaggcgcagttttatttggaaaaatgtacaagacatcaattggaaaatgtatctttataagtggggcggcagcttgtcagaattttgaattggatttggaagaaacgattttttcagaagagagctggggagaaatttatcgtattagagattctttcttccctgaaatggaaatctgcggatggtttttatcaagaatggggttttcggtagatttaaatgataaaattattcggattcatatggataactttagcggagaaaataaggtgctgtatatgattgatgcccttgaaaatgaagatgcattttatcagtttgaaaactattctttaaaaaaacaaagaggatactatatttattatgagacaaatcaagaaatgaaaaattatatgcttgcagaaggagagatgggacatataccggaacaaaaggaaaggggacgatattctgaaacaataaaaagggatacagcggtcgtgagaaattataaaaaagcattgaaaaaaaagaaaaatctgcgacccaaatccgtatttaggagccctgtttatataggttgtgggtttgttgctgccttagtttttgtttatggtattcatactctggcacagtttcaaggagatgataagacgcagacagttttttatcagcaaaagataacggatatgaaggcggattcagaagaaggaaagacagaatcaaatacacaagctggtagtaacgaagatacggcaacagtaaaagaggaaaaaacattgcaaagttcctccgggcaatcttcagaagataccggtacgagtagtgatacgaatgcaaacaatgaagaaaggcaggcagaaagttccgaagaaacgcaggaaacatggaattctatcgggggatattatacagtaaaacgtggggatacgttagcagcaatttcaaaggaaatgtatcattcctataattatatagaaaaaattgcggaagcgaatgggatagaaaatgttgatgaaatatatccgggtcagattttggaactccctcagattgaagattaaaaaggggtatgttataatatcaaatatgcgatgactcccatatctataggtgatgagcaacaaattactaaagaaaatttttgaatatgcagattatttttatagaaagagagagcaatggagaaacaggtatataattttgaagcgttgacaaaaatacgaaaaaaaagagaaaaaaaccgcaggataaaaatgattatggcagcggtatgcattgtggctgttctgattgttttatatattttatcatcaagtcgatgtgaatattatgtatataaagacaagacagatacagaagataatgtagatgtatcctatgaaacatttgcagatgggtatttaaagtatagtagtaatggaattgagtttcagaaaaaatttggacgttctgagtggaatgtagcattgtcttatgttcatcctttttttacaaagtcagattcatatgctgtacttggtgataaaggtgaaaatagtcttattctatttaataaaaatggaaaagtaaaagaacttacattaaagtatcctcttgttcaggcaacagtatctgatcagggaatcatagaagtgattttggagggtacaaatagtaattatatacaggtctatgcaaagaatggagagttgatagcagatatgcgttcttctgtagaggagacaggctatcctgtaacagcggctatttctccagatggtacacagcttgcggtaagttattattctatttcaggaatgaattcaaaaacatctattgtgttttatgattttagccgccagctgcaatcagatgatgtaacgttaaaaggtggatttgattatgaaagtgcgcttattcctaaattaagttttgtagataaaaatacagtagcggcatttggaaattctgctacatatttttataatatagaagatacaccaaaggtaaaaaaagaaatacagtttacacaggaaatcgaaagcgtatttgaaaatgataaatatattggatatgtattagagaattcggaaaacccggaaaaaggaaagtacagtcttcaggtttatgataagaacggtgctaaaaagctagaatgtaagttgaacatgaattatgattctattcagatgtggggaaaggaaatcatagcagtccgcgagaatgaatgtactatattaaatataaagggaaatattttattccagggagaattagaaggaaatggtatagaatcaattatgccggcaaaaggctggaggacataccatgtgatttttagggataaaatagtaaaaatgaagctgaagttctggaagaatagttaaaacgaaatgatgtatgtagagggggctgtcgcgctattgttccaactttagactattgaaaaacacagagagaccccatatataaatccacactcgttgaagtacttcgtcggattgtgtccaggtcagtaagacaagaggttgtcttcttcccttggatacaatcgctcctcgttcttcaaatagtgcagatttatatatggggtctctctgtgttttatttttattttatctcggaacaatagcccgacagccccttttatgttaaatgtgagatagaagagaagaaagattccgagagtacataaatgaaagttctaaaagaaaaaataaaaaagtgaaaaaacacttgacgtaacacaaactctatgataagatagcatacgttgcacatgagaacacattgatttgaaagaaatcggaaagaaaatcttcagacaaatgaaaaaagttcttgacaagataaaacatgtgtgataagatataaaagttgcacgacataaaagaacaacttcttctgaaagagatagaagaagaaagcaaaatggcttcaaaaaagaagttgaaaaaagttcttgacaaataaaagtcgatgtgatagaatataaaagctttcgcatgaaagcgaaaccttgataactgaataacaaaacaaccttgaacgttaattcaaatttcattcgggttttcctgagagtgatgtctgcagggaagtccatggaacagaacgaaagttcaaaacctaaataaacagtaaagacaggaaaagaaccagtggttctggacctcgatctgacatcttaaacactttatttgagagtttgatcctggctcaggatgaacgctggcggcgtgcctaacacatgcaagtcgaacgaagcaccttatctgattcttcggatgaaggtctggtgactgagtggcggacgggtgagtaacgcgtgggtaacctgccctgtacagggggataacagttggaaacggctgctaataccgcataagcgcacgagaggacatccttttgtgtgaaaaactcc

SEQ ID NO: 413 - DNA, 47412 bp, Eubacterium hallii
ccatcgcaaatgtaatgtgagagcaagtaaaaatgccgaacaggcattttctacgcagtgatatctttacagttgcgatggtctagtatttttattttcgtctgttccctaatgaattaaatagtaattatctgtttcctttttcttgtaaaatcacaaaagaatacttgtaatttatgacggagttgcatttactttaccggcacatttttatataatatacacatatagcataaatcatgatggattagtgtgtgcattggtctgctttttacatttatttgcattgatatgacaaatcttgttctctgtggctactttttagctgtagaacggtttactgatatgaacgaaaaaaacagattgatggataacgaaaggaggaatccatgacgaaggatatgatcaataacggggttaattcagatgataagtcccgtattattcaggagtatgttccgggtaagcagattacgcttgctcatatggtaacccgtccaaaggcttctgtttataagaagcttggtctgccggatgattatcatgatgcgatcggtattttgacaatcactccttctgaggcaacaattattgcggcagatatttgtacgaaggcggcttctattaagttaggttttgtagaccgtttttctggttctgttattattgtaggttctacttctaatgtggagtctgcactgaacagtgttattaccaccttctataataagctcggttttgataccgtttctattacaaagacttgatttagatacactttagtttggagattatttttttatgaaaattatgttaattggtccgtcggcagcgggcaagactacgctgattcagcgtcttattgatgaagagattaagtatgataagacgcaggcagtggagtatattggcaattttattgatacgccgggtgaatatatgcagcagaggggatactggggttctttgaccatcacttcccacgatgcggatattatcggactggtgcaggattccagcagtgaggactgctggttttccggtgggcttacaagtaagtttgaaaaaccggttgtcggtgttatcacgaagattgacaaggatgattcgaatccaaagcaggctcgttcctatctggagcttgctggatgtacgactatttttgaggtgagttcctataccggagaaggtgtggaggctttgtctcagggattccacgatatggtgaataagtacagggaagagaataaaagccgttatgccgatgattattttgattagaacagggggtggtaggcttgattacactatcaaaggagaatgtcgttgattatgtgaagtcaaggctcgatttttttaatccagatggagacattaaagtttctgcaattggagaaggtactgtagaagaagacggagatggttttattaactttgtctatcgtgtttctgacggagagcatcatttaattgtaaagcagtctactttggaagctcgttctaagggtagcttcactttggatttaaaccgctataagctggaatacgatgccatgaagatctgcgctgcgatcgtaccagatctgattccgaagttatatgactgtgatgaggagaatcgtgtatttattacagaagatgtttcctatcttcgaatctcccgcttccagcttttaaagggtgttacttatccaaagcttgcagaccagattgcaagatatatggcagcaacacagttttacacttctgaatattatttagatacaaagtgttttcgtgatctgagtgttcatttcatgaatacaactatgcgaaagattatggaagtcggcatgttccttacaagtgtaacaccggaggataccgtcggacgacctcttgatcctgaattcattacattttccaagagaatctgtgcagaccctgctgttctcttagcaagacaaaaactgagacatctttttatgtctaagggagaatgcctgattcactgcgacctgcatacctccaatatttttgccagccagactgaagcaaaggtaatcgacatggagtattccttcttcggaccttttgcttatgatatgggatattttaccgcgaactttatcgcacagtatgctgccgctgctttccgtccatttgagacagaaggagctcgtaaggaatttaaagcatactgcctgtttatgattcgtgaaacctatgtgaagtattgtgaatatttcacacagtactgcaaagaagattgcaagcctgagtaccagaatattccgggtcttgccgaagacttctgcctgacagctcttcgcgagtttatcggctttgctgcaagtgcaatgcttggtcgtatctgcgatcttattccatatccggattacgatgatattgacgattatgtacagcgtcacaacgctaaatgtttctctatcattttaaacagggaaatgcttgtaaaatgggaatcttataattctattgatgaatttattcaggacatccttactatagaagaaatctactgtagaaatattaaagatttgaaattataaaagggaggcacattatgattattcttacaaaggaaaatattctttcttatataaaagagcatgtgccttccctgcagttaaaagagccggttaaagtttctatgattggagaaggcgacctcggtgaagacgtggaaggggatggttactgtaactacgtttttcgcatcagtgatgccgatggacattcttacattgtaaagcagtccacagaacaattaaaacggcgtgggcgtgccctcactccgactcgtaaccgtttcgagtacgagattatggaacttagggcaaagattgttccgcagtatgttcccgctctgtatcttggcgacccggaaaacaatgtatttattatggaagatgtttcaaatctgaagctcattcgtttccaaatgaataaaaatcatcttttcccggaactggcaaagcagggcgcacagtatcttgctgccacacatttttatacttcagaattctatcttccaacagaagaataccgcaagcttctcgcacattttatgaacgcagaactgcgtgttgttatggagaacggcatcttcctcaatattttcggagcagatcagtacgatcctgcctgcggtccagaatttgaagaatattgcaagtcgattcgctttgacccaaatcttgaattccagagatataaactgcgccatctctttatgagcaagtcagaaacactgattcatggcgacttccatacttctaatatctttgcagatgatacacatttgaaagttatcgatatggaatatacctttggggcaccgttttcatacgatctcggattcatcattgcaaatattatttcccaggcctgctccgcatctgttcgcccatttgatacggaaacacatcgaaagaactatgtcgcttatctcatctcccttatcgagatgctctatacttactatattcagttcttctttgaatactgggaaaaagatgcgaagcttgaatataagattacaaatggctataaagaaagccttgctcttgatattttacgagaatgctttggctttgcagcctgcgtaaacttcagccgcgtatgtggtgatatggatacagccgactttgactgtatcaaagataatacactccgcacaaaggcgaagtttgcttctgttacaattgataaggttctgtttgaaaaatgggattcttataatgatattaaagaagtcattgaagatattgtaaatgtattattctagagaaatagacgaaaaagaaacaataccatatcccatctgctctgtagtcgctgtacttaagatgctcatccgcatcttaaacacgctccgaagccgcatctgggatagagtattgtttctttttctgtgttttggctccggaagaaatgaatgcaatcgtctttgggaaagagatggggaaggggacagaaggttgtggcttattctgatgccattttctcaataaaaatccctgatagatatatcttccaagcaagaatagtctcctgacctctcccccttctctcaccaaagactatttcattcattccatgtgataccaacacacagaaaataaaaataatagaccattgcaaatataatgtgagagcaagtaaaaatgccgaacaggcattttctacacagtgatatctttatatttgcaatggtctattatttttattttcgtctgttccctaatgaattaaatagtaaaaatatttcatgttttgtagtataatactaatacactataatttaagaatatgaaatggggtgaaagatatgatgtatccatatatgacattagcagatgaaacagaaattgttcattctcaaatcattgaaaaagatggcatgaagaaagtaatagtaaattttgaacgtccaactgaaaatggctttgattctgcaagatgtgaattaccagattataaatggacagagagaataggctattccgatgaagaaatagagatgtttgaagaacttttacacagtaacgcacatttgttgtacaaatatgctgaaaatggagggattcaaattgcctaaactatttatggtaagtggatatagcgtatatttttggtctgatgaaaataacgaaccaattcatgttcatgtagctaaaggcaaaccaacacctaatgcaacaaaaatatggcttacaaaatcaggaggctgtattttagccagtaatggaagtaaaatttcaaataaagagctaaatgaattaatggaatttatatctgctcagttttttctcatttgtgctaaatggaaacaagcatttgtgacagaagatataaagttctactgctaaaattaaagtttttgctaccaaaacacagaaaataaaaatataagcccatagccaatgtaatgtgagagcaagtaaaaatgccgaacaggcattttctacgcagtgatatctttacattgactatgggcttatatttttattttcgtctgttccctcctaatgaattaaataatagtcttagaaagaaaatacgttaaattttgatgtttttgtcttgaattcaagactatctttttcgattctgtaagaatctaaatagcagtatgtttctcctgctttcgatgctgcactgtcatggaaacgtacatcactgtctactttaactgtcatattccaggatggttctgtgattcctctgcagctatagaatacatcaaagattactgttccgatttcttctctgttatctttaaacgaaaatgatggctctgccattccttctaatccgttcatgcggcacataccgatgaaatttaagatgttctttttgttagcttctgtgattggaatatatgtttttcccattttgcttttactcctgtccttctatatttttgttatatatctgtttatattttttcacattatttttgttttgtctatattaattcaagaatatcccggcataattactgatacttaataatcctcttttttatcttgtctatattgaaattaggacttctttttttcttggaactaattccttttatagccgaaaaaggctgcccgcctacgggaatctttccctcctggccctgtatggctgaggcgaaagcccgatttatgcggacaacctttcttatatacttaagttgattataactactataattaactatccatgatgtgagggcttattacttcaataaactttcaacaatctgtggatgtggacgtggaataattgaagtagatgttacttctccactgattcctaattttgcaagacatgcattaactgctgatcttacagaggatacttctcctgtgattactaagtatcctttaccgcctaaacctctggcaattcttaagtcaacgatgctgactttggaagcctttactgctgtatcggctgcaataattgctgttaaagcggaaattgtctcaattgcgccaactgcctggatctgctgagttggagttactccagcaatagctgggagaacttcttcacgaatattgtcaaggatatgtgtgtcgattaagtaaattccgcttacgagttcagctttgctcatagcagcttttacaggacctacatgtccgccaacaataattacatatttaccaggacaaattggtgtagacagtaataattctacattacctgctttaaccatttcatctgctgtctggataccaacaggaatgcttttaatttctacgaatccaactgcttttctcactgtgtaaacaccatcctttatttttcgattgagatacaaccgtcagcgattgctttgactgtaccgctgatactagcatgaatacaagcacctaatttaccttctgcaggctgagcgatcacatcgccttttgcaacggtatcaccaacacttacacatggaactgcaggtgcgccgatgtgctgtcctacaggaatagatacgtgatctatctctgttgttaattctgtcagaggagctggcacattatactgagtcagtccaagacgagcaattaacttcttaatagggaatcgtttgtactctctcattggatgtactgattctggctggttatgcaatgtactcttaataccctgttttgccatgatacctttcagttcatgatttaccttccaaggctggaggttcatgatacatgcatactggcaaagacgacactctgaacataagaatgcgatcattggtgtatcagaaccatcgcataagcttccgtagcttgcaaatctgatagtcttgtttggttcaattctatgtccgatcagatgacgaggacatacttctgaacacatactacagtgacaacatgcagcttttgccatatgaagcatcttaggtattggaagttttacatcctgaattaacggatggtcttccggtaatacgattaagccttttgttgtttttgtaatcttagaatctaacgcaacatgtttacccatcataggaccgccgttaattacgacatatggtccgtttacggtaactcctccagcgaggtctaatgcttcttttactgtcataccaagtggcagtttcaatgtaatgtgattctttacttcaccggcaaatgtcacataagaatctgtaactggtttatcttcaaagtaagcattgtaaatgttaagcatggtctctacattggaaacgataactccacactgtagaggaattccaccttctggtacaattcttcccgtaacttcgtatactgtaatctgttcatcaccagctggatagaagtttggaaggagatgaaggctgatgccttcatactctcccaagagctggttaaagctgttaattgctgcttcatagtgaccttttaaggcaattacacccttgtctgcacctactgcttccatgcagagctttaatgcatcaagaattttctttgtctcaacggccataagctgctgatcgactcttaataacggttcacattcagcaccattaatgatgacatattcagccttagcattcatttttacatgagtaggaaaacctgcaccaccggcaccaacgataccggattttgcaatgatatcaataaggtttttttccatttaactcacctcttaattatttcattctgatatggagaccgtcctgtaatacacatcttctcttacggcagaatgatttagcagatgttaaaccttcacctgtaggtccggcaattgtgaatgttgtatatcccattccgccaacaccgatacctgcataagatggaccattctttacgaaaatagttgtttcgatttcttttgccatctttgtaagtttatctacattcttagaatgcatcatagctgtatgtctgttaccatgttctacttctacagcgaagtcgatagcttcgtctacgttaggaacacgaacgataggaaggataggcatcattaactcgatctgtacgaatggatgatccttaggagcttccatgatgatacatttaacttctggtccaaccttgattccaactttatcaaggatgtactgtgcgctcttacctacgaagttaacagctggtttctttctgtcttttgttacgagatcaaccatcttttcgatgatttcaggatcttttacttcgtatgcgccattgttcttcatgttgaagattaagtagtcagcgatctgatctacagcgataacttctttctctgcgatacatggaaggttgttatcgaaagaacatccgttaacaatgtcttttgctgctttttcgatatcagctgtctcatctactactactggagggttaccagcaccagctccgatagctttcttacctgtggacataactgctttaacgattccaggaccacctgtagcaacaagcatacgaacctttggatggttcatcatgatgtttgtgttttcgatagatggttcttttacagttacgattaagtttctaggagcgcccagttcttctaatttagcgttcagtttcttaattaaccagatggaaacgccttttgaacgtggatgtgggctaaatactacagtgtttccaccagcgagcattgcgatggagttacagataactgtttctgtagggtttgttgtaggagcgatagcaccaattacaccgaatggacagtactcaactaatgtaagtccgtcatcacctgataaagcttctgttgttaaatcttcaacacctggggatttaactgctgctaaacggtttttgattactttatattcataagcacccattccactttcttctactgcgagcttactcatgtactcaaggttttcttttgtacaaacaacctctctgataccttcaacgtatctctgtctgtcagccatggaatggttcatatattctttctgtgcttttgcggaagcttcgattgcttcatccatagtatcaaagataccatatccatattcactttcgcaggagccagtctcaacatcgtttaaaacttttttaacgactttttcaattaattcaacatcgatattcattatgcttttcctccttgcattttttctaatgcgtatgtcgctactgccatatcctcttcagcggtaccaccacttactccgatagctccgattactttgccatctttcttgattgggtatccgcctccaaaacaaataattctgccatcaccagaattatgaagactccacaggctctcacctggtttcgtcacatcagcaagatcacatgtcggacactttaaagcgcaggcagtgtatgctttatcctgagacacctttgtactgatcaaaagggttccttccatgcgctggaagtataataagtttccaccttcatctactgcggaaaatgcaactggaacaccaatttcttttgccttttcttctatgaatccagccatctttttcaagctttccattgacatatccatgctgttttcttcctttctcatagatcctaaggtttcaactacctgtctcactgtgtcttttaattcttcgatctcctgatcttttgctcttgcctcttcgagacgagccattgcaaagcatgcatcggataaacgattgatatacttgcgtaactcctcacgaacaggaacctgttttgccagtgctgtcattattctctctgcacgtcttacaattgttcttgaaacatgtaaggctgcggaagaaggattaactccaggtactacgaattctcgcatcagcccgttcacttcggtggatttatcaatgatattttcgaggtatttgatatcagcttccccgatcttatctttgagcatttccattcctcttgcatcactggctaattcagcacctgcctggaacatcctcttctgaatatgattaatatattcttttatttccggtgaatcagtcagggtataggccactcccaaagaagagattgcttcatcgacagttccgtaagcatcaacgtttaaactgtctttgtcaactctggaaccaccatacagacctgttgttcctttatcacctgtttttgtataaatatttgacattattcacacccttaacactgtgatatttctacggtatcgacaatgccgacaatcgcagcatctactggcaggtcagtctttttaccatctgacatacgtgcggagcttccgcctacgacaattacggtttcaccatcgccggctccaacagtatcaacagcaatttctgtctgtttctttgctgtaagatcctgattgatcttttcaacgataagaaacttactgccggtcaggcttggagccttaacagtagaaactactgtaccaatcactttacctaaatacatgtcttcacctacttactcttttacaatcgtaattccgcgatttaaagcttcgtcttttgcaagaccggtaactaatgcatcctgtcttacaacgattgttttaaatctcgcattctttgctatatcgactctgccgattacttttttatcaagttttacactgccggatgctcccgcttttttaacaggctggcttactgactgtactgccggctccatctttgcggaaacgattctctctttttttggtgccggcttactgttatccagtgccggaagagaaatctttgcagagaaaacttcatttactttactgcacagactatagtctgtagtcaatgtgattccgtatgcgagcatatcttcaagattatgccgcattttcgctttataagcttctgttactttaaagcctaactgctctcttaccttgttatccggacaacagccatcaatcgctgccacgattggctttcctgtagccatcgctctggaaatcatattggtaagaagattatcactgatacaatttgcaacctttgcggctgtattaattgtcagggacggaataattacaaactgactgtcgtctacaatctgtctgccgttaaccggagcgccctcaacataaatggcatccggatcaatgtcatttttgatacgttcttctgtaattacttctcctgctgcctttgacagtactgctgtcaatgtccagccgtcttttttcagttcatttaaggatgttactgcatccttatatccgatcaaagctccggagaaaagaacagttgccttcttacaggcctgtgcgtatcgtaagatgacctgatctgaaatgtattccacaatggttgacataagcgcttcttcaaattcttttctattcattatgccacctattgcttattgcagttcatggcaattcctaatggagtaaccagtaaaggttctttcggcttaatcgtcttaacccctgtttccttctcaaaaacactctcgaactttttaaagctgcaggcaccgcctactacataaataacgtccacatcgtatccctggataaaacgggcaacgattgctgccatcttttcaattaccggtttaaccacaggaaataccagcatttcctgtttcggatcttttttgattctctcggcctcttcaaaggagcatccaagacttccagcaagaaccagagtcatgtgtgttccacctgtaggctcatctgctgtaaagataacctctccatctttgagaatgctgataccggtcgttccaccaccgacatccactactgctccgtttgtaataccaagaacagaggcggcggcagttggttcatcaacaacattgattacatccagtccaacagattcaactacattagaaattacctttacgtttccagaaataattcccggcggaacagctgtggcagcttcgtaaaactccactcccatcaggtcttccagcttggctttcatatttctgaccgctctggatgcacccatgaaatccacaacgattccatcccgtacaaccgtggacggataggaggccccggcaattggtgtgttattggagtctacaacagatactacaatgttggcggttccaagatcaacacccaatctcaaatccccttcatagggacgaaattcttcatttttgataagctccgaaaatccaactaaaacgttattgtaatcgttcatgtgatccccttattcattctaatgttcgaataccgaatcattattgtcaggattgcatgtgtctgtctcggtatccacatgcatccattgcgcatatttgtatgtacaaaaagtacgttattattgatactatggcaggaaaggcgggaagccttcccttgcctgatttctaaattgataatccagagccgattattccgatttatttgttatcgttattatcggtgttcttttttcttctggatctgcttcttctatttcctgttgaagtctttcctttagaagtttctgcttttttatcagaatctttcttcgtttcagtctcttcaggtgctgcttcctctgtttccggtttctctactggagtctcttctgccggagcttctggtgcaggttcttctgccttcggctcttctacaggagcttcttccactggagcttcttctacaggaggttcctctgcaggttcttctgcttttggttcctctacaggagcttcctctttgacctcttccgtttcaggttcttctgatgtcggctcttcttcggattcttccactacaggcggttcaggtgcttcctcggttactacctcaacctctggttctgtttttggtttccagttctttacgagtaccggtttctttgtatctccttttggacgataaccttctgcaagagcgatttctcctccaacagtttctctgttgtctacgagtaattctctcatgccgtctgccggtcttgcttttaacagtgtgctctttgttccacttaaagaaccgttaactgcttctgccgcttttttgcctgctgcgattgctgctctacatgctccgacgttaccttctacctttacagtacacattccgccgccctttgcatattcatatccaagcagttttacgttagcagacttcactgctgcatctgctgctgccacacaggcagctaaaccaaaggtttcgatgaaaccaagacatttattgttagacaccttcacacctcctcacatttcagaattaattaattgtaaagccttaatccagaactttgaatggcattttctttaccagtcttgccgcattcgcgccaatcttccggaacagctctgtctgatataacttaatcttaaaaagaggggccgctttatccagcttctcatgctgaagaacaacgccttctttgctgataccaacgcccacccctaatcttgaattcaagctggcattatgtgcaagttctaatacggaactgcaatgctctgcctgaacatcataggggatgccttcctcctcgattccaagaaggacgctgacaaaatcagcttcagaaaggtgatcacagtcataaaaaactttcactgaaggtctgttatcaattactgtattgcttccttccataattgtctcctatacatcagcacaagacatcgcaagtcctgttgctaccgcattacgagggccttcgcatccgcgaatgtttccccgaccagctactatattatattgtgataatgcatcagttacgagagtcggcacctcgaagtcgagtgcagaaccacctactaatactacaaattcgatatcacgaacattaccggtaggactaaccttcgccaatgaacgaatcgcatttgttacgaatacctttttctttgcattggttcttaccatcttaatcttttccatggaatcctgtccctcaagcggaactaactctccatcttccttgactaagacaacctttgcgaatacattcggatctaatggctgttcaaagaactgtacggttccatcttcatgacgaatatggaaaagactttcaacctttgcgagagaatactttttaatatcttctgctgtattgaaatcttccagtccaagttcggactgaatcagtaaagttaccatgtttccggcccccgccagatgcacgagctttacattgccgtctctgtctttaattgaagcatccgttgatcctgctcccatatctactatggcgagtggtacatttgtacccggtgtagttaaagctcctttaatagccatatctgcctcaacaccgccaacatatacagggatttttaatcggtctgtcaattcttccgcgatcatcttcatctgaagacggtctgccttaaccatggcagcaattcctactgcactttctaaagaaaattcatttgcgagaccacctttaatcttctgaggattataagtatctacagcaagtaaatcctgaattttgatatcttttggatgctggtttgtaagatttgacataacctgacgaactttttcaagcataccgccggcattggtgccaggttcacctttaatatcttcgatgactggaacgctatttacagcttccatcatcttctcggctccctcttctacgccaacgattacttttttctttgcgcctataatctcaatagaaccggcagggatacgtctttcttttacgtctccttccggtgttttaatgacaacggcagaacgatttccgattaacgcgcgggcaatcggtacaacctgttttgtatcttccggagacagtttgaataatgttgcgataccatatgggttagagagtacttcgacaactccgccaacaggtgcaacttctactgcacataacattccgagaggtactttatcaatcatacctacctcatcaacgataggaatcttcttttcaagcctgttgttaatcaaaacgccatcatcgcgctggacaatggcacctgtaatgttaaatattttgttatatcggttaatgagtgcagcggcagcttcaaaggaaacttctgccggaataaccacaattacatctccgccatctttgacagtatctaatctgtcgatgcgctgagatattccaacaccaatcccaacaccccctggagtattgggattgtgtccaatcatagtagattccgtgataatagtttcggtaatagtctccatagcgacatcaccgataacgggagcggcttcattaatacgaacttcatcaagatcactgatttcaaaaccaacttcatcaagggcattcttcagtgactgaaaaactccgtgtatgttctgtttcgttcctttaattccagtagtacctgtaataccactcgaaaggaatgtcacatttttaccatcgattctggcaatcgcagtttccgttgttgcattgccaatatcaacgcccgcaactaatttcacttctcatacctccgtcgaaatcaatcaactaattatttttttaaacggttacgtttttcgtaaatgtctgcagcttctttaacgaagttaccacttactgtagcaccgtattcgttgattaactcatcaccgattgcatataattcagcttttgttgaacgatatggtctaagagcgttataaatctcaagaagtcttgcatcaggtactgggattaattcaccagctcttcttaagttcgttgcgaagaatccacgtcctgcagattcagcaacctgagcctgtaattccagagtttcttttgtgatacggaaatcttttgcatctaactttccatcaataactccctgtaaagttaaatcatttaaagattttccagaagcactcttgattaattctggttttttctctcccagtgggtaatcctcaaccgtaaccttgctttcacattcgcaggctgcggcagaaccctgcatgtttttcataacttcctgcataatctgtcttactaataattcctgatccacgattgacacctccgtctatttaaatacaactttaagagctttaggagccttatctctgtctgcatgctctgtctctttgatatgcagtacagcggataaagcctggaatttcggtcttgccatctggtcattctttacaggtaccggatttggtgattctcctttagcgtactgagcagcgtttttaccgattgctctgtatgtttcaaggtcgatcagtgggcactgtgggaataactctaagttagacagcggtggaaggtctttctgatggattacagtagtacctttggactgaattccaattccgatgcctgaacctgataattcagcagcatcatgagcgatgaaagatacatcggatgttctgtaaactttaacgattctacaggaaacaccttcttcttccagaccagccataacctcttttacaatatctgcatgaggaatacctacgatatttgttgtctgagattctccaaaagcaggagctaaacctaaaacaacttcgttaggatttgtgcctttttctgcatcaccgatttcagtaatctgcattccagggcactcataagtttctccctctacagcagaagctgcggaagtatctgcagtattcatttctttaagaacttcagcgataacactttttaataatttttcatcaattgccattatggttcaccttccttactcgattaaagcttagccggatctactgcagtacggatatcagaaatcttctcccaaagttctgggctgatctggtaacctgtcataggtccttcatagcagttagggctgttaacagcagaaattacatggaatttatcatcaagcatggaagctgtatgtaagtagtcaccaacaactttagctttctgaatgttgaagatagactcagcaacgtcttcaaatccacccttgtaaagagctttaacgaagtcgatacctgtaactccacgatcaagcatatctgtagcagctttaaggtcagctacaacgtcacggtcaggcatatcctgtgaaccacgagcgtatgtggcagcttcaacttcttcgtctgtaatttcaggtaaacctaattcacggaacagtgcctgaatagcttttgcagctttattacgtgctgcaacaacttcttcttcccttgcaggaagaagaccagcatcaactcttaagtcacgctgaattacgcaccaatcatcataatcgtctgcatcccagttggatcctgcgaacatgttatcatagttcggtgtggatgaatatccggaacagatgtagtcagttcctggaataaactgtggaatagaacgagcaactctacgaagatcagagtgtgtaaatgactggtcattagaggaagcgttctcaaggtcaagcatagcggcaattaagttctcacatgcaacggcgcggataccaccaggtacagcggcaggtacaccgatacaggatacagaaccattctgtgttccctgaacaccagcaccacgagtaacaccgaggcatctagcctcaaggtaaagcatagactttccttctgccatacccatctgaacctctgaaccagtaccagatgtaaatctcatcttaacaccacgagatgcgtagcaggatgctaagaaagcttttgaccaaggagtatcatcaccatccatgaatacgtcttcagttccgtatacggatactgtctcggcgtaagcggtgtaacctctcatacctaagtcaagctctgtagcttcttctacagcacactgtgtaaggataccaggacgtccaacgttagcacctaacataatagcgatagcattaaatggagcataacgtacaatacctactgttgtctccatctctgcaaatccacgtacagcagcttctgctgcatctgctgcgatctgaaccatgttatcctttacgtttgtaacgtggcactggttagctggttttaaacgacatctcatcttggtaatacccatcatagcttcaagtacgctgaggttaccaacgatttctactaacttagcaggtgtaactgctgtagtatattttaagcactcctgtctgttaacattaatgtcaactaacatacgcgcaatctccagagagtctgtagccattgcttcttctgcaaagtcaagattaatggcatatcttgcgatgaatgcgtcaagcatgtcgaattcatcttttgtttttccatccatttcaacaacttcgccgttgacgatcttgatagatggagttgggtcgaatgggctgttcatggcaataaagcctacttctggccattcctttgcataaccatcctgattaacaggtctttgatctaaatactcaaaacgtttacttctcacggtctcaacacctctcaaattccaattagactatcttttaccttcaatatatatattcaaaataaaagtattacaatatccaactgcaggctctcacccccgctttgtggatatctcatgcattattccttatgcggctctcaccccgtataaagaagctttaaaaatcagagcgtttcttagatatatggaacagtaccagattccagtggctcacttggctctaaagctttgagtaactgtttaccaacttctcttgcaccaatgatagcctgtctaactgctcctgaatctcctgtgaagaagaagttaacctcgttagagaaggatgttccaccattacctggtgtagcgatagcgataggatcgatagtagctgtcttagaagctgtatcggctaatacgataccaatacctgaaggagctcctacagtgataccaaatgctttaccaacaactgcgccaaatgctttctctaagcagtaagaagcacgtgctgtgtactggaactcaagatgtccagcggagtttccgtatacatcaccgaagtgtttgccaacgaagcttaatgcaacttctacagctcttcttgcatcagaaacatcttctgcaccgaatacgattaagcatccatgtccagcgccgccttctgtatcacgagggcactcgatcatgcaaacttctgtgtttgtagctttaacagcttcatctgctgcgaagatctgaggacctgcaccagtacgatctgcaaggataccgattgaacgatatttagggtcgatctttaataattcatgaacactgtagtcaaggttagcgattactaaaccgattgtgtgtcccatagctgttccaacatactctgttaaaccgcaaaggtcttcattgattccctgaggagcttcgcaagccatactctgagcaggagcatctgtgccacccatttttttcataacttcgtccatgattttagccatcatttcatctttcattgaattatacctccattaataattgatcagacaaggactaactctattgtggtaagatcttttctacgtctgtatgtggtcttgggattacgtggctggaaactactgtaccaactttatctgcagcaactgtacctgcgtctacagatgctttaacagctcctacgtcacctcttaccataactgtaactaaaccggaaccgattttttcgtatcctactaatgttacgtttgctgatttaaccatggcatcggctgcttcaattgcgccaactaaacctttggtttcaatcattcctaaagcttctttctgcataattgacctccttataaaattcttatctgccccgtggttgattgttctggcagactttattttggttgatttacaggatagtatcattatatagcacttttcacaaaattacttggctagtgcctataatttttagtttttaaacacataaaaactcatgcatttatttatattcatgatactttgttgccatattcaccacagagcagcaaatgattctgtatacaaacgctactattttgcaatatgatcaagaattttattaatatcttctgctgtaacctttctagggttagcctgtgtacatgcatcagccaatgcacgacgcacaatttcttctctgtgtttattaaattcttctacactgacgccacattcagacatacactgtggacgatccatatattttaacagacgctggatctctgcaatcagattagccacaccaactttaggcgtaggagctggcaggccaacgattcttgccatcttctgatacttctttgctgcgtcattactatgttttgcaccttctcttgccatatcagcattaaactcaataacataaggaagcactaacgcattggctcttccatgtggaatgtggaagattgctcctaaagcatgagcgataccatggtttacaccaaggtttacaaggttaaatgccatacctgcaaggcaggatgctctgtgcattttatctctcgccttaatatcataaccattgcggtaagcacgtggaaggaattcaaaagcaagctctgcagctttttctgccagacagtcagaacaatcgcttgctgtctctgaaacataagcttcaagagcatgggtaataacatccattcctgtatccgctgtaataaacggaggtgctgacttaacaagttccggatcaaggatagcaatatctggcataagactctcatcaatcaatggaatcttaacccctgtcttactgtctgttacaacagcaaactgtgtaacttcggaacctgtaccacttgttgtcggcaaggcaatcagtttgatcttcttctgattatcaggattctgcttttcgtcaatcttcttagccatatatacaatggccttcgccgcgtcaatggaagaacctcctccaagagcaactacgacatcacagtccttatcctgcaaaaatgcgatacccctttcaatcagatccattggtggatcagggacaacttcactgaaaacggaaacctctttacaattagacagcttctttaagattatgtctgccatacctgaatctaccataaacttatcagtgatcaggaccgcattctcatctttttcttcaagaagtgcgtctatggcgtcttcactgaataaaacttcagtggaaagtttaaaccgtttcattttcctcctcctttctgtttctgtacttttctctatactcagacggcgttaatccggtcttcttcttgaaggccttactgaagtaattcgcttcattatacgccagatccaaggcaatattaagcaccggaatatctgtgttaaccagcatttcttttgccaggtccatcttccggtctgtgacataggtgataaagttcacacccatctcttttttgaatatcttacttaaataataagtactgatattcacatggtttgcaacatcctcaaggctgattcccttcttgagatttctctctatgtaatcgataaccgccttcatgcccccttctgagagcttacccttgatattcatcttatcaaagagaatgtctaccatcttgataatttcattataggcatcatgtttattattataaagaagatacttaatcttaagcttctccatctgaactacaagttcattcgtatcaacgattccaagttcctcactgatacgcacgattgtcttagcaacctcctgcagtctctttgatataatattaacatcatgctcctctaagtataactggtctatgtactctcttaaaatgtctacagaagctttataagagcatttttttaattccatttcgaactttgaaagcaatttattactcttgccggtctgtcgtccctctcctaaacggcttgcaaatgacttcacagactcaagtaaaacctcttttctgataggtttgagcaggaaatcatcaaccttcaactttattgctctgtgtgcaatattaaaatcatcatatgccgttgttataataataacagcctttggaagttttttccttgcatatttaattacttccataccatccattccaggtatattaatatctaccagtaggagattgatatcttttgaatcaatcatctctactgcttcaaaaccactcttcgcttctccgacaatctctacatctaataaattctcctccagaaaaatcttcatggaggttctttctaattcttcatcctctacaattaatatcttatacaaggtttctctgcctttctatttctgttatttctactatttctattatttttactacccctgctatttctgctattattccgtaatcccgttgtttcgctgcttcattttctttattcctgtaccaacggcacctttattgttaccttcattcccatagaaggtttattctcactttcaattacaagcgcatattcatttccaaagtaatgaagcaatctggaattaatattataaagtccaacagatcctttttcattatctttataggcatctccacgtaaaacactgacaatctttgaaggtgacattccatctccattatcaataatatcaatgcataaatccccatcttcttctcttccattcacttcgatcatcccaccggaagccttattctctacagcatacttgattgaattctctaccagagtggtcagggaaagaaacggaagcttcacactgtaatatgcttctgatatattaattgaatactgcagccggcttcccagtctgatcttctgaatcttaagataattctgcacatgtgtcagctcatctcgaagtgagcttaacgggtctctgctctttcttaaaatgtaacgcatcatatctgcaaatgcatatacgacatcttctgtcatctttgcattttcaaaaaaagcaagtcttcctatcgtgttcagtacattaaaaagaaaatgcggattaatctgataatgcagtgcttttaactcgatatctcgaagagacttctccatctctatacgaagcttctcttctttcatgagcttataatccttttcacgaagttctgcatctaccttattcgcatattctctctctacagaataattatagctatcacagataatctgtgccacagcctgaatcttctctacagatacctctttcacctgattgtagagttcaaccagttcctgattatccttccaatcctcgctctgtgtcgtaatcttctttaaatctgcaaaatctgtgctggtaacctgtccggcaaggaaagctcccacatactgtccttttatcataataggaattgcaaaatcaatcagtcctgcatggcatatatatacatatgctttgccaatccttcttgctttccgtcctccacaggcatcacaatagtaacacttttcacgaaatgcatccagctcacgaagccttttacaaaaaggtgtaaaattactctgctttgtaatcggtgttccgttacagtctaccgttacaaaagccaggtctgtcgcttttgcccagttatcctgcagagtttgaagttcttttacatctactacgtcctcaatatagatattattcttttccgtcaatgctttgtcctccaaacatcagtataatccaacctaactggtcagaaatcaatgtttcttcttctttctatccttctttgtcagataacgacaggccttctctgcgcagttacatgcatcctccgtataacagtctgctccaatttctttcgcctgtttctctgtaaggaaataaccgcccaccataaagtaaaactgattccgaatacctttcatctcaaactcttcaacaacagctctcatatcctcttcagaatgaggcataatgccgcttaaacatacaatctgagcatgacttcccactgcctcctcaagaaatcttcttggtgaaacatccacgcccagatcaatcactcttatattcttactctccatcataatctttacaagattctttccgatgtcatgtaaatccccttttactgttcctattataacggttccaatttcttttttggcacgtcccacactataatgccgcagagtagaaacacctctgtccagtgccctggtaacgctcaaaatctccggtactccgacctcttcttttcgaaacttctctgccacttgttccattccggacaaaaaaccttcctccagaatcgtttgcggatttgttccttcttctaatgccatttttaccagatctgagactctttttccctgtccccttttcagggaatcaataatttcatctattgttgctcccatcttgccctccaaaaatctatcagagtgttccatggctttattttatactttttacacctaaaaagcaaattattatcgtattttttgcaaaatacttttttaaaatataaaatttaactaatttattctagtaatcgataaaattttttattcaaacaggcaataaaaacggtaaaaaaaggaatcagggaaattttaggcaaaaaaagaaccccaagaaagaaaaaatcccaatatttgtaatcttaggatattttctttcttagggttcgtctgtttatttaataaattacagtgtcactttttcaagatgccacatctcttttgcgtactcttcgatcgtacggtcagaggagaacttacctgcggatgctgtctggagcattgctgttctagcccagtgctgttcatcgcggtaagcggcgtcgattctgttatgagcttctttgtaagaatcgaagtctaacagtgtgaagtaagtgtctttctcaaggagtgcgtcgtaaagtgctctgaacagttctgggttctctggtgagtaaaatccatttactaactgtgtaagtacctgacgaacgtcctggttgttgttgtatacatctcttggattgtagtttccgtttttctcatattccattacctgctctgcagataaaccgaagataaatgcgttatctttaccaacttcttctacaatctcaacgttagctccatccattgttcctaatgtgagagcaccgtttaacatgaatttcatgttacctgttcctgatgcttccttagaagctgtggaaatctgttcgctgacatcggctgctgcaaagataagctctgcattagatacgcggtaatcttcaatgaatacaactttgatctttccgttgatggatggatcattattaatcttgtctgctactgcattaatcaacttgatcgtaagctttgctgtgtagtaaccggctgctgcttttgctccaaagataaatgttcttggaacaatatccatatccggatgtgcttttaattcgttataaagatacattacatgaaggatgttcattaactgacgtttgtattcatgtaatctcttaacctgacagtcaaagatggaacgtgggtctacatcgattccgttatgttctttgatgtacttcgcaagacgtactttattctggtatttgatgttcatgaattcctgctggcacttttcatcatctacatatacttttaaatgtttaagatgatctaagttagtgatccagtcatcaccaatcttatctgttacccagcttgccagtaatgggttaccatgaagaaggaatcttctctgtgtaataccatttgtcttgttgttgaacttctcaggcatcatctcatagaaatctcttaactcacgtttcttaagaatttctgtatgaagacgggcaacaccgtttacggaataacttcctgcgattgcaaggtgagccattcttacctgtccatcatagaggattgccatcttgcggatcttctcctgatctccaggatatttgttctggatttcaattacgaagcggcggttaatctcttctacgatctggtaaactcgtggaagtaatcttgagaaaagctcaataggccacttttcaagagcttctgccatgatggtatggtttgtataagcacaagtctttcttgtaacttcccatgcctcatcccactctaaaccttcttcgtcaacgagaattctcattaactctgctactgctacagtaggatgtgtatcattcagctggaatgttactttctcgtggaacttacggatatcgtcatgtgtctgtttatactttgcaactgcgcgctgaacagatgcagaaatgaagaaatactgctgtttcagacgaagttctttacctgccatatgattatcgtttggatataatacttcgcagattgttcttgcaagattctcctgctcaactgctttttcgtattcacccttatcgaaagaatctaagttaaagttattgattgcttctgcatcccagatacgaagtgtgtttacgatatggttgccataacctacgattggcatatcatatggtacggcacgtacactctgatatcccttctgaacgaacttctgtcttccattatgcatctcaacatctacataaccgccaaacttaacttctacagcatactcatctctcttgatttcaaaaggatttccgtatttaagccagttatccggtacttctacctgatagccgttctcaatcttttgtttgaacataccgtaacggtaacggattccacatccgtaagccgggtatccaagtgtagcaagagagtcaaggaaacaggctgctaaacgtccaagaccaccattaccaagagctgcatccggctcctgatcttcaataaggttcatgtcaagtcctaattcctctaatgtttctcttacttcatcatagcaaagaaggttaatcatgttgtttccaagagctcttcccataaggaactccatggacatgtagtaaaccattttcttgtcctgtttttcgtatgctttgtgtgtctcgatccagttgtcaataatgtcgtcttttactgagtaggcaacagcctgataaatctgctgtgttgttgcctcgtcaagattacgacgaaacagcatacggacattggactctaattcttttttgaacttttctttgtcgaaagtatcctttttaatcaatgaactgatcctcctaaattatctcgtgcaatcctgaaatctttttcgtgcctgctttcgctgaccagaatcacgcgccaagtctcgcgactgctcgacttgaacagtcagcctcagattttgagacgcacgtagtacatacgccgcaaaatctgagtgccgctggtcaaaaaccgatcgctaaaaacaagtgtttaaaaggttttaagattacatttttttctcgacacctaatcttactttttctccattaatatcccattccttggaatatccaccttccgtgtctacacgcatatcgtctgccaatacatcattcttaatctcatcagcatatttggtcatgatttctttaatcttatcatttccatcttcgtatacagtaatgtggtctgtcacttcaaagccggcttcttttctcattgtctgtactttactgatgatttctcttacaaatccctcttccaaaagtgccggtgtcagattcgtgtcgagtactacagtaactccatgatctgtctgtgaaacatatccttctttctgtgacatatcaattaataactcttccggcaataacttgattttatcatcgtttaactctattgtcaaaaagccatttgcgtctaattctttcttagccgcacttccgttaaggtttgctaaaatattacgaatctttcctaaatctttgccgtattttggtccaagaatacgcatctgtggcttaaatgtatagtcggtaagatctgatacatcttctttgaagataacatcttttacattaagctcaccttcgataatctgtttgtagtagtctgttaaagcggcttcgccatttacaaacatctgtccgattggctgacgattcttaattcctgaggcgttacgtgctgcacgtccaagaacaacgatgtcaagaacctcacccatatctctctcaagtttttcatcgatcatcgcttcatctacagcagggaagtcacataaatgaatactttccggtgcatctggatttatgctctttacgagattctggtaaatatcttctgtcataaatggaatcattggtgcagatgctttaataaacgtaacaagtgctgtatacagagtcatgtaagcattaatcttatcctgctccattccttttgcccagaaacgctgacgagaacgacgtacataccagttactcatgtcatcaacaaatgcctgtaatgcctttgttgtttccggaatcttgtagtttgcaagacactcatccactgtttttacgcaggaattcagtcttgataataaccatttatccataacagataatttatcgtactctaagctgtactttgtagggtcaaattcatcgatattggcataaagtacatagaatgcatacgtattccataaagtacccatgaatttacgctgtccctctgttaccgcatctgcgtggaaacggtttggcagccaaggtgcactgtttgagtagaagtaccagcggatcgcatctgctccatgctgctctaatgcatcaaacggatctacggcatttcctttactcttactcatcttctgtccattttcatcctgtacgtggccaagaacgattacattcttatatggagccttgttaaataacagtgtggactctgcaagtaaggaatagaaccatcctcttgtctggtctactgcctcagaaatgaactgtgcagggaactgctgctcaaaaagttctttattttcaaatggataatggtgctgtgcaaaaggcattgctcctgagtcaaaccagcagtcgataacttctggtactctcttcattagcttgccacaatcaggacaagtcagagtaatcgcatcaatatatggtctgtgaagctctactgtacgtgcttctggatttccgctcttttcttctaattcctggcggcttccgatgcactccatctttccacagccttcacactgccatacgtttaatggtgttccccagtaacggttacgggaaataccccagtcctgaatattatttaaccagtcaccaaatctaccttcaccgatgctctttggaatccagttgatcgtattattattacggatcaggtcatcttttactgctgtcatcttgatgaaccaggattctcttgcgtagtagatcagtggtgtatcacatctccagcagaaaggataatcatgttcaaacttaggcgcatcgaaaagaaggccttctttatctaagtcaacaagaaccttcggatcggcatcttttacaaataatccggcataaggtgtatcttctgtcatgttaccttttccgtctacaaactgaacaaatggaaggtcgtactttcttccaacctgtgcatcgtcctcaccaaatgcaggagcgatgtgtacaatacctgtaccatctgacatagttacataatctgcacatgttacaaaatgtgctttcttatgctgtttttccgccgcctttgcagcaccttcaaataatggcttatattctttatattcaaggtcggtacccttatacgtttcaaggatctcataagctggtgtttcttctgttccaagtcctccaagaaccttatccagtaattcttttgccatgtaataaacatagccgtctgcagcctttactttacagtaagtctcttcagggtttacacaaagagccacgttacttggaagtgtccaaggagttgttgtccatgcaaggaaataggcatcctcaccaacaactttaaaacgaacaactgcggaacgttcctttacagccttatatccctgtgctacttcgtgagaagataaaggtgttccacaacgagggcagtaaggtacgatcttaaatcctttataaagaagacctttatcccagattgtctttaaagcccaccactcagactcaataaagtcatcgttgtatgttacgtatggattatccatatcagcccagaaaccaactgtctttgaaaaatcttcccacattcctttgtacttccaaacagattccttacactggcggataaatgggtctaaaccatactcttcgatctgttcctttccgtcaagaccaagaagcttctctacttcaagctctacaggaagtccatgggtatcccatccggcctttcttggaaccatatatcccttcattgtacggtaacgaggaatcatatccttaataacacgagttaaaacatgtccgatatgaggcttaccattcgctgttggcggtccatcatagaaagtgtaaacagggtcaccttctcttgtttcgatacttttcttaaaaatatcatgatctttccaaaactgtgcagtttctttttctctctctacaaaattgagattcgtggatactttcttatacacgatacgtcctccttaatttagtcattttaatttaactatttttagattaaataaatttatattattatgccctatgtgcagaccagactttccagcaaaaaagaaaagctcccatccccagtaaaaggatgaaagcctgaactatcattataccacctgtacatactgacatatgcttctctgctaacggtgagattccgtcactgcttactgtaactcttcagcagtgcaactcaggagtgatgttcagatattctctactgacaacgggttcccactatctccgtctcactgaagcgttcgcgaattcttactgtctccatcaacgtttttatcacagataatcatatactaggcagaataaattgtcaacaaattttctttcattttacattatattatgctacaatactccttaattagaaaggagttcctatgtttaaaaaactgattgtatcttttctttgtgcgattgttgttgcatgcactgtccttggcggattttgcctgctgtatttttccattccaagccagaaggcaaaggcatctatttccctgccttctactgtagaagatagcgagaatgcagcggaatctactacagaagatactgattctgagaataagaatgtttatgtggctgatgtataccagtctctcactcttcgttccgaagctagtgcagactctgatgcaattactgatcttgaaccgatgacacatcttgaagttcttgaatttactgccggcacgaattatgcatatgttgaagtcttaagcggagaaaaaaagagctacaaaggctatgtaaacagcgattatattactaaattaggagaaccaaccgttcgtattggaacagaggagtaagaattatgttttctaacaatttaactatgatgaccgacctgtatgagctcactatgatgcagggatatttttttgaaggcaacaatgataccgttgtctttgatgttttttatcgtaaaaatccatccggcagcgcctatgccattgcctgcggactcgatcaggtaattgattatataaagaatctgtcattttcttatgaagatattgattatttaagaggactcggcatttttaaagaagattttctttcctatcttgccggttttcattttagcggagatatttacgcaatccctgaaggaagcgttgtatttcctaaagaaccgcttgtcaaagttatcgctcctatcatggaagcacagcttgtcgaaaccgctattttaaatattatcaaccaccagagtctcatcgcaacaaaggcttctcgtgttgactatgctgctggcggcggtgtcatggaatttggtcttcgtcgtgcacaaggaccagatgccggaacactcggtgcaagagctgccgttatcggtggatgtaccggaacttctaacgtacttgccggagaactttacggcattcctgtacagggaacacatgcacacagctggatcatgagcttcccggatgaacttactgccttccgcacttacgcaaagatgtatccggatgcctgcatccttttagtagacacttacgacaccttaaagtccggtgttccacacgcgattgaagtatttaaagagatgcgtgatgccggaatcacatctaaactcatgggaatccgtttagacagcggcgatatcgcctatctgtccaaaaaggcccgcaaaatgttagatgatgcaggatttacaaatgcgatcatttccgcttccagcgaccttgacgaatacctgatcaacagtttaaaaacacagggctgtacggtaacttcatggggtgtcggtaccaaccttatcacttcatcagataacccggcctttggtggtgtatacaaacttgccgctattaaaaagcctggtgacaaagaattcaccgccaagatcaagatttccgaaaatccggaaaagatcacaaacccaggcaacaaaacaatctatcgtatttatgataaagaaagcagtaagattaaagctgacttaatctgcctcgtcggtgaaacatttgacccttcagaagatttgaagatttttgatccaatctccacttggaaaaagtccattcttccagccggcagctatcaaatccacgaaatgctcgttccaatattcttaaacggacagtgcgtctactcctctcctgctgttatggacatcaaagcatactgccagcaggaattgaatacactgtgggatgagaacagaagactgatgaatcctcagaccgtatatgtggatctttcacagaaactgttcgatctgaaacacaagttattaggagacgaaaaataaatacgaatttgtaaatttcgtatagacgaaaaaagaaatactggcatatcccatctgctctatagtcgctgtgtttaaaatgctcgttcgcatcttaaacacgctccgaagccgcatctgggatatgccagtatttcttttttctgactatctaaatctacggtttaacaacatggaatgtgccagaaggctatggtcttccggagaattaaattctaaaggattgacattcaaattgttatctttccaatataaatcactaatttgttatttattattaaacagccagccgctgaaataaaattttatgctgaattgtaagaagactatgataaagaaaaaaagaattgttataagtattgcattttgtgactttgcgttgtgcaattttgactctgaaaacttcggattcgtttttccgaagtactaatttgtagattttgtatagacgaaaaaggggattctccaaaagtgggtatatttttgtcgatcataataagaacaattgttaatatctatgagacgagaaattgtattggcaatgaaagaccagaaaacatgactcccacaattgaaaaatttatagaatatttaaaatataaggaaagggtccctgctatataattaatagtcaaaaaagaaaaaacattgtataataaatatatcttaggggaggtaagtttattaactaaaaaatatagcacatggaggaggattacatatgacgggctacaaaaaaattaatatggagacctgggcacgcagggaacattacgaatactatactaaacaattaaaagttgaatacaatattaccgctaatgttgatgtaaaaaatgtattggatttttgtcattcaaaaggttacaaattttaccctgctatgatttatcttgttactaagacattaaaccgcattgagaattttaaaatgtttaaagataaatatggatatctttgcgcctgggacaaaatcattccgaattataccatttttcataatgatgaccatactttttctgattgctggacagatttttccgaagattttgatacattttatcaagatatcctaaaagatatggctactgccgcaacgaaaaaaggaattaaagcaaaagaaggacaacctgctaatttttactgtatatcctgcacgccatggacaacatttaccggttatggcagcagagtctctaatggcgaaccttcttttttcccaattgtattgatgggaaagtatacgcagcatggcaaaaaagtgttgatgcctgttaatatcacaattgctcatgcggtagcagatggatatcatgtgggattattctttcaatatctccaggaagaaattaataactactaatttgctggggacacagacgccgctttagtagaatatattgagctgaattgtagttagccttttaaagaaaaaagaatggttataagtttgattttgttccgttgcgctaagcattccattctgcccagaaaaacaggaacttgggaaaaacgagtcccaagttcctatggtcagaattccatagcgcaaagtcacaaaatacaatacctataaccattcttttttctttatcatagtcttcttacaattccgcataaagttttgtttcagcgactgtctgtttttaataacaaatagcaaattagtgatttctgttggaaagagaaggagattcttcagaagattatgagagttaatcagagaaaaattctccatgaggtaggaataagtaaatgtaatttttatacagtcgagtaagaaactatccctttctggagatgttgattctaatgaaaaccatagccttctgggcaatccccttattcccatccaagatttaaatactaatttccatctggagccaaaaagcagaaaaccagaaatttaggatagaagaaaatatgatgtcggagccagtaaaaatgccggtcagtcattttctacgccgcgactatcttcacattttcttctatatcaaatttttggttttcgtttctttagtccctcaaattaattatttaatcccccattctcaccaactgtagatttagaatagccagaaaaaagaaaaaaagaatacatcccagatgcggcttcggagcgtgtttaagatgcgaacgagcatcttaaatacagcgactacagagcagatgggatgtattctttttttcttttttcgtctacacgaaatgtacaaatcagtagttatagttttagtacatggaagagtactgctgttaacacaacgattgcatttgtaactgtctgaatcggtactgctttcttacagtagtgctgtacatctgtttctgttaatgcacatccagtgtaagtggaagagttcgttggtgtagaacttgttgcgagtgacaggttacatacaaacggtgcgataattgcaacagccggtattccaaatcctgcgccgatagaaataaataccggatacagagcattgaagatctggaatggtacaacgtaaatgatgacaacgcacagaagaagcatgataacgtgaatgtatcttaacaggaaagatggacaaacctgcataagtccgtttgagagggcttctaccatacctgtgttattaaatacggcctgatatacattgattgcaaggagcatgatcaggatgtttaagtacattggtccgactttgttgaatatttctccgaaattgtctttgtagttgatcattgcagtgattactgttgcaaaaataaatacgaagtatggtgcaatgccaaagattccgagtgccacaaggcagagaatgaagatgatcaagtttacccagaagagttttggtctgcggtttggattctcctcctgttgttctgcggcttctacgtttgtagtaactgcctgaaatgttccgacacgtcttttgtgtttgattccaaagtagatccactggaaaatgatcgccggaatgaaacataatccccaaggcatagatgcggatgcgagctcattggcatctaaaccggcagaggaagctgtgtatgccattccgattccccaggggataaagcacattgcggacatggctgtctgtgcaatgatgaaagctgcttctctatcaaagtcaaactttttatacagaggcaccatcaatggaaatgtaatgaggtatgcaggtgtgaagttacctgtcaggatactgaaaccgccgatgagggttgtcagaaccataataacaattacattcatcttgtttccgagttttgttgtgatagcagaaacgatcgtatcgaatacaccagcttctgtaagcatctggaaatacagaaatgcaaacaaaagcataaatccggcagatttcatcatggaagcgagctgttctacaatgaaagtgcttgtttcttctatggaatgtccaagaatcagcgcgcaaagaactggtgcaatgaaaagtacaaagttaaatggaagtttttttgttataacagtggcaactacgatgaaaatcaaaataaatgccatgactaaagtagcgttcataaataaatcctttcgtttattatagttatttacttaaatatgttttttaagaaattcatctacaatgttaagattttccgttgtccagaaagcgttatcgccatgaagcgcattttccagcatatagaatgtaacgtctttttcttcttcgcgaagttttttgtaaaggcgtacgctctgtctccaagatacggtgtcatcccctgttccatgcatcataaggattggaggaattggtgtatccttttctacataattggcacaggtgactggaacagaaagttcaggatgttcataaacattattgccgccgattaattttccttccggactgtctggctcgccctgatttaaagtggtaggaaagtcctctttctgacgaacgtctgtcacaccgtaaaaatcaacgatggcctttacttcacaggaaaattcattgtaatcttctgtatctaaaatgtcctgtccggcagtgattccggcgagtaccgcagtatgtccgccgctggaatctcccatgatgaaaatgttatctatatcgatatgatattcttctgcgtgctttcttaaaaatcttatgccagttttcgcatcctgaacctgtgcagggaaaacagccagatcactttctctatactgtaaaatagccgttacaaaacctcttcttgcaagatcagccatagcagaaagacgtttatactgatcctgcttcagccatgcagaaccttgcacataaagaatcgtcggatatttctgctgtgcggattccggttttacttctggtacgagcatttgtaatgtgcgctcaccctccggacgtgtaacataaacaacgtcatgtttataaacatggtagatttcctgaccagttgcctttatatgatgaacttctttcatctgtggaactgtctggaaaaaagtttcaaaatctgtgtttttgatttcttctggtgtcatttgtatgtcctttctaactcttgcttatgccaaagtatatacagtaaaatatgtatttaaattacaggagatataaactcgaacagcttatattgttaattatataactatgtcttgctcgcaggtcaatctgtcaaaatatataaaaatcataataatttttgtataaaataacgaaaaaatttttgtaactaacagtaaaagtgtttgagctgtttctttaaattttggaattttttcaagtgaataaaaacagtttctgagtgtaccaatggtttagaaatagtttagaaaatgataaaaaacctgtgagctgctcacaggttttagactttaaacaaccatttgattcattagaggaaaacagacgaaaaaagaaataataccatatcccatctgctctgtagtcgctgtatttaagatgcttgtccgcatcttaaacacgctccgaagccgcatctgggatatggtattatttcttttttctgtgttttggctccagaaggaatgaatgcaatagtctttgggaggaagatggggaaggggacagaattctctcgcttgctcaaaaggtatatcgtccagaagattagatactctctttaacaaacagtaaagagaaagaggattgtcattttacaaaaaataaagtagtcacctttatatataatgataaattcaccatatacagtgatagctgcgatatcattttatcatcattgaccgcatcgcagagacagtatcagaataagccacgaccttctgatttctcccccttgtttctccaaaagactattgaattcattcacatggagccaacacacagaaaataaaaagaatagaccattgcaactgtaatgtgggagcaagtaaaaatgccgaacaggcatactttctgaatagcagtagtcttctgacttctcctccttattcctctcaaaaactattgaattcattcacgtggagccaacacacagaaaataaaaagaatagaccattgtagctgtaatgtgggagcaagtaaaaatgccaaacaggcattttctacgcagtgatatctttacaattgcaatggtctattctttttattttcgtctgttccctaatgaattaaatagtaaaaaacccgttataatggaagctgcatgcgaaaatagtctttcctttccccagtttcatcaagagtaatcctcaggcggaagccatacacaggagctttaggaataccggatttatattcattataataacgaaggaactcgttaatcaagtctccctcagaagcgtaatggcctccaaggcataggtaagcagtaaacattctgcctccggaaatcttttcaaatccttttttatctttcataaaatcattatccgtatctacagagattccatgtccccatgaaaatgcagaaagatctcctttgaagtactcgggagaaagttccagtaaagagctgcttttaggagcatattctgcgagattgattccatcggattcacaggaggcctcatccatgtagttcagtccttttgtctgacggcgaaaataaaagtcagggcaatcctcaatgtaccatttgccaagtctgcggtccaaatcggccagttcttttcgataattttctataagttcacgagtatttagtaattccgttacctctgtggcaagttcctgacttcttttttcaagaagtgacgaaagaagagcattatccccttctttaagaagaagctggatgtcttttaaggaaaatcccatatttcgatatttcatacattcataaatatctgtacagctttttacatcgtaggaacgataattggattgttctcttctgcttgaggaaatcaaccccagtttttcgtagtatttaatagtatggacggatacgccggtaaatttagaaagcattccgacagttttttcattcatgatttcacctgcctgtatatttggtattactgtaattgtataattcccctttgataccagattgctacgtgccttacactctcgcaagcaagcttgcatcggctttctgacttttgactctggtatcattacattataataggtaccactgaaaagtaaaagcaggaatatatagaatcggctgtgaaatccatagaagttattatatatttaaaaaacggacaacgccggaatgatatgcgttgtccgtttctttaattgtgaagcattattttgagtaattacaaaatgaaatacagacagatactctcttgtaatcatacaaaatacttatacttctgtaattaagtatcctttttcttcaagtgttttttcaatcagatcgagtgttttttcggaatctgcttctactgtatggtaatggtagttagatgtgatatttttaagagggcttgacttgccgttcttaatatcatcgataaatgcctttacttttaatcgggaagaaatgccaagtggggcttccatatgaccgtatacccggtgattgaccattacgtttacaacagtgccgcctaaatccacaatcgagtaaagttcatcttctgtctgggcatctgtgtgactgactttaaatactcttgtaattgcatgcggagcattcaaaatgtatccacgattggtagagataatgtcataacctgcggtacgaagcagagcgatatcctgcacgattacctgacggctgacatcataaagctgtgccagagtcttaccggaaattggtgaagtgctgctttttattgtattaattaattcttctcttcgtttcgaaccagtcattgtgtatcattttccctttcattaattacagagcgtgaagattcttcagtgaaatatcaagaacaggtgcggaatgagtcaatgcaccacttgatatatagtctactccaagagaagtcagatggtcaatattttcttttgttacattaccagaacattctgtttgagcacgtccgtcaataatacgaatcgcttctttcatttcctcaacagacatgttgtcaagcatgataatatccgcaccagcttctactgcttcttttaccatgtcaagattttcaacttctacttcaatcttacgtacaaatggagcatattcttttgccatctgtacagccttcgctacgctgcccgctgcaccgatatggttgtcctttaaaagaaccccatcggaaagattatagcggtgattaaatccgccgccggcacgaacagcatatttttcaaaaatacgcatgttaggggttgtctttcttgtatctaaaagctttgtctttgttccttttaaaagagcagaaaccgtatgtgtgtaagtggcgattccactcatacgctgaagatagttcagtgcaacacgttcaccggataaaagcacacgaatatctccggtaactgttcccatgagctgtcccttctttacggcatccccatctttacagagaaattctgtctttgtgttctcatctaataattcaaatactcttttaaatacatccagcccggcaacaataccatcctgcttacagataagctgtacttctccttctacagcttctttcataacagagttggttgtaacatcctcactggaaatgtcttcctgcagagcgagacgaatcagttcgtctgcctgaagtttcatggaaattgtattcataggtagtttcctttctatataaataatacataaatttatacgataagtttatacggctgcagattcactgaagtctaacggtttaacggtctgttctaaaccacagatcttacgtgcggctctttttgcaaagacaagactttcaagaagagagttacttgccagacgattcgctccatgtacaccattacagcttgtctcaccaacagcataaagatgatccatagaagtcttgctgtcactgtctacccagataccacccataaaataatgctgtgcagggacaaccggtatccactcttttaatacatcatatccctcttccagacatctctgataaatattagggaaatgattgagaatcgtctctttatcaatatgttccatagaaagccagacatgattggttccgtctttttccatctgtgccttgattgctttcgtaacaacatcacgtggaagaagctcatttacaaaacgttctccgttcttattatagagaactgcaccttctccacgtaccgattcagaaatcaaaaatcttcttcccggttctttggaataaagagtggtaggatgaatctgaacatagtcaagatgctctaaacgaatcccatgcttcttagaaatgtctaacgcatctcctgtcagatgagggaagtttgtagagtgcttataacatccaccgataccaccgcttgcaaaaatcgtatccttggcgtggatgtgcatgatctttccatcctttgtcttagcgataatacctgcacaatatccatcctgtacaataatatctgtcatggtcatatattcataaatcgttacattcgaaagctttttcacctgtgcaagaagcttgctcgtaatctcctgtcctgtgatatcctcgtgaaaaagaattcttggtctggaatgtgccccttctcttgtatagagaagtttatcaccgtcatgagcaaaatcaacaccatagccgatcaggtcatgaataatctcctgagaactgcgaatcataatgtcaactgattctttacggttctcgtaatgccctgccttcatcgtatcttcaaaatagttgtcataatcattctcatctgttaaaacacagataccgccctgtgcaagaaaagaatcactgctctctaaatctgatttggtaatcataataatatttttatcttttggaagatttaacgcagaaaatgcaccggctacacctgtaccgactattactacatctgtcctaaaatccattgctgtttacctcctgcttactactttgcagccagctcaagcatcttttcgagaggttttttagaattctctcttaaagcatcactgacatgcacttcattctctcctgtcttcaatacatggagaatcttctctaaagtatttttcttcatattcgggcagactggaagcctgtctggataataaaatgtcttatctggattctgtgtctttaacttataaccaacaccttcttctgtacatacgataaattcctgacagtcactctctgtaacataattaataatgccggaagtacttccaacataatctgccattaagagaatagactcctggcattctccatgggcaacaatctgtgcatctggatgctgtgcctttacattcgcaacatcttccgcctcaatacgctcatgtgtcgggcaaaatccgttattataaacaaaattcttctccggtacctgactggcaacatagtgagccagattacggtcaggaataaagaaaatattcttctgcggcagttcctttacaatcttaactgcatttgcggaagtaacacaaacatcagaatactccttaagcgctgcagtagaattgatataacatactactgcaagatcatcgtattctgaacgaaccttcttgatcgtctcgatttctgccatatgcgccattggacagtccgcattcatatccggcattaaaacggtcttctccggatttaaaatctttgcactctcgcccataaaagaaacaccacaaaaaacgattgtctgctcctttaactttgtagcaaccttgctcaaataaaatgaatctcctatgtaatcagcaatctcctgcacctcaggacgcacatagtaatgtgcaagaatcactgcatctttttcttcttttaacttctttatttcttctacaattgtcatgaaataccctcctgtaaggtatggcctttaaagacccccttctgattttttccaaatttctgtccattataacaccaaagtttacatctgacaagacacctgttaaaaaagtgtaaagaagtttacaacaatggcagggattctatatcatataagaattccctgccatttatgctgtataccatatttatttttctaacatgattcaagaatgccctgatattattttacagtaatcgtaaatgttactttttctttatttgctgtatttgtacacgtaactgttgtctttccaggtttcatcccaacaaattccatttcatcatcatatattccatcatccatatcttcgaatgcaagaatcgtagaatcctctactgtccattttaactgacggtcttttactccttttccttttgttttcttaacttcaagttccaactcatcatttactcttatactacgtttcagagagccttttgcacaaatcgttttattttgggaagatgtctttgttgtttttttaacattcttcactgtaatcttaaaattaatttttttatcggtttttgtatttcgacaagtaatttttgttgtgcctgctttcagtgccttaaatttaatatcatcatcatgtctttcttttccggcaaatgttacaatagaagaatctttaatactccaagtcagatttttatctttaacagactctggcttatctacttctagttcaaatatctttcctttaataatactacgtttcttttttccctctcttgaaatgtcttttttctttgtagctgcctgcacagtattaacatttccaattgcaggagtggtataacctgccgcaaacaaaatagtaaataacaatacaactgccataccagggaataaacacattctttttctcataattttctcctttcatttcacataatttttgtaatcttttaagattttatcaattcaagtcgaacgtccgtgagacttggcgcgtgattctggtcagcgaagctgacatattcctatcagaatcactgcgcatcctcgcggagcgtttatctcagtcggagattggactcccactgagacaaatttgctattactcatcacctgaagaggtgggagtcttctcgactgagataacttgttttattttatatcttgattatactcacaaaaaatgagaaaatcattaaaaagcatatttaaaaatgacagatgatcaagttaagaaaggagtataaatctatgaggatgttaattgttgaagatgaaaaagatttatgtaatattttaaaaaaacggttgcaaaaagactacactatcgatatttgtatggatggcgaagttgctaaagattatctgaacacctatacttatgatattattttacttgatattatgctccctaaaatagatggaatcactcttttaaaatggttgcgaaaccaaaaaaagactacacctgttcttttactgactgcaaaaagttctattgaagaacgagtaaatggattagattccggtgcagacgattatttaatcaaaccgtttgcttttgaagaactacaggccagacttcgagttttgcttcgaagaaatatagcagcagatccaagcgacattcttatttatgaagaccttgtaatggatacgaaaaagaaaaaagtcagccgtaatggtaaggaaatttcccttactacaaaagaatataaattactgcaatatatgatgcgcaatcccggacatgtactttcacgtgatcagcttgaacaacgaggctgggacagtacttttgagggaggttctaatattattgatgtctatatccgttatctcagaaaaaaaattgactccgattatgaaaaaaaattaattcacactgtatatggtaaaggatattgtttaggagaataaatatgaaaacttcaaaactatcaataaaattccgaatcaccttttggtatactcttgtgttttctcttattttggctctcgtatttttttatatttattttctttctaaaagctacagtgtccatgatcttcaggaagaactaaaagatgaatccgctgatatgctggaaagtttatatgataagtctagcaggaatgatattttatataatgcagattggacaaaattctatgacgataatgtttctatcagtttatatgataaaaacagtttttttataaatggtgtttcgccagaagattttcctgataaagttccatttatcaagaataagatacgacagataaaatctgataaaaacatctggttagtatatgactattgttatgaagaatctccggaagattccatatggattcgaagcatcgcttcttatggacattggtcaagaattctttataatatgctatggatttttgctgttcttttccctattactgttttcatctccgcctttgtcggctaccatatattaaaaaaagcgttacaaccaatttatacaatcagtgatatggcaaaagagatatctttttccgtcaatctttcaaaacgtattgaaacatcaaacactcatgatgaattttcttacttgtctgatgcatttaattctatgattgctaaactggaaaaatcttttgaaaaagagaaacaattcacatccgatgcagctcatgaactaagaacaccaatttcagtaatacaaagccactgtgaatattgccttgatgaactaaagctcaccgatagtgttcgggaagaaattgagattatttataaaaaaacaacctacattggtcagctagtttctcagcttcttactatatcccgcacagataagcatagttttaagcctcaaaaagaagaagtagaccttactcttttaatagaatctgtcatagaagaacttcaacaaaaggcagcttataaaaatatttctcttttatttgaatatatcccccaaaatgaatcatatattattcaaggagacacgatgctcctaatgcgtatgatttataatcttatagaaaatgcgatcaattatggtatcaatggtggatgtgtctgggttaatcttataaaaaaccaagaaaacactgatattatcatcaaagataatggaatcggtatcaaaaaagaacatcttgataaaatatggaatcgtttttatcgagttgataaaagcaggagtgccggggaaggttttggacttggactttctatggtccgttttattgtagatattcacaatggaagtatctctgtaaaaagtaaacctggatacggaactatatttactgtgtcgttataaagcgatattatttaacttagaagctccatgagtaaatgaataattaattcttcataaatgcaaaaatgagagcagccacgatcgctgctctctttggagaaggtattcttgttacactaaatgcaacaaaacttataatgtattgggggggttacgagtattataatagcatttcctaccatgaaagtgtgcataaacatgaagaaatttcaaaatattttttatgcatttttcgcaatgaaatacccctatttgccaatattaaactcaatcttttgttcatatataacaacttcctacagtattcaacgaaaaacaccaattttgtacttgtaaaaatactttttatgaaaagaaaaacacaaaaaaagatgaccaacgaacggtcatctttttggagaaggtatttttgttacttattgggtgtagcaaaactatataatgtattggggggggttacgagtattataatagcattgggtcacccgaaagtgtgcataaagttttatttaattgaaaaaaatttttgtgcagattcattcgaattctgacgccttttgtcaatttgtcgaaaagactataaattctcttcgcctgcttcgttatttttaaacaatgcctcaaattcttctctgcttatacgttctttttcaagaagaagacttgcacaggaatgaagaacgtccatattttctgtgaggattctctttgcatctgtataacagtcatccacaatcttctttacttctttatcaataatacttgcaacttcctcgctaaagcttctggaatgtccaagatcacgtccaagaaatacttcgtctgtattctcttcatagttgataaagcccagcttttcggacataccaaacttcgtgatcatacttcgtgcggtatcggttacctgcttgatatcctgagaagctcctgtagttacatcatcaaaaattaattcttcggcaatacgtccacccatacctactttgatttcctggatcatacggcctcttgtttcaaatacgttatcattctccggtaccggcatcgtgtagcccgcagcccctacgccggtagggatgattgataccgtataaacaggtcctacgtctggaagaaggtggaaaagaatcgcatgacctgcctcatgataggctgtgatcttacgctctaattccggtacaaggcggctcttcttctctgttccgattcctactttaatgaaagactttctaatatcctccatacggataaagcgtgcattatttcttgctgcatgaatcgctgcttcattcataaggttctcaaggtctgctccagaaaatcccggtgttgtgcgggcaatctgatgtaaatctacatcttccgcaagcggtttgcccttcac

SEQ ID NO: 414 - DNA, 46745 bp, Eubacterium hallii
ctgtccgtaagatattgtaatcccatcaaatgaaaacagtccttcttatcaaacgttattataagtttaaccgcaacattttttcttcccagaacaatttcatactccgttgataagagaggaataaatgatgatacacaatcaacaactgttctcatctatattttccgcaactcccttcatttcataataaaattaagaaagaccctgcacttggcagagcctctcagcattttcttttgggagcttttgctccctagccagattgtggtaaatgctaaacccttataaagctggtaaggcactgccctctggcacaacaccttacttcaacgcttgacagacactcatgttgcctgttgttactattatattaacttaccaccacgaatatgtcaactgaatttcaatagtcattttttcatttttactttcgtcatttccttttttccatagaaaaaaagctccgaaaacctcataatcactagaaaatatagtgtttatgaagcttttagagccttttataaattctattctaatttacaatattaataattcaagaaattatttgccagccatctgagctgctacttcagctgcgaagtcctcttctttcttctcgattccttctccagtttccatacgaacgaaacctttgatagcaattttagcattgttagccttagctacttcctcaacatatttggatacagactgttttccgtcttcagcttttacgtatacctgatccattaagcagatttcttttaattctttgttaagacgtcctttaaccatacctgtgatgatcttatcgttagcgtctggtttttcattcttagctgctgctgtaaggatttcttcttcttttgcaagataatcctgatcaacttcagaacggtctgtatacttaggatttaaagctgcaacctgcatacatacgtttttagccatctcttcgattgcatcatttacaacatctgttacaacgtctactaaaacaccaatctttccacccatatgtgtataagaagctacaaatcctgcatcttcttttacctgctggaatctacggatgttcatgttctctccgatgatagcgatctgtcctgctaatgcttcgtttacagtcttagtctcatcaaatttccatgtttcagctaagaatgcatcgatatctgttgtttctgtttccattgcctgttctgcaacctgtgcaacataagcctggaacttttcgttctttgcaacgaagtctgtttcagcattaacttctactgcaacagctttcttcttatcatcagatacgataactttaacaagaccttctgctgcaacacgtcctgctttcttttcagcagttgcaagacctttttctcttaaaaattcaattgctttatcaaaatcgccttctgtagctgtaagagctttcttacaatccatcattccggcacctgtcatctcacgtaactcttttacctgttttgctgtaatagccatttcgattcctccaaattcatctcttttatgtggtcatatagattttgcacaaaaatgcctcggcctgtactaacggtgcaggctgaggcaatattgcaaacagaattaagcttctgcttcttcagcagcttcttcctctgctacttctgcatcctgtccctgatttccttcgattacagcatctgccatcttggaaacgattaatttaactgcacgaatagcatcatcgttacctggaattacgtaatctaattcttcaggatcacagtttgtatcgcagataccaactaaaggaataccaagagtttctgcttcctgaatacagattctttcttttctaggatctacaacaaagatcatatcaggaatatcctgcatctctttaataccacctaagttcttctctaatttttcctgctgtttcttcaggttaattacttctttcttaggaagtacatcaaatgttccgtctgcctccatagcttcgattttctttaactgggcaatacggctctgaattgttttgaagtttgtgagcataccacctaaccatctctggtttacatagtacattccacatctctcagcttcgttcttgatagaatcctgagcctgttttttagtaccaacgaaaagaatctttccaccgttagcaacacagtctctaatagcattgtacgcttcgtcaaccttacctacagacttctgtaagtcgataatgtagatgccattacgctctgtgtagatgtaaggagccattttagggttccatcttcttgtctgatgtccaaaatgaacacctgcttcgagtaactgtttcattgaaattacactcatgtcaaatctcctttttgtttgttcttccgctgctttcttattcctcagccacctttcttacaggcacttcgaccgacagaatccggcaacgtgttttttacttaatttaccgaacgaagtatatcatatattataaggttttgcaagaaaaaattataatgttttataaaaatctctgatttctgatgccatctgcctgcgtcgatcgtctaagatctgtattacatctgtttcattggcagtaaatatagtttctgcgagaccattttctttcaatgatgtacgaatcttctctatgccgattgctttttccagattctctttataatctacaggggactttttcctgataatatcttttgtttctttagaaatgtaagtaagattggcaacctgtccataaatttcccttgttttatatccgcattttgccagataagctttcggaagaatctgataagattctgttttatttttataaagttcttcaattgtcacatcgctgtaaagagaatgcacgcctcttgcacactgtgtagccacatacgcaagaaacggagctgtacgtgctgttgttgatgtaaacttctccggtaaaatattgttataaaattcatctgtaagttttagttcttcaatctgtgctaagtaggaagcaaaaccttcttcctgtgcattggcataatctttttgtacggtactctccccaccactttgataatgtccggtaatcatcgccatcgttatccattttgaaagaagagattctctttctttttctccgattccctgacggtacatcagaaggtacatcgcatagcaataatttaaaacggattgagaatatagtaaacgactacagctatatcctgctttttttaatgctttctggaatccctgaaagttctcttcgcatacaaacgcttttactccggcaccaagtttttcaaaagcttcttcggaaactttttttgaaatttcttttttagaaaagatttttttctctccgtctcttcctgataaaagatgtaccagatcaccgattcttgtctttccaaaataagaaattagtacaacttttaaaacatcagcgtaggatggaatatataaactttgttcttcattctggcaccaggtcagtgcttttccatattctgaattaaaaaattctgtctcattttgctgcaacacctgataaaaagatggttcacgtaataaatggcaaaaatagtcaatacaattccttatgtaatcaccgccatactgttcattgacagaaattttagacataacgaagtcttcctgattcaaaggctttccctgtaaattaatacgaataaatatttctgaaacaacatcaatatctaaaaggaatgataattcaattacaccaacctgatgttttacaatttcttttaatgtatctacagattcttctaatggtgtaaaatcttcatctggattcgcctctttatattctttttcaaactgtcggaaagaaaaatctcttctaaagaatatcgaaatatcaggaatccatctgctatcttcttcatgcttcgtatcacagacggcaaatcgttcttctcctttaccggctaatgggttaaatgcaatccggatccgatgggattgatactgctcatctaatacttcttttccaaggagcgccgccattaaagctgtgactctctgctgcccatcgatcagtattttctttgttccaccttttccaaagttgcgtacacgaacctgggaattctgccatacgatcaaatatcctataggatatccttcatacaaagaatcaatcaaagctcttacttcttctcccttccatacaaatggtctttgtatttccggaatagcaatttgagaattttcgacatatcccaggatactgctgacagaatattgtgttattttataattatccgctctcattctttatcctccatcgtatatgcgaacattatttaaaatgcaattaatgtttcatcttctttaattcgtcaaagaccacatcgttaagcactttaatataagttcctttcataccggaagaacgtgactcaataacaccggcgctttcaaactttcgaagtgcattcactataacagatctggtaattcccactctgtcagcaatcttgctggcaacaagaatcccttccgatccatctaattcatcaaaaatatgttgaattgcttctaactctgaaaatgataacgtggagatggcagacttcacaatggaaaccttacgggtttcttctgcattctcctcattaacagaacgcatcatttcaagaccgacaacagttgtcccatattcaacaagaatgatatcatcaatttcataatgatgttcttttctgtacataaataccgttcctaatctttctcctgcaatatcaatcggagtaataattgcctgataacgatctgtttctgtatgttcaaaaccaagtgtttcgaggtttacattctcttttgtagaaagtacacctaataaacgttcattaagaagtgtatcaacgtacccgccaacttcgttattgatcaactcatcaatcacttcaatatcctgtcgattcttgattccaagtactttaccttttctactgattaccagcacattagataataaaatattactcaagacttcacagatatcattaaatactactttatgcgaattattattgtgcaataatttatttatttttcttgtcttatcaagcaattgaacactcataaatacctccatcctaactgtcaaaattaacagacaattctttatctttgataagtttaacatatcttcccgccaatctcaacggtattatctaatatttttagtacttttttaaattaatttagaagtttgtacaattaaaataatttaattctataaattggatatatgaaagaaaaaaagtatagcttcatatccataaagatagctgctacagtaaaattacttatcctattcttcctgcagcaacgatctttacagctacaaacctatactctttctaaagttctctttttttattcaaaagcagataaattacttttcctcttccttgtctgtaacataaccacattctttatctgcgcatacaagctttttccctttttctaccatatatccgccacattctttacatcgaacagccgacggtttttgccagctcataaaatcacattccggattattgatacaaccgtaatactttctacccttctttgtctttttgagaacaatatcttttccacactttggacagcttacaccaatcttctcatagtatggttttgtattacgacaatccgggaatcccgggcatgcaaggaactttccatgtggaccgtattttatgaccatgttccttccacattcttcacagacttcttcggatacttcatctgcaatctttacttcttctaattccttttccgctttctcaactgcctgtatcatatcagggtagaagttttccacgacggtcttccactttacttttccctcttcaacactatctaaaagagattccatatttgcagtaaagtttacatcaacaattgtcgggaagccatcttccatcatatcattcaccgcttcaccaagttctgtaatataaagatttttattctcttttacaatatatcttcgtgccagaagagtagtaattgtcggtgcatacgtacttggacgaccaattcctaattcttctaatgtctttacaagagaagcctctgtaaaatgtgccggcggctgtgtgaaatgctgctgaggttttaattctgaaagtgtgatttctgtatcttttgtaatctttttcatggcagcattcattgtagacttttcagtatcgtaactatataccgtcataaaaccgtcaaactttactcgggaagccgcaacattaaaatgatattctcctgcttcaatcttaacagatgtcgtctcgtataccgcttctgccattctgcttgccacaaatcttgtccagattagctgataaagacggaataaatctcttggaagctgctctttgatcatcgctggagaaaggctgctgtccgttggacgaatcgcttcgtgtgcatcctgaatttttccggtctttgttgtctttactgactttttatccccaacaaactcttctccgtactgctgtccgatatactcccgacagtttgcatctgcttcttctgaaatacgtgtcgaatctgttcttaagtaagtaataagaccaatacttccttttccttttaaattcactccttcatagagttcctgtgcaagccgcattgtcttttgtgtagacatattcaaacgttttgatgcttcctgctgtaatgtacttgttgtaaatggaagcggtggtttctttcttctctctccattctttacagaaagtacttcaaacttttcatttttcagtttgtttactaactcttcaacttctttttgagaatggagttcaacctttccatttttatctccggtaaagtgtgcctccagaggtttctttgctcctggcacaagaatatcggctgacagactccaatattcctgcgagatgaactcatcaatctcttgttctctgtcacagataatacgcaatgcaacggattgaacgcgacctgccgataaccctctcttaatcttagaccagagaatcggactgatcttatatcccacaatacggtctaatactcttcttgcctgctgtgcatctacaagattcatatcaatatcgcgggaatttttaatagatttctttacggcatcttttgtaatctcattaaatgtgatcctactgcattttttattctccaattttaatgcatgatataaatgccatgaaatcgcctctccctcacggtccgggtcagttgcaagatatactttgtctgctttctttacttctttacgaagttgagcaagaatatctcccttcccacgaatcgtaatatattttggctcaaaatcattatcaacatctatgcccatcgtactttttggtaaatctcttacatgtccgttcgatgcgacaactttgtatgacttccccagaaatttctgaattgttttagccttggccggcgattcaacaataactaaatttgctgacattccccaaaacactcctaacttttaaatattatattgcaatttattgttttttatcaccaataaatttactatttcataaaacaattatacatcatacactatttcgttttgccgcgcaagcagaaaaaattagattttcctcaagtatacattttgttctatttgataaattatgtttttcaattcaaatttcataagaatatgttgtaactcgaaggcagaaaaatcgctattttccaaaagattttcaaaagttaccggtcgaactttatctatgagattgaatatcttttcttcattttcattttcacaaaaaaatttttgtaatttaaaatttttgctttcttttttctccatatccagttctatatttcctgttttttcctcttttactataatttctgcgatatcttctggggaacgtaccagagtagccccctgactaatcaaataattacaaccttgactgtaacgatccgtaattctgcctggaagtgcgaatatatcttttccttgttctaatccctgatctgcggtaatcaatgacccacttctttctcctgcttccacaacaaaaactccatcagccattccgctgataatacgatttcgcataggaaacattcctttttgtgaaggaattccaacattatattctgatatgattcctcctgttttacaaactttctgatataagttaaaattctctctcggataaatgctatcaattcccccaccaagaactccagcggtataaccacctgcatccaatgcacctaaatggcttgatgtgtctactcctgccgccattccactgataatctgaataccgtatccagttaattcagaagcaaattccctcgccatatttcttccatatatagtagcttttcttgcccctaccatcgccagaacaggctttgagaaatcaggaaaccttcctttataatataataaatctggtggcatatatagttgttttaatcgttccgcatactcaggagattctctgtgaataaaaaagattccctcttcctgtaacctttgaacttctttttctgatttctcccggtttttagaaaacggaaacctttcccactgtttttttgtaagaaatacttttatctcagaatctgaagcttcataaacatacttcggatgtctaaagtactcaagaagcttttttcgtgttttcagtcctattccaggaatattagcaaaccaataccaataaaaatcattatctttcattcaaattccccttttctttctgacgaaaatataacgcttcctccaaatgtctggcttttatatccggactttgttctaaatccgctattgttcttgcagtttttaaaatcttaaaataagaacgtccggtaagggaaaaagcagaatatgctttcttcataagtctttgtccctctgcatctaactgacaatactgttctacttcgctttttgtcatgcgtccgttaaatatcgtagaactttccgcaaagcgttccttttgtattacccatgcagcggaaactcttttttgaatagaggaagaagcttcttctttagaggatgcggtcagtatatcatatccaatctcctcacatcgtacaaataaatccatacggtcaagtattggtccgctgattctattttgatatcggagaatctgcctgcttgtacaacggcatttatccatgggatagtacccacagggacatgcattcgctgctataataaaaagaaaatccgccggaaatattaaagttctctcttgtctgataactgaaatagcatgattctcaagaggaatacgaaacatttctattatctctcttgcatattcaggaaattcatctagaaaaaggactccatgatgcgccagagaaatttctcccggttttggaacgattcctcctccaaacattccggctgcagtaattgcaagggacggtgcacgaaacggtcgtttatttattaaagtaaaacgttcctttaagagtccctttgcactatagatcatggtcgtatcaatcatctcttcttttgtcatctgtggcataattcctgatatacaggatgccagcatcgtcttccctacaccaggtggtccgcccaacattaaattatgataaccggctgctgcaatttccattgctctttttgccatactctgtcctttcacttcagaaaaatctgttatctgattccattctcctaaattcagtgcaccgttatctgttatctccccatctatacttaccattcccctaatgtcagcctctttctgttccgtaatctcacctgaatgtctgtctactatatacccatggcgtaagtaagaatagagttcttcaagactttgaaagctaacaacttccatctgatctacaaatgctgcttcctctatattctctttcgcaacgatacaccgatttattccattcttcacagcggaaacaacgattggtaatacaccggatatcggtcgaatctgcccattcaatgataattctccaataaataacgtattctttacatatgtttccgggatcagattcatcgcaaaaagaattgctactgcaacggcaagatcaaaaaaagtcccacacttacgaaaatctgccggcgcaaaattaactgatattctttttggtggcaatgcgatccctatattatgaagtgctgtacgaacccgttcctttgattcctttacttcgttcgataaatatcctgtcatataaaaattaggaagcccattactgatatctgcctgaatctgtacgatctgcccttctatcccctgtatcattccactaaaaacttctgctaccattccactctatcctaccttctatttttgtatattcagtaatattttgtaattataggttatttatagcatattttttccatatttgcaataatttttttcatttacaaacgtatggaacagaggcagactcctaacatatccttgcggaacttttttttaaaacaaaaaacaggtatcgagaatactttctcaaatacctgttctgcttatcaatgttattacttctggatgttctctccactatctaacatcttctttaactcattcataaaagttcctacatccttaaactcacgatataccgaagcaaaacgtacatatgctacctgttcgagagtctttagatgctccataacaacttctccaatctgtttactttcaatctctttatattctaaattaaacagttcattctcaatctgattcaccatctgttcaatctgttctacagatatcggcctcttatggcaggcacgtaaaattccggacataatcttagaacgatcgtaaggttctcttgttttatctttctttatcactgtgagaggcataatctctactcgttcgtatgtagtaaatcgctttccgcattcatcgcaaagtcttcgccgtcgtatggatgaattatcatctgcaggtcttgaatcgattacacgggtattatccaatccacaaaatgggcacttcatatcttatcctccagtattctagcttttatgatttcatttattgtgccgactattataacagaaaacctattattttacaagacatttcttttcatcgatatcgacaagaatactatcaactcccactcggattactgctccaaccggaatccgatattccgatttctttccaatacatccgcaatattttccacccgtaggcacataaatatctgtaatacaaaatctgcatacatcaatttctaaatctcccacacaaccaaggcggtgaccatttttacagttaatcacatctttatttccaagttcccaaaaacgcataaaaaaagccctttcttttattttatgagggcttttttgaataattctattttcatgacttatatctcatactgttcattaagatgcagcttcatccactgcaaaatatctatatatacagcttctttccttacttcatcacaaatattatgccgcattcctttataaagccgcatttccactcgatggcagctatcttccagatagcggtgtacttcttcaatcccttttccaaagttacctatcggatcttcctgtcctccaatcagcatgattggaatctctatatttacagagcggtaccactttttagaagaaacaagtgcaagcatttttaagatatcttcataagctgctacagtaatcgggacgtattcttcgtaaattcttgaacagttctttcgttctttttcatcttctacaagccacgaacaattatccctctctcttagaaaatgatggttcaaacgcttttctaaatctttttgaagataaacacttttatattgtgctcccagaatccgctttaatattgcgataaataaaagccttctgcggcaatatttctgtcttccgctagttccagataaaattacaccattgattcccttttcatgaatacaatccattcggacgatcaacgaacccatgccatgcccatatataaaatacggaacatccggatattcctttttcatgtaatgtgttaacttttttgtattttttatcagataagtccaaccattcttttcaccaaaatatccatagtcttctttcttggaagaacgtccatgtccaatatgatcgcatccacacaccataattccatgatcagtaaaaaagcggataaaactttcattccgttctatacaatctccaaaatcatgcacgatctgtatgattgctctaagatctgtttctggttcgtaaatataataatgtattctgtttatatgatctgaactctgataggttccagtaaatttctgataagccatacgaaagcctcctagcttgtctgcttcaacagcagatttcttttccaaactactatacaggaaaaatgtgaagaaaaaaagatgatttctcttgcattttcgttaagagaaatcatcttttctttcgtttttattaaatttcttacattttatctagactataatctgatctatacggactaaagaataatctttgcaggacatttctctgcacactttccacatccggtacatttactgtaatcaattttagcaatattattttcaacagtaattgcatctgcttcacagacacgagtacacatcttacatccgatacatcctgctgaacatacttcttttactgctttaccaaattctttggaactgcactgtactttgtgaggagctgcatatggaacaagctcaattaaagacttcggacaagttgcaacacatttaccacaagcaacacatttttccttatccactactgcaacaccgttaattacatgaatggcatcgaagtcacaaactttcacacagcttccaaagcctgtacatccaaaactgcaggcttttggtccgccaccaggtacgctcatggcagaaacacagtcttcatttcctgaatatttatatttagactgtgctttatcgcaggtacctgcacattttacaaatgcaacctgtttttcacctgcatccgcttctacacccatgattgaagcaattttatctgctactggctgtccgcctaccggacatgcacctaccggagcgtctccggctgcaattgccttagcgagggcatcacatccggcaaaaccacaaccaccacagttgtttcccggaaggcactctcttacagcaacttctttttcgtctaccggcactttaaatttctcggaagcaatgcccaggagaatggaaataacaagtccggttccgccgacaactactgccgcaagaataattccacttatactcatttttattcctcctaattaaatgattcctgaaaaaccaaagaatgcaatagacataagtcctgctgttaccattacgataggcattccctgccaggactctggaatgtcgttgtattccattttttcacgaattccagccaggataacaatagcaattgtaaatccgacagaaataccaaaaccataaactacagactgtaaaatattatatccatactgtacagagtttaaagctacaccaagtactgcacagtttgttgtgatcagaggaagatatacacccagagattcatacaaagctggcatagatttctttaaaaacatctctacgaactgtacaagagctgcaataacaaggataaaaacgattgtctgtaaataagttaacccaagtgttgcaagaataaatttataaattaatgatgtcactaaagaagcaatcgtgataacaaaaattacagctgctcccattccaccggcagtctctacctttttggatactccgaggaaaggacataatcctaaaaactggctcagtacaacgttattaacgatagctgcactgataatcaataatattaattctttcataatccttcccctttctatttattctctgctttctcatcagaagcagtttttgtttcttcttttttattgtctacggacatatcaaagaaactcttacttgaacagcaggtattaccacaggaagagcagtcaccacatcctgcagggatttcttccatttcgccattctttactttgcggttcataatcttgtttcttgcagctactaagcaggcaagtacaaagaatgcaccaggtgcaagaatgaaaatagtgatcggtgtatagaaagattctgccaaaacagtttttccaaaaattgttcctgcaccaagtaattcacgaaatgcacctaaaatagtaagggacagtgtaaatccaagacccattccaagaccatcaaagaaggaggaaacaggaccgtttttacttgcataagactctgcacgtcctaagataatacagttaactacaattaacggaatatatacaccaagagcatcatttaacgctggtacatatccctgtaaaaggaactgtactactgtaactaaggatgcaataattacaatgtatccaggaatacgaactctatccggaataaaattacggagaatagagataatcatattagaaaacattaatactactgttgtggaaagtcccatacctgcaccgttgattgcggatgttgttaccgcaagtgtaggacacatacctaaaataagaactaaggtagggttttctttaataataccattataaagtctttctaaagcgctattatttttcatcttagttacctccttctaatgactggaaataagcaagacagctattcatagcaccagtaactgctttacttgtgatagtcgcaccggaaatggcatcgattttcgcgtcatcaccggaaccagaaccgtcttttacaacggagaaagattctactttctttcctgcaaactgtttaccccagctaggatcatctttggctttcataccaagacctgctgtctcactgatagagagtacagaatatccacttaccgttccatcagactggataccaacagtaagctggatgtctccaccatatcccttagaggttgtaatattgaaaatataaccaagtgcctccccagaagcatctactgcttctactgcggaagaaataacatcactgtcatgtccttcaattggattctcgtttgctgcaataatcttagaagctgcttcctcggaaaatccatcaacttctttaaagtcacttgcctttggaaatactgttttataagcttccatctgtgcctttgcttcctgatcagcaatcggtccttttgtgattccatatactgcaccgagaacaagacctgcaacgacggtaataataacgagttttaaagcatcttttattaaagcgttcattattttttacctccttttccaaatgcggtaggagttgtaactttttcaattaatggcactaacaggttacagaagatgatcgcataagatacgccctctgcagaaccaccgaataaacggaagattcctgtcagaataccaagtaagataccaaatataagctgtccctttggtgtaataggggatgtaacgtagtctgttgccatgaaaaatgcaccaagcattaatccgccaccacacaactgctctgcgagatatgtcatatcgaatccatgtccgccaaaaagaagaacaaagataccaagtgttacaatataacatacaggaattctccagcttatgattttctttgcaatcagataaattccaccaagaattaataagatagcagaagtctcaccaattgtaccagcggtattaccaaggaacattgcttttaagtttacagcttctcctgcctttaaagctgcaagaggggtagcacttgttgttgcatcaaagcttccgccaaatcccttataagagaaatctgtcataattcccgcaaaagaaattaataagaaacaacgtgctccaagtgcagggttcataaagttctggcccagaccgccaaaaagctgttttacaacaataatcgcaaataatccaccgataactggaatccagaatggtacttccggtggaaggtttaatgctaataataaaccggtaagtgctgcactgaaatctttaacggttactttctggtgcatacaacgctgccatacatattctgcaagtacacagacagcaacacagattaccgtgttgataattgcttttactccaaaattccagaaaccaaataaagtagctggaagaagagcaataattacatcgagcataatgctatgtgtagaagccttatcccttacatgaggattggctgacacgttataaaattgttcgttcattttttcacctctccttatgctatttcttctttctacgaagagccatcgcttcacgacgccctgttttcatagactgggttaatcttctctttgccggacagatgtaagaacagcatccacattcaacacattcacatccgttcagctcgtcaaataatgcaaaatctccatgatccgcgatctctgaaagctttgtaggcataagacctgcaggacaaacagaaatacaacgaccacagcgaatacagttacttggttcacatgcggcaacttcgtcttttgtaaaacataaaagagaagagaacgtttttgcgcaaggaacatctaatgtagataatgccatacccatcataggaccaccagaaatcactttctctggctgagacttaaatccaccggctgcttctactaattctgctgcatttgttccatttttcaccttgaagttaccaggatttttaatggcatctcctgttactgttaccactctctcataaagaggttttccaagagtaatcgcctcatgaattgcaatcgctgttgcaacattatctacgatacatcctgcatctgccggaagcatagaggaattaattgcacgacctgtcacagcataaattaaagaacgctctgcaccctgtggatactttgtctttaatgctgctacttcaatacggctttcacttttacacatttctgtcaacttagcaatcgcttctggcttattatcttcaatgccgataacaccttttgctttcgggaataaagaaagcataatattaagaccagaaataagctgttcaggaatttccatcatacaacgataatctgcagtgatgtatggctcacattctgcagcattaataatgatcgtatcaattttgtccggttcctttggagacagctttacatgcgtagggaaaccggcaccaccaagtccgacaatacccgcttcttttactgcattgataattgcttcatttgttttttctgttactggttgaaaagaaacagtttcatactctccatcattctctacaacaacagcgtttaccttattaccggaaactgtcattctaggttcaatcttctttaccgttccagaaacagagctatagatgttggcagaaacaaatcctccagcctccgcgattttctgaccgactaatactctgtcacctttctttacacaggcaacggcaggagcaccaatgtgctgacttaaagggtataccagctctccctgtggtaaatattcagtaattggtttatctttacttaactctttaccatcatacggatgaaggccacctttaaatgttagtagtcccatttttttaccttctttctaaaattttttaaatcaaatagttcatgcacaatatcgtaagttttcgcatagattcttacaaaagcatttcaaatttgatataaaattcattctatataatataagaaaaaaatgacaaaatcaagaatcgtcatatttttaacgattggtaactttgtcatttttcttaatatatacaaacaaaattcacttttatccgattgttcgattattattttgtgtagttttacaatactgtatttgaaatagaacaatattgtatccaacatactatattattgttaaataataaattatgtcaatttaaattacttgctgataatatctatctgattctctttctgcgttccatcctgatcaaccacttcaataacaactttatgaggcagacaaacaatggtctcaccctttttactgattgcggcatgatttacacaaatcttatcaggacagtcggcttttatcatactgacctttccattctttatctcaagaatattctcccagtcatcttcttcaatacgaatcgtctgatttttatttaaagaatagcttccaaattctttattattcacacgaacctttaccaacgctccactcttaccatgtagctgcataaaagaaaatgttcccagcccgatgattagaaagaataatatcagaaaaatatcattcttataagactttttagttaaatccgatccatttctgagcaatcttatatcctcccatcgtgagcttatgactcagcttattgtgggacttagaaatctttccaagaaccgaacttttcaatgccttatagccttctggagatttttcttccagataatgccacaaatcatctctcatcttctctgattccggtgtattcatcttcatcaaaagtacagatgtcaccatctgaatcgtttcaagataatggagcatatactctttaagctgcgggcaggaaaatgtactttcatgcttcgcataaagatcaatcataatctcattcacccgaatctgctgatcgattcttgaaatcatgaccgtttcattaacagactggtcatcgcgtccaataaaatatcgataaaaatccacatcaagataatacatcttctttacgtatggcaatggccagtacacaaaaatattatctacataaaatgtatgttttggtaattcaaaatgaaaacttctcagcagctctgtacggtaaattaccgaatgcatcaaaatattctgactggcatggaaatgtccaatctcatcccatccaaaataacgattctccggcaggatagaatgatactgaatcacttttttatgcttcgctcctaccttttcatatacataattagaaagaagcatatctagcggttcttcttccttcatcgcctcttttaaaaaggcaagtatcttctgataagattccgcatctacccagtcatcactatctactactttataaaagaaacctgtcgcgttacggagcccagcattcactgcctctccatgaccaccgttttcctgatggatcgcacgtacaataccaggatatttctcctggtattcatccgcgattacaggagtatcatcttttgaaccgtcatcaacaatcaatatttccacatcttctccaccaggaagaagactttcaatacagtttcgcatataatccatagaattgtaactcggaattgcaattgtcaggatcttcatgaattacctcctttggtatccgtattatttctcaaatccacgatagatgatatcatctcttccaggaccgttagaaaccatagtgattggatatccaatatgttcttctacgaattcaatatatttacggcaattctccggtaaatcttcgtatttcttaattccgcggatatcacacttccatcctggaagtacttctaacacaggttttgccttctctaactggtttgttacagggaattctgttgttacttctccgtcaatctcataacctgtacatacagggatctcatcaagatatccaagtacatcaactactgtaaatgcaacatctgttgttccctgaaggcggcatccgtacttagaagcaacgcagtcaaaccagcccattcttcttggtcttccggttgtagctccaaattctccgccgtcaccaccgcgaacacgaagttcctgtgcttcatcaccaaagatttcacttacaaacgcacctgctcctacagcactgctgtatgccttacaaacagtgacaaccttcttgatctcatatggagggatacctgctccgattgctccatatgctgctaaggtagaagaagatgttaccattggataaattccatgatcaggatcttttaatgttcctaactgtccttctaataaaatattcttgccttctttgattgccttatctaagtaagcagatacattgcatacataaggagcgatcatctctttatattccattaatgtattatacaattcatctgtatcaattaacggtttatgataaaggtgctctaataaaatattcttctgtacgatcacacgctcaatcttctctttcagttctgcctcttcttcaaataattcacttacctgaaaacctactttagcatacttatcagaataaaatggtgcgattccggactttgtagaaccaaatgacttaccagctaaacgctcttcctcatattcatcaaaaagaatatgatacggcattacgatctgtgcacgatcagaaattaaaatcttaggttcaggtactcccttagaagttatttcctttaactcgttaaaaagtacaggtatgtttaatgctactccattaccgatgatacttgttgtatgatcgtagaaaatacctgatggtaatgtgtggagtgcaaactttccataatcatttataattgtatggcctgcattggcaccaccctgaaaacggataataatatcagaatcctgtgcgagcatatcagtaatcttacctttaccttcgtctccccagtttgcgcctacaattgcttttaccatgagctcattcctcccagctttaaaaacttagtattttatgggcatggcctgacccagtgcccaaacatatttcattataacttactttcttttataagtaaagaataattctaattacaataaattacttttctttgccattctgacaagcagatgtccttttggaaactttcgaagctctgcttctgtaattccctttaactttaattccagaacaaaatatacgataactgcaaataccacagaaatcataagacagataaataccaatatccttaaatgaataaaacttcccagtactcctgataagatcagataaataccctggtagaaaatataacataaaatacccattatcgcagagcagattactggaataataaatgtctttttcatttcctgacgatatcccagatacttacgcacacttaaattattcagtaaacacataaggaatgcatagaacatcgtagcaagcacaagggcatataaatccaaatctgtaaagtataacagtggagcaagcaccaccacatgcaggaaaagggcaatggctgcattccgcagaggaatgtttacttttccgattccctgcaaaacaccattgcttactgtagatagtgcataaaaaataatactgatacatcccacacgtaaaatacttaccgccaaatcaattgttgccttttgaggaaataaaacttccataattggataagcaagcgctcccatcccgattgctgccggaatgctgataatcattgtaaaatgaatagcttcctttacatgtgtattacattttttataattctccagtgcatagcttgaagaaatcgccggaatcattgccgtagacatagaattggcgatagcgacaggcatattaataagaactgtatattttgtctgaaatacaccatataaagatgctgcaattcgggaattcatctttttaaatcccataacatccataaataatgtctgatcaacaaccgtactgatattatatacaaatgtacttaagatcaccggagtgaccattaaaaagataattttaaaaatatctctgtaagaactatctacgccagaactatccttctgtatctcttttctaaaatactttttattacaggaataaataaacagcataaataacagtccggtaattactcccgcaccgatacccgctgcacttcccatcgcaccaaatactggaactttatctgcgtctcctcctgcaaatatatggatgaataaaagagctgctccaatactgatgacggcattcgctacctgttcaataatctgagaaagagaggtcggaaccattgttccatgtgcctgaaaatatcctcggaatacccctaaaaatccagagaaaaaaatggttggcgctaaaattctaagaacaggaattgcttttggctgattcgaaggaattaatatggaagcgccaaagaatgtaatgagactggcaatccctcctacaaccaaaacatacataagggcacatttaaatactttatgtgcattacgatactggtgtactgctaatttagatgagacaaccttagaaactgccatcggaatactgtaagaagatactaataatatcatcgtataaatattcactgcaataccataatatccgtttccttcatctccaataacacttgttaacggacttcggtataatacccctataattcttgttataatgcctgcaaccatcaatatcgatgcctgcgcaagcacatttgtttcttttgtatctttgttattcaactgacaaccacctttccaactttaagggttccttctcctgttactgcattctcacataatttaagggttatcgttaccgataacccttagtattatacgtatttctttatagcatgtcaatgcgaagtttacacattaatctctgctttcattccaagaatatctttattctcatcaagcacaggcttaacatattcgctgataaactcctctgtttgttctggagctcttcctacaaagttttctggtttcataattgcctgaagctgatccattgtcattccaaaagctgggtctgctgcaattctttcaagaagatcattatcttttccttcttctttaacaacacgtcctgctgccatggaatgctggcgaattctttcatgaagttcctgacggtctccgccggcctttactgcatccatcatgatattctctgttgccataaatggaagttctctcataagatgtgctttgattacctttggatatactacaagaccatctacaacattaagataaagatcaagaataccatcgattgcaaggaatccttccggtacagaaagacgtttgtttgcagaatcatccagtgttcgttcaaaccactgtgtggatgccacaagcgcaggattcattgtatcagacattacataattcgccagagaagcaattctttcacttctcattggatttctcttgtatgccatagcggaagaaccgatctggtgcttctcaaatggctcttcgatttcttttaaatgctgtaaaaggcgaatatcattagagaatttatgtgcagactgagcgattccggaaagtacgttcaatacacgactgtcaaccttacgggaatatgtctgtccggaaacaggataacaagcatcaaatcccatcttctctgcgatctttccatcaattttacggattgtctcatgatcaccgttaaataattctaagaagcttgcctgtgttcccgttgttcctttagaacctaaaagcttcattgtactgataacataatctaaatcttctaagtcaagcataagatcatgtaaccataacgttgctctcttaccaacagttgttggctgtgctggctgaaaatgtgtaaatgcgagtgtaggaagattcttatacttcatagcaaagccagaaagctctgcgattacgttaaccagcttgcttcttactaacttaagagcctctgtcataacgataatatctgtattatcacctacatagcaggatgttgctccaagatgaatgattccctttgcatttggacactgcacaccatatgcatatacatgagacataacatcgtggcgcacttctttttctcttgcttttgcaacatcaaagttaatatcatcggcatgtgccttcagttcctcaatctgctcctttgtcacactggaaagacctaattcatattctgtttctgccaacgcaatccaaagctttctccatgttttaaactttttgtctggagagaaaatatactgcatttctttgctggcatatctttctgaaagagggctctgatatttgtcgtacattgtttttacctcctgtggtaacttaattgttatcgcttttcttctctttatattataaattataaaataaaatctatattttcattcactacttctatgatgattttggaactctttatccctgttctcctctgatatcctgtgtcggtggctcgattggataatttccactgaagcaggcatcacagtatggtaagccctcgtttaactcttttaaacgatccatatgaaggtaagctaaagtatccgcttcgatactttcacagatttcatccagagtcttgccatatgcaacaagctgatcttctgacggaatatctgttccaaaataacaaggatgtaaaaatggaggagaactgattcttacatgaacttctttggctcccgcatcctttaacatacgaacaatacgtcggcaggttgttccacgcacgatagaatcatcgatcatgacaattctctttccttttacggcatccttcaatacgtttaactttacctgtacactactctcacgcatactctgtttcggcttgataaaggttcttccgacataagagttcttaatgaaagctgttccgtaaggaatccctgattccatggcataaccctgtgctgccggattacctgattccggaacaccaacaaccatatctgcatctactggcgaatccattgcaaggaactttccagctttaatacgactggcataaacaccaacgccatcaattactgcatctggtcttgcaaaataaatatattcaaaaatacatcttgcctgcttcgatgggtctttaaaacaaagttctttgttagactcaattcccttcggagtcagagtaactacttctcctggttctacatctcttacaaattctgcaccaactgtatcaagggcacaggtttctgaagtaaggaaatatgtattatctctttttccgatacaaagtgggcggaaaccaaatggatctcttgcaccaatcagctttcgcggactcattacgataagagaataggcaccctttaacttgcgcattgctgctaatactgcttcctctgctgttgcagcaaaaattctttcctttgccacatgatacgcaattacttcagagtcaattgttgtctgaaaaatagcgcctgttctttcaagctctttacgaagttcgagagcattcaccagattaccgttatgcgcaagtgcaagcgtacctttataataattcagtactaatggctgtgcattctctctggtacttgaacctgcggttgaatatctgacatgacctacactgatattcccctttaacttttcaaggttctcactgttaaacacttcgttgacaaggcccattcccttatgaacctgaatgttctttttaggaccattggtatccgaaactgcaataccacagctttcctgtcctctgtgctgcagagcaaacaacccataatacaccgttgaagcgatatcattgccatcaaaatcatatgctccaaacactccgcactcttcgtgaattccagaatccacacattcttcagaaaactgttcttccatatcaaacgccattttcttcctccataatttcattagtgaattaatttaattagcatattaaaacgattgtatactaacataaaataagggtctatacaagccatttctcataattcagaaccattcacaaatttttcgtatattttacatagtattttttatgaatcctacagattactttccttcattatgccgaaacaactttgaactttcaggaagaatccctcttttaatctttacggaaaggacacgacctgctgcctcatcaatctgactctctgataaagttccatctttaactgcttctaaaacaccttcaaatgcctgctcaaaattatctggcataagaatcatatcgtttcctgcttcgattgccatgacagcagcctggtctgcatcataaaactttgtaataactttcatattcatagcatcggtaataatgacattatcaaactgcagctcttctcttaatatatcagttaccataagctttgtcagggatgccggtgtttcttttcccgtaatctggcttaccgctacatgagacatcataaccatatccgcaccagcagaaattcccgatttaaacggaaggaattccacatcacgcaattggtcaatggttgcattcagttctacatatcctttatgtgtatcttctccgcactgtccctgtcccggaaaatgcttcaatgtagcacttactccctgtgcctgtaatcctttcacttcctgagagaccatatcagctactgtttttggctcagaaccaaaacttctatttcctatctcggtattttcagcatttgtattaatatctgcgactggtgcaaaatccagattaaatcccagttcataaatttcttttccaatggtttcccctacgtgatatgcatttttgctgtctccggtctttccgatttctgccatagccggaaactttgtcgtttgcatatttttagagttcgcaattcttgcgacggaaccaccttcctcatctaccgctgtaaataatgggatttctgcggttttctgcatatctgaaatcatttcttttacctgggtacgattttttaaattataagaaaaaaagattaccccacccggtttatattcctcaagattctttctcatcttctctgttacttctgtttctgcattaaaatcaagggagtctgtacagacaacaaacaactgaccgattttttcttttaatgtcatcttagaaagggcatcggaaaccattccatcaagagtaatctcatccacagccttatcttcagaagatttcgtactattttcagatttatcttttccctttttactccatccacaccctgcaagtgcccctgttaaaagcatgatacacagcaacagcactactcttttataattcttcattctgcctcctgcggtgaaaatagtgggtcaaatgtacgctttttgcgtactttttcttttgattcatttgcagcggctatcgcttcttcacaaaacgttttctgtgcttccactgcttcttttccacgtcggtctacttttcggtacgtaccatcttttaaaagacaatgtgcctttaatgtatcccgaagctgtacatccagtatatgttttgccttttcttttaaatccggtgcttcaaccggaaagacaatttctactcgtctgtcaagatttctaggcatccagtcggcacttcccatatacacttcttcatttccatcattataaaaatagaaaattcttgcatgttcgagaaatgtacctacgatagaacgtaccctgatattttcactaactcccgactttcctgcaacaagacaacagattccacgtacaattaagtcaatctgtactccggcacaggaagcctcgtataatgcgagaataattttacggtcacaaagagaattgcattttgcaataatccttgccggctttccttcctttgcattctgtgtttccctggcgatcatctcaagaaaacgctttttcatccagataggcgctacgatcaactgattccagtttgcaggttcagaatagccgcttaacatattaaatactgctgtagcatcttcacctacagcatttctgcatgtaaacataccggtatctgtataaagctttgccgtagaatcgttataatttcctgttccaagatgcacataacggcgaattccatctgcttctcttcgtacaacaagcgcaattttacaatgtgtctttaatccaaccaatccataaataacatgacatcccgctttttccagttttctcgcccagttaatgttattctcttcatcaaatcgggcctttaattctactaatactgtaacctgctttccattctcagcagcctgtgcaagtgctgctataataggggaatgtccactgacacgataaagtgtctgtttaatagcaagaacgttttcgtcttcagcagcctgtttaataaaagcaacgattggatcaaaactctcatagggatgatgcagcaatacatcgccctttcgaatctgattaaatatatttttatctgcccgcagctttttatttttctgtgggatataaggagcctcttttaaatcttcaaacccttcaatcccataacatttcataagaaaagtaaggtcaagcggtccattaaatgcgtacatatcacaggaatgaactttaaactgcttttttaaatacttcacaagacgtttatccatacgctcttcatattcaaacttaataacttctccccactgtcgcatttttaacgacttctcgatttcttttaataaatcttccgcatcatcttcgtcaattgataaatccgcatttctcataatacggtaaggcgctgaacagataatctcgtgattgaggaacaggacatctaaataatgttctattacattttccaataaaatgactctgcattttctctttggtccatctttctggggaagaagaattactcttggaagaacagaaggtacctgcactgtcgcgatatcatattctttcttttcctttttatctttattgcggctttttatcaatgcggcaatattcaatgttttattctggattaaaggaaacggtcttgaagaatcaatcgccatcggtgtaagaaccggatatatatttttgtgaaaatattcttcgagaaagtccatttctttttctgagagttccgaaaaagaaataatttccagcccttcctccgaaagtttcggtaacaatgcacgattataggttgtatattgtttctcacaaaatgcctgcattttttcattaagtgcacgtaactgttcctgcgcagtcattccggcaatatctttcttctgatatcctgcattcaccatatcttttaaagatgcgatacgtaccataaaaaattcatccaggttagaggcagtgatacttaaaaacttcattcgctcaaacaagggatttttgcggtctcttgcttctccaagaatacgctgattaaattccagccaacttaattctctgtttgtaaagttatctggttgatcaaaaacacttttgttcatattctacctcccctataatgctctccgctgcttcaatactggtgtgatgcctgtaaattcgctaaacaactccgcttttttagaaaatcgggtaatctcgagtgtaatatcctgattcgtttctaatgtgataatcagttcttgtccttttctcatcatagaacaattttcaaacttttgcttatgtccacgatccaaagcatttgccagcctcaaaatagaagaaagtttggcaatgcgaagatattcttctctccaaaaagcggtttcaagctcatccgtatccggtagttcctgcgtattatagagaacaatatttgcaatttcttccctttcccgatgggagagtcccatgatttctgtggacatgattaactgatatccattctttcccggatcatttagatttacatattttccgatatcatgaagaattgctgagatttcaagaatcagccggtctctttgtgtaagtccatgaaacctttttgttttatcaaatatttccaatgcaagttccgcgatatactgtgcatgaatcttactgtaacgataccgcttaccaatatatctggctgaagcgataatatcctgatagaaatcatgcgaaacttttatctttttcattttttgcgcataatctaccacactgccgtcacacaaattcgtagaacagatataaatcgtgtctgcctttgatcgttctaaaaatgttttataaacgagaactgacggaagtaccatccgcgcatcttccatagaaagtccatactttatagcaatatcctgataggatgcctttttgatctttttataaatatactgaatctgctcgtaactcatcgtatcctcaagatggagttccggcacaagacgattaatattcttgatttcatccccgatggcaatgacattcttaatatccttatcttttaagtagccactcttaaacatatctacttcatattgaatatattcttccaatacagaaatgtaatccagtacattattttcaacagattctgagaattcccgcaccttcgctgtaccaatatcaaggttctgtgtcatgtatagcacctgtttatcaaacaaggatatctgtacactacctgatccaatatctaaaattgcggtattcttttcaataatcttattgaaatccagctttaacacctgtattcccttatacataagaaaacggagttctgaattgctgagcatgataacgtcaattcctgtacgaaccttaatctgattcagaacagatacctgatttttagcatttcgaatcgcacttgttgcataacaatgaaattctgtaacgtcatactctttcattctctgttgaaactgttctaatacactgcatatttcttcaatctgagcaaaagtgatctttcttgtaaaatacgcttcttttccaagttcatattcataacgaatctcatctatcgtacgaattccttttgcagcagaaatttcatatactttcataagcatatttttagaacctatcacaatcgctacatatggactcactctcatttgcgcctccttttccgtatcataaaacggattctgccttcaattctttccctttctattttttctgtttttcatccagataaaagaaagaatccactgtatgttttgtatcgattaaattattatattgtaatatctgatactcttttaccatatcgctataaggcgattctaacgcagactcataatattttccattcttatcaaagcatcccattgccgtaagaacaggaagttttttacgaagttttaataaaaacttctgataagggctggtctctaagcccgcttctttcattatataggcgcttaaataattggcactcatcttatcaattgttgtttcctttatatcatagtttgcccaaataataaatggtgttctgtacttattcatgagttcttcatttgtaaggcttccggcattctttccaaacaagctgtcataaaaactactctgcacagccggctgatgatcgccaaacataacaatgatcgtaggttcttttacttttgaaaaatagtttgtcaactgtttaaaagcgttatctgtttttttcacaagagacagatactgttcagcctgctcatttttatggctgtcagtaatctggatatcattatgaaaattcgtatatgtcttgtcaaatcctccatggttctgcatcgtgacattaaatagatagaatggttcctctttctctgtacggttctcatataattcttctatctttttaaaatcagacttatcggatatatattttcggaacattttcggatttttaaaatcggtttccgaatagaaatgatcaaatcccatataatcatagacctgcacacgattccatccggaagcaagatatgggtgaagtgccagattgcctttgtatccctgtccttttaaaagatatgtcatattaggaagttttgcctttacaacctgcgtgtaagcgataattccattctgcaagaaagacatactgttccctgtcaaaaattcaaactcagaattacaggttcctgaaccaaagattgacatgtataaagaacctttaatcgtatttttctttaaactgtgaatatatggcatataatcttcatttgtagaaaattcgttaataacactcaaatcagaaaatgcctcattcataatgccgataacatttggctttgtcccatcagcagtttgaagacggcctttcttctttccagaatcatcatttgcaaacttctcttcatatttttctgcaatgtcttgtgctgcttccacagaataatctgaaggtttttcctgtacaagtgagttcatatttaaaacaaaaccaaaaaacagaccgtttttagcatatccttttttctgatcccacacattatttttaattccaaagctttttaatgttttttgttctatgacaaaatgtccgagtatagaactaagcagaccaattactaccagcataacaatacgctttttccaggtcagcttctttgaagacggacaacgccataatacagccagatacaatagcaggaataaaacattccatacaaaaattggctgtatgctgtatgtgtaattttccgccacgttcgctgccgtctgtgctgacataatatctgacggaacaatcggcgctcctttaaagcttaatacatagtaattggcaatcccgataatacaccacaaaatgcttccaaccgtaacggatacttttcttgaattaaatataagatataataatccaaaaaagagataatacaccagtatattcaaccagaactccgcctgtctcattcgaaggattggattatctgtaaatcgttccacaaaccagaatgtaaataggggtgcagcaaaaaataaaatctgtcctattactttttttgctgcctccggagccggtaatgcaaaccataaaaggaaaagcactaatgccatcattacacagattcctgcccactgccgataaattgttaccggataatataatttagaaacaaggtatttgccctgttcttcctgattaatctttaatttaccgcgaaaaccactctcttttgttgtccactgaaatactaatggttcttttccagattctgctccacttgtcgtaagctgaatactgtactctttctttttcgtaagctgaaggttcgtcttaaactctgtataatcattatttaccagatcaccgatattctttttaagctccaccagactctttccggtatttaaatcaataatattaagaactacctttccctttgcctgtccggaataatcatttccaaaataaacttttactgtttttaaatgcttatgctttgccacaaatttctgactcactatagaattggatgacaactggcagacctgatcaatccgatatttatttacctgatttgtcgcattcttctgatattccataaaatgagtacatacatacccggtgaggaaaagaagaaacactgtaattattgtctttaaaaccagtcctataggatttttctttttcacatgcttattttttactgtttcactcatgtactctatgctccttttatagaccgtttaatagtttcctaaaattttaaaatctgcaacttccgtacgaacaccctgaagtgcatttttcactgccgggtcatgtaagttcccgctgatatcaatataaaaacgatattcccactgctgatccggcaacggaacagattcaatatgacttaagttcaaatcattatataagaaatgagataatatattataaagtgttccactctcatgaagcagagaaaaagaaatactgatcttgtttgcattctgtgtatattgtctttttttggaaagaatcacaaaacgtgtgacattatttttatcaaaattaatacctgcatctaaaatatcaagaccatagagttttgcagcacggcggcttgcgattgctgcctgtgtcataatcttttctctggctactctttctgctgcaatggcagtattttctacactgactttctttacatcaagcttttctaaataaggagtacactgcatcaaaccctgcggatgagagagaacaagttctatatctttaatcttgctaccgggacagcctaaaaggcagtgctcgacttttacaaaaacttctcccaccatgcatacatcattctcaagcaggatatcataaacgccggtaacatctcctgcggaggaattctcgattgggagtaccccgtaatctgcatctccgttatttaaagccattgcaacatctttaaaattaacaactgcataatggtcaacatctgccccgaaaaacttttcgcatgccatctctgaaaaagagcctggaacacccggatataccactcttgtgtccggaaacataacaagttccggaacttccgtaaaataattttcaatataacggtctctctgatgtaccatatgatattgatactttcgactaatagacatcatctgaataaaaatttcttccaacccttttacgacaaatgggttagaacggttctttgtaatatcagacatcttttcatcttctttatttttattataaatggattcgccgaaggcttttttagaaagcgccaattctgccgcaaatcccattcttttctcaaacagttctgcaatttgataatctatcttactaatatcatctcgtatatcatctacttttcttatttctttgtccattctataactgcttcctttattgttcttttccttttaagtcctctaaaatatctgcgtatcttcttcgttctaacggatgtattcctcttggatataacatgcatagtggttctaatacaaaaagccgctttgtcatctccggatgtggaagggttaactcttcatcttccgttattagattatcatataaaaggatatcaagatctaatgttcttggtccccagtggatttctcttttacggtttgcttcattctcaatctggtgaagcttgtcaagaaactcttccggagtataaagggtttctatataatatactgtgtttaagaactttccctgctcggtataaccataaggctccgtctcaataatggcagcagacttaaaatttcttgtcttgggcaatccacttacccgttcttttgccagtttcatatattcttcccgctctccaagattcgaaccaacaccaatatatactttatgccagctcctcttaattttaacggaagcatagtccatatgcattaatactggcgcccatggctttttcacttcaatctctacttcatttatctgtggaaattgtaaaagaatacattcggcaagacgttcagctactctttctaaaagcttatcattttgctttgtcatctcttttttaacacaccgacagatatctccataacttacagacagagcaagttcatctgttttaccagcttctcttgtatccactttagatataatatctaccagaaacttctgtccaagaacattttcttccttgtacaccccatggtgacagaagacttccagattctttacacttatctcgtccatttattttgcctccagaattgcctcgatcattttcatttctctgtaatttgtctttacatcatgtacacgaaaaatagaagcacctttcattcttccaagaaccgttgttgcagcagttccctcttctctttgatctaccggtaaatccaaagcaagaccaatcacagactttcttgaagtgcccaggagaaccggaagcccccatcttgaaaaaacgtccatatgcttcataatagaaagattctgttcaaagttctttccaaaacctacccccggatcaagaacaattctttcttccttaattcctgcttttttcgcgatagcaagtgtttcttctatatctgagcaaaaatcttcaataaaatccttatattcatgattatctctgttatgcatcagacaacagacaacatcttctttcgcaagcaggggagcaagcctttcatcccattttaatccccagatatcattaatcatatccgctcccgcagcaattcctgctttagaaacttcgtatttataagtatctaatgatatcgcaatatcaaaattcttttttatggcttcaataaccggtacaactctttctatctcttcctgatctgtaatctttttgtgtcctggtcttgtagattccccaccgatatctaaaatagctgctccttcatttatcattctttctgcctgctttaatgcaagatccacagactgaaactttccaccatctgaaaaagaatccggtgtcacatttaaaattcccatgatataccctttatgtaaaaggtcaaattcgtactttcctattttcacaatatatcctccatttcttccataaaagaaagggatccacaagccacaagtacatcatccggcttagcggtatccagtgcccgaaaaactgctgcatttacatctgattcaatcgtgacggaaacatctgccacttcttttatcgtatctgctaaaatctgcgctgacaatcctctttcattgtttggcttaaatacataaacttcttttgccatcggcataagatatcggagcattttcttatattctttatcctttaacactcccattatataaatgattttcttatttgtaaaatatttttgtaaaaatgcagctaatttcttagctccatccgggttgtgcgccccatctctgtaaaataggggttctttttttagaacttctaatcttcccggccagcacgtgcggataatacctccttgctgtgctgatttcacattcatctcatctaattttttagcaatagctttccttgcattatttttctcataatctttacgaaataaatattcggatgcggcaagtgctgtaaccgcatttgaaacctgatgtctccccggaagctttgtctcatacctttgttctttccacaaaaacgtacttccataaggggtctccgatagtacctcatagtccgtcggttttatctcaatacattttacctttttcttcgttgcttcctgctctataactttacaaacttcatccgaattctcagataaaacaaccggacagctctcttttataattccggctttttgccaggcaatctcttctaaagtatcacctaaaaatgcctgatgatcatagcttattgatgaaataacagtaagttctggatgcctgattacatttgtcgcatccattcttccacccattccgacttcaatcagtgcataatccactttttcttccttaaaatacaagaaagaaattgctgtctccacttcaaaaagcgttggttttagacctgttttttcttcttctcttttcattgcttcttctacaatattatataaccgcgctaacttatcttttataatatattccccattaatctgaaatctttcttcatagcaggaaatggtaggagaaatatatcttccaaccttaaagcccgctgctattaatatagaagaaagataagcaaagatggagccctttccattcgttccggcaatatgcacaatctttaaattatcttccggatgcccaagttcttctaacaaaccctcaatggcatcaagtcccggaacactgccccttttttttaactcttctattaaagaaatgtaattcatctctgatgctccttcattttactgcgtatacaatcgaggattatcatagcacactatgagaaagaaatccagcgtatgatttgattcataagatagaaattagaaaaaacgaaccccgaagatacgatatactaccttcggggttcgttttttaatttatttcttagtctgtttcttaaacttcaaagattaaatcaccataacttgggaatggccatgcggattttgcaactaacatttcaagcttatctgctggttttcttaactcatccattgctgcaaatacaacatcatgataataatgaccctgttctgcaccttcttccatttcttctgctttattcgttacttcttcaagatgtgcaagagctacgtacatcgcctttaagttaacagaaatatctgccattaatgcttcctgtacagaagtatctacagcactgcttgctgccttgatcgcattaacagattctgctaagcttgtctgatacttaattgttgcaggaacaatctgtttctttgccatatcaatcatggttaatgcttcaatattgattgtcttagcgtatgtctcatacataacttctgcacgagattccatctcagcctttgtatatacaccatgtttttcaaagatttcaacggcatcctcttttactaaagcaggaacagcatctaccatacatttgatatttggaagtcctcttctctgcgcttcagcaacccattcatcagagtaaccattaccattaaagataattctgttatgtgctgcaattgtatctttgatcatgtcatgaatagccattggtaagtcatcggatgcttccagacggtctgccatgtcagataatacttctgcaacaattgtattaagtacggtgttcgggtctgcaatagactgtgtagaaccaaccatacggaattcaaacttgttaccagtgaaagcaaatggagatgttctgttacggtcagtagcatccttctggaaatgtggaagagaatgtacgccagagatatattcttctccctctaaagaacttgtagcctctccattatctacgaactgttctacaacgtcctctaactgttctcctaagaagatagaaataattgcaggaggtgcttcattcgctcctaaacgatgatcgttacctggagtggaagcagaaagacgaagtaaatctgcatgttcatctactgcacgaagaattgcagcaaggaataataagaactgcatattttcgtgtggtgtttcacctggatctaagaggttctccccttcatctgtacagatagaccagttattatgtttaccagaaccattaattcctgcaaatggtttttcatgtaagaggcatttcagacctaattcatctgcaacacgctgtgctgtttccattactaactgattatggtcagtagcaatgttgttctgatcataaattggagcaatctcatgctgagctggtgcaacttcattatgctgtgtttttgcagaaataccaagcttccataattcctcgttgaatttctccatgaatccaagaactctttctggaataacaccaaaataatggtcgtccatctcctgtccttttggaggcatcgcaccaaataatgttcttcctgtaaagattaaatcctttctctttaagaatttttctttatcaacaaggaaatattcctgttccggtccaacggatgttgtaacatgttttgctgttttatttccaaataatcttaaaattcgaagtacctgtatctctaatgcctgcatggaacgaagaagaggtgtcttcttatcaagagcttctcctttataagaacagaatgctgtcggaatacaaagaatagttgaatgtggtgtttccttaatgaaagcaggtgaagtgcaatcccatgctgtatatcctcttgcttcaaatgttgctcttaaaccaccagatgggaaggaagaagcatccggctcacctttgatcagctctttaccggaaaaacgaagtaaagttgttccatcactctgaggatctataaatgcatcatgtttctcagcagtaataccagttaatggctggaaccagtgagtataatgtgttgctcctttttcgagagcccattctttcatctcatgtgcaacaatatcagctacttccgggtcaagttccgcaccggcatcaatggtagccttcatcttcttatatgcagctttaggaagtctttctttcattactgcatcattaaaaacattggaaccaaaaattttcttcacatctgttttcataattattacatcctttcatgtgtattcttttcatcgacaattactgatttttactcgaagattaaaaaatataaaaagcgcccgagaatccttgtgattcgcgaacgccattgttctcatcgagattgaattatttactttttgcaattgctaaatataaaatacctctatttgttaaaaaatgcaagtagtttttctgttttttttcactttcatgaaattagacaaaaacaacttggctttataaattaaattcctatattttaaacaattgacttacttttcacttaattttgttaatccaatctcaaatatcccacaaaaaagcccccacaaaaaccattggcagtatgttgttccggtttttgcgggggatgacgtccaattatcccgctgaatatttcgtaaaattcttactaataattgaatttttcagcgaagtaatccttcaaatcttcaatcttaattctttcctgttccatggtgtcacgatcacgtactgtaaccgcaccatcttctactgaatcaaaatcataagtaatacaataaggtgtaccaatctcatcctgacggcgatatctcttaccgatgtttcctctgtcatcaaattcgcagttataaatcttacttaattcatggtaaatcttttcagcaccttcattaagctttttagaaagtggtaagataccgacctttacaggtgcgattgccgggtggaaatgcataacatttctcacatcaccatctttaatctcttcctcatcatatgcagcacataagaatgctaaggttacacgatctgcacctaatgatggctcaataacatacggaatatacttcttcttctcttcatcatcaaagtaagtaagatctactttagacacttcctgatgacaagtaaggtcataatctgtacggtcagcaattccccataactcaccccatccaaatgggaataagaattcaatgtcacttgttgctttagaatagaaagataattcttctttatcatgatctctgattcttaattcttcatcttttaatcctaaatcttttaaccagcttacacagaagtctttccagtatgcaaaccattctaaatctgtatcaggcttacagaaaaactccagctccatctgctcgaactctcttgtacggaaagtaaagttacctggtgtaatctcgttacggaatgacttaccgatctgtccgataccaaatggaatcttcttacgggaagtacgggctacattcttaaagtttacaaaaataccctgtgctgtttccggtcttaaataaacagtattctttgcatcttctgtaacaccctggaatgtcttaaacatcagattaaactgtctgatatctgtaaaattatgctttccacagcttggacatggtatattattatcatctatgaacgctttcatcttctcctgagaccatccatctacagaagattctaattcaatatcatgttcctgtgcaaagtcttcgataatcttatctgcacgaaatctttctttacactccttacaatccattaacggatcagagaatcctccgagatgaccggaagcaacccatgtctgtggattcatcagaatcgcacagtcaacacctacgttataagggctttcctgaatgaacttcttccaccaggcttttttaacattattctttaattctacgccaagatttccgtagtcccatgtattcgccagaccgccataaatttcagaaccctggtatacaaatcctctcgcttttgcaactgcaataatcttgtccattgttttttccatgatttctacctcattttctttattcgatatattctcgtcttttattctaccctgtctcttctgccaatgcaagtcctttttgtcagacataaaaaagattactttaaaaatgacagaactttcctgtctaaggaatagagcttatactatagcaagcatttctgccgccttaaatttatgttcaacatgaactgtaaaatagcgattcactacccactcaaattctttctcaatcgtttccttcaaggcaaaagaatagagctgatttaaaggaacagaggatacatattgtaaaacataaagcacagaagaagaaacttctcttccctgtccttttgctgcacacgtgctgcaaagcattccgccatcttcaaatgagattcggatcagattctcatcatttccacagtggacgcattgaaaacactgaagaccaaatccggcaaactgtaatatctttaattcataaattcttcgtatcaaagataatggtatcagtttctttttcattgcaaggaaagtcacaaataaaagattcagtatatttctctcatcctgaccttccattgtaaaatattctgctacttctgcaaaataggaactataataaatatcctctaaattatcttttaaaaaatgaaaataatctttacattccgcagaatttaaatatgtataatttcttgtatctgtaaccataaattcacaatatataagcggctgtgttacaccaaacaacggatgctttggtcttcgacttcctctggcaaatacctgtaactttcctctttcctttgtaagaatcgtaaggcgtctgtcattctccccaacagggtaaactgacagaatgattcctgtcaccttcgtctgttcactcatcgctgccttttacagttctttcttattatatccatagtttttaagaaggatatcactgtctctccagtcttttctgacctttacccaaagttttaagtttaccttcgtgtcaagcaggttctccatttcctctcttgcctgtgtaccgatttctttaatcatggaaccttttttcccgatgatgatccgcttatgagattccctttcacagacaataaccgcctcaatatctacaatatctctgccttttctattcttcattctctcaataacgacagcgataccatgcggaatctcctggcttaacaaacgaagcgctttttctctgacaagttctgcaacgatctgtcgttccggctggtcagtaatcgtatcttcatcatagtacatcggtccttctggaagatagttaaagatagagtgtaccagatcgtcggtattattcccttctaacgcacttaccggaataatttctgcaaaattacactgatctttatatgcaacaatcgcctttaacacttcttcctctgaagcaatatccgttttgttgataacaaggaaaatcggtgtctttacattctgaagcttctcgataatatactgttctcctccgccaataaacgttgtcggctcgactaaccataaaatcagatcaacctcattcaatgtgcgctccgcagccataagcatataatctcccagcttattctttgctttattaattcctggtgtatcaaggaagacaatctggccttcctcgcttgtatataccgtttgaatcctgtttctcgttgtctgtgccttactcgaagtaatagcaatcttctgtccgatcaactgattcatcaacgtagactttccaacatttgggcggccaataatagttacaaatcctgatttaaaaactctgttcatattttctttttccctctctattgtgtcagacttcttacctgcttaaataattctttctcttcttctaatttacgatcattaccaatcgcacatactgttcctgcatccatcattgtctcaatataacctgcaagagaacgaatcgtttcttccgtagcatcaagaacctgattcctctctttttgaatcatctctactgtaacaccagactggtatgcatgaaaagaacgatctcctaatgcggccggttctaatggctgatcgattccactaatcgttccgataatatattttgtcatatcacgctgtcctgcttcaaaattccttacatactctgctgcctttttatatacatcaagagtcgctgataaattcggatctctataggaagtaaagaaaccgtatccatttctggaaaagctgcacatacatccatatgccccgcctgttacgcggacattcacccaaagataatcataggaaaaaattgtttttaatacttttaatgctccggtatactcttgtccttccttttcaaagcagccaccgcttgctacatactgtaccttacttgctgttttaaatccttcattctttttctccatattgaacgtcggaactgcttttacacaaggcatctcgtaaagcatacggttaaactgtaacatttccccctcaagaagagacttaaaattaaattctcctgtgagagacagtgtcagattctctttacggaaaatacacatctgggctctcaccaactgtttaaccagaagttctgcattactatcaaagttcttatcaagcttctttataaattcataaaaaccgattccttctgccgtatctttatacttcatcatcgggtcaacgtaagaaagcgcacgattagccgcataaacatgtcctgatgccggaattctcgtatccatctttgtccgaagttcagaaataatctcttttaaacgcttcttatcatctacttttgaattcaggagaacttctttaagcaaagtcattccatcagcaacctgttcttccatacacttcatctggatactgaaataaggacgatatccatcttttttccatacaagtacattcatacctgtctggaatgacagccctccgattttcaaattaatctctgttgccagatcattataagaaaaatgctctgtatctacataacgataaatctctgtcaataatgttgcgtatggaatcaattcctcagggagttctgacatatcaaaacaaaaatctgaataaacaattccattcgtatgatattcatgtacaaccgctgttgtatctccaatcaccatctctttatttttaaacggacgcacctctcttgagatgtcactcaggcccaaagtaggaatcttttctaattcttcctgtgtcgatggtgtttcctgaaattcttttaactttttcgtatcttcaattagataatttaactgcttgttatttaatttattcttcatcttagcaagctgcgcttttaattcttcttccagacgttcattcttgccttcttccggatacagatatacatatgctttatgtgtgttatctaaaaaactctctttaataagctgttcaaaataacccgtatctactttttcttttaacgcagcaagtggagtcagcgaatccgcaagctccaacgctttggcatcatcataaagccagctgtttaagaaattgaggccatagatcaatcccttaggaaaacgtccaaaatcagcttctctatacttaaattcataattattgattgcagaataaatcgcctttttattaagacctttttccacctgttccttcagagcctcctctacggtctgaacaaacaaatcttcctttcctttaccagcattctttacgataatagaaaataaaggctgctgaattcctccatcataataactatccacatcttttccaagaccagcatcgatcagcttctttctgaccggtgctccaggcatagtgaagagtacataatcaagaatctgcatagcaagtccgcgttcattatcacaactgtcccctgcagctacattataacttaaatatacgccctcttcttcctcttcagaaacagagtacgtttctttcaatgtctctggagttaagaaaggtttctgtaatgcgacttcagaatcaacgactttcttttcataatgacttaaatactcttcatcaataaattccagttcttttgcaaaatcaacatttccgtaaagataaatataactgttcgatggatgatagtacttactgtgaaaatctaaaaacttctctctcgtaagttcaggaatcgcatccggatcaccaccggactcatatgcatatggcgtatcttttaaaagtgcttcctgaatctttcttgccagaacatcatccggcgaagaaaatactcccttcatctcattatatacaacaccattaaacttcagttcgtcatctctgtcagcaatctcataatgccagccttcctgtttaagaatctcatctctcttataaatattaggatgaaagactgcatcaagataaacatgcattagattatgataatcctgatcattacaacttgcgatcggatataccgtcttatccggatatgtcatcgcatttaaaaatgtattcagcgatccttttgccaattcaataaaaggatcttttgatgggaacttgtctgaaccacataaaacggaatgttccagaatatgagcaactccggtatcatctgccggcggagtacggaatgcaatactaaataccttatttgtatcatcattctctaccagaagaactctggccccagtcttcttatgttccaatacatagccatatccattcagctcttctatttcttccttttgtataaaggaataatttttaaaatctgtttcttttagcattcgctatcttcctcctgctttttataatttacaactattcagaatcatatatagtatgtccctgttttatggcttcctattccaatatgccattatacaatgcactttaaatcatgcagtgaatttacaaatgcattgcagactatttaatatcataacacaagtaaacaaaaaaaagaaggtcttaccgaagtaaaaccttctttctatttttataaaatattcagcaactatgtaggtgacatttcaattagttgttgattttctacacgcctatttatataaggaagaaacgtctatttttcgtgtatatattcttcgattttcacaaaaaataagctgtttttattgtctgtatatttttttagtacctttttagtacttttcacctgtgataatagccacttctgaaaaaggtatactatgcgctttagactattcccggaatgaacttccaatacctaaggccacacgctctgttgcacttgtccatgtatttgttgtggtcaagcttttttataacactttgacctaattattgctacagggtttataccccgtagcgtgcctcaaaaggcgttttataattgttataagaatgcggtcgttcgtgattgtaatgaac

SEQ ID NO: 415 - DNA, 45543 bp, Eubacterium hallii
aaaatcggttgtaaatccttgccgctttgcattctcttcaataaagctgacatcaaactctgcattatgcgcaaccaggctgcagccttcgcaaaattccagaaattccggtagaatctcttcaatcgtccctgcatctgcaaccatcgcatcatcaatacttgtcagttcggtaatccgcagaggaatcggccgctgtggattgacgaatacactgtaatggtctgctatttccccattacttaccttcaccgcgccaatttcgataatcgcatcgtgcagcgggctaaaaccggtagtctccaagtcaaatactacataatcatcaaaaagcgtctgtcctttatcgttcgtaacaagcttttttaaatcatttacaaaatatccctctactccgtaaataatcttaaatggttcgtccatcgtgatacaatgatttgcgatcgggaatgcctgcaatacgccatggtcggtaatcgccatcgccggatgtccccattcttttgcctgattgattacttttttaatgtcaactacactatctaaatcgctcattacggtatgaagatgcagttccacacgtttctcaagacttttatccattcttttttctgtaaagtcaggaatcggcttaataccggaaatagaagaaagggtcagatcgtgctcaaaggtatccatacgaggcattccctttactttataaaactttcctttttcaaataaatctaaaaattccgggagctggttgttggcaataaatatctttccaacaattgtgtccgtaaagtccgtaatatgaaaactgacgatcgtgcgctctcttcggatttccctcagttccatcttcagaatctttccgcgcacgacaacctgtccgatctcgtccacaatttcctccaaaggaacaacttccccatcacaatccttcccataaataacatccggatctttggaacgtcttctctggctaaattcctgccttcttgctcgctcttcaaagaaattaccggaataattatgatgcttcttttcttcttttggcgtttccccttcttccgctccgttctctttcttctcactctccacctttttaatctggctcataaccatatccacttccagattcagcttatgatttctcgccttataaaaagcctgtttcgcatcatcggtaaagtcgaacccaacctgaatctctttgccaaaacgatgagaaaaaagatgttccatatattcttttaaaacccgcgacttatctcttgcaagaaaggaatcttctaagagaatcgtcataatattcccttcaaatccccattctccattcgcaagaagactgtattccacacgccccatgttctttacttcatgaagaatactgccccagtaatcatttgtgatactttctagtgtataagctgcggataactcatacgtatcatcaaatgaaataaaaacagaggtctttccaaacagctcctttttgagatcgtaggcaactttatttaaaacttttctctggataatatgttcactctttaaatgaatcactaactgccttttctgctgcttcattactactttagaaacaactgcattggacaaaatatattttaaattgtcaggaaccgtataatctggaaatacttctggaaatgtctgtccttcaagcatcctttccctcctttccgctctagagcttgtttgaaaaatactttctgtaatctgcacgctctagagcttgtttgaaaaatgctttctgcaagatgtgcgttgcaatttgcgggagatttcgcctgaatgagggcggcgtagcgggctacgtcaactgaatgaaggcaaaatataccgtaaattgaggcgtgcaggttgctggaatgatttttcaaacacgctctagtatactcccggaatctttttgtgcttgattttgtgagaagactccgagagtacattttcaagatgttgcatatatttttattttcagaatacactttaataaatagtaatcggaaggactgttttttttgagtgcaaaaactaaaattgttgttgtaaaagcaaaagagcttatctatactgcattgtttgtctgcctgggtatcatactgatcctccttttgatctttatgtttgctccggaagaaaaaagtacaaaaacaagtgcaggtgtttacacacccggagtctatacttctaccatcgcacttggtgataatacattagatgttgccgtttcggtcgatgccgatcacattacctccgtcagtttaaatcatctgtcggacagtgtcagtgccatgtacccgctccttgagccatcacttgaagaaatcaatgctcagcttgaaaatatttcttcaatcgatgatctgaaattaaattcagaaaacaaatatacgggactgattctccagcaggcaattaaaaatgcgctttccaaagcaaaatcctgacaaagcagcattttaaaacgaaaaaactttacagccccagcttatcctttaactcgtccaattcgctcatccagactgctgaacttgcatcactcggcattcgcaaatctcctctcggtgaaaccgcaatcgaaccaacctttgggccatccgggaggcaggatctcttaaaatgctgtgcaaagaaacgccagcagaatgtacgaagccatttataacaggtggccacatcatattcttctccaaatgcctggcgggtcagacggaaaatcttttccggatggaagccaaaacgaagcatataatataagaagaaatcatgtagttcgtaaggtcctaccaaatcttctgttttctgtgagatcacaccatctaccggtggcagcagttccggacttaccggagtatctaaaatatcaagaagtacttcttttagctcctgctctttgcttgtatctgcgtaataccgtaccagatgtcttacgagagtctttggtacagaagaattcactgcatacatggacatatgatccccattataggtcgcccagccaagtgcaagctcggacatatctccggttccaattaccattccgttcgtctgatttgcgatatccatcagaatctgggttctttcacgtgcctgtgaattctcataggtcacatcgtgattctccggatcatggccgatatctgaaaaatgctgttctactgctttattaatacgtatttctcttaaacttgctccaagcttctttgtgagcgttaccgcattcgaataggtcctgtctgttgtcccgaaacaaggcatcgtcacgcagacaatgttctctcttggaatattcagcatatcaaatgcccgcgctgtcactaataccgcaagtgttgaatcgaggcctccgctgattccgacaaccgcagactggcaatgtgtatgcgcaagacgctttttcagtcccattgcctgaatcgtaaggatctcatcacatcgtctttctctgtctgctttatttgaaggaataaatggtgtgcgttcaaacatccggctaatctgggttctttcttcttttaatctaaaatacactctctcatacttcttatctgcgccctcagtcacaaaagtagtcatccttcttctatctgcctctaatctttgcagatcaatctctgtctcaatataactgttctggaatcttcttgattcctttaaaatagcgccatactctgcgatcatgttatgcccgctgtatactaaatcctgtgtagactctccttcgccggcacaagaataaaggtaggcacagacaagccgcgcagactgctgtgaaacaagattacgacggtacgtatcctttgtcgttgtctcatcactggctgacggattacagattaccgttgcaccagctaatgcatgatgtgtagatggcggcagcggagaccataaatcttcacagatttcacagccaatcactaattcctccatattctcacagcaaaataaaagattcatcccaaaaggtacatcctttccaccaagacgaatcatctttacctcttcttctcccggagcaaagtgtcttgcctcataaaactccgaataattcggcagataatgcttcggtactacccctaagatcttacctccctgtacaaataccgcacaattataaagcttatgattcactgttaacggaagacctagaacagtaaccatatcctgcccctttgttttctctaaaataacaaaaagctgtttctttgcttcatctagtaatgtcttctgtaaaaacagatcattacatgtatatgcagtaagcacaagttccggaaaaactaaaagcttcactccattcttatctgcctttttcattacttctattatcttttctttattgtgaatcggattggcaacttccacatcgacagatgccactccgacttttaaaaagccgtctttcataaaaacctccaaaaatacaaaatgggaatcctaagtaccttagtcttcccattattgtaatcaattatttatcttttggcaacaaacagtatacgaaaaatgtgtatatcacaaaaattgtgacaacatcttcataaaaagcttactcaaggaaatccttaagctttctgcttctgcttggatgacgaagcttccgaagcgccttcgcctcaatctgtctgatacgctctcttgttacgttaaattccttaccaacttcctcaagagttcttgtcttgccatcatcaagaccaaaacgaagcttgattacattacgttctctttctgtaagagaagccatcgcttcttcaagctcttccttcaacatggagaaggatgcggaatcaactggcgaaaggagagactcatcttcaatgaagtcacctaactggctgtcctcttcttcaccaatcggtgtgtctaaggataccggatctcttgatgtctttaaaatctcatcaatcttggcaaccggcatattcatcttcttagcaatctcttcattcgtaggttctcttccgagctcctgaagtaacattcttgaagtacgaagagttttattaattgtctccaccatatgtaccggtacacgaattgtcttcgctgtatcagcgatacctcttgtgatcgcctgacgaatccaccaagtagaatacgtactgaacttattccccttcttataatcaaacttctcaacggccttcatcagacccatattaccttcctgaatcaggtcaaggaaagacattcctcttcctacatacttcttagcaatgctgacaaccagtcgaaggttcgcctcgatcagctgctttctcgcctgctcatcacctttctcgatacgctgcgccagaaaaacttcttcttccgcagtaagcaaaggaatattaccaatctcttttaaatacatacgaaccggatcctctaagcttacaccttcaagaatatccgcatcgtcaataatctctacttcctctgcatcatcgtctataaaattatcatcgttatcttcatcttcgttggtatttaaaacatcaacaccctgtttttcaaaataatcaagaatccactcaaacttctcaggagttaactcgatgttcttaaacgcatcattaacttccttatactctaacacattcttattcttctgtgcctgcttaagaagcttctccataatattcgaaaaaactaatcttgtatcttccattctgttctcccaactttactataccaatctaactgctgtaccatatactaacacttcagcagccccctgcatcacttcactggatgaatagcgaacacagattactgcatctgctcccatctgctgtgcattcttcaccatcttatctgttgcaagctttctggctttctccatcatctccgtatacgaagtcagttccccacccactaaagtctttaaactgttcatgatatccttccctgcatgaacagtctggatcgaagaaccttccacaatacccaacggctcaacattccttcctgcaatctgttctgtagtaactaataacatagctcacctccattaccagtggcgacactcaacctattataatctcatgttatcaacataataccccaaaaaaaagaggttgtcaacaaaaagtgaggagaaatggacgaaaagatctgaaaactacaattttagattttgataaagaagaatttcttccaatattactttttattctgttgtgctaaacgttccattttgcccaatagtacagaaacttcgcagaaatgaatgcgaagtttctatagtcaaaattccacagcacaaaagtcataaaaagtaatattgaaagaaacccttctttcccgtagttcatcgccttgtagttttcaaatcttttctgacctctgcaataccctttttgtgacaaagtagatagggaaatttgtgattgtaatctatagtttgtattacttttctatgtatttctttgcttcatttaatggtagtaagccaatgggttctagctgtttatcctcaacaattttcaaagtatctttgtgcttctttaaaataattctccatacgtaggaacaggtaactacactctttatacaatctctttatataattaatctaagaaatattcctcgtttggagcctttttttgcataaaaatcacagacttctggacaattcccttcttctcccagcataaataactaatttgttatttcttatcaaaaacaaacagccgatgaaacaaaattttatgctgaattgtaaggaaactatggcaaagaaaaaagaattgttataagtattgcattttgtgactttgcgctatggaattctgaccataggaacttgggactcgtttttcccaagttcctgtttttctgggcagaatggaatgtttagcgcaacggaacaaaatctaacttataacaattcttttttctttagaagactgaatacaattcagctcaatatcttctactatagcggcgtctgtgtccccagcaaattattttatctttaagatcttctttacttctttacacatgtctgctgtttcgcatactgtgtcatgcagtactgcggcacttcggatatcttcgattgcctgtggtacttttacgcctgacagtttttctaattcgtcaatgagttcgaaatctgtcttactgtcataagaaggattgattgcattcataacgcttcttgtaaatttatatggacttgctgtagatgcgatcactgtctttgtcttatcgtctgtttctttttcatactttttataaacagcggctgctacagcggtatgtgtgtcaatgatgtaacctgtcttatcataaacttctttgatcgtctgtgctgtttcttcttctgttgcgtagtttccatagaagtctttcatctgttctttcatttcttcggtgatcgtataaacaccgtctgtgttgagttctttcatgaattctctgttcttctcggcatctcttcctgctgtctggtaaatgagacgttctaagttactggagattaagatgtccatggatggagaagatgtgaggatgaagtctctgtttctgtcatagcatcctgtggtaaagaaatcaaaaagtactttgttctcattggatgcgcagattaacttcgcaatcgggatacccatctcttttgcataggatgctgcgaggatgtttccaaagtttcctgttggaacaacaacgttgatctgttctccttcggaaatctctccacgtgccaataatgctgcgtagctgtaaacatagtatacaacctgtggaacaagacgaccaatattgatagagttcgcggaagagaactgatatcctgcttcgttcatttcctgtgcaagagctgcatcagagaacatcttctttacgcctgtctgtgcatcatcaaagttaccttcgattccgataacatatgtattatctccacgctgtgttaccatctgtttttcctggatcgggcttacaccatgttttggatagaatacgataatctttgttccaggtacatcagcaaagcctgctaaagctgcctttcctgtatcgccggatgttgctgtaagaataacgatctcgttctttacgtggtttttctttgcacttgttgtcattaaatatggaaggatggaaagtgccatatctttaaatgcgattgttgcaccatggaaaagttcaagatagtaggcatcctctttctttactaattctgcaatactttctgtgtcaaactttttatcgtaagcactgttaatacagtgttttaattcttcttctgtaaaatctgtcatgaaaagcttcataacttcataagctacttcctggtaactcattgcagaaagttcttttaatgacttatccagctttggaatatatgaaggaacaaacagaccgccttctccggcaagtccttttaaaatagcctcggaagcggttgctgtttcctgattatttcttgtacttttataaatcaaatccatttttacctcctgtatgcagtgtgcgtcagccgcacacaagtgtgtttcacaatcaaataaacgtcacaattatagcataatccaaactttttgtatacgcataatttgcaggttttcattcttatttattcttttttattttttcaacaaaattttcgaacaattcctgcctgtttttattcctttttatcatttattttttattctttattctttatgtttttatttttacgccttttattcttttgcctgcttttccatctgccatactgccagagcaatgaaggcaattcccataagaatacacacgatacttgctgccttataaaacaaaaaagaaaatgtctgtgtagaactgtctattccgattcttccacagtaaagattcatcaatccgctgtctcctgtaatgtttccataataccccatatatgctgccagaggattcaacaaactaaaaagcatacataaattgatagcgatcggtgcaagactttctgctcctgttactgaaatcgaaaatgaccgtattatttccgttgctaaaactgttcctaaaacaaacattgcttcgattgctgtattctgtgcaaatgcccagattcctttcttgcagtaactgaatgaaaaaacagaaattgatgcactccaaaaagtacagatcagcatcatgattccaaggcgtaggatttttcgccatggtaagccactgtagatgcaggacagagaaataatcggtaggcttgatacaaagagcatcatatatatggcaataattacagaaactcttgcgattacaaattgtttggaagaacctggtatcatagcgaattcttctaacatatgcttttctctgtctgtcgcatagaatccccacacagaaaacggcatcaaaacaaaaatcataccaatctgaaaagtgcttatgatcaaaaactgatacagataagaagaggtattataggaatagccttcctgtaaagattctgcattaaaaaacataaataaaattgtgataaatgcaagaattgcattataaaaaataatgatcatcggaagacggacatttcttccttcttttaaccattctacttttaaaaagggatttagcataagctcttacctccggaaaatttcttctatattagccagatctcgcatgtaattgtgaattaatgcaccggatgcaactaaatcagtcagaagctctgcttcttctttctctccgccgttaaaccggaaaatgacatcatctccgtcaaccgtcaccctgtcaaccagatgattttcttttaatacttccagtgctttttccatctgggctaaaatatgcatccgcactggacttttacataatgcttctgcgtatacttcttccactggtccaaaggtcaggttctttccttcttctattacaacaacatctgtaataaaacccatcatttcgggatacatggatgtgttgattatcatggatgttcctttttcatgcagactcagcaaaattcctatcatcttttttcttgctgtaacactcatattgtcaaaagggtcatccattaagagccattccggttcctgcaagattgcctttcccagatataaaaatggaaaagtatctattggaagttctccgataaatgtttgtttatacttggtcatctcaagcatctcaagaacttcttcgatccgcctgctccggtaacgtcctcctactttatacaaggataaaaacaactcatagtactcttccaccttcagaagattataaaagccatattcttttgacatatatccaaaattacaataagcattcctgccttcttcataaatagagatgccatccatataaatctgtccttcttctggcttttctccaccggaagccacctttagaagcatggatttcgcttctttatcctctccaagcaatgccagtatcactccatccggggccttaagatcgaaatgatctaatactttttccccttttctgtaaatagaaatattttgaaaatccagcattcttttccccctgttattctttataaattaacgaaatcaccggtgcagtcgtatactcattgctctcttttaactgatacgtaatcatcatttcaccggaatctgataaatacggtttaagagcctcctcatacaggcactcacctgcagaggtaaaaatcctgtctttcttttttgtacggtaattataggcataaatcttgccggtgaaattatccttgtttctcacaagcgcctgtatctccccttttcggtcaaagatatacgtcgcttctgtctttttttcatctaacgtatcttcttcaatcgccagaccttcttctttttgttccagacaggatatattaatattcaaaatcttctcgccagtattcttctcctttataggaaaatggttaactatcattgtgacatgattcttcaaaacatttttatctgaaaagagcttgaaatcattttcattcgttataccaacgatgagcagttcattttgcgacttttctgtattcatataggtctgctgaatatattccatcagattccctgttactgtattttcattatctgttccaaaaactgtattttcttcatcataacgattccagcacttcaccatactttcagaaactgaaacctgctgccctgcctttatattcttaagaatcacatattgattgtccctcattaaaataactctggaaaaattatttgcagaaatatttgtaatatctccggaaaatgaagtatatgttctggtcagattctgacgaaacacttctttttctgaatggtcaccgacatctcctgataatttcaaaactcttgaacttcccggcacgctttcttcaaaagcaatatcaaatcctttctttgtattgtttatcgtaacgtcctcgccggaagtttttatattctttccagtaatcgtccgataattataatctaccggaactacggaagtaaccgatggaagcagattcacacttgcttcttctccctcgtttgtctgatagagaaagtaaatggtttcctgttgcttttcactatcccttactcttaacgcagaaaaagcactgtcattgttcccagtcattcctcttgagcgcacaagcatacctgctgtaaagcatattgccagaacaggaacgacaatccagatgtactctctctttttaatctttctgagataataataggcaatcattacaagcattaaaatataacaaataaagaaaacgccataataaaatgtattcggtaactgtgacttcataaaggcatacaaagatttctttacataccaaagactcgtatcactgctttccatttcgttatctttttctagaaaatgtgtcattacagtagaagtcatcttatctcttccactccactgcaaataagaagtgttactaagactgaaacgaagtaccgatacccttcctgccccaaccactgctgtatatgcaatcgccggattaagatttttataggaattccaggtgtatttttttgaaaactccaacgtactcataagaaccaaaagctcctgtccacccccttctccctctggatcagacagagcagaaacttcaactccttcctgtacgataccaaaatcttttccgattccttctaacgaatctttagagtcttcctgctggcttcctcccgtaaggagcagcttccctcctgactttttaacccactttctaagggcgcgcttctgttccttagataactgtccggtatcaaacgaatcaatgatgattccatctagtccttgaaaagcttctacactttgtggaaagctttttcttgaaaaggtaatgatcctgatgtcttcttcgctctcttctccaacttctatactgtttaaataagataactgtctcgactggctactcaacacaccgatcaggctttcgctctgcccgctactttcctcttctttattcttcttatcagaaaaagaaacattctctgacaactgtgttaccccaaaggaatccttgatttcaaaacagatcaccgatggattcccaagctgcggaacattcaacgtaatggtctgttcttctgagcgctggcaccggatcgccgattgataggcaattccttttccgttctctcccggaagtgtaactttcattacgccggcaaagctcttatctgtagaacgaatctttaatgtgactggcatttccttatctctggcaacatatcccgccacaccaaaaacaacacttccggtacagttctctgtcttaaacttgtaacaatatccattcgtaccttctaatgtcttcttatcccattctacgactatcttttgtccccgctgctgatgccgacatccgtaaaaccagaaaacaacggaacacagaagtaaaagaagtaatattataatttttttgtaagtacggaataaatcattaatcatacttcattcctcgtatcttttctgttattttccggcttttggtgcatgcgcctgcacgaccggaagctcaatctgaaatctggttccggattcatcacttgttgcccatatttctccctcatgaagattcacaatgtttttggctatcgcaagtccaagcccggttccgcctgtttttaaggatcttgaattctctactctgtaaaacttatcaaaaatcttatccagatcttctgccggaataatctttccgtaattaacgatcgctacaaatgccatcttatctttcagcccggtatgcacttctacaagctttccatctactccatacttaatcgcatttgaaatcagattaccgattgctcttgcaagaagctcgccgtttccctcgatattgagtgccccttcataaaagtctgtgcggcactctaacttgtggtccataaagcttggataaaattcatctactaactgcggaacaaagagattcagatcaagaatctctttctttatctttactttgttcttatcgtatcttgtataatcaaataaatcttttacaagtgtctctaactgctttgctttcgatgatacgattccaagatacttctgcttttgttcttccgtaagaaagtctccttgtgtaaggagatcaagataaccaagtatcgatgtaagcggtgtcctaagatcatgtgccacattggtaatcagttcatctttcgtcttctctactgctttctgggattccatcgtttcatacaggttctgccgcatctcattaattgaagcagcgatttctgagaactcatcctctccctgcacaggaatctcttccatcagatctcccgacttcatacgctctacgccactgatgatttccctgacatacataacgaacttattcgatatcaaaataaaataaataaccagaagcaatatggtaaatattacgatcacccaggcatcaagcgctacagactgtgacatcgtaaatgttcctaaactcatctttccctgcccggatgctccccacactttcttatattcgccagctatgatctccgtctcatacaaatagattcccatgaatatgaggccttccgttgcaattgttgcaagaagacttaaaaacatgtacatgatcatcttaaaacgaaagcttttaaatcgcttaaccttcaattttgtagcctaccccccatactgtttttaaaatcttcggacttctggaattatcttcaatcttctcacgcaatcttcgtatatgaaccattaccgtattattcacttcataaactttctcgttccataccttttcaaaaatctcatctgtactaaatactctgtctcgattcgatgctaataaatataaaatatcgaattcaatcggtgtcagtgcaatttcctttccgttctttttcactacgtgcgctgccttgttaatcgtaagatcctgaatctcgatctcatccttcccagccgcttcctgctcttctcctaactgtattgtcgtatagcgcttcatctgcgactttactcttgcaagaagctctaacggatgaaatggcttcgtaaggtaatcatctgcgcccgtaccaaagccaacaatcttatccatatcttccgccttagctgataaaataagaatcggaatattactggtctttctaatctcacgacacacttctaacccgtcaattcccggcatcataatatcaagaataagcatacgaacctccggatgctgcttcagcgtttctaaacactgttccccatccgatgcctttaatacctgatatccatcattcaccagataaatctccacaagatccgcaatctctttatcatcatctactacgagaatactagcattcttttccatacatttgcccttcctttatgtttttattaaaattctgcataacattgaatggttacattttaccataaaactactctaaaagtccttacaaacttcttaccttgacatttttcaccttatttgctagaatgatgagcgatgctttgcatcttatatttgtttgtaagagtcggataaatgatcgcttccctttgttaccgaaaggtctgggaagaggaaagtccgggcttcacagggcagggtgccggataacgtccggtggaggtgactccaaagatagtgcaacagagatataccgctggcttatgccagtaagggtggaaaggcggggtaagagcccaccgattctctggtaacagagaatgccatgtaaacctcacccgaagcaagaccgaatgtaaaacgataatctggcccggattgttttcaggtgggtcgctagaggctgctggcaacagcagaagtagacagatgatcattcacgacataacccggcttatcgtccggctctttttaacaagtaaatttcacagactatgatgcgcgcagcttttagttctgtataacgaaaaagatttttttatataacatgaatcgtgcctgttgaaaaacatctgccgaaatatctcttcggattcggacaaaaaacgtgtccgccccgatagagatatttcggcagatgtttttcaaatgtcagattcattgttatataaaaaattctttttcttttgtaggctatgtgctgcgcttcactattttttatgtcaaaactttaagtgttattaaaaagagacgagtgcgacttggagttttatatgaaatactcttcttttctcgtagactttgtgctccactctgttaatttaatacatgatggtatttatttagaaaatgctgtataaaagagcctgtgggaaagaaatgaaatcttcggaaccctccccttttctccccctaaaatctgaaatagaaatcctccgagaattctttttgcaggttgccaacgaacagacccccgaaaactttttagataccagatgtaatgtcggagcaagcaaaaatgcggtgacgcattttctgcgcagcgattatctttacatctggtatctaaaaagttttcgggggtcgtctccctggctaactccaaaagatttcaaaatcccctatttcagattctgaatctctaacggatcataagttgtcatctggtatacatagtagttaagccagttcgtatataacgtattggcatggcatctccatgactttaccggtcctaattccggcttatcatctttgtaataacgttttgggaacggaacattatccattccttttgccagatctctcttatactccccgtcaagtgtcataacatcatattcaggatgtccagttacaaaaatctgccgtccttcttttgctataataataaaaggacctgcttcttcggaatctgccagaatcgtcagttccggattcttctccacatcttctcggacaatcctggaatgtctggaatgtggtgcattaaatacatcatcaaatccccggacaagaggagtctttctgtgaatcgtacgatgttcaaaaattccaaatattttttcatctaacagttccttacgcacaccataatgatagtaaagacctgcctgcgctgcccagcagatgtggaaggttgaagtgacatgtgttttagaccactccataatttccactaattccggccagtaatctacttcttcaaaatccagtgtctctacaggtgctcctgtaataagtaatccatcaaaatactgctgtttgatttcaggaaaaatcgtataaaaagtttccatatgggttctggattcattctgcgcattatgtgtttctgtttttaaaaaggtaatgtcaacctgtaacggtgtattagaaagactccgtaacagttgaagctctgtttcctgctttgtaggcatcagattcatgataataatttttaatggacggatatcctgttttaaagaacgttcataatccattacgaaaatattttcatgttccagtattttttttgccggcaaatcagtatttattctgattggcatatattttcatctcttttctattattgtttcaacccgttgctgtcgctaagtctcttttttgtaaaacattctattgttatttcatcatttttaatctttattgattattgtcaatcatcgaaagaaattcttcttctgtgatcacaggtattcccagttctttcgctttcttattcttacttgaagaagacatcgtatcgttattgataagataatctgtctttttagaaacagaacctgtcactttgcctccaaggctttcgatcttctcttttaattcctttcggtttgcgaagtgctctaccgttccggtaataacaaatgtcttatctaaaaggctctgtgccgattctccttctgctgatatattctccacttcaaaatgtaaatatggaagtagcttttcaaggagcttctggttatggatattatcaaagtaatctcttacacttgctgcgattacttctccgattccatcgatctgtgtcatctcttctacggatgctcctcggagattctctaacgaattgccaaaatgacggcataaaagcttcgcatttgaacttccaacgttaagaattccgattccgtaaacaaaacggaataactgtgtctctcttgacttttcaatagactgtattaaattattatacgacttctcaccaaatccgtccatagcaataatctgctctttatattgttctaaagtgtacaggtcattcaattcagacaaaaatccctgctcgatcattttcatcaacgttgcttctgacaatccttcaatatccatcgcatcacgactcacataatgagaaaagagctttactttctttgcgctacaatacggattcacacagtataacgtcttcacatcattctcaatccgcacttctgtcgcaccgccacaggcaggacaatgtgcaatcgggctgcatgttccacttctcgtcagattctcagcgatctgcggaatgatcatatttgccttataaactttgatatgatcattctctccaagctccagcccttccataatgctgatattatgaaggctcgcacgactgactgtcgttccctcaagctccaccggttcaaaaacagcaatcgggttaatcagccctgttcttgacggactccactcaatgtgtaaaagcgttgtctctgcctcctcatctgcccatttaaacgcaatagcattacgaggaaactttgccgttcttccaagagaattcccgtaggcaatatcatcataaataagaaccagtccatccgaagggaaatcattttctacgattttttctgaaaactgctgaatttctccgataatattttctcttgtcactctcttatacggtacaatttcaaaaccgagatcctgtacccagagcatattactttcaacagaattctccagctctcttccttctgcttttacaagtgcaaatgcaaagaaaaatacatttcttctggctgtcacttcattattcagctgtcttacagaaccactgcacagattacgtggattcttgtaacgcgcatccacatcttcaattccttcattaatctttcggaaatccgaatacttgattactgcttcaccacgaagaacgacctcgcctgcaaatggaatctttgccggaagatttttaaatactctggcattattcgtgataacctcacctacaacaccattcccccgcgttactgccttctgcaaaataccgtcacgatacgtaagcacaaccgtaagaccatccattttccaggaaagaagcccttctctttcacctaaccagtctcgtaatgcttccgggctctttgtcttatctaaagacagcatcggactctcatgtgtttctttttcgagttcactaagtacttcatagccgacattctgtgtcggagactggctcataacaataccagtctctttctctaacgcctgcagttcatcatataattcatcgtattctttattggaaaatacttcccggtcttcctgatagtatgctctagaagccttattcaatacttctacaagttctttcattcttgcctgcttatccatgataaaccccttccggttttcttccggcaagtttttcaagcttagaaagctcctcgccagtaatttcccgatactttcctgtcggaagatctcccagatgaatattcataatacgaagacgctttaactctcttactctgtagccacatgcctcacacatacgacgaatctggcgattcattccctgtgtaagaataatacgaaatgtatacacacctgtcttttttactttacatgggcgggtaactgtatcaagaatctccactccctcactcatctgctttaaaaaggcattcgtcaccggacgattgatcgtcacttcatattctttctcgtgataatttctcgcctttaaaatctcattcattaactccccatcgttcgtcattaaaataagaccttcggaatccttatccaatcttcctaccggataaactctctccggatacttcaaaaaatcaacgatattatctctttctctcttctccgtagtacaaacaattccctttggcttattcacagccagaacgatctgcttacggcttatcgaaatgcacttaccatcgacacgaacttcctgtcctgcatgaaccttctgccctaactgtgccggctctccatcaatcaaaatacggccctgctccacatagcggtctgcctgtcttctagaacacacacctgcatcacttagaaacttattcaggcgcatcggctcccctgtagaaatcttttctttaaaatcctgattctttcttcctgtatccgtcattacttatcaaactttccattcgctttattctgaaacttctctgcatctacaatgaatctctcatgcgttcccttaccgatcacacctgcaggatccttcacttccactgcaaaagtcagcttctttctatcaatctctgtaagtgttacttcacaacttacttcacagccaatcggactggcagaaacatgatctacgtttaaattcgtaccaaccgttgtcattccctcatcaagatggccatctaataaagcaactgctgtcttttccactaataataacatcgcaggagttccgtatactaaaagacttccgcttcctaatgtcttagccgcattctctactgttactttctccgtttttatcattttcattcctgtatctaaagccattttaaaacctcccaaattttcattgttctatttctaatgctgtattagtataccagaaaagagaaaatttttccattaaaattactattttattattcattggggaaatagacgaaaataaaaaaggcagcctatagccactgtaaagatatcactgcgtagaaaatgcctaaccggcatttttacttgctctcacattacattggctataggctgccatttttattttctgttttctttgtcaaagacttcaaacttatgttataatactttttaagaaactaactgattagtaatttatttttaagaaaagaggatattatcatgagtgaatcaatggcagattttgaaaaagaaattgatgagtccctgaaaactctcaacgttgtagagaatgaaggcgaggctcctgaagaagaaactggatttaatgcctgggataaagttcagcagtatttagaagatggcactgttctctccttaaaaatcggcggtatcgtgaataaaggagttatcgtttatgtagatggactccgcggattcatccctgcttcccatcttgagattggttatgtagaagatacaaacccatacctcggaaaaacggtagaagcaaaggttatcacagccgatcctgagaagaaccgtcttgtattatctgtaaaagaagtcctttacgacaaaaagcgtgcagaaaaagaacagcgtatcaacgcaatcgaagctggtgctgttcttaccggtaaagtagaatctctgatgccttatggtgcattcattgaccttggcgatgatatttccggcctggtacacatttcccagattgcacagaaacgtatcgagtctccagcagaagtattaaaagttggacaggaagttaatgtgaaagtattaaaagttgagaatggcaagatcagcctcagcatgaaagctttagaggaagttgctcctgaagaagaagatacaaacggagaagaaactgtaagctataaagacgaaggtgatgcaacaacaggattaggggcattactggcaggacttaagctgtaatcttgcttgattagacagacgaaaaaagaaaatatcccctatcccatctgctctgtagtcgctgtatttaagatgctcgtccgcatcttaaatacgctccgaagccgcatctgggataggggatagtttcttttttctgactgtgcaaatcggcagttgggaaccatcttctgtagtggaacttccttgtggagattttacaaatatttattgacttttatgttacatcatgtatatactaattttttagtaaccattgctatattataatgagatagcgcaaaatgacagattctatgatcttacatctagaagacttagaaaaacgctatttttcttaatttttttaactacactaatattatgatattagggtcaaaaggtattttgcccctaacttgatgccacgaattactccgcagctaatgtagctcccgtaattctgaaacattcaaaatccgctatcttatcggattaattcccgtctgtgaaaccaccctgtttcccgtcaaaacattttttatcaacatcgcagactgcatcgctatcgcccttgttgccatgcttgcctcaaaaggatctatttctaatccaaagtttattcttttcttaaaaactggaatttgcgggggatttactacgttctcaacctttgcacttgaatccaccactctcataaaagagggacatccaaaggtggcttttctctatatggtgctcagcttacttgcaggagtatgtacgatttttgcaacggagttagttctagaataaaattttccataaggaacaaatttcttgttgcggaatattccacatctgatataactaaatttcaagtatacacaactattagaatgtcagcctttttggatttaattccatggaaatccatatccttctggagaatccccattcttacctaactgtggatttggagtagacagaaaaaagaaaaaataatatatcccagatgcggcttgggagcgtgtttaagatgcggacgagcatcttaaacacagcgactacagagcagatgggatatattattttttcttttttcgtctatacaaaatctacaatcaagatttgattttctggaattctttcacatcttttgcgatttccccactcataagtatcatacaaataagattcggtattgccatcaaagcattggcaatatcggagaagttccataccagttctaatgtctgagttgctccggtgtaaactacaagtgagaaaacaattcgatagatcatattccatttatgggttcccattaaatattcaaaagctttttctccatgatattcccatccgagtattgtagaaaatgcaaataaggcgataccgattgttacgagatagccacctgcttttccaagtactgtagaaaaggctgcgattgttaaggcagagccgacataaagctgacctgttgacgggtcaatctgcccaagtacaccagaacttgcaatagcaagacctgtgatcgtacagacaacgatagtatcccagaaggttccggtcatattaatatatgcctgccttaccggattgtctgttgttgccgctgcggctgtaatggcggcagatcccattcccgcttcatttgagaaacagcctcgtgctacaccgtaacgtgctgcattcatcatggatgccacgatatttccacataaagcaccacctactgctttcacactaaatgccattttaaatatcatagagattcctgctggaaggttatgtatatttccaagaatgacgataattccggcaactacataaaaaatagccataacaggaactactacggaagaaactttagagatggtcttaattcccccaataataattaaaagtgcgagtactgtgatcacgacaccgaccatcgttactgacacaccaaaggttgcgtgaacggatgttgcaatggaatttccctgtgtcatatttccgataccaaaggaagcaattactgcaaacagggcaaacagccagccaagtactgcacctagctttttatttttcagcccttttttcatagtatacattggtcctccggacatttcgcctttttcgttaacctctctgtatttaatcgctaacatacattcagaaaatttagaagaaagaccaaaacaggcagatatccacatccatactaatgctcctgctccaccagaaaccatagcagttgcaacacctacgatatttccggttccgattgttgccgcaagggcggttgtaagtgcggaaaacggggaaacatctcctgttccacgactctttgttcgtgcctctttactcagagtcttttttaatgcccatggaagatttctccatgtcagaaagttacagcgaaccgttaaaagtactcctgttccgactaaaagaactaacatgactggtccccagacaaatgcatcaatctgggctacaattttacttatacttaacatctttctctctcctctcttttttcggatttcctatatatcagaaaataacaaaaggagcaacgaatattcgttgctccttcaacttatgaatcaagtatatcatatatgacaagtatgtcaatatgcaattttcgcttaagattccttcattttcgcttttaggttatctgtcctgcaaaaagaaaagaattctctacttattccatatcatgatagttttacccatcatcttattaatatccatctcaaaagccttagtcatatctgcaatagaactaacttcaacctgcgctcctacgatattactaaggtaaccgagaatctccggatactcctgatataattccactgttttttcaaaatcagctcttccacttcggctgcttccataaagatgaagtcccttctctaataccatacgagtattaataggaaccgcatattcagaaacaccaagaagtgcgattgttccttctggctgaataagatcgatcatctgatcgattgccttttgggaggcatctccacctacgcactcgattgcatgatcaatcgtcagtccctctggaatctcccataccagatgggtctcatcggcaaaagtgaagctgctcagcttatcttcattcgttccaaagataataagcttcgtatccggatgcatataccggaaaaatacagcagtaatataaccaaggttaccatctccccagattcctacaacgttccttcttgcatgagtaaaacgttcaaatcggcggagagcatgtacgctgacactgacaatctctgtaaatgctgctacagttctgtcaatatcctgtggtaagcgaaccagtctgtctctgtctaaagcgacattatcctgcataaaaccatcgaaaccgcttgcgcggaacttagaacttctcaaataattctctgcaataatatcatctttctcaactggtgtattcggaatcataacaaccagttcccctggtttaaattctcctgtcgcatcataaactacatcgccaatcgcttcatgaatcagagccatcggcaacttcttcgccataacatctgccggacgtgttccctgataataacgctggtccgcatgacagatagataaatgtgtcggacgcacaactaccttgtcactatttaaatcaatatcattaaatgctacttcaaatcttctgggtgctaccagacgatacactgtattcaacatttatttatcttctcctttaatcaacgtttcagcaactcgtaagtcatatggataagtgatcttaatgttaaaaacttctccttctaccagatgtacatcctgtcctttaataacaaaaatcttgcaggcatctgtaagaatctctttctcttcttctgtcagaccttcataaagctcttttaacttcttcgccttgaaagactgtggagtctgtccctgatacataacagaacgatcaggaatattgctgatgacctcgtgacctacgctctctacgatagtatcagaagcaggaataactgtatcacatgcaccatattcctgtgcataacgaatgttatcttcaataatacgatatgtcaggaacggacgaacagaatcatgtgttacaataatcgtatcatcatccagaccatattctttttcaatataacgaatagagttcatgatcgtctcattacgagtagaaccaccctcgatcactacaatcttactatcatcattaaagttcttcttcaccagattcttcgtatggttaatccactgagaaggacaaagtacgatcagcttctcaaacttactgttcacataaaacttctctaatgtgtgaagaatgatcggcttgccaccaacattaaggtactgctttggcttctcaacatttcccattctgctaccgattcctccggctaaaattactccaaaaaccatttgctcctccttttgttcaagggaaaatccctttttacacataaagtaatatagcgttatcatataccagattagggtatcatgtcaattaaattacttttttaacattctcggttatttctttataattcaggaatctctctatatctggatcgcctgttatttttgaatttcctaagaccttctttctgttaaaaataacgtctcaagatacttcattcctgtttttgttttaaaaatgttttccctcactttttcggctgtttctctgccacttccgtcttcgaatagatttactaagaagtcggcttccacaaggatctgataatcctctccttctattcctgtataggtatggtgatgagcgataaggaaaagcacccggtcaatgactgcttcatcgtatccaagtgcgcgtaacattggttctgctacagccgggccttctttttcctgatattttccgccagaacttccgtactttttttcacttattttaattccgatatcatgaacaatcgctacggttctgagaatatgcaacttttccggctctaattcttctgattcaccaatcatcttcgcaaattcatacacctttaaaaagtgttgcactctcttcggatctcctgcataatattccatcatcttttcgattagttttctgtcttgtttattcattatgttatgtcctccctgggctgtaaaaccagccttcatcatttgcatcatgccgattgcattttcctgatagtctaaaccattggtaaagtaattttatcacgaaaattttctatcgtaaaatgtatatttctcaccatggtctcacatcttaactattaattcgatttcagtaaccatatgtactcacggaatctttttgtgcttgatttcatgagaagattttttgtcagttgtgtccaaatttttaaggaggttttcatgaatattttatatgttatcctgctttctgttttttctctcattgttctttttcttttagcaaagctcatcggttatcgtcaaatgtctgaaatgagtatgtttgattatatcagcggtattacgattggttcaattgctgctgagatggcaacctctcttgattcgagttttttagaaccacttactgctatgattgtgtacggacttataactgctctgcttgcttttatcacaagtaaaaatatgaaagttcgacgttttatctcgggttctccatacattttgtttaatgatggacatttatatgaaggaaattttaaaaaagggcatatcgacctgtccgaattcctcgtgcagtgccgtctgaatggattttttgatttgaaagaattacaaaccgcaattcttgaagagaatgggcgaattagttttcttgcaaaatccgaaaaccgacccgcttccccttccgacttaaatctcattccaaaaaaagaatggctgctcccaacttatataatggatggagaaattctttacgagaatcttcttcattcaggaaaggacgaagaatggctaaaaaagcaactttccgcccatggatgtaaacgtctttctgatgttttccttgcaacaggaaaccagcaaaataccttaaatgtttatttgaaaaataatagaagcggaagcagcgtcataaaggaatagaatacttcatacaaaatttttgaaagtttttatcgtttttacttcacaaattgaatcttctctgttataattgattcgtttctatcataaatcggcatttctcttgtttttatttcctttattttcagtccggtttatgatagtacataaattttataagaattcatatataaggcttttttaaacaatgattttttatgcgattaccattgtttatattttttgcgtcttttttccgtgcatggcggacatgagtttttaacaggaatacattggaggttaacatgaaagatttagttgaaatccgttggcatggacgcggcggtcagggtgcaggcttaccgcatcgcagaacataaagatattcgtcttcctattatgatctgtcaggacggcttcatcacaagccacgctgtagaaaatatcgaattattagaagacgatattgtaaaaacttttgttggtgaatatgaaccagaacattacttattgaaagataacgaaccatttgctgtcggtccttatgccgttacaaactatgttatggaagcaaaacgtgcccagatgcagggactccgtaatgcaaaacaggttacccttgatgtggcaaaagaatttgaaaaaatttccggacgttcctacggattatttgaagaataccgcatggaagatgcagactatgctatggtcatcattggatctgccgccggaacaggaaaagataccgtagatatgcttcgcaaacagggagttcgtgccggacttttaaaaatccgccttttccgtccattccctgcagaagaaatcgcagaagcccttaaaaatgtaaaatacctcgcgatcatggatcgtaccgaagattacaatggtcactgtggccctcttggtgcagaaatcaaatctgctctttacaatgcagaccttcacccagctacattaaactactgctatggtatcggtggtcgtgatgttactgtagaaagcctcgcttctgtttttgaagatttaaaaactgtcgaggaaacaggcaagctcggtgaaacttaccgttatttatctgtcagagaataggagaaacaatcatggcttataatttaaaacaaacattaaataaagaagaacgtttatcaccaggccatagaatgtgtgccggatgtggcgctaccatcgctgtacgaaatgtactgcgcggccttcacgaagaagacgaagccgttatcacctgtgcaaccggatgccttgaagtatcctccttcatatatccatacaccgcatggaaagattcttttattcataacgcttttgaaaatgccggagcaacctgcagtggagtagaagctgcctatcgtgctttaaagaaaaaaggaaaagtaaaaaatactcataaattcatcactttcggtggtgatggcggtacatacgatatcggattccagtctttatccggtgcaatggaacgaaatcatgatatggtttatgtttgttacgataacggtgcttacatgaacaccggtatccagcgttcctctgcaactccaatgtacgctgatacaacaaccacacctgttggttccgaatctgacggaaaagcacaaaacagaaaagatctgactcaggtaatcgccgcacataatattccttatgttgcacagaccacctttgtacaaaactttaaagatctgcacacaaaagcagaaaaagcaatctataccgagggagccgccttcttaaacgttatggctccatgcccacgaggctggcgctacaatacccctgatattcttgaaatatgtcagcttgcagtagacacctgcttctggccattatttgaagtcattgacggtaaatggatcgtaaactacgttccaaagaaaaagctcccaatcgaagacttcttacgtccgcagggaagattcaaacatttattcaaacctggaaaagaagaattaatcgcaagaatccaggcagaagttgataggaaatgggaagaacttttggcaagagctaactactaatttgtagatttggtgtagacgaaaaaagaaaaaacactctatcccatctgctctgtagtcgctgtatttaagatgctcatccgcatcttaaacacgctccgaagccgcatctgagatagagtgttttttcttttttctgactatctaaatctacagttagtaaagatggggattctagatttctggataatcccctcttcccatcagactccaatactaattcccatctagagccaaagaacagaaaagcagaaattttatattaaatagaatgtgatgtcggagcaaataaaaatgccgagcaggcattttctatgaagcgactatcttcacattctgtttaatataaaatttctgcttttcgtctcttttatttctttcgtctctcaaacaaatttacttaagcatggaagctaccatctggtttacaagcttaccgtcagctttgccctttacttttggcatgaggtctttcataatcttacctctgtctttaccagttggttctgtaattccaagatcatcaagtacagactgtatcgttgccttgatctcatcctcactcatctgctttggagcaaattcttcataaacagcgattctcagtttacactggtcgataatatctgtacgatctgccggagacatctcaatcgtatctttgcactgtttgatttcttttgcaataatactattctcttctgcctctgttaaatcttctctcttatcaattgccttcgcctttaaagcaccaagaagcatggataatgcatcttttctttctttatcttttgccttcattgctgcgtacattgcagtacggacttcttcgattttactcaacttaaacccttctttcaaatagtataatcgttattcaaataaaactctactactatttccaaccaaaatcaagggaaaattctttaactactaatttgagggactaaagaaacgaaaaccagaaatttaatagaaaagaaattgtgaagatagtcgcttcgcagaaaatgcctgttcggcatttttactagctccgacatcacattttcttttctattaaatttttggttttctgttctttggctccagatgaaaattagtatttaaatcttggatgggaataaggggattgcccagaaggctatggttttcattagaatgaacatttccagaaagggatactttcttactcgattgtataaaaattatatttacctactcctcccttatggagaattttctcaggttaactctcataatcttctgggcaatccccttctctttccaacagaaatcaataatttgctatttgttatcaaaaccagacagccgctgaaataaacttttatgctgaattgtaagagaactgcgataacgaaaaaagaattgttataagtattgcattttgtgactttgcgctgtgcaattttgactctgaaaacttcggactcgtttttccgaagttttcgttttttgaggcaaaatgaagcgtttagcgcaacggaacaaaatctaacttataacaattcttttttctttagaagactaactacaattcagctcaatatcttctactaaagcagcgtctgtgtccccagcaaattattatttaataactaagtttacgattcttcccggtacatagatttctttgcggattgttccattgactttatccccaagtgcttcttttgcttttgcgaggatttcgtccttatctccatctggattgatggcgattgtacatttagtctttccgttaatctgtactggaatttcgatttcatcgtctttcatagcttcctcatcgtattctggccatgttgcgtggaatacagaatcggtatgtccaaactgttcccagagttcttcggaaacgtgtggagcaaatggtgctaataagataatgtatgtttctaatgtttctttatctacaccgccttttttcgacagttccatcagtttattgttgtattccataaatccactgattactgtatttaagctaaaggtattcagacggtttgtgatatcatgaacaagtttatgacgtactttgattaattctggtgttgcttttacatctttatctttgttatcaagagcaagtttccagaaacgtttcaggaaacggtttacaccttcgattcctttgtcatcccattcggaatcaagttctggtggtcctacgaagagttcataaattcttaaggagtcacatccgtaatctcttacaagatcatctggggatacgacatttcctttggatttactcatcttgataccgtttttaccagtgatcattccctggttgaagagcttcttgaatggttcatcgaaatcgattactccgatatcattaaggaactttgtatagaatctggagtataacagatgtaatacggcatgttctacaccaccaatatacatatcgaccggaaggtacttatctgctttttctctgtttactaattcttcattattcttgctgtcaatataacgtaagaaataccaggaagatcctgcccactgaggcatggtgtttgtttctctctttgccggagcgccacagcatggacatgttgtatttacccattctgtaatgtcagcaagcggggattctcccgttccggttggctggtatttttctacttctggtaaaagtaatggaaggtcttcttctggaaccggtactgcaccacactttggacagtgtacgattggaattggctcaccccagtaacgctgacggctgaatacccagtcacgaagcttgtagtttactgttttctttccgattcccatcttctcgatcataagaggagcttcttttttaagtacagaggattccattccgttccactcgccggaattgatcattgttcctgctgcttcggtataagcttctgtcatattttcgatttcttttccgtctttggcaattacctgaataatcggaatattgaacttagtagcgaactcaaagtcacgatcatcgtgagcaggtacgcacatgatcgctccggtaccgtaatcagcaagtacataatcggataaccagattggtacttttgctccgtttaatgggttgatcgcataagagcctgtaaatactcctgttttttctttatcctgaagacggtctacattcgacttcatagaagcattaaagatatatttctctacgtcttctcttgtttcatctgtagcaagttctttagccatggcatgttctggcgctaataccataaatgttgctccgtgaagagtatctggtcttgttgtgtatacggtaatcttttcatcttttccttctacagggaaatctacttctgcaccgtaactcttaccgatccattctgtctgcatctttttaactttttccggccagtcaagcttatcaagatcatttaaaagacggtctgcatactttgtaatacgaagcatccactgttttaagttcttctttgttactggagaaccacaacgctcacagcatccgtctactacttcttcatttgcaagacctgtcttacaggaaggacaccagttaattggcatctctttttcataagcaagacctgctttgaacatttttacgaaaatccactgtgtccatttataaaagtttggatctgttgtatttacttccatatcccagtcataaattgcagcgatttcattgatctgtcttttaatattcttaatgttggatgctgttgtaatcttagggtgtgttcccatcttgatcgcatagttctctgctggaagaccaaatgcatcccatcccattggatgaatcagataatatccctgaagcattttgtaacggctccatacatcactgattacatatcctctccaatgtcctacatgaagtccacttcctgatggatatgggaacatatcaagacaatagtatttcggtttctttccatcatttacgttaatcgggttctcttcccatttctggcgccatttctgctcaacggctctatggttataaggttctgccataggtttttcctcctgcatcataaaatataatataattatatccaattccttttgttcttatcttaatcttaacaaaagggtggatgatagttagctacttctgtgtttttatctgcgtactgtccttttccggtactttcacttctgttgttgtattcaccggctttttgccaactttaaacttaaaaatcttcgttacgcttacggctgtatatgggtctgtaatcgtacagctcactttatatgtcccagccttttttgtatttacacttccttttacacttaatgtttcaagtaaagcggaggcggatgcatacggcgaacttacttttaatacatcttttatctcaaatgtacttccgtaagcaatcgttctttttccttttttctttaatgtcagcttcggacgatatggattacgtgtatccggatcggttggatcccaccatgctttacgctttgttgatacctttactttagggcgtgccggtttctttaaggtacggctctcgcctataacaacctttgttccaatcctgcaattatcatatatccactttgcatcagtaacagccaggcggatacatcctgccgatgcctgcacccctaacttattatattccttcgtggataccttactcttattcacactataatacggtacagaatggaataaataaggaccatgtattcttgtactgtactgtccatatacaccatgtatcaatgcacgccacttatactttgctgttgtgttatatgtaccgcttatcgttctgtaattctttcctgttgaacaatacattgcttttacaagcttaccagttcttgaatctgttacattcacgagatttgtctttcgatttacataaatagtatatttacttgcagcctgcgcatcaatcgtattaaatcgaaagaatgcaaatgcaaacataagcatcgctgtcagtaaaagtattctttttggcttgtttctttgcttcatctcttctccttcctctcattatgaaatctttctattcaggtaattacgcaaaactccatttttattatataatctttctggtttttgtaaagaagaagtttgtaaatttgtaaatttgccctgtacgttcttctatgttataatacaaaacatagcaaatatatgttttatatgttaaaggaggctcactatgattgaatttaaccattttaattttaatgttttagaccttgaaaaaagtattgctttttataaggaagcaatcggtctttccgttgtccgcgaaaaagattccagtgatggcagtttcaaaatcgtctatctcggtgacggccgaacaggcttcaatctggaacttacatggatgagagacagaaaggaaccttataaccttggcgatgaagaattccatcttgcatttaaaacagatgactatgatgcattccacaagaagcatgaagagatgggctgtatctgctacgaaaacccttctatgggaatttactttattaatgaccctgacggatactggatcgaaattgttcctgtaagataggagtttcatccgataataggatatacttatgaattataatgaaccatctataaaaaagaaaagagaagaagtattctccaaaaagaagcgaaagcaaactactgcttctgcaattatttttcggattattttgattttgatctgcgctgtaatcgtcagtggatccggtttactatacggctcctttcgaggaatcattgacagtgcaccaaaagacttttctctcgcaccgaagtattctgccactattgtttacgatgatgacaataaacaagtgcagcagctttctgattattcttctaacagaattcctgttgcctatgaacagattcccgataatttaaaaaatgcatttatctccattgaggatgaacgtttttacgagcatgatggcattgatttcaagggaatccttcgtgctttgtggacagatatccaaaacggatctacttcacagggtgctagtactcttacccagcagctcattaagaataatgtatttgaagctggcggagagactaatattatcgcaaaagtaaagagaaagattcaggaacaatatcttgctataatcgctgagaaaaagtacaacaaagaagatattctgactaattacctaaacacaattaatcttggtaagggaaatcttggagtggaagccgcttcaaagtattattttggcaagtctgtaaatgaacttacgttgtcagaatgtgctgtattagctggcatcacaaagaatccaactttcttaaaccctgttgattatccggaagataatgatgccagacgtaaactgatcttgaaaaaaatgtaccagttaaactacatttcagatacggagtaccaatctgctcttgaagataaagtatatgcaagaattgcgaataaaacagcacaaggacgaaagaattctgtatattcctattttacagatgctgtaatcactaaagtagtttctgatctacaggaacaaaaaggatatacacagtctcaggcttatcagcttgtttatcgtggaggacttcgtatttattccacgcaaaataccaagctgcaaaagattgcggattctgtaattaacaatcctgataattatccggtagacacaaagttttccctggagtataagcttcaagttacacatgaagacggtactaccagtacttatacagaatctaatgtggctgcctatttccgtaagaagaaaaaggatccaggttataaaacaatttataattccaaaaaagaaatgaaggctgccgtaaagacatttagaaagtctgtcataaaaaaaggggatgcaaagaagtcgcaatccatacactattctatggaaccgcagctttcttattctttaattgaccagaaaactggtcaggtaaaagttctcgtagggggacgtggtcagaaacaagatgatcttgccttaaacagggcaacttctgtaaagcgccagccaggatctacttttaagattttatcgacgtatgcccctggcattgataccggaagtatgacactcgcaaccgtatttgatgatgcaccttaccgctatgaaaatggtcagaaagttacaaactatgtatctaccagctacaaaggactcacgacacttcgtgatgccattatcgattctaataatattgtggctgtaaaggcaatcacagctcttaccccacaggttggatttgactttcttcaaaagcttggatttacaacgttagtaaataatcgtgtaaatacaaatggtgcttatgaaagtgatgtgaaccaatcactctctcttggaggaatcaccgatggcgtaacgaatgttgaactgactgctgcctatgctgcaattgctaatcagggaacttataacaaacctattctttacactacagtaaaagacagtaatggtaatgttctcctcagtaataaaacttcttcccgaaaggtaatgaaaaagtcaactgcatggcttcttacaaatgccatggaagatgttataaagaagggaaccggcagggaagcgcagcttgattctgatatggcaactgctggaaagaccggtactacatctaataattacgattactggttttgcggatataccccttactacacagcttctgtgtggaccgggtacgactacaacacttcgtttgataatgataaagattatcataaagtaatctggaaaaagattatggaccgtatcatcaaagaaacgaaacagtctgtaaaaaactttcctgcatgcaaaagcattaaaaaggcttctatctgtatgaaatcaggtaaaaagcctcttcctgatatatgtgcaaaggatcctcaaaaatctatggttcgtacagaatactttgcacccggcactgtaccaaaagacagttgtgatgcacatattgctgtcaccttctgttctaaatctcatttagttgcacagaagttctgtcctgaaaagttccgatatactaaagtcttccgcgtgagaccaaaacattctaccggtaaaacagaggatgaaccttacttcctgaatattgatatcaacaagaagaaatgtaatatccataccaatgaatggtatttaaagaagcaggaaaagaaaaagaaaaaacaggaagataaattaaaaaaacagcaggaacagcagaataacaataatatcactactccagatgatataagtaaccagattaaaaaaatacttaatcaataatttcacaacattccagaataccttggtattcttgctttaagatgcgtgtcaaacagcgcaaaaaaatatcctatccggtatttttgttgtccggataggatatttttttattctttcaacatttttattttcattttttccaacaaaatatctctttttttactactcgatttttcacttaaaaagttaaacttgaattagttttgaaaatcctttttttggtttgttccgtattggtattcctttcctgtaaacaatataattatattatgtatttcgtataatgatacattgacacaggaaaaccaattaaccaaatgtactctcggaatctttttgtgcttgattttgtgagaaaaactccgagagtacatacagatttaaaggaggatgaatttatgttagcaaaaggtttttcaaaaccaactgatcgagttgaacgtcttagaagtatgattgttaatgctgttccttgtatcgaagcagaacgagctgtactgattacagagtcttacaaggcaaccgaaggtcttccaatgatcatgcgccgcgcaaaagcattggaaaatattttaaataatttaactgttaccattcgagatgacgaacttgttgttggtactcttacaaaagcggttcgttcctgccagcttttccctgaaaactcttacaaatgggttatggatgaattcgatacaatcgaaaccagaatggctgatccatttaaaatttcagaagaagacaaggctactttaagggaagtacttccgtactgggaagataaaacgatcagtgaccttgcttccagctatatgtccgaaaaaacacaggaatgtattgctaatggtatctttaccgtaggtaactatttctttggtggtgttggtcatattatcattgattacgataaagccatccgtcgtggttataaggcaattattcaggatgctgtagaagcgctgaaaagctttgattgtaacgaccctgaattcattcagaaaacacagttctgtaaagctgttatcactgtattatctgctgctatcaactttgcaaaacgttattctgataaagccagagaaatggctgctgttgaaacaaatccaacaagaaaggcagaattacttcagattgctgctaactgtgaaaatgttcctgcaaatggcgctacaaacttctatgaagcatgtcagtccttcattatcacacagatgatccttcaggtagaatccagtggacattctgaatctccgggacgttttgaccagtatatgtacccatatcttgaaaaagatcttgcaaatggttccattactaaagattttgctcaggaactgttagactgtgtattcgtaaaattaaatgatcttaataaagtacgtgaccagatttccgcacaggcatttgccggattccaggtatttcagaatatcggtgccggtggacaaactgaagatggtatggatgcaacaaatgaattatcttatatgatgatggaaacagttgcccaccttcgtcttagcgcaccatctttctcaattcgtgtatggcagggaactccggatgaattcctttatcgtgcatgcgaacttgccagacttggctatggacttccagctatgtataatgatgaagttattattcctgcacttacaaaccgcggaatctcccttcatgatgcacgtggttacggtctgatcggctgtgtagaaccttctgttcctggaaaagaacagggctggcatgatgcagctttcgtaaatgttgctaagattctcgagattactattcataatggtaaagttggcgatcttcagattggacctaagacaggtgaagttgatacatttaatactttagaagacttcatggaagccttccagaaacagattgaatattttgtatactacgtggctgaagctgataactgtgtagactatgcacatatggaacgtggcgaactcccattcctttcaagctttgttgcagattgtatctctgacgcgaaaggtatttgtgccggtggtgcaaaatacaactttaccggtcctcaggcatttggtgttgccgatagtggagactctgtgtacgcaattaaaaagcacgtctttgacaataaagacatcacatttgctgagttaaaagaagctatggatgccaacttcggttatcctgtagatagtgatactgctccttgctctgcatccgctgaaacagatatcgaaaaagacttatatgaccagatttgtaagattcttggaaaagaaggtatcagttttagtaaacagtctactgctgccgctgctcctgctgtatgcagcaacaatgaaaaatacgaacgtattcgtgctatgatggatgcaacagaatgttttggtaatgatattgacgaagttgatatgattgcaagacgttgtgcacaaatttactgctatgaagttgaaaaatacagaaatcctcgtggcggtcagttccaggctggtatctatcctgtatctgctaatgtattatttggtaaagatgtcggcgctcttcctgatggtcgtcttgctaaaaagcctctggctgacggttgttccccaagagccggtaaagacgtaaagggacctactgctgccgctgcttctgttgcaaaacttgaccacgaagttgcttctaacggtactctttataaccagaagttccttccttccgcagttgccggagatcagggattaatgaactttgcttctgttatccgaagctactttgataagaagggaatgcacgttcagttcaacgttgtagacaaagaaactcttcttgatgcacaggcacatccagaaaactataaagatttagttgtacgtgttgccggctacagcgcaatgtttactgagcttgcaaaagaagttcaggatgatattatcagcagaacagaacagcatttctaaattttaatcaacacgaactgagtaaacagacataaaaatttaatttcaaaaattattttagaaacttattgatttttaatttataatccttttgcatcataaattttccggggctgtcacaggaggtcttatcctatcctcttactgtgacaacccctttgagtattttagaaaggagattgcattgcataccgaaaaagatttacttgccaacaatgacgaagaaaacagagacaattttgacaccgatgtcggcatacttgaattatttggaaaagagacattagaaaacttacaatccattattgctaaagttactggattgggtctcgttactgctgattttcgtggtgaaccactcactactatgacttcctttacccctttttgcaagtttacaagagaaagaggaaataacgggaaactatgtaatctttcagatgcgtttggtattgtccgctctgcgattacccgaaaatactgcatctatttttgtccatgcggattaatagaagttgccattcccattattgttcatggaaagttcttaggcggctttctttccggacaggtaagatgcaacgatgcccccgatgatattcctcgattttccggtcttattcatccagaataccttgaagaagatcagacaaagattaatgaatatttccagcagcttcctgtctatgaatatgaaaagttttcaaatattgctgaacttatttatcagatgataaaccagcttgctgaaaatgaaatgctccgccaacagcaatatcactcccacaaagttcaggagaaaaagctttcttcccgaattgaggaactcgaatatgaaaattctactcttacaaaagagcttaattatatgagggcaaaattaaaccctcactttattttatccctgcttactgacatttccaatctttctattttggaaaatgccgttaaaacaaatcaaatggcagtttcactggctcaatatttaaaatacagtctatgtactacaggagataatattttactcgcagaagaattaaaacaaattgaatcttatttcaatatgcttaaaatcaaatatgaagatgcgctcacttattcaattacgataaaaaagaatatagatatgttacggataccttcccatatcctttttccttttttagaccgggctgcatcattgattacagtaaataccggacatcttgacattgctatttgtatcttctatgagaacggctacataattattgatatcgtatctaattttaatccggagcatacagaagacaatcctgcttcttctttcaaaaattttccggataacacaaccttccactctctgatcaaaaatatccgccagagacttcacagtatttttggtaatgattatgagatcaaggaaagctatcaggataattctaaaatccatgatataattaaactgccaatatctcacgaggaaaggattatgtaatgtataatgtattaattgtagatgatgacacattaatgagagatacgttacgtgctatgatttcacgttttaaaaattttcagattataggagaagcagctagtggctctgaggctgtctctatctgccgccattatcctgtacatctgatttttatggatattatcatgcccggaattacggggatcgaagccagtaaaaaaataaaagaagtttctccacaaacagaaatatgtattctttctgcttattcggattttcactttgctaaagaagcaatggaactgcatataaagaaatacttttccaaaccggtatccattcttgatattaatcattatttggagaatttttctctttcttcttttgaaagtatctgtcctcatctctctctagctttagaattgatgaattctcagaatttttcaaaaacttataccggactttctgatattatcaacaagatttattccaatcagaatacaaacatagaatccctgaaaaaaacttttatcgaaattggacagggactcttagactctcttgaatatgccagcccacacaatgaagtcaccgatttatttcctttacctgatacctggcttatcaatcaggaaattatgaaaatatggctttttaagatagcagattatatttatcagcaaaaaagcatacggcgttacagtattctagaaggtgtcttcctttttatcgaacaacatattaaagaaaaaatctctttagtacagattacagaaggaagtatgataagccagggatatcttagccgtatttttcgtgatcagtttggcattagtatgatggaatatatccgtcttcgtaaaattcaaatggttaaaatcaactttatttttactactcataatacctccgatgtggctttcatgctcggctttaatgagagcagctatcttcagaaagtctttcagaaggtagagggaatttctattcaggaatttaaaaaccgactaaaataatcaatatcctgcgatagttcatatccctctgctgttgctactttttcattttaggctggaaaataagtgctgccagataagaaaaaatcaatgcagaactcgtaccggcagcggcggcttttaatcctcctttaaataaaccaatggtcccttcctcttttactgcctctatcacacctttggacaggttatatccaaatccggacagcggaacacttgctccgcatcctgcccattttattaaaggctcatagatgcctgccgccccaaggattactcctgttattacgagtaacaccattactcttcccggcattaactttgtatgatccaaaaagatctgtactaatgtgcagataattcctcctactacaaacgcttttacatatatcattttttctcctttccggattccagccatactgcatgtgcaattgccggaattgtccgtccttcatttgcagaaacctgagacagtaacgctcctgtaggaacaaaaagaacttttttccattctccactggctattttaggtaaaatcactgctgataacatcagcgcagagcaggcacacccgctgccacctgcgtgtgtatcctgactgcctgcatcaaaaatctgcattccacagtccatatggtttttcttaatatctttatgattttcatcaagaagttcaaataacaacttctgacctacacttcctaaatctcctgtaataatctgatcaaaatcttctggtttcatctcaaaatccaacagactctgataaatagtatctgctgcagccggagccatacatgctcccatattaaatgggtcctgcacaccgtaatctttaatcttccctgttgttatcccccgaatctgtacgtcacctttttgtgtatttagcaaaaaagctcctgctccggtcacagtccaggtcgcactgtacggccgctgacttccatatccaagaggaaaacgaaactctttttccgcactggcaaaatgactggagcaaccggtcaataccaaatctgcgaatcctccattcaccgtcatcgcaccaatagataaggctgcccctatactagaacaggctccatacactccgtaataagggattcccagttcagcaattccaaaagaggaagcaatgagctgtcctaataaatccccacaaaaagccattctcacatcttcctttttcttttttccttttcgaatagcaatctcacctgcggtctttaaaaaactgctttcactctcttcccagttttcttttccaaacatcgggtcatctacaattaaatctaaatgtttccctatgggtccttccccttctttttttccgcccacacacgcatgactcattattttcactggttcttgaaataaaacgctctgttttcctttcatttgcagcatataataccacctctccatagaaatttcaggaatagtattttcccttttccataaatttatgtatgatattttcattagaaaaacaaaaaacggaataaagtatcgtcataattatacgtttcctatactttatcccgtttcatctgtttttcttaattaataatccactttaatcagacataatccctgtggaggagctgtcggtccggccatctgccggttctttgcctcaagtatgtccggaatctgttctggttttatctttccttttcctacttctaaaagtgttccaacaagaatccgcaccatattttgaaggaaacctgttccatgaaaatcaaagtaaataaaacttccctttctcgtaatttcgattttgtcaacaactcgtactgttgacttcttcatccgaggatttccacaaaaacttttataatcatgttttccttcaagataggctgccgcctgctgcatcttttctaaatctggtcttttttctaaaaccgttacatactttctctgaaatactggttttaccggaccatcataacaagtgtaacgatataacttaccaaccgctttatatcttgcatgaaatcgttcggatgcctctttcacttcctttaccgcaatatcatctggaagatagcgattcatatactcccgaatttcatctggtgtccgttccctgccgcctctttccttatctgctgcatcaaatactgcattcgcaaccattcctcttgcatgcactcctgcatccgttctgccggcaccaagtacatctatgaattctccacacattttcgttaatacattttccagttttccctgtatcgtatctctgtccggctggtgttcccacccataatacctgctgccatcatagcatattgttaatttataattctttttcactatgtacctcgtctttctttttccctgactccaggcttttctctattttacctgtctcattatttatatctcagtctacaccaaatcaaaatatatcgctgataaaataatatctacctcttgtttcataccggtaaaaaggttacttccattcagactaatctcttcttcctgatgatattctttactataatcaaagtccgatgccgtaacattcttttcgcctgtcaacatcttgtaacttgttctctccatcttatttacacgttcttcttcctgcctttgtaactgt

SEQ ID NO: 416 - DNA, 45159 bp, Eubacterium hallii
aagaattcggtatacctatcgttaataagcgtatttctatcacaccgatcgcattagtaggtggtgcatgctgtaaaggtccggaagactttgtccgcattgcaaaagagttagaccgttgtgcgaaggaagtaggtgtgaactttatcggtggctattctgcattagtaaataaaggaatgacaaaagcagacagatatcttatggaatctatcccggaagcactttctgtaacagacagagtatgtagctccattaatgttggttctacgaaaacaggaattaacatggatgcagtaaagatgcttggtgagataattcttgaaacttccagaaagacagcagataaagacagtattggtaatgccaagcttgttgtatttactaacgcaccggatgacaacccatttatggcaggtgctttccatggtgttacagaagcagacacgattattaatgtcggtgtcagtggaccgggtgttgtaaagcgtgcacttgaaaatgttcgtggcaaaaattttgaagaactttgtgagacaattaaaaagacagcatttaaagtaactcgtgtaggacagcttgtagccaaagaagcttctaagcgtcttgatgtaccttttggtattattgatttatcccttgcaccaacacctgcagtcggtgacagcgttggagaaatcttagaagaaatcggtctggaatatgctggagcaccaggaacaaccgcagcacttgcactcttaaacgatcaggtaaagaagggaggcgttatggcttcctcttatgttggcggtttgagtggtgcatttatcccagtaagcgaagatcagcgaatgatcgatgcagtagaggcaggagcacttactttagagaagttagaagcaatgacttgtgtatgttctgttggacttgatatgatcgctattcctggagatacaaaggcaacaacgatttccggaattatcgcagatgagatggcactcggtatggtaaaccagaagacaacagcagtccgcattattcctgtaatcggtaaaggcgttggtgatacggtacagtttggaggacttttaggttatgctccaatcatgccggtgaatcagtttgattgttccgcattcgtaaacagaggcggaagaatccctgcaccaatccatagttttaagaattaaatagtaacttgtcggagacaagatggacgctcctaaagggagacgatagcttgtatttgtgattctatcactgtgggttgaatgtttacttaacggttcacattcaattctcgctaaggtcataaatataggatatcgtctccctttgggagctgttttttgttaaacgggaattattgactggtcactgcacatgaacgaagtgacaccacatatccatgagcgtcatgcattcgatgccataatcgacaggaaatgtagctggacgaaagtgacttgactgagtaaattgaaatggaaatatgacggagagtgtgatatgatttgaatggaaaaatatcacttcaagacggtagacataatgatgataattttgttggtaattgtgttgagaaagtgaatacagaacttaaaaatctatctgaaagcagagaaatagaaaaaatgtggaatcaatttaagagtaaaattgtttcgtggaaaataaccaatactgtgatgttataaaaacaatatctactccgatattaaatatatatagttaataaagagaggtgcatatgctatgccagatatactcgtggttgaagatgatgaaaatttaaatcgtggaattgcattctcactgaaaaaatccggatatgaggttttttcagcagaatcagtgaaaaaagcgaaaagaattgcaagtgataataatgtggatgttaccatttgtgatgtgaatcttccggatgggaatggactggaatttgtaaggtggatgagatgcaattataatacatacattatttgccttacagcactagatcaggagatggatcaggttatgggatatgaagcaggggcagatgattatattacaaagccgtttagtctttcggtacttcttttgaaaatagaagcacatttccgccgcagacaggagaaaacggaagccggaaagatgatttcgggagatatcgtatttatcgcaggagaaatgaaagtcctgataaagagtcgtgaaatcagtctgacaaaaacggagttgaaaatgctgactttttttcttcagaatccgaaaaagattctttcaaaaacacaaatattggaaaatgtgtttgatctggacgggaattttgtggatgaaaatacaatcgctgtcaatatcagaagactccgtgagaaaattgaagacaatccggctacaccggtctatataaagaatatcagaggtcttgggtatatatggaatcaggaggtaaggcagtgacaaagagatatcgcaagaagattacagtagtgctctccttggtattgcctgttatagtattgtttgcaatattaaattgctttaccacgtatgtgttttatgaagattataaatataaaatgaatcttatgacagacattgctgcaaaggaagaattttccgggctggatgttgtttcagaattgcttaaggataaagatattgaagccaacgaacagggaaggcgattattggagcaatatggatactggggaaataaagggaatgcattttattcgcaatttcggcatcaggttatggtgatcggtgctgtaagcactgtgatatgcgtgctttttttgacttttttattttattggaagaaaaaagaagatgcgtatcatcagaaaattttagaccagttggaagaaattctgatcagatttcgtgaaaataaatttgatgatttactgaaaacggaaaatcatgcagaactggaaaaattgaatgaccagcttgaagcaatcggacatcatattcagttgctaaaggaagaagcacgggaagaaaaagagagcacgaaagaaatggtttctgatatctctcaccagttaaagacaccggttgcagctttggatatatgttttagtgtgctgatgcagaatgacttaagtgccacagaacaggaggagtttcgtatccgttgtcggagtgctctggatggactagagacattattgcagtcgcttcttgaaatatccaagatggaaactggactgattcagatgaataagaaaaaacttccgcttatggatactgtcatatctgctgtgaaccgcacttatcctaaagcggatgagaaagaaattgaattcgtttttgactatgaaaaagagttggaaacatgcacgattatgcaggataaaaggtggcttggtgaagctgtgatcaacgttctggataatgcggtcaagtacagtccgtgtggttcaaaaatatttatccggttacaaaaaagaaacgatcttgtaagaatggaaattgaggatcagggaattggtattccgcagaatgagtatcataaaatttttcaacgattttacagaggaagttccaaggaggtcatggaaaagagtggtacaggaatcggactttttctatcgagagaaattatcgaaaaacacgcaggtacgattacggtaacctccggcaaaaagaaaaaaggaagcacgtttgtgattcaattaccatatgttggttaaattttaagtgagcagaagtcttacaattttgtaagattcctgctcgttttttgaaagtgaaatgaaagattgccctgatacaatttggatgtaggatgaaaaggaggcaacacatgagtgtgatattagaaaccaagcagctttgtaagttttatggcgcaggtgagaatcaggtcaaagcggtcaatcaggtggacattcagattgagcagggagaatttgtcgcaattgttggaaagtcaggttccggtaaaagtacattacttcatatgcttggagggctagacaccccgacaaaaggcagtgttactttagcagggaaagatttatacaggatgaaggaagatgcccttgctgttttccgcagaagaaaaatcggatttgtttttcaggcatttaatctggtttcatctgttaatgtctgggaaaatattgtactgccactggggctggatggaagaaaagtggatgaagcgtatgtaaatgatattattgcaactctggggattgaaaaccggatttataatctgccaaatcagttatccggaggacagcagcagagagtagcaattgcaagagcactggtgaatcgtccggaaattatatttgcagatgagccgacaggaaatcttgattctaagaccagtgatgaggtaatcgctctgcttaagatgacagcaaaaaaatatggacagacaattgtaatgattacccatgatgacgaaattgcacaggtcgctgaccgtattctggtgattgaggacggacaggtggtggatttcagatgaagacaataagcaggattgcatatagcaatgacaaaaggaacaggacaagaagtatactgatcatgatggcaatctgtctgaccacgatgctgcttgttatcatcagtactgtgggaaatggggtaattcatttacagaaaagtcaggcggcaggatcatatggaagcaattatggtctgtttgtttccgcagacggatcgcagttaaaagaagtaaaccgccgtgcggaaatagatgctacaggcactatgtgcaccgaaggtatcataaaaggcaatgaaaaaggcgggtttgtctgcatggatgagactgcaagaaaaatgcttccttataataaagaatatgagttgaaggaaggaaagtatccggaaaaaatgcaggaaattgccgcaggaagagcattttttcgtgcaatggggtatggtgatgtaaagatcggagatacggttacactggattaccgcgcagggatgcagtcagaatataagccggaagaatttgttgtcagcggaatcctatatgatcgggatgagtataccatcgaggcatcttatgttgctttcgggtcacaggagttttatgatgagcacgtcgcagagaatgacagacagtataatatttattttactttaaatgattctgcaaatgtatctatgaataatattgattcggttataaagcagattgcagcagcttgtgggatcgaagaaaaaaacgttatagtcaatgatctctatttgcaatgggtcttgcagccgagttatgaaacgattgcggtatgcgggattttgattcttgcaattgtacttttctctgttgtggtcatttataatatttttcaggtcggtattgccaacaagatacaggagtatggaaaaatcaaggctctgggagcgacaaaaaagcagatgaaacaactgatcttcagagagggtatgtttttgacaatttcttcaataccagttggattgcttcttggttttctgattgcaaaatgcggttttaactggctggtagaacagggaaaccttgtatcaaccggaactggctccatgggagtccaaaatcagcagatgccactgttttccctgcctgttatgcttctatgtattttcgtgtcattttttaccgttgctttggcgctgcgtaaaccaatgaaaattgtttcacggatttcacctatcgaagcaacacggtatttagaaaatgcagaaacacacaaaaaaggaaaacgaaatggcagaaaaaatgtcaccgtgttttctatggcaatggcaaatataacaggtaatccaaaaagaaccattggtaccatcctcacactggggctttcctgcgcattgtttgtgattatctctaattatgtaggaaatattgatacggagcatgaagcacgtctttccgttaatcacggacaatttgaactgcagcttgactattctgctgagtacgatgaaagatatccggagaataatctggatacgattctgacggataatccattgaatgattcaatgattgaagaaatcaaaagcattccaggagtgacagatgtcatgacgagagagattgtctctgtaaatctgaacggaacaagatttccggctactattgtgagtaaaaatgattttgcttttatgcgccaagacggggatattggctctatggactatgatcaggcggtaaagaatggtgaaattttctttggctggtcaacgtggatggaacaagatggatatgctccgggtgaatccattgcatttgactttgagaatggaagtgaaacctatacctatcagggaaaaattgcaggatcctttgtaagcgcggacacttatcttgtcattccggaaggtgtataccgttccatgaatccgaggggaaaagcctatggctatctgtgggtggattgtgataaaaaagatgttgcatctgtggaacagagtctgaatactttgatttctaatacttcgcatataaaaatggatacctatcatgcacagttacaatctgcagaattcacagctcgcatgatgaagcttggctgttatctgtttatggcggttgtaggactcatcggttttatgaatatggcaaacaccataatcatgaatattacgacaaaaaagcaggaatatggtgtattacaggctgtgggtatgacaaataaacaattaaatttatgtctgcagttacagggaatgatgtttacggttggtaccatatgcgtagctttgatcattggtctgccgctcggctatgcacttttttcctatgcaaaacataatggaatatttggaatgaatatctatcatgtcccaatcgtaccaatttttattatgatttttttagtcgggctgttgcagattgtactttcctgcgttttaagcagtaatctgaaaaaggaaacgctagttgaaagaataaggtatcagggatagcaagtaaccaagatataatcttgcatattctttttctgtttacccgaccaaagaggatgttcagacatacgaagagacgattatgttggaagaatagagttacgaacttccagttcgtagaattcaaaatttaatatgaaatgtgagatagagcgtatggaaataaactatacgttctatttgtttgcctttttgaaaaaagcgattaaaaaactattgacattttgttactgaagtcaacaaattaatattttcagaatgaaattggagtctccttcataatatttgtagagacgaagatgaaaggtgaaatgtatatgcattatcaaaattacacttaccggacaggaagttatcgaaaacaacataaaagatatactgcgaatcgaaaaagacaggaggaatatgaatctctcccgtcttttttgttttttcggctgcgtttgcttatttgtattatgttgtttttggcatttgttactgcagataaatatgttttgacaaaagaggatacagcaccagtgtttcagaagatagagaagaatcagtcctataaggatctaataaaaaaatacaagttaattggtgaatagaagattcttatatacaaagaaagagcgctcatgataagatatttttaaaatataagggagattacatacatgttgatatatttaatggcattagataccgaggatgagaggataaagtttgttaggctttatgaggagtacagaaatcggatgcattatactgccagtattcttttaaaaagtgagatagaggcggaagatatagttcatgatacttttcttacgctgacagattatctggaccggatcgatgaaaaagattcagttggaacatggaattatattgttactatcttaaaaaataagtgctataactttttgaaacgcaataagagaatagaattgacggaagacgaagaagtttttgaacagcctattgaaatgtataatttattagaaaaccagttaataaaagaagaggcggaagaatttttaaatactctgattaagggattaaaatatccttaccaggaagttatttatcttcaatatcataataagttaaatagccgccagattgcagaacttcttaggaccagtcctgcgaatgtaagaaaaatttcaagtcgggcgagagaacagctgaaaaaagggatacaaaagaaaggatatacttgtgaatatggattttgaaaaattattggagcaggaagcgaggaaggctgccagacaggattatgaagaggtaacagaaaaaacaaaagattattcttacaaatattccaaagcgtttatccagaaaatgaatgcgatgattcatgaggaaaaaagaaaggcaaaaaagaaaagacgatggcatattttgctggtggcagcgattattttaatattgaatgcaggaattgttctagcaaacgatgatttgagagaaaaagtaggagagcttatcattcagttttttgatgataatgttcacatacgcagttctaaagaaatagcagattcagaagaaacatttcggcagatgcatcttggctatgtaccggaagggtatcatatactatatgagacagagaatcctacgactatgtatgatgtttattatgaaggcgcaaatgataattatattacttttatgcaaggttttaaagaaaatgtagatgtacatattacttatgatgggacaggaaggaaaaagattcgggtaaatggaaaagaaatctatatgattaaagatgggaacataacctcttattattatgaagatggagaatatcttattactttgtctggtacagaaaaagagtcagaattaataaaaatgctaaaaagtttgaaataaagtgtcacaatttacttactttaattgtgtcttatatagaggaaagaaattttgcaggaaaagcaagggatatggtaattgaaataagatacatactgctataaaaaataccaggtatctaatgaaaatgtatataaataaaaattaaagtgaggaacaaatgaaatttgaaataatatattccagaaaaatacgagatgcagtggccatgtttacaatatttatgtttatatgtcagtatggcttgaccagagaagatgtggcagagaatttttcaagaactgcaccaacctggggatggtttgccttttatgtagtcatgagttttattcttattttcttgatatgggatgatgactatattttatcggagtctggaattatatgccgaaggatgatttttactagaaagtacacttgggatgacttcccttactgtggaatttgttataaagaaggggaggaacctgaggataaaaaagaaaaattcctatacttttcaaaaaaaccgaaatcccacagaaaatttgagaaagtgtgtaaaagaatagaatatacacctgaagtagaagccatttttcagatatattgcccgtatatggataagccagactgggagttttggaatgaggaattaaaagagacacgagtatggaatgaagaagatttccgaacttataaacgggaagttttcaaaaaagatattatacaatctgtctattttttacctgtgctatgggtattaaaatttgtagataattattacattcctgtcatattgatgggaataacagtgtttatttattgcagctcgtatgcggataaatgggcaagtagaataaaggatttgacaaaagaatatcagagagcggcattacgtcaattgatagatgagaaacaggaaggttatagaatgacagaaagtattgcggggtaaaaatgcttaagaaaatcattaagaaaagagcgtatacgggtaataaaatagaagatagattatatgtttttacagatatgaaaaggggaatagaaggttatgtaaaaatactttgctatcatattgatgaaaatggagatttaaaatacgaatttgaatggggagaaagaccgtatgtttttatggggtatgtaagaagagattttgatagaaaaacagtaatagtaggagcagatacaaacacaaaatatgtaggcgattattatgtagcttttgaaccggaaaataaacgatttgtgccaatatatcctattacagatgaggcatgggaactgtatggacatacaatgctagaggaaaataaactccttgctgctaatcccaaatatgtgaaagtaatagatattccatcaagaaaagttttggcaaaatatgaaccagaaggaacgatatatagtgctactttcctaacaaaaaataaaggagctatttttacggataagggagtatatgaaattacattttaaagagaggcgaattcatgactgacggagaaaagctgacattaatacaaaaatatgaagagttaccagaggaagaatttaaagaggagtgttttgaagatttaaaaaagttcgcctttgataaagatgatacagtcaaaacttttactgccagtgtactttcacgttttgtaaatacagcaaaacagaaggaagccatcgagattttattgcaattatgtcatgaagaaaatgagctggtaagaacagaagcttatgatgctataggttgctattgtgaaaaaagcgtggtaaaaagtcttgaaaaagctgttttatcggaaaaagatgggttggcaagaagttatgcaattgattcgtggatttatgtacaacagcatttgtgtacaaacgagacagaagttattggatatttgaatgctatattagaaaaggaacgagatgataattgtatcttgaattgtctgtatgggaaatattctttcggagagagagctgttttggatgaaatacttaattatatcaagaatacagattatcatatacggtgtagtgttttgtctatcattcaattgattttggaagacgaaaactgcacagaagaatggaaaagaaaaataaaaactacacttacagaacttttaaaaagggaaaaagcaaatgcagtgaaagagcaggcagaagaaataatgaggtggctataatgtggcatatatggaccatagatgactgggagaaaaatattgatttgaccagagaagggcatcgaacaggactccggttacgatttgataaagatattgactgcgaagttcgcagagcatgcaaagaatttgccgtctttttgcgaagagaatatttttttccaatccgggtagtgatttatataaaaaatgtcaagaagcttatcgcgatggatggagataaggtgtatgggacattttggagtatgtatgatgactataatattgaaccacatattcgtgtagccgcaggggattatactgatttgtgtcacaaatggggaaaagatagtgcgttaacagcgatactatctacgatagcacatgaacttacccattattttcagtggattaatgcattaaaactgacaccgattggacaagagaggcaggcaacaaattatgcacgatatatactagatgaatatgcggaaacgagagaacatccatagaggatgatgaataaataaacatcccctatggatgttctctcttatttattaagaaacagaactttgcatattttcactatatttctcaaagcttttttctattttttccagtttccgggcatgttcttttaattcttttacgagtttttctctatcctgccgttcttttttatagttgatacgatgttccatgctcgcccagaaatccattgacattgttcggaactgaatttctacagggaaatattccataccatcaagacaataaacaggaatgccgagaatgatgtggtaactacgatatccatttggtttgggaccagcaatatagtcccgttctttcatgacgattaaatcggtctggctttttaaaatttcgattaggttatatatgtcattgacaaaatagcagataactcttgcaccggcgatgtccataagaaagtttttcgcatttgtcatagagggttttttctcctttttaatcagtttatcttcaatactttttttcgatttgattcggctttgaatgttgtgaataggaacaggatgtgtagccgatgattcgtataaagtgtgatttaatgtatcaagacggcttaaaagcatctgcatggcatcttcatatggtttaattaaattataatattctttttcattcataagtttagtattcctcctcatatcatttatcattctattggaaaaatgtgtttaatgtatggtagagaaataacggtttgtttacggtattcttacattagagcatgtttgtaaaattattcctgcaacctgcacgtctcaatttgcggtatattttgccttcatttagttgacgtagcccactacgccgccctcattcaggcgaaatctcccgcaaattgtaacgcacatcttacagaaagcattgattttttgttgatgtactatcattacaatgatataatgtcttataaggaggcggaatacatgggaaaatttaaaggggctgattttgcagacaaaacagtttatcttttatggacgagaagacccagtcgtaactatgctaaggctgggatgaatcgtccagttggtgttaagacagctcactcttgcggacatacttcctcttaggctgtccctgcttcttgatatactcttcgattacttccagatttgctcctccagtactgccaagataatagctgtctgtccaaaaagaatctccccacagatattctttaagctgctccttatatttcttacgtacctgtcttgcactgacctgtttcatcagtccgatatatcttgccagctccttatccggtggcaggctgaacagcaggtgcagatgatccctgtctgcttttccctcgataagttctccgccccatccttccaggagatgacgcatctcgtctaacaaaaaatctgcgatctcatctgtaatgcacggcttacggtattttacaacaaaaacagcgtgataggataaactccatacacggtggcgttctcttctgatcttcatgctccttgatctccttccacgaaaatatgttctattaatgttgataagttatctgttttgtgctataattatagcataaataaagcatatttacaatcgtatggttaactggaaaggagtaagactatggagtataaaagtacattcacaatcccatctgcaaggatatatatggatgaattatcttctgtagagcaggatatggtccggctgacttttctccggtataaccgcatgaaggaatggtactataaccagtcttataatgaaaaatatctggggattccttttgccgtagatggcaagacagagactgctcttctcaaagaacattaccgtgtcttgtacggaggaaagctgtctgattattatgtcacatccttgttttcttctgtcaatggaatgaggaaatcccagaaggagttattaaagcttgcggagcaggaacggatgcagcggcaggagaaccgccgggagaaagcagattccttaaaagaacgccttgtgcggatgcaggcagggaaagactggctgaaagcctttgggcggtatcttgctgggaaaggaacagagccaaaagccccgtctgtacaaaagcagggattcacttgttctagcggaaaacttttctatcgtggaaaaaagaaccaactcgtagaagcagagccttttgtctatgaacgggaactggagaaacggatccggcaaacaaaagcccatatcgcacagattgaagacaagatccgccggacagatgaaaaagctggcaggattccctcccgcatcacattcggttctaagaaacagtacaagaagaaagataccctttcccttacgggaaaagaattaagggcatggcaccaggagcgtgactttgcaagaaaccgtatcgtaaacttctccggtcgtgctgtttccccagatgggaattacctctgtaaatatgatgcagaggggcacactctggaagtaacaatgatcaatggagagaagatcctgttccatgaagttcattttccttaccgtggagaagaactggcacagtaccttaaagaacggaaaggctctgttggctatatgatggagcgcaagaaagacgggaacggcagggaatatcttatctttaaggcagccctgacggtgaaaaaagactatcttaactacagtacatccgatggagtccttgcttacgactttaattatgaccatatcgcatgggcagatgtttcgtcagatggaaacctcatcaaagcaggggtgatcccgtttacactggacgggctgtcgtccggtcatgcaaaagaaatcttaggcgtggcagtaaagaagctggtatcccttgctgtagacaggaagaaaccgattgtccgggaagaccttgattttgtaaggaagaaggcacagatggaataccgggaaaagaggcagaaccggaagctttccgcccttacctacagtaaggcgatcgctatggtggaggcaagggcattccgggaagataccgctgtacttaaagtaaacccggcgtataccagccttatcgctaaagtaaaatacatgaaactaaagaatctgcctatccattgtgccgcagcttatgtaatcgggcgcagggggatgggatttttagaaaaactaccatcttacctcaactgtcttgtgccaaagacacagaaaaaccgctggagaaccgtctttacccacgcaaaaaaggcagattcttcctactttcggaagaatctgcctgtatgggataaatggaaacaatttgatgccaatgtacataactataacgaaaactattccttgtggaaagaatcctattccatgcaataaaactttgtaactgttcacttatatatgtcactgaaaacatggagcctgctgtaccgctctctcgtttttccccaaggttaggggactggcgggaaacggatggatgcggcaggctcccaacaggaggaagcagatgctgcagagccggaaagcctgacccatgccaaaacaggcacacctgttaaagttggtgatggttggtctggacccatagacacgagctaaatcttgtataccccgtagattgtaaagtcgggggttctctctgaaaaaagattgccctgcaattttcttttcagaccgaatccatgtcgtaactatcgcagatagttaaggcatggtagttcaatgcaagggactctaatgcgagagaaacgtatcgaaaagaaattcgtaacagacattcctataaaaatgatatttttgttttggatattctcagagaggagatgaaggacaatgattcacgcatacagcgaatcttatctatatgatgcgaagcaaaatctgtctgaatgttttgattatgcgattagcaattgtcgttttaatgcagatatattttcaaggctgtttgtccaatctggatatgcagacaaatttgaacgtggaaatccagcgattgtttcaggaatatctgggatagaactggctcaggaaatcattatgtacgcttatatgaattacaaatttccagaaaaaatattttctgaggaacgttctgaagtctattgggctggttgggctttggcagagtatcagtgggctacctgtagacgattcaaagatattttttcaagaatacctctttcagaaattgttacaatgtatagcgtatatcatgaaatggatatagggcatttcattgaagatatgaataaaaaatatatgagcgtaacacaggaaattcatttaaaaacaattcgtgaaaatcgtggcatatctcaagtagaacttgcagcactttcaggtgtaaaacttcgttcgatacaaatgtatgagcaaaaagtaaatgatattgataaagcacaggtgagaaccctttacaaactttcaagagtattaggatgcagcatcgaagatttgttagaaaatccggaactgtaaaaagttaatactttttatttttggcagtaccataattcaagaatgccccggcattcttgctgcgagatgcgcgtcatgcaatgcatgacatacttcttctgcgcatctctgcaatcctgccggaggctatatcagatgagggattgactcccccccactgatactgatttgttgctcgccacctacagaggtgggagtcatctcacatctgatatatagcgtcagaaaggaaaatcatgaaccagaaaaacatagtaaaagatatacagtcaaaactttttgaacttcaggatataaagtaccgggattttcatgcgaagcttatgccgacggtgaataaggagaagattatcggcgttcggattcctgtacttcgttcatttgcaaaggagtttggtaaaactaaagaggcaaagctgtttttgcaggtgcttccacattcgtattatgaagaaaataatctgcatggtcttttactagagcagataaaggattacgaaaagtgtttacaggagttggaacgatttctgccttttatagataattgggcaacttgtgatttgcttgctgtccgtacggtaaaaaagcatcttgatgtatttataaaagaggtgtatcgctggatacaatcacagtatacatatacgatacgatttggaattggtatgttgatgcgatattatctggatgaaaattttcagatggagtatccagaaaaggtgatgcagatttgttcgaaagagtattatgtgaatatgatgcgggcatggtattttgctacggcacttgcaaaacaatatgagaacattcttccatttatagaggataaaaagctggatgtctggacacataataaaacaattcaaaaagcgattgagagttatcggataacaccggagcagaaaatgtatcttagaacattaaaaataaagtaatgattccattcgaggtgacaaagtgaaatcactatcaatttatacacttacaagaaatcagagtatagagcatgtatcaaaactggaaaggcagttatctggaaggaagtttcctttaaaaatacgtacctgggaatgggggagtatgagagcattggcagctcagttggaaatgtatatgcaggaagtatattccctccgttttttctattctttccagattccaagattgggaaaagagtttgatcttcttcagattaaggacaatcatatcgtaaatattgaattaaagagtggggtggtttcggatcaggcaattcgtaagcagctgattcagaatcgctattatttatctgttttaggaaaaccaattcaatcttatacttatattagcagccagaacaggctggttcgtctgacacatcatgatcatatcgtggatgcagactgggaaagattatgtgaggatttacaaaaagaaggtatgaattatgaaggaaatatcgaagatttatttcgggcggaattatatttgatctcaccgataacagaccccgtccgttttttaaaaaaagaatatttcctgacttctcagcaaagagatattgagaaaaagattttaagagatatttatgcaaagcgatcaggctgtttttggtttagtggaattccaggaacaggaaaaaccttgcttctttatgatattgctatgaagctgtctgttcgccatcgaatctgtatggtacattgcgaagagaatggagaaaagtggagaatattacatgaacgtttgcaaagaattgattttttggcagatgagcagattcgcatcgagaagaaaagtggcagtcaaaatagcgggcaggatagtagccgagattatgatcagaagaagcaattcaattgcgaagaaagagaagccggaacacaaataccgcttgaaaaatatagagggattttagttgatgaagcacatttgctttccaaagataagatagaaagattgttagagttaagtaaagagcagcctgtgatattttccagtgattccgaagatgttatctcatcagaagaaatggataaagagaatataaaaaagttggaaaatcagacagatattaaggtgtttcgattgacaaatcgtattcggacgaatgcggaactttctacatttattcagaatatgatgcatttgccgccaagaatgaattcgaggggatatccgcacatttttgtagtatatgccaatgatgatgttgaggcagagaatttgctaagtgattatataaagcagggatatcagtgggttgaaatagaagaatcagagaggcaggaagcgcaggcagatttaaaaatgcaggcggtcagagatatggataaaatagttcttcttcttgatgagcggtattattatgatgaagaaggatatctaagggcagcctgttttatgaaaaatggaagttcgtatgtaagaaagatttttcacaggttgaatcatgcaaaggaaagtatagctttggtagtaaagaaaaatgagaaagtatataatacgttgctggagttattataaacaaaagaaaataatggggaagcgctagagcgtgtttgaaaaatcattcctacaatctgtacgccccaatttgcggtatattttgccttcattcagttgacgtagcccgctacgccgctctcattcaggcgaaatctcccacaaattgtaacgcacatcttgcagaaagcatttttcgaacacgctctaaaaaaatgtattttaccaagtgtgttttctctgctttttttgttatattttgtgctataataaaaaatgattttttttagaggagacatataatgctagattttgtaaatgattattcagaaggcgcccatgaaaagattttacagcgattgttagaaactaacatggaaaagctgtctggctatgggacagatcaatattgtgagtcagcaaaacagaaaatcagggaagcctgtgaatgtccagaggcagatatttattttttagttggcggaacacagacgaatgctacggttattgatgctttgcttgagcagtacgaaggagttgtatctgcagatacaggacatatcagtacacatgaggcaggagcaattgaagcatccgcccataaagtgttggcaattccgcataagaacgggaaagttactgcaaaagccgtaaaacagtattttgcagatttttatgcagatggcaaccatgaacatatggtatttccgggaatggtgtatatttcccatccgacagaatacggtacactttacagtaaaaaagaattggaagagttgtctatagtctgtcatgaatatgatgcaccactttatttagatggtgcgagacttggctatggtcttgtcagtgaagaaaacgatgtaacactagcggacattgcttctttatgtgatgcattttacatcggtggtacaaaggttggagcattatgcggagaggcagttgtatttccgaagaataatgcaccgaagcattttatgacaatcataaagcagcatggagcacttcttgcaaaaggacgattgcttggtgtacagtttgatactctttttacagatgatttatatcttacaattagtaaaaatgcgattaaaacagcgaatacattgaaagaggctctaaaagagaaggggtatactttctatatagattctccaacaaatcagatctttctggtcttagaagatgaaagattaaaacagttagaggaagaagcagcagtcagcttttgggaaaaggcagatgatagccacacgatcattcgccttgctacaagctgggctacaaaagaggaagaaatcaaagcattgattgaaatcttataaaaatactttggattcttttcttaaaatcgtctgtagacaagtatagtttgaaaggagcatttttatgagtttaaatgataccccatccggggaaagaatacatattggtttttttggcagacgaaatgccggaaagtccagcgtggtaaatgcggtgaccggtcaggagctggcagttgtttcagatacaaaggggacaacaacagatccggtttctaaagcaatggagcttttgccgttaggtccggttttgattattgatacacctgggtttgacgatgaaggacagcttggagaacttcgtgtgcggaaaacaaagcagatattaaacaaaacagatattgcagtacttgttatagatgcggtagaaggtttaaagcaatgcgatgaagaattgctatctatttttaaagaaaaagatataccatatttacttgtatataataaagaagatatgcttaaggaagagcaaaaggattctttgctagaggacaataacaatgcggtatatgtgagtgctctgcaaaagacacatattcaggaattaaaagaaaaacttgcaaaacagataaaaacagaagatcagacgttacagcttgtcggagatcttgttcagccttctgatctcattatactggttattccaattgattctgctgcgccgaagggaagactgattttaccacagcagcaggttatccgcgatatattagaagcgggaggggcggctatatgtgtgaaagaaacagaactttccaaactgcttactgatctgggaaatcgcccgagtatggtaattacggacagccaggcgtttgctcaggtgagccaggtggtaccggaagaaattttgcttacctctttttctattttaatggcaagatataagggatttttagatgaagcggtacagggagcagcagcaatccgacaactgaaagatggagatcgtgttctcatttcagaagggtgtacacatcatcgtcaatgtgatgatatcggaacggtaaagattcctcggtggctgaaaaattatacaggaaagaatcttataattgagacctcctccggtcgggaatttccagaagacctttctccattttcattaattattcattgtggcggctgtatgctcaatggacgtgaaatgaagtatcgtatgaagtgtgcaaaagatcagcatatcccattcacaaactacggaattgccattgcacatatgcagggaattttagaaagaagtattcaagtcttccccgatcttgttaaaaagataaaatttgatctgtagattttaaaatcaacaaaaaacgatatctcttagatggctgaaggtgcatcttagagatatcgtttttcttttatgcgtatttattgtattaaaatcacataaatcaagcctgtgcagaacgctttgtaagtgtttctacagtagaacagtatttgtctacaagacataccagaagtgcctcacgacttcgtggcactttggtaagattcagcggccacatatggtgtgcgataatgtccttttctttatcggttaaagaaaagcgggtgctggcattgagaagagcagtgtgtgcatgagaaaatccatgccacctatggctgtcatctttctcgtgccagtcataaagataaaagtcgtgaagaaaagcaccaatgacaagggactttacgttagaaccaagccccaggcgtttatttaagtaatagcatacttttgtaacatacataacgtgctcgtatgtacttacgctgccatgctgacagaaacttttcatggaacgtgcttctttactgttacagtatttttctaatattgtatgaatttcctgaatttctgtattgcttaacttcatataaaatcatcctttaaaatcatcatttatattatagccctgttacaatttgttgaaaatatttggacttagattacttctgtcttccagtaggcagcgctatatggaggaagatccatgccgccgccaaagtcaacggtttctcctgtaacaagatctgttccaagaccggagcgcgcattaaaatcagcgtgaaatgtgttggaatcagcattgattgcaacaataacacgctcctcatcacagcttctttcaaaaatgagttgtttatctcttacaagaagattcgcatagccaccgttgtataaagccgggtgagtatggtgtgccttcgcataagcggcaattgcatcagaaagtttgttccattccggtttttcaaggcgaggacgaatctcttcatctcgtccctgttttttaccttcaatgccccattcacttccataatatatagaaggaacacctggcattccaaatagcaggccataaataacaggcagctgctgtttatcctctaaaatagtagcaatacggctgacatcatggttatctacaaaagagagaagatgctttccgcggtaaatacaccagttttcataaccaaactggcggtttaagctgtagctgatctcatgcatgttcgcacagttaaaactggaatacaatcccttgtaacattcatagtttgtaacagaatgacacttttcatcattcatatacatattataatcgccatgtaatgtttctcccataagaacaaaatcttctttcagagtactggtaaaacggcgtaactcttttaagtaaaaatcactcaggcagtaagcaacatcaaggcggagaccatcgataccataaaggtctgtccattgtttgatcgcatcgaactggtgctgtctgacatctggattatcaagatttaacttaacaagttcgttatgtccttcccatccttcataccagaatccatcattatattctgtatttccatcaaaacttaaatgaaaccagccacaataagggctgtcccatttcttttcctgcacatccttaaatgcccagaaaccgcggccaacatgattaaatacaccgtcaaataaaattttaagacctgcctcgtgaatagcatcacatacttccgttaagtcatcgttcgtgccaagacggcgatccagggtgtagtaatctctggtgtcatatccatgatagtcactttccatgagaggattaaagagaacacaggtagcaccgagctttttaatatgagaaatccagtcctttacttcaaggatggaatgtcccacaacactgtcatcgctgcttctttcttcatttaaaactccacagagtcctaatggataaatctggtaaactactgcttcatcgaaccacataagctgtccctcctaaatatagaaaatgctcgtcagccttaaaaaattgagcctccgagcattttcattatagcataaattctattaggattcaaattggaaggtccaatttaggcatacaatttgaagaaaaaattatgctgcgatataaggggagattgcctccataatcgttggcatctcattttctctttccatgattcttaaatcaactttgttgcggatatccatagtcattactccaagaagagacttggcatctacaacgtactgtccataaattaagtcaaagtggctttcaaaatcttcaatagcttttacaaatgatgtcgcattatccacagagccaaacttgattgtgactgttttcataattctacatctccttatcataaatgtatattataccgataaatagattgccggtataaaaataaatttttactaaatcgttttgacgattttggcttataatatttcatataaggcaaaaagtcaagaaaaattttcagaagaaagaaaatcgtaaaaaaaaataaagtgaacatattttgaaagcttcttgcattttttattcaaaatagatataatagaatggtgagtataaaataataagaatttaagaaaggaaggatacattatgaaaaaattcttatctgtagctttagcagcagttatgatgttatcattagcagcatgtggaagcagctcaaacaaggcagaatctagttcagaaggaggcagtgcttctgataagacttatattatcgcgacagatacaacttttgcaccatttgaattcacaaatgataaaaatgaattcgtaggtatcgatgtagatatcttagctgcgattgcaaaagatcagggatttaagtatgatttacagtctcttggttttgatgccgctgtagctgctcttgagtccggacaggcagatggaacaattgccggtatgtctatcacagaagaaagacagaaaaaatatgacttctctgaagcttattatgattcctatgtatgtatggctgtaaagaaaggcagcagcatcaaaggatatgaagatttaaaaggtaagaaagttgcagcaaagacaggtacacagggagctgactgtgctgagtctttaaaagataaatatggatttgatatcacatatttcgatgattccgcaacaatgtaccaggatgttaagacaggcaacaccgttgcatgtttcgaagatcagcctgtaatggcttatggtgtttctcagggtaatggtcttgagattgtagcagaagagaaagataacttctctacaccttatggttttgccgtattaaaaggacagaacgcagatttactcaagatgtttaatgaaggtttaaagaatattaaagcgaacggtacttatgatgagatcgttgcaaaatatacctcagcgaaataattgagagacaaaggttaggtaagaggttaatttatgaatctatttggagttttaagtgaagtctatccaacattgttgactggacttactatgacagttaagattacgattttatctctgatcatcgctttggttatcggtattttcgtatgtcttatgaatatttccagtaatattgtattacgtggaatcgcaaagttttatatttggctgattcgtggtactccgatgctggtgcaggcattttatttctattttgctctgccacagttagttcaggcggttacaggctcacagttccgcattaccgtatttacagccagtttagttacacttgccctgaatgcaggcgcttatatttctgagattttccgaggttctattgagtccgttaataaaggacagatggaagcggcaagaagtcttggtttaagttatgcaaagtcaatgcagaagattattcttccgcaggcagtgcgtatctgtctcccatctcttgtaaaccagtttattattacgttaaaggattctacgattctttacgcaatcggtttatcagaggttatgtataatgcaaagatttatgtaggaagaacgatggaatcatttgcaacatatacatgggtagcagtcttcttccttttgatagtgacagttctgtcatttatctcaagatatgttgaaaggaggatgaatgcgtaatgacaacagagaaagatgtaaagattcatgtaaaaggtctgaagaagagttttggacatgtacatgttttaaagggaattgatgcagagattaaagccggtgaggtaatctgtgtcattggaccttctggttctggtaagtcaacatttcttcgctgtctgaatcgtttagaggaagcaacagccggagagattcttgtagatggacagagtattacggaaaagggttcaaatattgacaagattcgtcagcatatcggaatggtattccagcagtttaacctgttccctcattatacagtaaaagagaatatcatgcttgctcctgtagaacttaagttaaagtctaaagaagaagcagaaaagaaggctcttgagctgttaaagcgtgttggtctggcagagaaagcagatgcaaagccaaaacagctttccggtggacagcagcagcgtgtggcaattgcacgtgctcttgcgatggaaccggacatcatgctgtttgatgaaccgacttcagcattggatccagagatggtttgtgaagttcttgatgttatgaaagaactggctgcagaaggaatgaccatggtcgtggtaacacatgagatgggatttgctcacgatgtagcagacagagtatttttcattgatcagggtgttattatggaacagggaaccccggaagaggttatggatcatccaaagaatgagagaacgcagagtttcttaagtaaagtattataaaacattttaaataaaaaggcatctgtttctgacaggtgccttttttaggaggttgttatgcgaatcgttgtaaaagtgggaacatcaacattaacccatactagtggaagaattaatattagaagaacagaaaagctttgtaagattttaagtgatgtaaaaaatgcaggacatgagcttattttagtttcttctggtgctattggtatgggtgtaggaaaactgaatatgaaaagtaagcccgaagatatgcccacaaagcaggcggcagcagcgataggacagtgcgagttgatgtatctttatgacaagttatttagagaatataatcatattgttgcacagatgttgattacaggattagatttctccaatgaagaaagtcatagtaactttcagagtacattgaatcgtctcttagaattgaatgttattccgatcattaatgagaatgacaccattgcgacacaggaaatttctgtgggggataatgatacgatgggagcaatcgttgcagaaaacgctcaggcagatttattaattatcttaagtgatatagacggtctttatacaggggatccgcgtaataatccagatgcacagctcattgatactatattttctattactccggaaataaaagaattagcaggaacaaagggaacaactcttggtacaggtggaatgatcactaaaattcatgcggcagaaatagcaatggatgccggaattgatatgattatcgctaatggaacaagaccggaactgctttataaaattcttgatggagataaagttggaacaaagtttatcgggaggaaaaaaggatgacaacaagagagattctggaacaggcagtcacagccaaaattgcgatcaactcagcagatacagagaccaaaaataaagcacttgccaatatggcagatgagcttttagctcatacagatgccattttggaggcaaacaagcaggatgtagaagcggcaaaaggaaagatttctgatgtaatgattgatcgtctgatgttagatgctggacgaattgagggaatggcaaagggaatcagagaattgatctgtctagaagatccggcagggaaagtaataagaacggtagaacgtccaaacggaatcattattgaaaaaacagctgttcctatgggagtgatcgcgattatttatgagagtcgtccaaacgtaacaagcgatgcggcagcactttgtatcaagagtggtaatgtttgcgttcttcgaagtggaaaagaagcatggaagagtgcagatgcagttgtaaaagcactaaaagaaggaatgagaaagtccggacttccggcagaaggaattcagcttatcgaagatacaagcagagaaagttccgtagaattaatgaaggcagtaggatatgtcgatctcttaattccaagaggaggtcctggtttgatccgctcctgtgtggagaatgcaaaagttccatgtatccagaccggaacaggaatctgtcatgtttatgtcgatgccaaagcagactttgataaagcgttgggcattatcgagaatgccaaaacaagccgtccaagtgtttgtaatgcggaagaagtcttactcgttcacagtgcagttgctgaaaagttcctgccattattacagaaaaagttagtggaagaccgcaaagaaaaaggagaaattccagtggaacttcgtctttgtgacagagccgctaaaattatttcaggaacaccagctggggcagatgatttcgatacagaattcctagattacattcttgcggtaaaagtagtagatagcgtggaagaagcagtagaacatatttcaaaacattctacgggtcacagtgaggcaattatcacagaatcaaaagaagcagcagactattttacgatgagagtagacagtgccgcagtatatgtgaacgtttctacccgcttcacagatggaggagaatttggacttggctgcgaaatgggaatatccacgcagaaactccatgccagaggaccaatgggcttagaagaattatgtacttataaatatatcatccggggagaaggacagattcgttagtaatttataggctaaaccaacaaaggcagaaaacgaaatactttatatttgtgactttagtcgcggcgcgttgaatgttcgcttaagcgcttgcatccaacacttgctccgaggccacaaatatagagtatgtcgtttcctgccttctgtttgctataaaaaaattctactttcgaaatgtctaatccttcaaccatcttccacaaatcctatacctatagcattgttgccttaaatttgaaaataaaacagcccttataagttcttattatataaaaatgcgccttagagcaagctcaaaatacgattgcgtattttgagtgcagtgatacgaagcatttttatataataagaacttataagggcgtctctttattccaaaccttaagcagcaaactcctgctgtctttgatcaaggattgctttatattcatcgcaattatctgctgtgatattctcaagctcatcatccggaagaatacgtctgtcatagtttcttcggaaaaatcctcttaaataaataagaaaagcagaattataaatctttcttgtcagtcttaaaatctcttcataattaatctcttttaaagcgtgatataaatcaaagaaatcatcggtatcaagatgtgcaaactgtaaagtctgctctaataaaacgtcatcattctcaaagagagatatataacccagcaaatacattaactggcggaaggtcataataaagtcattcggttctaatgtttcaaggaactgctcaaaactgaccttcactctccatagtccttcttctaaaagatggcggatagaaatctcattaaatggaccaggaatctgaatcttatcgatatgtacggtttttaacgtgagacgctccataaaacgggcgagtgtaacacgacaggcatgaaattcggaataagcattcatataaacaaataaatcttcggtctcatcataggaactatttatgaaatcataaaaatgagtaaattcatggaatagaataaagcgggcataactgtcactataaagatgaaagcgagggttcagatgcaaaatatacttaccctcaagaagttcaaggatattaaaaaaaccttcaacatatttttccgcatcatactgtactgccgaaatctgaatatcttccggcaaatcatacttttctttatattcattccacaaatcattaatctgtcttagattcatatgtaacccgccttccttacctaattgtttatattatataacaatgctttttaaataacaacgctataataaaaagaaaaaggataaattcttgcgattttattaatctgccttataataaaagaacatttgcgttgtgagagcgccttcttctaagtctttctggctgacccagtctccaaaggaagaagtgccgcgctttggaagataatgtggatccattagcagatatttatctttttttgcattgtaatcaacaattgttccgtagtgtcctggcagatatacaatggcagtatcgccagcttttaatttttgctttaattccttaaaagattctccgcatccgtcataagaaaatccatacttataaccgaacttttcagcagccgccttaaacaatccgctgtcagttccgcaatcttcaatacgatagcgtttatcagaagcgtattttgccagttcatatggatcagggaaatgaccgcttaatgagtaaatagcatttactgtagcaaaaattccacatccagaagtacagaaattatttgtttctgtatcttgtgttgtttcatttccgtaatgatgcttgccccaaaggggatcaaattggacaaaaacctgaagatttcccttttcaattgcctttttattcctggtaagacgccataaagcattctggttattggtaaattctaaaagattgctgttattttcagacagaattcgcttggtatttacatcgcagataatataataatttccttttctggtaatgcggaaagtacctgcttccttttcagttccccaaagttcattaatataagggttagattcctgcaaggtatccgattttagatatttatcttcatttgcttttttgatagtgtagcaattatttccgacatacttaaaggtataagtgagtgtatcggtatatgcatgatagctatccgtagaaaaagcagaagaattcttgttttgataaaaagaaagatggtatgttccattcgcaaaaggtcttttttcccgtccgtcataaatcaggcagtttgattgaaactcttcctttgtgatccagccataattactagtcccttttttagaagtgtactgaatctcgtaccaggaaccagaagaacctacaacctttactccactgtatttaggaagcatcgtttttaaatcttcactgtagtcagaaatatatactggcaattcattacgcgccaaagcataaatgaaatcagaatggctctcatacccatgctgaaatgcaaatgatttcgatggaatgagaaaacatccgcaaataatcaaaagtaaaaataaaatagaatgttttttcaaagatagccctccgtttgtttttcatgtactctcggtattcttgatattcttatgattccgagagagtatgttacattttacaaaagtcttaaaaatattaaatatatgttacattgcgcattattataccatgaaatatcaaaaatgaaaacaaacatattgcataaaatgtataggatattatggcataattccgatgaaagagattgagataaatgataattcatggtaaaattatacaaagtatttcacaaatgaactctttctatgatttcgttatagaaatacagaacgaaaggaatgaagacaatggaacaaagaaaaagaatttttggagcattagatgatttaatgcgttctccaataggtgagagacttcgggaaagaatgttccgggaattatctacaaaagagatacatgatatgctgcagaaagagcagaaaccctataaagaattaatggcatattaccaatgtgcgctgatggaagtagagacaaagtttcgtgtattaaacgagcagttttctcttgttcacgatagaaatcctattgaatcaattaaaacgagagtaaagagtcttgaaagtataacagagaagttaaatcggagaaatcttcctttttcaacacaaagtatcgaagagaatctggcagatattgcaggaatccgtattatctgttcttttagggaagatatttattttcttgcggactgccttttagagcaggatgatgttacactagttcagcgtaaggattatatcgaaaatccaaaggagaatggatatcgaagcctgcatcttattgtagaagtgccaatctttctagaacataagaagaagatgatgaaggtagaagtacagcttcgaacgattgctatggatttctgggcaagccttgaacataagttaaagtataagaaggatattgtatcggatcagttaacggctgatctgaaactgtgcgcagatgagagtgcagcacttgatttaaagatggaccggattcgtaaggaaatagaagtgttaaagacacctcttgcaaaagcggaagatggtaagagtcggtgaagaagttgtaatgatatattctctggaaataaattgattgtaaatcagctataaataggtataaataaagaaaaaagacatagttaaatgatataagcaggaggtctgtgtatatgatttatatgtctttttttattggattgattctcatatgtaaaggaggagactggtttgttgatgccgcatcaaaaatatctgaaactctgggaattccgaaatatgtagtgggagcaacgatagtaagttttgcaacaacaatgccggaaatcatcgtatcggctgccgcagcattaaaaggacattccgctatggcgattggaaatgcagtaggttccgtttcggcaaatactggaattattcttgcaatcagtctgttttttcttccggcagcaatcaaaagacaggattatattataaaaacaatcctatatataggaaccctcgtattacttctgattagtttcaaagacagagtatttgattggtcagactgcatattactattacttgccggaattttatttttaataatgaatataaaaaatgcatttcaagaaagaaataagggctttcaaagaaaaaatcagaaaaacgatagtaaaacacagaaaaaagaatgctggaaaatgtttgtctggtttttcataggtgcggtcgctattgtagctggttcagaaattttagtaaaatccgcatgtgaaattgcggaaaaattacatatcagtgaagaaatcatatctgttacaatcgttgcaatgggaacttccctcccggaatttgtaacgacagtaaccgcaatcatcaaaaaagaatcttctttatctgtagggaatattgtgggagcgaacatgattgattcggcatttatccttcctgtatgtacattactcggagggaaaagtcttcctgtttctacgcagatggcattgattgatatgccggtatgtattttagtatcagttgtggcattatttcccatgttatatcggaataaaatagcaagaatagacggagtctttacattattaatctacagcagctatttgatatatatatgtcggggtaatttgtgatatcaagttaaagtcaaaaggttcaaacgccgttcgtgtatgcacgataaggagtttgactttgtaatctgagaaacataagaaaatatagttgacaagaagaaattatggtgttatatttcaaatagaacaaatagaattcacaacgagagggtgaagattatgtcaataaaaaaggattattatgaagttcttggaataaataaaaacgcagatgataaagcaattaaaaaagcataccgtaaactggcgaaaaagtatcatccggatattaatccgggagatgccaatgcagaagcaaagtttaaagaagttacagaagcttatgagattttaagcaatccagaaaaaagaaaactttatgatcagttcggtcatgctgcttttgatggaacaggaggagcgcagtcaggtgcgtatggcaatgccggcggttttgaaggctttaacggctttcatggatttaatggagccggcggattccatggaggaacctatcgtacgaagaatggtaacggatatcaggaattccattttgaaggtggagacatgggagatatctttgaaaacttctttggtggaggtttcaaaaagtctggatttcagaatgatttcaaacaaaccggaggttttggaaatcagcagcattatcagacaaaaggctccgatattcatgctgaaatcaatgtaagttttgatgcagccgcctttggtaaaaaagaaaccattcatttaaaagatgatcagggaaagatacaggcgctagaagttaatattccggcaggaatcgaaacaggacagaacatccgattaaaaggaaaaggttctccaggatatcagggtggtagcgcaggcgatttgttcctgaaagttactgtaaaagaaaaacctggatttaaacgagaaggtcaaaacttatataataccgtctctattccatttattactgccgtactcggtggcgatgtaaccgtacagacaatttatggaaatgttcgctgcaatattaagccgggaacgcagtcaggaagtaaactcagattgcgtggtaaaggtattgtatccatgaagaattcttctgtatatggtgatcagtacacaacagtggaggttcaggtaccgaagaacctgaccccaagggcaaaacagaaactcagagaatttgaagatgcctgtaaagcagcttaaggtctggtttgtaggtttgatgtagacgaaaaaagaaaaaataccatatcccatctgctctgtagtcgctgcgtttaagatgctcgtccgcatcttaaacgcgcttcgaagccgcatctgggatatggtatttttcttttttctggctactctaaatccatgccaaaactccacagtataaagttacaaattcaagaatgtcccggcattcttgctgtgagatatgcgctctgccggaggctatatcagatggaaattgactcctccactgatactgatttgttgatactttttgtcaagtcatttttcagaaactagtttttaatataggggtatttctcttattgcgatacctcactaaagcaagtataatatgaaatataacatatttttaagaaaagaggtgcaatcatgggaatttatttgaatccagggacaatagaatttcaggaaagtataaattcagaaatatatgtagataagacaatgcttattgagagaacaaatgcagctcttagaacaaaacaaaagtatatgtgtatcagccggccgagaagatttggaaagtcgatggcggtggacatgcttgcggcgtattacggaaaggattatgattcggcgccactgttcgatggattagaaattagccattgtgagacattttccacacatttaaataaatataatgtttttaagataaatatgcaggaatttttaagcatgacacagaatgtagatgagatgcttaaagtacttcagaaaagactgattaaagaattaaaatataactatccagaatatgtagattgtgataatctggtgtttgctatgcaggatattttctcttatacgggacaatcttttattgttttgattgatgaatgggactgcttgtttcgtgaatataaacaggatgaagaggcgcagagaaaatatttggattttttaagggtatggctaaaggataaagcatacatcgctcttgcctatatgacaggaattctcccgattaaaaagtacggaacgcattctgcattaaatatgtttatggaatattcgatgacagatcctggaaatatggcagaatattttggtttcacagaaaaggaagtagagaatctttgcatagaatatggaatgagtatagaggaaacaaaagcatggtataatgggtacggtctttatagccataacaaacaggaagatattttatattctatttacaatccaaagtcagttgtagaggcaatgttacgtcacagatttggtaactactggaatcagacggaaacttacgaagctttaaagatatacattcagatgaatatggacggtttaaaagaggcaattattgaaatgcttgcgggtaatagcgtaagaattaatataggtacctttcataatgatatgacgacatttgcaacgagagatgatattttgacgctgcttgtgcatttgggatatcttacttatgatgtagaaaaagaatccgttagaattccgaataaagaggtggctcaggaatatattaatgcaatcagtacaatgggttggaaagaggtaatttcttctataaataattcaagaaaattattagaggctttatggaatttagactcagataaagtagcagcaggagtagataaagcgcatgaagaaatttctattctccaatataatgatgaaaattcattgagctgtacgatttcactggcattttattttgcaagagaatactatacgatgatacgggaactgccaacaggaaaaggttttgcggatattttcctgataccacgaaagattcatatggataaaccagcagtgattattgaattaaagtgggataagagtgcatcgggtgcgattgcacagataaaggagaaaaaatatatagatgctttatcagaatatcagggaaatttgcttttggcaggaattaattatgataaaaaaataaaaaagcatacttgcctgatagagaaggtagattataaaaagtaaagaggtgctaaaatgacaacgattttatgctatggggattcaaacacatacggttataatccggtaaatggtttgcgttatccaaaagatgtacgttggacaggtgtattacagaatatgctcggtgaagaatatgtggtcatagaagagggctgcaacggaaggacaacagtttttgaggatgcaaaggagccatggaaggcaggtcttggatatttaaggccttgtcttaatacgcataaaccgattgactttgtgatcatgatgcttggcagtaatgatttaaaaaggatgtttcatgcatctgcacaggaaattgcggatggggcagaagaactggtcaaggtcataaaggaatttacaaaagaaaagcagggatatattccaaaggtagttctggtgtctccgccggagattggaaaagatattgcggcatcagagtttgcacgttcatttgatgaagatgcgattattcgttcaagggagctttctgttttatatgagagagttgctaaaaagtatggttgtattttctttgatgcggcaaaggtagtggagtcatcaagagtagattctttacatctgatgccggaggcacataagaagttagcagaagcgttttatgataggatttctttttagattggcactcgactattgacatggctaataatatctgtataataaagttaggcaaagcaaatggccttgaaagaagggatattatgtttttttggaaaatagatgatgagacgataaggtgccttattaataaagaagagattgggcagatgggttttgatttaaatgaattgagttcggataatgatttgatggaagaatttcttaatgcgattattgcgaattctaagaattatattaactggaatacggataatggtgtgcagaattatattgcaagagcattaccttcggaacagtttctcattacgattagttgtacctttcaggatgtagcgattgaccgggatttagatcagatcaagaagatgacgacggcattaagagagcggatttctgatgaccggattgacagtatttattctatgagcggagaagaaaaggaacgggagtttgaggctttagcaaaggatctccatgatgtgtgtatgggaaatacaacagaaaaagaagaacaagaagaaaagggagcagagaagacagcggcagagaatgtatcttcagaaatgcctaaagactctgctaaagatatggtatcttctaaagcggcggaacagggcgggtcagaacaggcggtaagaccacatattccggcccagaagctgatttttaaagagttccgtaatctgattgatttttgttctcttttgaataaagattactttattccgtcaagtctctataaagatgcagaggaatatattttgttagtagaatttccgatagagatggataattcaaagataatcacttttatgattacagcagaagaatatggagcagaatgttcaaaccagaggcttgagggatattatctgtcagaacatgcaacgttacttattaaagataaggcagtagaaacgctttatcgtatgaattgattttgtaaatgaacggagtatcgtggtaaaatgtgttatgattttttgctatattttatgagaaagcgggaattatacataaccaaataagaagaattatgatatactaacagggagtcggttgtaaaacagattccttgtttttgtttatctcagttgagaggacttccacttttctaagtggtgattaataactgtattgcgtttgagttttacaggagaagtgacagaggatgattaagcagttgtaaaagaaaggaacgaaaacagatatggatttatcagatgtaagaaagaatattgatcgcgtagatggagagattcgcagacttttcgtagaacgtatgactctggcagatcaggttgcctgtattaaagcgaaaacggaagataaaatttataaaccggacagggaagaagtcattattaagaaacagacagaaggaatgaagccggagttagtaagagaatatacagcattgatcaagagaattatggaagtaagccgtaagtatcaatatggaagaacattagagcttcgtcagtgttttccatttgaatatacgaaggtgcctgcggtaatcttaaaaccggcaatggtaagagaagaattatatacctgtgaagactattcaaaagataaagtgattacggtagcctcttatgaagaagtggcagattatattaaagaaggcaaggcagatgcgggaatcggtattattgaggaagttggaatcggagtatcagatgaacttcataatctgcttgcagagaaggagctgtatatcacgcattgtaaagtgcaggaagacgggggcgtgcgccgtaaggtcgttacttttgtagatacgcttgttgtactgccatcgcataatcgtgtaaagattatgtttgaatgtccgaatcacagcggaagtatcagcagtattttatctatgatttctgattatggagtcaatctgacggagattcattcccgtccgttctggaaggataatagctggaactataagttttttgctgagctgaatgccaatattgatacaaaagaaatacgtgcattactataccagctttctcaggaaacagagtatttaaagattcttggaagctatgcctgtgagggagatttttaaaatggattttttagaagaaaaagtatttgaccgggagcagtatgatacctatatccgccgcattcattatgatgaccgggatgcggtcatgtatgagaaaatgctccatttccttttcccttatattgtggaagaacgagggatagaagatcgcgtgggtctgatggaagaatatattcattggaatgaacaattaataaagaagtgtctgtatcatttgccgcatgatatgccttatattaatatttgccgggcgtatcagtctgttgtgctgctgctggcaggtaagttagaagaaggaatagagcagcttagaaagattggaacagagaattttcaatatgatggaaaagcaccgaaagtgatcatgacacaggatgggacgatttataaaccagtatcaaagctgtttcttttatataattatgcaaaggtgttgaaaaaaaagggagattttgaaggccttgaagctttcaaaaaagaatttccccatgcatttactgtttatggtgatgaaggacatacagaacatgacctgttttacaagcagcaggtagaacaatacgaagaggtattgttttatccgatctatcagagagtttataaagctggacggggaccgcaggatttctttgtttattatgatgtggaaaagtcggtgcctgtttcacatataatttcaatttaatagcatttaatattttatggagggaaaacaaatgaaggaatattcattaggaacaaagtgcgtacagggaggttatacacctggtaatggtgagccaagacagattccgatcatacagagcacaacatttaaatatgagacaagtgaggcaatgggccgtctttttgatttagaagaagagggatatttttattctagattacagaatcctacgaatgatacggttgcaagaaagatttgtgaattagaaggcggaagtgcggcaatgcttacttcttccggtcaggcagcatccttttatgcagtatttaacattgcttcgtgcggagaccacattgtatcctcatcttctatttatggtggaacatataatctttttgcagtaacaatgaaaagaatgggaattgattttacatttgtttccccagattgtacagaagaagagctgaatgcagcctttcagccaaacacaaaggcggtttttggagagaccattgcgaatccggcacttacggtattagatattgagaagtttgccagcgcagcacatgcacatggggtacctttaatcgtagataatacttttgcaacgccggtaaactgccgtccgtttgaatggggcgcagatatcgttacacattcgacaacaaagtatatggatggccatgctgcaggcttaggaggctgcattgtagacagtggaaactttgactggacaaagtatccggagaaatatccaggactgtgcacaccagatgacagctaccatggtgtgatttatacagagcgttttggtatcggtggagcgtatataacaaaagcaacagcacagcttatgagagatttcggagcaatgcagtccccacagaatgcatttattttaaatcttggattagaaagtcttcatgtccgtatgaaacgtcattgtgaaaatggactggcagttgcaaagttcttacagcagcatgaaaaagttacctatgtaaattactgtggtcttgaaggagatgcttatcatgaactggcagaaaagtatcttccaaatggttcttgcggtgtagtaagctttggtgtaaaaggtggaagaaaagcagcagagaattttatgaaacatttaaaaatcgcggcaattgaaacacatgttgcagatgcgagaacctgttgtctgcatcctgcaagtgcaacacaccgtcagatgaatgatgaagagttagaagcatgtggcgtaaaaccagacttaattcgttattcctgtggtttagagaatgcagaagatttaattgcagatctttcccaggcattagagcagatttaatattcagattcagatatagaaagctgtaggggtatgaaagtatttacataaagatgcaatacccactacagcttttttgtaatagggacaaattggaaaaagaaaaagtaaataagtcttattttgcacacattttaaatgtataatgccttttgtaacaagttgttaacaaataatatatatttacacaacaattattgcgagaggagtttacaattgaaacataaaaagacactatttacattcttgcttctgtgtgggttattcgttcttagtaagccggtatccgcagcgaaagtaccagtaattcgtgcaggcaagtcaacgaatttaaaaggaaccatcattaatgtgaagtacagaggaacagcagtgacaatggcggataatgcagcggcaccatctattaagattggttctgatatttttgtaccatgcaaaacgcttttttctgataatggaatccatgcagcttatgcagcagatggaaataaagttacattaagacatggaagacgaaaggttattttttatgcgaataagaagtatgcaaaggtgaatggaaagaagatgagcttaaaagttaagccatattttgttacatataagcggagtaatgtaagagattttcttgttcctgcaaagcaggcagcttctttccttggattaaaatatagttatcgcagcgatgcgcgtctggtaacactggggcttcgtaatgggattgaacaatctgcgacacagacaagaagtgtggataagaatgagtttattgatacgatcggaccgcttgcaaaggctaactataaacgcacaggaattcttgcttctgtaacaatggcacaggctattttggaaagcggatggggtcagtctacattagcagagaacgggaataatctttttggaatgaagatcagtttatccggtaataactgggctggttctgcatgggatggaatcaactattataagaaggctacatatgaatacggaggcagcggcagatattctatcaaagcaaagttccgtaagtattcctgtgtggaagactctattgaagatcactctgcctatcttttaggggcgaagagcggaagcagaaaaagatatgcaggattgacgaagacaaagagttataaaaagcagcttcagataattaaaaagggaggatacgctacatctggttcttatgtgaatgatctgtgcagagtgattcgtacatatcatcttaccaaatgggataaataagtaaatattcataaagacagtatttgaccctatagagaaagtgtattatagtaaaagcaggtttcggcctgcttttttgaatttttgatattttgaattttatcaaagcaggttactatttataaggggagattaattatggaacgaatgttagaaggaatggtcatctttattgccagaatacataattatattttgtcattgaatgatgcctacgagaagaactttacagataaacaactgcatttccttgtaatcgggattataggtatgctgattttagcagtaatctatccgctatttaagattttaagtgaaaatcatatccttgcgattgcatttatttatgtattcacagttattgttgttataacctttgctattgagatcggacagaagctttccggtaccggaacaatggatttcgcagatattgtatttggacttgcgggatttttactaatgtttgctatatttgcagttattcgagaaattattcttgctatcgttaatcttttacgaaagttaggaagacattagatatatcagatgtgagatgacttccacctctgtaggtggagagcaacagatcaagaatcctgtaaaagggattctttttttctgttcatattttttctgcatttttttcatacaattttcagaaaattagtgtatgatatagaagaaaagaaaattaagcaagaatgagggaggctttttcatggataaattaaaaataatgatcgtagatgatgagagcagaatgaggaaactggtaaaggatttcctgaaaaagaaggactttgaagttgtagaagccgcagatggcgaagaagccctggatatcttttttaaggataaaagcatcagtttaatcatctgtgatgtaatgatgcctaaaattaatggatttgatgtagtaaaagaaattcgccagtattcacaggttccgattatcatgctgactgcaaaaggcgaggagagcgatgagcttaatggatttgatcttggagtagatgaatatatttccaaaccattcagcccaaagatccttgttgccagagttgaggcaattttaagaagaagtaataacctttctacaggagaaatacggaaagcgggcggtattgaacttgatatcgcagcacacgaagtcagaattgatggaaaggagattacattaagttttaaagaatttgaattactgaactatttcgtaatgaatcagggagtagcactttcaagagaaaagattcttaataacgtatggaattatgattattttggggatgccagaacgattgacacccatgtcaaaaagctgcgtagtaagctgggcgaaaagggagagtatatcaagacaatctggggaatgggctataagtttgaggtagattaaataaggtggcatcttgcagcaggaatgccggggcattcttgaatggttaggagtacagtatgagaaattcaatacgatttaagatgacatcaatattaatcctgatcgtaggatgggtcattgtatttacgtggtttttgaataatacattttcagaaaaatattatgtgtcatctgaaaaagaatccatcgtggagacttttaataaagtcaagaatatcttaaagaatgaagaggatcaggataccattgatgaggaaatggaacagatttctaataagacaaatataaagatgatgattgcgcagtccagtaactattattatagtcaaaatgtaatatttagtaatctgatagacggaagtaaaacatacgaagagattcttggttaccttgatcagattcgaagccaggtcattcttggcaataagggcaactatttctggggagataataaaaagcatatcctgccatgggaaagggcagaggagaataacttttctacactgataaataaaggatatttcgtaacacagttaaaagatcaggccagtgggcagaatggcatttatctctttggatttacagataacgattatttgatcgccatgcgtgtgtcaattgaaggaatacgggccagtgcagatatcagcagccgctttatgatatatatcggaatgatcggtatcatactgggaagtttgattatctttatttttgcatccagttttacaaagccgattaaaaatatggcatctgttgccaatcgaatggctaatctggattttgatgcgaaagttgaagtcacgcaggatgatgaactaggagaactgggcaattcaatgaatcagttatcggaaaagctggaatcgacaatcgcagatttaaaatcggcaaacctggaactgaaaaaggatattgagaaaaaagaaaagattgatgatatgagaaaggaattcctctcccacgtcagtcatgaactaaaaacaccgattgccctgattcaaggctatgcagaaggcttaaaagaaaatattacagatgacgaagaaagcaaggacttctattgtgaagtaatcgcagacgaagcgaaaaaaatgaatgcaatggtcaaaaagcttctcacgctcaatcagattgaatttggcaataatcagctcagcatgcagcgttttgatgtgtgtcagatgattcaaaataagatcaattcatcacagatacttttcaaaaagaagaataataaagttctctttgaagaacaaggtccggtatacgcctgggctgatgaattaatgattgaagaggtatttagtaactatttgtctaatgcattgaatcacgtttatgaaaacggtacgattcgaatctggtttgaacgtatggatagtaaccttcgtattcatgtatataatgacggtaaatgtattccagaagaagaactcaataaactttggatcaagttttataaagttgataaagcacgaacgagagaatacggaggaaacggaatcggtctatctatcgtagcagcaacaatgaaagcacatggaaaggactttggagtagcaaataaagaaaatggagtagatttctactttgatttagatgctaaaattaaatcctgacccaatcccacgaatcggttaaattcgacagtctttttataaaaagggttatatctcttgcagaaaatacatcgttattatggaaatgttagtaaaataggggggaacaatgaaagagaagaaatatgctgctgaaaagatagaaaattttcaggtagaagttcctatggaagaatatgtgaaagaatgtgtggatgttgcgacgtttcttgaattttgcaaggaatgttcaaactatgggaaactatggtgttgtccaccatatacatttgatgtggagaaggattattggaataagtatcgtaaaattcaaattatgggacgaaaattatatctgccaaaagaacttac

SEQ ID NO: 417 - DNA, 44777 bp, Eubacterium hallii
aagttaacttaatcgtaactgcaacagatgatgctgtaaaagcaggtgcacatgcaggaaagatcatcaaagaggcagcagccttagtaggtggcggcggtggtggacgtccaaatatggctcaggccggtggaaagaatccagcaggaattaaagctgcattagaaaaagcagtggaaatcgcaaaagaacaattataaaacttaatttgtcgatttcgtatagacgaaaaaagaaaaaataccatatcccatctgctctgtagtcgctgtgtttaagatgttcgttcacatcttaaacacgctccgaatccgcatctgggatatggtatttttttcttttttctggctattttaaatctacagttgggcaatgtggaatgtaccagaagaatatagctttccgggaaattaatttctaaagggctgacatttaaattgttggatgttactgaattgctagaatatagaaaaagagaaaaaaccatagacttctagggaaactcctcatttttccacacaaactcctgatttcatctggcgcaaaagaacagaaaagcagaaatttgatatagaacaaaaagtgatgtcggagcaagtaaaaatgctggtcaggcattttctacgccgcgactatcttcacattttgttctatatcaaatttctggttttcgtttctttagtccatcaaatcagaatttcgataggaggatagtttatgattcgaccaattatgagagatgttttgtttctcaaaaagaaagcagttcctgcgacaaaaaacgatatgtcagtagtgcaggatttacttgatacgttaaaggcaaatgaagctggctgtgttggaatggcagcaaatatgattggggtaaacaaaagaattattgcggtgaatatgggatttgcgaatattgcgatgttaaatccgatgattgtgagtaaaaaagaaccatatgaagcggaagaaggctgtttatctttaaaaggagttagaaaaacgactcgatatcaggagatagaagtggagtatgaagatattcattttaaaaaacagcaccagaagtataaaggctgggtggcacagattatacagcatgaggtggatcattgcgaagggataattatttgatttgtgaagcaaaacagacgcatcgagagaaagaagagactctatatctgtgactatatcacttgtgggttgaatgttcgcttttgtgctcacattcaatcctcgttctaagggcacaatatagggtctcttctctcttttggtgctggcttcgtcaattttgttaacttacctatggtaaatcataagttcaagtcgagcagccgcgagacttggcgcgtgattctggtcagcgtaagctgatatattctttacagaatcactgcgcatcctcgcggagcatttatctcagtcggagattatactcccactgagacaaatttgctgtcactcaccacctgaaagaggtgggagtcttctcgactgagataaatattaagagaatagttttttcttcactttcgtatattcttcttcagtatatcctttttctaatattttttcttttttcgtctacaccaaatctataaatcaggagttggtttctgctatccaattctgaacagtttcaatagagagatttacagcttttgcaatctgtttcacagacattcccatttcgagaagggcaagagtagtttctcttgcttttttcaattctccagattgctccccacgcagaaaaccagactgctctccttcgttatagatttcttctaattcctgacacatttgattcactccttccgtagtttcttttaactgctgtactcttgcagacaggacattactatacattttgtctgcttctttacaatgtaagtcatgcattaagcggtctaattcggtatcgtcctgttttttcgagtttacatataaaatatgttgtccatcttgaaatatatcttcggtttctttgattcttctttgtatgtgactgattggttggttgtatccaaggacatcatttttagtaatgaaaatgacatatgtttccgggagattgtcaaaaagatcgccgggattcagtagattcatatccagtagaccgcagtggtatctgctatttacgctacctccgttatgatatgtcaatggttgctatataaatattatatacataatttgacataaaagtcaataaatattttacctgtccctgtaaagataaaatttatggtagaaaatatggaaagcttatggcttttaaaattgtagaaatcctaaaaaaattgtataatgtgacgaattttttgttgtaaaaagtaaaagtatatagtaaaatttcaagtgagaatcttaatgattgagaaaaaatgacaagtgtagcaacaaaaattattcgttttatgtcaaaaatttaaggaggaagacgtatgaagaaaagaaatgtttttttgatgttggttgtatttgtgttaggtatgtttgcagtttgtttttctgctaagaatgtaaaggcaatggagattgcagaagatggagaatatactcttgtgttaagtaccacatgggatgaagatgaatatattgatggaaaaatttttaaaataattcgatttaatctggctgaagatgaaactacggttaacgtgtcagatcttacaaaaggagtagaggtatttaatggaaagaatatatttaaaaattgttggaaaagaagtagttcagaagaaatagttactgaattgaagattagtgattttaatggatcaggggaactatggaatgggagtaaagcagaacaatatacaaatggctgtgtcttatatccaaagttttctgatgaaccgttaaaaaaagagggaaagtattatatcattcttgatggatttgctggtaaagttaatggagagaatgaagttaagattgtcaaggctgcggacgaatttaacagtttggatctgtcagaatatacagcagaaagaagcggctgtgatttctgcggatggggatacgatggacagcagataactaaggtggataaatccttttttaaagatgatgatgttacagtaacaattacggcattatataagagtaagaagttttatggcgtggatagtaaaggattattaaataatccagatttgccagaagaagagagaccacgttcatatgtgttaaatcttgatgcaaatggtggaatgcttgaaaataaagaaatcaagcaatatgactatcttggtggtggaaatagtggaacatcaatggcaatatttcattatattcctgttaaatacggttatatttttaaaggatggaataataagaaagatggaagagggaactattataaatatatgtattggcgttcctggagagggagagaggattcggaatttgacctcgctggaaagatagcagatagcgactactatactaacctgactttatatgctgtttgggaaaaaaatgaaaatattcctattcctaaaaatgatacggttaaaaatgatacggttaaaaatgatgcggttaaaaatgatacgatacctgccgatgaaaaaccagtaaaagtaatagtaaagaagtctgcgattagaaaggcagtccgtacaaaaaataataagaaaattaaaattattttaaagaaagttgcaggtgttaaaggataccaaatccagtatgcaacatcaaagaagtttacgagaaaaacaacaaaaatggtaaaagtcaaaaagaatataaaaactattacaaagttgaaaagaaaagtgtattatatcagagttcgtgcatacaaaactgtgaaaggaaaaatatactacagtaagtggagcaatgtaaaaaaagtacgaataaaaaagtaagaagaatggagagccatttataatttatatctgatataataaccaaaatgaagaggtaaaagaactggagaaataatttatttaaaaaattttaaaaaagttattgacgaattagtattttgtgctataatgttagacagtgcaaaaatacccagacagttgtattaggcacaatacgcaactggagggaggttaggtgagtcaatgtcaagtattatcgttaaagaaaacgaatctttagacagcgctcttcgtcgttttaagagaagctgtgctaaagcaggtattcagcaggagattcgtaaaagagaacactatgagaaaccaagtgtgaaacgtaaaaagaaatctgaagctgctagaaaacgaaaatataaataagtgctgtaagaggacatccagtattggatgtccttttttcactttatactgggaagatttgatgtttaagagtttagattcactctgagattataatttttaattcccatcttcgtctgtgtccgtttgccaaacaaatcaaattatacagaatcgtgattatgtaaagttcacaaaagaaaaactttcttttataaatagttattcaaaatatccttaaaattgcataaaactaattgaccgatttatacaaaagtgatattattagaactgggatgagtgtatgaattgtcatatacttccaacgatatattatttctttgaaggaggagattattttgaagaagattattaatgcagtagatcaggtagaaaaccagatgatagaaggtatggttaaggctttccctcagtatgttaagaagcttgactgtggtaatgttgttgtcagagcgcagaagaagactggcaaggtagcattaatcagtggtggtggaagcggacatgagccagcgcatggcggattcgttggaaaaggtatgttagatgctgcagttgcaggtgctgtatttacttctcctactcctgaccagatttatgaaggaattaaagccgttgatgatggcaagggcgttttaatggtagtaaagaactatacaggtgatgttcttaacttcgagatggcagcagagatggcagcggatatggatggcatcgatgtaaaagaagttgttgttaatgatgacgtagctgtacaggattctttatatacaacaggtcgtcgtggtgttgccggaactgtatttgtacataagattgccggagcattagcagaaagaggagcaagccttgacgaagtacaggctgttgctcagaaagttatcgataacgtaagaacaatgggtatggctattaagccttgtactgtaccagcagccggagaacctggatttgaactggctgacaatgagatggagatcggtattggtatccatggagagcctggtgttgagaagaagcctcttgaaacagcagatgagattgttgatacacttcttgagaagattttagcagatatcgactatgcaggatctgaagttgcagtgatgattaatggatgtggatctactcctttaatggaactgttcatcgttaataatcatgtagcagatgttttagctgagaaaggtatcaaagtatataagacaatggtaggcgaatacatgacatctcttgagatggaaggattctctatcacattacttcgtctggatgatcagatgaaagaacttttagatgatgaggcagatactcctgcacttaccgttacaaaataatagaacaacaagcagactgtctaaggccagttattgacagactgaccttagacaggttacaatgaattataaaaagaccggcgtaatctgcgtgggtcttttgttacagtattaatatgataccagggtaaaaggctagaaagccgatgtaagtatgcttgcaagagtgtaaagcatgtaataatctggtatcaaaagggtcaaaatactttttgaacccaacagtataatatcaggaaagaggacataattatggcagacgtaaaaaaagtaattgagatcattgacaagattattgcagatgtagatgagcagaagttatttttaacagagcttgataatgtaattggtgacggtgaccatggaattaatcttgcacgtggttttgatgcagttaaaacaattgaaggaacatttgaaggcaaagatatcggagctattttaaaagcaatcggaatgaagcttgtttctactgttggtggtgcttccggtcctttatacggaacagcatttatgaagtcaggtgctttactgaatggtaagacagagatggatatgaatgactttatcgaaatgcttcaggtttctattgacggtatcatgaagcgtggtaaagcagtaaaaggcgagaagactatgcttgatgctatgattccggcacatgatgcaattgcagcttcctatgaagcagataaagatgcaaagaaagctttagaagcaggtgtaaaggcagcggaagaaggtattgaatatacaaagacaattatcgcaacaaaaggtcgtgcaagctatcttggagaaagaagtatcggacatcaggatccgggcgctacttcatttacattaatgcttaaagcagtacaggaacttgcataagagaaaggaattagaaacatggtaggtattgttgttgtatcccatagccagaagttagcagaaggtgttgtggaattagcatctttaatggcaccggaaacaccgatgaaggcagccggtggaatggatgacggcggatttggaacaagctttgaaaaaattacagaagcagtcgaagaagtgtatagtgaggatggcgtagcaatctttatggatttaggaagcgctgttatgacaacagagatggtcttagaatctatggaagaccgcaagatcaagatggttgattgtcctgttgcagaaggaacgattgcagccgcagtagttgccgcaggaggagcttctcttgaagaagttgtgcaggtagcacaagcatcgaaagaacaggcaaagttctaatttgtagattttgtatagacgaaaaaagaaaaaacgcgatatcccatctgctctgtagttgctgtatttaagatgctcgtccgcatcttaaatacactccgaagccgcatctgggatatcgtgttttttcttttttctgactgttctaaatctacagtttgtcaatatggaatatgccagaaggaagttctattgcagggggcaacagacgccgctgaagagagattgcttaactgaattgtattaaggtttctaaagaaaagagaatttttataagtttgattttgttccgttgcgccaaacgctccattttgcctcaaaaaacgaaaacttcggaaaaacgagtccaaagttttcagagtcaaaattccacagcgcaaagtcacaaaatgcaatatttataaaaattctctttcctttactatagtttccttgcaattcagcaagaagttctattatagcggctgtttaacctcatcctacaactcagttaaaaaacaaggggattgtccagaagtatacaatttctattcagatggaaaactccagaagaaatgagtcaatcctttagattttaatttcctgaggatccataaccttctggagaatccccattctcaccaactgtagatttagagtagtcagaaaaaagaaaaactaccctatcccagatgcggcttgggagcgtgtttaagatgcggacgagcattttaaacacagcgactacagagcagatgggatagggtagtttttcttttttcgtctacaccaaatctacaaatcaggagttctatttttttcttctttctcatagggatataaaaaatacatggtgtgattttatgctggaaaggaagagtccttttgtctgttcggtaaatggagcaaaagaaatcagtatagaaaattatggaagtctgggtgatttcagtgatgaaaagattgtgctcaactgctataaatgtaagatgattattgagggagaaggtcttttaattgaatattttactgatgttgatatgaagattacaggtcatattcattcaattcatttttgaagggagaagaagatgctcttttcgttatttcattttctgtcgggatattgccgggttgttttaagtgggatgaatcaggaacgttttttaaatctctgcgcagcaaagcagattcttttgtggaatattaaaaaagagggaaagcattatattttttacataagcagagggggatataaagaacttcaggaaatatcagaaaaaacggggagtacgttccggtgtatacagaaaaaaggaatcccgtatttgttctgcagatataaaaaaagaaagtgttttgtgttggcacttttgttttgtacagctatttttattgtcatgtcctgttttatatggcaggtgcaggtgacaggaagttatggacattcagaggaagagcttcttgattatcttgagaaaaaaggagttcatagtgggacaaagatttctgggttttcgtgtgcacgattagaggagcagattcgaaaggattttgaagacatagcatgggtgtcttgtgaaagaaagggaacacttttaagagtcagagtgaaagaaactttagataaacgtgatcaaaaggagggagaaaagcaggaatcaccatgtaatcttattgcttcaaagaaaggaaggattgccagtatacttgtaagaagcggaagtgcaaaggtgaaaaagggcgataaagtaaagccgggggacgtacttatttcaggggttgtagagattaaagatgatgcgggagaaatcgcagaggagaccttagtaagggcgcagggcgatgtttatgcaatttcaaaaataaaatatgaagatcattttccattaatttattataaaaaaaattatactggaaagacagaaaaaagttatcgctttttgataaatggttatacgattaaaatgccggaacgtaaaacagcatatgcagagtatgatgaacagtccagagaaattttgctgcatatcggaccgcagttttatctgccggtttctctttttattataacaaaggcgcagtgtcagatttcaaaagagagttatagtgtgtcccaggcaaagaaggaggcaaggaagcgcctttttctctttttgaaagaatatgagagaaaaggggtggtaatcctgaaaaataatgttagaatagacagtgataaaaatgagtgtactgcaaagggaattatcaaaataaaagaacgtgtaggtaaagttcaggagatttcctcaacattaaatgggaaaaaggatataaaacaagagcctgctgttttaaacagataattttggcagtaagttcaattacaaatcatatagtgggattttgaaaatatattgacaagaaaggaaaatcagacaaagaatgagtatagcagaacaggaattcccttttccagcggaacatgcaagtaatgtttttggtcagtttgatgcaaacatgaaaaagatagagaagacattgcatgtaacgattatttttagagatgacaagttgaagttaattggaggagagaaggattgcgatagagcaaaacatgtaatagagcagctccttttattatcgcagagagggaatgatattacagagcagaatattaattatacactttctctttctatgacgaatgaggaatctacggttacccagttagatagtgatgtgatctgtcatacgatcatggggaaaccgattaagccaaaaacgatgggacagaagaaatatgttgatatgattaccgataagatgatcgtatttggtgtaggacctgcgggaaccggaaagacatatcttgcgatggcaaaggcaattacagcatttaaggcaaatgaagtgaatcgtattattctgactcgtccggcgattgaagccggggagaagctgggatttcttccgggtgaccttcaaagtaaagtggatccgtacttacggcctctttacgatgcgctttacgaaattatgggtgcggatacttttgctaaaaacatggaaaagggattaatagaagtggcacctcttgcttatatgagaggaagaacgttagataatgcatttgttgtgttagatgaagcgcagaatacgacaccggcacagatgaagatgtttctcacccgtattggttttgggtcaaaggcaattattactggtgaccttacgcaaaaagacctgccgtcaggtactcgttcaggtcttgatgatgcacttcatgtgcttaagaatattgatgaaattggcgtatgtaatctgacaagcaaagatgttgtgcgtcatccgcttgttcagaaaattgttaccgcatacgatgagtatgacaaaaagaaagaagtaagacaaaagagaaaacagagaacaacaggaaagcaggagaaaaaatgacatttgaaatagaaaatgtatatccggaagtggttttgccggattatgagaccgttattaaaaatgtaatcgaagctgtattagattatgagaaatgtccgtatgaagcgcaggtatatgtacttttgacagataatgaggagattcatcagatcaacagggaacatcgccagattgatcgtccgacggatgttctttcttttccaatggcagactatccggtaccgggagatttctctgatatagaagaaagagatccggatgcttttcatccagaaacaggggaattgatgcttggagatatcattatttccatggataaagtaaaagaacaggcgaaggcttatgggcactctaatacaagggagctggcatttttagttgcgcacagtatgcttcatctaatgggatacgatcatatggtagaggaagaacgtatagtaatggaaagaaagcaggaagagattcttaagagttgtggatatattcgggagatggaatcttgaaacatacaaaaaagcataggatatgggatacgattattgttggtgcaggagcagccggtatggcagcggcaattgcctgtaaagagcagggacagaaagttcttctgattgataagcagggtcagatgggcagaaagattcttgttacaggtaatggaaagtgcaatcttactaacttttcacaaaaagaagaatattatcggagtgattgtcccggaagagcgcagaaagtactgtctgtgtttgggcaaagagaagcaatggaattgttccaaagtcttggaatttatacgaaggataagaatgggtatgtttatccgtacagtgaacaggcggcaagcgtgagggaagcctttgaagcaggtgtactgtccggaacgggagttagttttgttcctgaagcggaagttcgtacagtttctgaaaaagaaggtctgttttatatcggggtacatttgctttccgaagaaaatgtacaacagaaaaaagaaaaatgctatgtttgcaagagccttcttattacaaccggtggacttgccggaccaaagtttggatgtgatggcagcggctatacatttgcaaagcaatttggacacaggataataagaccgcttccggcacttactgcattaaagtcatctgctccgtttttaaaaaaagtgagtggagtacgtaatcaggcagcgattacattggaaatcaatggcaatgcagtccgacatgaaatcggggaacttcaatggactgactacggaatttcaggagtggcaatttttcagttgagccgctttgctattacagcgttagaagaaaataaaaaggtttcattatcttttgactttatgccagagctttcttcagaagaaaaaggaaacctgtttttaagtcttgcacaaaataataaaaagaaaagtatgttatcttttttaaagggactgtttccagcgaagctttgtccaattattttaagagaggcaaaggtagaagaaggacaaacgacgggcagaatgaaaaaacaagattgggagaatcttgtaaaagcagttgctcatttttcattgcgaattaacggatatgcaagttatgaaaaggcacaggtaacgagaggcggagtctgccttgatgaattaacagatacgttagagtccgttttgcagcctggactattttttgcaggagaagtagcagacgttgatggaacttgcggaggctataatcttcaatgggcattttcgagtggtacagtagcaggaagagcgattgtcaagagaaatcaagagctttttaaggatgaccggcatacgatggaagaaaacaatggtatttcagaaaggaaccgaagaagatgatacgaatttcacagttgaaattaaaggtgggacataccagggaacaactttttgaagagattattcatcaggcgcatgggaaaagacctgtctcctggcagattgtaagaaaatctgtggatgcaagaaagaagccacagcttttttatgtgtatacaattgatgcagagtttgaaaatgaaaagaaacttctttcagccaaaaaaagtaaatggacaaaaccatctgtttcaaactatacctttccatatagtaatagtaaagaagcaggaatgtttttcaaagaagaaaaactggaagaacgaccagtgattgtaggaatgggaccagccggactttttgctgcgttagttcttgcgagggctggatttgcccctgttgtttttgaacgtggggattgtgtggagacccgatctgaagttgtggaacatttttttgagacgggggaactggatgaggaatcgaatgtacagtttggagagggtggtgcaggaaccttttctgatggaaagcttaatacattagttaaagataaatttgggcgaaatcattttgttttgaaggaatttgtgaaacatggcgcaccggaggatattctttatgaagctaaaccgcatataggaacagatattttaaaagatgtggtggcatcaattcgaaaagaaatcgaaagtctgggtggggaagttcattttcggacaaaggtttgtgatatattgtgtgaggatattgccggcataaaagaagatgaggcagggaaagtccatgaacaggaaataactgctggcaggcagaacagccagatcaaaggacttcttatcgagaaagacagtgttcgtacaaaatacccttgccgcaatgttatttttgcaatcggtcacagtgcaagagatactttttctatgcttcatgaaaagaagctcttcatgacaccgaaagcatttgctattggagtccgtgtggaacatccggcgcatcttattaatgaaagccagtacggaaaagagtatccggaagaacttccaacagcgagctacaagcttacacatcagtgtgaaagtacgggccggggaatctattctttttgtatgtgtccaggaggatatgttgtaaattcttcttcagaaaaaggacggctttgcgttaatgggatgagttatcatgaccgggcaggacgtaattcaaatacggcattgatcacaacagtgacaccagaagattttccgtccgacagtccattagcaggtttggaatttcagcgtaagtatgaggagcttgcttataaaatcggaaatggaaagattccggtacagctttttggagatttcatgaaaaaacaggtatccacaaagattggaacagtcaccccatcaataaagggagattggcagtttgcaaatcttcatgagtgtcttccggattacgtttgtgaatctcttttggaagggatgaaggcttttggacgcaaaataaaggggtatgatgcagaagatgccgttttttcaggtgtagaaacaagaacatcttccccgcttcgcatggaaagaaataagaagtttgaaagtaatatcaaaggatttttcccatgtggagaaggagcaggttatgccggaggaatcacttctgcagcaatggatggtattaaaactgcggaagccattgcagagaagattctcacacagaattaagtacagccagcagcaagacaaagattgattgcatctactaacaaagatatttctgtgtttacaaacgtaggaccattgtgtataatacaacggataaaatactactacgaattctggctggaaaagccttaggatttaagcgaagtaagtggttattgataattattaaaagccgcttagtatacgaggagggacattatgaacaacgtcgatatcgacagaattaatgaattataccataaatcaaagtctgtgggacttacaaaagcagaagaagcagaacagaaaaaactccgcaaagcttaccttactgccatccgcaaaaacttgcgtggttctttgaaccgaattgacattcagaataaagacggaagtatcgaaaatcttggtgagaaatatggaaagaagctggataaaaactaaaatgccagaagaagctttagaattaaaaaagaatctgcggtgtgatatgaaagcaagacgaaatgcattgacagatgaagaaaaaaaacatgccgcagcaaactgcctgtcaaaattaaaagaactgccggaatttatgaatgcagacaggatatatgcctatatcgcctgccggaatgaattagaaaccgcagacattattagctggtgtctttctcatggaaagcatgttgccgttccaaaagtacaaggagaaatcatgcatttttatgaaatcactgcgctatctgactgtgttcccggagcatttggtatccttgagccagcaggagaagaaaaagacagaatcacaactccaggctttatgcttgtcccaggacttgcctttgataaaaacggaaatcgtcttggatacggcggtggattctacgataaatatctcgcatcccatgaggagattataacagcggcattggggtatgactttcaaatcgtagaaaaagtaccgtccgaatcccatgataggaggatggactatttaatttattaggcaaaatagacgcccccgaagagaaaagcgcctctatatttgtgactttagtcgcggcggtttggatgttcgcttatgcgctcgcatccaaaccttgctccgaggccacaaatatagaggcgcttttctcttcgagggctgtctttggctggatttttaaattaaatagtgcatgggaaagatttgaggttgaaatcggaagtctctcatccccaaattactcccaactaatcagtcatcggttttgtgaaggttataaatatctgccggattgtctgatgtaaataaggaagatattctttcatggataccggctgctggtataaaatgcaactatagcaggtagaacctaccagctctaagattgtaaaaagcattaattcctgattttcgcaggagatatgattctgtgtcagcatatcctgatagtaatcataaaactgtcgggaattttccgggacagtcttctcaaaagcatttttaaagattccccaggaaagattcttagagatgaactgaagaagcttcggttccttttctaatcggtctataatatgatcaatgacgaaaaacatctggttttcaaaaccctgaatattctgttctattaaagctgtatgtgcattcccaaaaagctgacttgttttatatgttacaagccggtctcttaaatcatatttatctttaaaatataaatagaaagttccttttgcaagacctgcccggtttacaatgtcggaaatggttgttttagtaaaacccttttcggtaaacagttcaaaagaggtctgcaataatgttgtattcttttgttttttatttgtctcaacttttcccataataataccaccttaagcgatgttgaatgtatttgggtacattatgtaacaaaaatgaccaaaagtcaataacgtaaaaatgaccaaaattcagtttcacttattgaggaaaattgtgcgttactcagtgttgaccgatggtcattttttgcatataatgttggttagaaaaataaaatagattgaagaaggggatgataagtttgttgattaagatgggtaagcagattgcgaaacataagtttcttatattgcttattggatttttgttactgataccttccttaataggaacagtaacaacaaaggttaattatgacttacttagttatctgccggatacgcttgagacagtaaaaggtcaggatattctggtggatgagtatggtatgggtgcattctcgatggttgttgtcgagaatatggaactaaaagatgtacagaagcttgagagaaagtttgaggcagttgatcatgtaaaggatgttctctggtacgatgatattgcagatctgaatcttccaatccagatgataccaaagaatttaagagaagcattttttaaaggggatgccacgatgatgatcgtactttttgataatacgacatcgtcagatgaatcgatgaatgcggttgctgagatgcggaaactggcgaataagcagtgttttatcagtggtatgtcaggagttgttaacgatattaaagatgtagcgttagatgaactgccaatttatgttgtaattgcagcagtattatcttttcttgtattggaattcactacggaatctttccttgttccggtgtttttcttattaagtatcggaattgctattttgtataacttaggaagtaacgtattcttagggcaggtttcttatattacaaaggcactgactgcggttctgcagcttggagttacgatggattattccattttcctgctaaatagttacgaggagtataaagaaaaatattcagaagataagaaccgggcgatgggtcatgcgattgccagtacgtttaaagcagttgtcggaagttctgtcacaaccgtagccggatttgcagcactttgttttatgacatttgcactggggcgagatcttggtattgttatggcaaagggtgttatcatcggtgtagtatgttgtgtaacgattcttccatcactgattcttgcatttgataaacagatcgagaagacaaagcacagaccgttgattaagagcgtagatggtgcatcaaactttattattaagaatcattggatatggttgctggtattccttgtaatgttacttccggcaatccatggaaataataatacaaagatttattatgatattgcaaagtcaatgccatcgactcttccaagtaatgtggcaacagataaattaaaagaagactttgatatgagtacgatgcatatgatcatgatggacagcaacatggattccaaagataaaagggatatgttagatgccattgataatgtaaaaggtgtaaagtggacgatcagcatgaattcacttgttggagcaactgttccggaatcaatgattccaaaggatataaagagtatgctgcaaagtggcgatcatgaacttgcctttatctgttctgagtatgaatcagcaacaccgcaggtaaataaacagattgcaaagattaataagataacgaaatcctacgataaaacttcgatggttatcggagaagctcctttgatgaaggatcttgaagatgttaccaatattgatattcagaatgtaaatgttgcttcaatcgcagcgatttttattatcattcttattatatttaaatcaatatccctgccggttatcctggtatcgattattgaatttgcgattgcggttaacatggcggtaccgtattatcagggtgtcagtcttccgtttgttgccagcatcgttattggaacaatacagcttggagcgaccgtagattatgcgatcgtttatacaagccggtatttgaaggaacgaagaaatggtaagaataaattagaggcaatcagcattgcacacaagtcaaatatgctttctattataacgagtgcattgagtctgtttgctgcgacctatggtgtagcctgttactcacaggtagatatgatcggttctatttgtacgttattagcaagaggtgctattataagtatgatcgttgttttaactttgctgccaacgatgttccttatttttgataaggtaatctgtaaaacgacaggtggaatgaaacatattgataactaaatatatcaacaattcagggagtgatgaagatgagaaataaaagatttataaagcatacttcaaaagcatttgctattcttatgagtgccatgatggcagtaggaattgcaatgccggtaagtgccgcagagaaaaaagaaacaaaagtagataagtcagaaactgtttatgtgaatgcgaatgcagacggaagtgtagacaaaattactgtaagtgactggttaaagaaccatggaagcagtgatgcattagaggatttttctaatcttacgaatattaaaaatgtaaaaggcgatgagacatttacccagaatgcagacggttctatcgtctgggattcaaaaggtaatgatatttattaccagggagaaacaaatgaggaacttcctgttactatgaaggtaagttattatcttgacggcgagaagatggatccgaaagatatggcaggtaagagcggtgaagtcaagattcgttttgattattacaataattctaacgaaacagtaaaagtaaaagggaaaaaatacaatataaagacaccgtttacaatggttactggaatgattctttcttccgatgtattttctaacatcgaagttaagaatggtaaagtaatcagtgacggagataagagtgttgtagttggtctggcattccctggtttaaagagcagtctgaatcttgcttcttatgataaattagaagatgtagatattccggattatgtagaagtaactgccaaagcagataagtttgaacttgctttgacagcgacagcggcaacaacaggaacattaaaaaatattgatacaagtgatttaaatgatgtcgatgatttaaaagagaatatggataagctgacggatgcaacagataagctgatcgatggaagtgaagcattatcagaaggtatgggaaccctttcttcttccgccggagaatatactaagggtgtatctactgcaaatgccggtgtaaaacagcttgtatccggtcttaatacattaaattctaaaagcagtcagttagaatccggtgtagagtccttaaatgaaggtttaaaggcactgaaaaaaggaacaaaagcattaaattccggtatttcttcttatacgaagggagtttctagtttagatgccggtctgcagtcagcagcaggtgggaccgataagttacaacagggagcgggtgctctttctaaaggcattacagactatacagagggagccaatgatcttgcaaatggaatcaaaaagttaaataataaggtttctggaatgagtaatttggaactgccaagtgacacagaattaaaggcagtaaagaaggcatcctctgcgttagaaagtgatgcgaaaaagttacaggaatcagcagcagagattcaatcggcaattgataagatgaagaagttatctgaagcagtggaggcgcacaatagtaagatagatgaacataataaagaagtttcagagaagttcagtagtgcaaagaaagcgttagaagatgtagacagtaaggcaacagaagaggcaaataaacagatttctgataagaaaggttctatgagcagtaaagcaacagcagatgccaaagtagcagcgaagtcagcgattgacagtgtaaatggtttaacaccggagatgaagagtgcattagagaatgcgatcgacagtaaagttagtgtaagtgtagagccatcaagcattgaaatcagtggcctgacagatgatgctaaaaatgcattagtagatgttccaagtgcagataagcttacgcttggtgaactgaaagtcagtcttggagatatcgagactcttttgaaacgtatgaaggaacaggcaactactttagagaattttgcggcaaataccggttctttatctgatgcagcaggtgaaataccggcattgatcaaaggtgttagtgatctaaacagtggagcgaagaatcttacagcaaataataaaaagcttacaagcggtatgaaagatctcacttccggtcttagcagcctttccgatggtcttgatacaatgacaaagggagcagctactttaacaggtaataataacagtcttacgaccggagcagattctgtagataaaggaacaggcaaacttgtagaaggaagtaaaaagttagtaacaggtgttaaagcatatgcacagggtgtgaatgccgcagcaatcggcgtacagagtctttccaccggaatgaataagttagattccgcaggtggtcagcttacttctggcattgataagcttgcaacaggaagtgatactcttacagagggattaaaaacatttaataatgacggaatcagtaaactttctgatcttgcaggagatgatcttgacagtgtgatcaatcattttaaggcagtgaaaaaggcagataagagatatcagtccttcggtggaattaaaaaaggcgcagaaggcagtgtgaagtttgttattgaaacagatgcgatcgaaacggaagatgagtaggaaaatcgcataaaaacgagagataacaggtaaaatttaaagaaatcccttgataaatagagaaaaacctgttatactacgaatagtatactgtagatgataagagtgggtggctgcccactcttattgtatgtctgggaaagaggtgagaatcaacatgaaaagaacagagattgttgcaaagacggaagaacttgtaactccaattattgaagagaatcattttgagcttgtagatgtggagtatgtaagagaaggtgcgaactggtatctgcgcatatatgcagataaagaaggtggtatcaacattgatgactgtgttttgatcagcagggcgcttgaagagaaactggatgcagaagattttatctctgatgcatatattttagaagtaagctctccgggtcttggaagaccattaaaaaaggagaaagatttcaagagaagtattggaaaggcggtagagtgcaagctttataaagccattgacaaacaaaaagaatttgaaggagtcttaaaagactttacagaagataccgttacgattgaaattgacgaaaaagatctggtattagaccgtaaggatattgccatgatccgtcttgcgattgagttttaaagagatatagataaacaggaggatacgagaaaatgagtgaattaattgatgctttaaatcaattacaaaaagagaaacatattgaaaaagaagtaatcatgcaggcgattgaagattctttagttgcagcatgtaatcgtgactttggtaagaacgccgttgtaaaggtaaatatggacagagaaacaggagatatctctgtatatgtagaaaagactgtagtagaagaagtagaagatcctgcaacagagatcagtttagcagatgcaaagatgatccgtttccattatgaacttggggatgtagtaaatatcgaagttactccaaagaactttggaagaatcgcagcacagcatgcaagaagtgttattgtgcagaagattaaagaagaagaaagaagagttgtatttgaacattttgcacataaagaaaaagatatcgtaacaggtgtagtacagcgctgtaatggaaagaatatcagtgtaagtcttgatgataagaccgatgctgttctcacagaaaaagagcaggtaaaaggcgaggtatttaaaccaacagaccgtattaaactttacatcgtagaagtaaaagatacaaacaagggaccaaagattttagtttccagaacacatccagaacttgtaaagagactttttgaaaaagaagttgcagaagtttatgatggaacagtggaaattaagagtattgctcgtgaggcaggttcccgtacaaagattgcagttgcatccaatgaccctaacgtagatcctgtaggagcatgtgtaggtatcaacggagcccgcgttaatgcaatcgtaagtgatcttcgcggagaaaagattgatattattgaatggaacgatgatccggcagtattaattgagaatgcattaagcccatcaaatgttatttccgtagaggtagatgaggaagaaaagagcgcacgtgttgttgttccagattaccagctttctcttgcaatcggtaaagaaggacagaatgcacgtcttgcagcaaaactgaccggatataagattgatattaagagtgagagccaggcagcagaactttctgaaaaattagactttggtgatgattttggtgattttgatgagatggaagatttcgatcttgaagcacctgcagaagagacagaagaagtatctgagctgacagaagcagcagaaagcagttctgaagaagaggaatcttttgaggaagaaattccagaagaaccagaacagtaagaacggaatctggtgaacagctatgggaaagaaaataccacttagacagtgtgtaggctgtcgtgagatgaagacaaagaaggaaatgattcgggtaatcaaaacgccggagaatgaagttgtccttgatgtgaaaggaaagcagaatggcagaggtgcttatctttgcttttgtgcggaatgtcttcagaaagcaagacgttcaaaaggattggaacgttctttaaagatttccattcctgatgagatatatgaccgattagaagaggagttgaaggaacttgacacaaaacagtaaagtattatccatgcttggacttgcagcaaaggctggtaaagttgccagtggagaattttctactgaaaaagaagtgaaatccggcaatgcctgtctggtaattgtagcagaagacgcttctgacaatacgaaaaaaatgttccgaaacatgtgtaagtattatgaagtgcctatggagatatttgcgacaaaggaagaactagggcattggataggtaaagcgtacagggcttccatctgtatcttggatgaaggttttgcaaaatcgattgttaagaaaataaatctgaatatggagggatagtgtatgccaaaaatgagagtacatgaagtagcaaagttattagataaaagcagcaaggaaattattacaaagttaaaagagcagggagttgaagtacagagtcatatgagtacggtatcagatgaaaatgtagaaaaattaaaagcagaattccagaaaaaagaatctggcaataatagaggtaataacgataaccgcggtaaccgtaacgataacagaggaaatcgtaacgataatcgtggagataacagaaacaataaccgcgataatcgcggaaaccgcaatgataatcgcggggataacagaaacaataaccgtaataacgataaccgcggcaaccgtaacgataacagaggaaatcgtaacgataatcgtggagataacagaaacaataatcgtaataacgataatcgtggcggccgtaatgataatcgtggggacaacagaaacaataaccgcggcggtaatgacagaagaaacaagtcttctatgggagatactccgattaacgcaaaggaaacaagaaacggtaaagaaaaccgtcatgatattaatcgtgagcacagccgcgacaataaagagaataacagaaatgaaaatcgtggtggaaagaataaccgccgcaataatcgcaacaatgattttggtggacagagaaagcagaagaacaataagaaacagcagcaggctcctgtacagccaccaaaacaggaagagccaaaggaagatgtaatccgtaatattactctgccagatccagtatctttaaaagatttagcagatgcctgtaagattcagccatcagttatcattaaaaagcttttcatggctggacagatggttacgatcaacacagagttttcttttgatgatgcagcagagattgctttagaatacaactgtattgcagaagaagaagtaaaagttgatgtgatcgaagaactcttaaaagaggaagaagaggatgagagaaacttaacaagcagaccaccagttgtctgtgttatgggtcatgttgaccatggtaaaacttctcttcttgatgcaattcgttctacacatgttacagcaggcgaagcaggtggaatcacacagcatatcggtgcgtatgtagtagagattaatggagaaaagattacattcttagatactcctggtcatgaagcatttacttctatgcgtcttcgtggagcgcaggcaacagatattgctgttttagttgttgctgcagatgatggtgttatgccacagacaatcgaggcaatcaaccatgcaaaggctgccgaagtagaagttatcgttgctgttaataagattgacaaagagggcgcaaatgttgatcgtgtaaaacaggaacttacagagtatggtcttattgcagaagactggggtggaagtacagtatttgtaccggtttctgctaagacaggtgaaggaattaatgaacttttagagatgatttctcttactgccgaagtattagagcttaaggcaaatgcaaagagaagagcaagaggtcttgttatcgaggcgaagcttgataaaggtcgtggtccggtagcaacaatccttattcagaaaggtactcttcatgtaggagacagtatcaatgtaggccacgcatttggtcgtgttcgtgcaatgatggatgataaaggtaatcgtgtaaaggcagcaggcccatctacaccagtagagattcttggtcttaacgatgtaccattctccggtgaagttctcatggctcatggaaatgaaaaagaggcaagagcaacagcagatgcatttattgcttatggaagagaaaaaatgcttgaagagacaaagaataagttatctcttgatgacctgttcgatcagattcaggcaggtaatgtaaaagaattaaatctcgttgtaaaagccgatgtacagggctctgtagaagcagtaaaacagagtctcatgaagctttctaacgaagaagttatgatcaaggttgttcatggtggtgtaggtgccattaatgaatccgacgtaatcttagcttctgcatcgaatgcgatcatcatcgggtttaatgtacgtccggatgcgatggcaaaggctgccgcagaaagagaaaaggttgatatgagattatatcgtgtcatctataatgcgattgaagatattgaagcagcgatcaagggtatgttagatcctgtttacagagaaaaagtaatcggtcacgtagaagtacgtcagatttacaaagcttctggagttggaacaatcgctggatgttacgtacttgacggttctatcacaaaagatgcacaatcacgtatcgttcgtgacggtatcgttatttatgaaggagaactggcatctctgaaacgtttcaaagatgacgtaaaagaagtaaaatcaggtttcgaatgtggtatcgttttcgaaaaatataatgatattaaagagggcgaccagatcgaagctttcgtaatggaagaaattcctagataacaggaggtgctgttatatgagaaaaaacagtgtaaaaaatacccgaattaattctgaggtattaaaagaattaagccggattatttccagagaaatcaaggatcctagaattgctcctatgacttctgttgtatccgtagaggtggctccggatttaaagacctgtaaagcttatatcagtgtacttggtgataaagaagcacaggaatctactttagagggtcttagaagtgcgcatggttatatccgtcgtgaattagcccgcagtattaacttaagaaacacaccggatgttcgttttattcttgatcagtcgatagaatatggcgtaaatatgtcaaagaagattgatgagatcaatgcagcaatgcatgcaaaagaaaaggaggcatccgaagaatgagtacagacaagagagaaaatatgacatttgccgaaagaaaaaaagagtttgaacttcagattcagaacgcagagacaattgccatatccggtcatatgaatccggacggggactgtatcggttcctgtcttggactctatacctatattgtggaacagtatccagagaaacaggtaacactattattagaaccggtacaggaaaagttttcttttttgaaatatgcggatcagattactcaaaaaaaagaaagtacggaaccgtatgacctgtttttttctcttgattgttccgatacagaacgtcttcatgaatttaaaaaatattttgaagaagcaaaatacaagatttgtgtagatcatcattttaccaatcagggatttggtgatctgcaatttatcgtaccggatgcttcttctacttgtgaagtattattttctatgtttgactgggaaaagatttcccttgcctgtgcacaggatttatacatgggcattgttcatgatacaggtgtattcaaacataccaatacaacaagaaagacgatggagacagcaggtgctttacttgaaaaaggaatccattcagaagatatcattgatcgaacattttacaaaaaatcttatgtgcagaatcagatacttggaagagcacttatggaaagtattgtactcttacatggaaaagtaatcttttcgattatccgtaaaagagattttgatttttacggaattaacagcagtgatcttgatggtatcattgatcagcttcgtgtaacagagggcattgaatgtgccattcttctttatgagaaagaagatggtaacttcaaagtaagtatgcgttctaacgatgcggtagatgtcagcgcgatcgctcagatttttggtggtggtggtcatatcaaagctgccggctgtactgtgcatggacagccaagagatatcgttatgaatatcacacatatggtagagcatcagttaaatgaatcaggagaaaagcaggaatcaatttatgataagcggaattcttaatataaaaaaagaagcaggatttacttcccatgatgtagtagcaaagctgcgcggaattgtacatcagaagaaaatcggacacacagggacgcttgatccggatgcgacaggagtacttccggtgtgtcttggaaaggcaaccaagctttgtgatattattggagactgggataaaacttatgaggcagttcttctccttggaaaagaaacagacaccgaagataccagtggcaagattcttggggaaaaagaagtaacagtcacagaagaagaaatacaaaacattattctttcttttcagggtacgtatgaccagattccacccatgtattcagctaaaaaggtaaatggaaagaagctttatgagctggcacgacagggaatcgttattgaaagaaaaccttgtccggttacactttcttctattcacattaaaaagatagaactcccttatgttacttttgaagtaacttgttcaaaaggaacttatatccgaagtctttgccgcgatatcggggtaaaagcaggatgtggaggatgcatggcaggtcttatccgtaccagagtttcttcatttagaattgaggaaggatttacgctctcagaagtagaagaaatgagggacagagatacactgtcagaacatatcataccagttgacaaagtttttttacatctgccagctgtttttgtaaaagagaagggagaaaaacttctttataacgggaatccaattgctgtagatttatacgaaaaagaaccatcagcagaaagacagaacgcaaatgaaaagcaggagtacatatacacagtcagtgacagagtacgtgtatatgacagtcaccataattttatagggatttatcagcttcaggaaaaccaggtattaaagccttataaattgttcctgtaaatactcacaaaatccataccgcaaaagactagcggtttcggagggaaaaatggaatatataacaagctcagactttcattttaaaaacaccgcagttgcacttggaaagtttgaaggaattcaccgaggacatcagcttttaatggacgaagtaaaaaaacaggagcttcatggacttcaaagcgttgtatttacttttgaccgtccaaccagactaacccttaccggtgatacaaaatataaacagatctatacaaaagaagagagaaaaacaattcttgaaaaaagaggaatcaatatattgattgagcatccttttacaaaagaatttgctgcacttactccggagagatttatccgggaagttcttgtagaaaaagtaggggcaaaggtcattgttgtcggaacagattttcattttggaaagaaccggtccggcagtattttagatttagaaaacctagaagaagaatgtggatatcatcttatcgttgttgaaaaactgcagttagacggaaaagatatcagcagcacaagaattcgtgcatctcttgaaaaaggagacatggaagaagccagtgcacttttaggcagaaactatagtgtttccggagagattattcatggaaatgcgctaggacgcacgatacaggttccaacaataaatcagaaagtgccatcctttaaattactgccgccaaatggcgtatatgtttcaaaaattcactggaatgatgaagtatattatggcattaccaatatcggaaccaagccgaccgtaaacgacaccaatgaaaaaacagtcgaaaccaatatatttgattttgataaggatgtttacggagaaaagatggttgtagaactcttacattatcacagaaaagaaagccgtttttcttccgtagaagcattgcagacacagctttttaaagatattgaatttggaaagcaatttgttgcaaagattaggtaggatactagggaagcagagtttgacggagttatgacaagcattgagaaaatgtagaatcatataaagctactggaaaacaataagaatttacccatgtcttttagaataacagaaaaaaggagtttctgaaaatatcagagacttctttttttattgcaaaatcttttatttatctaatttttacgagttcttttgaggaagaatttgcagaagtatcttgttgaaattataatatcattgtggtgaatttgatatgggaacgatacttggtgccgaaattatcggcggtatcgttgcaatcatctttggaatttttgtaaaagagattagaaaactattcccggatgttgttactggaactgtaatttttacaattggtctttctctttatccaaccgcgataaaatacatggctgggggagccggatcaaaagaattcggaagtatgaagaattgggttgttgctctttgtacatttggagttgttcttattttaagtaattttacaaagggaatttttaaattagggtcatccagaatcatataatttcaataatgatgattctggaagattataaatatattagattgtatttttcgattttatttcatctaagtaactatacagagtgtatttggatattcctaagaactggcagacctttggcccggatttggtaatcaggaaagcaccagcttcatttaaaaggcggacaacctgcaccttatcttccttagtcattaaggtaactggcttaccgatatgccgtacactctgcgagattaattcgtctaataaatcgctgatatttacagcaataggttctttggtagtatcttcttcaatagtaccagtgaaggaagatagctctttttccatagcaagcattaaggaaatgtcataattgattccgaaaattccaatgattttatcagaatcatcacgaataaaaattgtacttgattttaagatttttccattttttgtttttgtgagataggcgagcttatcttcctgttttaagttttgcttactattatgaagagactccagaacaatctgagaaggtccgtcaccgattcttcttccagttacgtgtccattctcaatggcgatgatagagtgttctatgtcttttccctgcaggtcatgtacaacaacttcacagttagagccgaactgtacagccagaccatgagcaagccttgtgtagaattcaataagagattttttcataatcaataaaacctttctgaatggaatattttataactatttaagtctgttatcataggataaagcagacaaaatcaaaagaatttaaatagtgtatttcattatatcagttaaaaaaaataaattcaatttctaatctaaaaaaaatttaggaggacagctaaatgttattaataggaaacggaagagtaattacacgcgaccaggaataacgatttcttacgatattacaggaaaccggccatatatcgaaaaaaatccatattccgtacttcttaaaaacttaaaagaagcaatagaagcagagacaaaacaaaaagctgtggtcaaagcctttaccggctacacagatactgcagtcatcgcaggaaagctgcataatacagaatgtatgtcctacggtccaggaagcctgcaatatgcacataaaccagatgaatttgtagaaattcgggatataataaggtgtgaaaaagtgataaattatctggtaatgtccctgtgtggggagagataaacaaacatatacaaaatgtttttgtggaaattgtctgaaaattagtgtataatgtaaccaaatgcaaaaccgccgagacattctttaattataataagagcaggcgtaagcattttctgaaaagaacgacaaaaggggtggtgtcatgaacacaataatcacaataggaagacagtacggaagtggcggaaaagaaatcggaacgaagctcgcccaatattacaacataccattttatgataaagaacttttaaaagtagcagcgaaagaaagcggtatctgcgaagagatgtttgaaaactttgatgaaaagcctacaacaagttttctctattctcttgtaatggatccatatgcattaggttataatgcaacatcctttgatatgcctctgaatcagaaggtattccttgcctcctttgatgcaatcaaaaaggtagcagacgaaggtccatgtattatcgtaggccgctgtgcagattacgccttaaaagattatgacaataagctgaatgttttcgttcatgcgccaatgtcctttaagaagtcccgtattcaggaacagtacgagattccagaagcgaaagtgaaggacgtagctatcaagacagataagcagagagcaagctattataattactacacttctaaaaagtggggggatttaaagagttatgatctttgcattgacagcagtatcttaggtattgatggaacagtagaactgattaaacaggcagtggcattaaaagagaagtaaaaaataaaagagaacagaaacccgaaagactaagcagaagcatttgtctttcgggtttctttaactttatcttgtctatagcaacttagaattctattcttcttcctggtattctttattcaccttattataagaaataaaatatggtgcgaagttcttctcctcatcttccttttttaccggttcacacttgcggataaagtttgttcgtgtcttaggttctgctgctggtgctaaaactccatgcgcttttccggcatcaatagactttaacagccaggccatgttgcggcctaaggtacgcataaccataagaccttctaagtcctgttcgacctcttccggtgagtttccatgtaccatgttccagtaagcggaagggacgagaggcatattattcatcataaaatacttattaagctgttctaaagcagcagtagagccggcacgacggcagcttacaacagcggcgccaggcttgtaagggaaacctccggtagagtaaaacatacggtcaaggaaagaagtgattccaccgcttgctccggcataatgaacaggagaaccaacaataagaccatcacattcttccatctttttaataactacgttaacagcatcttctccaaaaatacattttccaagtttgttcttacggcacataccacagcccatacagccgcgaatcggatcatgaccgataaaaaatatttctgtttcgatgccttcctgctgaagtgtcttttccacttcagagagtgcgcggaaagtacatccgttaggatgtggacttccatttaaaagtaataccttcataaataatcccaaccctttctataagttctataagttcttttgtttctggcaatgcttcggcatctttgtaattctgccggagactatatcagatgggactcatcgctcatctgatgtattatctgtttttaaacaggatgttggtgtatagttctcttttacataatctggtccgcagacctcatgaactttagtaatagaaattggcgtaatgccgcagacacgcaacagttcacaaccaacttgttttccggcttctaaagccttctggacagtggatacatctccggaaattcctgcggaaaattcattcatcattgtaagattatgtgatggagagccgtaccatacgatgtcaacgagagcagccttcattgcctgatcaacggcgacaataccgattccggcaggagcggcaccaattacgccgaatgccttgccaagtggtgtgccaaaaatctcatggagaatctcaccggcacgtggagtgacatgggattccatatgtcctacttcattaatataaatgcaggcagcccagtaatcaatctgctttaaggcaatctctacaagtcttctggcatcggaaatattctctgcaccaaggacaaagagacatccctgtccacactgtttgccagcatcaattgccatctcaaaacgaagcagcttcgcattcactgcttttacagcatcatcgatcgcaatcgcctgtgcgacagttccggttcgggaagatacaatactgatagcctgatattcgtccggaatctgcagaagcgccttaatatcttcatgaattgttccgataacaagaccaatggtgtttgctgcagcagtgccgacgaactgggctgcttcggactgcaaaaaattattcacgttcattgttatctcctcctaaatctttaaatagtatagcatggactgggaaaaatgtatatatgatgccagaaaatcaccttgtttttgtaaaaatatacaggtatacttatgtaataagattttgaatgcgaagaatttttttggttttgaaagaagtataacttttgagtgaaaaatattgtagttttggaggggtaattatgataatggaggtaaagaggttcaaaaaagtacttgtcgcaaacagaggagagatagcgattcgtgtatttcgggcattgagtgagcttggaatcggctcagtagcggtttattcaaaggaagatcggtatgcgttgtttcgaacaaaagcagatgaggcatatccgttaaatccggataaaggaccggtggatgcttatctggatattccgacaattatccgaattgcaaaggagaagaaggcagatgccattcatccgggatatggatttttgtcagaaagtccggagtttgcagaagcgtgtcggaagaatgatattgtttttatcgggccgacagttgatgcgatgaatatcatgggagataagatttccgcgaagaaggcagcagaggaaagtaaagttccgattatagatggcagtgattttattattcatgatgcagataccgcaagtaaggttgcagacgagattggttatccagtcatgttaaaggcaagtaatggcggcggcggcagaggaatgcgtatcgtgaagagtccggaagagatggaggaagcttttgagaagtcaaggaatgagtcaaaacgtgtttttggcgagtcaaagctttttattgagaagtatttgatccatccaaagcatattgaagtgcagattcttggagataattacggtaatatcgttcatctttatgatagagactgttctttacaaagaaggaatcagaaggtaattgaatttgccccggcatggtcaatttctgatgagacaagaaagaagattttagattctgcaaaaagactggcaagaagagttggttatacgaatgtaggaacgatggaattccttgtagatgaggaggaaagaccttattttatcgaaatgaatccacgaatccaggtggaacatacggtgacagagatggtgacagggatcgatattgttatttcgcagattcttgttgcggaaggctatccgttaaattctccgacgattcatatttattcgcaaaatgaagtgaagtgtaacggttatgctttacaggcaagagtgacgacagaagatcctgcgaatcatttccttccggatacagggaagattgatctgtatcgttccggttctggtgggggaatccgtcttgatggcggtactgcttatacaggtgcgatcattacaccgcattatgacagtttacttgtaaaagttgtttctcatgacaggacgtttgagaatgcgattcataaatcagtacgtgcattaaaagaacttcgtattcatggagtaaagacgaacattacatttctgattaatgtattgaatcatgagacatttcatcagggaaagtgttttactacatttatagaagaaacaccggaattatttgaattacattataaattagaccgtacaacaaagatattagagttccttgcaaacaagatggttaacgttaatccgggaccaaaaccgtttttagaagatcgaaaagtgccggttgtagatacagagagaaagctatatgggacaagagatgaatttttgcgattaggagcggaagaatttacccagaaagtttatcggagtcagaagctgtatgtgacggatacaacgatgcgtgacggacagcagtcgttacttgcgacaagaatgcggacaaaagaagtggcaggtgcggcaagagcgacaaacctgtatttaaaggatgcgtattcaattgaagcctggggaggggcaacgtatgataccgagtatcgttttttaaaagaatctccatggaaacgattggatattttaagagagcgtatgccaaatgttatgatacagatgctgctgcgtgcttcaaacatagttggatacagtacctatccagataatgttattaagaagtttatcaaggtatccagtgaccatggtgtagatatttaccgtatttttgacagtatgaactggatggaaaatatgaagcttccggtagaagaagctttaaagacaggaaagattgttgagggagccatctgctacaccggagatattttaaatccaaaggaaatgaaatatacgatagattattattgtaaaaaggcaaggcagttagaaaagatgggatgtcatgtgatcgcattaaaggatatgtcttctttattaaagccatatgcagcgaagaagctgatcgaagctttaaaggaagaagtacgtgttccgattcatcttcatacacatgatacgacaggaaatggaattgcaacatatctgatggcggcagaagcaggggtagatatcgtagactgtgcgatcggttcgatgagttcccttaccagccagccatcaatgaatgcattagtggaagcactgcggggaacaaagcgtgatacaggaattgacccggacggattacttgttttaaatgattattacgaacatgaacgtaagatttataagccatttgagagtgatatggattctccaaatccggaaatttataaatacgagattccgggtggacagtattctaattttgccgctcaggtaaaagaaatgggtgccggcaatgattttaatgatattaaacgtctttataaagaggcagatgaagttctcggaaatattattaaagtaactccgacatcaaaagttgtcggtgatatggcaatttttatgttgaaaaatgatctgacaaaagataatattttagagaaaggaaaagatttatcttatccagattccatcgtacagtatttcaagggtgcacttgggcagccggaaggaggatttccagaggaactgcaaaagattgtattaaaaggacaggaaccgattacggtacgtccgggaaccttacttccggatgtggattttgatgcgatcggagcgtacctgcgggagaattactacatggaatctatggaacagccggaagttatggagcagaaagtattaagttatgccctttatccaaaggtatatgaggactattgcgagcatttccaggcatataatgatgtatcgaagttagaaagtcatgtttacttctatggtcttcgtccgggagaggaaacaacgatccagattgaagaagggaatgatacgttgattaagtttatcggcaagtcagaaccggatgaaaaaggatatcgtattttacagtttgaagtgaatggatttttacgcgaagtgaagattcttgataagcattttgaagtaaaggcagatcgaaagttaaagactgatccgaagaatccgggtcatcttggggcgaccttaccgggaacaatctgtgatatccggattaaagaaggggaccgcgttcagaaaaatatgccgcttatggtgattgaagccatgaagatggaaacaactgtcatttcaaaagtgaatggtattgttgataagatttatgtaaaggatggagaggaagtgaatgaggatacccttctcgcatcgtttattatcgatacagatgaacagccggaagaagtgcatccagaacttcctaagatggatcttgcatccttagatgaggatgaattcaaaacagtcgaagtggctgaaaaagaaaataaatgaattttggaggtgttgatggaaagagagcatattactccgcaaggagtatctgtatttcacgataaaaatgaaaatattcacagtttctgcctgtgcttgtatgtgcgggcaggatcactgtttgagacaaagaaagagaatggaatttctcatttttttgaacatatcgtatttaaaaatattcattatgccatgggagagaatctgtatcagaccttagatcggtgtggacttgattttaatgcgtctacttatgaagaatttattcagtttattattacaggtgcaccggcacattttgaggaagcagcagaaattctgacaggaatatttgcaccgtttactctgcctgaagaagcaattgatacagaaagaaagcgtattaaagcagaaattcgtgaagaagatgaggagagcagcctgaattactttacaaaacagattgcgtggaaagatacttcgttagagagaacgattaccggaaagaaaaagacactcaataaaataagaagaaagcagcttcgtgcttttcaaaaaaaggtactggctgccaataatattttcttttatatcagtggaaattacccggaatcttccttatctgtactgacaaggctgctagagccatattctttttcctttttaaaagaagaacgggagaatatcgcaccggtgccaaagagatttggacagagaaagccaaagatctatgtgaaaaacagcaagaaaacctgtgtctgtttttctgtagatattgatgcatcccgctatacgctggcagagaaaaatctgttatttgatattttatttgagggagaattctgtaaaatccatcaggaactttcagagaaaaaaggctatgtatatagttatgacccatgttttcagcattataataacattgggcagatgactcttgtttatgaggtgttaccgaaacatctttatgattctgtagaaacagttatagaagtattaaagtctatgaaagaaggaattacagatgaactttcttatgttctgcctcactatatagataatgcaggctttttattggatgatacggaagaatttaactgggtcagagcttatgaaggacatattcttgacgtatactataaagatatcgaggaacgaacagagtcttaccgaagtgtcacaacggagcgtatgacacagatctgccgggaagtattcagacaaagtaatatattactgacaataaaaggaaagaagaaaaaggtagataaggagcgtctttccaagattctttgtacgttagattgacccggaacgtttcttgggatataataaagtcgtttatggaggtgtaatgttatgagagagaattcatggcttagttatacggatgaggatgataagaatgtagaagttctcgccggagagtataaagaatttttaagcaaatgtaagacagaacgggaatgtacagagtattttactaaggaagcagaagcttgcggctatcaggatcttaataaactgatcgcacagggaacccgtttaaaagcaggagataaggtatatggtgttggcatgggtaagacgatcgctcttttccagattggaaagcagccgcttaccgagggaatgaacatcctttgtgcgcacatcgattctccacgtcttgatttaaaacagaatccgttatatgaggatacagaattatcttttatggatacacattattatggcggtattaagaagtaccagtgggttgcacttcctcttgcacttcatggcgtagtggcaaagaaagatggaacagtaatttctgtcaatgtaggagaagacccggcagatcctgttgtttacgtgacagatcttttgattcatcttgcaggaaagcagatggagaaaaagggatcggtcgttgttgaaggtgagaatctggatattctcgtaggaagccgtcctcttgccggagaagaaaaagatgcagtaaaggcaaatattttacgcattttaaaagaaaaatatcagatagaagaagaagattttctttccgcagaaatcgaagtagtaccggcaggtcctgcaagagactgtggacttgaccgcagtatgatcgcaggatatggccatgatgacagagtatgtgcatttccatcttttgcggcaatgatggagacgggacatgttgacagaacttcctgctgtcttttggtagataaagaggaaatcggaagtgtgggagcaacgggtatgcagtcgatgttttttgagaataccgttgcagagattcttgcattgatgggacaggattctaatctggcagtaagaagaacactggctcgttcaaggatgctttcttctgatgtaagcgctgcctatgacccagcttatgcagaagcatttgagaagaagaactgtgcttattttggaaaaggaatggttcttaataaatataccggagcaagaggtaagtctggttctaacgatgcgaatgcagaatatcttgcgagacttcgccgtatttttgatgagaataaagtcgcttttcagacagcagagcttggaaaggttgattatggcggaggtggaacaatcgcctacattgcagccctttatggtatggaggttgtagatagcggtgttgctgttttaagtatgcatgcgccttgggagattatcagcaagtctgatttatatgaggcgaaaaaaggatatcttgcctttttaaagaatgcttaagtgtaaaaataatcttgaactggagaaacatatgaattgtcagaatgcacagtccatggtactgaatttcattaataataagttagataaagaagaaaccaaagaattcattgagcatatccgtagttgtaaagattgctgggaggaactggaaatctattatgttatgctgatcggtttaaaacagcttgatgaaggagaagaactggccgctgattttaaagagaagcttcagaatgaagtggacagccgttatctggagatagaaaagaattctaagcggaagtatgcggcaaagatcgtaatcgttcttacgatagcggtaatgcttatctggatgtttgtgtatctggtttttgcgatgtttctttaaattgtaaagtctggcagagtagaggatggaagtgttaagtaaagcatgacgatccttcaatatgccagctaacctgcactgaagaaagaaaatatctgaattcagtcgcaggtttttgtgttataggaggaaatatgtcagataaaattatactgttagacggacatagcctgttgaaccgggctttttacggtctgccggatctgacgaatgccgaaggaaagcatacgaatgcagtacttggttttctaaatattatgcttcgttatgtagaagaggagaagccgacgcatcttctagtggcatttgaccggaaagaaccgaccttccgtcatataaaatataaagaatataaaggtacgagaaagccgatgccggcagagttacacgaacaggttccgttaatgaaggaagtcttaaagacgatggaaatcccaattatcacacaggcgggaattgaggctgacgatattttgggaacgatcggaaaagaagcggaagaagccggttttgatgtagcaatcgtatcgggagaccgggatttattgcaacttgcaacaaaaaaagtgaaagtaaagattccaaaaacaaaggcatccggaacagtgacggaagattattatgaggatgatgtccgcgaactttacggcgtgagcccaacagaattcattgatatgaaagggcttatgggagatacttctgataatattcctggagtccctggaatcggggagaaaacggcggcaaagattattaaggaatatcattctattgagaatgcttatgaccatatcgaagagatcaagcctgcacgagctaaaaataatttgcaggaatactacgaacaggcaataatgagcaaagatcttgcgacaattaaaaaagactgcgatctttcttatgattttaaggatgcaaagattggaacactttttacaaaggaagcataccagttatttaaagagcttgagctaaaaagtctgtttaagtattttgacgaggaagaaaaggaagaagaaacactagaagtagtgacaacctctgatttaggagaagtggagaatatcttttcttctattaaaaagagtggacgggcaggacttggtgtgatcggtgtcagcggaaattgtaaaggaatttctcttacctggaaagagggtagtgtactggcattaatcggtggatttgtcacagaagattatttgaaagaaaagatagtagaacttttaaaagagggcacagaacttatagtccttgattataaagcattgcttcatttcgtagaggaagtcagagagtatgaaagccagattcaggatgtcgggattcaggcatatcttttgaatccgctgcagtctgcttatgattatgaagatattgcaagagattaccttagacagatgcttccatcaagaaaagaaatctgtggaaagaaagcaatagaagaagtatttgaagcggaagaagaaaagacagtacagatggctgcctatttttcttatgttccgtttcatgcttacccacttgttcttgaaaagttaaaagagcaggagatggaagaactgtatcttaccatcgagcgtccgacggttgctacactttatgacatggaaaagtatggaattacagttgagaaagatgctttaaaggagtatggagatcagcttattggcagaattgaagagttagaacaaaatatttacgaaaaagcaggtaagacttttaatatcaattctccaaaacagcttggtgtgattttatttgaagatttaaaaatgccttttgcgaaaaagacaaaaacgggttattcaacaaatgcagatattttagaaaagcttgcaccggattatccaatcgtatcagagattttagagtatcgtcagcttacaaagttaaagtcaacgtatgcagacggacttgctgcatttattcaagatgatggaaagattcacagtatttttcatcagaaagtaaccgcaaccggaagattatcaagttccgatccaaacctgcagaatattccgattcgtatgccgcttggaagggcgatccgcaaagtatttgtcccagatcccggttatgtatttgtcagtgcggattattcacagattgagcttcgtgtgcttgcacatatggcaggagatgaacacctgatcgatgcgtaccgacatggagaagacattcaccgtatgactgcatctcaggtatttggcgtaccatttgaagaagtcactccgctgcttagaagaagtgcgaaggcagtaaactttggtattgtttacggtatcagcgcatttggacttagtcaggacttaaagatttcccggaaagaagcaagtgactatattaataaatattttgcaacatatccgggaattaaaacataccttgatggcaatgtggcttttgcgaaaaaagaaggttatgtaaagactttatacggacgaatccgtccgattccagagctttcttctagtaactttatgcaaagaagttttggagagagagtggcaatgaactcttctattcagggaacagcagccgacattattaagattgcgatggttcgggtaagtaaacgcctgcaggaagaaaacttagaatcccgactcattttacagattcacgatgaacttttgattgaaacaaaagagaatgaaagaaaagaagtccgtaaaatactagaagaagagatgatgggagcggcacagcttaaagttccgctgtctattgatattgaagaaggaaagacctggtatgaagcaaaataagaagcgaaatgatataaaagttgttggcattaccggcggagttggttctggaaaaagtgttgtcatgaatattttaaaagaaaaatatggagcagaaattattcttgctgatttagtggcacatgatctgatggagcctggacaaaaaaattatttagatattgtagaggcatttggaaagaaagttcttgccaaagataaaacaatagaccgtccggcattagcaaagcttgtctttggagaccaggaaaagcttagccgactgaatgccattacacatccaaatgtaaagaaagaaatctttcggagaattcaaaggataaaagaaaaaggagaagtatctttcattgcagtggaagcggctctccttttggaagaaggctatcaaaatgattttgatacgatgtggtatgtgtatgttgatgaggcaacccgtatcgaaagattgaaagaaggtcgtggatataccgaagaaaaatgtcatgaaattatggcaaaacaacttccggaagaagtattccggaaggaatgttctacagtgatcgacaaccatttaggaatctctgaaacggaaaatcagataaaaacggcggtagagagcctgctttctctttactaactctttactaataagataatttagtatataatggttggtaaatttgagccaaaaggatggtaaatagatgaatttagcgagcatcgccagcggaagcagcggtaattgtatatatgtaggtaatgaaaagtcccattttctcattgatgcgggaatcagcagaaagagaattgtggagggactgtcacagatggaagtagcaccggagacgatacagggcatttttgtgacacatgaacatatggaccatatcagtggtcttggtgtgtttcttagaaagtatccggttcctgtatttgctacagctagaacaattgatgagattttaagtacatcttcgcttggaaaggtggataagaatctttttgagagtatcacacccgatcagccaatttacatggatggaattaaaatagaagcctcccgtatccttcatgatgcggcagatccggtctgttacacagtaagcgatacggaatctaaagttggggtagcaactgactttggaacgtatgatgagtatttagtagagaagatgcagggatgtgaatccctcttggtggagtcgaatcatgatttaaatatgctcatggttggtccgtatccgtatcctctcaagaagcgaataatggggaataaggggcatctctcgaacgagagagccggacagtttttgtcaaaggtaattggagaagagtgtaaacatatttttctggggcatcttagtaaagagaataactatggtgaactggcttacgaaacagtaaaggtagagcttttattacataatattgatcttaataaagcagactttacacttcaggtagcaagcagaacagcgcctacctgtgttatttagcgttcgtatcagtatgattgattataatctatacagaggtcagtacatcagggaaaaaggttgaattgtaattattaagagtaagaatcgattgcttttactaattactttaatatttatacatacataaggagtatttactatggaaggaaaaaagcttaagaaatcaattatcaccgtactcggaaaagattctgttggaatcattgcaaaggtttgtacgtatcttgcaaacaataatgtaaacattcttgatattaatcagaccattaccggcggtttcttcaacatgatgatgattgttgaatcagaagaagtagttaagactttccctgttatggcaagcgagcttgagcagattggtgaggagcttggtgttaagattcaggcacagcaccaggaaatctttgaaatgatgcaccgtatctaggaggcctgctatgttaaacataaatgaagtaattgaaaccaataagatgattcatgagatgaaccttgatgttcgtacgatcacaatgggtatcagcctgttagactgcgtcagcgaatctcttgatgaagtatgcgagaatatttacaagaagattacaacaaaggctaagaatcttgtaaaggtaggtaaggagatcgagaaagaattcggtatacctatcgttaataagcgtatttctatcacaccgatcgcattagtaggtggtgcatgctgtaaaggtccggaagactttgtccgcattgcaaaagagttagaccgttgtgcgaa

SEQ ID NO: 418 - DNA, 44660 bp, Eubacterium hallii
ttaaaccgtagatttagatagtcagaaaaaagaaataataccatatcccagatgcggcttcggagcgtgtttaagatgcgaatgagcattttaaacacagcgactacagagcagatgggatatggtattatttcttttttcgtctatacgaaatctacaaattcgtatttaaatatttcctcaggtactttccagtataggatctcggttcgtctgcgacttcttccggggtgccgcaggttaccatcgttccgccgccttcgccgccttctggtcccatatctatgatgtaatccgctgttttgattacttctaagttatgctctatgacgacaacggtattgccaccttctgttaaacgctgcaagatatctactaatttatgaacgtctgcaaagtgcagtcctgttgttggctcatctaagacgtaaatggtcttgccggtgctctgacggcttaattctgtcgcaagctttactcgctgtgcttctccaccggagagggtcgtggatggctgtcctaacttaatgtaggagagtcctacatctcgtaatgtttctatctttcttcggattgatggtacgctctcaaagaattcgcaggcttcatcgacattcatgtctaatacttcaaagatattcttgcccttgtactttacttctaatgtttctctgttataccgctttccatgacaaacttcacaagggacatatacatccggaaggaactgcatttcaatctttaaaataccgtcaccggcacaggcttcacagcggcctccctttttattgaagctgaagcgtcctttatcgtatcctcttgctttggcatcttttgtcatggcaaatagttcccgaatatgatcgaacacgcctgtataggttgccggattagaacgaggggtacggccgattggagactgatcgatattgatgatcttatctaactgttctgttccttcgatttctttatgtttacctggcttgatccgggcccggtttaatacacaggcaagcttcttatagagaatctcattgacaagggaactctttccggagccggagactcctgtgacacaggtaaatacacctaatgggaactttacatcaatattctttaaattattttcctgtgcgccttttacggtgagatagccttgtggctgtctgcgtacttccggaaccggaatcttccttttcccgctaaggtaggcaccggtaatcgagtttggattatccatcagttcctgtgccgttccgattgcaacgacctctccaccgttctcgcctgctaacggtccgatgtccactatacaatctgcttctcgcatcgtatcttcatcatgttctacgacaatgagggaattccccaggtcacgcagtcgctttaaggctgaaataagcttatcattatctctttgatgtagtccgatacttggttcatcaagaatatatgctacgccgacaagtccggaaccaatctgggttgcaagacggattcgctgtgcttctccaccagaaagggttcctgttggctgggaaagacttaaatagtcaagaccgacatcattcaagaagccgattcgtccacgtatttctcttaatacctgctttccgatcaactgttgtctttcggtaagctgaatctcattaaaataagaaatcaaacgctttacagaaagctttgtaagctcagagatgttgtactctcctactgttactgctaatgactctggctttaaacgctgtccatgacaactatcgcatggtgttaccgtcataaagttctcatactctgctctctggcgttctgaatgattctctctgtagcggcgctgcacgttacggatcagcccttcaaacgcaacatcatatataccttctccgcgctttcctttataatacacctttacttcatgaccattggttccatgaataatcacatcctgtgcttcctgactcagatcacaaaatggtgtatttagatcaaaatgatattcttttgctaatgcatcaagaatcgctcttgtgtaactcttggcatctgtacaggactgccaccccatcactgtgattgctccatctgcgatgcttaattttttatctggaatcataagatcaatgtcaaattccatcttaaaaccaagtccatgacagaccggacaggcaccaaacggattattaaaagaaaaacttcttggttcaatctcgtcaatactgattccacagtccggacaggaaaaactctgactgaagttcagctgttctttcccaacgacatcaacaagaagaattcctccagtaagcttcattactgtttcgattgaatctgtcagacgattctcaattccttcctttatcataaggcggtctacgataatttcaatattatgcttcttattcttctctaactgaatctcttccgacagatcataaagattcccgtcaatgcgaacacgcacatagccgctcttcttcgcatcctttaaaatcttgacatgctcgccctttcttcctcttacaatcggtgccagcagctgaatcttcgttctgtccggaagcttcatcaaaatatctacaatctggtctaccgtctgcttggaaatgaccttcccacactttggacagtgcggaattccaactcttgcataaagaagtctcaaataatcataaatttccgttacggtaccaaccgtagatcgtggattccggtttgtagacttctgatcgattgaaatcgcaggagataacccctgaatatcgtctacatccggtttctccatctgtcctaagaactgtcttgcataagaagaaagagactccatatatcgccgctgtccttccgcataaatcgtatcaaatgccagggatgacttaccggaacccgaaagtcctgtcagtactacaaattcattccttggtatatctatattaatattcttaaggttgtgctcccgcgcccctcgaatacgaatgtactccttcttttcactcattcactttatcctttcccaattagatatatctctttatcaaatgcatctctcttaattcaagaatgcccctgctttcttgctctccacctacagaggtggagttatctcacatctgatatatctctttcaaatgcacctctattaaatgtctctctcttaaaaccaaaaatctattaatcctcataatctctaagtgcaatcttgtacttcttcaattcatctcgaagctctgctgcctcttcaaagttcagctcagctgctgccttattcatcttcttcgtgagctttgctatcatttccgtaagctctttgcggttcatagattctctgtctttctttaaagcactgtcttttgtatgctttccaccaataccatccatgctatcatcactgtcattcgtaattgagataacatcacgtaccgccttctgaatcgttgtcggagtaataccatgttcctcattataggccatctgaatctcacgacggcgcttcgtctctgtgattgccgcacgcatagaatctgtgatcgtatcaccatacataataacgtgaccttctgcgtttctcgcagcacgaccaaccgtctgcacaagagatgtttccgaacgtaaaaatccctctttatccgcatcaagaatcgcgataagtgtcacttccggaatatcgagaccctctcttaaaagattgattcccacaagaacatcaaatacatccatccgcagatctcgtacaatctcaattcgctctaacgtatcaatatcagaatgtagatacttgacacgaatatcaagttccttcatataggcggtcaggtcttctgccatccgtttcgttaaagtagtcaccaggaccttatgcttcttctctacttccttgttaatctcactgatcagatcatcaatctgcccctccaccggacgaacatcgattggcggatcaagaagacctgtcggacggataatctgctccgcacgaagcatctcatgctccccttcgtaaacattcggtgtcgcagaaacaaatagcatctgatcaattcgttcttcaaattcatcaaaattaagcggacggttatcaagagcagatggcaaacggaatccaaaatcaactaatgtctgctttctggaacggtccccggcatacatccctcttacctgcggaatcgtgatatgggactcatccacgatcataaggaagtcatccccaaagaaatcgatcagcgtatatggcgccttcccaggctctaatccggtaagatgtctggaataattctcgattccagaacaaaaaccagtctccttcagcatctccatatcaaagttcgtccgctcggaaatccgctgtgcctccaaaagctggtcattctccttaaaatactctactctttcatcgagttcttccttaatcgtcttcaccgcacgttcaatctgctcttgtggcacaacataatgagaagccgggaaaatcgccgcaaaattaagacttgccttaatctcacctgtcagtacatccacctgcataatccgatcaatctcatcaccaaaaaattcaatatgaatcgcatcctcaaaagtagaaacaggaacaacctccagtacatctccgcgtacacgaaaacttcctctcttaaaatcaagttcattacgtacatactgaatatcaatcagccgacggacaacttcatccctgtcaatctccatccccggacgcagtgagatcatcatcttcgcataatcattcttactaccgattccataaatacaggaaacagaagaaacaacaataacatccttccgctcgatcaaagccgctgtcgcactatgacgcagcttatcaatctcatcattaatcgaagaatccttctctatatacgtatctgtagaaggaacataggcttccggctgataataatcataataggagacaaaatactccactgcattatgcggaaaaaatgccttaaactcactgtaaagctgtgctgccagtgtcttattatgcgctaagatcaacgtcggcttattcaactgtgcaataacattcgccatagtaaatgtcttaccggaaccggtaacaccaagcaaagtctcaaactgattcccttctttaaacccttctaccagttgttcgatcgcctgcggctgatcaccggtcggcgcaaactcagacactaattcaaaatgatccatgaagcatcttacctccctcttcatcgtagtatgcttccgattatatcaaatatacgaacaaatgtacataccaaaatccaaatatttgttctgatttaatgtcttccgcttggattattcatcttatcgtatcgcaattcatctaaacttccttatctagctctttcttaaattgctcagctgtcatgttcaccttggccgctgcactcacaacagataaggttccatcctttactaattctttgagcatctggatttttccttctgcttttccttctgctcttccttctaaccggctttcgttaatcatatcttttactgcttcacacacatttatctccccctttccttctggaacatagatcggtgtttttgttatgtcccgtatcactcgtgccgcatcattatccatattctgcatggtatgccaatctctgtcgtatccagctcatgtaaaaattctgggtctacgacctgctctccaccataaatgaaataattaaaggcatcagaaaataccttacttcctctcatgtattcctttgtaatagcatctgctactcccatcggaatcatctccattctttatatcttttaccattggtcacctacactttctctgattatttgatacgattttgtctctttatattatatacatatttttacataaaagtcaatatcttttgtgcttttattatttttttgtttagtaatgtgccaaaaaaggattgtactttaaaaagtacaatccctttcttgttatgcatatgcttccactatatttactcactatacttcttattcacttttgcgtctttttacgatgaggaatataatcacaagggctgcgactgcgccgattgcgatccacattacgattggattattatcgccggtctttgtgctctttgactttttagattctctttcggatacggtttccgtttctttcttcttcttccttgtggttggttcgtcttcctcttcttctgtggagctttcggctgcatcgtcttttacgatgttcgttaaggtgatgctgccttctgtattctgcagagacatttctactttgccttcgccgctgatttcatatgcaaagttatctaaattcagggcgttaccgtttgcatctgtttcttctacgataaatgttgtttttgattcatttgcgtctattggtaccgtgattcttactgtatcattctgttttaactgtacgacctgaatcttctcttttcctgttgtaccgtcggaggattctgtctgcttataaacggttgcgtagaaggtgtcatctactgtagttgtctgattattttctattacgtttttcttaatagaaagttctccactcgtcaaatattcatccggaatttctgaataaatattggcgatgtccatctgtttttgtgcgtgatcttgcagctggactttattatctgtgatactgcctgccgcatcttcttttgatgtatcggtgtcggtctttgtatcttttgttccgtttccgacaacccaacgatactgtttttgattcttgtctttttgtggagcatttattttgagtggtgtgccttcctgctcggtctcaaatacatagtatgttccatctggaagattttcaaactttactgttgcggtgctgctgtctttaaaggataattcctttacatagtttcttccatatgggatggttccgctttcgtcacagaagagtcctacatagtactttgtttctgttgattccggagcgattaacggctttctttctaatgtatccggatcttcatataaaatatgcttggtgacttcgatggagccgttggtatctaccttctgtgcttttggggatacctttacatcatagatccagttctgaccgtcttccatatatggaatagcaactaaaaatggagaaaatactccgtaaggattgcttaccggctgtttgataagataaatgccctggtctaaatctttgaagtctgctttgccgtctgcatcggtgtttaccgtggtggtctgcagagtggctgctgttgtcttatcaagagcgctgatcgcatcatcgagtgttttggctgctgtctgattgctctcccctgttgtgatgtcgtttaagttgactccggtagtgctaagggcatctaccgtgttaaatgtcagatgatttccgccctctactacggttcctacctgatacatacggatcggtacattctccctgtccgtaccgatgtcggaaagagttacttcgatacttcccttcttatccttatcataactatctgccgccttgctctgtgccggaagtaacaaccccgctatcatcgtacaagtgacaagaaaaacggacagatatttactgcacttttttcttcgtatagatttcatcactatttacctcctttttccctgatctgtctctgacgccttgcgcgcctttccatttcccgacgttttttctcccgccttgcctttatcctctgtatgataaaataaataagcagcaacaggagcagtgccacagacactaataatgtcttctgcttcagaagccattgccataaattctctttcaatgcttccttcgcatcttttgtctctcctttatatggaacacgcatagcgtggatcaaaagcctgtgtgagttaattccgtacggtgtacaggtaacaagcgttgctaaatctcttccctgctgtatcgcaagactctctacgttagatggttcgactgtttcaatgttataaactttatacgcaagagttttatcaaggatatgaagataaaatatatcattttcttcgatctgatcaagattggtaaagagttccgcacttggaagtcccctgtgtcctgtaaggacggcgtgggtacttcttcctcctatcggaaaagaagttccttccatatgcccgacaccacgctctagcacttcagcggaagttccgtggtaaatcggcagatacactgaaatcttcggtatctcgatacttcccataactccggtatcttcttctaaattcaagatctggttataatcactgtcttccttgtttcctttattagaaaaggcatcggtaagctgtggggtcgtgcccgctaaccgttcattatacgcctttgcttcctgccagtattccttcttcttctcttcattcatcttctggacagtatcgtcatatgttgtcaatactgttccctggtgcaactggttatacagagtactcagcgtcgggtaattcagtatcaaaaatccaatcgcaagtagcaaaactgccagtattcctacgaacttatttctcatttcttcttaacaacccgctttctcttcattcgtctgcgcctcttcttctcctgatacctacgataaataaaagcgatcaacagtaaaatcactgcgattatcgctgccagaacatatgccttccacttagaatccttcttcgtctgcgtatgttccttcttcttcgcttcccgatacggaatccttgttccccgcactaaaagacgatgggagttaattccgtacggtgtacaggtaaccattgtcacataatcttcatttctatcaatcaacagatcactggtattttccggcaataccactttgatctgatttacttcataagccagtgtctgattcagtacatgaatgtaaaagacatctccttcctttacctctgtaagattatcaaacatttttgcagacggcagaccggtatgggctgagataacagcgtgtgttcctcttcctcctacaggaaaagaactgttttcgagatgccctgctcctttctctaaggaagtgctgtctgttccatgatagatgggtaaatatactttgatcgacggtatctcgatggaacccatcacgccatctccgtcaatgtttaaaatattgttataatctgcattctgctccttcaccgcatccgcatcaaacgggtcggtcagtacgacattaccgagcagctgtgtgttgtatatatgcgccttatccagttcttttttaagctctttttgtgacatctgcgccgctttctcatcatagtcttcaataacctgcccttgatggcggctaatataccagtcactaaatgcaggatagagagtgaccccaagacctgccagaaagaacaggcatagtattgcatttatgatcttctgtttcatcctgttcccatccttgttataaaccagagagaaaccagatgaggttcctccctgacaaaaagtatgccttgtattgagcggcagtcacgcccactcggtcactgccttgctccactaatcagtgaagcatccacacaaaaaacctttttcacctgcgggcattaacgcccgcagtatatatcagattcacttcataatttaaataaaacgtatttgttcaaatttgttcaaatattaagtcttaattagtctgtgcgctatcgctgctgactatgctcttttcttcttagaagaaacaaggagaagaacagcaccagccataactacaagaccaccgattgtgaagatgtatgtacccataccaccggtagatggaaggttaaagcctttgttgttagtgatggttgtttctgctaatctagattcattataaccttccttcggagttgtcttattgtcaattgtatacttcatcttacccgtaggctgtccattcgcaagttctggagttaatgtaactgctattggttttgataaaagagtatatccagatgctgttttttcctctttaagatagtatgttgttccattgtcttcaactactaaaccatcaaaagtaatgctaccgtctttaactgtttgaataacacctactctatctgtacatgcctcatctttatacaatccaaattgaacaccatctttttcttgagcaaactcgctatctaattttttatttaatttaattgcataagtataaacttcaggtatatcagagttagatgtcttttttccggcctcaattgtagcagtatttgttgcagtagtcgcataagttgcagcatttgtaactactgctttataagtaagtgtaattgatttaccattattgtttttaatataatctttatcacttattgtgatagtaaacttggtattattattagtcacctctaggttatatttttcagtatcaacattctggttattgttattaatgatgaatgtttctaatgaaaatttgttatcatcagtattattaaatactaatcctccacttaaagtatcactaatagtaattttcacatcatctgcagctaattcttcttctgttaaatatggaaggtttcctgtaactgtatatagtaatgtatctcccctttttacagaagcagccgctttgtcagctaccgtaccatctcctttaacaactgccactttcttaattaaatgattagaaccattttttggtgtagctactaccttgtagtcccatgaacttccatcttcagttgtacgtggtacatcaacaaagaatggtgctcctaaattataattctttggtgctattgtttccactacaagataaaggccaaaatcagcttttccaattgtaattggcgtttctgattcagagttagatgtagatgtataagaatattttccttttatatattctccctttgaatctttcactttgtctgctaaagcattcgcttttgcttctaacgcacttcccgataaagttcctaatttttgtacatcagcatctgttattcctttatcatctggattattttcattttttttaaacgtatctgttacagtatatgataactgagttgatatattctgattcactgttgctactttataaatttcaaatgttgccccagcaagatctactccaagtgaatctgttttcttaatttttaaagttgctgaatccttatcaaagatatgagaaggagttgcttccgcatttcccgcatttgctgcatttgccattgctggtaataaggtaattgccatcatgattgctgttgttacagccaataattgttttaataattttttcataaattattccccgctttctttgtgttttatgaagtgtctttgtgtttctatattatgaacaaagcgaatgagctttgttataacttatattatttgtctctgcccctcaccccaaatgaggagcagagtgtatatgttgttattatgcagtttgcatcttggtaatgtgttagattactcttttgcgtctgtgacgaaggatgtaacatcctgctgccataatcataactgctataccaataagtgtggctttgaatctgccaccggaagccggcatgttgaagagtttgttgtttttgatggtgtaggtgatattgtaataatagtttgtatcacctattttaatcggtgtatctgttgttgatacatcagtacttgatgccgtatatggcaaggttacttctatcgggttcgctaataatgtatatccttttggagactgaacctctgttatctgatagctgcctggcgcaataccagtaaagtctgcttcaccatttttatttgttgttatattctgaggttcagcttcagttcctttcttcttcagagtgaactttgcaccttctagaggtgtttttccatctgcatctacttttttaatatgaattgatgataaccttgcttcgtttgtaaatgtcgcataaccttctgcagctgtcgtcgctttgatagctgtaaccacaccttcttttgatgttgttttctctatctccgtttcgttaagtcctgttacattacgattctcatcttttccaatcacgttgccctctgtattagttccaattgtaaaggtaatcgaagaatcatctgcaattggattagaaatttcattgtaacaatttgtcgtttttgtaacgctttgtgaaccttcacttgttgatattgttgatgttattgaattttcaatatttttcaacttatattctggattaagagattcattaattacataggttccacgaggtaaatcactagttgtttcataaacaaccgttccttcgccagagatcttttcacctttttttacagtaagatcaatctttttaagttctgtagctgttccacccggtgccgtatattctacattaaattcaaatgttttatcatcatccggtgctggtgtatgtataccatcgtctaactttttaattaattgaatcttaccagctactacatttacgtaataatagttatcagaaatcttcttatgtatttctgagagttctgttcccggtgccgtacttaacgttcctggagctttattggtctctctttcgttcatagtatacggaacatattctacatgaagattatattgttcaacttgaactcctacagttgttgtattatgtgaggtctttttatcattgtctacccctatcgtatatacaaacttaccaacattatcctgtgtattaccataggaatatggtttagaaatagatgtttttgtaccatttaatagcttgcttatttcgtcagctgttaaacaagaactttctggaatattataggtgttctttgatgctccattgttatccttttcaaaaccattaattttcggttgctcttcatttaattgttccaataagtttgccggatcaatctcgtctcctaaaaatactgtaatttctttgttatcctgtgtgatatcaagtagtttaacatttactgctggctgttcaaaatgaaccgttcctacattttctaatgtaattcctgactcagaaccatttgttataattttattaccgccaataaaatcatccttggcttttacagtaatagtattactccattttttatttccatctttatttttattaggaattgtttgatcagtccacgttacaacctgattgccattttcatctaatgatactactccaccgttttttaatgtaattgtttttccgccctttaaatcttcattggtgattacagtaccatcatcatcattatcgttaacaaccacaaatcttggatcaattacatctgtaattgttgctcctgtaatatctgagttattagtaacttcactttgaatttctttaaatattgcattaagtgatgctgcatcatttgcttctttcgcacaaccttcggaagcaattcccggatacattgttccatcatatgttccgcctgctaaaaaagtttttgatttctcatcaaggtcaaagcctattgtatatactgtgtaaccagcatcttttaattcatttgcgctagtttctgcacttgtttgagcagtcgtattccattctctacccccacctgttggcttaccgtctgtaaacaagattacatatttcggattttcatcatttgcatttactaattctgtctttgccttattaagtcctacagccggatctgttccacctttagcatttaagttattaacaaaactcttcaatgtattggcattatctccaactccaacttgcattaactctttcgactttccatgatctccataacccgaactactgaatgcagtaattccaattttactatttggagaattagtcttcgtgtcatctataaattgatatacagaatttttcaaagctgctagcttggttgtcgtgtctacaatcttctcgtaaatttcgcagtctttgtaatcattatcatctgctcccttcccatcgacataccaagaactacttccaaataaatatggtcgatcataatacatttctttatatacaccatttactttcaaataatatgtctttctcgagttcaattcatttcttccagatgatgtattcgttgttataaatttatatgtttcactggtattaattgagtctcccatagatccagatacatctagtactaacataatatccacaactggtttttttgtcgttattgtcgtattagatacctttgatgctgcatcaatggtaatatcatacgtccttttatcccagtcttttaccttcgctgtcttactggattggatgatttcttccggcttttgattgctgatttgatattctccattggttgatgaacatttattttctcctaaatataatgttgcttttaacttacctgttgttgtattttcagtaactcttactgtccaattatttggggaaacaacatatccagatggagaaactgtttctttaagtgtatattctccttttgctaagttatcaaacaatactttaccatcagcatcagaaattgctacctgtttagtcttcgtttcgttattggtaagcataaagtgtgcatctggaagagctgtaccttctgtatttaccttttcaaactcaaattttgttttcttctgttcatccactgttatcactcttgcagatgggagagtaaattccatattacaatttgattcaccacctcctctttccatatacaagattgttaatgtatgtttttgtgatttctgttcttcacttaatgattttgatggaaatcctaaatcttcccatagattagtttctcctgaaacagctctatgaataccgcctaaatcaacaacaacttttctaccatccagaataacccataaatcatcatctccagtaaaactataatttaaaggacctacataatcgccaatagtgaattcaatatcatatctcataccaaaataataattatgatcttctttaaaaccggtctcctcgtatggcaatctgttatcatctaatggaaagaaattacttcctgcatctctcgtatattgaccatgttttaccgattttaatgtataggtgtctccatttcgattaaagattaacttataatccttataatactttcttaaatatcgagtagacttctcattgctattataaaaattgtcctctgccgtcaaatcagagtttacgaaaaatcctggctcatcataattaaattctacatttccatccgtatctaagccttttactaatccttttactatgttctttccatcattattagaattataaagattgcccttccacctataactatataatggataattctgattatcagctgccgtacctgcagataatttatcatttctattattcttataattagatatctgattaatagagtaatagttatcaccagcctgaccagcttttaaggtataatcgtaaaatgcaacctctgtctctatcggtttgcttgttggataataataaacatctattgttgaatcacttgttaaattaaagtctgtgttgctctgtacggcaccatttaatatcacttgttcaacaacccaattttttgctttcgtatagtcgctaatagatgctcctacatctaatgtcttcacatcatccgcataaatcttattattagttccatattgataatgatgtattgttactttaatcttatttgtctgactccgattcacaataacatactgcgagaagtgtgttgtctcaaatacaacatttcccttcttatctacctcaccgtccatgttctcgactttattcttgtcgtctatggaatacggatgcgttggcaccggctttgatttccggtacgtctacggatacttttacggtagctcctggctgtacttctttgccatctgcttcgaagtggatgtcgtaagcgaggatgttcttgatggccttcttttcttctttgatggctgcctgctctacgttctcctgtgctttctggctaagttcgattggttttacaacgagcttggcatctgccgggaggtctgcttcattctctgctgtgactgttacattgacatcatcactcttgtattcgcggattacggaaggagtctttgcggtctgctcggtgctgtctgcttcgtctgtctttgcgctgctgacaacgtaagttccatctggatacttcggcatctcgttgccttcggtgtcttttaccatagtaacgccttcgctgcttactaatactttccatgttgttgtgatcttgtcatagccttttggggctttggtttcttttaatgtatacacatctgtatcggagccttctggctttacgatattaaatgtaacgcgtccttcttcgttctcggactgtgcgctgtaatgtacgccgtctttgtataattcaaataccgcgccacctttacctgtcttggcgttagtgtctaagtttctgaatgtaaactgtgtcttctctttcttttccttcaccaatttgaatcggtacatgccgccattgctgctgtctgttgtgctgatcacgtctacgtagtagtcacttgcatctgtgcttgcgataatgcttcctgcattgttgctggctgctgtcatgtgccatccgtctgtaagaacggatacgttctcaaccggtgttctttgtgtatagttcgatgccgttcttccgtggaaggtgcgttccttctctccggcatctgccaaagatcctgtccagaatgcaagataatccatgtagttatcgtctgtcagttctacatcctttggataaacaaagacaaacatgttgtccttcgcatagatattctcactgtctgtgactggctttaatgtataggcatagttgttcttgttcttatctgttatcgtaaattctccacgaatgcgggtaatcgttgtatcttttcctgcttttccttcgttcttccacagagcggaatcatataactttccactctttgctgttactctgccgttctttaaagatgtggatgtgtgcttgccgtaggaacgggatccattccagatctggctgtcattatcaagagaaaggtcgatgcctgcgatgtcactccatgtccatgcaagtgccttcttccctgttgtatctttcagtacaagtggggtattggtgcgtgtccaggattctaccggaacattgccatcttctttgctctcaagctgtgtctgtgctgcagtaaccatcgccgggtataatgttgtaatgtcattaccattcacatcggatacagtagtgtaagtaagtacaacataggtacaaagactcttcgctgcaaactgcatcgcatcgcttccggtccgtactgcatcggtattctttacctgtccgtcatcggttacctgataaataagtgtgttctgtccgctctttgttccaagatttgcaagtgttacctgcatacttccggaagggttcacactctttccgttaaagataaaggaaagatcataggcttttacggagtctacgagctgtgtgttctcctcgccgactgccttattaatgatctgtgtctttatcttgttcgctaccgttgtctgctttacacgtaagtctgcctcatcggaaagatcctcggcatcctttaaggtaacctttgcctgaatggcgcttcctctgtatgtgtattctgtcttcgtatctttatcattattattattagtattcttctctgtttctcttacttttgaagtagaagaaccaccacttttagccccagatgcggccttgtccttttcgtgactgttctgtgagttctcagaacgctcggtcgtacctgcggtacttctattctctatattcttctctgtattctcctgcttcgctacggtgtcttgctggacggatgtatcctgttgctcaacaggttcttccgatatcgcttcttcttcctgcgcagcttctgcctgtccttctgcctgcgtaccttctgactgatccgctgcagtcgtaacctgctcctgtgttccttccgaagcaagtcctacaatgtccggtgtgcctgtcaccaataatgctgtaactaatagcatcgtaacgagctgcttccatcgtttccggctgtcctttactttcttcataatgttttccccgctttcttttagattgttctatgtcctggattactgtcctcgattaccgtgacactctaatctgaattaaaacatcttaaagcatgcagtccccaaaaaaacatattctggatatctttcatgcgttctccgtaagaatccgaaccccacattcttcctcttactgttacatccatccctatattctattgtgaactgccccgctttatgtcaaaagtttatcctgcgaatgatagcatccgtggtaaataaaagaatcactacatctagtggattcttccttagcttttcactattttatcacaaatagccaatcattccaactatattattaaatttttatttattgtttatacttttatattattttgcaacaatatactaataattctaaagtgttttctttattattttgattattaatgagatttttatcattattttacatatatgctatttataatattgttgattttttactgcaaatatgttgcggcaatttcttttaatgcatcctgattattctcgtaccatcgttcatagctaagctttttctcggaaataactttgcccagttcaataaagaactttggaatatctgtagcaagcataatgccccactcttctccaaatctttcttctccctgtgcatcctgtccgttcacataaaatgcgaatgcaggctctgcttttccgttcacgctctttgatgcgccacgaaagcccagttttccgatttgatgcgttccacaggaagatgggcagccagatatatggattctcggcagtacgccatccgcaaagtgatatggctctaccgcttctactatgcttgcaagtaagccctgggaatctcttaagccgatctggcagacggtacttccgatacaggataccgaagtttcaaacagattcttcgcaccgtctgctgtaatcttatgtattctttctgcctgctcttcctctagattaataatatataaggtctcatcgggtgcgacacgaacttctgcattcgctgcatctttaattacggcatagatttcctcaaacttctgcgctggaaccattccaccaaccggatgataggcaactgcataaagccctgcttgtttctgtgcgatcacacgctctgatgcgccttctgtctgcggataggctgttacatttttattgtcattgcctgcttctttggcatcgtctccttgctttgacagtacctgcgtttcttttataagaagagcgtcttttacctctgcttttacttccataagcttttcctgataggcttttttatagccttctacgcctaatgtttcctgcatatatcttgttcttgactttgcccggctttcataattaccgtaagttgtaaacgtacggaccatcgcctctacatagtaaagaacttcttccggcttcacatcttctgctacttttacacccatcttgtagttatttccaagcccaccggcactgtatacatcaaagcgaccgttttcctttgccacaaagccaagatcacggaatgtcgcatgggttacatttgccggagaatttgaaaatcctacctttaactttctcggaagcttgactgttttaatgattcccatcagatagtctccggctctttccgcataaggaagcacatcaaaatactcgccctgttctacaccggatagcggggataccattacatttcttgggaaatctccgccaccaccacgggtaacgatgccaacttccatcgcctgttccataatgtcacagactgccttcatgccaagatcatggaactgcacagtctgacaggtcgtaagatgcactcttctaacatcataagcagcgatcgcatcaactaaaaactttaacttctcctttgtaattcttccgcccggcatacgaagacgaagcatactcgcctctgcgcccctttgtgcgtaactgccaaatccaccggaaaagcctttataatcctttacgctgacttccttcgcataaaacttctctgtcatctctctaaaatcttttaagtcttccttaaattctgtcattaaactctgattcattcctcttctctctttctatttaagtattattttaagtattatcttaagtattttcactagtgaataaattataacacgccgcaatataaatttccaatagtacatctaaaaccatggaggaaaagtatgtaaagctatggaagatatgctgcaaacacgaaagcaatgatatcaaaccgcagaattgttagcactctttttagttgagtgctaatttttccttgacattctggtttcgtggtattagtataagaatggtattgataaaaatacaaagacgatgttttaattttatataattaattttaaggagatgtttattatggctaaacagggaagtttatcaattaacagtgaaaatatttttcctattataaagaagtggctctattctgaccacgatatttttatccgtgaattagtgagtaacggatgtgatgcggttacgaagcttaagaagcttgctgttatgggtgagtttgaagaggcggatgatgagaagtataaggtagaggttcgtattaatcctactgataagacgcttacttttatcgataatggtatcggtatgacagaagaggaagtcgatgaatacattaaccagattgctttttccggtgctgctgcttttatggaacagtataaagataaggcgagcgatgagcagatcatcggtcacttcggtcttggtttctactctgcatttatggttgctgataaggttactatcgatactctttcttataaagaaggtgccacaccggttcactgggaatgtgacggcggcacagagtttgatatggaagagggcgacaagacagaacgtggtactgtaatcacactttatctcaatgatgacagttacgaattctgtaacgaattccgttgtcgtgaagttcttgataagtactgctctttcatgccggttgagatttactttgttaatgaggaagaagaagagaagaaagcagaggaagctgcaaagaagtccgctgaagaaaaggttatcgatgtagaagcaaaagatgcggattctaaagatgctgactccgaagaagatggtgattccgaagtaactcttgaggaagacgaggaagaggatactcctaagccaatcaaccagattcatccattatggactaagcatcctaatgactgtaccgatgaagaatataaagaattttatcgtgatgtattccacgattataaggagcctttattctggattcatctgaatatggactatccatttaacttaaaaggtattctttatttccctaaaatcaatacaaagtacgatacgatcgaaggaaaaatcaagttatataacaatcaggtatttatcgcagataacattaaagaagtaatccctgagtacctcttattattaaaaggatgtattgactgtcctgaccttccactgaatgtatcaagaagtgcattacagaatgacggatttgttaagaagatttctaattacattacaaagaaagtagcagaaaagctttccggtatgtgtaagacagaccgcgaaaattatgaaaaatactgggatgatatcagcccattcattaagtttggctgcatccgtgatgagaagttcaatgacaagatgaaagattacatcatcttcaagaacatggaaggcaagtatgttactcttccggactatcttgaagctggtaaagaaaaatacgagaataacgtcttctatatcacagacgaggttgcacagtctcagtacatcaatatgtttaaagagcaggaaatggatgctatttatctgactcaccagattgatacaacatttatcactcatttagagcagagaaatccagaagtgaaatttctccgtatcgactccgaacttacggataacttcaaggaagccatcgatgagaacgaagaaaaagaacttactgagaagctttctgagaagtttaaaaaggcaaccggtgttgaaaacctgattgtaaaggttgaaaaactgaaaaatgcggacacaccttctatgatcactgtttccgagcagacaagacgtatgtctgaaatgatggaaatgtacggaatgagcaatagttctaccggacttggcgctgaaggcgagactcttgttcttaacatgaacaatgaccttgtgcagtatgttttaaataatgacgaaagcgaaaatactacaacgatctgtcagcagctttatgaccttgcccgcctggcaaaccatccattaaaacctgaggaaatgactgcattcgtagcacgttccaataaaatcctcacaattttaacaaaataaatactaatttattttaaggactaaagaaacgaaaaccagaaatttaatatagaagaaaatgtgaagatagtcgcttcgtagaaaatgcctgaccggcatttttactggctccgacatcacattttcttctatattaaatttctggttttctgttttttggcttcagatggaaattagtatttagatttgaggaagaagggattgtccagaagtctatggttctcattagaataaacatctccagaagaggatactttcttactcgactatataaaaattatatttacctactcctaccttatggaggatttttctctggttaactctcataatcttctggagaatccccttctctttccaacacaaaatcactaatttgctatttattattaaaaacagacagccgctgaaataaaattttatgctgaattataaaaagattatgataaagaaaaatgaattgttataagtattgcattttatgactttgcgctgtggaattttgactctgaaaacttcggactcgtttttccgaagttttcgttttttgaggcaaaatgaaacgtttagcgcaacggaacaaaatctaacttataacacttcttttttctttagaagaccgcgtacaattcagctcaacatcttctactaaagcggtgtctgcgtcccagaaaattagtattttttaataaaatttgttgtattttttatcattctttttgagttctttgtttatatagtttccacccattttttctcgtaatgtttcttttcctgagaaaagattcgttcctaatccaaggcgttctccgtcgattttggctccgagtgctgccattgttgttgggaacatatccattgttgtaaaacgacggttctgtgttgcagcttctttgtaagcgcactgtggattaatgattgtattatatactgttctgatatagtttccgcttaacggtttccaaaattgtgaaccggtatctaccatagatgtatggtctccaacgataacaatcgttgtattctcgtaaaaatcctgttgttttatccagtttataaaatcatatacctgtttatctgcacaagctactgcatttccataggttgtattatatttattatcgcagagactgcatagaaagcctgttgggaagtgggtgtctaccgtaagcattgtaagattaaatggtttgttctctgaagagagtttttttaattgtttttttgctctttcataaagtattttatcttcatgtccccagtaaactttataatcttttgggatatctccttctttaatcgcagcattataatcttctattttgtagtttttatgtgttttaaagtaggcatctctccctgcaaaatcaccatcacttccacacaaaaatacctgctgatatccttctttatctaaataatcacccaatgctgtgagattaggcaaaaatgtatcagatactgttccggcattttttacttttaaattaattgctgatgtttgtgcaacaagtccaccggctgtatatgctgttccttctaagcatacaggacctcccatttttttatctgccttatcagaaaactgcacattttctttggcaagctttgtcaggttagggatataattcacgtccatcgtgccgccttccgctttatctgtgtagctgctctccattgattccataaaaatataaattaaattattctttttgtctggaaatgtaacggtagtattatccggatctacatagtagtcttcataaaatgtagacacttctcttgaatttcttaagtattcccacataccgatttcgcttccctgcacatggatcgtatgcaaaagaattactgccacacaaagttctattataattttactccatcttggaatttttttctgtgaaaatatttttaatgtataaagttctcttttgaaaaatatataacataatacaaccattacagttaagataacaggcggtaacactgctgtttgtataatgctatgtataattccactgtctgttcctttaattggactggttaattgcagtaatatcgttgaaaatgcaacatctccgcaagtaacttttacccattctactaaatactttactaataatgcaagaaatattcctaatggcacgcataaagcaaatggaaatgcaaggattttaattataatgtttgactctaatttttgtcgtccttttaaactggcaaacaggaaaaagcagcaaggtaatgctataaacatactataatagacaagaaaatctctttctttttctttaagacgttcctggtaatttccatttaattctatcgagccaaagtcaaattgtgcccctatcttttttccgatcacgatttttgctctgctaacatctctttgttctacaggtacaacggcctgtgttgctcccttttgtgtcttgaaatttactttcttttctttggaaaagtcctcgtctttcctatttgtatacattacttttattgctatattttgttcaattggtttggaaaaatgtattacaacattctttaaaacatcctcattaatttctttaataatattaggatttggctcttttactgtaaaatgtccatcttgaatatcatatcgtgaaaattctgtttcaggtgtatccaacgtatgtggcttcaatgcagcttctttagaaattccggatgcaaaccaagaaaatactgctgctagaagtacaatactaatcacaccaacaatcttccactttcttttttgtgctttacaatacaataaaattgtaagcaacaatactactactataccggctatcttcataaaaatcggagcgccttcttttacaaaaggcactcctccttttaaatataatgataagcctgttccaaaaaaagcggttattacaatcgctatgtaataataaattaccgattttctctgtcttttttctcttttttctgctctcatttcttctctcatttattatgtctacttatcactgaaattctttatttgaagtacttatctactccattagcaattcccttcgccagcttcttctgataggacgcagagttcaactgacgatcctctgttgagttcgtaaggaatccgcactcaagaatcattgtaggaatcttagcccagttaattgttgtgtaatagtccgaacgaatcgttccatggcttctcttattcactgcctttgcaacagaggataaaagacagctgcctaacttgcgggaactattaaaaatcttcttgccaacgtaacgggaactacctggcacacatactaatggtccctgtgcgcttgctcctgatgcgttacagtgtatacaaatatgaatgtctgcaccacttgcattggctttcttcgttctctgctgattagacagtggacagttattggttgttctgagcatgattactttataaccgcgtttctctaattcttttttcgccgctttcgcgattgcaagattcgtcttatattctggaatatgtgtacgtacacctgctgtaccggatgtcagctttgcctttcttctagatgagcccggtgcaagtctttctgtagaagaaattcctctctgttggtgtcccgctgctataaataccgttctctgcttctttgcttttttggtcttctttgtttttttcttcgtttttttctttgttatctttttgtccgttttctttgctgtctgctttgcagtggttgctactgtcgtagccttagctgatacctttattgtacttaccggtatcattgtaagaactaacaatactgctaaaagcaaactgaaatgtctttttaaatgacttttcatactttttcctcctttttcatcaagaatcttaatgtatcagcacaaaatcacatctgctgcatttctttttttattatacactgactgctggacttcgtccatatattcatttcttaatttacagtcaactttattttttaataagacctcaaaactcttgcattcttgccgagaaatgtgtaagttttatgatatctgatataaaaaaagcaacagatttctatttatctaaaagataaacagaaatctgttgccttttcctcacatctaattgatgtaacagctttaccgtctacatagggcaattcgtaaattacactatagacaagtgaaagaactgtatctgtaattagaaacgagctgggttcagcttaactccaggacccattgtagaagtaagtgtagcacttctgatgtactgtcccttagctgcagctggttttgccttaatgatggcatctattaatgtctggaagttttcgtttaactgctcctctgtgaaagaagcttttccgattggcacgtgaatgatgtttgtcttatcaagtctgtactcgatcttaccagcttttaagtcctgaacagctttagcaacgtccattgttactgttccagccttagggttaggcattaaaccttttggtccaagtacacgaccaagacgaccaacaacgctcatcatgttaggtgttgcaacaactttatcgaattcgaaccatccttcgttctggatctttggaataagttcctcagctcctacgaattctgctcctgctgctacagcctcttcagccttatcaccttttgcgaatacgagaacacgtacttttttacctgtaccattaggtaaaactactgctccacggatctgctgatcagcgtgacgtccgtcaagacccattttgaaatgagcttcgatagtttcatcaaattttgcactggcagctttttttacgatggctactgcttccggtgcgtcgtataagttcgttttatctctgagctttgcagcttcctgatatctttttcctcttttcattctaaataacctcctgtggtattatcgggagcgaccctcccacttcgttgtatctaatcaattccgattaatcttctacagtaatgcccatacttctggcagtaccagcgatcatgctcattgctgcttcgatgctcgctgcgtttaaatcaggcatcttcatctctgcaatttcttttactttatctttagaaattgaagcaacctttgtcttgttaggaacgcctgatccggatttgatgttacagtatttctttaataatactgctgccggtggtgttttagtaataaaactgaatgttctgtcctggtatactgtaataactacaggaatgatcaaatcgcctttatctgctgttctggcgttgaattcctttgtaaactggacgatattcacaccgtgctgacctaaagcaggacctacaggtggtgctggagttgcctttcctgctggaatctgtaatttaatataacctgtgactttctttgccatgatagctatcctcctattgtggtaattgcgggaatctccctcccacttgtctgctctttacagagcgtcttataatttcttaacatctacaaattcaatctctacagaagtctcacgaccaaacatatctacttcgatggtaacagtctgtttattcatgttaattgccgttacagtgcttactcttccttcccaggcgcctgaagttacttccactaaatcgcctacttcgatgtcaatctctacttcactgttactgttagcaacaataccaagatttctcatctctgcttcggaaagtggtaccggatcggatcccggtccaacaaagcctgttacacctctggtgttacgaacaacataccatgtatcgtcgttcatgaccatgttaactaacacatagccagggaacattttcttagatacgttctttttaactccacccttcatctcgactacgtcctgaagagggactcttacttcaaatatctgatcctgaagctttctgttttcaattgtcttttcaatattagccttcaccttgttctcgtagcctgagtaagtatggaccacataccagtttaattctgacatatattcacctttacctttatactagaccagaaaattaattccatactggagaaccatatccagggttgcaataatgacacccaggacaacggatacaaccgttactgtaattgtctctctgataagcgtttttctgtcaggccagctgatatttttaaattcggctttaaggccctgaaaccagcttgttttctctgttttctttgcttcgtcgctcatcttatcactccttaaaaaccggtccgactattttgtttctttatgaacagtatgctttctacagaatctgcaatactttcttgtttctaatctttcaggatgatttttcttttcctttgtagtattgtagttacgctgtttacattctgtacatgccaatgtgattctcacgcgcacaacttccacctccaattttgttaaacgtagggtttattctcataaaccaattttaggcataaaaaaaagacctattccatcgccacattaatatagcatacccaaagtacgttcgtcaatgcttttttcgcacaaaatccaaaaaagtattttaagtttttgcacgaattcatatatttttttctcttttcctaattgtgcataagttatccacaaaatccacactctcttgtggataaagtggacaactcactttttatgtttctcagagcaaatgttttcgctcttttttataatcggtcttattttcttaaaatgtggataaaatcttgataactctcaagatacaaacaaatctctcaatacctattttatggtgttattttcagataatttgcgtatcatttttaaccaatatatggaaaatttgtcgttgacaagaaacgaatgttcgtgtatgataattgcatagggagaaatatataaagtaaatgtaaaagttaagataattaagataattaagattaagaaaggattttacttatgaacaaacagaccatccgtattaaatattttactgataagattgagaaacttacttatattgatgggaagtccgactggatcgaccttcgtgctgctgatgatctttgtctgaagaagggagattttgctcttgttccacttggaatcgccatggaacttccacaaggatacgaagcccatgttgttccgagaagttccacttttaagaactttggtgttattcagacgaatcatatgggtgttattgatgaatcctactgcggagataacgaccagtggtttatgcctgttctggctgttcgcgatacagagattcatgtgaatgaccgcatttgccagttccgtatcatggaacaccagcctacgatttcttttgaagaatgtgacagattagatggttcagaccgcggtggttttggcagcaccggccgggcataacgcaatatcttagatctatcatttatattatattattatgaagagttttcgttgttttctttcttttttacaaatgataaagcagcattgctcttctgtatactttaagttacagcgagtgaagttacctatagcactccggttattatccgcactttttccaagacattgccctgtatgtgctaaactggtgccatacggaactctaatccattcagaatgtcagactgtactgccttttatctctggtcctacctgtctgcgctgcggcaaaccggtttcgtcttctgcgcaagaatactgttatgactgtcgtacttttccaaaaagttttcaaaaagggctttctctttttctatataataaagaaacgcgtcctattatgagtgcgtttaaataccataataatcgaagacttgctgatttttttatctgggaacttttctttcagcagtattctcagaattattttcacatttattccaaaaggtattctcacagccattccagaatttatgcagcaatagaaagtctggggattgacgcagtcatacctgttcctattcataaaaataaatacaaaaagagaggttataatcaggctgaactgcttagccgcagaattgctctgatatttaacctctctcattatcctgatatgctgattcgctctgtggatactctcccacaaaaacagtttactccacaagccaggcttaataatttaaagaaagcattttgctttaattcacgatatgataaccttgttcaaacaaactcttccctgtctgtgctacttgttgatgatatttatacaagcggcgctactatggaagcctgcacccgtattcttttaagtgccggcattcctaatgtttctgttttatcaatctgtatcggcatggcaagagattgatcagattccatctttgagacattcattcaatccggaataccgcttttgttctgtctcattatgaatcatctgttctaccatagactgccttcccacgatagctgcacacttttgcgctcttgtaattgctgtatatagaagatttctgttacaaagaatcggaggtccgctaagaagcggcagtactactgccggatattcacttccctgtgatttatgaattgtaattgcataggcaagttctaattcatccagatttgagtatggatattctacctcccggttctcatcaaatacaacggtaatccgttcagagtaggtattaatctgcttgatcacacccatatctccgttgaatactccaagtccttcttcaacggagaagcctttttcattcgtaatcttccattcaagcttataattgttctttacctgcattaccttatctccctcacgaaagactcctgtacgtccttctttttccttcttggattctgatgcaggattcagataatattggagaacctcattcaaatgttccacaccaagttctcctttacgcattggtgtgagaacctgtatttcaaacggagatgtaccaatatattccggcagcttggtttttaccagataaatgagcgctcccattaccgagcggacatcttgtttttcaaaaaagaaaaagtctttgttcttattatttaaggtaataagttcgcctgcattaattttatgtgcattaagaacaatatggctgctctctgcctgacggtatattttagaaagacgcactacactaaacgcttctgaatcaataatatccttcaaaacgtttcccggtcctacacttggaagctgattcgaatcccctacaagtatgagccttgttcccggaacgattgcttttagaagagaatacattaaatgaatatctaccatggacatctcatcaagaatcaccacatcggcctcgattggattctcctcatttttttcaaaatgagaactacttccctcctcgattccaccagaaacttccaaaagtcgatggatcgtttttgcctcatatcccgttgcttccgtcattctcttcgctgcacgtccggtcggtgctgcaagaacaatatccatgtgttccatttcaaagcagcgaatcataagattgatggttgttgtctttcctgttcccggaccaccggtaactacgacaacacctttcgtaagcgcttcttccactgcctgtttttgtaaaagatcaagctgaaaatccatgctttcttccagttcactgattcgctttccataagcgcccttttccatcgggaattccagatcaagatttaaaagcatcctggaagtattcagctccataaaataataagaactcaaataaacatgttcctcttcattcacagtccgaatcatcagctttttatcaagaactaactccatcagatggtcttctataaattccggtgacatagaaagaagctgccctgcacttcggcacaaaacatcttttggtaaatatacatggccggaaagagaagcctgctgaagagcatataaaatagctgcacacacacgaaaatcggaatctggtgctataccagcctttgccgcaatcgcatccgctgcccggaaaccaattcctgtaatatcttctgccagtttatacggattcgtcttcaggatatcatacatcttgctgccatattcctcaaaaatacgaaccgcaaaacgactggtaattccatactccgataaaaacatcatcgcatggcgcatctcctgcttttcctgaaactgcaccgcaatatccatcgcctttttcagtgaaatcccctttacttctgccaaacgctccggttcactttcaatgatgtcaaatgtattccctttaaactttttaattactcttgcagccagcgcagctcccattcctttaatcgcaccagatgcaagatagcgttccatcgccgccttatcttccggctcctttacagtatacgatgtcatccgatactgtgggccatgcgccggatgatctacatattcaccttctgcacagatatattctccttcattgatataatgaaaatttcccacgaggacttcgtccccgtgggttgtttcaatgtccattacggtatatccattctcctcattatgaaagcgaatatgacttacatatccttccagatgagccatttaaaatctcctactttgtaccaagatactcaatgtactggccggtaccaatcgcaactgctgtcattgggtcatcggctgtcatcgttgtaattcctgtcttctcttcaatcaactgttctaatccctgtaacatacttccaccaccagtcagtacgattccacgatcagaaatgtccgctgctaattcagggggagttctctctaatacactatgaactgcttctacaatctgtgctgtcgcttcacgaagtgcctctcttgtttcttcggaagttacagtaactgtcttaggaagacctgttacgaggttacgtcctctcacttccatagaagactcttctgcacgtgcgtatgcacttcctacctgaatcttaatatcttctgctgtacgatcaccgatcaacagattatgcttctttctcatataacgaacgatcgcctcgtcaaaatcatcaccggcaaccttaatcgatgtacttactacggtacctccaagagaaataaccgcaatatctgaagtaccaccaccgatatctacgatcatattaccacatggtttcgcaatatcaataccagctccgattgctgctgctaccggctcctcgataatctttacatctcttgctcctgctgcatatgttgcatcttctactgccttcttctctacctctgttactccactaggaacacaaacagaaattcttggctttcttccaaataaactcttgcccactgacttatgaacaaaatacttaagcatcttctctgtaacggagtaatcactgattacaccctgtcttaaaggacgaaccgccacaatattaccaggagtacgtccaatcatcagacgcgcctcttcaccgattgccttaatctttctcgtatctacatcaaaagcaaccactgaaggctcttttaatacgacacccttcccctttacatatactaaaatactcgcagtacctaaatcaattccaatatccgtagccattaggaatctcctttccttataaactccatgtcttttatccataaatactgattaaataatcactctaaataaccaatatcaaaatcgtatcccggtgtactattcaaaatgctgacacacccgttactattataaacgaaataaatcgaatttccaatagttttttatcactaagcgcataccgacttagtttcgtaagattttacaattcattccgcaactcatttgacaaatcattacaaattcataacataaccattctcataactattcttacgtgaaaaaaggtactgaggattatctgtccactccccaatacctgttcatcagcccttcgcatatgagggcaggatcagcatcaatcacgctgcttattcgtcaattcccttctctcttaagtactcaataacatctccaactgtttcgatgtcagcaagttcttcagcaggaatctctgtatcatactcctcttccagcgccatagtaagctcaaataaatcaagagaatccgcacctaaatcttccttaaaagaagtatccagtgtaatctcatcttcttcgacacctaactgctccgcaataatctctttcatcttttctaacataagaaaaaatctcctttttataaaatgtgttaataatgttcaaaatcattcaaattcagatcacacaaatgatccgtccacaagttacgtagcagcaacgccgctatctttaaaacttcaaagccactttccttaaaaacagtacaaaatgaccttttgactctagtatcatactattcccacatttctttgtcaatattttttaaaggttatcttttgtgaattatatcccctcttttatgaaccttcttaattcttcttgacataagaaaaaaaatacaatattataaaaatagtaactcttattattattatttaatataaatgatatcaactattcaaaattacggaaacagcgttaactacgaagtaattcgtgacatcaattcagggatcaaatatcttttgaccctgacatcagtttttataaaaacacgaaccctatttatgaaaggagaataaatatgagcgcgccgatgaagaacagccgtcaaagaaatgccatattagaatgtgtcatgagtcatcatgatcaccctaccgccgacattatttatcaggaactgcgcgaaagctttcctaatattagtcttggaactgtataccgtaacctttccttattaacttctttaggaaaaatcatgaagatcacctgcgagaatcatgctgatcgtttcgatggccagacaattcctcatgcacactttcaatgtaagtcctgcggatgtcttcaggatattccattcaaaccttctgttcatccacaagaagacattggcgaaggcttcgatggaatcatttctgactataccattaccttccgaggatattgtgcaaattgcgctcaaaaatcgtaatttgtagatttcgtgtagacgaaaaaagaaaaaaataatacatcccatctgctctgtagtcgctgtatttaagatgctcgttcgcatcttaaacacgctccaaagccgcatctgggatatattatttttttcttttttctggctattctaaatctacagttggtgagaatggggattctccaaaagtctacactttttattcagatggaaacttccagaagaaatgtgtcaatcccttaggcttcaatttcccgagaatctataaccttctagagaatttttcgctagttaactctcataatcttctggcgaatctccttctttttccaacagaaattaccaatttgctatttgttatcaaaacaaacagccgctgaaacaaaattttatgctgaattgtaaaaaactatgataaagaaaaaagaacaaataccatatcccagatgcggcttggaagtgggtttaagatgcgaatgagcattttaaacacaacgactacagagcagatgggatatggtattcgttcttttttcgtctatacgaaatctacacataaatatttttttaatttttttgttgacaaattttcatctttaggttattataaaacagtaatgattatcattactttttcaaagaagattttcattactatgcaatgttacttatatgctttcgataacgaataagacgccatcttaatagttatcagacatttattttagaaaaggagattatttattatgaagaagtttgtatgtagtgtatgtggatatgtttatgaaggtgaagctgctccggaattttgcccactttgtaaggcaccggcttctaagtttattgagcagacagaagagaagacatgggctgctgagcacgttgtaggtgttgcaagtgatgttccagaagatattaaggctgacttaagagctaattttgaaggcgagtgcagcgaagtaggtatgtatcttgctatggcacgtgttgctcaccgcgaaggatatcctgagatcggattatactgggaaaaagctgcttatgaagaagctgagcatgcagctaagtttgctgagttacttggcgaagtagtttctccaagcacaaaagagaaccttaaagtgcgtgtagaagctgagaatggtgctactgctggtaagttcgatcttgcaaaacgtgcaaaagctttaaaccttgatgcaatccatgatacagttcatgagatggctcgtgacgaagctagacatggaaaagcattcgaaggattacttaagagatactttggagataaataattactaatgtactgttagtgattcggataaaaacagacgaaaaaagaaataataccatatcccatctgctctgtggtcgctgtgttttaagatgcttgtccgcatcttaaacacactccgaagccgcatctgggatatggtattatttcttttttctgtgttttggctccagaaagaatgaatgcaacagtctttgggagggagatgggagagagaccagaagactactgcttactcggaaggtaatctcatcagaagcttattttccctctttaacgagcagtaaagagaaaggaaattgtcattttccccaatattaaagaaatttcctttatatttatcgtatattctaatatatctctcttgagaagaatgatatatcgctacaatatagtggttaataaaaataatagaccatagcaaatgtaatgtgggaacagaacaataaaaatcccagacagagatatcttccgagcaagaagcagactcctgaccattccccattatccctccaaagactattgcattcattccttctggatccaacaaacagaaaataaaaagaatagaccattgcaaatgtaatgtgagagcaagtaaaaatgccgaacaggcattttctacgcagtgatatctttacatttgttatggtctattctttttattttcgtctgttccctaatgaattaaatagtaaattaatatttttttattgctttttttctaaaagtatagtagaatgattaggtcagtttttgacaagcttccttggctcagttggtagagcgacgcattcgtaatgcgtaggtcgccggttcaagtccggcagggagcttttttttattttccagaaacttttcctgaaatttttttaagaactatatttaagtcgagcaatccatgcgttataaagcacacgaatatgagttttttaatttgccccaaaaacagaaaagcagaaatttactataaaagaaaatgtgatgtcggagccagtaaaaatgctggtcaggcattttctgcgccgcgactatcttcacatttccttttatagtaaatttctgctttttgtatgtttttgtttatttataaatcatacatgaattatacgattacgccgttaagattaagctgttgatcgccttctccttttccatagccaagatggtcgtactgtgccttgacttcttcccatggaagcttatcatgttcctctttcagataggaaattatatctgcgataccttcgcctgtaaatgagcttgtcataaagatcttcttacaaccggcaagtcttagccagtcagcggcctgctctgggttcgctgcccaatggtcacactttgttacgattccaactacttctctattagattgcgctgttacgtttggcggatatagggaaaatggttctgttgcgctaatcaaaagacctactacatctgcttctgcactatatacagcaagggaacctgcaagttcctttgtttcggcatattcacccggtgtgtctataatcacatcatagtgattaatatactgtgttttatgatagacaatcttcttgcctttcatcgcctgtgtgagtgttgttttccccgcctcacttcttccaataaatattatctttcgcatgtctacacttcctcatctgcaacattttgttatatctattctatcacatcaaccaatgcaggaaaaggtcaaaatttggagaattctttgcgttttctgcgaaattttagttcttctaatccttcttttatcttttctgttctttcattatagataatatcataacttacataagataaaatcaatgcagtaagtacatccacaacggaatgctgttttaaaaacatggtggacaggataatagaagtagtcataaaaaaggccgctcctcttatcactttcttttctttcagatacggactgttttttacggcaaaatacactgccatcgagttaaacacatgaatgctcggaagtacatttgtcggcgtatccatcgagtagatctttctggtaagctgtataaagatattgtctcttgtaaatgtgtccggccggagttctaagccgttcggatatacataagaaacaataataaatatcgtcattccaatcataccaaaatacattaacttacaaaaggattccttttcccggaagaaaaagtaaatacctgctattgcaatgtacacaaaccataaaagatatggtatgataaacacttctataaaaggaatataccgatcaatcgcacagtcaataatatgtaattgatccggcactcttttttccaaataggaaaatgccgctaaataaaacggaaagtatagcaggagtaaaccatgcttataattctttaatttttctgtcataatatcaccttttttacccgattgctatatattcaggaatgtcctgacattcttgctgcgagatgcacatcgtgctgtataaactgtataaatagtacagatgcctgcacaatttattatcttaaaaatgtaacgcaactttcttaataagtcaatgtattttcccactcttcacaatatcttaaaaaaattgttattttttcccttttcttttttcttcaaaatccgctaagtatccttttaactgattaaaggcatccgcatactttggagagaccatagtagggtttcctttaataagcattcggacattaccagttccctttcttttcaggcggaaattgcgctcttttaactttccaattctttctttcatatcaagcatttcgagtttctgatgttctggaagccttggaagttctgccatttctctcatcttagccagacgcagttctatttcttttcctatttcatccatacgctctactgccggatggttcttaacatattctctccactcctgatcaagaacagcgataacaacatctgctctctttcttaatataaccacttcttttcgtacattttccattccaacaagaatatttctaagatcaattgcatcacgtacagaaatgcacagatcgactgcaaggcctgcacttactatccacacaaagatttcatctgccatctttggtataatggcaagcacgtgtaatagtgccggatggaatacttcgttcatcaatatcgtcaaaaatccccaggcaaccgaagaggacagacagatatatcctttgtaattaaacttttggttggaataatcccagtatcttactttaagcaatgcctccattgctgctccggttaccagctccagcagcgttgcacccaccacacctgcaaaataggtgagtatcagattatctttaaatggttctgacacaaagagcatcattaccgctccacttccgtaaataggtaaaaacggtccatggagaaatcctctgtttacccactgtttctttctaaatgatacatagcaggattcaaaaatccacccaagaaaacaatacacataaaaatataaaagccactgttgtgttgtatactgtcctatcattttatccttcccttccaaaatacaaaaatgtcaatttcaagaacacctcgatattcttcgtcagattcctgcttactttcctgttttgcaaaaactcattctgttcttctttatagaaaaaagcttctgaaatcataatcttctataattccagaagctttttttaaatcacataatcatttccattcttcgcataatgccattcaatcaaatcagctaatgtcgtatggtcgagcaccccgctgattgcctcgttcagctttctccagagaggaatcgttatacattcttccattctttcgcaaacttcgcttccttcttccagacaaggaaccggctccatactgccttctgtaattcgcagaatcatacctaccgtatactcattcggatgctttgtgaggagatatccaccctgagggccacgaatacttctcaaatatcctgccttggtcaataccgaaacaatctgctccagatacttcccggacacttcctgccgtttggcaatatctttcactctcaccggcttcccttctgcatcattcatagcaatatcaagcattaaacgaagagcatatctaccttttgttgaaatcctcataatgctctcctatttctcttttactatattatccacttatcagcttaaatactttactctaaagaatgaaaaggcggtcattactccaaccatgagaagtaaccacgctatcatagtaaccatacctgcgtttcgatttctctttgcctgcatattcaagcctacacgccacataataaagccgatgattgcaacaacaattccaagccccatccacatctcaactgtcattattcttcctcctgattctaatatgtattctcgaagtacaaaaatgttccgagagtacattaactgtctcattctctcaaacagttactttatctttatatgataagccattttccgtattcttgtcaagttataataagcgtgttataattctaataattttaaaaaagaggtggttctatatgacaacgattaaatgccgtaaatgtggtaaagtttatccatttgatgaaaaaatatgccccgtatgtgggtacgatattcgaaaagacgaaacattatctccaagagaccgggctgcacttggattaaaaagtgattctgccctctttgatgaaacaaacaaagaaaatatggaacgctggaagaaccagacaaaggaagagcgtttagaagaagcatgggaaaaccgaaacaaatttgaaatacgtccggaccaaggaggactcccacgtctcaacgttccaatgaacactatgttttttctaacggttattttaatcgttattgtatttttagccaaatacttagggtgacatcctccccacccgtagaggtgtggggcttccccgtgtgtcccacggttgtatttgttctctaaggtcatgcaattaccagccgcattccttatggaatgtattattacattagatagaagcttcgatgcaccagaaagctaaaaaggagacattattttgaaactttatgaattttcaaatggagataccatacataaatacaagaagtctattgttattctttttaaaggacaacgaaatgtcctgagtaccggtccaaataatggaggatttacaacagatttatctgctgtttttaataatgatgccaatcccggttccggtatggggattaaacttcgggcagatacttatcgggagcacatggatattttggcagaggaagacttaggacttgattcttctgcctgttccggtcttctgactgctgcaagcatggagaacgctgctatttctacactctcctatgaagacttttccgtcacagctattactactgcaggtgtacgaagtaacggaggtcgtatcggagatccggcttcctggcatgaaaagtcagaaagttcctttgacgatactactccaaccggcaccatcaatattcttctttacattaatgccgatctgaaaaaagaagcgatggcttctgctctcgtctcctgtgcagaagcgaaggctgctgctatgcaggagcttttaatttccagccgatattcctgtggaattgctaccggaaccggtacagatggggtcatcattatagcgaatgccgaatcaaacactcatcttacgaatgccggaaagcacagtaagcttggagaattaattggacgtactgtaattacctctatcaaagaagcactcaggctccagcagggaatcactacacactcacagcatgatattattcgacgtatggaacgtttcggagtgtctgaagatgcattatgggactgttacaaagagacctatcgtaatctgatccgagcggagtttaccgaaatacttgaccatatcaggacagaagaccgtcttgtaacatattcttcactttatgcacatttactcgatcagctaagctgggggcttctctcctttgctgaatgtcggattgctgccggcaacttattaaagcttgctgatttacatccgaatcctgattatggaagtgaaaatatcgtacaaaattacattcttgcaatagcagaacgaatctatcatgaatctgttcgtccaaagcaaaaataagacactaccataagatactgttccaccaaagagaagatggttgtcgttagccatcttttttctttttatggaaaaatttcaggggcagatctgactcacatgaatcaaatctgcccctgtttggaactatctattttccgacagccctgtttttattattcattatgtagtaaactaaattactattattatattctataattatattctataatggtaatgcagcgtaaacagctacagctactaatgcaccgattacaggtccgattaatggagctgttaaaccgtaagcccagtcagcatcacctttacccttaataggtaagatagagaatgctaaacgaggagctgtatctctggctgcgttcatagcgtatcctgtaagaccaccaaatgtagtaccacaagaaacgattgttaagaatacaccaaatgttccaagatcaaatgcgccacaagctgctttaatagcgaatactaaccagaatgttgcgattgcttcctgaagaatgttgtaagggatatttcttacaccaggagctgtacagaatacacctctaaggctgtcacctaaatctgaagatgcatcaaactgaggtttaaatgctacccatactaatactgcaccaatgaaaccaccagccatctcagcgataatcatttcgataataactgcgattgtgtagccatctgctgctgctaatgttccgtctgcgaacagagcgattgtcagtgcagggttataagatgctggacagatgccgctgaatgctgctgctggaagtgctactgcaagaccccagccaagtgctataaacagagcgcctgctgctttaaatccagaattgttcagtgtaacgttggcacaaacaccatcacctaataatacaagtaaaatggttccgacaaattcaccaataattacgttagtcatattaattcctcctattcaattaatgtttccaattaagtacactagtgctgatttaaatataacacttataggggtatttgtctttttacattgtaagaattatgtgagaatctgtcatatttcttacgatattttttcgtttttttaccttacaattccattttcatgggctattttgcactatttcagtaattattcctatctttcttttagatattttatctaattattatgtttcttgctcggttacttactctttcgtaattcttacggttgaaagaaatttatcaaagagaaactttatttccatttggagtaactgaagattaatttcctcatgctccctgatgtaattgatataaaatccaagaaaagcctccgtaaaaaatgctactgtaaaatcttccttctccttacgcagattccacacagaatcatccagacactcttcgaccataagacgtactctgtgttcaaatagtttatataagtcactgcgtacttcctctacactcagattctttatcagctttctgtaatatttataatcctcacatgtgttcataaataatgtatgaaaccacatttcaaacgattcctcttctgacggaagtttttctacgatttcctgttcaaaaatccagtgcatgatgtcatatttatcccggaaatgataataaaagttttctctggtcatggcgctctcttttgcaatatcgcttatcgtaatcttctgaaacgacttcttacacacaagctccttaaatgcctctgccattttccctttcgttccgttcattttgtctccctccactagcaatctgtttatctcagtcgagaagactcccacctctttcaggtggtgagtgacagcaaatttgtctcagtgggagtccaatctccgactgagataaacgctccgcgaggatgcgcagtgattctgtaaagaat

SEQ ID NO: 419 - DNA, 43600 bp, Eubacterium hallii
ttcattacaatcacgaacgaccgcattcttataacaattataaaacgccttttgaggcacgctacggggtataaaccctgtagcaataattaggtcaaagtgttataaaaaagcttgaccacaacaagatgacttaatacaattcagtcaaaaggcacacacttttggagaatccccattcctgcctaactgtggatttagattagacagaaaaaagaaaacctatcctatcccagatgcggcttgggagcgggtttaagatgcggatgagcatcttaaacccagcgactacagagcagatgggataggatagtttttcttttttcgtctgtaccaaatctacagattaaaatttgtcgtatagaccaaagaagaagatgaagaggacgatgagcggaagtatataagagatatatcctctcatccagttttgtattttcagaccttttccggtattggcttctgtagtgaagttcttccagccccagccgtatctgcttgtacagaataaaagatatacaagagaaccgagaggtaagaatagattacttactaagaagtcttcaaaatcaagcacagcaccgccaaatactgcaaaaatgtcactgctccataagttatatccaaggacacatggaacagagagcagaatgatggcaattgcattgataaagctggatttctttctactccatccggttaattccataccgcaggaaatgatattctcaaatacggcaagaatagtagaaaaagcggcaaaggacataaatatgaagaataaacttccccataatttacccataggaatatgattaaaaatattcggcagagtaatgaagataagtccagggccggaagtctggtctacatggaatgtaaagcaggcagggaaaatgatgagtccggatgtaatagctacaaaagtgtctaataaagcgatatttaaagattctccgagcagggagcgttctttttcaatataacttccaaaaatagacatagcaccaataccgagacttaaagtaaagaatgcctgattcatcgctccggtaattgttttgatgattccgatttctttcattcgttcaaagtcaggaattaaataaaagcttaatccttctttggcaccatccataaaaaagctgttaatggcaagaatgaccataataaataaaagagagatcatcattacctttgttactttttcaagaccgttttgtaatccgatggagcagattaagatgcctgcgataacaatgatgaccatccaaaagcccataacctgtggctggctgagcatggtattaaactgtgaagctacagcatcggaatccaaacctgtaaactttcctgttgcagtcagatagaagtaatgaagcatccatccagcaactgttgtgtaaaacatcattaataaatagcagccgattagtgtaatgtaaccatgaatatgccatttctgtcccggcttttccaaagcatagtaagcttttaccgggcttttttgactggctcttccaactgcaaattccattgtcataataggaagtccgagaattaacaggaaaagaaggtagaataacacgaaagcgccaccgcctccctgacctgccatataagggaacttccatacatttcctattccgatagcacaaccagcggaaataagaataaatccaagacgagaacctaatctttctctttccttcataagtacctcccttataaaataatgtataaatacttcggaaattatatagttttaccagaaaaatgtcaaggataccttttcttgattttgtgggattctctgatataattaaaataataatgtactaaaaatgattttgaaagaatagagtgagggagaaaaaatgacagtaaaagaatgttaggaacagatgggctcagattatgaaggtgttctgggaagattaggaagcgaggctatagttaagcgtttcgcattaaaattcttacaggatccaagttttgctcagttaaaagaaagtcttgctaagaatgatggagaagaggcatttcgtgcagcacatacattaaaaggtgtgtgtctgaatctgggatttgatgaactttttgaagtgagtgcggaacttacagaaaagttaagagagagaaaaactgcgggaagtgaagaattatttcagaaggtatcacaaaagtatcagaaaacagtgacggcaatccagggcttggaataagttcagatttgtagattgtacgttatttagaaaagatgaacccctgaacagtatagaagaggaaacggaattgtttcaggcttctatactgttcaggggttttatatcagtcgagaagactctcacatctttcaggtggtgagcgactgctcgacttgaactgtggcaaaaagagagaagattacgcggtctttgctccggcttttctgcgtacccatcccataaagcgggcaaactctcttttgtttgtaaatatttcttcataacaattcagtatttctgaaaccatctgccgcatataggccgtatcattctcattgcacatttcctgggaaagatagttatcgtgtaattcctgaattctgttctttaactgtgaagaagaatcaagcttcttacaaagtggcatggacatctgctctaaagcaccgtctctcatccatctagtcatcttcttctcgtaagcgtaatgttcgggaattgttccttcaaaaactgtattgtgtggataagtaaaataatcttctacataatgcagaacccagccaagttttaaataagaaaaacaaccgccccggcccttctcttccaaaacttccatgtgatttattattttatcaaaagtcgcttcccacgtatgtccttccaaataggtatatacaaataaatccggtaatatactaccaagcaacaaagctgctttatgagttttgtgcatattccctgttaatgactttgtcacaactaaatgtcctattttatccattaatttaatttctccttttaaaaacagaatgtcctttcggaatgttttcgtgcctgacgttgtgagtacatcatataatttgatatacttttgttattatacactttctttctgtcttgttggtcgaattcacctaatcgtaagaaatacttaaagattataaattgttaactttgatgtgccaaaatacgttgacaattaaaacctgtcatgctacatttaatgatgttaggggcaaaataccttttgaccctaacatcattaaatgacagaaagttaaaacagaagtgtttggttatatacattttcggaaaggattttactatgagttcaatgataactgcggatacaatacgaaaaatattatcggataatataaataaagaatattcattttccagagaagaagcgattgcaattatgaatcttccggaagaaaatatgcctttccttatggaaatggcaggaagtttacgtaaaaaatataagggaaatcatgtgagtattcatctgctcacgaatgcccgaagtggaaactgttctcaaaactgtgcttattgtgcacaatcctgccgttcgaaagcagatattgaaaaatacaaatgggttgatgatgaaaagttatacagcgataatgcttttgtacatgataatcatctttcaagacattgcatcggtcttagtggaatgaagtttacggatgaagatatcgaagaacttgctgaaaaaattcgtgttatgaaagcagacgggacacatctttgctgttccattggttttcttacggaaaaacaggcattaatattaaaagaagccggattagaccgtatcaatcacaatcttaacagtagccggtcttactaccataatatatgtacaactcacacttacgaacaacgcgtaaataatatacatatgcttcagcgcctcggttttgaaatttgcagtggagggattatcggtatgggagaaagtaaagaagatatcgtagatatgctcctcgatcttcgtgagattcaaccggaagcacttccgattaacttcctgcttccgataccgggaactccactagaacatgcagacactacagtactcaccccgtcttactgcatgaaagttttatgtcttgcccgcttgttagttcctcaatcagatatccgttgtgcggctggaagagaagtttattttaaaggacgagagaaagaattactcagtgttgtagattctatctttgcctctggttatctgacagcagatggacagggaatctcagatacgataaaaacaattacggatgcaggatttgtatatgaaatagaatctgattgatttctggcaatatagacaatttaatagaagaagatagcaaaaaagctctggattttagttatatttaaaaaattcagagcttttttgtataaatgatgaaaaatgcagggaataactttaaaaatttattttgtgttctgaaaatgaaataaaaattaggaaatgccttgacaaaatgaaggaaaaggtctataaagcttcatgtatacaaaaggtatacataaggaaggagaggacttagaaatgaatacattagtaattgttttaattgcggcagttttattaacagcggcatatgtattttatggcaggtggctttctaaaaaatggggaattgatccaaaggcggaaacaccagcacataaatttgaagatggacaggattatgttccgaccgatggctggacagtatttagtcatcagttttcttctattgcgggagcaggacctgtaaccggagcgattcaggcagcagtatttggctggcttcccgtactcttatgggtattaatcggaggtattttcttcggagcagttactgattttggcgcattatatgccagcgtaaaaaatgatggtaagtcgatgggacttttgattgaaaaatatattggcaagctcggaagaaagttatttcttgcattttgctggttatttactttaattgttatcgcagcatttgctgatatggttgcaggtacatttaatgcgtatacagtagacacaaacggagtgatccgtcttgcagatgctgcaaagacaaacggagcagcaggaacaatttccctgttatttattgtattcgcaatgattttcggactgattcacaaacattttcaactgacaggctggaaagagacagtggttggtttagtatgtacagtagcagcacttgcgattggcatggcaatgccaattactttaggaaaagatggatggacatatattacatttatttacattttctttgcagcagtattgccaatgtggttattaaagcagccacgtgatgcaatgacaacgtatatgtttatcggaatgattgcaggtgcagtagtaggtttgcttgtagcacatccaagcatgaatcttcctgtatttacaggatttcataacgaacaacttggaaatctgtttcctattttgtttgttaccgttgcctgcggagcagtttccggcttccacagtctggtatcttccggaacttcctccaaaacaatatcgaatgaaaaagatatgttaaaagttggatatggagcaatggtcttagaaagtttactggcagtgattgctttatgtgtagctggtgcagcggcttctgctaatggaacgccggctgacggaacaccatttcaggtattttctagtggtgtagctggattctttgaaatgtttggaatccctgtatacgtagcacagtgctttatgacgatgtgtgtatccgcacttgcacttacaagcttagatgcagtgggacgaattggccgaatgagttttcaggaactgttcagcgtagatgatatgacacatgcagaaggctggagaaagcttttatgcaatacatatttctctacgatcgtcactttactggcagcatttatcttaacaagaataggatacgcgaatatctggccgctgtttggctctgcaaatcagcttttatcagcattagtgttagtgacactttgtgtattcttaaaagtaacaggaagaagcaacaagatgttattccctccactgatcatcatgctttgtgtaactggaactgcattagtagagagaacgatttcacttgtacaggcattctcagccggaacagcaacattcttagtagaaggattacagcttatcattgctgttttattaatgattcttggtgtgatcattgtagtaaattcacttagagcatattttgcatccaaaaagaattcagaaacgatttagctgatatgtccttcatcctatttagtttatctcagtcgagaagattccaacctctttcaggtggtgagtgactgctcgacttgaatagaaaaataaacgaaaatacaaacatcagactatagcaaatgtaatgtcagaggttatagcctgatgtttttttcactgttctttcacaggaattaaatcataatctgttgacttctattcgcataaaaattataatcttcaatgtattagaatattagaaaatgggttcgagggaatggagcaggatgatggatacagcaaagatgaatcaggcaattcgaattgccaagttatattatgaattacattataaccagctggaaattgcggcgagggagggaatcagtaagtcttccgtaagccgtattttaaagaatgcgatggatatgggaattatagaagttcgtatcaaagattctgtcctggcagatagcagtctggaaaatgaattaattgaacgtttcccgatcaaaagagcaattatcgtgccagatttggtaggcaatccacagatattaatgcaggacgtatgcgcagccttagcagaagatcttcctcgttacataaaaaatgacagtgtgatcggagtaacctgggggcatgcactggctgtattggcacagcaacttccgaaaatgaaaagaaaaggtgtttccgtcatacagttaaccggtggattttccagagcaatatttgaatcaggggcattagatgttctgaagcgatttgtcgatagtgtaggaggaattggatatcagattccggccccggcaatggtagcagaaccatctattgtagatgcactaaaaaaagatccacagattcaggaaattcttgaaatggcagaagtatgtcagactgcgatatattctgtaggaaacctggagcggccatctattgtatatgagatgggacttatcgatgaaaatgattataaagattttagccgaagaggcgcagtaggagactgctgttctcattttatcaataaaaatggcgagcttttcgataaaaaaattgatgcaagagttgttggtgcttctcttgagacaattaaaaagattccaaataaacttgttgttgccgtaggtaaagaaaaagagaaaatccttaccgcagcacttcggggtggtttggtggacagcctctacattgacgaaccaacagcagaacttattgtaagacataatccaatcaattaagaggatgaaatatcagatgcgcagaagaagtatgtcatgcattgcatgacgcgtatctcgcagcaacaatgccggggcattcttaaattgaaacgtagagaaaaataataaaaagcaagagaaaagaaaaaagagaaaagaaagagataaaaaataagaaagagatagggaagaaattatgttaaatcaattttccagaacccagcttttattgggagaagaagcaatgaataaattaaaaaactcccgcgttgcagtttttggagtcggcggagtcggagggtatgtctgtgaggcactggcacgaagtggagttggaacatttgatctaatagacgatgacaaagtatgtctcaccaacctgaaccgtcagatcattgccactagaaaaactgttggaaaatataaagtggaagtgatgaaagaacgaatcctggacattaacccagatgcccaggtaaatattcaccagtgttttttccttccggaaaacgcagacgaattttcatttgatgcatatgactatgttgtggatgctgtcgataccgtcacagccaaaattgaaattattatgcaggcaaagaagaaggaaatacctgtaatcagcagtatgggagctggcaataagcttgatcctacagcttttcgcgtagcagacatctacaaaacaaaagtatgtcctcttgcaaaagtaatgcgccgggaattaaaaaaacgaggcgtaaaaaagcttaaagttgtttattcagaagaacagccgatccagccaatcgaagatatgtccataagctgcagagcaaactgcatctgccctccgggagcaaaacataaatgcacagaacgacgtgcgattccgggaagcgtagcatttgtcccatctgtagtcggactgattatcgcaggagaagtagtaaaggatattgcaggaaaataattatcaaataaaataataatcaaatattgaagaagtcaagggaactaaaacgaaaagaaagcaatgaagaaatgtaaaattacagtcatgcgtaaagcatgctataaagatttgatgaaaaaatatgagaaccctatggaacatgcctgtgatatggaagaaggacaggtttttatcgcaaacggatggagtaagccagacggaatgtgcgatagtgcctgggagagtatgtccccttttgttatgacacttgcctatggcggaaaagatatttacaacggttggatgaagaatgaaaagtctgcaatgatatcctgtaacgatggatttcgaccagtaagttttctgattgaagctttggaagaagaagcagattgagagattctgaagaaaatgattacagaatataattagaggaacgtgatgtttgatattagcgacaggatagaaccattagaactatcggatgttttttatagattagaagaactgttagaacaagatcaatttgagttgatcttcccagaagataaacataaaaatacattccaaaaacagcaggatatatcactggtatatttaatgaatgatgcagtagaaagttttcttgtatttcataatgcaacgatgacaggagaatatcagaaggaatatgaaggggagatacttgcagttcttgataaaaaagaagaacagtatgtattagttgtgcatcagggcgacagcgttgtaaccttgttttttgatacactgctgcagaaaaacaatttatacaattacggggatgtcggacatttctgggtaaaagggtatgagtacctgcgtgtgttagaatatcgcctggcaatcctgcgtgataaatgcgactatctggatgaatcctgcagcaccccggaagaaagaaggttagcttctttagtagaatttccaccactaaattattgctgttaccctgccgtacccgaaaaatacattgttccaagagaaaatccatggcagcctactgaaaaagccatcaatctaatgctagaaatagctaaagaagcagaagataaaacatttatccggcttttatcctattataagaaaaacagctccacaatgatgtcaagatggatcgcttacatgctgcatcggaaaaaccatataaaaatagtcaacatacttacaaaaagattacaaaaagcagcatcaatctatccgaaccgctcctttggaacaaagaacgatataaaaattcaaaaaattctgcaaaaagcagaaaaaagaaaacaagaattaaaagaagcaggaataaaagcagatctcatcagagaagaaccatttgtagaagctaaagattctgtacagtataaaatatatataatgaaatggaaaacacaacatgggaactaccacacaaaaatagaagaaataactatttgattcattgagagaaaacagacgaaaaaagaaacaatatcatatcccatctgctctgtagtcgctgtgtttaagatgctcatctgcatcttaaacacgctccgaagccgcatctgggatatgatattgttccttttttctgtgttttggctccagaaggaatgaatgcaatagtctttggggagaaaagggagaaaaatcagaatactactgcttgctcggaagatgtatcatccagaaaattcggtgttttctttaacgaacagtaaaaataaagtggattgtcattttccgagaaattaaagtagtcacctttaaatttagtatcagtgacagcattgcggagacaatatcagaataagccacgaccttccgacctagccccttctctccaacaaagactattgcattcattccatgtggtaccaacacacagaaaataaaaagaatagaccattgcaaatataatgtgagagcaggtaaataaaattccatgatagagatattttccgagcaagtagtagacttctgacctctcccccttcttttttccaaagactattgacttcattccttctggagccgaaacacagaaaataaaaagaatagaccattgcaaatgtaatgtgagagcaagtaaaaatgccgaacaggcattttctacgcagcgatatctttacagttgcaatggtctattctttttattttcgtctgttttccctaaatgaatcaaaagtaattcacatttatttcacagaatcctcgttgacaactttggtcataaaagcttacaatagtctgatagacaataatggataattgtaagaattttcagaagattattattgcctgtaagtatgcagaaaggaagaacagacatgaaagaagtaaagacaccgagaaagccgtttattttttattatattgtagtgcttctcatactcatgttaatcaatatgtttgttatgccaacgattcgggaggcaagtattaagaaggttgactataatgagttcatgaacatgacattgaataagcagattaaaaaagtagagattgatgattcacagattacatttacagatcagaatggcactgtgtataagacagcaaagatggacagtgactggggattgacagagagattgtaccgttccggagctgaatttacaacagaagttcaggaacagatgtctccattagcatccttcctcttatcctggatcattccgattattttgttttccgcattaggatactatgcccagaagaagatgatgaataagatgtccggtgggagagcgaatatgatgtttggtatgggtaaaagtaatgccaagatttatgttccatccgaagagggaatccgattcagcgatgtagccggggaagatgaagcaaaagaaaatttagcagagattgtagattatcttcatcagccgtcaaagtattcagagattggtgcgtctatgccaaagggagttctcttagtaggccctcccggaactggtaagaccatgcttgcaaaggcagtagcaggtgaggcaaatgtaccgtttttctctatttccggttcggagtttgtagagatgtttgtcggtatgggtgcatcgaaagtaagagatttatttaaacaggcaaaggagaaagcaccatgtatcgtatttattgatgagattgatgcgatcggtaaaaagagagatggtcagattggcggtaatgatgaacgtgagcagacgttaaatcagctccttacggagatggatggatttgaagggaataacggtgttattattttagcagcaacaaaccgcccggaatctcttgacccagcattaacaagaccgggacgatttgaccgtcgtgtgccggtagagcttcctgacctggtaggaagagaggcaatcttaagagtgcacagcaagaagacccgccttgcagataacgtagatttacatgcgatagcccgtatggcagcaggagcttctggagcagagcttgcgaatattattaatgaaggagcgttaagagcagtaaggaatggaagaagaatcgttacacaggcagaccttgaagaaagtgtagaagtagtaattgcaggttaccagaagaagaacgcagtactgtcaccaaaagaaaagatgacggttgcttatcacgagataggtcatgccttagtggcagctaagcagacgcattccgcaccagtacaaaagattacgatcataccaagaacttccggtgcattaggatacacgatgcaggtagaacagcaggataaatatcttatgacaaaggaagaattacagaataagatcgctacgttaacaggtggtcgtgcagcagaagaaattgtgacaggaacgataagtacaggagcttctaatgatattgagcaggcaacaaagcttgcaagagcaatgatcacccgttacggtatgacagaagaatttgatatggttgcaatggaaacggtcaataatcagtatcttggcggagacacctctcttgcgtgttccgcagacacccaaaagcaaattgatgagaaagtcgtagaagttgtaaaaacacagcataaaaaagcactggatatcttaaatgaaaataaagataaactccatgaattagcgaacttcctctacgaaaaggaaacaataaccggagaagaatttatgcagattctagaatcttaatcaaatactcgtattagttatcaaaataaaaaagagagatgtaatttgcgattgataaaatggaggaaaactatgcgaaaaaaagaacgtgcagcgattgtaatagagcgacttaagaaagaatatccgggagcagactgcactttagactataatgaggcatggaagctgcttgtcagtgtgcgtctggcagcccagtgtacggatgagagagtgaatattatcgtgaaagatttatttgcaaagtatccgggaatcaatgaactggcgcaggcagagccggaagaaattgaagaaatcgtccgcccctgtggactcggtaaaagtaaagccagagatatcagcaaatgtatgcggatgctcagagatgaatttgattctaaagtaccagataactttgatgatctgatgaagcttccgggagtaggaagaaagagcgccaatcttattatgggagatgtctttggaaagccggcgatcgtaacagacacacactgcattcgcctttgcaacaggattggtctggttgacaatgagaaaaatccgaagaaggtcgagatggctttgtggaaaattataccgccggaagaaggaagcgatttttgccatcgtttagtgtatcatggtagagaagtttgtacggcaagaacaacaccttattgtgaaaaatgctgtctcgctgacgtttgtaagtcatatgcttcttatatgaaagaaaaaaagcagtaaaagggaattgtgcaaagcgaaaatttgtagtaaaataatttcagcaagtcagtctttgcaataatgcaggatgtgaattgaggaaaactataacttatcacattggaaaaaggatggacaacatgaaagaatttaaaccaatcaaagaaggaaaagtccgcgaagtatacgataacggggacagcttaattatcactgccacagacagaatttcagcatttgacgtaattttgaaaaacaaagtaacagacaaaggtgctattttaacccagatgtccaagttctggtttgatcttacagagaacacagtaccgaaccacatgatttcaacagatgtgaaagatatgccggaattcttccagaatgagaaatatgccggacgcagcatgatgtgtaagaagcttgagatgttcccgatcgaatgtatcgttcgtggttacataacaggaagcggctgggaaagctataaagagaacggaaccgtttgcggtattaagcttccagaaggattacaggaatctgagaaactgcctgaaccgatctatacaccttccacaaaggctgatcttggagatcacgacgagaacgtatcttatgataagacagtagaaatccttgaaaaagcatatcctggcaagggtaattactacgcaaacattttaaaagagtacacaatttctctctacaagaaatgtgcggagtacgcttgggaaaaaggtatcatcattgcagataccaagtttgaatttggtcttgatgagcagggcagagtcgttatcggtgatgagatgctcacaccagacagctcccgtttctggccaagagaaggatacgaagcaggtaagggacagccttcctatgataaacagtttgtaagagattggttaaaacagaatccggacagcgattataatcttccggaagaagttattgataagacagttgcgaagtataaagaagcatatgaacaactgacaggtgaagaatttaaatactaatttgtagattttgtgtagacgaaaaaagaaaaaataccatatcccatctgctctgtagtcgctgtgtttaaaatgctcgtccgcatcttaaacacgctccgaagccgcatctgggatatggtattttttcttttttctgactatccaaatccacagttggtgggaatggggattgcccagaagtctatggtttttattggaatgatcatctccagaaagggatactttcttactcgattgtataaaaattatatttacctactactgctttatggagaatttttctctggttaattctcataatcttctggataatcccctcttcttcctcaaatctaaatactaatttccttctggagccaaacagcagaaaagcagaaatttcatatataatacaatgtgatgtcggagccagtaaaaatgccggtcaggcattttctacgccgcgactatcttcacattgtattatatatgaaatttctgcttttcgtctctttactccattaaattagaaaaatatgttgaaaaagcgatacataaggattatatttatattaatagatacaaacaggagagatgaaaagattttaaataaatggagagtagggaaggaatattgattataggaatttgcgatgacgacaaaagctgggtacaaacctgtaagaatacattaatgaaatttgctgcttttatcaatattgatatggaaataaagtgtttttatacatcaaaggaattattagattatcaagatataccgttagatgccgttttccttgatatagaattgggaaggcagaatgggattatgattgccaaaaagttgaataggatacgcccgaactgtcggattatatatatgacgaattatttacattatgcgacagaaatttataatacggagcatatatggtttgtagtgaaaaaacaatttcgtgacaagataggggaaattataaaccgaattttacatgatcttgaaaataaaacagtacatcttgtattaaaaacagtaaataatgagattatttcggttataccgtcggatatctgttatctggaaagagaaaaaagaggaacgagagtagtaacagtatgggatgagtatcatgtaaaagaacgttttgtagagatcattccacaattatcagaattagatttctctcaatgtcatagtagttatgttgtgaatttcagacatgtgaaggaattacagagagacatgtatatactttatgatgagtcagaaaaagaacagacagtacagattagcagaagatttgtgcaaaagacaagggaggatttcttaaagtggtctgcactgtttgtatagaggaatatgtatgggagtgctagttaaaacaagtctgtttatatgtatcttatggggaatacatatatggattaaacaagttatagatacagaagaaaacaatcagaagatggaagaaactttagagaacatgaatcattcttatgtagaatttcagggaaaaatcaatcaggcaaggaagtatcggcatgatatcccgaagcatcttcatatgatggaacaggctgtttcagatattatagatgatgagtattctgttgatactatgttaaatgcgatcgcgtgtgtaacagaggaaaagtgtcaggaatacaatattcaaataaacatcaatcttgcgataaaagaaagagaaatttttgataaattaaatattgaaaaagttgatctttcaggattgcttcaaaatcttctggataatgcgatagaggaatgctgccgtatttcagaagattttgaaagaaagattttatggacaatgaacacgacagaatacggtgtaaaaataagagtggaaaacacatgttgtaatataaaaaatatagattttataacgaaaaaagaagataaaaatgcacatggatggggcgtaaaaattataaaggaagttgttcagaaggcaggcggaaatataaactatacaaaagaagaggggaataatatttgtgcggaagtatttcttccgttcattgggaatttctaaagattggggaaaagtaaagcaaaaatatgaaagaaattatcgaaatactgagtggggaattttatgggttattctgtggaatctttggatgtgttatagacagtatccttatgataacactttttggaaaaaagaaatacagttatatcttaccggtgatgctcggcctgcgttttgtgatctataacgtaggtctgttactcattgccaatcatttttatggaggacagcagtggtttcggcttatgatgtctaccatagcgtccgccagtacatttcttattatgtttctcaccacatttttgtggaaagaacagttagcaaaagtattgctgggattttgcttatgtgatttcggtggaacagccattgtatatggcgtaccatcattgggatttcatccagtggtgaatgcaatactatctatcattattttcctgattatttataaaatcataaccccactattaaaaaaatatcaaaattacagaataaaacattcgtacatttgcagtgaaatattaatagtactcatattaagtggatggctcagtaactttctttatgtcagtatagaagacagtgtggcagcacaagatacaatgctccataaaatgggaatatattttagtataatggtggctttgagcgttacagtggtattttttatttacagcatccagctttcaagaagaaaaaagcagcttatgtatgccacagagcagatggaaagttattattcaaaagtaactatacaagtaaatgaattgcaggagtttcaccaggacgtagaagagggttttgaagaaattctaaaaacaaagaaggcaggaaccgtaaaagaaaagaaacagtctatacttgcctatgtagagcatttgcaggaacggtatcggtctataaataacatctttttctgttctgattatattgtagacggacttctatatgattttaagatttcccgtcaaaaacagcaaaagaaaacagatattctttttcaaaattatgacagaggattcatcagacaggaagatatagtagaaattctattaagtcttatggaatgtggtgtacaagcagaaaagataagtcttcatgcagcggcaatgaaaaatcaattaatcctgtgcatgacagaacaaagcctatcaaaacagctcggacaatccaatcaagaaggaggagaaagagataaaaagaaaagattaaaaagacgtttgaaaaaatatctgaaaaaatacgatggaacattttatagtacagatatacaaggagacacacaaaaaataatcatcgccttacggaggaattagaaaatgtcaattggaatgatacttcatcttcttgcacaagacaggacaatgttaatagaagcattattaggaaatatactaatctgcattgttgtttacacactatttggaaaaagaaaatatgactggttttttccggcagcatgcgctgttcgatatattttttacaacattggtctgctttccatatggaatgcaatgtatggaacacagaattggtataaaattacgatgtcaacctgcgcaacggcaacagccttaattcttgtaattattacagccatcttatggaaagaaccattatcaaaagtaatggtaggtgtatttgcagcggaatgtattaatgatggcattctctatcaggtaatgaaaatgaaacttcccataatacaagaatgttttttcgcggtagttatttttacagtattatattttattgtacggccactattaaaaaaatatcgaacctacataataaaacatgaagtgatatgccttacactcatatttactttttttatcgcagggtggctcagcaatatattatataatacatccgccagcctgcatcaaaagccaatgtatctgcttgcaaccagtttattcatcggtggaggaatcgcattggggataacttttgtcattcataccagaagtgtttttcaaaagaaaaaagaattaaaacaaaatacaaaacagatggaacattactatcaggaaatacaaaatcagataaaagaactggatgattttaaagaaatagcagaaggaacattgaatgaattaagcgaattgacacaaagtctttcacataaagaaaaaaagaaacaaataaaacaatatatccaaaacttagaagaaagatatcagaaaatcaatcagcttttcttttgtgatgactatttgatcgatggactccttgctgatcttgcaacgacatgtaaacagcaaaatatcgaaacagatatcctgtttcagaattatcatagaggaaacataagcagagaggacagcgtaaatatccttttacagtttattgaatatgctaaatatgcttcaaaagtaaaaatacatgccgctgctatcaaaaatcaattagtttattctgtcgaattaaaagaacagacaatttcagaaagaaagattaaaatttcaccaaaagactttaaaaaatatgtgaaaaaatatgatggagaagttagcatcgaagaagagagtgggacagtaagaattattttaggattaaagagataatataggaaaaaaatagaatttaatggaatatttcgataagaaaaataatttaaccatctctggttcaggaaaatctaattgaacaaaatcgctgcgcaatggtctgctgagactatgcgcagtttttttatccatacttttttatacaaacaaggccgaccattttagaaaatcttccctcgtttttttaacatatctcctgctaatctgcacaatctgttctttctttgactgtccataaagtatatacatatctctttgtaattcctttacatgacgaaagtttacagcgtagctatgatgacattgagaaaaatccagttccgataattgaggaaggatatcatctaatcgttccttcacatagtattctttccatacggttacgattcgtgtccctctcttttccttttccatatagcagatatctgatggaataatagaaatgagttcatttttcgttgtttttaaaacgatttgggatttcttattctcaagatcatacataattctatgaataatctctccaactttatttcggaagtctttcttgacaacaaaccatatatgttctgtattatagatttccgtggcataatgaagataattcgtcatgtaaacaattctacaattcggacgagttctattcaattcttttgctacggaaatccctagcttttttcctaattcaatatcgagaaaaatagcatctaatggcacctctttgtatgctaataattcttctgaatcagaaaaacatctagtttctaaatcaacattgataaaggtggcaaactctatcaatattttgttacaagtctgaagccattttttatcgtcatcgcaaattcctataatcaatatttcttccctactttccatttatttaaaatcttctcatcctactgcttgcatctattaatataaatataatccttaggtagcactttttcaatatatttttgttttttctatataaacccaataaagctagaaaactctttaaaatctaaataatatcttcaaggttctgaagataaaaaatttttcaacagtagatattgttttaaattgagtgaaactatcaagttgatattagaatattaatgcattatttactgctgtgttgttttttgtaaaagcttttcaataaaataatggagaatatagagaattaaattaaaaggaataaaaatcaggaatagctaccaaaaatgtcgaaaaaatgaccagttagacgagaaagattgaaaaaaatataagcaagatataatttaaatataaaaagtgcataacaaaatgtaaaggagagagggaggtaagaatacaatggcaatttcaaaacatgaagagaaaaagcagctttctgaggataacgaaagaagagatttagaaaaaaataattttgtgtttccgcctgcttatagccgaggaaaaagaaaaatacagtttccaataggaatggattcattaggaaatatgtatatgcaagagatgcagagagctggttccacttgtgcagcttttttgacgggaaaagaagattcaggaaaatatagttttctggagaatgtgataaattatttagttatgttatatcacccagatgatgtggaattatggattatggatttaaaaggaacagcgcagattactaacattatagaacattgtcctccgcatataaaatatttattagttcctaaaggagaaacgatgatatttgcttttctggataggatagaaaaggaatataagcgccgaattaattttttaaataatgtaggacggtcagaaaaatatagacattatggaagctggaacaatttattagatgtgccccaagaagtatattttccttccatatttgtgattattaatgaagtatctatattatcacaggcaattgaaaaattacaagggtcgagatatatgaaagattataaatatacattgcagaatatacttactcaaagtaaatcagcaggttttcattttatctttgcgaatcagagatttacatctggattaagtggattttcaagtatagcgatggaacagataagagtacgcatggcaatgtcagctacaacttcatcagaaatttgggaaacactaaatatttctacaaaatatttaacagaaaggcagatttcatggattgatgatttgtctcaaaatcaaatattattatgtccaaggttattacctataggtttagaaaagatagaaaaaccttcaattgagaaagtaaaaatattcaatatgtcagatgaggaacgtaatcttcaatataaacggtttgactggttgaaacaaaagatggtggtaagtaaaaagtatgaaccagatagaatagatagctatgtagaaaagcatccgattttatataatggggaacagtatatatttgatgaatgtaaacagaatatggtggaattttgtagggaatattcacaacgaatggattttgacccgaatgatcttgttttatttgcaggttatccattgagtttattgccatcagaccctgttattatgagacagggagaaagtgaaaatatagctttttttgctaacgaaaataattatattaagaatttgtcaaatacattatttgcgtgcctgcgttctattaatccaaagaggataaaaatagaaatatgggcattgcaggatgataaaaaaatgaaaatatttccagaatattggagtggatttaaatgtgtaattggagaagaaaatatatgtaaacgagtaaaagaattaaaagaggaattgtttaatgatcaattgagtaacacctatatattagttttcagtccatatatgatagaacaaagtataaaacgtgagatagaacttatgaagataaaaaatcaaaattcagatacagtaattcaaagcaaatcagcgaataaagttatggataatgagttaaatgatgaacttcctttggatgaattgtctgatactttgaatataagtagatcaatgaagaaaaaaatatctgaaatgcaagggttatatgatattgaagaagatttaaaaattctttgtcgatatggatgtgatagtggattgcactttgccatgatcgagaattcatggaatgaatttaaagaaatgagattaaaaatagactggtttaaacatatattctctataggattttcacaagaggattcaatgaatattccgtttggttcagttgcgggaaagacggagtctgacatgatattttatacagatggaacaagatataaactttttttaccatacggacatagtgaacgttaaatataaaaaattagagtagctaaagcgtggaggatgaaagaatgggagataaataattattatgaaagagcaggaattatgttggggaatgcatttttgcaatgctagtatgtttaaaacaattactcagatagaaatgtatattcgtagcaagaaaaaaggagagttaaaaattttaaatagagaagaaagcatacattattatatgacagaatatggacaggtttttaaatttaataaggaaaaatttaaatcatatgagttggatttacagaatatggtgtggtttcaaaatcaagattttgtgaggacatatttaggagacaatgtaaagtatacagagataaaaaaatttgcagactattatgattatagataagaaataaaatgatttttgtgttctgataaccaaaaatgtcgaaaaaacgaccacttagacacaaagtattgaatagaaatgtcgaaaagatataattcaaatagaataaatagcgtgaaaaaaataagggggcggagaattttgaatatgactccagaacaatggtataaaataatttatcaaaaagctgtttctttacttgaagaagaaaaaaatatttattggggagaaaagaagcaaagcgagcggataaaagaacaaatacaacaaatacaagatgattataggaatgaaaaagctaaaattctaaatacaaaaagagagttggaaagatttttagatgatgcaaaaaatcattatttaaattatatagtgttgaaacctagaaatgtagaaaatattaatatgccttctcttaaaacattaagattacagattgatgattattcggagtatgatcctcatgccagagaattgtatgaatattctttaggaggtttagaacttgtaaatcgggtattgagtaggcttgataaaaaacaaagagaagaagaaagaagagtagggttaaatcaggtaagtgattataagaatagaaaagaaacaaataaaagaagatattttgagttattacaaagcaaagaagtagagcaattaatagaatgcttaaaacgggtgaggcgtgattcatatttaagtaataattttcaatacaatccaccgcaaaaagaaccttctgttttttatataggacaagtagcgatgccaatgccatttccgaactatatgagtgaggaagttagaaaaagatttggaagtttttatgatttttcaagttgttctttaatatttcctaaaggtttttcgacaaatactgggggaaaggtatatatagaatatgaggatgagatggaaaattcacttatagaaggaataaaaggagtgatttcaaatgtattatgttgttttcctgcatatcctgaaagaattacatatattgatccaataacttgtaatagtctttgtctagaagaaatgagaaaaatagtatcgaaagtgaaatgtccgggattaataagatttccagaagaaaaaaaagcagttaaatcagtgctagtttcgctggaagaagaattaaagaaagaaaaaggtaattcaagaacccgctttttgattattaaaggatatcctgattattatgattcagagagtagagaaattttacaaaggttatgtgccagtgtgaatatatatcatttgattgtcttgataatgaaaacaaagcaggaggacgaaagaagaaatgtctttgagaatcagcttataaagcagtcggttagggtaagtactcaaaatggaaaatttattcagataagcaaggatggaacaagacagcgaccatttttttggtattcgtcaattaaaaaaatttcagatgaggaattgaagaagattcaaaaagattatgtaccaaaagaaaagggaacccgatatttggaaagagttaatccagaatttccgccaaactatcaacgtggaaatagagagatacagtggccttttggaatagattcatcaggaaatgtacataaagagacgatagaaaaaatgtattttgcagcttttctaatgggaggttctggttcaggtaagtccactttattggaaaatctgataaataatttggttatgtcatatcatccagatgatgtagaattatggattatggatttaaaaggaacagcgcagattactaacattatagaacattgtcctccacatataaaatatttattagttcctaaaggagaaaagatgatatttgcttttctggataggatagaaaaggaatacaagcgtcgaattaattttttaaataatgtgggacgaccagaaaaatatagacattatgaaaaatgggaaaagttattagatgtgcccaaagaggtctattttcctgcgatatttgtgattattgacgaagtatctatattgtcacaggcaattgaaaaaacgcaagggtcgagatatatgaaagattataaagctacattgcagaatatacttgtgcaaagtagggcagcaggttttcattttatctttgcaaatcagaagtttacatctggattaagtggattttcgagtacagcgatggaacagataagagtgcgtatggctatgtcagcaaccccacaagaaattcaggaaacagtaaatatccctaaaaagtatttgacagaaaggcagatttcatggatagacaatttgccacaatatcaagtgttattgggtaaacaccctgaagaagagaatgaattgcctacacttgataaaatgaaaacattatatattccggatgaggatcgtgctctccagtataaacgatttgactggttaaaacaaaagatggtgggagacaaaaagtatgatccggataggatagagtactatgtagaaaaacatcctcttttatataatggggaacagtatacatttgatgaatgtaaacagaatatggtgggattttatgagagatattcgcaacgaattgattttgacccgaatgatcttgttttatttgctggatatccattgaatttgttgccagcagaccctgttatcgtgagacaaggagaaaatgaaaatcttgctttttttgctgatgaaaataattgtattgagaatttatcaaatacattatttgcgtgcctgcgttctattaatccaaagaggacaaaaatagaaatatgggcattgcaggatgataaaaaaatgaaaatattcccaaaatattggagcagatttaaatgtgtaattggagaagaaaatatatgtaaacgggtgaaagaattaaaagaggaaatgtttaataattcgttaagtaatacatatatattagttttcagaccgtatatgatagaacatagaataaatcgaaagatagaatttatgaagataaaaaatcaaaattccaatacgatggttcaaggcaaagcagcgaatcagttattaagtgatgatttagcaaataaaggtacggataatgaattaaatagtgaactttctttggacggattatccaatattttgaatataagcagaccagtgaagaaaaatgtatctggaacacagggattatatgatattgaagaggatttaaagattctttgccaatatggaagtgatagtggactacattttgcaatgatagagaattcctggggtggatttagagagacaagattaaaaatagactggtttaagcatatattctctataggatttccacagggagactctatgaatattccatttggttcggttgcgggaaagacggagtctgatatgatattttatacggatggaacaaaatataaactctttttaccatatatacataaaaaagattgaatgtggaggaagtaaaatggaaaatgcgacacgagaaggttataaaaaaatattacaagctttgagagattatgtagagacagtgaatgataatgaaaaagtgcttttaaacgcagcaaatgtttgctgtgaagcaatgggaaatgacaaaattagtacggaaagtaaggaaaaattagaagaaattcttgcaagggtaaatagactatatcctatggtagatgatttgtacaatcaaatatcacgggaatatcaagaagcttttgatatataaaatgggaggtgagaattatggcagagaatagaaaccaagttgcattatatcaagaagcagcggatgcaatgagagactgggcaagagttataccaggtgcggtagagaatttacgggaggcaaatcaaaaggtatatagtaaaatttcagatgttgcgggagaaggagggccacatacagatcagatacttgaaatagtgtcataccttcaaaatgaactggaaggaattaatgcagagacggaaaatatgattaccatgttaaatactaaagcagccaaaatagaggctttaattgcaaaatatattgttgcgggtaattgaacagctcaccaatctatagttgattggaacaacagtatgaatacaatttctgagattgaacaattagaggagttagaattaaaaggagaaattcaggggtacaaagtgatttctggaatgaaagaaccgttatatagaaaacatcatcttccaactccaaatacaggaagcttttcaggagaatatggaaattctttcttttatcctgtaagcatagctgccagagaaaaattaaaagaatacaacaaagattgtgttatgtatagtaatggatatccagattttttaccatttacaactcagacaactccgtggggaatcatacaattttctgaagaaataggtcatatgacagaaagcagagtaagcagaaaagttgatggaatagttgaagaaggaaattttattcaggcagaaagagttttttgtgacaaaattaatcgaagaaatccagatttaaaattaactttgacacaatttcgttcatggtataaacgtgcgaaacttacaattcatgaatgtgcagatggaaaaacagtacaacttgttcctacagcaattcatgatgcatgttgtcatagtggaggtgtttcggaacagaaatatcgaagtgcaatgggggatatttgtctggatgataaaacaaattaaagtagagaactttcatgataaaaaataaatattattataatggtttaactacaagggaaagggctgcctgtgatgaattacggatagctatagaatctttgcagacagaagtacaatttaataaaacattatcttcagaagaaatagaacatgtattatatgcaatcaactatgactggccggaatattattatttttactgggtagaaaaaatagcactttattcagataaaatgtcttttatattgaaatatcagtatccaataaaagatattccacgcaggaataaaatgatacaggccaaaattcaggaatcgttgcagaaagcaaaagaggcaaatttacaaggcgattttgcaaaaagtgtctggattcataatcatatttctaaacttacgacgtatgattatggttcattcgaagaaagaacatctgaaaggagacagaaggaggcgcatacaatagccggagttttttgtagaaatacggctgtctgtgagggaatagcgaaagcatataaattattatgtgattatcttggagtagagtgtattttagttgtaggaatggcaggaaatgaaccatctaaggttcttgaaaatcaggatcatgcctggaatatgataaaaataaatgaaaaatatgggcatgtagacgtaacttgggatatgtgttctagtaggatctctaatcagtattgttatgattattttggagtttcagataaagtgttttctgcaaatcattcatggaaaaaatatcctgtctgtgtagagcatgggggactaacttattttgagcagaccgggaaattatttaagaatccaactgagttaaagcaatatgtaaaaaacgagattagtaaacatccttcgaaattgtattttcaattggataatacagcatcaataacagacaaattaatagaaaaaattaaggaatatattaaaaagcaaatatttcaggaaagtgtaggtagtaaaaattatcaactatatatgaatagagaattatatatttttctatacataattcattattagaaagaggggaggaagttttcatatgaatgaaaaattgaaaaaaggacaaacgttatccaccaaattaggagtgacggtaacaattaaggagtggttggctgaaggagggcaaggtgatgtatatttagtagaatatgccggagaagaaaaagtattaaagtggtataaaaaagctgctataggagacaattctcaaatgttttatgataatcttgtggataatattcatagaaaaagaccagattcacattttatttggccagaagatattacaccatataataatggacaatatggatatattatggaagtattaccaactggctattatgaagttggtgattttatgaataaggtggttatgtttaaaaattatcgaataatgattgatgcggctttaaacatgataaaagcatttcggattttacataatgcaggattattttatcaagatattaatgagggaaattttgcaattgaccctaataacggtgatgtaaagattatggataatgataatgttgccccgagtggaaaatcaacaggtgttcttggtaaaccgagatacatggctccggaaattgttataggaattagtaatcatcagagagcgatagaaaccaaagcagattatgtgccaccatttgttatgccaagtgtgcagtcagatttatattctatggcagttatcttatatattttatttaccttaaatcatccaatggaaggaaaacattacttggtgccggggttaacggtcaaaacacaggaaagactatacggaaaagatgtagcatttatgatggaaaataatggtaaaggcaatgatccagacccgattgttcataaaaattcccttattatatggccaatgttacctaaatatattcaggaattatttttaaaagcattaggagaagaaggaataaagaatccaagtaaaagaccgcaggaagtacattgggtggatgctttggttcggtttagaagtgatattacaacttgtcctaattgcaaaatggaagtgtttgtaaaagatggacgttcatgttgttgtcatagatgtagcgaagctttgaagataccgtaccgtttggaattcttagactatgcaattccggggaaaaaaggagcaagaatttatgcttctcaattcaaaacggtgaattatgaagaaatgttggacattgcgggtacaattgtggcaaaaccaaatgagccttcaagtttatgggttttaaataaaagtgatgagagttggcgtgtaacaacaccaagtggaaagcataagagaataaatccgggagaagtattaccattgaaagataatctttcttttgaagcaggaaaaacagcggtaagagttaagaaaaattagtgttaaataagctatgtaaggagaaaaaacaatggatgaaatgatttttgaaaatgatggattatttggagatatgacagaaacacctagaaaaaatttaccaatattttatttgttagatacatcaggaagtatgataggggaaccaattgctattcttaatcgtgcgatgacagaaacaatggaagaattaaaaaaagtagcaaagaaaaacagtaatgctaagttgcaaattgcggtaatggagtttaatactaacgtaaaatggatgcagccagatggattagaggaggcagaagatttttattgggttgatttgcaggccggaggactgacagaagttggagcagcacttaaagaattagatagtaaattatcaagagagacattcttaaaaggaattatgggaaatctgatgccggtcattattattatgacagatggtggggcaacaagtgactataaaaaagaacttgatgaaattaagaagaatagatggtttcagaatgctagtaaaataggctttgctgttggggaatatgcagatttagatatgattgcagatgtagtaggaaattcagaggcagtaattaaaaccgatgatatgaaaacatttgctaagttaattagactggcttctgtaacagcatctaaaattggttcagtaagtcgtacttctgcaggtggaagtattacagaggagattgttaaaactgtaaagggagaatctgagcaccagccattgccggaagaaccacctttccctgaccctgtaccagaggatattccacctttccctgaccctgtgtcagaagatgacccttgggatgaaactgaatttgactaattaaatattttcagaaaggaaatataatggaaaatatttttacatttcataaaactgtcaggggatataatcatataagaaaggatactccatgtgaagattattcctgttcttatttgtctttgtcttcatacgaggaaaaatgtccagaagaaaaggaagaagtccagacaaatgaaataataagggaacagatgcaatcagagtttatttccgatgaagaagcagagttatggggatttccagaagaaaaagtaaattctgtggaaggtgaacgcgcctattatatagcagttgttgcagatggacatggagattctgattgtgtaagaagccagattggctcacaatttattgtggaagtggtaacggagtgtatgaaaggatttgcagatggatattatgaagacccatttatgtttaaatcaaatgtttgcggtcggaaatatcatttacggcatattacggacactattgtatcgcaatggaatgatagggttaaaaatcatctatcggagaatcctttaacggaagaagaaatagtaaagctttcacctaaggcggcagatgcatataaaaataagaaagctttatcgcatttgtatggaactacagtgataggcagtttattaattgattcatttcttattttaattcaacaaggagatgggagatgtgaagtcttttatgaaaatggaaaagtagaacaacctattccttgggatgaacgttgctttggaaatgtaactacttccatgtgcgattctgacgtaaatgaaagattccgatactgctatatcgatttaaagcaaaatcctgtttcagcatgttttgtaggtaccgatggaatagaagattcttatcgaaatatggaaggtacacatatgttttatagaaacagatgtttagaaatgataaacgataaaatagaagaatatgaaaatggtttatcagatacactttcacaactaagcaggcagggaagtggagatgatgtttcaattgcggggattatttggctagataaattagtagtattaaaagaactatttattcgtcaaaataaaaaatatccgctggaagcatttatagtctcgaatgaaaataaacttatttcaatggagcgtaaatatgattttctgcgagaagaacaggatagaacagaaaatgaatataacaagcttcaaaagcagtatgatgttttgaatgaagaacatgagaaattgaatcaacactgtcaggatattgaaaagagattgaaagaattagaagatgacattcaaacaggagaaagagattctgcacatatatttgacgaagatgccatgtatttaagaagatatgatgagtttctttctgagttacataagcaaattttttcaagaaatattaaagatatagtggatagtttttttgaacctttagaaaaattaagtggaagatttactgaggtatgggaaagaaaaaaatgtgatgaacaacaaaagataacaaaattgaaaggagaattacaaagcacaattgaaaaaatgcaaaatatatataaaaaaatggagattttgcaattaaaagtagatgaggtaaagcaaaaacgagacgaggcatatcggcagtttaatgaatacgatttaaaaaataaacagataaaagaatcgttggaaaatgcaaagagggaattagaacaattgaatgaactaggataatagagaactttgtgatttttaaagtgtaattgaactagctgatatattcaagaaaagagtatatcagctagtttggttaaaaaagaaatattgattgtgagagggaaagatggcaagtaaatatttattaaatgaagaacagagaatcagagacaattatgaattaaaaatgcaggctgaaaaagatgcaggggagatgaggaaaaaagagctggaaagacaaaaatcggatatatttgatagcggatgttgtactgcatgtgtattaggtatagttattgctattgttgtatggattttagctcatagttttacagaaggattaggtgcaggattactatttatagtggcaagtgcagtagtagttcctatttattctggattaaaaaaaggaaaaatggataaaaaaatcagtgagtgtactaagcagacagaagaaaaaataaaagaagcagagaagcaaagagatgaggagataagattatttggagatactcataaaagaaaatgtgaagatagaacgaaatattttatacagagtactcaaacaaatgaattagaggaatggttatgtaaaaaattcagtgcacaaattgatgggatagacaggagaaagcatataaaagagctgagggcatcctatcattttacagtggaatcgactggtattgtgggggataatggaaagtttgattttataatagaatgctatcaagttttaaatgatttctatgatcagatagggcttgcgcgagcactttgtaaaaaagtgcagtatactatgcaaaaaaaatatgaattagattctacaggaacagaagcaaaaataacagtatcaggtaatgataatcatatgtgcttggaatattatgcgccaaatggtcaatatgaatttgcaaaaaaaatataagagtaaataataattataatatttgtaaagaaaatatgttagaaatttatttgtgaattaatggagcggataacataatgaaatgcagacagtgtggaagtgaatggaatgttaatataacggtatcaaataaaataaaaaaatgtccattttgtgggtggataatagagtcagaaaatattcattcagcaaatgaaatagattccatagaagaagccattagagaaatttatcgtataggtggtgagaagactatttgttccacacagttagtaggatatttcagtgatcttgcaccagtattgcgaaaatataatgttcttataaaaaatttaattagcatgaatggaaacataagtttatttgaggcagcattattagatgagacacatcgcaaaatacaaattattcgtgtagcagaaaagttacaagcaaattattttttggatagaaatatatgtatcgaattatgtgaaaatttttgcagagcaatatatttagaaaatcaaaaaataaacaagacaggtaatgaaaatacggatgtaccaatcaatattgatgaagaagccagcgtattgaaaaaatcaaaaaaaagtgtgaattcttattacgattctaaaaactcttgtagtattaaaaaaattgaagagatggcagagcaagaagattcagaggcacagtatacactagcagagtattattataaacaaaagcaattgtcagaagcttttatctggtatgaaagggcttctaataacggtaatagtaatgctttatataaaaagagtattatgcttggaatgtcgggaaattacaaagaagcagcaaaaaattgtagaaaagccgctgtgttaggaaacgctgttgcacagtatgaatatgcagtaatggttgaaaaaggaataggaacattccaagatattgatgtagcgaaaaaatggtatcacaaggctgcagaacaggggcatacgcaggcaaaaaaaagatatgatatgttgaaagtagagaggaaaaaatgaaacaagtaaaatgcaatgcatgtaaagaaaaatggtatattgataatcagaatgaaaagaagattagggtatgtccattttgtgcagcagatattagagaaaaaatagaattaaagaatgttaatacattaggagaagctatttataaagccatatctgaccggggaatagaaatattagataaccatcagaatatgtatgcctacttattagatacaataccagagctaaaacgagaaatacggatattttctaaatctttcgaaaaggaatgtctagtcttgtataaagaagcctttaataaaaatgcaaatgaggttgaattaacgatgcagcaaattaaacatctgcttattgaagaagaaggtttatcagaagaatggacaagtaaaatatgtaaggaatgcagacaagctcttatgtattataggggagaaagtccaaagtatattattcttgcagatatagtggacgtagatttaaagttggtggaaattaagaataaaaaaatagaagatataaaatcacataccgtagaaaagaaaaaagtaggaaataaaatatatattaaaaagattgcatcagaaatagataactatactatatgcggaaggagaaaatatggcaacaaaaaataatggagataatagtggtatttttattatattggtgataattgcattgataattttagggatagaatgtattgatatacataaagaaaattctaaaaagaatataaaatatgaaaattcagaatacagcgtaggagatacgattacatttggaaattacccacaagatagtgatggttcagaggaacctatagaatgggtgatattaaaaacaaaagaaggaagtaaagctttgattattagtaaatatatattagaagagagaaagtaccatgaaacaaaagggaatattacttgggaaaattgtgatacaagaaagtggttaaatacagaattttataatgaggcatttgatgaagaggaacaaaagaagatagaaaatacgattgtgagaatagaagataattatagaactgaaacagaaggggggaatgatacgagggataaaattttccttttaaatatagatcaagctaataatcttttggatacaattgacagagaaactgaggggacagaatatgtcaaaaaaacttatggagcagaaggaaagcagggatggtggctttgttctccaggatgtcttagtgataaagtagcggttgtacgttcgtatggtggtactgattcagatggagctgaatcaagtaaatattatgggggaatccgaccagcattatggataaattcagaatcttaaatggaaactaaaaaataaccgaaagatagagtgggtataaaattaaaaatatattgaaagaaataaaaggagagtattgtggaagaaaaaaataataatgcaggtcttattattatccttgtgataattgctttgataattataggaatagagtgtatagatgtacaaaagaattcagataccgatacttcaacgacagagtataatcaggactgggatgatgaaattgaagatacggatagtacaaacaataatgaagaaagttcaatgaagtatacagataatacggatatgaatattaaagagtgtttgaaagttgatgcttaccaaaaagtagaaagtacagatggcagttttgagtttgcatatcctaaatatgtttttaatgattatgatatagatgatgtaaataatgattataatttctactataaagatgaagatgaaaatataaaaatgcagatgagggtttatacagaagaatatgaaggaaatcctgttgaaaaagcaagagagctatatgataatttttgttccagagctacagaggttctctaccaaattgaacctaaggatgaaattgatgggcaaggtatggcaagaacaattgtagcaggaaaatttgattatgaggatgcagatacctgtgtatattatgtgggagcaagtgatgaaaatagggattatataatggagttctattatcctgatgctaatccagagtatgattatgatgacgtaaattatatattagactgtgtgtaccgatattgttcatttgcaggtggtacatataaaccaagaagttatgaaatgtttttacaagatgatatgggagtaaaaaagtaaaaaatatattataagataggataaagggacaggtataggaaaattaagatttgtatcttatatcaaatatgtttttttatatattatcttaaatagtaaatttatgcttgtgttttctaagggagaatatagaaacagatggaaagaaaatcgttagaagaagcattcgcaaaaatatatgatattggaggtattgaggttttacaatcagctgaatttcaggaatattttgctgatatagctcctgagttgcagaaatatagaggtatagttaaaagtttcgtaaatatagaaggaaataaaaatttagtcaagataatatcatcaaatacggaaaaacaaaaaatagaagtattaaaaattgtacaggaattagaagataaatatttatataagaaagaaaattgcactgatatatgtatagcattttgtagaactataggtattaatatagatatttgtgaaaaagaaaagagtatagaagaacatataaatactactaaagaaaagaatgatataaagatatcgactacgacacaaaaaaatatacagaacaatagcgaaatagaaaaatatatagcgttttgcagaactattggtattaatataaattcttataagagtatagaagaatatataaatactactaaagaaaagagtgatataaagatatcgactacgacacaaaaaaacatacagaacaatagtgaaatagaaaaatatagagtaggtgatattatctcctggggaaattacccaaatactagcaatggttcagaaagaccaataaaatggaaaatactcaaaataaaaggagataatgcattactactttgtgataatatattagatgcaaaggcatatcataataaaagaaaaaaagttacatggaaaacaagtgatattcgtaagtggttaaatgaggatttttatgatacggcatttaattttaaagagaaaatatgcatccgcaatacgtttatagaggttaaaaataatcttatatttagaagaaatgacatagaagataaaatatttcttttaagtaaggaagaagtggaaaaattctttttaacagagaaagatagaaaagtgcaggcaactaattatgctctaaatagaggggtatgtcctggtgaagatgaagatggttattactatcgtatggaagataataagcttgtaaggtatcgtaaaaaagattttacaagctatgcaagttggtggcttagatctattgaaaagcgtgaatttagggccgatatggtgcgtgaagatggaacaattggtagaagaagagtgcattggaatgatataggtatccgaccagcattatggattgatttagcagtttttaatatggtatctcagtggtagcttgcgaagaaaagtgagaaatgggaaaaactgcaaataataatgttatagatattgatggatatggaatagcagtagtaaaagaatattatggaaaaacaggatttgataatgaagatgtttaatgatgcaactgggttcaaaaggatatttctaaaagtaggttatacagatctccgaaaaggaatcccaggccttacggcaatgatacgggaatcttttggatgtgacccttatgaaaaaaatgtccttttcttattctgcggccgcaggactgacaggataaaggcaaacggactaaatccatttcggtatctggaattcctgctaacagaaatgatggaacatgaagaagatacggattaccgttttatagatgatctgttaccgtggtcagactcaataccagatatatgcaagatgaagaataaaaaagagcactgagaagtcagtgcctttttttgtttagggtactcatggtttaccgtgtaccgtaatactcacaaaaatatcagtgtttatatgattataaccgaaaatgtcggaaaaatgaccacttagcctaaaaatgttgaataaaactagaaataagttataatttgaatacaaataaatagagaaatatagtattagggagatgaaaaaaatgataaaagcagatgagttaagagaatttagaccagtggtacgttacagagatggaagtgagattacattacaggcagtacagaatgcacttgaggcggctgccaatagtatcgggattccggtagccttttatgaggatcaggtgaaatcaggtggaatatttaataagactattgaaaattgtattgtactttatcatcctgaacatcaatatgattattttaagttttgtatacgtatagctacagaaggttcatatgcatttatttcatgtaatgatttcggtcagagtaaacagatgaataaggctgatcgtgttgaagcatataaagaagatagaagaggaaagagcatgagttataaagttggatctataatcggtcagggaatttcaagtattggaaaaagtaaacagaaattagaagaagaacaaaattattataactgcataagtgatattttagacgatgttatttcatatgataattaataatattggtgtattaaaaaatgttttgtaaggagaaaaatatgggaatacagttatctagtagggaattttacgagattatgaagaaaattgaagaagccgggaatgatagaagaaagttggaggcaattaaagagcttattgaacagtacaatgaggatgatccagaagttaaaaaacttgtacgtaaacttagaggataaactagtagtattttagagttgtatttattatatgtatagtaatgttatatatacagtaatgattttttatctatatggataaaaagaaagtttaaatatgaatagatagagtggtaaaaggaaggttaggagaggggataaaaatgattttagaggaagaaataagaaatgcggaacaaggaagtattggggctatgtgtcgtattggagattattattatcagaaaataagaaatgaaggttatgaaaatgaatacgagaatatggctttaaaatattataaaatggcggctgaaagagaagaattatatggaatgtatagatttatagaaataggaaatataagtgcgaaagtagaactttcgtttgcctatcaaattggtatacaaacagcaacgaaacggtgtgaagaagtttatagtatagccgaaaaaacattgaattttatagaaaaatatggttcagaaaatgaagagatgataaataggggcatggtattgtatcagttttatatggcttcctattatcttgcaatatgttattattttataaaaagtgaaagggaagcaggaagattactttcaagaattgataagcaggatataggagtacaagctaaattattattagcacttagtatttttataggagaaaatgatttttcaagacatcaagaagtgtatgatttgttattagaacttgaaaataatatagaatttgcggaaactgagaaaatggaaatagaagaaacagtatatgcatccgcggcattattattgtcgcattattgtagaggaaattttttgaatcttactccagatttagatagagctgtagaagttttgaatttcgtaaaaagtcatttgaagagagaagatgaaaaaaagaatatagaaaatgaactcaggcgttatcataaaaaattatttggtggatataaatatgtgaatgattaaaatgagatgaaggcaactattgggttgaaatatataaataaagatttaggaatattacagtgtatatatgagggcattttaggggagataataatatatggaatgtaaaaagtcaagatttaattttatttataaaaaatctgaagatgaaattgtaatatataacacttatagtaaagctgtgattttgttaaataagacagaatataatcagtatttaagtttaaataatatggactatgagatgcagaatacattattagaaaatcatatactggttgatgaaacatttgatgaagtaaattttcttatgtattgtcataatattacaaagtattcacatgatgcactccatttggtattagcgactacaatggagtgtaattttggatgtccgtattgctatgagaatcggagaaagggaaaaatgagccttcaagtgcaagaagctattattaactttatccataaaaatttagaaaagggaataaaattattggatattacgtggtatggtggagaaccattattatacccggaaattataaaaaatatgtctgaaaagatacatacattagttgataaatattcttgtgaattgaatatgtatatggtgacaaatggttatttattaacaccagagttagtcgaaatgcttgatttgattggagttgttaagattcagattacactagatggattaaaaaaattgcatgatgcaagaagacatttaattagtggaaaggggacattcgataaaatttatgaaaatttaaaattatttgaagaatattcaattagagtagatgttagaatgaatgttgataatgaaaactataaagattatattggactacagaaaaaaattaatgagttaaataatttaaacgtaattttatatccatcaccagttgaagacattaataaggatatagaaaataatgttagtgattttatgacttttgatgaatttgagaaatttgccggagagattggaaaagaagggatgacctctgcagcaacgacagttttagatgataggtattgttattgtcaggcagaaacagaaaacaactatgtcatagatgaactgggaaattgttacaaatgttgggatcaagttggaaggacagaaaatagttgttttaatataatgagattaaatgacaagaattattctaacattgttaaatttatgtgctggaatccttttacagattctatatgtaaagattgtgtttttttgccagtctgctttggtggatgtaaattccatagaatgaatgcaggaaaatatgattgtggatttactgaagaatcaatgaaaagttatcttgaggaaactttttttgattagcaattataaaaaggaggtgagagatatgaagattattcaaaaggcaaaaacaactccaaagaattttaaaccacatgcaaatgcgtgcgatcatgattgccttgcaacttgtaagaaatgtccaccgagaacgtgttaattggttctaataaaattgaggacatgagaggaggtgaataatttttcacctcctattttcttatgtgtgccagtaatgtacgtttctaatggataagaggtaagcgctacataatcgcccggattttcaatttcttataaccatgcgatagtccttttatcggagtgctgcttccaatgctaaatctagcttttaggattcgtttgctctaaattttctttcaatccatctctgaagactcctaaattttttagaaggagtatatttattatgaagtcgaacactacaaaaatttataggcgaaccgaggaagaatgggtttaacttatccaggaatgtcgtacgagtggactttccgataaagaatggtgcagacaaaataacattatcatcagtaactatgaaatttttatgcggtttgttgtgtaccgcttacggtgaaagtccacaatctgccctagtagtgggaagggtatagcccaaaccaagggagtcatggatgactgcgaattcagaggaaggtggaagcaaatttttggtctgacgaacagaaattacatcaggctacagttaaggataaagttgcatagcaactaaagttccataactattcggaattaactgtggtgaatgtggcagatggatgtagagaaagaaatgtgtggtactttactttggaatggcagatatgaaaagttttttgatgcaaatagatgaatgaccatgccataaaataagggaaatctattggaaacaatggaagaaagtcaaaacaaagtttgaggaactcaaaaaattgggtgtagaagaaaaaggtgtggatatgcgccaatatgtgaaatgaaaactagagaagcgccgtatatggaactgtatgtacggtgctgtgggaggtagataaaataattatttacctcccaaccgattttaggaaagaagagtaaattatgttatatggttttattaaggaagatataaaacaattagataaagaaaatccactttatatacaagctaggtatgctcaaaaaataggtaagtattgtgagatggatttaaataaaaagatagttatagataatgtgggaaatgcaatatcaattgataatgagcttattatgttgagatgtacatgtgataatttgaatcaaggaattagaatttataaagaaaaaggtgctaacttatttgaaaaatatgaagatatacagaagatagaaaattggttttattatggtgaaatatataatagaataataattgaagtagattataataaattaaaaacaaaatcagcagaaagaagaaaattattgaattttataagtaaatattcaataatttttattaaatcaaagcataaaggattttcatgtgctgtttcggttaacatattattagagaaaagaaaggcatttatagaatttctatctcagcaatgtgcgatttggggcgagaaacttttgatttgtgaatatttgaatgtgaaaaaagattctttagggaaaagagaatcaagatatattgttataaatggggaagttatcaattcatcaagacaaacaatttctttgttgcatacggttcctaaatctcatgtaaaaaaagcggaggaaaaggcaggaataattaaaaagataaaaggattccccgttaattatgtgttggatttatgcgagttttttgtagatgaggaaaagtatattgatgtagtagaaattaatcctttaacaacatcaacatgttttattaataatagtatattttttgataaagagatttcagtaattagacataaagaagaaattttaggaatgggattggagtattatatggattatacagaaaaaacttataaatatataaataatagaacttcaaatggagaatataattatttgtcagaagatttttatgaatttttatctatttagaaaataagaaatgtacataatataaatcagactgtagacaaagtggtgtctggttcttagatcagacaccggtagtgtaaattattctgtgtaaacctctcagattgatgataaaatcataggtttatagaatacaaaaatataatgtaatgggctgaatggcatactttgctattcagcctgttgtttatttagt

SEQ ID NO: 420 - DNA, 41565 bp, Eubacterium hallii
aacggttttctctttaagaactgctacggctattgtagcatattgggtaacagttaacaaggctcctcccaccacctaaaggtagtgggtttccgcctatggcaaacgaaaggattttatttatgaaaaatgattcattttacgacacagataattataagaagaagcgacagacttccaataaaagttctgtaagttatcgtacctctaaagcaaggaatgcttcttataagccggtttccgctgcttcctctggaaagaaaaccaaacgtatgaatgagcatgaaccgaatcatccaccgaaaaaagtatcgaaaaagaaacatggctgcctgcttcccctgcttctttttattgtgttgatcggaattattgcctttttcgcttttcatttttcggtaaaaggggctttttctaaaatcaaaaagtaccctttggatagatcaaatgtaactgtcaatgatacggatgctaacattaaagattatcaaaacattgctctttttggtgtagacagccaggataacaaaattacagatactggttcccgaacagactgtatcatcatcgccagcatccataaatcaaatcataaagtaaagctgatgtctatttaccgagatacttatgtaagcatcgatggagaatatgataagatcaatgctgcctattcctacggtggtccggaattagcactccgcactatcaatcgaaatcttgacctgaatatcaccgattttgccaccgtaaactttaaagcattagctgatgccgtagacgtactcggtggaatccctcttacgattacttctgagaaagaactgaaaaacctaaatgattatattggaaatatgaatcatattaacggagggaattctcctaaattcgacaaagtcggaacctacacctttgatggaaaccaggctgttgcctactcccgtatccgttacatggaaggcggagatcacgcaagagcaaaccatcagcgtcttgttcttgaaggtattatgaacgccgccaaaaagcagccattcaaacttggaaagttaatcagtaccgtcctcccacagtgtaaaacaagcctgtccgataacgaccttacaaagttaacattttctatggcccgctcctcgatcacagactcacaggcttatccgtttcaatcagaagatgagcggtacggcggtatttattatggttttcctatcactgccaagtcgaatgcgatcaaggcacacgaatacctctttggtacaaagaattatgaaccaaccgatgaattacagaaaatcagtgcaaaaataaaaatagtaactgacgacataggattaacggattaatgctttaagttgtaataacagacgaaaaaacgaaatcctagatatagcaaatgtaaagatatcgcagcgtagaaaatgcctgttcggcatttttacttgctctgacatttcatttgctatatcccggatttcgttttttctgtttgttggctcctttatatttaaagcatttgtctttggttatgattggggtatcttctcctagaaattgtcttccctgcttttttactttctctgacatttcatttgttatacccaaattttcgttttttctgtttgttggctcctttatatttaaagcatttgtccttggctatgattggggtatctttattcttcgtagtagttaaatttcggagttgcctgtatctggcaggatgctttcattgttcttctgtttttgtgaaggagaacatttatgaggagcatttctccgttttctaccatttcttcaatgtcttcttctgtaagttcctcgtaatcttctgtgatcatgtctgcatattttaattcgagatatacatcacacatatttccgagtgattcgtggaatgctatttcgtcaggttctagttcgctttcgctttcagcctgtgcatatccgtaggacataagaatcggaattcctaattcttttgcaagtttacggataccatccatgagaggtttcatatcttcggagtcttcaactgaaagtatattttcgatattatcaataaagacaaccggcttatgtgctccttctgttacaatagaacggattaattcttctaaaatgtcgcttgctgaagcgtcttccatattgtcgacatattccgatacggcttcctgatcaagtacgaaaagatgctcgctgattctgcctctgtaccagtttaattcgtcttttaaggaacgaatatctgcacctttttctccggtcatgattgccatagaagatacggctttttcttcatcttttttattcatttcatagcttaaacgtgaaacagtatctaccatcaggtcatatctggaaagttctgtagaaatataaagtacatcaacgccactctccgctgctctatctgcaatctgctgcatgaatccattctttaaatactgtggcatagaatctacaaaatagcttcctttatgaagtccgtaacgaagcatcgcatctaaacgcttaaaacctgtgcttaacttacggttttcctgagtatccacgatatattcttcaaacttatccatgaaacttgcagagtttttgagaacaaatggattacgtacacttacctggaattctttttcttccactgtttttccggtagggattaccgcagtaaattctctttcttctttttccggtgctgctttttctttacgttttaccacgtttttatgctttctggaatgtaagctgcgctcactgcgagaatcttttttcactcgtgcagatttcttttcttctttttccggtcttgtcttctctacctgaatcgtatgttccgattcagaaatatattctgctgtctcgctctctttttctgcgtctttctgtgctgtttcatcctctactttttcgtcttcgtcatctgaaagaatgcttctttcggattcttttgagtccttactattctctgttgtttcagaatcttcttgatctgctggttctgtatttactgattctgtatttatctcttctgtatccacttcttctgccgaaatattttctgctgactcttcagaagcttctgtattttccatactttctgtttcattcagcttttctgtttcttcgaaatccgtattatcttgtacaccagtttcttctgtactttcaacattttctacagtaggttcttcggaatcttctgtattttcttctgtgtttttctcttcaagttcttcctctacaaagtcttcatccatagcgatttcaagttctctttcaagatcttcttcatcaagatcttctaagtctcctaacgtgtcttcttccttatctaatgcggaaacggatgctttcttctttttgccattctcctgctcttctaaccatgcatcaagtactgtctctgagcctgctaattcaagtaaaagcattctctttgctctctcatatacctctccttccagtccaagggaagcaaggttgtcgagtgcttcatcaatttcagcctgtgtatgttccccaagaaccagttcacctggatcaacatattcatattcatctgattcttccggttcttcttcgactaaagccgtttcttccggctgttctgtctctgaaacaatctcttctgcttctacaggttctactggattgccttgtgttctggcttctgcttcctgttcggattcttccttttcttccttttgttctgtttccgcttctattttctgctccgtttctgcttccagcttcacttctagttcttcattcggtttctgctcagatttggatgcttcctctaaagcttctggctgtggttctgactgtgttgcaacagtatcaactgtatcttctgcatcatcatctaaatcaagctcatcaaagcttaaatcatcctcactaagttcttcctctttttcctgagctgccaacgcttttttcaatgcctcaatctcctgcgcctcttttgcaatatcgacagccgacttcgtctctcttacttcctgtggctccggtcttgctgcctgctgtgcggctctggcaagttctacagcagatactgcccctgtttctggtgtctcctgcggtactgcagctacttccggttcttctggtaaaacattactttcttctacacttggtgtctccgaagtatttcttgaaatgacttctccaatcagagattccatatcttcctgacttaccgtaccaccactttgactcatcattcgtttcaggttttcaaaaatcgtctcattaattacaccaagatctgcattcgcatcctcagataaaatcatatctgcattctcctgcacaacttcctgactgatcatgcgaagcatatcatctgaaaatgccggtgtctgctctgttccctgcgctgtggcatcacttgctgcctctcctgttccatcttgctgcaactcagcctgtgaactctgtgcctgctgtggtaaaacaccaacttgttccttaatctcatccggcacatctgtgatatcttccggtgcaactcctgcttctaactgcttttctttataaagctctctttcgatttctaacttttcttccggagataaatcttcataatcttcaaatgaaaccaattcatcgctatttttttccatataattcagaatttcctgctgatgaagcgcaaattccatcggatcctttccacgctttcttgcctcttccataagaagttctgctctcttttccgcttcaagcttcatttgatcttcttcccttgctttggcaattgcctctgctgctaactgggaagccgacttcgtttccggcatctgcatctctttcggttcatattcttccttctggtgcgcttcttcatctttatcgacagctgcctgcgccagctcccatgcagaaaccggtctccttctctgttcttctaacgctctctcttctgcctgattcgcttcatcctccgcaagcatctctgttgctgtcttctctcttccgtagcggatctgagaacgatcaaacggatactctacttttggatcattcaatcccatcatctgcataaagttattataaattaaatcattcagattcgctgcttcctgcggattcacatcatcctgtccaaacatatcataggcattcccattcccataatcttcattattaaatgtctgctgttctacttccggctgtgaagcagaaattgtctctacctgtacctgcggctgtaccggctccggttctggctgtgaaactgcctctggtgcctgtactggctgcactggctgctgtgcctcttctctttttcttccaccattcttcaaacgttcttctatcatattcactgcggaagccgctctctcagaatcatccatctcctcaaatgtctttggaggaaaaatatctggagccattgattctgccatcttctgaatcgtatctgataattcccgctgttctgccggttcttccggtcgtccagtgatattcatagccatatctataatatcattaatgtcaaacggtttctcttcacttccctctgttgcgctatgctgtgctctcaccacgtccagcaatgccttcataatatcttccattataattaacctccgttatatcctctgtcttccttttcagattctaaattatataaagctattctaacacctttatgcgattattacaaacaactattgtattattacatcttttccgtcaatttccttcaagccctataaaaagttgttctaaacattgctttttttaactaagtctgcgatactataaatagttgattgatgattaccgctcatacatagcattatgtaatttgcgatcaaattaaagaaaggagaacttctttgaaaacttatattgacttacatatccattctactgcttctgacggaaccttttccccaacagaaattgtaaataaagctttaaaactcacagaaaaagacagccctgttgtcatcgccctcacagaccatgacactgttgccggaatcgatgaattccaaaaagctgctgccaaacacaaagaccgactgacagctatttccggtcttgaaatttctacagattaccatggtgttgaaatccatgtactcggatacaatatcgacatacataataaagaacttcttgaccgtcttgccgtttgccgcgaaagtcgtgacggacgtaatgaaaagattattcaaaagcttcaggagcagggctttaaaatttctatggatgaaatcaaaccggataaacccggcgaaacaatcgcccgcccacatatcgcaaagcttctcatgaaaaagaaatacgtttcttccgttcaggaggcatttgacaaataccttgccgaaggaagatgctgttatgtagaacgcatcatgcctactccagaagaagctattcatctgatcaaaagcagtggcggcatccctgttctcgcccacctcatgctctataaaaaactggactcttcccagaaagaagctttaattagagaattaaaagaagccggtctcatcggaatcgaaacatattacaacacttacacaccggtagaacaagaatacgttgccggacttgcaaaacagtggggactcattgaaaccggaggaacggacttccacggtcagaataaaccacatatctccctcttcacaggccagggagaaatggaagtcccacaaaaagttttagaaaacttaaaatactaatttgagagactaaagaaacgaaaaccagaaatttaatatagaagaaaatgtgaagatagtcgcttcgcagaaaatgcctgttcggcatttttactcgctccgacatcacattttcttctatattaaatttctggttttctgctttttggctccagatggaaattagtatttaaatcttggatagaaagatggggattgtccagaagactatgagaattaaccagagagaaattctccataaggtaggaatagcaaattagtgatttatgttggaaagataacaatttgagtgtcaatcctttaaaatttaattttccggaagaccatagccttctggcacattccatgttgttaaaccgtagatttagatagtcagaaaaaagaaataataccctatcccagatgcggcttcggagtgtgtttaagatgcgaatacgcattttaaacacagcgactacagagcagatgggatagggtattacttcttttttcgtctacacgaaatctacaaattagtattttttattgttcctcctcccactacgtgcttgtctctatataaaactactgcttgtccttttgtaattgcacgctgtggttctaaaaagtgaattgctactgttccatctggatttttctttgctgttgcttctttttcagcttgatgatatcgaattcttgcttttacgacttcatcttctgctaattcttctatccagttgaagtcatcagcaatgagattggttttaaataaatcttcattgcttcccagaatgactttattctcttctgggcagatttctgttacataatatggttttggtgcagaaattccaagtccttttctctgtccgatcgtataaccataatatcctttatgctggccaacgatctcgccttcctgatttacaaaatcacccggttcacttttctttcctgttgttttttcaatgaatgccatgtaatctccatccggaataaaacaaatatcctggctatcatgtttatgtgcattgaaaaatccctgttcttctgcgatttttcggatttctgttttagtgtaatctcctaatggaaaacaggtatgtgcaagctgttcttctgtaagggaataaaggacataactctgatcctttgtctcatctacaccttttaacaggtgatatccctgctcatcctgaacgactttcgcataatgtcctgttacgatcacatcacaatgtaaagcttttgccctcttataaagatgttcaaactttaaatgacggttacattcaatacatggatttggtgtcattcctttctgataacaggaaataaaattgtcgatgaccttttctttaaagtcgtctttaaaattaaatacataatatggaattcccagtttgacacatacgcttctggcgtcttcaatatcgcttaaagaacagcaggtcttttctctttccattccaatatcttcattatcataaagcttcatcgttacaccgatgcaatcatatcccgcttccttcataagataagctgctactgatgaatcaactccgccactcatagcaattaatgctttttttgccatatggcacctcctctatatttcaattactatttatcaaaaattctttgtttaataaatgcctcatataaacgttattatgataacattctcctatttgaaagtaaagatattctaattgacaaatcctctcattgcacctataatcattacgacatattttgaattattttttcttaattcatgcatttttatagagttttccacattttttgttcaatataagggggttatccaccgaatttttgaagattttgtgggtaaaacttgtgcgtttcagaattacgagaacagcgttagctacggagtaattcatgacatcaagttagggacaaaatcctttgactctaacatcagtatatttatattagaaagaaggtttttctttgaataaaaaagtgcagatttcagaatcaattgaacttggtatcctgcttgccttatcgggtggtttcatggatgcctattcttatataggaagaggaggggtttttgctaatgcacaaacaggaaatatgcttcttcttggtgtacatctttcggaaggagatattcctgctgcgattcgatacctttgtccggttcttgctttcactttcggaattgcgctctctgatatcgttcgaaacttaggaaaaggagggcatctacactggagacagatttctgttgttacagaagctatcattcttgtcatcgtaagcttttttccacaaagccataatcttctggcaaacagtttaacctctcttgcctgtggtatacaggtggaaactttccgaaaaattcatggcaatggtattgctacaaccatgtgtatcggaaatcttcgaagcggtacacaaaatatttacactttcttccagacaaaaaaacgggattctcttgaaaagggactcctctactacggaattattctctgctttatctgcggagcaatcattggaaatcaatgtattaaatatttacatgaacgggcaatccttgtatcttccgctctactcttactttccttcatcatgatgtttataacaagggatgaagcgtaaaaaacgaaaaccagaaattttcttttatagtaaatttctggttttctaatttctgattttctgttttatattctataaatcaatcttttttctttgtaatctacgatttgcatcgtctttcactagaacatataatactgctgtgactggtatcgcaaatatcattccaattactccaaaaagattgcctccgattaaagcggcgcttaaagtccagagtggagcaagcccaacggaaccgccgactactcttgggtaaatgaactggttttctataaactgcacaacctgataaacaacgatacttaaaagacctttccatgggtctaccataacgatgagcaatgccccgataaaacaggctacaaatgctccgatatatggtatgaaggaaaggagtgccgtaagtaccgcgatcaaattggcgtacggaagacgaaaaacggtaaatgcaacaaacattagcagaccaagaataactgcttcgatacactgtccagagaaaaatttagagtatgtttcattcacaagattggatatgtaacatattttatcggcatgctttttggataaatgtgcataaagcatttttttgcattgtcttgagagagaattcttactcaataatacatagattgctataataaatcccattaacgcattgactgctacaccaaaaaaagaggtggtagcatccactacttttcctagtgcatttcctacgtttcctacatttcctgtaatctgtgccataagtttattaaaatcccaagaggcaatttcttttgaaatccatgcagtatccattccgttactccgaagccatgacagccattttggtgtattttccataaaaacaatataaatactttttacggaagttacaagtcctggtacaaacatcgtgtatacaattccaatcaaaagaacgatgcaggccattgtcgcaaataagcttactcctgttaccggcattttttctaacttcggatatttcttttttatttttgtaaaaagctgctcaaacattttcataggaacatttagaacaaatgcaagaatcagacctactataataggaaggatcaatgcaatccctctctgtatggtcttgatcactgttggaaaatgcatcagcaaggcaaataatacaacgccaaatgtaattaacaaaaggcttctttttgtttctttttccattaaaagtacaatctctccatttcttttatgctttctcgaaatctttttgttcttaatcttacttgattttaaagaaaattcaagaatatcctgtcattcttacatctgatgcgccagatattcttctatataatgcgatgccgttgctccatctgctacggcagttactacctgacgaagtgcttttgtccggacatcaccaatggcaaatacccctggtatattcgtgcgtgttgactcgtctgcaataatatatccggcttcatccatagcaagaattccttcaaacaattcagaggacggttttcttccaatactgataaatgcaccatcgacagaaatttctgtatcttctcctgtctttacattatgcagctttgcaccggtaagcttcttatcgtataaaaattcgctgactgttgtgttccagtaaaattcgatattcggtgtttcctctaactgcttatgataaacctttgttgcacgaagagaatctcttcgatgaacaagaatcactttttcgcagattcttgataaggtcatggcatccgctgctgctgtatttccaccaccaataaccataaccgttttgtttcggtaaaacattccatcacaggtagcacagtagccaacgccacgtccaaccaattctttctctcccggcactccaagttctcttggaacggcacctgtcgcgataataatcgttttcgccttaaatgttccttcactgctctctatcttctttatctcaccggaaaaatccacactcagtacttctgcaagctctgtctcagcgccaaaacgctctgccccttgctgcatcttttccgccagactgaatccatcaatcccttcctcaaagcccggataattatcaatctgggaagtaagtgccatctgccctccggcagacagcttttcaagaaccatcgtagaaagtcctgctcttgcacaataaagcgccgctgtatatccgccaggacctccaccgataattactacatcatatattttatccatcgtatttcctttcctttttatattgtatttctgtgtttctacatttctacatcttacaaatattcctgaataaatgtttcaatttttgccttagaatccggtgcaacgatcgttcctgctacttctccgtttttaaaaagaagaagcgttggaatcgtatcgattccatatttttctgcaatttccggagcttcatcaacattgacctttgcaaaaaccagcttgtcctcctgctgttttgcaatcttatcaaaagctggtgcaattcttcgacaatacgtacaccatggtgcccagaaatctacaagaaccggttgatcagcctttaaaatctgctcttcaaaaatctcttttgtaatatttattattgccataaaaaattcctcctaaaaattaactcttattttcatcggtagtttccatcgatagtttccatgtatactttatattttaccgtatactttacatcttaccgcaaaaggcatacatgtatatttcttataataccacacttcacgaaagtttactcttattttctgatttaattcattcatgttcatccaggaaaaattaactggaacgcgaggctgtatatttaatagatattttctattgattcacagtgtgttctcgattgataatcctcctcaatactcagtataatagagtcatcaaatactgtgaaaacagtaggtagaactaatctttttgacttatttttatactaacaataacaatcattttttaggagggtttcataatgaaaaacaaatatgcacatatttttgagccattaaccgttcgtgcaatgacagttaaaaacagaatctgcatgatgccaatgggaacaaactatggcgaacagaatggtgagatgagttttcttcatatcgattactacagacagcgtgcaaagggtggcacaggtcttttaatcgttgaaaatgcaaacgttgatttcccacagggttctaacggtactacacagcttcgtatcgatcacgataactatcttccacgtctttacaagttctgcgaagatatgcatcgttatggtgcaaagctttctatccagatcaaccatgcaggagcttctgctatgtcttcccgtatcggtggacttcagccagtatcttcctctaacattccttccaaaacaggtggagctgtccctcgcccattatcaaaagatgaaattcttgctatcgtaaaaaaatacggagaagctgcaaagcgtgcacagactgccggatttgatgctgttgagattcatgctggacattcttacttaatcagccagttcctctcccctgtatacaatgacagaacagatgaatttggtggaagcatcgaaaacagaactcgcttctgccgtatgatcatcgatgaagtaagaagccagatcggacctcatatgccaatcatgttaagactttctgctgacgaacttgtagatggcggaaatactttagaagatactttaaaatatcttgaatatttaaatgacgaagtagatatctttgatgtatcctgtggtcttaacgactccatccagtaccagattgatgcgaactacatgaaagatggctggagatcttatatggcgaaagctgtaaaagaaaaattcggaaaaccagttatttccatgggtaactaccgcgatcctcaggttgtagaagacactcttgcaagaggtgactgtgacttaatcggtatgggacgtggtcttatcgctgagcctaactgggttcataaagtagcaaacgaccaggaatgtatgcttagaaaatgtatctcctgtaacatcggatgtgccggaaaccgtatcggtggaaacagacctatccgttgtacagttaacccatctgttcttgaaggagacacacatcttggacgtaaagtaaacaagaactgtaacgtagttgtcatcggtggtggtactgctggtcttgaggcagcatgttccgcagcagaagttggatgtactacattccttcttgagaaaaaagatgttctcggtggacttgctacagaaatctccaagattcctgcaaaacaccgtttaaatgatttccctgtataccttcagagacgcgctgccgctcttgataacctttacattttcaagaacgtagaagctactcttgaagtaatcgagaaattcaacccacacatcatcatctgtgctactggttctgctcctcttctcccacctatcgcaggacttcatgagaacattgataaagaaggtggaaaagttgaatctatcttaagcatgatcaaacatgtacctgattacccagaagatatgacaggccagaaggttgttgtaatcggtggtggtgctgtaggtcttgacgtagtagaattcttcgctccaagaggtgcggaagtatctatcgttgaaatgatgccggcaatcggacgtgatcttgatcctgtaacaaagaacgatacaaaatgcatgatggaaaaatacaatgtaaaccagcttacaagcacagctcttcaggaagtaaaagaagactgcttcgttgttaagagtccggaaggtgaagtttacgagcttccattcgatcatggatttgtatgtcttggtatgagagcacagagcaaagtttacgaagaagtatccaaagcttataaagacactaacgttcgtgttgaaaatatcggtgatagtgtacgagcaagacgtatcattgacggtacattcgaaggacgtaatatcatctttaccttagaacaaaaaggatttttataaaatactaatttgtagatttcgtatagacgaaaaaagaaaaaataccatatcccatctgctctgtagtcgctgtgtttaaaatgctcattcgcatcttaaacacgctccgaagccgcatctgggatatggtattttttcttttttctgactattcaaatctacagttggtgagaatggggattgcccagaaggctattatttttaatcagagaactgtttatccataaggaaataacagtgacagccaatgccttctacttaatccgttttctttcactataatgtccttacaattccttttgatttagaagatcaactacaaatccagtgggaaaatattctcctctggagatttttattctagtgaaaaccatagacttctggacgatcccctctttttccctcagactaaaatactaattccttattaagaacagccagccgctaaaacaaaattttatgctgaattgtaaggaaactatggtaaagaaaaaagaattgttataagtattgcattttgtgactttgcgctgtggaattttgcctcaaaaaacgaaaacttcggattcgtttttccgaagttttcgttttttgaggcaaaatgaagcgtttagcgtaacggaacaaaatctaatttataacaattcttttttctttagaagactactacaattcagctcaatatcttctactaaagcggcatctgtgtccccagaaaattagtatttaattttttcagacagacaaaacataaaaattgttgtataatgaatacggcttatgacaggcgatgaatgtattgaaacatttaccccagcaataataagcattctacatattctttttgcatccgtatgtgcactacataatatttaaatttaaccaggagatgattttatgcacatcagtttacttcttatgaaccagattatacagctttttattatgatctttatgggttttatcattgtaaaagcgaagcttctaaaagcagaggatagtaaaatattatctgtcattgtactttatcttattattccctgtgtaatcattaatgcttttcaggtagattacacaccgcagacagtaaaaggacttcttattgcccttgctggttctgttatgacacaggtaattcttttgattgttgtttctattttgggaagagtatttcatttgaatgaagtggaagttgcttcaatctattattctaattccggcaacttaattgtaccaatcgtgacgtttattttaggaaaagaatgggttctttatggctgtgtttttatgagtgtacagcttgtatttatatggacacattgcaagaaaattatcagccgggaatccacttatgactggagaaaaattgtattaaatattaatatgatctctattgcaattggcattatacttttcttaaccagaattcatttaccagcaattatcaataatacgttaagtgcggttggctccatgatcggacccgcaagcatgattgtaactggtatgctttttgccggcatggatttcaagcagatttttgcaaataaacgagtatatttcgtttcattttttcgcttaattattgtccctgtaattgcactttttcttatcaaatgcagtcagctttccacattttcttcaaatggaaataagcttatgatgattgtctttcttgcaatcattacaccatctgcttctaccgtcacacagatgtgccaggtctatggaaatgactcacagtacgccagtgcgattaatgttgtgactacccttcttgctattgttacaatgcctcttatggtaatgttatttcagattgctatataattttttactttatcgcaatctaacaatggatacactcatattgacattaatatctctcacaactcagaagctaattcgctttccagttttcaaaaatatccgaggactcttttaaaaagtcgtaggatatttttatttcgctatctatttctattttatcttcttccagaataggccacggattacatactcctatggtgacatcctcccccacctgtagaggttggggcttcccatcctcggcaagtttggttctcgttcgatagtactaccgtgctaagcataagcgagctatccccgtgtgtcccacggtttatattaggttattatgttgtggtcatacatttactatccgcattccttcatttctgatatttatagccgcatttacatctctgtcgtgatgggttccacactgtggacaatcccactctcttaacgcaagatttttcgttttaacattcttataaccacaaacagaacaggtctggctgcttgcaaaaaatctccccaccttcacaagctttttcccctgttcctccagtttgtatttcaaaaatgttgtgaacattccccagccgttatccgaaacagatttcccaaaatttagcgaccgcgacattgctttcatatccaaatcttctatacatacgcaatcatatgcattggttatctgccttgactgcttatgcagaaagtcttttcgttgattggaaaccttttcgtgaagttttgccaccttaagcctctgcttattgcgattgttcgaacctttctgcattctggaaagcttacgttgttctctcgctaattttttctctgcgttcctgtaataccttggataggcaggctccttaccgttgctgtcacgatataattcatgcatggaaaaatctaaacctaaaaacttttgcagctccttttcctgtacttggtcttcatactcaaaaagaatacttgcatagtattttccacttggggtctgacttactgttacagatttcagtctgtattcacttggaacagacctgtgctgttttaagcggacttggccaatcttaggtaatttcaaatatccattagacagagttatgttcccattgatgcagaccgtggaatagctgtttttattccgcttttttgatttgaatcttgggaaacctgttttcggctgtttgaaaaagttctgaaatgccgtatcaaggtgtctgagcgattgctgtaatgcaatactatctacttcctttaaaaatctgtattcttccgttttcttcattgcagccatttcttttgcacaaatggtatatattacattggtcttgttctcctcatactgccggatctttctatcaagccaatgattatacaccattctgacacatccaaaagtcttagcaaacaaaatcttctgttcatcattgggatacattctgaatttatatgctctgtttgccattccaacacttccttttcctagaaaaaccgactgcgatacttgaccacaagcacacgatgctagtatagtaagaatactaaatgtacgttattatctcaatttattgtatctcaattttttattattcgactaaagatactatactataattaggatgctctatcaagtaggtaacagacgcaattcatctcccaccttagaggtcagagtcttcttgctgtaaaaggataaaatacgaatttgtagatttggtgtagacgaaaaaagaaataataccatatcccatctgctctgtagtcgctgtgtttaaaatgctcattcgcatcttaaacacgctccaaagccgcatctgggatatggtattatttcttttttctgactattctaaatctacagttgtgagaatgggggattgcccagaaggctatggttttcattagaatgaatatctctagaaaaagatactttcttactcgattgtataaaaattatatttacctactccgacctcatggagaattttttctctggttaactctcataatcttctggagaatccccttctctttccaacaaaaatcactaatttgctatttattatcaaaaccagacagccgctgaaacaaaatttcctgctgaattgtaaggaaactatggtaaagaaaaaagaatggttataagtattgcattttgtgactttgcgctatggaattctgaccataggaacttgagattcgtttttcccaagttcctgtttttctgggcagaatggaatgcttagcgcaacggaacaaaatcaaacttataaccattcttttttctttagaagactccatacaattcagctcaatatcttctattaaagcggcgtctgtttccccagcaaattagtattttcccatatacaggtctacgagtttatctcctgcctgtttacgaatcgcatcgtatactggctggcatttttcctgcatttgtttccaggttttctggtctacatctacaatctgcataccttcgtcttcaagaaccttctgacgctgtatgcgacggtcatcggcagattcacgagctttttcctgtgctgtttttgcagcctgatcaataatcttctgctgttcttttgtcagtccctgatagaattcgtcactgacaattaatgttgtataatctggtactgcattcgtgctgattaagtatttctgctgttcgtaaagcttcgcacttacgataatttcgtaagcattttcctgtgcatcgatcgttccctgctggagtccgatgtatacttcggagaaactcattggtgtagggtttgctcccatctgtttccagaactgaagatgatatgcgttctccattgtacggattttctgacctttgaagctttcgattcctgtaaatggtttggcgctggtcattacacgaaaacactggtctgcgattccaagtagatcatagcctgcacctttataaattttctgaatttctttctggaaatctggattatcgattgcttttcgggcatcatcaatattttcaaataaacatggtgtatcaaatacacaaagctgcggcatgaagcttacctgtggtgccggagactgtacaacgaatgggatatctccgtctttacagctctccataagttctcggtcaccacctaatgtactctgtggatatacattaatcttcatcttgccatcacttaatttctctacttcttttgcaaactgtgttgcgaagatgtgtgtgattgtatcttctgtactacaggttgcaagtggccatgcgtatctctgttcttcttctgcacctgactttgttatcttaccacttgccttagaatatccaaagaatatggttcctgcagtaatagcgacaagaacaactgcaaggataacgcttgtaaattttcctttcattttgattctcctttcctaatctaaagcagacacagactgatctgtggaataaatgtaataagtaacaatgcgattaagaagaaaccaatgagtggcattgctctttttgcgatatctacaaccggaatatcggtaagagagcttgctacgaaaaggtttacaccgattggtggtgtaacaaaaccaatcgctaagtttacaaccatcatgacaccaaaatgaatgggatccattccaaagccctctacgattggaagaaggattggtgtaaggatgaggatggcaggagtagtatccataaccatacctacaagtaataatacaaggttgattacgatcaatacaacaaccttacttgtaaaatgagcaagaatccatccactgataagctgtggaacctgcatcagtgtaagtactctggagaatgctatggatgctgctaaaataaataagatcggtgcatatgttcttactgcttctacaaatacatcgtaaactttcttaatcggaagtgatttataaatgaaaatactgacgatcagtgagtagaatacagagataacggctgcttctgtaggagaggcaacacctgagtaaatacatccaaggatgatgactggagacagcactgcaaagaaactgctcttaaatactttccataatccctgtgcatgaagatcatcgatctttgcattaatcttttctttatcttctccatgtttcttacaataaaatacggcatataccattaaaagaagtccgataagaactcccggaacaattcctgcaaggaaaatgtcacttacagatgcccctgatgccataccatacataataaatggaatacttggtggaataataacaccaagacttcctgcaactgcaactaaggcagtacagaactttttatcgtagccaagctctactaacagagggattgtcatactgccaactgcagcaactgtagcaattcccgaaccagagattgctccataaaacagacaggttattactgctgcacatggcagacctgctgtacgttttccaatgaaatatgaaaagagatcaaataacctcttagaaattccacctcttgccataataataccggataaaataaacatcggtactgcaaggagtgggaaactgtcgattccaccaaacatagaacggataacgtaggaagcacttgctgtaaaagacggatcaaatactcccggtaatactgcaaccaaaccaagggatacagagattggaatcgctattaataaaaatacaaagaataatataaatactactaatggtgacattctttatttctcctccgcttctctttttcctgtaatgatctcaactcgctgtataaacttctgaatcagacggatacagcataaaacaaaactgattactgtgaatgactgaatcaggtacattggaattccacaagctggacttaactgtccacttgccattcctgcttttacatatttccatgcaaaaggaaccagataagcaaaaaagagtaactgtataagataacttaccagtcgcatataatgaactcctttgcccggaagcatacctactaactggtcaatcttaacggataaaccgttcttaatacaataactggcactgataaaaccagaaataataaacatatatctcgtgatctcctcagaccaggacagggaagctgaaaaagcatatctggcaataatctgccctcccataacgattgtcattccacacaataacatcaggagtatggcctgttccaaattattatccagccactttaataccttcataaaaatatctcctcttctaatacttgtgtactaacacaccaaaaaacaaaaatatcctttgtttcaatctatttcggtctacatctgtttttcagaaaataaaattaaaacagcagtgtattactacaacagacttaccatagatatcttctaaaatacttacaattcaagtcgagccgccgcgagacttggcgcgtgattctggtcagcgtaagctgacatattctttacagaatcactgcgcatcctcgcggagcgtttatctcagtcgaagattggactccccttttgtgcatcggttagtatttatagatatattctatgaatttgcaggttttaataggtttttgtttattttttaactaatgatattaaaaaaataaacagctaaaaacatggtgagcctgtatatagtataaactatatacaggctaattatcatttgcttttagttgtaatcatctaaattcccataactatttaaaacaacttcacaaggatttaaaataattactttaaaatcgctatttatcttaaactttattccgcttttgctaatggagtagttccaaataccttcttgtatcttaagatgaggtacagtgttgctactacctgaactactgctaagataaacataagagtcattaatgtgtataccgctttactttcaccggaaatgactgttaattttgctacaattacaggcataagataagaagcagcgcccataaatgtatagtagatacctgtattacgtccttttggtccaggtacgaattcctgtaatacagaaagacctgtctgtaaagcaccaccggcacaaccaaatccaagaattaagattgcgatataaacgatcgctacctgatgtactaaaagtactgctaaaagggagcctgctgtgataaccgcgtcaacaatcaatacttttaacggatgccattttaatttactcatcattacagcccagaatgctacggcaacgatagaaccaacctgatacattgttgtcatagatgctgcctgcatttcgctaagtccacagtatgcaagaccgaacgcttttgtatactgctgagcaccatacataactgccattactaagaatgcatagaaatatgtgaggaatgctgtaaactttccaggtgcaacaagctgtcttgcttttgctgcatcgatttcagcctggtcagctctcttgtcgcttcctgcgccagcgtttgctgctttttcatcatcataaacgaatcttgcgatacatgcaaataccaatacaacacaagataatactaaaggaattacaatgttaatcttccagttacctgctgctgctgtctgtacgcagatcagtgggtagaagatacttgataacgctacgaagaacttaatcataattaatgcggaacctggtgctgcaggatatgcttcctgtactgctggatatccggatgcatcccagaaaccagatgtagcaataccacctaataagcccatgattgcagctacagttgcattgttcgttacaaacattgttgcgaagcagatgatataaagaattgctccaccaatcattaacttcttacggccgacacggtcagaaatctctccaccaatccatacagaaatgaatttaccaaatccagtccatgcgattgctgtagaaacggctgcaacacctgctgcgtacgctgcagattccggattagacatatcaaatccccattttgttgcaaagtttacctgattctgtgaaaaaataagtgcctgcataccatgtgtcaaataagccatgtacacacagatcattgaccagatatattttttcgctttcatacattttctcctctaaatttaaatgtaattttaaaatgctgctatattaactcatcgtcagtcattcactgtatccaaacagtgaatgacgactgatgatttaattttaaattattttgcctgttctgcctggaatttctgatattcctcgattgggaaatcttttcctgtaaacagactgtagttaacaacaccctgatataaaagcattccttttccgccgattgcctgacatccagcttcttccgcttcaagaatcatctttgttttttcaggattgtaaactgtatcagcaacaactaagtctttgcggaataaagatttatcgattaatgttacgtcttcatgaggtttcattcccatgattgtagcattgattacgatatctgcattgtttaccgctgctgcaagagcttctttgtcttcaagatgctccactgttactttacattcaggacagcgtgctgcaagcttttctttagtagactctgctctgctatagaattcatcatcaatgttgaagattgctacttcagaagctccgtctaatgcaagctgtacctgaattgctgtagccgctccgccagctccaagaacaactgttttcttacccttaacgtcaacaccgtttacttcaaggttctttacgaaaccaacaccgtctgtgatatgtcctgtgattactccggcatcgttaacaaatacgttacatgctccaatgatctctgctgcaggagataatttatcaactaactctgctgcaatgtttttacatggcattgtaaagttaccaccacgcatgttgaataaacggatgctgtcaaatacagcaggcatctgttctacatttacatcaaatgccatatatgcatagtcaagtccatcatgctggaaactgaagttatacattgcaggtgatcctgaatgtcctacaggtgttccaaacagtgctaaaagtcctgtgtgtccgttaatacgtctttccatttgttattccctccattattgcctgttatatcttaggattagatatttaatgcaacatcataagcttcttttgttgcgtctaaagcacgacgagctctgattgcatcaccaactacatgtacttctgggcagatagcttttaattcgtcaacgaaatcataaacaacttcctgaccttcacgatgtgtatatttagaaacatatcccattgaaagaacaacagtgtcaaatcctcttaattcatatactgtctcatcggatttatcggctgcattcttgtagcttacgccatcaggataaatctcagatactgctgcatttacatactgatgaacatcatactctttaagaccttccataaggaatactctatgttcgtggattacatctggtccgatagcatctctcatctcgatgatagaaacatcatgtcctttttctgcaaggaactctgctgtttcagcacctaccataccgccacctacaacaagtactttatgtcctaccggacgtttaccggataagcagtctcctccatgaactatttcaggagctgtgatacctttgatgaatggaagtacaagtgtttcagaaccagttgctacgatcactgcatctggagcatctttcttaataagatctgctgttacttctgtattaagaacaatctttacaccagatttttcacattttgtaatgtaacttctgatcatgtttgtgatatcaccttttccaggtgggtaagcagcaagtctcatatttccaccgagtacgtcgcttgcttcaaataatgtaacgtcatgtcctcttcttgctgcagtaaatgctgcacacataccagcagggccgccaccaattacataaattttcttcttcgtttctgcttctttcattccttcgctctcacgaccaagaactgggtttgttaaacagcagattggctttccagcatacatatttgcaacacaaccctgtaaacaagcgatacatggtgtcatgtcttctaatctgtcttccaatgcttttttaggcatagcaggatctgcaagagactggcgtccaaatgcaactaaatctgctgtaccagtacgaaccattacctcagcaaactgtggctctgtgtaacgaccaactgtgataacaggaatagatacacatttcttaatgtttgctacatattcagcggagaatccaccatgaatacctgtaggagcccacatatattcatcttttaaatgaacagcacgagatacatgaagtgcatctaatccgcaagactctaaataagttgcgattgcacacatatcatggttgtcaagtccaccgaacatatcctctgtactgttgatacgggcgagtacagcgattttgccctgtgttgcttttttaacttcatcaatgatgagggttgagaaacgcattctgttctcgaaagaaccaccaaactcatcgacacgtttatttgttcttggagacatgaaagaatttacaaggtaaccatgtgccatatgaatttctacagcatctgcaccagcttccattgctcttcttgcagcttctccatatcctcttgccaattcataaacctgttctgttgtaacttcttccggaatatctcttccatctgctgatgatactgctgtagctgcctggattggtgcgccagcgttctttgcgttaccttctggtccggcgttctgtaactgaatggaaactttagctccttctgcatgacaggcatcaattactttcttgaagctaggaattgatgcatcatcatataaacaaggttttctaggaccaccctttgctcctttatgaacaaccgtagcctcaagtgtaattaaaccaaatccaccctttgcacgtgcgccgtagtaagcaacagactgatcactcattgttccgtctgtgtttgcaaagttgttacccattggaggtactacaaaacggttctttacttccataggtccaatctgaattggtgaaaacatattttcaaacttcataatttaccccttcctaattattcacatgaccgcgccgcagcctctaacctgcgggctgcggtctattatttcattttagcttttgacaagttaattatataattcaagtaaataattaaagattaaagtacttctggccaaacctgctcaagaactttctttgtattatcaaatgtatgttttgcagcttctgcaacacctttagcaaggatagcatcactgattacttcaacaccgattgcttttggctcaatacctttttcacgtaccatcctaacgaagtctgctgtacatccgattcctgttccaggagcgagacgatcatgcatagactcatctcttaagatgctcttagcgtatggacgatcccaaacgtcgttgatctgaatagaaacgatcttatctgctgggatatctttaattacatcaagatcgattggctggtttgctcttacccaatgccatgtatccatgattaacttcgcattgtcacatccagaaccttttacaacagcccatcctttttccatgttagggattccgctgtatggcattggctcaacaccgatcactaattttcctgctctctgacataactcttttaatttctgagctgtatgttctacagagtaatcttccattaatccacagttgatgtgacctacattgaagagttcacacatatggaagcacatctgctctttgtatttctgctcataagaacgagcatcctcagcccactgtacgatgtattctacttcagtaaccttcatatcatatttttcaagaattgcaaggatgtcttcatcgtgaagtccttcgtttaatgcatctacataagtctcagcacgaagaccgattccatcgtatcctgcttcctttgctgcttttacacgctcctcaaatttgcactggtctccaagtgtccatgaactaacggtaataggaaattcttttgacatgatatgtcctccttctcatttgaaaaaatataattttgctttaaaattttacttgttatttttttaactttttaagttacttagattataactcgttttattcaataaaaccaatcgagaatattcgtaaattcatagattttttttatcatttatgttaaggtaaaacataggaatttttaaggtagatttctaaaaaattcatggcaacaataagctatgattgggttgtataatactaagatttttaaacaatactttttattaaagggggtttttcaatgaacttatttcacttacgttattttgaaacacttgccagaacagaacattacagcaaggccgctgaaattctttctatcacacagccaagcttaagctacgctatttctacattggagagcgaactgggcatacagctctttgaaaaacgtggacgtaacattgtactgacaaaatacggtaaggcattttattctaatgtaaaggaaattctcgcaagcttagataacgcagtaagagacatcaaattagtggcaaacggtgaaggagaaatcaatatcggctttctccgtacactcggaacagactatgttccaactaccgtaaaaaactttcttgatcttcacccagataaaaatatctggtttaatttcagttgtgaacatggtctctctgtcgatctggtccgcagtcttatagacagagaatacgatatggttttttgttctaaattaaataatagtccgatggtcgaatttatccctatcgcaactcaggaactcgttgtcatcgttccaaaagatcatccacttgccgtcaaagacagtgtaagcttaaaggaaactcttgattatccacagattatcttccgccacaaaagtggattacgccacattattgatgacttattcaaaagtatcaatgcctatccggatattctctgcgagattgaagaggatcttgtcggtgccggctttgtctctaaaggatttggcatcatgattgctcctaagtttgatggccttaactatgtcgatgtaaaagtactcaaattgacacagccttcttataagcgctatttttatatggcaatcctgaaagacgtataccatccaccattgatcgaagaatttaaaaaatatgtcatcgaacaaagtactctaaataaagaatatcgctttggatgatatcttctgatttgcaggggttgagatagacgccgctaaagaaaattacttaactgaattgcattgaagtttctaaagaaaagcgaatttttataaatttgattttgttccgttgcgctaaacgctccattttgcctcaaaaaacaaaaacttcggaaaaacgagtccgaagtttttagagtcaaaattccacagcacaaagtcacaaaatacattatttataaaaattctcttttctctaccctagttttcttacaattcagccggaagttctattatagcggctgtctaatctcattccacaaatcaataaaaaaacaaggggattgcccagaagtctataattttcatttgaataagaatctccaaaaggaaaaaatttcttaccgaattgtatttcaccttctaagaaaagagaatttttataaatttgattttgttccgttgcgctaaacgctccattttgcctcaaaaaacgaaaatttcggaaaaacgagtccggagttttcagagtcaaaattccacagcgcaaagtcacaaaatgcattatttataaaaattctcttttctttaccctagttttcttacaattcggccggaaggtctattatagcggctgtctaatctcattccacaaatcaaaaaaaaaacaaggggattgcccagaagtctacaatttctatgtcaaatggaaatctccagaagggaactcatagccttctcgacaatccccttattcccatccaagctttaaatattaatttccatctggagccaaaggacagaaaaccagaaatttaatagaaaagaaaatgtgatgtcggagcgagtaaaaatgccgagcaggcattttctgcgaagcgactatcttcacattttcttttctattaaattttgggttttcgtttctttagttcctcaaattcgtgtttaagatgcggatgagcattttaaacacagcgactacagagcagatgggatatggtattgtttcttttttcgtctacaccaaatctacaaatcaaaagttatatgttcattaagtttttattttctggattcactgtaatttctactgaaattatttgtggataaacgtagttataaatttttctttctttgatattttttaaaatctcatctttatagctaagaaaatattctacatcagacatacgccctactgcactgataaaaaattcctgatttgtcaggttctttttatccgatagtgccatatcttcattttcctgtgtatcattatctacattgtctacatcactttcatcatattcgtcatcatccatatatatatcgtctgatgtatactcatcatcacaatacagatttttatcgatatgtatagactttacattatctgaatcatagcgtactttgatctgaatcttatctttaggaatagactttgatgtttttacctctatatcaccattttcattattgtatgttgtaaatgacgtatttatcttcttcgttttgtctgtatataaattctccatgaatgttttttccgctattttattacttccaattcttttttctcccatatattgaaaggaagaatattcctgaaacattactcctgctccgattccgcagcaaagaaatcccgccataaaaattcctaccaaaacttttctataactcatgcatttacacctttccctttcaatatgtagctaaataaaaaaagaatatatgctgtcatactaagaacagctcccagcgcaacgataacacatccgataaccggatagccctgaaatgccataacacttaaggttcccagactaactaatcctgccacatcaaaaaaggctgccgggactaccagacaaattaatactacttttacaaaaatcaagaaaatcttctttgccttatcccagctccatgaaatagcactgccactcgttttccttgctttatctgctatattttctattgtttctcctcgatttttcttaaatcgttccatagtctctactcttttattctttttaagatcacgttctttgcttttcttctttcttttctcaaaaaaatctttgggcagtaaatctgcaactcccgtcttcccattccttcctttgttctttacttcatattccggatccaaatgataggcatcaagaatctctgcaatcaaatcatcaatattcccgaaatcatcgattgcctcttcctccttcattccactttccatgcgcatactgatatgttgtgaatactcttctatcatatctttccgctctttttcattaagcatctgaagccggtcttccagctcttttaaaaactccttctttaacatccactatctctcctttaaaaatcgattcacattctgggaaaattcttcccactccttttctaattctcttaaatgaagaatccccgcagcagttaaatgataatacttcctcggtggcccttctgttgattctcttaaatatgtctcaaaataatgctcattggtcagtcgttttaaaataggataaatggttccttcctttacattcactactttagaaacttctgcaactagctcatatccgtacatatccttttgttctaccgctgcaagaacaatcagttccagaacccctttcttaaactgtgcattcatttatttttgcctccttgttgatactatattatcttaggtactatgtaatgtcaaatagctgatttacaaagatttacggacaatactaatttgtagatttcgtgtagacgaaaaaagaaatactaaattcacagttggtaggaatgggggcttaaatgcaaatttctggttttctgttccttggctccagaaggaaattagtatttggatttgaggaagaggagattgtccagaaggctatgatttatatataagtatctattcgcgaaaaatacaaatccttttatgaaaataaaaggaaggagctttgtaattagtattgctattacgtttacgttatagcttattctaagttacaaagaaaggtaagaaatttggtgaaaagaatagaagaagtttgtcggttatcaggagtcagtaggagaacgttacaatattatgataatgaaggaatattgtcagtgaaacgttcggaagaaaattatagattatatgatgaaacagctatggcgcgtttatgggaaattttgtggtataaagagatgggatttaaattaaaggaaataaaaaatattcttacagttacgcaaaaagaaaaaaacaattatctgaacgaaaaaattcaaatcatagaaggaaaaattcaagatttagaaaaacagataaaatttattcgatatatagaacagcatggcataattccgattcctataaatgaaaaagaaaaaaatataacttataaagaatacataaagaaaataacagggtaattacaaacaaagaaaaatagaaattttgaatgtaaaaacatatctgcatatataaaaataggagatatagaaaatcatataaagatataataacattataattaaataatatttattttacgaaagaggagaaggtatgaaagatatttttaaaggtgtaataattaaagtagtttcaattattgttgttgcaggtttaattggtcttggaggaatatttctatataattattttacaaataatattttgggattaaatcaacacgcaaactcaagtaatattcagatcgttaaagaaaaattaaaagaaacagcagaacttaatacaggaagttacttatgtactacagtagtcacgaaagaaaattcgagaacaattaaaggatggaagatacctcttactcgaaagagttttgtaatatcctatgatggaactgtaaaggcaggcattaaagatcttaccaaggcagaagtaataccgagcgagggaaatgttgttataaaattgcctgaaatagaaattactgacataacaattgataatgattcttttaagataatggacgaatcaaacaacattttcaattcaattagcataggcgatttaaacgatgcacagaaagaattaaaaaagaaaatgaaggaaagagcagttgaaaaaggagttttggatattgcaaaaaataatgccgaaactttgctatctgaaatgttaaaaagcccaaccggagattatgatgtaaaagtagaatggaaataaacgtttcccgctttccaaccaaaatcactactttgctatttgctgcctagagatattcattctaataaaaaccatggacttctgggcaatccccttattcccatccaagatttaaatactaatttccatctggagccaaagaacagaaaaccaaaaatttgagatagccagaaaaaagaaaaaataccatatcccagatgcggctttggagcgtgtttaagatgcggatgagcattttaaacacagcgactacagagcagatgggatatggtattttttcttttttcgtctatacgaaatctacaattaatatttataatgattcatgtaatgttgtgagcatttcttttaactcgccggcacccatctgtcccggtgcggaagcttttcctacggcaccgaatgtaagtgcagatccaaatacttcaccgcacacacgactgattacacctgttgcggccatggacattgtgatgattggacggtcagcataattgtctaccatttcttctgttgctgcaagaagggtgagtacgtcctttttgttctgaggcattacagcaattttagggatatctgctccaagctcctgcattttgcggagtctatagataatatcagattttgctggtgtcttgtcgaagtcatggttggatgctactacttttactccatgtttgtgtgcttcttctacaacagcttttacagcatcatcgccggtaaatgcttccatatctacaaggtcaacatatcctgttgcactgatcttctggtttaattctacataaaccggtgtgtcgattgccttttctccaccttctttagaagtacggaatgtgaaaaggattggcatttcgccaaggacttctcttaactgttttgctgtttcttctactttttcaaaatcaaaaatatcttcgtaccagtctacacgccactctacaacatctgctccgattggaaggatcttctttgcagcgtctaagatttcttctctcgtttttccaacgataggtacacaaattttagggattccttctccaattgctacatttcttactactacagggttcataacaaaatcctttctcaaattatttctcagaaataatgtctaataatttctggcgcattgcttcgattggaggttcctgacctgtccaatattcaatctgggcagctccctggtagagagacattccaagaccgtttaagatagttgctccagcttcttcagcatctaataagaactgagtttttgccgggttgtagcaagcatcaaaatagaactggtccttgctgataaattcttttggaagtgggttttctccgatatgacttcccattccgattccgctggcatttaatactactgtagcttcttttactttagaaaaatcacctgccgggcagaattctgctactggtgcaaagttcttattgatatcttctactaaagccttactggattcttcaaatacatctgtgatgtagattttctttgcgccgtagtaagcaagtgctgaacacatagcacgacctgctccaccactaccgatacagaagtaagtgttctcatcaatcttaacatttccatctctttccatggatctgatgaaaccgattccgtctgtattatatccaactaatttaccttccggagtttttacaactgtgttgctggctcccattttctcgcataatggatctaactcatcaaggtactcaagaacctttactttatttggctttgttactgcaaaacctgcaaagttcatgtaacggataccgttaactacgtctgcaagatgttcgttatttacttctgtgtagaaataaatcatatttaagcctgctgcttcataaccgcaattctgcatctgtgctgcaaatgactgctttaatgggtcaccaagtaaagtaatcatctttgtattaatgtcaacttttgccatgatatataccttctttctctttctttaaatatttattatgtgattatttatcattcttatttatcattctcatccattgctaataacttctgaacaagttcttcgcatacttcgataatgctcttgccatctgtattaataacaatatcggctgctgcctcgtattttacacgtctcttttccatcaggtcagcgatgaacggaacattcttattgttctcgataactggacggtcatgactgtcctttactctgtcgaaaatcgtttccggtgaagcggtaagtaatacaactcgtccgtttttcttcatctcaacaacgttacattcacgaagtggagttcctccgccacaggagatgacaacattctttcttgcctgcatctcgataagaagattggtctctaaatcacggaagtactgctcaccatgaacttcaaagatatctggaatactcattccctctctctctgcgataatctgatccatctcaataacgtccattgcaaacaatgtttttaaatattcggaaatacttgtctttccggcacccataaatccaataagtacgatattataatcaaaaagctttcttgcctgcatctgcttacttgctttaccgattgcatggaaaatatcccatacttcacttgcattgctctcgtcctctaaacgaccgtcgagccattctttctgtctctcttcctgttccgggtcaagaatattaaggccattctcttctttgtaagccataatatctttaataatatgatgtctcatcagtatggcatctaaaagtatctcgtcacactgacccagtctctttcttaacttttctaaacgagtcatgttgctgctctccttctttcgtctagtttattagtttcggactgtacgatgtgttttcactaactttcacacattaaacagctaagttattataccacaggaaaaaagctacaacaagtaaatggaacaaaataaatctataggaaaattctattaaattttagattttttctataagtagtatttaaaacaaattctgcgtgttttatataatagtattagaattgaaagcgtttcggccatctttgtaaggagtgatatatccataaggtattgtcgttcttgattttttataaagattttataaaaagtctatcataatctcaataagtactaaaacatatttaaaaaatgctttaattaaaataaaaaagcctctctggagtaattattatattatctccaaaggggctttttataatatttaatttctaacttaggggaattttacttgtggttttttcgttatttggaattagttatttttttgttatttgattgtaaatcttgattatcttgtatcatctttatatgccggcaggtttgggcctgcctgccgacatatattcaaatttccagatttcggattctttgcacaatatcctataattcattaaaatgtatttgaaaaatgttttctgtaaatatattataaatcgaggtgttcatatcacagtaataatttttcaaatatattctggtttgttgatagtttattgaatttatttaatgaatcctacctgtgcggagattttctcaatctgttcatctttacgtttgttatattctactttctgctgctcaaagaagttgtttccttctggatcgatggatacgattaaagggccaaattcttttacgcggcagttccataaggtttctggcattccaagatcacgccattctgctcttacgatttcttctacttctgttgcggctactacagcgtttcctgctgggaatacacagtggattgctccaaagtctttgcaggcacgttctgtattttctttcataccaccttttccgatgatcacacgtacaccagtttctttcacgaattcatattcaaatttttccatacgcatactggttgttggtcctacggataccatctcaaacttatcattttctaaaggacggataattggtcctgcatggaaaatagcattatttcttacatctacaggaagttctcttccttcttctactaaacgacggtgagctacatcacgacaggttgtcatgcttccatttaaataaatgatatctccgattttaatgccttttaaatcttctgctgaaattggtgttgttaaaatcttttttccatcttttacttctaccattataactctacccccgtatgtgttgtaattttataatttaaatccttgtcaaatacaatgtgtcctcttctgtgactccagcatcctacgtttacggctacaccgattgcggatggatgacgggctgtattttcgatatttactcccattacggagtattttccacccataccctgaggtcctaatccgatagcattaattccgtcttctaataatgtttccatcttagctgctctctcattatcattgtgagaaccgattggacgcattaaagcctttttagaaagaagggctgccgtttctacagaagttgctacacctacacctactaataatggaggacaggcatttaatccgtatgttgtcataacatccataacgaactttgttactccttcgtatccttcacctggcataagaaccattgcttttcctggaagggtgcatccaccaccagccatgtatgtgtaaatttcacattcatctgagtcaggaacgatgtcccagaatacagttggtgttccttttccaacattcttacctgtattgtactcatcaaatgtttctacactgttatgacgaagtggtgcttcaaatgttgcttttacaacagcatcttttaatagtgcttcaagctctccgattaatgggaactttgtaccacattttacccagaactgtaatactccggtatcctgacaacttggacgattcagctttaccgccagttcctgatttttaaacatagtatcatagattgttttggaaagagggctgtcttctttatcacgaagctcctccagttttgcaataacatcatctggaagtttctttgcaacatgagcaataaacttagccatatgttccgtaagttgtgttacctgttcttctttagacatttagaaatcctcctgttaatttacccgacggtcagcgggatttaaatatgtgaatgaatgaaagattaaccgtatacattttcattaataagttctgctttaatttattcggccggagcaacccggcctgcttaaccggctctctatcctgggaaaaatggatagaaaatcggaagaagtatcatacttactaccgttgccactaaaatcattggcacaccagctttggcataatctttaaatgtatagccacctgctgttacaaccattgtgttagccggcattccgattggtgttgcatatgcacaggaaccaccaatgacacatgccatcaatacggcacttggatctgcacccattccctgtgcaatggaaattccaattggaaccatcagggctgttgtcgctgtgttggacatgaagttcgtcattacacagcagagcataaagattacaaatgtaagtacatatggagatgggttatcgccaagcattccgattaccttttctgcaataagttctcctgctcctgtttgctctaatgcagctgctaaagaaagcgttcctccaaaaaggaaaatcgtttttaaatcaatagatgccagtgcatctttctcactgattactcctgtaaccattaaagctaacgctccaatacatccgatgacacaaagcttgataccaagctgttcctcaaatatcattcctactaaggtaagtagtagaattactaaggaaaggtactgtttccactttggtacatggctaaaatcctttgactcatcaaagattccttcgtcgcttccttctttattcggaagaaacttgtatccgataaatgcaaagtaaataattcctacaattaaaatcggaacaccaactttggcataatcaaagaatccaaacttaaggccaattccttccatacctgactgcgcaatcatatttccaggagcaccaatcaatgtgaggttacctcccatcgctgctgcaaaaaccaaaggcattaacagtcttgaacgggaataccctgacttcgctgcgattccgataactactggaatcaggattgctgctgttcctgtgtttgaaagaaatccactcatcacacctacgataaccatgatagctacgataagctgtctttctgtctttgcaaaatgagtaacaattccgccaatcttgttggccattcctgtttcaaacaatgcccctcctacgataaacattgctacaaacaagataacgttgctgtcgataaatcctgcgaacgctgtctgccattcaagtacaccggtaactaccagtccgacacatacaatcatggatgtcagtcccagtggaatcttctcccacataaacatgacaatcgcgaacagcaagaaaagtaacgtgattgttatctgactcatctctttacctcctcatttgttagattcgtcttacgttttgcttttatcataaatcctcttaccctttccagtctcccatatccagcaaatgaaaatcccaatttctttacttgatgttttgcttttacgtttctgatttatgatttttgatatttgattttgtatccaaatctcgattctaaaatatacctttattgagaaaaagtcaactatttttcgctctatttgcatcatttcggcaaatacaataaagttgtgactatttttttgtgcagaatgcactaaagaaaatatcttagttaatgcttgtattgccgaataaagaactgatataatatttatacaaataaaaatataatctaaaaaattggagaagaaaccatatgtatattatggacggaattgtatatgctggagaaccaacagaaagtctggaaataacaaaagtaaaacccttagatgacatgataatgttaattacattttctaacggcgaaacaaagttatttgatgccactatattaacaggaccagtatatgaaccattaaaagatgataagattttcaaaaatccggtaatagaatatggcgttattacatggaataatggaaatattgactgctccctgaaagataaatagaccacaaatatggtctatttatctttcagggagcgtctacttgcctgtggcaaactaattataataagtcagcatatcatctctgcttcgcattatatgttccttcatggctgcttctgctgcatctccatcatgtgctttgattgcttctaaaatttctccatgttcttttacagaaactttggcatagtcttcttcagaaaccatattacccatagaaagtccattccaaagttcggagatcatgtttttcatttttccatttcctgcagctgtccagatttcattatgaaattccctattaatatctgtgtagcgtgaaaagtctttattctctaataccttacaggaatcttgatatatttcttcaagttccgaaatatctgtttctggtgcagcacaaaggcgagctgccgctccctctaagattgcacgaagctgataatgttctttaatataagtttctgttacaccaagaacaactgctgctttatttttccgaagctgaatcaatccatcgcgggcaagaatctgaaaagcttctcttaccggcatcgcagatacattaagctgcgatgctacgctttcaagtgaaagcacttcgccttctttcatctgccttgacaatatcgcctttctaagttctgccgctactcgctcttttgctgacggcatcttaattggtcttaatcccatcatttattctttcccctctctgcatttacgttatctgcaagcgccttcatccatgcatctatttttttgaatattttctttcttccagaaatactgtcgagattcgcaccattttcttctaaaataatctgtttcatctcttctctgcatttgctttccttctcattggctccacaggatacggcaaagcgaatatagcactccgaagcagtatagagcaatttagaaaaataggcattatccgtacattctaatactacctcatcaaaacgtttcgatgtagataaagatgaagaaagaatcattattgcttcttttactttatcttcattctccaaattctttaccgctttctttaaaatatcccctatcatttcataaataatctgaatctgctcttccgataattctactgcataaattcttcttgtagccagacggacaatcagcccctgtccctctaatacctgaaatgcttctctgattggaattctcgaagttccaaacatttctgccagttcttcctgctttaactgcgtccctccggcaatccgaccggaaagaatctcatcagcaatctgttgtgccatgtaatcactgaggcgtttttctgataatgccctcattcaaatgttcctcctccaatttttccttacttaacaatacttctatcttataatgccgcaatacttaacttaagatagataggttaagatggtatctctattaataatgtatccaaaatcacataaaaagtaaagaacttttttactatttaattcattagggaacagacgaaaataaaaagaatagaccattgcaactgtaaagatatcactgcgtagaaaatgcctgttcggcatttttacttgctcccacattacagttgcaatggtctattctttttattttctgtgttttggctccagaaggaatgaatgcaatagttttttgggaggaattaagggggagaggtcagaaggtcgtggcttattctgatactgtctccgcgatgcggtcaatgatgataagatgatatcgcagctatcactgtacatggtgaatttatcattatatataaaggtgacttactttgttttttgtaaaatggcaatcctctttctccttactgctcgttaagagcgagaaaataatctttggacgatacatcttccgagcaagcagtagtcttctgatttctccccttgtctccaccaaagcctattgcattcattccttctggagccaaaacacaga

SEQ ID NO: 421 - DNA, 40020 bp, Eubacterium hallii
gaaaaaagaaataataccatatcccatctgctctgtagtcgctgtgtttaagatgctcaaccgcatcttaaacacgctccgaagccgcatctgggatatggtattatttcttttttctgtgttttggctccagaaggaacgaatgcaatagtatttgggaaagagatggggaaggggacagaaggttgtggcttattctgatgtcattttcactatgctgaaccttttttcaagtttcactgatgataagatgatgccgcaagctattactttacatgataaatttataattatattgtcgcaatatatcatttttttctgatgagatatccttccgagtaagcagtagacttctgatctctccccccccccttaattcctcccaaaactattgaattcattccatatggtaccaacacacagaaaataaaaagaatagaccattgcaaatataatgtgagagcaagtaaaaatgccggcaggcatactttctgggtagcagtagacttctgacctctcccccttaattcttcccaaagactattgcattcattccttctggagccaacaagcagaaaataaaaagaatagaccataacaaatgtaatgtgagagcaagtaaaaatgccgaacaggcattttctacgcagtgatatctttacatttgttatggtctattctttttattttcgtctgtttcccctaatgaatgaaatagttattctccgtagaagtgaaatccttcttctcgttgttttctacgaagtgaccgtctgatctctgctcgttcccattcttttctgtcttcttcggattttaagataaggcgagggagaatggcagggcggttatctggtccaagaccgattagagttagaaaagcgcgattgatcaatgctctttttccatctgtattttctacataagtctctaccttaacttccatggaagtatgtccaacatgtgtgacttttccaatgatgacaatgacatctcgctgaaaagcaccatgtaagaattgaagattatcaacagaagcagtagtgacattcatctgggaatgccgttttgccacgagtgcggcaacttcatcaatccactgcatcagaacgcctccaaaaaggcggcctgcatcattaagatcagatggacggatgatgtgtacagtttctacaatagattcttgtaccgttttagcacgaaaattcataaaaaacctcctggtttgtttaatgtactctcggagtctttcttgcacttgcttttgtggctgatttcccgccagttgcacccgaatttcattaacgtacgcaccgcgtacgcctcaaaaatttgggcacaactgacaaaaaatcttctcacaaaatcaagcacaaaaagattccgagagtacattttattttattacaatctcatgttctgcgggttccaaagtcaaaacaccgttcgtgcttgcacgataaggcgtttgactttgggaccctggtgtcatataaaaattatatcgcagctatgccggattagcaatttgaagttgaatataaggaatgctttgtgtatgtttcgtctgaaaaaaggatggggtcatcatattggaataacaaaaaaatatcattcattttgcgaatatagaataaaagatgcaaaaagcctaaaaaagaggtaaaaaatgcatctagagagtaatctgttgtgcaatgtgtatttaaaatgagtgacccattgttgaaattgtatagattgtaatgtccaatattgaaattttcaccaaaaacaaattgtctatatatgttataatgccgaaaaaaataaaaagtattgcattattttagtcaagtggtataatacaaacataaacattgggtgacccattagggggtatgcagaggaggtgctgtatcgttgtttttgaagttttttttagcaatactgcccattttatggctgataatcgcgttgagtgtactaaaaattgcaggtcataaagcttgtttaatcgcattggtgattacggcagtattagcagcaggttactggaagttgagtctcgtatgtactgcgacagcaggacttgagggcgtgcttaatgcattgtggccaatctgtctggttattgtagcggcattgtttacatataatctgacgttggaaaccggggcgatggagttgattaaaaagatgctagccagtgtttccgttgaccagagagtgttacttttaattatcggatggggtttcggtaatttcatggaaggtatggctggattcggaacagcggtagcgattccggcatcgatgttggcagcgattggtattaatccgattctttcggttattgcttgcttggttgttaactccacaccgacagcatttggttctgttggagttccgacagtaacacttgcatccgtaacaaatcttgatgttttacagttgtcaggaaatgttgcattgattcaggtaattcttacagtcttgtcaccgttctttatggtatttatcgttggaaagggattcaaagcaataaagagtgtattgccaatgattttaattgcttctctttcatttactgtaccatggtttatcgctgctcaggtaattggatgtgagcttccgaatatcatcggatcgattatttctatgatctgtatggttgtggcagcaagatttttaaataagaatccggaagaagaatacagagtagcattatctggtgaagaagaaagcagtggatttactgcttcggaaggtgtaaaagcctggagcccatttattttaatctttttacttttgatgtttacttcaacattatgtccgccaattcataatctgattgccgatataaagacgacggttactgtgtatgcgggtgagaatcctggttctctttcctttagctggattaatacgccaggtgttatgattttcatcgccgcaattatcggtggactgattcagggagcttcttttggaacaatgggaaaagttcttgtagaaactctgaaaaaatactggaagacgattcttacgatctgttgcgttatggcaacagcaaagattatgggatatagcggaatgatttctgatattgcagcagcattagttgttgtagcaggtccgttctatccattgatttccccattggttggagcacttggagcatttgttacaggttccggaacatctacctgtgtattatttggtggattacaaagccagacagcgctatctcttggactgaatccttcatggatggcagcggcaaatgttatgggagccggcattggaaagatgatctgtccacagggtatcgcgattggagccggtgcgatcggcgcagttggttctgaaagtgagatattaagaaaagtatttaagtattttgtgatttatgtagttattgccggaattatctgttatgcaggttctatggcaggattctaaccgatgtattaagttaaagaaatttttaaagaactttattattttttatataaagaggaaatgattaggaggtagaaatatgtacaatcagttgacaccggaaattatcgaagaaattaaaaaagtttccaataatgtcttcttaggagaagagattaatccggactatgcgaaagacgagatgccgatttatggtacgcatatgccagatttagcagtacagccacgttctacagaagaagttgcagcagtaatgaaaatttgttatgagaataatattcctgtaacacctagaggagctggtacaggtcttgctggtggagcagttccattatatggtggtgttttgattgatatctcaaagatgaacaagattaaatcctacgatatggaaaactttgttgttgaaattgaagccggtgttctgttaaatgatttagcagaggattgtcagtcaaaaggaatgttatatccaccagatccaggtgaaaagttcgcatgtgttggtggtaatgtggcaacaaacgcaggtggtatgagagctgttaaatatggagcaacgcgtgattatgtaagagctatgaccgttgtattaccaactggtgagattacacatcttggagcaactgtttccaaaacatcttcaggatattccttattaaatcttatgattggttctgaaggaacacttggtattatcacagagttaacattaaagattattccagcaccaaaagctgttgcatctttaattatcccttacgaagatttagagacagcacttgcaaccgtacctaaatttaaaatggctcacatgaatccacaggcgattgagttcatggagagagaaatcgtacttgcttccgaacgttatgttggaaagtctgtattcccacaggaaatggacggaattcagattggtgcatatcttcttgttacattagatggtaacagtgaggatgaagtagatgcattgatcgagcaggctgcagagcttgtattagaagcaggagcaattgatgtattagtagcagatacatctgctaagatgaaagatgcatgggcagcacgttcttctttcttagaggctatcatggaagaaacaaagcttcttgacgagtgtgacgtagttgtacctgttaataagattgcagaataccttacatttgtaaataagaccggagaagaatgtggtcttgttatcaaatccttcggacatgccggagatggaaaccttcatatttaccagtgttccaatgatctggaagaagaagagttcaaaaagagagtagataaattctttgacattatttataaagaagcaacaaattgcggcggtcttgtttccggtgaacatggaatcggctcaggtaaagtaaaatatcttgttgattctgttggagaaacaaacatggcaattatggaaggcatcaagagagtatttgaccctaagatgattttaaatccaggcaaagtttgctaccgtctgtaatattaaggaggaagaagaatgaatatttgtgtttgtatcaaacaagtacctgatactaatgagattaaggtagatccagttacacatacactggtaagaaagggagttccaagtattgtaaatccttttgatacctatgcacaggaagtaggtgtccgcttaaaagaaaaattaggcggcaaagtagttgttatttccatgggaccagaacaggctaaagaggcaattaaaacctgtctttctgtaggagctgatgcaggatatcttatttccagcagaaagttcggcggatcggatacattagcaacaagttatatcctttctgaagcaatcaaggcagtagaggaaaaagaaggattaaaatttgatttaattctctgtggtaaacaggcagttgacggtgataccgcacaggttggaccggaaatcgcagagcatcttggacttccacagattacatatgcattagacatcattgaaaaagacggagatatccaggtaaaacgtgaatgtgatgaaggttatgatatgatttctacacagcttccggcagtagttacagtagttagacttccttacgaacctagatacccaaccatcaagagcaaaatggctgcaaagaaaaaagagattcctgttcttacagaagaagacattcctgcaatcaatctggagcgttgcggattaagtggttctccaacaaaagtaaagaagacatatacaccagtaacagaaaagaatggtgtaaaacttcaggatattgaagcagaagatgcagcaaaacaggttgttaaattaatttacgacgcaaaaattttgtaaggaggactgaagaatgaatcttgcagattataaaaatatttgggtttttattgaaacagaatgtggtaagccaaaaaatgttggttttgaattaatcaacgcagcaaaaccacttgcacaggaaaaaggctgtgaattgattgcagttgttattggtaaagacattgaaggtgttgcaaaagatgccatctgctatggtgcagattccgcaattatcgttgatggaccagaatatgaatactatacaacagatgcttttgcaaaagcacttgttgcattagtagaaaaatataaaccagaaacattgatgattggtgctacaaacaatggtcgtgatttaggacctagagtttcttgtagattaaaaacaggtcttacggcagactgtacagcaatcgcaatcgatgaagaaacaggaaatgttgcatggacacgtcctacatttggtggaaacctgatggcaacaatcatgtgtccggaaaaccgccctcagatgggtactgttcgtcctgcagtatttaaaaaaggtgcttatgatgaagcaaaaacaggtgagatcgtaaaagaagagattacggtagcagcagatgaaattcgtacaaccctcatagagagagtaaaagaagttgctgaatctatcaaccttgaagaagcagagattattgtttctggtggacgtggagttggttctcaggaaaacttccagttattacaggatcttgccgatgtacttggcgcaactgttggatgcagccgcgcagtagtagatgcaggctggatgccacatgcacatcaggtaggacagtctggtaaaacagttgctccgaagttatatttcgcaatcggtatttccggtgcaattcagcatgtagcaggtatttccggtgctgatacgattgtagcaatcaataaggacccagatgctccaatctttgatgtagcagattacggaatcgttggaaatttaaatgaagtagttccagcgttaacagaagcattcaaagcacagaaagcttaattggtttgtcaatggctggccttccgttaaaggaaggtcagacctgaacatataaaagcaatatattaatcaggcagagatttctggtacgatataaaatgaaatagccgtcagataatagtattgtgaatgaagtcacaggcaaattgttaaaaaaaaatcaaagaagtaactataacaacagtaagatttattgtggtattattttaaattcaatattttaaattcaaaattaacaaaaaaacaatgtattaaaaatgaccgtgacaggaggaaatagttatgaattttagacaggacgaggaacatcaggatatattagaaatggtgcatgactttgcagtaaacgaagtaaaacctttagctgctgaaatcgacagaacagaagagttcccaatgaagaatgtcaaaatgatggctgaaatgggactgatgggaattcctttcccagaagagtacggcggagctggaatggatacattagcatatattcagacagtagaagaattaagtaaatactgtgcttctacaggtgttattctttctgctcacacatcattatgtgcaacacctatttatcagtttggttccgaagaacagaaaaagaaatatcttcctaagttatgttcaggtgaatggattggtgcgttcgctttaacagaacctaatgctggtacagatgcatcaggtcagcagacagttgcagtagatgctggtgatcactgggtattaaacggatctaagatttttattacaaatgcaggagcagcaaatgtattcttcgtacttgctatgacagataaatctcagggaacaaaaggtatctccgcatttatcgtagaaaaaggatacaaaggattctctatcggaaaacatgaagataaattaggtatccgcgcatcctccacatgcgaacttatttttgaagactgtatcgttcctaaggaaaaccttgttggtgaacttggaaaaggtttcaaatatgcaatgatgacattagatggtggacgtgttggtattgcagcacaggcacttggtattgcagaaggtgcattagaggaaacaacaaagtacatcacagagagaaaacagttcggaagaagaatttctcagttccagaatacacagtttgaaatggcacagatgcgtgcacagacagaagcagctaagcttcttgtatatcaggcagcatgtgcaaaagatgatcatgaaccattctcacataaagcagctatggcaaaacttgtagcagcaagaaacgctatggatgtaacaacacgctgcttacagttatacggtggatatggatatacaaaagattatccaatcgagagaatgatgcgtgatgctaagattacagaaatttatgaaggtacttctgaagtacagatgatggttatctctggatggatgggtgttaaataaggagttgagcagcatggatatgaaattacctttttcaactaccggtatgatgctgcatcttgacgattcgatggactacgaggttttatcctcgtccatcgagtccatgccaaagagcgataagacagaagatgagattgttcttgatgcaatggcacatccgattggttctccaaagctttccgaacttgcaaaaggaaaagaaaatgtagtaatcatttgttccgaccacaccagacctgttccaagtaaacatataattccctttatgttaaaggaaatcagagaaggtaatccggatgcaaagatcacccttttaattgctacaggatttcacagagcaacaacgagagaagagttagttggtaagtttggagaagaaattgtagatcatgaacatattgttattcatgacagccaggacatggatgcaatggagaatataggaactttgccgtccggggcacctcttttaatcaacaaggttgcagcaaatgcagatcttcttgtaagtgagggctttattgaaacacatttctttgcaggtttctctggaggaagaaagagcatccttccgggagtatccagtaaagtaacggtgcttggaaatcactgttctaaatttattgattctccatatagcagaactggaattttagaaggaaatccgattcataaagatatggtagctgccagtaaaatggcacatcagaaatatattgttaatgtaattattgacgcagataaaaaagtggtacacgccgttgcaggcgatgcgatagaagcccatgccgcaggatgtaaattcctgcaggattattgccaggtagttcctaaaaaagccgcagacattgctatttcaaccaacggcggatacccgcttgaccagaatatgtatcagtctgtaaaaggaatgactgccgcagaggcagcagccaaagatgatggtattcttatcatggtttccaattgtggtgacggacatggaggagaaggtttctatgaagctttgaaaaactgctccagtccggcagaccttatggaagaaatcttaaaagttccacaggatcagacaaaaccagatcagtgggaatatcagatacaatgtcgtatcttaatgcagcacaaagtcatctatgttatgtgcgaagaaaatcgtaagatggcacaggagatgggatttgctgttgcaaatgatgtaaacgaagctcttgagatggcaataaaagaaaagggaaaagatgcccatatttcaattattccggatggagtttccgttatggtaaaaaaaccagaaaattaatagtcaaacatgtttgcttaatgtgaaattcatttttcgcattttgtaggcgggcctgcaaatgagcagcaggtccgccatttttttagtataatgattcagtagcagagaaatttgggatgcgcatttatttcccttgtattgttaatattttgcacttgcaaaaaaagcagaaatcctataaaataaacatttagaaataaagaatgataaaaatctaacagaaatgtgacggggaggcgacaaaaaaatgaatgaattcacagattttaaaacctacaaaatgaagaataaaaagatataccaatatgtatttgattatttttctgagcagattttatctggcgaattaaagataaatgacaagattttaccagaaagagaaatcgcagagaagctggatgtaagtcgtaattccattcgtgaagtaatgcatatgttagaaattaacggactgcttgattgtcgtcagggaagcgggaactatatccgctgtgaaccgcaggaatatatgatacagttcatgaatatggtcatggcgcttcataaaattgagtatacagaagtatatgatatccgtatgggatatgaaaccgtagcgttacggttagcgattaaaaatgcaacagaagaggaaattgaacagcttcatcagattttaataaagatggatgaggttgaagatccaaaagagagtggtaggctggatatggagtttcataacaagctgatcgcagcatctcataatcgtctgatcgtattatattcatcaatgatcgcagaattgatgaatcggtttatctcagattttcgtgttcgtattatggcagatccaagacaggcagaagcgttaaggcgagcgcactggaatatttatgattctttagtagcgaaggattttgcagcgggaagctttgcgatgcagagacattttgatatagtaggtgagaagcttgagtacctgcagaaacaattggataattaagagagaaaacttctgtttattttagctgacattgaccgaaattatgcattgagccgcttgcgtacgtttggctcgaatttaaaaatttcggtagaaataaagcaaaaataaacagaagtttttctataagaaaatgtctgctaataaaaaatgtctgttaatttacccgatgtaaaagcagatatttctgccgggtagccataccccctcgtatatgccgctcagatttattgatatctaaaatatcacgcacctcttcagcgagatgatgatcgatctgtgggagacgttctgtaagatctttatgtacagtcgatttactaactccgaattttgtagcagtctttcgtacggtagccttagaatcaataatatatcttcctacctcaatcgcacgtaattcaatgtaatctttcataataaaagtcctgtcttaaaatctttttaccatcatatgaaaaagataacaaagacatgcaaaaaacatttctgtttttgcttctattctatacttatctatacttcacttacttctattatttttacgatcagttcattgtcttctggaaaaaatgatacaaaaaaacaccgttctgatggctgataggaaacggtgttcttgcgagcagtcactattgaaggaggaggagtgactgctctattggataatttaattgaatagttgagacgagatgaaatcgtatcactcatcttggcttaagtataccaattttcgataaaaatgtctatgcatgagtttgccaagaataaccgttttttttcgttttttcttggcattatgaataaattgggttgtattgcattgataggagaacaattattatgagcaaaataactaattgttcctgaaaacaaacaaaaaacaacggttgatagaggtaaggaaggggtttacctttgtttttcttttggtacaataaataagacgaaataatgatatagtatattcagaattacgagagtagcgttagctacggagtaattcgtgacatcatagtattatatataattataaatgtaagaaaggattgcatattagaaaaaatagaaaaatgagaggacatcaattggatacactgataaaaagggaaaagatatttgataatattatagttccttcaggaacgaagaaggaggccataaaaataatcagtcgtctctgtgcgacacacaggctactagatgagagtacgttagaagaggcattttggaagagagaagaatgggattctacgggatgtggagacggaattgcaattccgcatgcacttgtaagggaaacgaacaaagtacagcttgcagtgatacgatttcgctatctgatagaatgggatgcttttgatgggaagccggtaggtgttgcttttgccatcatcgcaccggaggaaaccgggcaggagaaatacctttcttttcttgcacgtcttgccagaaagcttgtggatgaagagtttatcgaaagttttcgaaagtgcagaaatgaagaggaaatgtatgaatatctgctgtctgttttttaaatcccagattcgatatagagtatatagagagaatcagatataaaacagatatagaatagatgtagatactaagtgaaatttattgagtgagaatttatagagagaaagtttaaaagtatgaaaatagttggagttacaaagtgtccgaccggaatagcacatacctatatggcagcggagcggttagaaaagacagcggcgaagcttggttatgagattaaggtggaaacacaggggtcacagggaacagagaataaacttaccagaaaagaaatcgcaaaagcggactttgtgatcatagcagcagatgtcagtattgatgagccagagcgttttaatggtaagaaagtatttaaaacaaggattaaaccggtattgaaaaatacagagaatatttttgaacggttagaagaagaatattttattatgggtggtatagatgctgtgcaagagcatgacctaaaagacagtgatgctgaaaatgccggaaatatgatagaacattctgataaaaaagaatctacagatatattaggacagcttatgaatggtgcatcctatatgattccgtttgtagttgtcggaggtctgctcgtatcattatcattatcttttggagcaacgacttcaccagatggagaagttgtttttcttgggatatgggataaagtgcatcagattggcgcacttgccttcacattaatgtatccgatcctggcgggctttattgcattttctatcgcaggaagagcagcacttgccccggcgatgatcggagcaatggttgcaatgaatgaagagattcttggaacaaaggcagggaccggctttatgggatgtattattgtcggctatttcgtcggatatcttgtgaaatggatgaacagctggcatgtagtaaaagaatttaagccgatgatgccaatatttattattcctcttacaggagtgataacagtatcggcattatttatttttgcgattggaaaacccgttgcaatgatgatggaggtactaaataccatgctagtacaactggcggcgaatccttctagtgcaattatacttggcatcgtgctcggtgcgatgataggagtggatatgggcggacctgttaataaggtagctttcttttttggagtaacgtctatagcccagggaaatcttcagattatggggattgtgtctacttctatagccgtagctccgttatcgatggggatagcggcgcttatcggaaaagagaagtttacggaggaagaaaaaaatgcaggattttatacgatatttatgggaattataggaatcagtgaaggtgcgattcctttcgctgcgtccgatccaattcatgtattgccagctatcattgcaggatcagcagttaccggagctttttcggcagcatgtggggtaacttctgcagttccacatggagggctggttgttgctttatttaaagcgacaaattatatgtcactgtatttgctgagtgtaattttaggtacagctgtatctgcagcaattgtactggcatttaaaaaaaagcagaatttcagataaaaaagaaaaagaagagtactattttgttgttttttcaaagaaaatactcgtttctatattgaaattgcaaggaaaatgaaataaaattttaaattaagcacatcttttgttcaaaaataagtcaaactatgcgttttacatttttgaatgatctgataaaattttagtgagtgaggagtgattcgtaaacatgagattcacaagacgggatatgatgatgatagagtatttgagagattatgaagtactcgaactggattctatgtcagaatatctgggagtatctgtaaagactctgaaaaatcaactgaaagaattggcggaaatgctgaaagaatttggagtggatatccgatttgtttccggtaatcagttgatggtcaggggacatgagaagtttgcggaagtgatgagtgtgagcatccctcgctttgagatggaatttgaaagaagattccttttacttctggtattgcatgataattttctgacaatacaggaaattgcagatgagcttctagtaagcaagtcttacgcagaaaagcatttggcatcgattatgaagaagtatccggaagatatccaggcacagcggcattatggtatccgctatgcagcatcccagaacaaaagaagagaagtatttgttaagatactgtttccgtatttgttcggggaagattatattgtggctttagagcagtttgatagccttcattttccactgtttcattattttacgaagaagcagatggagaggacgagaggagcagttttacagcttcaggggttagaatggtttcagcttaccgatgagtcgctgcagcagctttttctttatattttgtttcttgtccgtcatgcagacagcgggaatacagaaagaccggctgcgatacaggaagacttcattaatacgcaggaatttgacggattatttgaatggattcctggctggtgtcaggaatttggtctgcccgattcaaaagaagaactgcgctatatgtatacgttgctgttatcgcttcgtaaacaaaaaattgcctgtcaggatcagattatggagaaaatgagacatccaatccaggaaatccttaaagggattacggagagactcagcgtggatttttgtaatgatgaagatcttattgagggattgtcttcccacatttataccacgattctcagaggaaatcatctggatattgaaacggatgcgtatatggtaaagtcgatgaaacgtcagtatccttttggatttgaaatggcagcgatcgcggcagattacatcgcagatatgtataatctgtctatgaaggaaaatgatcttatctatcttgccattcattttcaggcagcaatcgaaagaatgaaagatgaaggggaaaagacaaaaattatcattgtctgtcattttggagcagcggcagcaagaataattcgatcgaaaatagaaagaaagcttgttggcgtgaaagtaacaggaatgtattccttacaggaatttaaatccctttctcatttagattgtgactgcattgtgacaaccgaacgcattttaaaagcggactttccaatcatttatatttctatggctctttcagagcgtgagatgcgaaagattgaggaaggaattaaagaaattcaggtaaaccatttattggaattaaatatattagaagcgattattcttcctatagaagaaaaagatatggaatctgccataaaagcaatggtacagccattgcaggaagaagatttcgtgacggaagaatatatgcagtctgtcctcagcagagaggaaatgtcttccacaagtcttaattacattgccttgccacatgggaatccggcaatggtacacaatacaagactggtgatcggaagaatggatcagccgcttttgtgggatgattctaaagtaagctgtgcgtttttatttgcggtatccgcggaaatgctcagggaaaaaccgatgctttttaatacattttatcggacgatggcagatccgaatgtagaggagagtattaaaaaacttcagatggaaaagaatcttccagatgaggttttcagacaaaagctgtttcatattttgagatagagtaactaataatttctaacaggagaggaaaggatgtgaagttaacatggtaggaattattctcgcaacccatggcaattttgcgaccggtatccagcagtctgcttccatgatttttggggaacagccaaacgtggcagccgtaacactgcagccaaatgaaggaccggatgatgtgagaaagaaaatggaagaagcagttgcatctttcgaagatccgcagcaggtgttaatcctcgttgatttatggggtggaactccatttaatcaggcaaatggtcttattgcaggtcatgaggatacatgggcaattgttgccggtcttaacctgccgatgcttattgacgcttatgcttcccgtatgatgatggatacagcgcaggaacttgctgtacagatttcaggaagtgcaaaagaaggtgtcagaatttacccagaaagcttagagccaaaggaagagaaaaaagcagcagctacttccgatggacagccaaagggtgtattaccggaaggaactgtagtaggagatggaaagatcaaatatgtgcttgcacgtatcgattcccgtctgctccatggacaggtagcaacagcatggacaaagactacaggaccaaacagaattatcgttgtatctgatggagtagctcatgatgatcttcgtaagagtatgattcgtgaagcagcgcctccaggggtaaaagcaaatgtagttccggtaagcaagatgatccaggtagcaaaggatactcgttttggaaatacaaaggctctgttattatttgaaacaccgcaggacgctcttgcagcaatcaaaggtggagtagatattaaggaacttaatattggttctatggctcactctgttggcaaggtagcagtcagcaaagtattatctttagatgaaaaagatattgagacttttgaagaactgaagaagttaggcgttaagtttgatgttcgtaaagttccaagtgattctcaggataacatggatgaaatcctgaaaaaagcaaaagctgaattagcaaaatagtatttaacaattaatattaggaggaaacgtcatgtcaattatttcaatgatcttagttgttatagttgcctttctcgctggtatcgaaggtgttgttgatgaattccagttccatcagcctttggtagcatgtacattgattggtctggtaacaggcaatcttgaggcaggtattgttcttggtggtagtcttcagatgatcgctcttggatgggctaacatcggagctgctgtagcaccggatgcagctttagcatctgttgcatctgctattattcttgttcttggtggacagggagttaaaggtgtaagtacagcgatcgctgtagctatccctcttgctgtagcaggtttattcttaacaatggttgttcgtactctttctgtagcatgtgttcaccgtatggatgctgaagctgaaaaagcaaacttcaagggtattgaattatggcacatcattgccatctgtttacagggacttcgtattgcaatcccggcagcatgtcttcttgcaatccctactgaaacagtacagaacttcttacagtctatgcctgcatggttaacagatggtatgtccatcggtggtggtatggtagtagccgttggttatgcaatggttatcaacatgatcgcaacaaaagaagtttggccattcttcgcaatcggtttctgtctggcagctatttcagatcttacactgatcgcacttggtgcaatcgcccttgcaatcgcattcatttacatcaacttatctgaaaatggtggaaatggaaacggtggcggaaacgttggtgatccactcgatgacattttaaatgactattaagaagtaaggagggtatagaaatggcagaagaaaaaattactttatcaaaacaagatcgtcgctctgttgcactccgctctactttccttcagggttcatggaactatgaacgtatgcagaacggtggatggtgtttcgccatgattccggcgattaagaaactgtacacaaacaaagaagatcagaaggcagctttaaagagacaccttgagttcttcaatacacatccatatgtagcttctcctgtacttggtgtaacacttgccttagaagaagagaaagcaaacggtgcgcaggtagatgacgcagctatccagggtgtgaaagtaggtatgatgggacctttagccggtgttggtgatccggtattctggtttactgctcgtccgatgcttggtgcgttaggtgcatcccttgccatgggcggaagcatcttaggaccaatcttattcttcgtattatggaatgtgatccgttgggcattcatgtggtatacacaggaatttggttaccgagctggtagcaagatttctgaagacctttctggcggacttttacagaaagtaacaaagattgcatctattcttggtatgttcgtactcggttcgctgattgaacgctgggtaagtatcaactttactccagttgtatcaaaagtaacattaagtgagggtgcttacattgactggaagagccttccagcaggagcagaaggtattaagacagcactttcccagtatgcttccggaatggctttagatcctacaaagattacaacgttacaggataacttaaattccttaatcccaggccttatgccattattactgacactgttatgtatgtggttacttaagaagaaagtatctccgatcgtaatcatccttgcattgtttgtagtaggtattttaggacatgtagtaggtattttgtaatttacaaaatcaaacacagaatagttccgagcgtacatcggatataagaggagggctgcagtaaaaatatttttaatatttttgcacagccctcttgatgttatgtatacattaaaaacattaggagggtgaatatggcacaatcactgaatacaaaagtggatctggttatggatgccacttcctttcacggaatgaataattacggaaaaattatgattggcgacagaggtttcgaatattataacgaaaaaaagatgaatgactatatccagattccatgggaagaagttgattatgtcatagcatctgtaatgtttaagggcaaatatattcctcgattcgctattcagacaaaacgaagcggaacgtttacatttgcggcaaaaaagccaaaagaacttctacgtgcggtaagaaagtatgttccatcagaccacatggttcgctcgttaagcttttttgatgtgttaaaaagagcttttaaaaagtaaatatcggtgacatcaagttagggacaaaataccttttgaccttaatattttatgatggaagtattataatgattctgacttaaacgattcagaaaacttaaaagtactttttgctaaaaggagaacgaagatggcaattttaaaattaaaaccaagcggaaaagattacatttggggtggacataaacttgtagataactacggaaaagaaatgacaggtgacagactcgcagaaacgtgggaattatcctgtcatccagatggtccaagctttgttgcaaatggcgaagatgccggaaagacattaagacagtatattgaggaacatggaaagaacgtacttggaacaaactgcgagcgttttgaggactttccaattttaacaaaattcattgatgcacaggataacctttcaattcaggtacatccagataacgagtatgccttaaaaaatgaagggcaatatggcaaaaccgaaatgtggtatgtagtggatgcagaagaaggtgcttatctctatcatggattaaaaaaagaaatcagcaaagacgaatttgcaaaaagaatcgaagaagacactcttcttgaagtattgaataaagtaccggttcataaaggggatgtattctttatcgaagccggaactatccatgcaatcggtaagggacttattattgcagaaattcagcagaactctaacgtaacgtatcgtgtatatgattacggaagagttggaaaagacggaaagaagagagaactccacatcgagaaagctttggacgtaacgaatcgtgcaccggcgaaaaaggatggaagccattatccacatatcgcagactgtgattattttacagtagataagcttaacctcgatggtaaaacctttaacaaaatggagggaaccgtttcggaaaaatccttcttaagcattcttgtacttgacggcgaaggagaaattaccagtaatggtgagcgtgtatcctataaaaagggagacagtatttttcttaccgccggaagcggagaatatagcgtagaaggtgtgtgtgatgcactcataacgacaataagagagtaggaaattctggtttgccgcaggcaaggtagacgctcctaagagagaaggcaccctatatttgtgactctatcgctgcgggttgaatgttcgcctccgggttcacattcaatccttgttctaaggccacaaatatagggtgccttctctcttggagagctgtttttatttcctgattctccatcactaatttgtgggagtagaatacacagaagcagagaaaaaattgtaagttaagacttagaaagaacagaagtctcgaagctcctaatatgtaaaaatgagccttagagcaagctcttaatgcggacgagcattaagagtgcagtgatacgaagcatttttacatattagaggtttcgggacttcgtctgtttattcccacctcctcactaatctaaaataatttattgacataaagcgtaaaagttgctatactgtaaatcatattaagactgtaggaaaatcgttgaacaaaagtagtaccttttatccacagcataccagagagtcgggtcaggtggaagccgatatgtgaaggaagagggaatggatttgggagatgcaaggtgaaagtaacagtagctgatgccgcgtcctcgcgttacaggggtaggatatcgatggaagttataagagagcttttgtccgtatcggatttagagagaataacatagaattatctggaagaatctttgtatatgttgtctggcacatcttaggcagagcggatggcaggaaatgattttttaagaatgattttaagtgattaattaagggtggcaccgcggaatatttcgtccctgacgttttttatgaacgtcagggatttttttatactattttatcgcctacagaaagaagggagtacatatgaagcgtataagaagggcatacagtaaaacagtcagtcttattgatgagacagcagtacagatttatggaagttttgtagggaagagaagaggatttcttcttgagagttacgataaaaataacgggcggtatgtttttatgggcaaggatccggaagaggtcattacaagtaaagaaaacgggctgcttattgcaagggcagatggcataacaaaagagattaacgggaatccggtgaatcttttaaaagagtattacagtgattttgaaatccataaggatgatgaacagcttgcgtttacaggcggtcttgtcggtggtcttggctatgattttgtaaggtataaggaggagctgccggataagaatccggatgagattggaattagtacgatttcattgatgcttgtgacagagtttttatctattgaccattttgcagaaacaatgacagcggttgttgtggaggatgatacagaagcaggaagaaagaaagcgatgttccgctgtgaagaaatggtaaaggaagcgtttgcgaatatccacaaagatgagaagtcagaatttcagccagatggaaagattataaagcagtcagatactttagaagaatatagtgaaaaagtaaataaaatcaaacagtatattatagatggacatgtattccagacggtactttcccagagatggacgattgagacgaaacagaaaggttttgatctgtataaagaattaagagaaatcaatccttctccgtatatgtattattttaattttgaacagtttgagattatcggaagttctccggagatgcttgttaagcagaaggataataaggtgttgacctgtccgattgcgggaacaagacctcgtggaaaagatgaggcagaagatcagctgcttgcggatggattgatgaaagatccaaaggagaaagcggagcatgtgatgcttgttgaccttgcaagaaatgatatggggcgcatcgcagagtttggaacggtaaaggtaaaagatttcatgcatattcaacgatattcgcatgtaatgcacattgtttcgctggtagagggaagaaaaaaaggggagtttcatccgcttgatcttgtaaatgcctttcttccggcaggaactttaagtggagcgccgaaggtaagggcaatggagattattgatgaactcgaatccgtaagaaggggactttacggtggagcaatcggttatattgattttaacggcgatatggatttttgtattacgatacgaacgatgattaaaaaaggggataacgtttatattcaggcgggagcaggcattgtagcagatagtgatccggaaagtgaatataacgaatgctgtaacaaagtaagggcgcttgccaaggtattagttcgggaggaaaatttatgatattgctgattgataattatgattcttttacctacaacttatatcagtatatgggaatctttgaaaaagacattaaggttgttcgaaatgataagatgacgataaaagaaatagaacagttaaatccggatagaatcgttctttcaccgggaccgaaaagtccgaaagaagcaggaatctgtatagaggttgtaaaacatttttatcagaaaaagtcgattcttggtatctgcctgggacaccagagcatcggagcagcatttggagctgaaattgttcatgcaaaggaactgatgcatggaaaacagtctttgatcacacaagatggaagaggaatttttgaaggaattccaagtccggtgcatgtagcaagatatcattctcttgcggtagatgaaaagacgctgccggacgtttttgaaatattggcaagaacagaagatggagaaattatggcgatgcagcataaagaatatccgttaattggaattcagtttcatccggaatctatttataccgatcatggcaaaaagatgatagagaattttttgaaattatgataaggattcatgacaaaaaagaggtgacataaaagcgatgattttagatgtaattgtagaagataagaaaaagaaattaaaagagcataaaaaccgcatcagtgaagaaaaaatgaaagagcttgcacttgcctgtgaaagaaaaagtatttctttttatgaagcgctggcaaagccgggactatctattatcggagagtttaaaaaggcttctccaagtatgggtaagattaagatgacgatggagcttaccgacagaattgatgaatataatgagtccgtagatgccatttcctgtctgacagaagaagaccattttcttggaaatacagaatattttaaagaaatcagaaagatttcgccacttccgatgatacgaaaggatttcatcattgatccataccagatttatgaggcaaaagtaatcggagcggattgcatccttttgattgcggcaattctttcagatgatcaaatgaaagaatatgataagtttgcggcgaaacttggtatggatgtgttagtagaaacacacgatgaagaggaaatggaacgggcattaaaaatccatccaaagattattggtgtaaataacaggaatttaaaggattttacgatttctcttgaaaatacaaaaagacttcgtccgatggttccggaaggaacagtatttgtttcagaaagtggtgtgacaacaaaggaacatatcgcatttttaaaagagtgcaaagtggatgccctgttgattggaggcgcctttatgttatcggaacatccaaaagagctggcggcagattggaaggctttatatgacaaaaattaaaatatgtggaatgacttgtgaggaagatattaaagcagtgaacaagtatttgccggattatattgggtttgttttattttttccgaaaagtaaacgaaatatttcgataaaacaggcaaaagatctgcttgcaaaggcagataaacgaataaaaacagtagcagtcgttgtctcaccgacaatagaacaactactgcagattgaagaagctggatttgattctattcaaattcatggaactatgattaaagaagtctatgaacggtgtcagcttccaattttaagagcatttaatatttccaatgtggaaaagttagaagaatatgaaataaaagataaaatcaaagggtatgtatttgacagcaagaatccaggaagcggagagacatttgactggaaactgcttgatcctatcagacaaaaacaaaaaacagagcttttccttgcgggaggaatcgatgaaaccaatgtaaaacgggccatttctgaagttgacccggatgtgatcgatttaagttccgcagtagaaaaagtaagcaaagatggagctttttgtggaaaggatccggaaaaaataaaaacaataataacaatagtacatggtcaataaaagataaaataggaatattgacaggaaaaaggcagagggacaaagggctcatgccgcaataaaagaaaggactttattatgcagaataagaaatatggtgaatacggtggacaatatgtagcagaatctctgatgaatgttttaaaagaattggagtcagcatataatgaggcaatcaatgaccctgaatttattaaagaatatcattattatttaaaggaatatgtaggaagagaaacgccgctttactttgcacaaaagctttcgaaaaagtatggtacaaagatttatttaaaacgtgaagatttaaaccataccggtgcccacaaaattaacaatgtaataggccagattcttttagcgaaacgtatgggtaagaaaaaagtaatcgcagagacaggagctggtcagcatggtgtggcaacagcgaccggagcagctctttttgatatggagtgtacggtgttcatgggcgaagaagatatggaacgtcaggcattaaatgtgttccgtatggagatgcttggaacaaaagtggaatgtgtaaagagcggaagccgcacattaaaagatgcaacaaatgaagcaatccgtacatgggcaaaaaatgcagaagatactttttatatcattggttcagccgtaggcccgcatccatatcctcagatggtaaaagaattccagagagttatcagcgtagaaacaaaaaaacagattcttgaaaaagaaggaagacttccggattgtgtccttgcctgcgtaggtggcggctcaaactccatcggaatgtttgcagaatttattgatgaaaaagatgtagaattaatcggtgttgaagcagcaggctttggaattgaaacaggaaaacatgccagtgcctttgcatccgggaaagcaggtgttcttcatggaatgcgttcttatctgctccaggatgatgacggaaatattcagattgcaagttcgatctctgcaggcttagattatccgggagtcggaccagaacatgcatatctccatgatagcaaaagagcaacttatgtttcaattacagatgatgaggcaatgcaggcgcttaaagaactttgtcaagaagaaggaatcataccagcaatcgagagcgcacatgcgatcgcttatgcattaaaaaaagcaaaaacaatgaacgaagaccagattatggtagtaaatctttcagggcggggagacaaagatgtacatactattgcagagtattttaaagagaaatagaaaagaagaatagaaaagagaaatagagacaaaaagattccaagagtacagtattctcatagggaggacagaaaacatgaatcgtattgaaaaaagaatggaagaattacaacaaaaaaatgaaaaagcatttgtaacatatatgacagccggtctgccggatatggaaggaacgaaagcattaataaaagcacaggacgaggcagggattgatattatcgagcttggaataccgttttcagatccaacagcagatggtccggttattcaggatgcatcctatcgttccatctgtaaaggaacaaacgtaaaaggcgtatttactgctgtagaagaagtaagaaaagattgtgaagtacctatcgtatttatgatgtactataatacaattctttattatggcgtggaagcatttgctaagaaatgtgcggaaactggcgtagatggtctcatcatccccgatcttccaaaagaagaacagtttgaactggtagaggcacttgaacacacagaaaatgccccaatcctcattcagcttgtcgcaccggtatccgcagacagaattcctatgatcttagaaaatgcaagaggatatgtatattgcgtatcttccatgggcgtaaccggacaggcggcacatttccataaaaacgtaagaaattatctggaaaatgtaaaatcagtatcaaagattcctgttatgatgggatttggaatccgcactgcagaggatgtagccggattaaaagatacgattgatggctgcattgtcggaacacattttattgaacttatggaagaaaacggttataatctggatgtggcaaaagaatatatccgtacattcaagaaggaattaaacgcttagaatatttttgcaaatggacaaagacaagaaagtggcatataataaatgcggcttttttgttttttcataaattctaaatggattataaaatgatataaataaaagaacatcgaataaagaatatctagttaaaagaagatctagttaggaaaggagcaagttactgtttataactttttatgagttttcagtagtagatgaattaggacaatgaaaaaagaagtaaaaacaaatgtaatgcgtattcttgaaaaagaaaaggtagattatgaggcacattattatccgcatgggaaagaagcagtggatggcgtgacggtagcagaacttaccggacaaaatcctgactatgtttttaaaacacttgtaaccgtaagtaataaaaaggaatactttgtgtttgttattcctgtagcggaagaacttgacttaaaaaaagctgccaaagcagttggagcaaaatctatcgagatgattcatgtaaaagatattaataaaattacaggatacattcgtggcggctgctctccggttggcatgaaaaaacagtttgttacaacatatcatgaaacagcacagaacaatcctgtgatcatggtaagtggaggaaagattggaacacaggttgaatgtaaaccagatgaactgttaaagattacgaaaggacagtacgcagatatttgtaaagattgatctttccacaaacagctattttagctgtggcaaagcaaagaaaaagaaacggcaccttttagatatggtcatatagtatctaagaggatgtcgtttcttttttctattttaaaaacagtttttaataatgtctggatcaagtccatttttacaggttgcttttcctactgcaaagtacaggactgctccggcaagaagcccccatacgacagcattaattccggcaacatgtacattataatagcagaatacataagtggcggcggcaccgattgaactgctgacggctgcctgcttcgttccttttttccagaatagtccgccgataagaggccagaagaagctgcattccagaccgcctaaggcaaatagattcaggaagaaaatgatatccggtgggttgatcgtaagtaaaataacgataacgccgaaggcgaaagtaacaagtgtgcttaactttccgacatttttattataggaagccacctttaccgggtcatcttttacaacatagttacgccataaatctttcacgatcgcagcggaagcaagaatcagaagcgagtcggctgtagacattacagcagccatcggagcggcaaggaatgttccagcaagaccgactggcataatcttttgaacaatgtatgggataaagtaatcagaggttggaagattacttgtatccactaatgcacctgcccatgtaccggccatatgcatgccgacaatgataaaactacaggtgatcgctccgatccacatagcggaatgaaggctcttcgtgtttttaaagcccatcgcgcggacagcagtctgcggaagtccgagcgtaccaaaaccgacaagaacccagaagctaagcagagtaccaggagtatatacagagaaaagattgtcatacacaccgggaagattcttcgcaagtcctgcatcaattccggcaagtcctccccctgcttttaatacaaagaaaataaacaaaaatgtaccgatgcacataataattccctgaattgtatctgtgatagcaacggcactgaagccgccaaaagaagtataaataataacgactgcgccaaaaatcaacagagagacgacatgatcaagcccggtaatagaagaaatcaaagtcgctccgccggtaaactgtccgatcatctgtgccataaaaaatgcgaccataagtaaactggtaataataactaaagcatcacttttataacgtgccttcagataaccgacaacggtaacggcaccagttcttcttgagaccattgccagcttattaccaagcacacctaaaactaaaaatgtaaccgggacctgcactgtagcaatccatgcctgtgcgtatccataagtaagtcctgcggcacctggaccggatataaaagaactgacggaagtgtaagttgccatagtggtcatagccaaaagaagaccattcatatttctcccgccaataaaaaactttttctcagaggatacatgctgtttacttccctgccgtttactgaatacaataccgataatcgcattcaaagcaaggtaaataacaaaaataccaagaatgactttctgatctgcagacattattcttctccctcctcttcgtcatcatattcaaaatcaataaatacatgctttaacaaataccataccccaagtaaagagagtacgatcgtacctaatgttgacacactgaaccatgctggcataccgagaaagtaaagaccacttccgtttagtaaaaatgcacttaaaatatgccatgcacaacagatggcaacaacaactaatgttccacgaatttcgcggatacactgttcgtgtttctcctgtttcgttaaattcttcatctttcaaatctccttaaattaaaggtcagagtcgtaaaaaagatatctgccacaaatattatcgtataaaaaagaaagaaaatcaatttaaattttctttttttaatggacattctaatggatgaaattaattggacgattgcctttagatatctattgaaaaaatacagaatatgagatattattttacgacaaagaaaaactgtcaagaaaaagaataagaaaaataagacaaaataagaaaaaataagacagcgaaaggaagatagctatgaaaagtatttacaagaaaaaggtacacctgttgctgctcgcggttctgtgcctgaccgttttattatttataccgcagaaagtacaggcagcggcagtgaaaaaaccttcgcaggtaaagaacctcacagtgaagcttactgcaaaaagggcggcaaagcttatctggaaaaaagcagcgcatgcgaagaagtatcaggtatactgttcagtgaatggcggcaagtataaaaagataaagacaacaaaagctgcctccgttacacataaaaaactaaagacaggtgcagtttatgtttataaagtaagaggaatcaatcagggcaaaaaaggcagttattcttctgtacaaagaatccgtacactggcggacaccaaaccgggactttcggctgcggtaactggtacaacagcagttttggaatggaataaagtaaagaatgcgaccggatattatttatataaggccggagccaatggaaagtggaataagataacagcaataaaagaaagaagctatgtcgtaaacggtcttgagttaggcggagtttatagttataaagttgtgccatatttaagagcagacggaaaaacatttaaaggcagcagttcggtaaagaagattacaatgccagcttccggctggttattagactacgtgcagccatatgcgaaaccattaagctatgaaagctacaatgcacgtgcctttacgatgagaggaacttcctatacgcatggatttgcagtaagaggaacgttgcgcaatgatgaaggaatctattttaacttaggaggaaaatacacttctcttacttttaaaacaggtataaaagatgggaaatatactgctcgaagaccagcaaaggtaacgatcaaggcagatgggaaaaacatagaaaacggaacctttgagattaaggatgacgaagcgttctccacacatacgattaatgtaaaaggatgtaaagatttaagaatttatattaagggttttgttacagaatatggatttgcagatgtaaagctcagtaaataaaattaaccccttgacattttccccaaaaagtatataatagtgatactacggttcaaagaacccttatgggggcttgtactggtttcgacggggattttgaacgtggggcagccatctgtggtccgggaccacattaaaactcggaactaaatataaacgctgaagataatttagcatacgctgcctagttgcagctgtcggccttagtttccccacagattaagagtccggcaccgaatatgtgggacactcgtattccaaagctttgcggagtatgaagtaatatgaagctactgaaatccggagtttgtctttagacgccggacagagggaatgttaaaatagagactgtgatgggagataccgtacggaataggttttcggacaggggttcgattcccctcaggtccataagagacccatgaaatatgacttatttaagccatatttcatgggtctctttttctttacttacatcattttgcctactggccttatatcatatgcaatttttattttcaatatgcatttttttctataagttgttattctgtattgcgatattcccccccccagataattgttcaatgcgacaatataatacaatataataaagtcgaagaataatagtgtggattcatcatgatatttgccaaaacgtgataggattttttgtttgcaaacttgttcatcttattgtaaaatagagcggatacttcatatggaagaaaagagaggacgaaagaatgaatgcaaaagtaaagggaatcacctatgctcttattggaggaacatgctggggattgtccggtatcgtagggaagctcctttttgatacaaggggattgaatgcacaatggcttgtgacggcaagacttattattggtggatttattatgctgctcattgcctttttgcagaaaaaagagaagatttttgatgtatggaagaataagaagacggcatgcagtatgctgttatttgcagcatttggaatgttagcgtgtcagcttacgtattttttatgtgtgcagtattccaatccggcaacggcgacagtgcttcagtatacttcgccggtcatgattatgattttatgccttttccttgataaaaagctgccgagaataatagatatccttgttctgattgctgtggttgcgggtgtttttcttatgtcaacgcatggggacatccacactcttgcaatttcacaaaaggcattgatccttggaatgatagcggccgttacgattgtattttatacggtatggccggtaagtcttttaagagagtttggatccccgtccgttattggctggggaatgtttcttggtggaatcatgctggcaccattttcaaaattttgggtactatccgggaagtgggatgggtatacggtaatattagttggaatcgttattatttttggaaccgtatgtgcatttacctgctatttaaaaggtgtcatgtatttaggaccgataaagagcagtctgttttcctgtatggagccgcttgtctcaacaattcttacagtcacagtactgcatcaggcatttgctatggcagatcttgtcggaattgcagtcattattatcagcgtgacttcgttagcggtaaatgatgtgattgaagaagcaaagacacataaaaagaatcaaacagaacaaatggaacaaaaagaatgaaaaagtcagaaaaacgtactaaagtatatttgttagatagaactaaaatagcagatccggtaagtttttcttcgtggaaagactttcttccgaaagaacgatgggaaaaaacagtccgtccggtaagagaagaagacaggaaaacggagcttgctacctggcttttgttgtatcacgccttaaaagaatggggaatcccggaagaaagtattcatgcagatggggcatattgttatggagagcatggcaaaccggaacgaaagaagaaagaagtctgttttaatctttcacattccggaaagtatgttatgtgtgtagtgtcggatgtagaagtcggttgtgatattgaaaagattcagaaagtaagatggaaactggcaaagagatttttttctgaaggagaatatgatattctggaaaagttaaaagaagaaaatccgggggcagaggaagaactttttacccggttctgggtgttaagagaaagctatgtgaagaaaacgggcgaggggcttggactctcgcttgagggcttggatttttcggggatatcaggttataaaggaaaaaagaatgggaaagctttaaaagaaagattttttgaatgggaatatgacggataccggattgcggtttgtgaggaaaaagacggtgaaccggaacttgttgtatgcagccggactattgacaattgttttctttaataatataatttgtaactatgcagagccatgcagattttcaataaaaaggagagggacgatggcagtagaaggaacaaagatcaaagagatgatggaaggaaagactcttgagaaggataatataaagaagatgtacgatatggtgcagaatgcatcagaaccagaagagaagaagaaggttatgaaacattctgttttttttattggacagcttccattaaaagagaatcatattgttgatttggaacagacaagaagaattgtaaatggaagtgtgccatttgcagaagtagacacctatatggattatctgttaaagggactttctacgcagaggcttcttttagagaaagaagatggcagctatgaagtgaatacgaagtatgagaagtcagtgataaaggttcgtaagattgccagagcatttcagcttgaacaggagaaggcattagaagcaggaatccctaaagcaaagaagatgtaccagatgggaacaaagtactatcattccggacagtatggagaagcggcagcttgctttatgaatgcagttgaactggcagaataccgtatggcttactatagccttggtttactgtattttaagggacaaggtgtggacagatctcttgagaaagcggtttattatgccagaaaagcgcttgtaaagggtgcggtgatcgcacaggaacttgagcaggagattttagaggcgatgaacgcttaagtgtgtaagaatgtctatacattcttgaaagtgatcaggattgataatcaagattaattaagtgaaaagtagttaaaaagaagattagttaaaaagaagagtggtttaaaactagaaaggatatagttgattatgaagaagtttgcagtaattgcacttgcagctgttttatcaatgacgatgttgaccggatgtggtaacagtaagaaggcagcggaagcgacaacagaagtaaaagaagaaacagtagattattcaaagggactgaatgcggacggaacgttagaaggggtaaaagcatctgactatgtaacagtttgtgattattcctctttaaagattgcgaaaaaagatatagaagtatctgacagtgatgtgcagagccagattgattctattttatctaattataagaagcaggttacagatcgtaaagtaaaaaagggtgatgtagttaatattgactatacaggaacgatcgatggcaaagagtttgatggcggctcagctaccggtgcgaatcttacaattggttctggaacgtttattgatggttttgaagatcagttgattggtaaaaagccaggagaaactatacaggtaaaagtaacgtttccgaaggattacacgaatgcagatgttgccggaaaatatgcggtgtttgaaacaaagattaattatatcgaagaagaacagaaactgacagatcagtttgtaaaagagaacttagtagattcttatggtgttacgtcagcaaaagaaatgaaaaagaagattaaagatgagatttacaagtcgaacaagacagattacatctggaatcatatgattgaaaagagtacgtttaaagaaattccggaccagctgatcaatgatcgtatcgatgttcttgtagacggattaaaggcagagttaaagtcatcgaattattctttaaaagattatctttctgcatacggtattgaagatgaagatgctttgagagagcagtataagagcagctgtgaaagtacagtaaaagtattcttagttgcagatgcaattgcagcagagaagaagattgctgtaacagacgatgatatcaaagaatattttaatggggaagatacggcacagtatgagaagttatattctaaaccgtatttaaatcgtgtcgtattaaatgatcttgtattaaaagaaatcgagaaaactaccacagtgaaataattaataaaaatcatatggctgcattggcaatagaccgatgcaatcatatgatttttttatctcagtcgagaagactcccacctctttcaggcggctcgacttgaattgtttcataaataatattctataaaaaatttaaaaaattcaaaaggaaattttgaaagtataattagcttttcacattgtcactaacgactttataatggtcaaaacagagggattcatcataatatattctgtccttatcgatgatctttgcctgaccttcttttgcatcaataatggttaccgcacagttataaggaacacgctcctgccagaagctgtctttattctcgtagagaggattcaacatggcacgaagagcgcagccatgagttgcaataagaatagtcttgtcttcataagcaggattatgaatcagctcgttaaaaaaatcagcagttcttttcatgacatcagcaacactttcaccatccggtgctccctgatattgaaaaggatcagtgtagaagctgttataatttggatcaggaatttcaaagttactttcaaggcagcaaagaccttcccaggaaccccagttaaactccataaggcggcggtcttcaatgaccggaatcttctttccaaaaaatgcttccgaagcggcaacggcaagttcgccggtttctctggctctttttagagggctggtaataacaaggtcaaaaggtacttcttttaatgcctcgccggtaataactgccagatcccggccgcttttattcagcggttcatctgtccatccctgtaaacagcctaaagcgttcagtttcgtctcgccatgtcggataatataaagtcgcataggtaaatcctccctctgtaaagaatgtactctcggagtctttctcacaaaatcaagcacaaaaagattccgagaatacataagatgtatttataaaatcaagtatatcaatttcggcagggtatggcaagatacgagggcaggaaaaggatagagtgtaaattttttattgacaagaaggtatacaatatggtaaatttcaagttagtagttaacaaatggaaatgcttgtgttgtgtgagaatcaggatgtaaagtgataagtaagggagctgcatttagatgacaagaaagaggtttctaatgcagttttttttgagcatataagtcataattataatcgtattagttttagaatgacgggagcagtgttaatcagaatagtccaaatgatgttcgtaataattattatttttacagtaagggaaatgtaatttacactggcgtgggacatctttccggaattaccgatacagaacgtaatttgtttgcgaatgccgttattgctgccgcaaacgttacggcagttgatccagaagccccgtttcttgatgattttgacccggtagctgcacaggaagagtatcgttattatatgccggaccgcttaaaagcatcggaagctggtgctacatcaaatattttagatggggacaatacgttttgtattcgaatccgcgactacaacatggtcgcatcaaacttaagcaatacggacagtaacgcaaattctcttacaatggagctgtatatcgaagataataaaaatggaaaagagatgaatatcaatggcgaatctgcaaaggtaagtaaaatttcagtgtccggaaaggcagatatcctgaaaaaatattcggacggacagacgatcacagttaatcaggaaggacagtttaaattacaggggaatgataccttccagtttagcttaaacgatatggaaagctatttaaaaggaataaatacaacatataaaaaagaatgtcgtatttttgcgaaagtagatagtacagttaccttatatggggtgacagctaataaagaaacctggacttcggtaagtttaaaaccaagacaactttttgatttggattagtcagaaatatatgatatactttacataagtccggcagatactggtctgccggattattttatgtggattataatacaaaaagattgcaagaagatataatatatatagataaaaaggggagaataaaatggcagcttacacaatcgaaaatgaaaagttatctgtaactattgatgcgcatggggcagaacttagcagcatttatgataaggaaaatgacagggagcttatttggcaggctgacgccgctttttggaatcgccatgcaccggtgctttttcccaatgtaggaaagtattatggtggacattttacttataatggcaaagcatatccaatgggacagcatggatttgctagagatacggaatttgagcagatagcagcaggagaagatttcgtaacgtatcgtttatgtgccgacgaggaaagtaaaaagaaatatccgtttgattttgtgctggaaattacgcatagattagagaacaatcgcctatcggtagaatggaatgtgaagaacgtagatgataaagaaatgtattttacaatcggtggacatcctgcatttaacgtaaatattcttccagatacagattttgaggactattcgcttgtgtttaaagaaggaatagaaactctttcctatattcttattgatgcagaaaacggtactgcactcactgataaaacatacaaactggaactgacaaatagcaaatatgctctgaaaaaagatatgtttgataaagatgccttaatatttgataatggacagatcgaatgggtgggattagcattaccgaatggaaagccttatattgcattagaaagcaaaaacttccctaactttggaatatggtcgaaaccgggcgcaccatatgtttgcttagagccatggtgcggacgatgcgataataaaggatttcaaggggagatttctgaaaagccgggcatcaacacattaaaagccggggaagtttttaaaaagtcctatgatatcattgtatattaatatcacgaattacttcgtagctgacgctgctcccgtaattctgaaacattcataattgctcatttttctatgaaaaatgggctgcttaacagaaaatatttgtggttaatttggaagaataaaaagtactctcggaatcttttatgtgcttgattttgcaagaaagattccgagagtacattaaagtgataggagggcgagctattggcaggagcaaagaaagaaaaaaagcatattgttgtatttcaggatgaagagggcaatgtcttaaagacttcctttgtttcgcatgaagaagaggcgattcctcctgaacttcccaaaaagaaaggcgaatcggagcatcatgaaataaagtttcaaggatgggaccaggatatttcctgtgtgcaggggaatcttgtggtaaaggcggtttataaagaagtaccgaaagaatatctggtgatgtatttccatgagagtggaaagttacttggaacagaaagtgttccatacggtcaggcggcatcacagccatatcatccacaaaaaccaaagacagcggaacactattatatttttaaaggctggaataatgatctttctcacatagaaaaagatacgatggcaaaggctgtctttgaggagagggaacgctcttttacagtagctttttttcatgaagacggcacagtattaaaaaaagaagaagttttatatggacaggaagcacatgcgccacaaagcccggtaaaacagcaggatgcagtatggcattatatctttgaaggctgggataaaacctttgatagtgtaaaagaaaatatagaagttcatgcggttttttcatctgtttacaatgaatacaacgtatgtatctatgaacgattatcggaaggtaatatcggtttacaggatgaacaactagaagaaaaaataaaagaaaagcaataccattacggagacttaatagagtatcccaagttaaagaaaaagggatatacgttacgctgggataaccatccggaaacagtaacgcaagatgaagaaattcatgcaagctgggagttttcaaatccggcaggcagggtagccgaggtggaaggaaatcgctatgaaattataaacccgtccataaagaatggaagtgtccggttattatattatatagaagataccagtcagattcagattccggcgcaggtaaaaatcggtgattattattattttatagaaagagtagcaccgaaagctttttgcgattgtagaaaaatgcgttcgcttacgttgccggattgtattcgggttctggaaaaagaagcactcgctggatgcaggcgactagagaagattactttaggaaaaagccgtaattccagactgcatagtatagaaaaagaagttttttgtgaaaatgagcatctaaagactatttatttaaaaggaagaaacttgcaaaaagtttatgcagatacatttgcccgattaaaaaacgaagtagaagttcatgtacgtccggaaagcctggcgaatatgaacaggctgcttcaaaaaggagtaaggacaggtaaagtgaggataagagctggtaaatgaaagagcgaatccccaagctatgctgggtgaatataagatataaatgccggtattatatagtgcttataccaaaataaaaaaataggtgacaaatatcagatatagtagggggaagaataatatcagatgtgagatgactcccacctcttcaggtggcgacaaattagtatcagtggtgggagtcaatccaccatctgatatagcctccggcaggattgcagagatgcgcaaaagaaatatgtcatgctttgcatgacgcgcatctcgcagcaagaatgccgaggtattcttgaattttgtaaaagaaatagtcaatttatctataataatgataaaaaaataacaatatattaaagcaaaagaacacacagggaaagaaaaatacaaaaaaagtacagtatacaatgctttttaagaaaaataaaatttattcaaaaaaagcttgactcacatataatgttgtgatattataatatccgttgcacacgagaaacccatttttcttggaaaaatgaaaagaatcttaaaagaaagttaaaaaacttcttgacagattagaagttgtgtgatagtatataaaagttcacatttgaaagagagaacagacttcttaaaaaagaaaaaagttcttgaaaaaagttcttgacaagaacttgaagatgtgataatataattaagcgttttcgaaagaaaacacaaaaccttgataactgaataacaaaacaaccttgaacgttaattcaaatttcattcgggttttcctgagagtgatgtctgcagggaagtccatggaacagaacgaaagttcaaaacctaaataaacag

SEQ ID NO: 422 - DNA, 39789 bp, Eubacterium hallii
tctttcctactaacagattggaaccttcacccttcttagtgatttctgtcattggaataccaagctctcttgaaagaatttccattgttctaggagtacagaaacctgcctggcaacgacccatacctgcacgagttctacgttttacaccatccatagttcttgcaccaagtggacgattgattgcatccatgatctcgccttcagtaatcatctcacaacgacatacgatgctgccgtattctggtttttctttgattaaagcattcttttcttctaaagtaaggtcttccatatggataacatctttacgttttgcgatgaagttgtctttctctgggaaatgatatttatcctgaatctgtccggcaattctctcagcgatcgcaggggaacttgtaagtcccggagactcgattcctaatgcatcaaagaatcctggtgcatctttcgcttcttcgataatgaattcatgttctggtaaatgagcacgaagtcctgcgaaagaagtgataatcttattcataggaagttttgttcttgtaaggtagctgtgctgtgctttgtaagctaaatcatcaagaatatcctgtgtagtttctacatcatctttaccttctatatccgttgcagatggtcctacgaacatatttccatggattgtaggagcacagagaatacctttacccatcttacctggaagtgggaatacagttgctgagaagtaatctcctaattctttatcaagaagaaggtactctcctctacgagcgatgatatgtttcttatcttcacttaccatgttatgaagagtatctgcatatacacctgctgcattaacgacgatctttgtctcaaatgttcccttatttgttactacttcgtaatgatcatctttcttaatgatgttctcaactgcatgttcaaacttgaattcacatccgttcattgcagcgttctcacccatagcaatcgcaagtccccatggacaaataataccacctgttggaacataaagagcagctactgtgttatctgttaaattcggctccatcttaagagcttcttctttatcaatgatacggcatccaggaacaccattctcttttgcctgctctaaaagaacatctaacttacctctttcttccggtacagtacagacaataagggaaccgttctttttaatagggtaatccaaatcctctgctaattcataaagaagctcgttacctcttacgttcatctctgccataagagttcctggtttacagtcataaccaccatgaacaataccactgtttgctttggatgttccagatgctacgtcatcacccttatcgattacgcacatatttacctgatacttggacaactctcttgcagtacaagtaccagtaacaccggcaccaattacaataatgtcatacatatcttcttatacctccatttgttttggccgcatgacaataagctacgcattccctttctgcttatctatgcaataaaatatatcggaaaataaataaattcaccagtcgattgctcacaaaaaaatacattccgataaaactacacaaatataatcacttttgtcacccgtttctatatgtatatattacaacattttctttgttctgtaaattatacacttttacaaatgtgcttaatattttgtatttttccaaagtgtttgggaaaattcccgaaagcaacataaaaaattactcttactatttcattcattatgaagaaaaacagacgaaaaaagaaatactaccatatcccatctgctctgtagtcgctgtgtttaagatgcttatccgcatcttaaacatgctccgaagccgcatctgggatatggtagtatttcttttttctgtgttttggctccagaaggaatgaattcaatagtctttggatagagatgggggagaaatcagaagactactgcttgctcgaaagatgcatcgtcagaagcttaggtgctttctttatataatatactctaattcaagaatacctcggtattcttgctacaaaatgtgcatcatgcaatgtatgacacgcattggtaaaagcgatatattgcgacaatataatgataaatatatcatgtacagcgatagcttgcagtatcatcttatcatcagtgaaacttaaaaagtcagtatagtggagggagtatcgcatatgtgatgtgggagaaagtaaaaatgccggcaggcatactttctgggtagcagtagacttctaatctcttccccttatctcccccaaagactattacattcattccttctggagccaacaagcagaaaataaaaagaacagaccattgcaaatataatgtgagaacaagtaaaaatggcgggcaagaatactttctgagtagcagtagacatctgccgcctcccccttaatcgttcccaaagactattgcattcattccttctggagccaacaagcagaaaataaaaagaatagaccattgcaaatgtaatgtgagaacaagtaaaaatgccgaacaggcattttctacgcagtgatatctttacagttgcaatggtctattctttttattttcgtttgttttctctaatgaatcaaatagttgacttattcttttttgtctactacaatagtgctagtgttatggtactaaattagtatatttcagaggaaactattttgtctgaaatagatttttttaatgtatctgaatgactacattacagattggagaaaattatgaacaatgttatcgagatgagtcacccgcttattaagcacaagatttctcttttaagggataagaacacaggaacgaatgaatttcgtaaattaatcgaagagattggtattttaatgggctatgaagctttaagggatcttccgttagaagatgtggaggttgagacaccaattgagacttgtatgacacctatgatttctggtaagaagcttgcgattgttccgattcttcgtgccggtcttggtatggtgaatggtattctggctcttgttccaagtgcgaaggttggtcatattggtttatatcgtgatgaagagacacatgaacctcatgaatattattgtaagcttccggacccgattgatcagcgacttattgttgtattagatccaatgcttgctaccggtggttctgctattgctgccattgacttcatcaaagctcatggtggaaagagtattaagtttatgtctattattgccgctccagaaggggtagaacgtcttgcaaaggctcatccggatgtacagatttattgtggtaatattgaccgtcaattaaataaggatgcctatatctgtccgggtcttggagatgccggtgatagaatcttcggaacgatttaaatctaacttttatgccagtattagttagattctataaaagagcccttataaaaagcccttattttgaggctctcatttaagaaaggaaagtattatgttagaaaaactttttaaactatccgaaaatcatacggatacgaagacagaggttttagcgggtattacgacatttatgactatggcgtatattttggctgttaacccaagtattatggccgctaccggtatggattccggagctgtatttaccgctactgctcttgccgcttttgtcggaacattactgatggcgattttcgcaaactatccatttgctctggcaccgggtatgggactgaatgcatactttgcctatactgttgtaatcggtatgggatatacctggcagtatgcactgactgctgtatttgcagaaggtattattttcatccttctttcccttacaaatgtgcgtgaggcgatttttaatgcaattccgatgaacctgaaatctgccgttagtgtgggaattggtctttttattgcatttgttggtttacagaatgcacatatcgttgtgggcggttctacattactccagttattttctgtagatgcgtacagtaaagcgaatggtgtggaagcttcttttaacaatgtcggaattacggtaattcttgcattggcaggtattatcattaccggaattttagttgttaaaaatattaagggaaatatcctctggggtattctgatcacatgggcactcggcatcatttgccagtttgcaggactttatgtaccgaatgcagatttaggattttacagtcttttacctgactttagcaaagggctttctattccaagtcttgctcctatctttggaaagcttcagtttaagggaattttctctgtagactttatcgtaattttatttgcatttttattcgttgacctttttgatacgatcggaacacttgtcggtgtatctgccaaagcagatatgttagatgaagagggaaagcttcctcatattaaaggggcacttcttgctgacgctgtagcaactactgttggtgcgattctcggaacttctaccactaccacttttgtggaaagcgcttctggagtatccgaagggggaagaacaggtcttactgctgttacaacagcgatcctttttggattatctctgtttttatcaccaatcttccttgcgattccatcttttgctaccgcacctgctttagtaattgttggattatatatgcttagtaatgttacaaacattaacttcactgatatgtccgaggctatccctgcttacgtatgtatcattgcaatgccattcttctacagtatctccgaaggtatctccatgggagttatcgcttatgttgttattaaccttatcacaggagaggcaaaagagaagaaaatcagtgcattgatgtatgtactggcaatcctgttcatcttaaaatacatttttctataattttcaagttttctaaagcgtgtttgaaaaattatggggctgtcgcaccaaaaacagccctaccctatggcagggattcatgcattgcatggaatcactgctatatttttataacaagcgtgggacctatggtataaagagcagacgacttgcgttttgcgactcaactttcgaacgtttatggaaacgccattcgccacgcccgatgccaaaagctgtttttgtttccctagtctgtagcaaagcaaaagaaaaaagccgaacttttttgcaaagaacggctctgggtgtataattatgttatgaaaactacaaaaaattatacagaaagaccaaaagaagaccaggtgacaacgcgtcagatgttcaagattgtaatctatgctgccatgaaccatatctattccagcagggatattgaaactgcctgatcttttcgtttatcacattttttttgcacagttttctatttttcctgcctgtgttccataccatattgttccatcatcttcacatacgcttcctcctctgcctgtaatgcatccccatttgcccagaaggacagagcaaatatagaaatacaaaatagtataactgtgcttagaattcttatgattccatatttgtacgcttttttatcaaagagttctagaaatccttgtgcggtcaaatacccgacaaggaatcctgctgtatttgcaatcaggtcatcaacttcagggagtcttcctgtaaacgcctgaaaaatttcgataaaaagagaagtaaaaaatcctatgagtattgctttttcccagctcagttttttcttatgaccatataaaataaatatcagaaacccgtaaggtgcaaataaaaagcaatttaacgtcaccatttttattgaggcacctttaaatggaatatttaaaagtgaagtcatattcggaaccgagtatacataagtggagatgtcagttctgataattcctgtaattgttaaaatcgtgcacagataaattacgagcaataattcacaaaacagatacttaaatccatatttttttagcctctctccattcctttttttcagcgaaaacaaaataagattccaaagaagccatagaatcattcctaataaaatacattgcttagcctcccagattccatcgataatataactaatatagcttctcatactcacctcccacatttgaatgaattacattactcctttaataattgctgcatttcatcatctgtacaaatagaatagcaatatatgctatttcctccatttttattttcataatttacctgaatatccatgtttccatttattacggttattcctggaacatttaccatctgctgaagaacaagtttctcttttactttattaattcgttttttatctgttattctatatctggtattttctccggtattttcatcatatccttcaacccaaatactactgatatttaagttatctattgtctggttgacagcacagcctttttgtgctaaaaatgcaagcgtctttttaaaagatggataaatataatacgtatcctgtgttgcattttcacttcccattgttccacctattgatatatctatatttcctacgggaactgttttttgtacatctgtgtagcttaagccgtctaactcacttaaataagtatcaaagaactgctttttctcttcttttgtaaggtttaaatattctgtttctatccctgaccaggttatttctttaatatcattataatttcctgtatagagagaatagatattctttttaaattctcttgtcgcatacagtttattataaagttcttttgcctttttggaacgaagggtatagtttcttactttacggtttccgtttttcatacaaaatgttgtagaaatctcaatatcaccgctcatcacttcttttttagatacagatgcaaagaataaaaacttgctgtttttctcatagtaccctgaagaggatgtttctgcactgttttttacttctgctgattctttgattacggaaagagcaagctgtttttcttctccttttaatcctgcccgttcttctcctttcccccaatatccgtaactattcacttctgttggctttatttcgatgctctcgacactggatgctttcgggatatacctgtcatatccaaaaagatctgcactaaagcttgccatgataaacaaggaaccaagcatgatgactatgagttgttttttatgacaaaaaatcgctcttacatcaaattcataaatgcattcaattaatgcatgtatgacgaacacaccaaatacaactccgaatataagccagaaaatggagcttgcatttcccaatgaatagaaaatgattcctgaatataaggcagatggaatgactaatgacactttaattgctgtatttgcctttgtaaatgccatggcccgtcctgcactttctgccggtcgtctattatagagcgcgcggcacagtacatataaaccgataatccataaaagaagaatcattatatactttatctgtatttctctgctgctattgatatctgccattccccgaagtccgatccataccggagaaagatagttggttatattattataaacattatctgctgtattcccagaataggtggcgaaaaaagagccggcatataatgggaaaatgttataaataacaattggaaaatagcttgcaaataccccaaatcctaatataccaacgataatattccctgtcataatcattgccagcgccatcgtcagccatgttgctgtaaaaattaacaaataccagagactagaactgattatttcccatcctcctccagaaatctgttgctgcgcaatgacaaattctattgcttcttctacaacaagcggaatcagaaaaataaagaggctgttttgtactaccagccgaaataatgtcgctctctttatcggaagggattcgtaaaaatctgtctgctttctggaatgtaaataataaagacttactgccgcactgcatgccgccaggccgattaccgcacctgccattcccatattcgggcgaaacaaacgaagcacttcatcatgtgaggaacattcatttactcccattactaaaaaaactgcttttataaaaaatgtaagcactgtgacaatcgtcatgccaagcattctctttctattttccctgcttagcttagagtatgagattcttgatgtcataacctactacctccgtttcactgataaatatttcttctaaagacagcggaatacattcataaaataccggttttaatacagataacttcgccattacctgttcttcactacccctgactgtcattgtgacaagctttcctcttcggttaaattgtaaaatgtcaaacattttctccagcttcttgtcatcctctcctggcaatgcacactgtactttctgaatattacacttcatcgtttctaaatctttcgataagagaacaccacccttatgcagcaatccgacatgatcacaaatatcttctaattctctcaaattatgcgatgcaataatcggagtaaactttctttcatcaatttcatttgctaaaatacttttaatcccctgacgcataaccggatcaagcccgtcaaacgtctcatcacagaacaaatactctactccactgcatattccaaaaagaatcgaaagctgctttttcattcctttagaaaatgtctgaatcttacgatctttttgtaaagtaaacttcaccagaaacttacggaatctcttctcattaaacgcaggatacaatgtcttataaaacgctgccatatctaacggtgtcgcatttggaaaaaaatactgctcatcagaaatatagaaaaatttctgcttcgcttccacgcaatcccatacagcttccccatcaatcagaatctctccttcctctggctttaacacccctgccatcatacgaagaagggtactctttcctgcaccattcgttccaaggagaccaaaaacctgtccctgttcaatagaaagactgacatcacttacggctgcaatcttatcgaaacgcttgctgaccttcttaatttctatcatctttccacctcctcataagcttcattaatacaggccagcgcctgttctttcaaaatacctctcgctctcagctcctctacattttctttaaacttaatcagaagcttctcctgttcttttataatcagattctcattcatcttcacaaaattccctcttccctttacggaataaataaatccttctctctccagctcactatatgccctctgaatcgtattgggattaatcgaaagttccatcgccagcgaacgcactgatggcagctttgaatccggctccagcactccattcaaaatcaatgtctgaatcttctctgtaacctgttcataaattggtcttttgtcattatagtcaataaaaatcacatcgaacctccttcctttctgtactgctaaattcaagtcgaacatccgtgagacttggcgcgtgattctggtcagcgaagctgacatgttcctatcagaatcactgcacatcctcgtggagcgtttatctcagtcggagattggactcccactgagacaaatttgctattactcaccacctgaagaggtgggagtcttctcgactgagattaaatttcaaaaattttaagcgtgcgtgatttgcgatttcttgttgttcgaagtgtattaaacatgttagcagtgtattaatactattaatacacttaatataccttagagataccccaatgtcaagggggagacgaactacggtaaaaggcttcttccttaaatttattgattttgcaatttcatcagcttttctcttgacaaattccatatatgtattataattaaatatataaaatttttatatataaatatttaaaacatagaaaggatgtgattttatgttttactatccactttcttctttactgatcgaatgtctgattctctccattgttgaacgagaagattcttatggatatgagatcagccaaacagtgaagctggtggccaatattaaggaatctacgctttatccgattttaagaaagttagaacagaatggatacctgcatacttacagccaggaatttcaggggcgtaaccgcaagtattattccattaccgattccgggaaggagcagctcattttcttaaaaaaagaatggaacgaatattatcacacaattgatgacatcatcgaagggaggatgatacctgatggaaaataaaagatataaaaagaaacaggatatccatttaacaaaagaagaatatcttgcccagctaaagaaatatttaaaaagacttccaaaagaagattacaacaatgcgatggattatttcacagaatattttgaagatgccggttcagaaggagaaacttctctgatgcaagaacttggtacaccaaaagaagctgcctatgatattcttgataatctgatcagcgaaaagaaaaaagatcccggcactccggtatggaagatcatgctacttaccttccttgcaatctgtgctgcacctctcggcggttctctgctcattgctgtgattgctgttgcacttgcctgtgttcttgtaatcattgccgggcttctatgtatttttgctttaggagctgcctccgttattataggaggaaaactttttctccggggcgcagttgccataaccgcatctctttctggtgcaagtttaatttccggtgcaggattatttagcattggacttggtattctcgctgttttagcagtcatttatttttgcaaatggattattttaggacttgctcatctgattcagaacatgagcagaaaaaggagtgtgaactaacatgaaaaaaactacaagaacacttttaggaattggcggtgctttctgtctgatcggcgcacttttatttggaatcggatttgtgagcggtggcacaaagtacgttcatgccacgaatttaaatacaatgaatgcacagtcagatcaagatgcaaaagagaatcattttacattagaaaaaacagaactgtctgattttaactctttaaatataaacttaaaaaattcagattttaatataaaagaatctcccaatgagaaaagctatattgaatatgtgcaggagacaacaaaggcgaaaaaccctctctcctattccataaagaatcatacattaactttaaaagagaatggaaacactggagcttcttacactgtttctgtcgatatcagttttttgcaacctcttctttcgggaaaaaatatggcttcctacatggacgaaaagtccaactataaaaactatgtcactctctatcttccgaaaggcaagctgttgtcttctgccaaagtcaatcttggatacggtgatttttctttaaacaatgcttcccttaacactgccgatatcacacttgacgatggagatttcattgccgatacgataacagtaaatggcggaacgatttctctttcttatggcgactgcgattttaaaaaagcttctcttagcaacacaacgattaaatcagccgatggagacatttctatgaataatctttatttatcagaaaaagtaaaactcaccctctcctatggcgatgctgtgcttactttaaatgattccacaaaaaatacagccggatttaatctcattacccattacggaacaatcaatacttcttctcttaccggaagtaaaacagaaaaagacgatgaggaaactttcaaggcagaatcaaaagacggaaaaacagtgcttaacataagctccgaagatggagatattacaatcaagtagctaactaatgccattcacctgctatcttagatgtataaatcttctggtaagaagatgataaaaaattttttattgacaaaattccttgttttaacatagaatatagacaataagagggagtagttaatatccatagaattcctgatttcttggatgaataacagtcgtcatcacgccgcaaggccgggtgttattgaaataacgagacttttatcaatcatctataattatttcagaatcattttatattcactataatcactatgattttgaataattacaattatttttgatgtgataaaggtctttttttattttcttttatcacaagaaaggagaatatatggaatatgtattactagtagtcggatttattcttttaatcaagggggcagatttctttgtagaaggaagttcttctctcgcccaaatcctgaaagtgcccagtgttgtaatcggacttaccattgttgccatgggaacgagcgcaccggaagcctctgtcagcatcaacgccgcccttgcaggaagtaatgatatcgccatcagtaatgttgtcggatcgaatattttcaatggattagtcgttgtcggggtatgtgcctttttatctgcattcaaaacaaatcgtgatattttaaaaagagatatgccactcaacatccttatcacatttattttatgccttatgtttcttgatggaaaactcagccggatagaaggcggtatcctctttgccggaatgattttatatattgccgtcatgatctatcacgcaatcaaaaatcaatcggaaaacgaaccagaaaaaattctttctttgccaaaaagtattatttacatgattgccggtctcgctgcagtcatcttcggcggtgacttagtcgttgataaagcatgcatcattgccactaacttcggcgtaagccagaactttatcggacttactatcgtcgctatcggaacctcgcttccggaactggtaacttccattgttgccaccaaaaaaggagatagcagtcttgcactcggaaatgctatcggctctaacctgtttaacatcttgtttatccttgggttctcagccatcctttcaccattgcacgtactaaatgaatcaatcatcgactgcggtattttattaattagtagtatccttttatttatctttgcaaaaacaaagcagcatatgtcaaaactcgaaggaattgtctgcatcggactgtacctggcatatatgggatatcttttgatttaatttagcggatacagacgaaaaaaagaaagccagcctatagcaaaggtaaagatagtcgcggcgtaaaaaatgcctgaccggcatttttacttgctccgacattacctttgctataggctggctttctttttttctgttctctggctccagatatgataattaaatcttctataggatattcggtaattatccactagagcgtgtttgaaaaatgcttataattaaacacagaaacggtctgtttacattattattccggttgttttggtaagccggcaaatcctgcttctaaatccttatcggtaggaatgtaatcactcatctcaccgttgttatatttttcatatgctaccatatcaaagtatccggttccggtaagtccgaaaagaattgtcttttcttctccggtttctttgcattttaaagcttcatcaatggctacacgaatcgcatgactgctttctggtgcaggtaagattccttctactcttgcaaactgctctgctgcttcaaatactgatgtctgttctacacttcttgcctcaataagcccctgatcatataattcagatacgatactgctcattccatgatagcgaagtcctcctgcatgatttgcagatgggatgaatccgcttcctaatgtatacatttttgccatcggacatactggtgcaggtaagattccttctactcttgcaaactgctctgctgcttcaaatactgatgtctgttctacacttcttgcctcaataagcccctgatcatataattcagatacgatactgctcattccatgatagcgaagtcctcctgcatgatttgcagatgggatgaatccgcttcctaatgtatacatttttgccatcggacatacttttccggtatcacagaaatcataaacatatttaccacgagttaagcttggacaggaagccggctctactgcaataaagtgataatccgcttctccacgaagcttttctcccataaatggagagattaatcctccgaggttagaaccacctccggcacatccaataataatatccggtttgattccgtatttgtccatggcaatctttgattctaatccgataacagactggtgaagaagtacctggtttaatacacttcctaaaacataacggtaaccttcatgcttcgttgcagtctcaaccgcttctgaaatcgcacagccaaggcttcctgttgttcccggatgttcttctaaaatcttctttccaacttctgttgttgtagatggggatggtgttacacttgctccataagtacgcattacttcacgacggaaaggtttctgttcataagaaactttaaccatatatactttgcaatcaagatcaaaatacgcacatgccatagaaagtgcagttccccactgacctgctcctgtctctgtagtaacaccctttaatccctgctgctttgcataataagcctgagcaattgcagaattaagcttatgacttccacttgtattatttccttcaaatttataataaatctttgcaggtgttccaagcttcttctccaaacagtatgcacgtactaatggtgatggacgatacatcttgtaaaagtctttaatctcctgtggaattggaatataagcatctgtttcattcaactcctgctttaccaattctttacagaatatcggttctaactcttctgcctttaaaggttctaatgttgccggatttaataaaggggctggcttcttcttcatatctgcacgcacgttataccagctatccggcatctcattctcttcaagatagatcttataagggatttctttattgctcatgttcttctcctttgcaaatgtttttcttttaatttaataatttaacactctagtctaatacattatgctatacacagtttatactatctgtcttcccacgtcaagtagattaactatttgatttcttagagaaaacaaacgaaaaaagaaataatcccatatcccatctgctctgtagtcgctgtgcttaagatgctcatccgcatcttaaacacgctccgaagccgcatctgggatatggattatttcttttttctgtgttttggctccagaaggaatgaatgcaatagtctttggggagaggagggggagaaagcagaagactactgcttgctcgaaaggtataccatccataagagaaaaatgatatattgccacaatatagtagtgaatttatcgtatacaatgatagctgacaatattatcttatcagcattgacagcatcgcggagatagtatcagaataagtcataaccttctagccccttccccatctcttttccaaagattattacgttcattccatgtgataccaacacacagaaaataaaaataatagaccatagtaaatgaaaagtgagaacagatcaataaaaatccccgacagagacaacttccgagtaagaagtagaacttccgaccactcccctttctctccgccaaagactattgtattcattccttctggagccaacaagcagaaaataaaaatattagcccatagccaatgtaatgtgagaacaagtaaaaatgccgaacaggcattttctacgcagtgatatctttacagtggctatgggctaatatttttattttcgtctgttttctcctaatgaatcaaatagtaaaaatttatattttttgagtagaatatcaaatgtttttctataaaatgacatgataatatatgtttatattggctgactaatctgttgacacattttatagaattgctataattttatagagaataaagatcagtacatgaatatatgagaaggagagattattgtggttaaagtagaactattaaaagaactgaataacggcattcgtttttacgctttggagaatgaatctttgaagcttgttgttgtaaatatgggatgtagaattatggaaatccttgcacctgatgcttctggaaaaaggtctgatgtgattcttggtcttaagaatattgaagattatgcaaatgatccggcttattttggagctgtcattggtcgtgttgctaatcgaatcggagatgcacgtttcacattaaatggaaagacttatgaactctatgctaataatggaaagaatcatttacatgggggaaaagaaggatttgataagaaaatctttgatgttactcctttagagaatggtcttcgtttccactatctttcaaaagatggagaagagggttatccgggtaatctgaatctgtatgtaacgtacactttaaatgacaatacattttccattcattatgaggcagatacggatgcggatactgtcgtaaactttacaaaccatctgtatttcaatctttctaatacattagaaaaagttaccgagcattcccttcagattaatgcagattacatcggctgcgtagatgatacttgtcttgcaacaggggaactgcttcctgtaaaggatactccttttgattttaatgaaatgaagaaaatcggacaggatattgaagcagatcatattcagttaaagaatgctttcggctatgatcattcttttgtattaaagggagacgaacgacagttaactttagaagaaccggtttctggcagaagacttgttatctcaacgaccgctcctgttgtgcaggtttacactggtaacttcctgaaggatggctgtatcggaaaagcgggaagagtatatgaaaacagagaaggcgttgctctggaaacacagcttatgccaaatgcgattcataccgaagaaaacccttctgttatcttaagaaaaggggaaaaatttgaatccactacaaattatatttttgaaacaatataattataacttgccccgccaaaaatattataattatgtaatctattaagaaaaagcagcaacacaacagaattccctactataaactatggcaaggaattctgtttgttttttatgggatcatgcttgatacattttcttttgttacttttttatatggcagataaacacattttttgttttcgaatgtaatgttctccattccttttcctgtgactgcagcagtgataagttttaccatcgcttttgcctgtccttctttatcgttatataccgttgcggctatttttccttcctgcactgcttttaatccttcttttgtgccatcaattccaaagaaaacagggatattggattctgtgtatccaagcttttcataagcatctaccgctccaagtaccatagaatcgctgtttgcgattaccatctctatatctgttttatattctccgatcagctgcatcattctcgtctgtgcctgggcacgattccaatttgcaatctgatagcttagtttttccaaggcaattccattggcttttagacattctacgacactttctgtacgaatgatcgcatcctgatgtcccatctctccttctaaaataacatactgtatttttccatcgttatttctgtcaacttttttattgtctttaatgtagtttgctgcaagttccccctgtaattctcccgactgcttcgcctttcctcctacatagtaaagtttatcccatcgcatcaaatcttcttctactggctcacgattaaagaaaataattggaatatctttttctcttgctgcatcaataatttcagacggctccgttctgtctgccagattcacacacaaaacattacatccatcatttatcatctgttttatctgatcgttctgaactctttgtgactttgccgcatccatgatcgtcatacttatggcatagccctgcttttccattgaactgcattcctctttaaatgaatctaacaattctccaataaaagtgtccttttgatcatagcaggcaacacctatataaatctgatgatccgttttgggctggtttttactgcacatagaaaaaatcaaagtccctgcaaacgctgccattatgattattcctgtgatttttatcttcatgcggtcctcctgttatctgttcttttactttatatttattcaagtcgagcagccgcgagacttggcgcgtgattctggtcagcgtaagctgacatattctttacagaatcactgcgcatcctcgcggagcgtttatctcattcgtcaaatcatattgggactgcttatttgtcgcagtaaacttgcttgtctcattttattgactgagtgtaaataacaaatcttgattttcctgcgagaaaaggttctgtctggtaagtatagtatacggtactttctgattttccatctgataaaatgatgtacgtaacttcttgactgtttcagcaacacattgataacctgccgtaaattcatcagatacaataagactctctgcccaccttgtatcaagataatatacagcctcggtggaattaccgattccatatacgatcgctccagataaattattttgtttggcagcttctccggcttctacaagactagtatcatccaatgccaaaactatatctacctttctttgtgactgtaatattacttttttctttattccttcatcgcgagataccgaccataagatttttgctccactatcctttaatgtatcacgaactcctttttcacgcttgctatctgctcctgaacgactgctctctgtataaatacctattttctttcctctaagatttccattgttattttcaagaagttttcctgctaaagcgacacccatatcgtactgatccggctccgttaccggaatagctgattttttttctacgttgttatcaggactttctcccgccagcattatcggtacttttttctgtattttttttagcttggaatactctttactgcctccaaccatctttacaataatcgcatcggcacctttatcaatttcctgctgaacgacttctatctcatcttccgacatattgatattcgccttactgattagcaccgtattcactccgtattcctgcgatgccatttttaatccatacttaaaggcggaccactggctctcttctatgtcaggaatgaccacagcaattctttctgctttttgctcatttttattatacagcataaaaaaagctaacgttgcaaccagaagccctaaaacaatttcggttaaaataaaggttctttttccattcttcatgtttcttcctgtttatctttctgagacgaactctcaaacttcttccggttttcctctgaataaatgattgccggtattttgattgaaacggttgttccttcgtctaattcactttcaatatttaatccgtactgctctccaaataaaatctttattcggttatttacatttaccagtcccacaccggaaccttttttatgtactctcttcgtatcggtgaggagaaattccacttcctcttctgggattcccattccattatctgttacagacagaagaatttcatccttctgtctgcttccacgaacaataatttctccgcagtcatccatttctcttacaccataattaatcgcattttctaagatgggctgcagaatcagctttacgatacaacagtccaagatatccggtgcgatatcaaaagaaatctgaaatttatttttatagcgtaccttctgaatattcatataactttgtgcatgctgcagttcatccttaatagatataatcgtatgtcctttagaaagactgatacggaaaagtcttgcaagctgagaaatcatgaatacggcctcatcattcctttctccttcgatcatccatgtaatagaatctaatgtattataaagaaaatgtggattgatctgactttggaggacttccaattcactctttcttctctctgtctgttcccatacaattttttgcattaacgctgtattttgtttataagattctcgaatagatcttcccagatggcgaatctcatgtgaacctccaatataaatttctgactcttttccttcttcatattctgtaacggaattattaagcttcatgatcggacgtgaaattcttacggatataagacggttaattaatgtaagcatcatcgccatcagtaaaattaaaataagcacaaactgctttatgtcaagcatcttacttgaaaaaatagaatatggcataacgcagactaacttccagcctgtataaccaatcgtatctacaacaatttctcttcgctctccattgactctttcttcatacacactttcttttgctgtcgcagctttcttactgctctcatttttcattccattatcaagctgtacctgatggggatgatagataatctgtccattgctgtcacacaaataaaaatactgcccgctccccgcagtattaattctatccatcattcttgcaattcctgaataatccatatcaacaagcagcacgcctaattgtgtattgcttccattcgtcagctcgacaacacgacttgaagagataacccagtaatatcgacaggacccatcatcgaataaattctgtacatgcggtgtagaaaaatgaatattttccatctgattcatcgcatgcataaaccactcctgttttgtcacgttcggatcttctttctgtgccacaacaggttccgcttccatcaggcttccggatttgttataaatagcaatgctgcgaagattttctttattcgcttcatataaaagattcatcccactgtgaatcttatctgattgactggaaatatcactttcttttataatatcgtaatataaagcatcagatatctgccgcatattgatcagataatcttccacactctctatggtctgatccatcagtttttgattattttctaatatctcctgccttgacatactggaaaaacgcaagtacatcacacttcccatacacagcatgatcactgcggaaataacagaaaaggcaatcatcaatgttgtctgtatatttcccggtttatacataaataatttttctttacatcccttcttaaatgttttcatactctgtcctgtattttgatggggataccccatattgtcgtttaaatacatagctaaaataattagggtctgtgtatcctacactttttgcaatcatatagctcttttcatttgtctctacaagcatcctggctgccttttccatacgataacctgtaagataaccaacgaaagactttcctgtttcttttttaaatatactggaaaaataagaattagaaactcctaattccctgcatatatcgtctaaaccaagtgactcttcctgataattattgtgtacatattcctttgcctgatcaataagagatctctttgaatgatctctggcatttgccatatcttcatgtaatgccagacacaagtttaaaagccatttttcaagtacctgtggttccatattgcttagcagcgtatataactgccctgctccaccggataatttttgaatatccagttcattattcaccataaaatgatacatttcactgataagttccattactgctacgtgatatttctctagagactttgtcggaacaatcttatgttccatatagcgttctactgcactcttaacatccggattcttcccaagacagatcatcttaaaaagatatgccagttctgttccatcagccgcctctgtcgctacctttctttttggaacgatctcttttaaattaattgcctggttgcttccatatagtacccggtaagaaactgcttctcttgcactctgataagacttcacaagctcaagaatgttatcacagacctgaccaactcctaccgtcacaactgctccgatcatatgatttacatatttacaaaaacgatcacaggaatccgtaagttctgaaacttcttctttgctttctaactgaacaatcattaccgtatcccctaaataattaaatctctttcctcgccacttctcttctagtctttctccagcctggcggtcaacagaaatagctaaaagctgaacatctatatctttcggcacctgtgttgttgacgtatgtataataatacaggcataccatggacctgtaaaatcaatctcatagttcataatatacttgccaagttcctcttccggaactcttccttctatcagtgttgaataaaagttcgcctgcagcagcggtagagaatccttataatactttttaagaagctctgcacctttcttttcattaatttcctgatctaatttcttctttaaatcttcaaaaacttttgtgatttctgcagcattcaatggttttaatatatactcttcaatttcaagatgtaccgcttccttggcatattcaaaatcatcgaagccagtaaataaaactaacttcgttgcaggatatttttctcttatctgaccacataattccagcccatccatatatggcatccgaatatccgtcatcactacatccggttggatctcctctaacatttctaacgcttttagtccattatttgcatgtcctacaacggaaaatcctaattcgttccattttaccttttttgcaattatctgagttacttcttcttcgtcatcaactaataataatgtatacataacctctctcctcatttattactattatatcaattttccaaacataagtaaatctcagcacaacaaaaatagtgccagtagctacgatccttaaatcgtttctgctgacactattttctcatatatttatatattaccaaagaggaattttaattatttcttctgtacgtatttcagacagtcaagtgttactgcgataagaataatgatacctgagaatacgaactgaaggtttgtatcaataccaagaattgtaagggagtatgttaatgctgtaaagatacatacaccagtaactacaccggaaatcttaccgataccaccagtaaaggatacaccaccaactacgcaggctgcaatggcatccatatcccagccctgtccataagcagcggaaccagaacctaccattctcgcacattcaagccaggaaccgaatccataaaggataccagccataacgaatgctccaagtgtaactgcaaatacagaaataccggaaactgctgcagcttctgggtttccaccaactgcgtaaagattctttccaaatgttgttttattccagatgaaccatacgattacgatagcagcaagtgcccataaaataattgttgggaatccatttactttaggaataatcatatttggaatggttgcttcaatagaaccaaaggatacaccttttgttgcataagttactaaaccaaaaattacaagcatgttcgccattgtcgatatgaatggatgcatcttaaacttcgctgtaaaaaatcctgctatacttgtaaataccgtacataaaacaatacatacaactaaagctaaaattactcttccaacaaccggaacgtttgtaaaatcaaagatatgtccgaatacagaaccagtatttacaccctgatgcataataatagttgcagcagtcatacccataccaaccattcgtccaacagacaagtctgtacctgtgaggaggattaatcctgctacaccaagtgccaggaacattctaggggaagcctgctggagaatgttcagtatattattatatgtgagcagaggggttccttttttaataggagtgatcacacataatgcaataaagattaaaataatagcaatgtacaatccattctgtaaaaggaatgttctacgattgaatgtatatttatagttctcccacttctgtgccatctcttctgcgaatgtgaaatctgacaaacgcagtaaatctataagatgatacttataagtaagagcatcatgttttctgtctttaattcgctgtttttctttttccagctctaacttttcattagaaatacggttcttatgtacgtaattctcttctttaatctcaacctggtcagacatacctgccagtgcttctttatgctctttttctaactgagcaagacgctgtttatggtcttctaaagctttcgctttttctgcctcacagctttcttttactgcattataatacagtttttcaaagttctctttcaggtaaccttctgcatctgcgatcagttttgcaactttatctttattctgtgcttctacagcttttgcctgatttaattttgcctcaaactctttaatttcatattctttctctcctttagagagagttttatctctttttacactttcgataagattctggtactcgattacttctgctgtaccatgttctcttaattcatcaatttctttttgaattttaccaacatattcatcaattggctgtctcagctgtctttcctgttcagccgtaagaatttcaccatttgccatatctatcttctcccttaattataggtattttgcactcagtctcaaaagttcttcctgatttgtttccttggtatttacaattccggaaagatgtccgtttgacataacaccaatacggtttgtaattccaagaatctccggcatctcagaagaaacaacaataattgtctttccttcttttgccatcttgataatcaactcataaatttcatattttgctccaacatcgataccacgagttggctcatccatcataaatacctgtggactacgctccagccatcttccgaaaataaccttctgctgatttccaccggaaagacttgaaatcatatctccaggacccatacattttgtatgcatgactttaatttcatttgcagttgcctttaccatcttagaatcagaaatggcagctccacttttatatgcatgtaagtttgcgatcgtcgtattgaaagtcaaatctccttttaagaagagaccattcgcttttcgttcctctgtaataagagcaaatccataatccatcgcttcttttgcacaactaaagttcataagtttattgttcagataaactcgtcctgacgctcttgttcgtataccaaaaatcgtctctaacaattcagtacggcctgctccaaccagaccatataatccaaagatttctccttctcgtacatcaaaggaaacatcttgtaaatacggctcaaactttgttgacaaatgctgaaccgacaacacaacatctttcggctgattatctacaggtgggaaacgattctcaagaactcgtcctaccatcgctgcgatcagctcattcatatctgtctcttttgcactctttgtcataacaagatttccatctcgaagtactgagatttcatcacagatttcaaagatttcatccatcttatgagaaatatagataagggaaataccctgatcacgtaacattctcatcatttcaaaaagcttttctacttcctgtactgtaagagatgaagtaggctcatctaatacaattactttagaattataagaaattgcctttgcaatttcacacatctgtctttgagatacagacatgtttctcataggctgatccaagtttactgtcatacctaacttacggaataacttggatgcctcattcttcattctcttttcatcaattactccaagagaattcactggatatcttccaaggaaaagattatccactacgtttctttcaaggcactgattcaattcctgatgtaccattgcgattccattttccaatgcatccttcggaccggaaaagtttacttcttttccatccagatatatatttccttcatctttctggtatgtaccaaaaagacatttcatcattgttgacttaccggcaccattttctcccataagacccataacagttcctttcttcacatcaagattgatgtgatcaagtactctgtttcgaccaaatgatttactcataccacgtatcgataagatagtatcgtctctcttatcctccatactttctgctcctataactaatatatttactgatattacttctttacttcttgaaaatttcagggagaataacttctccctgaaaccttccttgttaacttcttgttaacatcactataaattctcaaaaatatgttcattatatgcaagtatgttcaactacataatctgaaacatctgaaattgaaaatctgtacgctctaaatagttagaaactactgatttaaaatagctgtgtaagaagctgcgttatctgtcttaaccatgttgattgcaaatgcatcgtactggcttgggtttccaagacggtttgtaacgttagattctgtctgtccgtcaccaccgatgtactctacatcaagatttaaaagatcatcatagttctgtaaaagtggctgatatgttgagcttaagaagttatcagaagcattgtagatattaagccatactttctttgttgcatgtttggaagaatctaactgattagatactggtttccaaacaactgtagaatctgtgaaatctttgtagttatctgctgtaactgcagcgtttaatgcatagtaagatctctcttcttcgctatatttatatacatcttcgctaagtacgtttccagcttcatcagctgttccgatacctgtatctacgtcaacaccatcaagtgcgttacgaagtactctaagtgtaaggtaagcctgaacatcggcatgctggctgactgttccgccgtaaccttctgcgatagctgctactgcatcactgttagcatcgtatccaaatgtaggaactttgttatcttttgaccaagcgttaaacattgacattcccattccatcgttgttagatacaactaaatcgatagaatctccaaaagaagaagcccatgttccgattgcgttaccagctgttgctgcatcccatgtagcacctgcggagtttttcatttcctgagaagcaagctctctgatcacatatttcttaccattaacttcaacttctccgtctttaacctctgcagcttttccatctgtgtttgttcctgtaggagcactgttaagttctccgcctttttcaacacctgtaccaagagctttacgaacacctcttgtacgagcgatagaatcgttatgtccgatgtcaccgattgctaaaacataaccgataactccgtcaccattacggtcaactttatcaatgtttttctcgatatattctttaaccatctgaccctgaacttcagcaccctggttagcatcaaaacctacatagtaagtatctttgttaaagttaagagctgtcttgtcaagttcacctgtagaactgttagaaggctgacggttaaaccatacgagtggtttatccttgttagctacttcagaagttgctgctgcttcacttcctgtgttagcctctcctttagtatctcccccactgctgccgcatgctgctgtagaaactactaaagctgctgccatcatcattgctacaattttctttctcattattattaccctcctcggtttttgttgatattgccagtataaacgattttttaacaagaaacgatagaatatttttagattcacattaaaaattctatgattttattagcaaaacgaataaaaaattctatgattcaatacattatgtggcaatgccaagttttctcccctccccatatgttcaagacaaaaaagtttttaataccttcaacactccatcttctgcatatcctggtataatttcatctgctgcttctttcgtttcttttcttgcagtatcaaccgcatatcccttccccgcatattcaagcatcgcaatatcattgatattatccccaaaagcaatcgtttcttcacgtgaaatccccaactcctcacaaatactcctcattgccgttcctttatttgctcctggtctgacaatatcaatccaatacttacccgaatttaaaaactccagttttccgtcccatttatcttttatatatttcttacaaatctgatctacgttttccggatgatacatcgtcatcatactgaaatcttcttgtggaacattactccatcctcctgttccgatcgtatcataatgatatccatctattaataacttatgcattggcgttccctcaaaaggacaatacgtattcgttggtgtattcaaaagtccttctagctgatcaaatttcgataactgttcccataattcttttccccattcctgaggaatcggcttcataatttttgacttcccattatgagatactacattaccattctgcgatgcaatccatagtttatccataacaggtgcaaacacctcttttatactgatcatatgtcttcctgaagcaaccacaaatacaattcctttttcaacaagcttttcaatcacctcataatattccggattaatctgtaaagtcccatctttaatcaatgttccatcgatatctgtcataaccatttttatcataattcttattttcctcctatgtttaaataaaatcagtatactctatgattgatataggcgcaagcaagtgctattatattgataaacaatcaatattattgactgtttatgatgtatttcaatcatttcaatctaatcctggaggtactttatgattcctgatgaacgaagaaaacaaattttagaactgcttaatgaaaaagggtatatatctgtcgaagaactctcacagaaattatatgtcagtcttcctacgatccgacgcgatcttactttacttgaaaaagaaggatctgtattaagaacacatggcggcgcttcttttaataaaccagactcttttgctgaaccttttgccctccgcaaaaaaacaaatcttgaagagaaaaaatatattggaaaaatagctgcatcactcattcaaaataatgatactttatttatcacttcaagcagcacctgcttagaatttgctaatcatatcgaaacaaactttcatcttgatattctgacaaacggaatgccacttgctcataaattatctgaaaacagtaatgttaccgttgaatgccctgccggcatttacaactacacacatgaaggaatctatggaaaagaagtaaaggaactgattagcaaacgttatgcccaatattgttttacttcctgcaacggaattgacctggtaaatggcctgacattttcaacagaccttgacatgacattgatacgagcctgccggaaaaattgcaataaacttgttgtacttgcggaccatacgaagtttggaatgacctactattttaaaactctcagtataaaggaaattgatattattattactgatcaggaaccagaggaaaaatggattacttactgcgaagagaatggaataaccctgatttattaacttctaatttgtgggacgtgaaacagacgccgctacaatttccatagcggcgtctgtctctggggattcctagttttccccttctccatattcttgaaattcaagtcgagcagctgtcactcaccacctgaacgaggtgggagtcttctcgactgagataaaattttcggacaacctgcaatgactgctttaaatttcttcctttccgcctgtctttgcacgaatcacaaaaagagccgcaaccaacagcacaatacaaaccggaagtgccaaaagtgaaaactgtgtcagccctacagcctgcaacacaccaattataaaataaccaatcatgcagacagccgcaaccaatcctacatatggaagctgtgttgccacatggttaacatgctcacaatggccgccagctgatgccataatagtagtatcggaaattggtgaacaatgatcaccgcagacagcacctgccagacaggatgcaatcgaaattgccatcatctgaccagatgggaatacaccaattacaattgggattaaaatactgaaagttccccatgaggttccagtcgcaaatgcaagaaatgccgctactacaaaaatcaccattggaagaaagccctgaagtccctgtgcgaagtgctgtaccatattggctacaaatacctttgcaccaagaagatttgtcacaccagacagcgtccatgccagtgtcagaatcataatcggtgcaatcatggacttaaatccatctggaatacactctgtaaactcacggaaagaaagtacatcacgcatcatataataaacaaaagtaaatgcgagcgtcacgcttccaccgagtaccagacctaccgatgcactcgaatttgcgaatgcttccacaaaggatgctcccgtaaaaaagccaccggtataaatcatggctacaatacagcttataatcaatacgactactggaagcaccaggtcaagtacatgagagttttccttaatgatttcttcttcattgtcctcatacggtcttcccggtgttgtaaacaaatcaccggcaatagcgttcatctcatgattcttcatcggtccaaaatccacacgcaaaacagtaattgtaagcagcattactaacgtcagaattgcatatagattgtatggaatggtctggataaagaccgcaaaaccattaattccagaatcggctggaacagatgacgtaactgcggctgcccaggagctgattggtgcaatgatacaaactggagctgctgtcgcatcaataatataagatagctttgctctggataccttgtgacgatccgtcacaggacgcataacacttccaaccgtcagacagttgaaataatcatcgataaaaatcaacactccaagaatcataacgctaatctgtgccccaatccttgttttgatgtgcttagatgcccactttccaaatgcagcagaacctcccgctttgtttaacagtgatactaagatacccagcatgacaagaaatactaaaattccaacatttccggagtcagacagcttgcttaccatgccgccatcctcgttaaatagcatcgtatttaacattaattccagattgccattggcatacaaaagtgctccagccagaattccggccagaagtgatgtatatacctcttttgtaaaaagcgccagtccaattgcgattactggcggcagtaatgatagtgctgttgcgtatacggtacttgtatactcaccatctgcggatggtttgcctgtcagcatagtgattgcaagcaacacggcaaatactgcgatcagtccaagcattacggcttgttttcttttgactttcattttcattatacttcttcctctctgtataatttatattattgggaaaaacacttctgagacatatcttgctacatattacaagccacataaatgaaatcaacagcaaacgattacacaaaaacagagaagcccagatggacttctccctcgaaatcttttcttacctcatcgtatttctcgaaatatagtacattgtagcatgttatttttaagattgcaattactctttgcaattctctttataatattttatatttttgacataccatacgcatacttcctgcaaacattcgacagagtatacgagaatgttccacaatatcatatgacatatcatgattaagccagtcaataagctggccaaacaactcacattttaaataacttatcacaaattccaaatcctttgaatctactctttccgaatactccctggaacgaatataagtacgtgtcacatgctcacaaatcttcatgagctgtttctcataaaattctctgttagatgaaccataaatatgataaatcattctcttatttaaattgatttcttgcaaggctgcagtgactttctcttcaaaagtagattcctccggcaaattctctatcaccttcgccgtcatctccacaataatctcttctaataaagaaggaatatcctgaaaatgataataaaatgaatttcgattcacaccacagtcctctacaatatctttcactgtaatctgggaaatcggtctttctgttagtaactttataaaagaatttttaatttctcttttggcaaaagggggcattctgtgcacttccttccttaaatttataaatttatcaaatttgtcaccttaaataccgctacgctcattacgcactacatgcaacataatatcatagattctttctttattccattaaattttctaaaaaatcaataaattctttcttggtatttgtataaagtatctatacttttttctcttccacctcatgatagattctaaatccatctctgccatttctttttgttgtataaagtgcttcatcagcatgcttatacaactcgccaaatgtcgtgccatcttttggcataaaggccgctcccatactgcaggtcaatgtatgttcctctaactcctctatcggaagttctctgagatactgctgtaaattctccatcctccgaacggcaaattcttctgaagtgattccctccataaatataagaaactcatctccgccaattcttcctacaatatcattctctctgaaagaactcttcaaaagatgaccaatcttatataaaactctgtctcctactgcatgaccataagtatcattaatctgcttaaaataatcgacatccatcatcataagaacagcaccggacttacttctgtcactatgcagccactctttaatacgttgttctgttcctgctttattatatagctgtgtcagtccatccctgctggcaatctctctcatcttcttctgtttcatggatgttctctggaaaatgagaatgaaaaatgtaatcacacccacaccaatgaccgcaaacagaatcacttccttatttccaataaactgaaattcctcctgtgctttactttgcggaaccatatagcagagcatccaattattgatatgcaacggctcatatgccagatagctcatggcattcttttctttaagaacaagaataccagacttttgcttcttgatattaacctttgctgacttcattgtttcctcggcaacctcaccactctttgtataaaaatcatatacattatcattaataccaatctttcgataagaaagtccgctatcaaaggaaataatttttccggaagtatctatgatcatagaaaaaccaatgccatcataaatatcattaaataacatctgattcaacgcacctacattataggatgctccaagagcacctgtcacttttccattcctgtaaattggtacagcaagaatcacttttgttcttccatctaccttactttcaagtggcggactcattatcttttgtccctgcatcactttcttaaaataccctctgttttttacattctttcttgcaccgttattgtaataagtatgtccatctgccttcataatgcctatcagattcaaatcctgttcttttacaatactctgaatcagccttttattctcctgacaaaacagatcttctctttcacccatgtaagaagccatacccgtcagataattaaactgaatatccagcactgacttcaaatgatagctctgcctctctacatttgttgcaacagtttttctactgctaacttctacatcctgctgcaaccatgataaaaagaataaaagactcaatatcataaaactaagaaatgctgctataatcagaaaatacctttttatctcgttttgttcgattctcttctttttcatgttgcccatcccctctccaaatatactttgcaatccataaattaattatgattttatcataccatagcatttttcttctgtcagtcacattcttttacaaatagcaataaattttcgacaaaatcggaggggttactatttgattcattagggaacagacgaaaaaagaaataataccatatcccatctgctctgtagtcgctgtgtttaaaatgcttgtctgcatcttaaacacgctccgaagccgcatctgggatatggtattatttcttttttctgtgtgttgactccagaaggaatgaatgcaatagtatctgggagggataagagaaagaagtcagaaaggttcctgcttgctcggaagatgtatcgtcagaagattattttctcgctcttaacgagcagtaaagagaaagtggattgtcattttccaaaaatataaatattaaagaaatcgcctttatcgcatattctaaatatatctcttgagaagaatgatatattgctacaatatagtggtgaatttatcgtatacaatggcagctggcaatatcatcttatcatcattgacagcatagcagagacagtatcagaataagccacaaccttccgacctctcccccttctctccccaaaagactattgcattcattccttctggagccaaaacacagaaaataaaaataatagaccataacaaatgtaatgtgagagcaagtaaaaatgccgaacaggcattttctacgcagtgatatctttacagttgttatggtctattatttttattttcgtctgttttctctaatgaatcaaatagtaatttaatactgagattcttctttgataattgcggcaaattcctccacgctcattgcgccaagttctgggctgtcattctcatcaataagatctctcttacgaacagaaaccgttcctgcactctgctctttttctccgagaataagcatataaggaactttctggagctgtgcctgtcggattttatagccaagtttctcgtcgcggtcatcgacttctacacgaacgccgcttgctttgagtgcttcagcaacctgttttgcgtaatctgcaaatttgtcggatacaggaagaacttttgcctgtaccggtgctaaccatgttgggaactttcctgcataatgttcaattaagattccgataaatcgctcaatagaaccaaatacaacacggtgaatcatgattggacgatgtttttctccgtctgctccaatatattctgcctcaaatctctgtggaagctggaagtcaagctggattgttccgcactgccatgttcttccgatagaatcctgtaaatggaagtcaagttttggaccatagaatgcgccgtctccctcatttacttcgtaaggaatattcatggctttgattgcattttccaatgcatttgttgctacttcccactcttcttctgttcccatgctatcatctggacgagtggataattctacatgataagtaaatccaaatttcttatatacttcatcaatcaattttacgactttctggatttcattttcaatctgcgcctctgtcataaagatatgggcatcgtcctgtgtaaagcatcttacacgcatcagtccatgaagctgtccggacttttcgtgacggtgcacaaggccaagttccccaagacgaagtggaagttctttgtaagaacgaggctccatcttataaacaagcattccacctggacagttcattggttttacagcaaaatccatgtcgtcaattactgttgtgtacatattttctctgtaatgatcccagtgccctgatgtttcccaaagctgtctgtttaagaggattggtgtggagatttcttcgtatccttctcttgtatgcatttttctccagtaatcaatcagagtatttttcagaatcattccctttggtaagaagaatgggaatcccggaccttcttccatgatggtaaataatccaagttcttttccaagctttctgtgatctctcttctttgcctcttcgagcatattcagataatccttcaattctgatgcttttgggaaagaaattccataaatccttgtaagcatcttatttttctcatcaccacgccaatatgcgcctgctgtagaaagaagctttattgctttaataacacaggtatttgatacgtgaggacctgcacaaaattcctcataatctccctgcttataaaatgtaatcgtctcatcttcaggaagttcttcgatcatctccaccttataatcttcctgtctttctttcatataggaaagcgcttcttctttttttacctcaaaaacttccagtggaagggactgttttacaatctttttcatttctttttcaattgccgcaagattctcttctgtaaatggaaaagaaaagtcaaaatcataataaaatccgttgtcaatcgccggtccgattgcacactttgtatccggatataatctctttactgcctgagccagcacatgagcgcttgtgtgccaaaatgcttcctttacctctttgttgtcaaaattaccttcgattacctgtccatttttttccagaactttcatttcattacctccaaaataagaacgaatctgactgggacctttctttttttcatttgctccaggcattttaagacatcagccttcaaagtcaggagtaattttctgtaaagtaaaaaagcacccatagattacagtatgactataatctaagggtgcagtaaatacacggttccaccttattatttcacttcagattctatgattaaatcctatcccttaacgcgggcatacggcaacacttgtgaaatatcccaaaatgtcttacccatctcaaaaaatacttcttttcgcatcgcagctcaggaatggttttcatatatttcctcatgaataactctcagcattcattactctctctgtatgattctaatatattactcttttccttcatcgcttttcgctgtttcgagtgtatggtagcactattaaaaatgtttgtcaatgttttattttttatatttttgagatctggatgaaaatctgtctgaaattgtatcctttatattagaaaaatactgtggaagtaaaatccttcgctctggagagaatacttctttccatggataattgacagcttctctcgcttctccaaacttgtctttcaaaatcgtttccgttaaaagcatggcggcagtcatcgcagaagtcattccccaaccgttaaatcctgttgctacatacagtcccggcgtttttcttttagaagcatatgacccgatatacggtatgccatctaaactgaaacaatcctgcactttccagttcgccatctcttttgcttcaggatagtacattgctgctgccttccttagctcctcccattcctgaacctctctgccactttctggcttgtacattcctcctgtcattaaaagtaaatctccatagcttcgaaaagagagtcctccctgcgcttcatctgtatacatcccattcatcttctgtgcattccccagtgccagaatacaggactcttccctatgcagctttctgttatacttgccaagcttctcataaaatggagtatgtgttgtgcagataatatgatctgccactgtaacgtgcattccacaccatatcgcacgtctgaaccagtcatcaatctctaccccttcatatacatgtatattctgatacttttccaattcttttacaagaccattcatcaatttcgctggatttaactgtgcctgcccctgaaaacgtaccgctcctgatgtagcaaatggtaattctgttgcctcacaaaattcgaccttcccaccgattcggctgactgcatcgatctctttttcaagcttctctctatcattcttagaatagacataggaactcgtttcttcaaaatcacagttaatctgttcagaaagttcccgatacttctgtattgccagttcattcgcctgaaaatacattcttgccttctccacaccatctcgttctactaacttgctgtagattagaccatgttgagaagttacctgtgccatcgcatccttccccgttcctccagcgattcgatttttatccaaaagaatacagtctactccagcatcttttaaaaaccaggcacacagtataccacataaacctccgccaacaatcgctacatcggtcatctccatgcattccatctttccataatcagacttctctgctgtgtcgatactcctccatatagaatctgacatccttctatcctcctgaaattattaaccattataccacctttagcatttttattatacaactaaaaagaaaaagaatgttattaatttttcttaaacattctttttcttcttttcatactgcttttttaatataattactgtttatatagtttattttgttctgtgtattattcgtttaatttaaaatttactttttatatgatgccagattcaaagaaatatcctataattcagatggcttacttaatatagaagttacagtatctccttctttctcccagacccccaaatactaatttccacctgaatctagccagcagaaaagcagaaattttatatcaaatagaatgtgatgtcggagcaaataaaaatgccggtcaggcattttctatgaagcgactatcttcacattctatttgatataaaatttctgcttttcgtctgtttctccaatcaaattagtaattttttctctaattcatgtaatttttctgcagcttccggattttgtttttgcagtcttcgttctaaatgctctctgctttctaccaacttttcccatatctctggattttcttgttttaattctatctccaaatgatgacgacgtttttcgatcatctggaatataagctgtttatttttatcctcttctagatttgcggaaagttcatctaaatgaagttccattcttcgaagaacctcatcctcatcaatagcaccgagattgtgccatgcctgcatttgttttgaaagacctttttccgaaatttctttgatttccggccaataatgcagattcgctattacccgatgtactcttttttcgatttcatttacggtatcttcaccaaatgcccatgcaaactcttctagtgtattttcttcttcggcaggtaatgtatgtagccacagtgctttttttaatttttctattttttctgtattatgcttatgaacaggcagttttcctgcatgttcccgcaattcttctaagctttcctgcagatttgccggaataccttccagtggaaatggtttttgtaatcctgaatcaagaagagctgccgtaattgttcttctgatacatccttcttctattaatccacccatttcaagatttcgaaactgcgtattaagtgcctgcatatgttctgtaatgtaaaatgcaattccttttttctctaagttttgttttaacataagaatcgtatccgctgctgttatatcaatacttgtaattgttccggcatctacgattactgtttttgtgtcttcttttaaattattttcaatatcttcctgaaataatttactatttgcgaagaaaaggtttgcattaaaacgatagatcatcgtgtgttcaatcggatgtgcataatgatttttatctaaatcataaaaaccatctcttcctggaatacctccaagaaatgctcttgtcggattcgtttcccgaataacaactgccacaaaggatagaatgattcctataattactccgtaaattgttccaagaaaaagtactgccatgcaggctgctacaaaaatataaaattcttttcgacttactttaaataaacgaactgccaaatgccattctacaacattcattaatgcagagattacaattgccgtcaataccggaaccggcaagtatcctataaaccctgctgcaaataaaaggaccattaccatagaaatcgctgctgtaatagaaacagcctgcgtctttcctccaaactgttcattcattgatgttcttgaaatacttccatttaccggacagcttcctgtaaaagcagaaataatatttcctgccgcacaggcaaggatttctttattatcatctattttataaccatttttcgaagcaaaattattctcggaaagtaaagtttctgccataaca

SEQ ID NO: 423 - DNA, 39314 bp, Eubacterium hallii
agatttttttactgtatagcatgggaagtttagtacctgatacagttacagatgagcatgtcttgtctgtaaagggtgctgtcagccaccctatgatgtaacgccactttagatagcaatatctatcagggattaaaggtcggaggtgtaatccgttagtacgactgggcagttacaagcccatgacctttaggtcgtgggtagttgacgcgcctgctgcattttccactgcaatactgcagttcctccagattattacgaatcttaactgctacttttaaaaaagtctgtaattcttcttcgctgactccctcacgaatctcttcttctaccttttcgatattttgaagaaaacgtttatgaatctcttctcctttttccaaaagacacagacgctttaaacgacaatctctctctactgccactctggctatatatcctttttgttccatctgttttacaaggcaggttactgtagagcgcgcaatataaaactgcgcttcaatatctctttgaaaaatctcttcctccttatggtcatataaatatcccataatccatccctgcatcaccggcatcataccattcttccctgattcctcatcgctcattgccattgctttcctcatcaacatattatctatagaacggatattaaatcctatcgtatcttctctcttcacgcaatctccttctctgtttgtttctttgacctatgcctttagctttccaacttgtttgaatagaaactgtttgacattgaattgttcaatattaaacagttttgctttactattatatccttttcccttcatttgtcaagaagttttactatttcattctttagagggaacagacgaaaataaaaagaatagactatagcaaatgtaaagatatcgctgcgtagaaaatgcctgttcggcatttttacttgctctcacattacatttgctatagtctattctttttattttctgcttgttggctccagagaaatgaacgcaatagtctttgggagaataaggggggggagaggtcagaagtctactgcttactcggaaggtatctctgtcatggaattttatttacctgctctcacattacatttcctatggtctattctttttattttctgtgttttggcttcggaaggaaggaatgcaataaatctaaaggtgactactttaatttcttggaaaatgacaatccggtttcggttttcatctgcaattaatttagaaaattcttccggcagaatttcaattcgcgcaatcatgccatggattcttacacgtacttggtgatatcccatgtcaagaagtaactgttctgctttatctaccattttcagtttttcttcagaaatggtttctccatatacaaaacgagaggagagacaggcaaaggattgtttattccaagttggcaatcccaagtctttggagagcgtgcgaatatcatctttatttaattcactggctcttaacggactttttattcctaattcttttaaaaaattctctaaatgttctttctttttattctgttctattgatgccataataaaatcctccaaatgtcatattggttgcatagtacaactatatacccactttgtcaataagtttatatgttgttgcgaattttctttaacaaaatcaaagatagtgctataattaaaaaatcaatattataaaaggagattttcacatggattacagacgttttaaagataccatctgtctccgccttgaccccggcgaagaaatcatagaacagattgaaaaagtagcaaaaaaagaaaagattcatcttgcacagattaatggattaggcgcactcaatgactttactactggtgtttttgatacctcagaaaaaaagttctatcccgttcattttgagggggcttatgaaattatttccttaacaggaactgtcacaagacaggacggcgaagtatatcttcaccttcacatggctgccggtgataaagatggccatgtatttggcgggcatttaaatatggcctatgtcagtgctactgctgaaatccagattcagattattgatggaacaattaatagaaaatacgatgaaaaaataggactcaacttgtttgattttactatttaattcattagagaaaacaaacgaaaaaagaaataataccatatcccacctgctctgtagtcgctgtgtttaagatgcttatctgcatcgtaaacacgctccgaagccgcatctgggatatggtattatttcttttttctgtgttttggctccagaaggaatgaatttaatagtattggggagggataagggaaagaggtcagaaaggttcctgcttgctcggaagatatatcgccagaagattattttctcgctcttaacgagcagtaaaaagaaatcgcctttatatttatcacatattctaaatatatctcttgagaagaatgatatattgctacaatatagtggtgaatctatcgtgtacaatggtagctggcgatatcatcttatcagcattgacagcatagcggaggcagtatcagaataagccacgaccttccgagcaagcagcagccttctgatttctcctccatctctctccccaaaaactatttcattcattccttctggagccaacaagcagaaaataaaaagaatagaccataacaaatgtaatgtgagaacaagtaaaaatgccgaacgggcattttctacgcagtgatatctttacatttgttatggtctattctttttattttcgtctgttttctcctaatgaatcagatagttactatgtaaggtgttttggtgttcccacctgggcatataccgatattttttcgcgttctcttttacgaatccgttccgcacattccttaatcttatgacagatccacatataggctgttgttccttcttgatagttcgcttctgcatacatattgattcgtccatccacgcgcatctgctctacctgccgcatggcttccatatctccatgtgggtaaatagcaaaggttgcaccatgatttttattcacgagggaaaaagcaggaatatcgcttggtccatcagccacatagatgatattttgaaaaggaactctgcgaagttcttctggcatcttggtatttacttcgaccccttcatggcggtttacacctttattaatctcaaacaaagctctcgttttactggtattatcaattgtatagccgatttcactgattatcctgccaccatcttctgtctcttcttcaatcagttcacaaccccagattccctgcacatattgtgcaacgacagagccttttattacctggcttaatcctgtacttacgatataatgttctactttaatatcatattcctgataaatagaatcttcttcaatcagcttccttgtttcttcaaaaatttccggaattccttcataaaaatgaagattctttccaaaatcatagagcatcgcattatttaaacctttaaaaattccttttttcgcacagtggataaaatggtttagataaatagtatccgggttcacccggacaccctgctctactctatatttttctggaagaaaattaacttctctccaaaagtcggaagaatccactccataatactcaaaaatcggttcttccatatatccatttactaatgttttatcaaaatcccagacaactgcaataatatttgccatatcttaccccttattaaaaatcatctacatggatgtttttctttgcatctttgagctaagacaagaaagcctccgcattcctgctacgatactattatatcttattttgtaaatctatgtcaacgaacataactcccatacttttttaattcttttccagttctttttccactttaaaaaactttataaataactatagcacaaataaaatcccaattactgcatatatgatgtgcaataattgggatttcatttgtgtgttttactttattcttatatatgtgtttatatgtgtcgtgtgttattgtttatttatatgtttatttatatttctttgtgtttacgttcgtattcttattctccaaatacagctttataatctgcctggaatttttcgattccctggtctgtcaatggatgctttgtcatctgttcgattactttgtaaggaacagtagcgatatcagcgcctgcaagtgcacaatctgttacatggatcggatttcttacagaagctgcaataatctctgtgtcatatgcatagatatcaaaaatttctgcgatctgtctgattaaatcaactcctggctggttaatatcatctaatcttccaatgaatggggaaacatatgtagcgcctgcattcgcagcaaggattgcctggtttgcagagaagattaatgtaacattcgtcttgattccttctttagaaagaactttcactgcttttaatccttctactgtcataggaatcttaacaaccatgttcggatggattgctgcgatttcacgaccttctttaatcattccttccgcatctgttgttgtagcttttacttcgccactgattggtccgtcaacaatggaagtaatttctttaattacttctgtaaaatctcttccttcctttgcaattaaagaagggtttgttgtaacaccacagattactccaagatcattagctttcttaatgtcttctacattagcagtatccacgaaaaatttcatttgttcaacctccatttatttttgctttatttgatactaccaatataacatgtaaagaaagaaaatgcaagcataaataaaagaaaaaataaataaaaataagtaaataacgttttttattttctttctgtctcgttttttatttttttctctttttttactggaataaatttatatttcacgttataataattgtgctgtttagaatatagtgacaaactacttttacaaaaattctaaacagagatacataatgtattcttggaatctttttgtgcttgattttgtgagaaaaactctaagagtacatacatactatattggaggatcttgccatgatgcagttagaacgccagaagaagattctggattacttaaataaaaacagaaaggctacaactaaagagctgagtcagcttcttgatgtgtctgctactacaatccgtaccgatttaaatcagatggataaagagaaactcattacaaaaacgcatggtggtgcagtttataatgatagaagtcttgataatattgaattaaccggaagagcttatatttttgatgaaagagctttggaaaaccgcaaggaaaaggaagcaatcgcaagcaaagcaataaaattaattaaaaatcatatgtgtatttatctggatgccagttccacctgctatacacttggtatgaagttatccggttttacaaagctcactgttattacaaacggaatcaatctggcactggcattaaaagatgttcccggaatcaccgtaatcttaaccggaggaatcgtcacttctgtttcttcttccattgaaggcttgcttggagaagatctgctcacaaagattcacacagatatcgcttttgtatctgcacgaggcttttctgtagagaatggtctgactgactttagtatttatgaagcagatttaaaacgacgctgtgtaaaatcttccgctaaaacgattgccttaatcgaccatacgaaatttaacacaacatcgatttctagttatgcatcattagatgacttaaatatggtcattacggattttggtctctcagaacatacaaagtccatctatgaaaatgccggagtaaatcttgtactggctaaagaagtctaagccgaagcctgctactgatactacttcctccttttcttttgtgaccttattgtatttctgaaaatattcaagttgagcagtcactcaccacctgaaagaggtgggagtcttcttgactgagataaaaatatcctggcaagtacaaattttttcaactttgtaacatgtccaggatatttttatattttaaatcagatgcgtgtcttctaatttttccataaatgcatcatttaattttatgatcggttttctaagtaccaatccaagtataagagaaagtatcaggaaaatgctcattttaccaagagaagtccaatacgtcataccgtacattccccctatcgtctctcgaatcgctctcatgctatgcacaaaaggaagcaatggatatactgccttgaaaaatgccggtgctacttctatcggaaaggtacctccagaacccgcaacctgtataacaagaagaataaccgataccgcttttccaatatcaccaaaagaaacggtcagggtatatataatatttacatacacaatactgctaaaccagcctgccagcataaagagaaatggatgtttacactgaatcccaagataaaacaaatcaccaagacaaatcagcgtactttgcaataatcctacaatgagaaaaataatataacgtccaagatatatctgataattctttacttttttaagtccctccacagcggcttctgaaacaccgacttttaacatagcaaccagcacgattcctcctacccatatagaaagagtagaataaaatggtgccatagaagaaccataattttctattggatataacttcgttgtatttaaagaaaccggtgcagataaaaatgtagaaatgtcttctgtattatctgatagcaatgactttatatcagataaattgccggcatcttgaagctttgtaagtttatccgtaagtttttttatctgttttgctgatcgattcaaaagatcacaagaagtagttattgctgcttttatatctgtaagatcatctgctgcattttcagcggtcttactgaccttatctgttcctgtatctaactttttcagtaatccgtcaacatctgttcctgtattatttaaagaagaggataaatcttcaatgctgtctttcagattatcttcatacttagactgcacctctgataaactctttttactatcctttaataacgaatcaatgtcttctttcccactttgtatattttctgaagagttacgaagttcatccgcatttgctgctaaactttcacttaattgtttctgaattgcaaccgactcatttattttggcaacaacttctcctgtataagaagataattctggatgatctgttcccagcgcagaaatactttttcctaaagaactataggatgctgcaatattatccattttttcggataatgtctccattgtatctgctactttatctgcatcttttgcctgcgatttaaaagcatcatcaataagctctgatgcatcatcataaaaagaacttccggcagacaaagcttcattaatgccatttgttgccccggatattgttttcttcacaccggataaagatgtttttgtattttccagagaggtcaggctttgctttgactgcgttttagactgttcaagatactttgatgttgtttctaataatttctgtgcagactccaccataccagaaaatgtctgcagggtacttgctgatgcagatagatcagaagtaatacgtttcagatttgtaatcaaattcgaagtaattgtttctgttcctgttttatcagccgcacttgaaaccgtctgcaatgctgtcagagcaacattagatattgtttttataaaaacttcatttatctgcgtctgtatcgctgtcgctcccttatctgtaacctttggtgcaatcgcattttcttttgcattagaatagtacataatctgcggtttttgtacatcctctgtaaaaacactcatcatatttttactaaactctttcggaatgacaatcgcagcgtaatacttcccggatttcacgccgttcactgctttcttttttgttgtgaaaatccagtctaactgtgtattttcatgtaatgcagaaataacctgttctccaagatttaaatcaacagaaatcaagtctccttcgtatccttcatccactgtagcaaccgcaacctttaatccccctgtattttcataaggattccagctcgccgcaatattaaaccaggcataaagagagggaacaacagtaataccgacaataacaatcattgcaatgacattctttcggatacgatttacatcgcctttaaaaatggcccatatatttttcattattcctcttcctccttttcctgttttatctctttctttttctctttcattctttctaataattcctccggtgataagccggtaagcgcaagctgttttatcattttatcatgaaaatattccagacagatcaaataaaggcaaagtattactaaagaagtgatccaaaggattaaaaataccagtttagaattcaagctaaacatcaaaatcagaaaaacaagaggaataatcaacatacataaaaatccacttcgaatcattaccggatatcgtttttcaaatctagcagcactatttacaaattcttcctttaactcttcgtcccgcataagaacttttaacattacagaaagatttcctttttcatttacacctgtttctgtttcacataacattaaatctgtctctgcaagttttttatcaaataaatggttgagattcataagcagcgggcgaagcacaagtccaataaaaaaagcaatcggtataaatattgccagaatcagcagattctttatatagtagttactgtacattccggcaatacattctctcattgcattaattccataagtaaatggaagtaatggatgcagaacctgaaaaaatcctggagtcatctctattgggaatgttccggaagaacctggaatctgcagaataataaaaagaacacaaagcgcttttcctatatgctttaacgtaatcgccatcgcataaattaaactgacatatacaaaagaacaaaacatacccgcaatgataaataaaagcggatgaacgcattgcactcccaataatataatgtcaccaatacatacgatgcatccctgaacaagtcctacagtagcatataacagccatcgtcccatatacgcacttgtcgggctaaaatgatgcacttcatcatctttatccacttcctgtttaaaaatagaaacaagaatcaaaccaccaacccataaggcaagattcgtataaaacggtgtcatacctgaaccataattttttacagaatacattgtctctgacttaatttctaccggagaagacataaagtcagaaatagaatccgcatcaagacctcttaaagaaagtattttttcataagcatccgaactttgtaatgcttttaaatctgaactaatatttccaagttctttatcgagtgtcaccaaaaccccacttgtatccgtaagtgcagaggatgtgtccgttaaactagcgcccaattgttttaaaattaacttcatctggtcaattgttggtgaaatatttgataaggtagacgataatgttccacttaatgccgaaagactatccagtaaattattgatacctggtaaaattgtctgattcaaacgatctgtatattgatttaatgctcttttatttttagaggataatgtttttaactcttttgttgtatcttttgccgtctttaatgcgctttccagtccggcacttccagattttaaagaagtaagtaattcctgcaaagaagcattctgcttttgtaatttagaaatttcttcattcactgtcgttaaaagctgatcatccccatttaagtttgtatttaattctgaaaggtgatttaaaatctgcgcatttttctctgttaaatcttcaatcgaatcgatgccgctttttatcgttgtatttgcctttccggctttcgcttcaaaatcacctaattgttctgaaaccgattgataaatgtctccaaagactgttttcccatctgaaagattctcactaaatgtactggaaaaatctcctgcatatgatctgcttttttgcaaaagagaggaggtatccgataatgctttatttccggaatttgctgcagtttttacttcatctaatgtttttactgtatcattgattaaagaagatgattgttctgttgtattctggaaattctttaacactttctgatattgtgtaatatttttcttcacttctgcaagattactatccatcttaatatttaattgcttcacatcgcctgtcagatcttttgccgaaccctgcacaatttctgaaatagtctgcgctgctacagaagaaaatgtatcattaatctcctgctgtacagttgttgctcccgtatccgtaaactttggggctatcgcgttctttttctcattaatataataatccaactgaggagcttctatttttccagataaaacactgagcagggagctgctgaaatcttccggaattatgatcgctgcataatattcccctgactttacaccctttattgcctcttgacgtgcaacaaacgtccatcccagcttatcattctcttttaaattacttgcaatggtattacccgcattcaatgacagcttttcattatctgccccactgtcttcatttacaattgctattttaattcccgccgtattcacatacggatccatattcgctgcaatattaaaccaggcataaagagaagggagtatacatactcccactaaaatcaaaagtgctgctctattatgaaaaagtcgttttatgtcccgtctgaaaatctgaaatgccttcttcatcgactatcctcctgttataaatcttttaacgtataaaagtatatcaaaaaacaattcaaaaatctactttaaaaaatgacgattagtcattattttttattcataataaccaaaaaacaagggactaaaattttctgctttttgcaattcatcctcgcagagcgttttttaatttacaggaacacaagtttctgcaaaacaaaaatatagcagggattccatatcacaaaggaatctctgctatattttttaacaggaaaattcacaggacttcgctgttacactttttatcttgtgtccactggagtaaccacaggctcttagtcctaattgtactacctgattccagctctttcctgaaagttcaataatcgtatcatcgtcaaattcaatcacacaggcattctttacttcacattcaggaccacatgcaatcttatacatatttttacggcttaatgcaccgatttcttctagaatattaatcatgcggtatactgtagctgttccgattccggaatctttcatggatgctttataataaatttctttacaactagaacagtcctcattcaaaatcacatctaaaagcatctttctctgtctggtaatccgacagccactctcttttaacttttgcaatatcatatctttctgcatctgtgttctgtgaattcccacatcgttaatcggaagattctgattggatttttgcagcatatccacacttctttctttatctgttctttatctaaatctaatagaaaataatctaaatggttattcatttttgttagaaggagtgttcacaggggcagagcaatgtcctgcacagtgtgagcagtttcctccacattgaagtgactttccactttttttatccttcaccatacttcgaataatcagcgcaacgatcaaaacgagtatcagtcctacaattattgttcccatctgccacacatcctttctataacaattttactaaaataatctaactaagtatcaatatatattgctgcatctatccgaaactgattataccatatcatcccggatagatacatcatttttaatcatcttatttcactatcttgcttttacaacgttcttaacatttacatttaatgtattactttctttgtacggtctaaacagaagataaaggaatccgataatgagtgcaaaggctattactgtaccaattccaaatgtacctgctgtaattaatgtaccaatctggaaaatacaaagacttacaacgtaagcaagtaagcactggtatccaatcgcaaagaggaaccactttgtattgttcatctctctcttaattgcacccatcgctgcaaaacaaggagcacaaagtaagttaaacactaagaaagaatatgctgctactgccggaaggctgtttgcaagctgtccccaaaattcgctaccatcttctgcaacttctgcaaatccgaagagaataccgaatgtacctactacgttctcttttgcgattaatccagtaacggctgcaactgccatcttccagtctccccatccaagaggtgcaaagattggagcgattacattaccgatagttgctaaaatactgtcatttaactgttctgcctcaagcattccaaagtttccgtcaacccatccaaagttcataaggaaccataagataattgtagataaaagaatgattgttcctgcttttttgatgaaagaccatgctctttcccacatacttcttaatacgttagaaacagttggcatatgataagctggaagttccataacaaacggtgcaggctctcctgcaaacatttttgttttctttaaaataataccagagcaaatgattgctgcaataccaacaaaatatgcgcttggtgcaacccaccatgctccattaaaaagtgctcccgcaattaatgcgataattggaagttttgctccacaaggaatgaatgtagttgtcatgatcgtcatttttcgatcgcggtcattctcaatcgttcttgaagccataacaccaggaacaccacatcctgtaccaattaacattgggatgaaggatttaccagaaaggccaaatttacggaaaattctgtccatgatgaatgcaactctggccatgtaaccacaagactctaagaatgcaaggaatataaataatacgagcatctgaggtacaaaaccaagtaccgcaccaacaccggcaacaataccatcaaggattaatcctgataaccaatctgcacacccaacagcatttaaagcaccttctataatgctaggaacactagggatgaaaagagacttaataccaaagagatgccatccatcaccaaacactccatcatttgcccaggtcgttgcccagtcacctaccgtagataccgatacataatacacaacgaacataacaaccgcaaaaatcggaagtgcaagccaacggtttgttacaatacggtcaatcttatcagatgttgtaagcttcttcgctccattcttcttgcagctatctgctactacagaagaaatatatacatatctttcatttgtaataatactttctgtatcatcatcaaatgcatcctcaagagcattgatctcattagacacatctggaactgtactaagctgttctacaatcttatcatctctttcaagaagcttgattgcaaagaaacgcttctgttcttccggaacctgagaacctaacatctcttttacaacagaaatagcatcttctacctttttatcaaaactatgtacaacctgtgcagattgtttagaacgtgctaatgcaactgctttctctgcggcttttttaattccggttccttttaatgcggaaatctcaacgacttcacatccaagatccttaccaagctttgcaatatcaatcttctctccggacttttctaaaagatccatcatattgattgccatgattaccggaataccaagctccataatctgtgtagataagtacagattacgctcgatattcgtaccatctacgatattgatgatcgcatctggtctttctccaataaggtaatttcttgcaactacctcctctaatgtatatggagaaagggaatagatacctggtaagtccataatgacaacatctttatgtccctttaactttccttcctttttctccacagtaacacctggccagttaccaacaaactggttagaacctgtcagggcattaaataatgtcgttttaccgcagtttggattacctgctaatgcaatttttactgacatttttttctccttttcctcaaattctaagcttactaatgtttttaagacaaaactaaagtttatagttgcttattttaaaatgtttaagctaacataataatgtatttactaatacttattagcatttactaacttgcagggcaaaaaaaagaggagctattctacctcgatcatttctgcatctgctcttcttaaagataattcatatcctcttactgttacttctacaggatcacctaaaggagcaacctttcttacgtaaatttcaacaccttttgtaattcccatatccatgatacgacgctttacaggaccagcaccagtaagcttcttcactgttactgtctgaccaacagcgacttcttttaatgttttcatgtctttattctccctttttattcatacttattcatcggaacaaaagcctgccttaaacaagaattttgttagccatatctcttccgatagcaactctggaatctttgacattcacaatgagactgccattgatttccgatactacagtcacaagaccgccaacaacaaaaccaagattttcaagaaactttttcgtttctgacctgcctcctacttttttaataacgttaggttctcctgctctcaccatcgacagtggcatataatcatctccttttctaaagcaaatttcccgacagcaccgaaatacccagtgcgtctgtatgaatttcttttttacgtaggttagtataccctaattgtaattagaagtcaatatgtttattgagaaatattatcaacaatattgatttatagatttggtacagacgaaaaaagaaaacatatgctatcccatctgctctgtagtcgctgtatttaagatgctcatccgcatcttaaatacgctcccaagccgcatctgggatagcatatgttttcttttttctgactactctaaatccacagttagtgagaatggggattctccagaaggttaaggattttcgagaaactaaagtctaaaagactgacacatttcttctggagttttcgttttttgaggcaaaatgaagtgtttggcgcaacggaacaaaatcaaacttgtaaaaattctcgtttctttagttaatcaggattttaatttttttctcattgtgatcttctgtgtgaagagttccttccagattgccggatggaataatataagcagtgggaataattccaaacgtcctgcaagcatatcaaatataataacaagcttggaaaaatcactaaaaaatccaaagttacaatctggtccaaccatagaaagtcccggtccaatattgttaattgtcgccgctacagctgtaaagttcgttacaagatcatgtccttcaaaggatatggcaaaaacggagacaacaaaaataatcataaatgtaatcaaatatacgttaatagaacgtaccacttcgtgttcgatcggtttaccatccatcttaatctttttaacactttttggatgaatataagagtttaactctttggtcattgtttttaccataacaataaaacgagacactttcataccaccgccagtacttccggcgcaggctccaacaaacatcaacagtactaatatcgtacggcaggtctgtgaccaggcatcaaaatttattgtagcatatcctgttgtggtaataatggatcccacctggaatgcagcatggcgaagagcatctgcaaattgcatatttcccataacaagacttcccgttataatagctgtagagacaaaaataataccaaaataagcttttacctcttccatttgaagtgcttttttaaactttctaaataaaatcagataatatgcattaaagtttacaccaaaaagaatcataaatatcgtgatgatccactgctgcaatgcggtataactggcaatactatctccttttataccaaagcctccggttccggctgttccaaaagataacgtaatcgcatcaaaaaccggcattctactaatcagcagaaggataatctctaccactgtcatacctaaataaatgacataaagaatctgtgctgtatactttatctttggtacaagctttcctacagaaggtcccggactctccgcacgcattaaattaatatgagatcctccactaagtggtattaccgctaacaaaaatacaagaactcccatacctccaatccagtgtgtaaaactccgccaaaatagagcacaatgtgacaatgcttcaacatccgataatatactggaacctgtcgtagtaaaaccggaaactgtctcaaataatgcatcgatcaaagaaggaatttctccagaaatccaaaaaggtaatgcaccaaaaaaacttaagaaaatccagctaagtgccgttgccacacagccttcttttaaataaaatacatgatttttcggtcttcttattgtcattaatgttcctaacgtcatagcgattgccgcaacaagcagataggcaaatcctgtacgttcctgataaagcacagcgacaatacaaggaagaagcatcaatactgcctccacctttaatacatagcctaatacaaaacgaataatcgaactgttcatatcttcctccgtaccttacgctaaaatatctttcaaatcattaaatcccgtatgtgtcgttacaaccattaccgtatcacctacctgtatggaatcctgaccatttggaagaataatctttccgtttcgattaataaagcaaagaagcaagtctttcttcaatgccagatcctttaaaggaatattggtaatttcagattcttcatacactctaaattcaattgcctcgacacgatggtcaaacatatgatataaagtctcaatattactgtcaagagaagcacgtcttgcacgaacgtaagcaataattgcctccgatgtaatgtatcttggataaataacacttccaagatctaacttagcaatgacatccttaaaattgatacgattaatctttgtaatcacctttgccttagaaacctgtcttgtgtggagagttaaaagaatattctcctcatcaattcctgttaatggaacaaaagattcaacataggaaagcccctcttcttttaataattcctggtctgttccatctccattaataatgatcgctttcggaagaagaaccgataattcctcgcagcgttctttattgttctctataatttttacgtcaattcctacatctaaaagattcttagccagataataggctgcctttcccccaccgatgatcatcgtattctttacctgttttgtctcaaatccaatgtgggaaaggaattctctcgcaagctttctggatgcaacaactgaaatcacatcccctctttgtaaaataaaatcaccaccaggaatgtatacttcgccgtctctctctactccacatacaagaatattcgtatgtatctttgcacgaagttctgcaatttcaataccatctaatatattgccctctggaataacaaacttaattaattctgcctgtccatgtgcaaaggagtttacctcaagagcagatggaagaaataaaattcttgctgcttccctggctgcttcaagttctggattaataatcatcgcgagacccagtttttcacgaagatatcccgcttctttactgtaatccggtgtacgtactctggcaattgccgcacaatcaccaacctgctttgcaacagtacagcaaagcagattcagttcatcagattctgtaacggaaatgatcagatccgtttcttcgattcctgcatccatctgtacactataactggcaccattacctacaatacccatgatatcatacatattcgcaatttcctgaacctttttcgcattcttgtcaataatgataatatcatgtccctctttgctaagctgctccactaatgttgttccaaccttaccacaacctactatgataatcttcaatccttttttcactggcttactctttccagagttcataaaaccaaacatatttcttcctcctgtgttttcaacatagccttctcattatagcagatattggtgatttgtaaatagcatcatttacaatattactattcatcatccaaatgctgctgtttcagccaatttttcatcatcatacgctgtgggagaagctttgcagctatatgtgagatttttgtaaaaagactgtagatggaaatatctttacattttttcgcatcttttaaagctttttttgctaccttatccggcgtgaccatacctacatacttcgttgttgctttccttgctccaatttccgctctcttatataaatctgtttttatccagccgggacatactgctgtaacacagatccctttctcttttaattccacatttaacgctcttgaataatttcttacaaaggactttgtagagctatatatgttctgatacggaagtggctgaaaggatgcctgagacgcaatattaatcatatgacttccttttttcatataagggatacagacaagccccatcgccacaacagcatccatattcacatgcatcatgttcaaagattcttcaacacttaaatccccataagaacaaaactttgcaaaaccagcattattaacaagataggaaatctccagattcttccgcccggcttcctcatgcagctcctctccaaaacattttatctggcggacactggagagatcaatagaatatattttaatctttttaccaaacttatctttcaaacgactaagtttcttttcatttcgagctaacgcccatatttcgtcaacatttttttcttttaagagaagacggacaaattcccgtcccaatccacctgttgcccctgtaactattgcaatcttttttcccttgatcattcgattccctctcctttaattattcgtacaatttgccgcatcaattgcaagaacaagcattaaccccattaattcgtcctttggttcaagaaaatcaatcacataagtgtctccccaatgccatggctcctttgtaatatgtataaccgcactgcatgcctcatatacatcataattccaggaaagaaaatctccctctacatgccagccattataatctaattcatactgtgggtgaaaaaaggtaaacttcttttttataataccgcaggaatgcccgcctatcatcacttcaaactccggcaaaaaggtaagaaccttctccttaatcagcccaacctcatgtccattcatatcatatacatgcaggcgatgccccaacgataaaaattccgcctgtacaaaatatttcttattctcatattcatcgtatatatcaaaggtatctgaccaggaaaatactctttgctttattaaaaatttcataaataaaatcctttcgtttgccataggcggaaacccactacctttaggtggtgggaggagccttggaaattgttactcaatatgctacaataaccgtagcagtttttaaagagaaaaccgttagatgtgttgctcatcaaaggcactcttttgtacattgacaagatatgaggttgcagtacgaaattcgtgtattgcgtaaaatcttaatcgtaaaaaaatttttactgtatagcatgggaagtttagtacctgatgcagttacagatgagtatatcttgtctgtaaagggtgctgtcaaccaccctgtgatgtaacgccactttagatagcaatatctatcggggattaaaggtcggaggtgtaagccgttagtacgactgggcagttacaagcccatgacctttaggtcgtgggtagttgacaagcaatcacctctgtttttacttagcttattataccacgttgtttttttgttgcctactcctatatatgcatcatatctctgttttaacataaaaaagccatcttgccggataacatttttgctatcggcaaaatggctttttcacttcttattattatctattttggcatatgtaattgaataataagattaatttatctcactttttagttaggaattactaactgctgtaagaatagcacaactcattagaaaaagtcaacacttttacatgagaataattctcacagagcacttatatcacttcgtgatttaaccatttccggcttcggaatcgtatggtaaagattatatttcgaacagtccagtctacaaacattccaatccatactgccatcggtcccatatgaaatgctcttgcaagaaaaataacaagacttactctgcaaaaccacatagaaagtacagagactgccatagagaattttacatctcctgccgcacgaaggccataggccggaataaatgccataatccacacaatcggttttacaatactgatccatgttaccatgtaaatacacagcttcgcgctttctggctccattcctccaaaatatgtgataggacgtaccaaaagatagaaaacaagacaggatatcactaaagttatctccgcaataatacaaagcttctttatataatagactgcttcctcttttcttcctgctcctaaagtttcacctacaacggtcatcagaccgattccgataccaatcgcaaggattccatttaaattttcaattacatttgtcattccctgcgctgcgattgcggctgtccccatcatagaaactgtagattggattgccagttttccaaactgaaacatactgttttcgataccggaaggaattccgatatttaaaatctttttaatctctctccaatttggccgaatagaaaagtaatctctgaatggtatttcaagagaagggtttctaagcttccataatacaatactcatgctgaagaaacgggagcctgctgtcgcaattgctgaacccgcaacgccccagtgaaatacccagacaaatatgacatccaaaaatgcatttaaaaaattagatgctatagaaatctgcatggggaacctgctgttattctgtgctcttaaaatacaggagccatcattatacaatgcgataaacggataagacagcaccgaataaaagaaatactgttttgctcccaccataacatctttttctacttttccaaaaatcaaatgcaaaagctgctgattaaatacaagacaaactccggcaatgatcaccgataataataacgtaataaatacaagctgcctcgctgcttcttttgcacttttttcatttttacatccaagataatgagaacacactacggttccaccagaagcaagtgcaaagaatgcctgcacaattaaaatattaattgcatcaaccaatgataccgcagaaatcgctgcagaaccaagattactgacaactaatgtatcaatcgttcccataaaagaattcaaaagctgatctaatgccagtggaattaataatgctgctaactttcgattactatataatctttccggtatttgttttttctgttttattaattctgtcatttatatactgttccttcattatttaaaatttttttacgcaattttttattatactgcgatacaaaaagggatgcaagattacctgcacccttttttgttcttttttttattcaaaaggataaatcattccccactgctttctaatatctgttaacacactcattacatcgcggctgtaagtgagatattcttcatttccaccgtttaaaacataattctgcatatcttctacttcataatccaatgcgtatgcagtttctcctgcttcgatggtttctgtatgtccatcacttgtataagtgatcgtcgctttatctcctcttggataattataaatctcaataaatccatcctcgcaggcaacaactcctcttttaggctgcttcgcacgcattgtaagtgccattaccaccatctgtccatctggatttcgaagaatgattcctgaagtctcatctactcctgtttcaaaataattagcagttgtaagaattgtatctggtttgctcttcataaaaaatcttgcaaagcttgtcgcatacacaccgatatcaagtaaagcccctcctgctaattctttagaaaagaaacgatttgtcacatcatattccttacagcttccaaagtttacctgaatcatcttgaccggtcctagcttaccactgtccacaatctctttcagcttcttaaatatcggcatatgatataaagtcatgccgtcacaaataacaagcttcttctctgccgcaagctttactgccccctcaagctgtgtatcattcactgtaattgccttctcacaaaaaacgtgctttccactttgtaatgccttcattaaaaattcataatgagaattatgtggtgtcgcaatatagacgatatcaatattttcatcggcaagcatctcatccacactgccgtaaacatgctttacaccaaattctttagcatatttttctgcactttctatacttcttgcacagcaggcatagatttcaccattcacacgctgtaatgcctcacccatttcatgagcgatccagcctgttccaagcattccccagtttaactttttcattatataatcgacttcctttctatataaaacactttttcaaacgctctctaatacttaatatcttattatttttcgatgacttttacttcatcctcacatacacaaagaacaataaccaaatttaaaaatatagtacaaacaaaagataaaaactcgaacttatggcagatataatatcggagcaggtaaaaatatcaaacatacctttccatgttgcgactctctttacatctgttataagttcgagtttttattttcatccgtttttcagataaatcaaattattatttcatttcttttgcaagtgctgcaatctgtgcttcactttcttcatttactgcagaacgaaccgttactgttgtgtctgcaaaagtaatattcttactcttttcaaaagctgctttcataatcttagctgccattggcgcccagcttccgttttctacaaaacctattttacgattctgatagcttctctctgttaaatgattaataaattccttcataaatgggaagatgtctccattatatgttgttgttgcaagaattaactttccgtagcggaaggcatcttctactgcttcggccatatcatctcttgcaagatcagtaacaacaacttttgggcagccttcttctgttaatttctctgctaagagttctactgctttctttgtattaccgtaaacagaagtatatgcgatgactgttccctctgtttctacctgataagaagaccagatagtgtaaagattcaggtaatgtcctaaattctctgttaaaacaggaccatgtaacggacagattgcattaatctcaagagaaccaactttagcaaataacttctgtaccattggtccatactttccaacaataccaatatagtaacgacgtgcctcacagtcccattcttcttctacatctaatgctccaaatttaccgaaggcatctgcagagaagaaaatcttatctgttgtatcataagtcatcataacttcaggccaatgtaccattggagccattacaaaagtaaggttatgtttacctgtacttaatgtttctccttcttttacgacaatctggcggtcagcaaagtctgtaccaaaaaactgtttcatcatagggaatgtctttgcatttccaacaatttttgcttctggatatttttctgcaaaatttgcgatatttgctgcatggtctggttccatatgctgtacgatcagataatccggtgttcttccggcaaaagcctcttcaagatttgcaagccattcatccttaaaatgagcatctactgtatcaaatacagctactttttcatcaagaacaacataggaattataagacataccatttggtacatcgtactgtccttcaaataaatctacttcatggtcattcacaccaacataaatgatatcttctgtaactttaaacatataatcacctcatattttttgattattttcaagtcgagctgccgcctgaaagaggtgggagtcttctcgactgagataaacctgtttcctttgcaactgccacattttacccttgcgacacagttcctattatataaaatttaattcaagtatacaagatagtaaactacgattttttctcaaatttcctctatattactcattttcttgtattttataaaaaacaatacctgtctttgcgcaaacagccttttctatttttctttcttttttctctaattcgcaaactggctattgtaaagattcgcataaaaaccatttttctttaacagattctcatgatttccctgctcaataatatgtccatcctgcataacgagaatcacgtcggcattctgaatggtagagagacgatgggctacaataaagctggtacgtccttccatcatttttgcaaaagcattttgaatcttttgttctgtacgggtatcaatcgaagaagttgcctcatcaagaatcaacatagccggcagatcaagcatgactcttgtaatacaaagaagctgtttttgtccctgactcattccggctccatcttccgtaatatacgtatcaagaccctttggcatctttttaatgaaactataggaatgtgcttcttttgcagcagtaataatctgctcatccgtaaagccttctcttcccattgtgatattgtcacgaattgttccacttcgaagccaggtatcctgtaaaaccattccataggaagttcgaagactttctcttgtgatatcacgaatatccgttccttctaccatgatcttgccctgattcacatcataaaaacgcattagaagattgataattgttgtttttccacagccggtaggtccaacgatcgcaatgcgctgtcctttttttaccttgagattaaaatcttctatcagttgtttttcttttgtataagaaaatgcaacatgagaaagcgtaacattaccttctggattccttaagatcatcgcgtcttttttatcatcactctctggtttttcctcaataagttcaaaaatacgtgcagcgcaggctaaagcattctgtagttctgtcactacgccggatatttcattaaatggtttcgtatactgatttgcataacttaataaacaggtaagctgtcctacactcagtcctccgctaattgctgtaagtgcaccgcttaatgcaacacttgcgtatacaatactatttacaaaacgagtggaaggatttgtaatagaagaaaagaagattgcttttaaagaatatccctgtaatttttcatttactttagaaaaacgttctgctgctcttttttcgtaaccaaaagcttttacaactttttctccctcgatcatttcttcgattaatgctgtctgttctcctcttgtctcagactgcaatttaaacatggagtaagtatgtgtagcaataaaacgagcgactagtaatgaaatcggtgtaagacagacaactaacagagcgattcccaaatggatagaaaagataaatccaagcgttcctaaaattgtaactactccagtaaaaaactgcgtaaatcccatgagaagtccgtctgcaaactgatcgacatctgcaataacacgacttactacatccccataggaatgtccatctatatattttaatggaagcttctcaatctttttcattgcttcgtttcgaatgtctcttgtcacatgaaaagtaatatgattattgcagacattcataatccactgtgcagctccggtaaaaacaattacaaccgcgcctttttcaagtatgcctgcgatcgccataaaatctacctgtccctttttaatgatatagtcaatcgcatctccaacaagaatcggaacatacaaggttcctgcaacagtgactgctgccatcacaacagacacaataaggagaaaacgataattctttaaataataccacacttttttcatcgtgctttttcttttgccagctgctttctgctctgccatctacgcttcctccttcttaaactgtgtttcataaatctcgcggtaaatatcacaggaagcaatcagctcttcatgtgttccctttcctgcaatctttccatcatcaagtacaagaatactatcggcatcctgaatagaagacgttctttgcgaaacaataaacaccgttggtttacgcttcatattttgaattgcttttcgaagttttgcatctgttgcatagtcaagtgctgaggcactgtcatccataataaggatatcggactgtggtactaatgctcttgccaacgtaagacgttgtctttgtccaccggaaagattctttcctccctgttctacaacagcatccaatctgccttcttttgtatccacaaactcttttgcctgagaaataacaagtgcttcctctatctgttcttccgtagcatcaggacagccaaacatcagattatctcgtattgttcctgcaaagagctgcgctttctgcggaacaacagaaatcatttttcgaagtgactcataagtgtattcccgtacattttctcctgcgatatctatttctccttctgtagcatcataaaatcttggaatcaagtttacaagcgttgactttccggaacctgtaccaccaataattccaattgtctgtcccgccattgctttaaaagaaatattctctattgcatgatctccgcctccggcataagtaaacgatacatttttaaattctactgccggaacatcatttctaatattggtagatttttcatttccttccttcatggatggttcgatagaaaaaacatcctgaatacgattaaaacaagccatcgcccttgtaacagatataattaaatttgctaatttgatcagttccacaagtatctgtgacatatagttataaagagctactacctgaccctgtgataatgttccaaggctgacacgaaccgctcccgtatgaataaggacaagaattgcaaagtttatgatcacaaatgtaagtggattcgttaatccggatattttacctgctagtttttgtgataaagtcaactgttcattctgacggaaaaacttctcatattctgcctgttcctggcgaaatgcccggattactcttactcctgtaaggttttctctcgttgttccaagaatcgtatctaatcctgcctgtactttcttataaagtggctttgtaataaacataacgccaaaaaccacaatagataacaggataattgcaacaacaaaaatcatcgctgcctttacatcaattgtaaaggccatgatcattgctccaaatacgataaacggagaacgcagaaaaagccggagtacaagattgataccattttgcacttggttaatatcactcgtcatacgggtaatcagtgtagaagtacctatcgtgtccatttcctcatatccaagtgtctgaatatgcgtaaaaagctcatatcgaattccggtcgcagcccctactgccgacttagctgcaaaatactgtgccgtaattgaacaggtaaggccaactgccgccagtaaaagaagcaacagacacatttttataatatggctctgattctttaaaataataccatcatcaatgattgaagcaacaactaagggtacaaataattcaaaaaaggcttctagcattttaaataaaggagccagaacactttcctttttatagtctttcataaagtataataatttcttcataaaaattcttctttccgtcctttctgttaaattcaagaatgccccgttacagtttaacatcttctttcgtctttttaaagagatagataaattttttcatcagctttatttgaaaaattgctttcaatatgttatcatattatcaactgaatttatatttattgaggtgattataattgaaggaaaaatacaacgaatccgctgaaaactatttagaaacgattttagttctcagcaaaaaacttcctgttgttcgttccgttgatattgccaatgagcttgactttaaaaaatcgagtgtaagtattgctatgaagaatcttcgtgagaagaatcacatcacagtaacagatgccggatatatctatcttacagaatccggaaaggcaattgctgatatgatctatgaacgacatcagatacttacatcctgcttggagaaattaggtgtttctgcagaaattgcagaaaaggatgcctgcaagatagaacatattatcagtaaagaaagctttgaagcaatcaaaagacatgtaaagacgaacataaaataatcgaatatcaacattaaaaaaggaatggtatctacgatctgctatcgattgatactattcctttttactttttatcttgtattgttagattactctgcttatatccatcaaagagcagtaatactgccggtatccttctctttctctcagataaaatactttggcatatacagacatcttttgctccccttcacgtaaaagtttacgcggataactttaatatttccatcgaacacctcaaaaaaaactaccggtcctaacacattatttaacatactgtcactgacaaaattcgtgtctataaactcacgaatatgcatcggttcaacctgtttgtaaacaagcccctgggcatcaatctgtcttttgtctcttaacaattcctcaaacttcttaatcggcaatggtttataattgcttccagaatattagcacttttttgtctctcctcttccttaaattgcaaaaagcgcatatcaagcttcaacacatccactggtatattctttagcatatttaaagaagagtaaccacagccaaaatcatccatcataacaaccagcctttgagccactgacaaaccttctcccagacataacgatctaattgatctatcatcttattcttttctaatacagggataaatcctcccggtaaaaaaacttctccatctggcttttgccaacgtactaatgcctccgctcctacaatctgtccggttacaatattacattgtggctgtgcaaaaaaggtaaactcacctttttctaacccttcttctattgctgctaaaagataaacttcttcttctaagctggattccatttccattgtatatcgacaaatatgccacttataatcttcttcggcatgagacaatgcaagcattgcatgatcatacatcaattccgtcatattctaacgcactttgtttcagacaggtataaatataacgaatgacttcatcccctgaacttctcccatacaatttattaaaaaggcggaaatgttcaatatcaattgctactatgcaatatgtgttcggaagaatttccggaagccgcttccgaagcctttccataaaagaatggttataataataatcacttaaattgttactgttcatcgttccttttaccttacctgtccttatttttgcaatatctgtcattgccaaattctgttttttattctatcatactttctgcaaatataccataacccattttaggattatcaatcaaaacatgggtcactgctccaactaactttccattttgtaaaataggactgccactgagtccctgtatgattccaccggtgagtgcgatcagttccggatcggtcacttttatctttagagtttttaaagaatctttttcatgaagaaagattttttctatttctatggaatactctttactttttccactgatactgcttcttaaatatgctcttcctgtctgtatttctgatttttttgcgacaggaagtttttcacccacacaaaattcttttttattttttatcatttttccaaatataccgcctgttgtattcgcatatatttctcccagataattttgcggcacataattgatcgttccaattacttcacccggcttacctgcctttccttttaggatagaggcaatatcggcccgataagcacttcctccttctatcaggaactgcactccgatatctccatcactaattccatgccctagcgccgcaaaggttccatcttctctgataaaagtaattgttcctatcccctgtgtatcatttcttatccataccccaatctgataacaattatttttacctgaatacactggttttatttttatttttattattttcttttttcttttaatggttaaaacaatttctttttccctatttttttgtaataaatgtataaattgctgttttgtcgtaattttctgtccatttaaagtaagaatatagtctcctgcttttattttgcaggcggccggacaaacagattttccattctgacattctacctgctgtagtcccagaacaagaattccttctgtctttacataaataccaatcggaacacctgacgcataaacctttgtattcttctccttctgggataactttttgttctgcctctgtatctgcgtagaaaatacatcttctgattgcagataaggcccgtactttcctatgactgacaagatgaaaaccaacaagacaatatagaacccttttaaatttttcctcataaaaaatgcccccatatctaagttttcacttagtatggcaggcatactgctgtttcaaacagacatattttactgttttgccagggtacgcatttcccttgcattctgtaaaacggcatctgtaatacgaacaccaccaagcattctggcaagttcttttatagattcttcttcggtaagtaaataaatattactgatcgtagaattggaatcacttgttttttcgataagataatgtgcatctgccattgccgcaatctgaggcagatgcgtaatagcgattacctgtctctttttcgcgatgcaggcaagcctttccgaaactttctgcgctgttcgtccgctgattccggtatcaatttcatcaaaaatcaatgtttctattccctcttcatctgcaagaatcgacttaattgccagcatgattcgggaaagttcaccgccagatgcgatttcatgcaacggtctgactgcctggccaggattcgtagaaatcataaaacatacggtatctcttccatgaggagagtactgtgctgactgctcaaagacaatttcaaattctacatctaaaaaattaagatcgcgcagcgcttctttaatcaactgcgttaaaggaattgccgcatcttttcgcaaagaagtcagtttatcgcactgtatatccagcttttctctcactttagataattccctttttatcttggaaatatactcttcataattggaaagtttttcatatttttcaacgctgtcatcatgatatttttgtattttttctatggaatctccatactttgcttttaaatgattaataagatttaaccgatcttccagttcagcaaactgctctccatcaaactccatagaatctatatatccggacagctctctgttaaaatcattaagcaatgaatctatcgtttgcagctgttccgttagtcccttcgccccggcatccatgctttctaccgtatataacttttgtactgctgaaccaattaaatctcctgcgcagccactttgtcctgctgtcatttcatgtactgctgaacaatcagaaagaatttctctcgcatgagacactttctgatattgcgcttctaatgtctcatcctctcctgactgtaaattggcctcttcaatctcctgaatctcatattttaaaaactccatctcccggattctctgctcttctcccatattctgttcagaaagcgtttgcctaagttcctggtattcatgataaagagatgctgttttttcctttattggcgtaatcagattcctgtggtaactatcaatgatctttaaatgattctgcggttttaaaagaagctgattttcatgctgcccgctaagatcaagaagaagcggtgaaagctcttttaatcttccgattgttacactgatatcatttactttattaatcacacgatgattggtaattcttcttgatatgataatctcaccatcttcaaatggaatttcaaattcttccatcttttttcgtacagcctcgctcttcgtatgaaagatcagttcaattaatgcactatcacagccatttcttatcatatcctttggaatctttgcaccaagtgcagattgaatcgacccgatcaggattgatttacctgcaccggtttctccggtaagtatattcagatgatctgtaaaatctacttctgtttcctcgataagtgccagatttttaacgtgtaaatttatgagcatagcaacctccgatgttaacgatgtcctttcataattgtgtcaatttccttcatgacttcttccaccatagaagtttctttcaccacacacatgatcgtgtcgtctccggcaatacaccccagcactccatgaagagaaatagaatctattgccgccgcacatgccatcgccatgcctggaacagttttcagtactaaaatattttccgcattgtccatgtgaaggattccttctgacaatactcttttatacttactagaaacatgaatatcctctgcttgaatcggtgcatatttctgtcttccatttgcaccggtaaccttggtaagttttaattcgcggatatctctcgaaacggttccctgcgtagaagaaaatcctgcttctgacaattttttcgtcagttcttcctgtgtttctatatcatttgtccggataatctccagtattttttcctgtcgttttcccttcatttattatctccacttctgttataaaagcttctccttcaaaatctgtacaaagctgacttccgttgccttaataaacggagttacctcctgcgatttatatattttcacctgatccccaggaaatagagaaagaccctctcttccatcaaaagaaatgattgcctcttccttgatgttacttctgatctgttctacttccactgttacaatatcttcctttgcgaggacgatacttcgtgcggtcagggaatgcggacagattggagtgatcacaaagtttttacaggtcggattgatgatcggaccaccggcggataaattatatccggtagaaccggttggagtacaaacgatcactccatctgcacgataacggtcaatgactgaaccattgatgcctacctttaatccaataactctggatgctccaaagcgattaatgttaaagtcatttaatgcaatatatgttgctgctttttctccctgtttatacacctctgcagtgagcataatgcgattttctacctggtactggtcctggagcagtaaatccagagtctttgacaaatctgcaaggttcacatctgcaagaaatccaagtgttccaagattaattcccagtaacggaatattacttccaaccagcatccttgctgccgcaagaatagttccatcccctccgattactaaaatacactgtgttccttctggtatatcaattgaagagacatctctgtcatattggtcatagatgttacatactgcacctaatcttgaaatatgatgtctgatctgttctgtaatttcaagattaatatctttttgcttatttgcaataataaaaaaattattcatggtgtctattttgccgcatcacgatgagaaagagactggtgggatgcggtaacgacatccggtatcgtcttctcatcaatctggctttcctccggtctgtttaataaatgcaataaatactctatgttgccctccggtcctttgatcggagaatagtcaagatgcaacaaagaaaacccaagtgccgcagcaaaatccataatctgttttattacatcttcatgaacggcccggtctcttacgacaccttttttaccaaccttctccctgcctgcttcaaactgtggtttgatgaggcagacaacctgtcctccttctttcagacatgcctttaccggtggcaaaatctttgtaagtgagataaaggaaacgtcaatagaaataaaatcgaccagctctccgatatcctccggcttcacataacgcatattcgtcttttccatacagacaacacgttcatcattccgtaacttccagtcaagctgtcctcttcctacatctacagaaaatacttttgctgctccgttttgcagcatgcaatccgtaaatcctccggtagaagcgccaacatccatgcacactttatcttttaaagaaaatccaaactgttctacggctttctccagttttaatcctccacgactcacgtatcttaatgtggagccatggatttcgattgttgctgctgccttttcatcaaaagtacttcctgctttatcttctctttgaccatttacaaaaacaactcccgacatgatcattgcttttgctttttctctggatgcagctaatccctgttctactaataatatatccaaacgctgtttcatcttttaattcatcctatctattattgactttacgatggaatcggcatcgattccggcctgttctctttgctgtgccacagtggcatgacgcacaaaataatctgatattcccagtgacagcagatcattatgatatttatttttatgaaggaaggcggaaaccatctgaccatatcctccaattaattcattctcctctacggtaacaataagcggatactttgccgcaagctctcgtaataagtcttcgtccattggccgaataaaacgaacattgacaagccccggattatatcctttttcctgaagatgctgtactgccttttcacactcttccatgatacttccaacagataagatcacgacatcctgtccttcatgaataacttcactttttccaagttctacaggagcgttgtattcagaaagtccctcatatacgcttccccttggatacttcatagcaattggcccgttatattctaaagcaaacttcatcatccccggcatttccctgccatttttaggagccataagtaccatgttcggaatatggctaagataggaaatatcaaaaataccctgatgtgtttctccatctgcccctacaagaccggaacgatcaatacagaaaaacactggtaacttctgtatacacacatcatggagaatctggtcatatcctctttgtaaaaaagaagaatatacagcaaataccggatgcattccctgtgccgcaagacctgcggcaaaggtaacagcatgttcttctgcgatacctacatcaaaaaaccgtttcggataatattttttaaaacttttcaatccagttccggatggcatagcggcagtaattgctacaatctttttattattttttgctaaggcaaccagactatccgcaaacacatctgtatatgttttcttcgttttctttgctaaaagctctccgctttgtctgtcaaatggtccgattccatgaaacttttccggatccttttcggcattcttatatcccattccctttctggtaatcgcgtggatcaataccggtccctcatgctgcttcgcccggttaatcgcatggatcagttcataaatatcgtgcccgtttacaagtccgtagtaagtgattcccatattttcaaacaacattcccggaataaataactgcttaatggaatctttggacttctttaacgttctggcaacgctctttcctactcccggaatattgttcagtgcactttctacattctctttaaattcactgtaactctttctggatcgcagatcatttaaataacggctcatcccgccgacattttctgaaatagacatcttattatcatttaagataataatcatattctttttttcttttcggagaatagataaattatttaacgcttcatacgccattccaccagataacgcgccatccccaatcactgctacaacagtattatctttttgttcgaggtcccttgccactgccagaccaagtgctgcagaaatcgatgtggaactgtgacctgttccaaacacatcacattcactttcacttcttttaggaaagccacaaagtccatccttttgccgcagtgttgaaaattcgtcttttctccctgttaatattttatgaacgtaagactgatgtcccacatcatatacaactttatcctccggaaaacgaaggcagatatgcagcgccatcgtaatctctactgctcccagattcgaagcaagatgtccgcctgtctgacttacattattcaaaagaaaatctctgatttcctctgccaaaaccgggtagagcttaggagaaatccttttaatatcatttggttcttttatctgatttaataaacgtcccattacgcatcctccgagagtacatatctttaattctttcttccaactaagtataatagcagttctcgtaaaaagtcattcttatattctaaagcatcaaaaagctgtaatgcttcctctgtatactgcttcgcatcttctccagactgttctaagccacgaaaaagtacatatgtattctttccgttcttttcatcgctccctgctggttttcctaatgtctcacttgtactcactacatcaagaatatcatcttctatctgaaaagcaatcccaactttatttgcaatcttttctatggttgctgcttcatcctctgatgctccagctaataccgctccgatcatcattgcacactcgatcagggctgctgttttattgttgtggatgtacatcaacgtatcaaaacttatttccttattctcttcttccacatccactgtctgaccaccgatcataccgtagattcctggctttttcgccagaatctgcattgcttttgctgtcgttatatcctgtgcgtccccacaaaatgcctttgatgccgtttcaaatgcataatttaataaggcatctccggcaagaatcgccatcgcttctccaaactttacgtgagctgtcgggagacctcttcgaagatcatcattatcaagcgccggaagatcatcatgaatcagggaatacgtatgaatcatctcgatcgcagccataaaaggttctattacgctaaggtcttcccctccaaacatcctgtaagtttccagcataagcatcggacggagacgctttcctcctgcctttacactataattcattgcagttaatactgtcttttgcaatcctttttcttccggaagaaacggatagatcatattttcaatctgttcaatcttcttcggaagctgttcctttatggatggcttcattttgtccctcctgtaagataattatctctttttgtgttttatctaatgtctgcgaacacttatctaaaagctttactccttttttataaaggtccatcgaatctgctaagctgacttcctcttcggaaagctgctcaataatgtgttctaactgttcaaaggcttcttctattgaaaacttcgcttttgccatatttcaacctctttactttttattcttcttcagatgaaccggtattacttctgcctctccatctgaaaaggtaaggaaaaaaggaacttctttctccagctgttctatggaagcaaccggccggccatcttttgtctgtgcaaatgcatagcctccctttaatcgattcgttggagcaagcccggaaagctgatctacgtatcttgaaaacatctgctgacgactcctgtacttttcttttatggcctgtgataaacgattctccaagcgctcatagagcaatttatgttttaaaagctttctgtccggtcttcccgcttcaagctgtctttgtaacagaatcatctgctgccgtaactgcgcacacctttgttctgcctgcatatccaatgcttcacgataatttgaaagctttgtaaaaatagactgcatatccggaatcgcaagttcacaggctgcagaaggggttgctgcacgaacatccgcacaatagtctgcaatcgtcatatcaacttcatgaccagttcctgatataatcggcgtatctgcctcataaatcgcatccgccaccggcatctcattaaatgcccacaaatcttctatcgaaccaccgccgcggccgataataataatatccacaccagctttatcaaaatatcgtattcctctcgcaatctctgccgatgctccttctccctgcacttttgccggataaaggtaaagctgtaccgtctgattccttcttcttgcaatactcctgatatcttcgattgccgctccagtaagcgccgtaacaattccaatcttttccgggtaagcaggtaaaggtttctttctttcaaaatcaaaataacctttttcggcaagctcctgcttgagtctttcatagcggacatacagttcccccgctcccgccagttcgatctttcggacatataactgataggtacctgcctgttcatacactgaaatatttccgcaagcctcaatcagctgcccatcctccagatgaaaagcaagtcctttaaaccggtcagaggaaaacataacacagcgcagtgtactcttttcatcttttaaagtaaaataaatatgcccggacgaatgatacttacagtttgaaacttctccctttaaataaatcttcttcagtgcatagtcactttcaaaaatacgatgaatataagaattgatctgtgttacagaaaaaatatgcttcattaatataaaccacctcaatgtactccgcagtttccattctcgcagagcgttttttatattaccggaacaccgttcttcgtaaaagtaaaaaagcggcagagaattcttcctgccgcctcattctttttcagttatccaggtacaggtcacgaattattcgctatgccagcttcgcaagaactccatttataaagcggggagcttcctcactgcaataaatcttcgcaagctctacggcctcattgatggcaactcccgtaggaatattcgcatcatttgtaatctcatatactgcaagacgcaggatagccagctccggctttccaagtcgttcgagtctccagccttcacaaatagaatgaatcttgtcatcaatctccggcagacgctttaaaatgcttccgatctttgtctcgatatagagctgatctttcgcttctacatccggtctttcttcaaaataccacttcatctgctcctgcaattcttcctgtgtattaaattctatacgaaacagtaaaagaaaaatagtttctcttacctttcttctggacatcttcatgtgtcaaacctccgttatct

SEQ ID NO: 424 - DNA, 38535 bp, Eubacterium hallii
atacttagacattccatctgcaaaataagataacttcacacgaccattcagcgtattgattgaaaagcggttttgtgttaaggaataatctctgttccagaccagatcatactgaggctttttgaacaagggcttaatccattcgttttgattctccagaatggtcttatatctggcgataacggtcttcaaaacagactgagccatttgcgatttaagaccaaacttttcccgtaaagtagaatacaaaaccttattaagtgaaaactgctttaagtcgtgagtatggaatacatagtctgaaacataattgcaggcgttacgataaacagacatcgtttcatcaagcaaaactttatcagtttccgttgcgactatttgaattttagctgtaatagttatctgttccatagatgtactcctttcgtagatatttcactaaatatattatataataataattagtgaaaatcaatgttttgaggtgaattatggataatagatacaatcgtcataacagacggaaatacaaccttaaagtacatatagttctagtaaccaaatatcgtaaacaattactcaaagattctatcgctgatgatgttaaacaaaagattttcgatattgcgaatgcttatggctacgaaattattgctatagaaaccgacaaagatcatatacatttcttattaagttacgatacaacagataaagtttgcgatattgtcaaaattgtaaagcaagaaacaacgtattatttatggcacaaatatggttcgctccacacatgaaatcaaatacatagcactgtaaaatcaaagtaaatatttcgatcaacagaaccttttatgacaacatctctttcacacaagtacttcgataatcacttggtgatattttatatctttctttaaatactcggttaaacgttctctgactttcaaatccactatccagacaaatatttgtaatagaatcactcgtattttccaaacgatggcatgcatagttcagccttacatcgttaagatattgattaaagtttctatggaatatcttggaaaatagtctggataaaacatatttgctcacgcccaggtcttttgccatctcttccaacgaaaacttcttcttgaaatttgctgatatataggaaactgtctggtaaataagatcgttgctccccacactgctcttttctaccaaatttaattttcctatgcagcgtgccaacacaatttgaagatatgcctgtgcaacagtaatatccgactgttctgtctctaaaattgcatttataaccctatatacctccgtttcaaccttttccgctttgatgattgggtattcaggagccatggattgcatgatatctgcaaatttggctatcgtaaatggcgatgcaatcagataagtcgctttatttacaccgggtgtcagtacctgatagtgatgaataacatctggaaatacaaagcctatatctcctttttccatatggtatagttcctgtccgacaccaagttctaatgatccacttgttacacaaacgatctccagtgcattatgaagatgtggttcaatatgttttgacttcctatttattgctataatctcctcttttgtgtcaacatattttaactgcatgaaatactcccctttgcaacatttgtctatatcttctttcgatttggcaagcaatccttttacacctatcttataatcaacttgtaaataaggaaaggaggaattgcaaatgagcaacctaaaaaaatatctgaatgaccttttagtattctacactgaatattttgagcatccttaccatgtataaatactaaaaggactattttgtgaaaactgaatattttcttaaggccatttcacaaaaatgaagtggtccttttttattttcaaaatacagttctatcactttatatatagaaaaaagcactgtctcatcgagcaacgaccagacaacgctttcttctgtcaattctaatttatgtctaatgcatctgttacttcatctgcagcaattcctttttctgctttcagttttttatttgcatcttctacattcattcttgaaagtacaaacataatcaatacatcaaagattaacggaagccaaagatacatgaactgcatcatatcaagtgcagactgtggctgagttgcatttgttccgacatatccactgaactcaagcatccatccaacaacagctgttccaatacctccaccgatttttacaccaagagaagtacaagagtacatcgttccgtcaattctctttccctgcgtaagataagtgtattcagagcaagatgcgataactgcattcatatctccctgccatggtccctgacctaaggctgcaagagctgtaaatgccatcatcagcggaacactgcccatatatccggcaacaacaacaagtgctctaccgatgactgctaagacgtaacctcttaagttcagtttatacatacctttccacttaccaactaatgtcggtgtgaaaatcagggcaatgatcagtggaatatttactgcccatgcaaattgtccaaacaaattcttatttttcagtacccatgtcatgtaataaatgcctgctccaatcatggcaccatataactgctgtaaaatatatgttccacaaatcatcatgtaatatttgtttttgacaagaagcttgaatgcctgtaccattccatacttttcattatcattctttacttctccttcattaagttcttcctccggaagttccttaacagaaagtgctgaaatcgtatttacgaccagaccaatgattgcatagataatagcaaccgttctccatgccgcagcatctccaccacatttatctacaaatccaactgtaatcgcctgaatcagaagacttgttgaaaatgcaaaaataaaacggtaagatcccatctgtacacgctctttgctgttctttgtaatcagtgacgtaagtgctgaataagcaatattgtttgctgtataaaacccaccatttaacagtgtataagaaataaagaaccatgcatatttagccgttgttcccaaactcaccggtattgcaaagcagccgaccagcgtaatggcacaaccaatatatccgtatagcatccagggtttcgcttttcccattttactgtgtgttttgtcaatcattgatccaaaaaatatatccgtaaaaccatcaaatagttttgatacggcaatcagggtacccacgacacctgcagcaagtcctaccgagtccgtcagatagaccatcataaaagatgtcaggaacgcatagactacattacctgcaatatcacctgatccgtatccaattttgttataccatttcaaatactttttttcttccatcgaatttctttgctcctcatcttcatcgcacttagaatctcaatatggctaaccgtatgatatttaattctgtttttttctctgattttgtctgattgctctgtatatccggactttacattacaatcagactctctttccttgtttacgggttacatgaaactttattatccctttacatacggtatcagtgtaaactgaaaccggaataatacatcatcaaatcggtactgctccaatacaactggaccacaactattagaaccaatgccatttaatgcgtagtcaacacagaatactacactatctgattctattaattcataattatgcgttttcttctcaagttcttcctgtgtataataagaagcattgaatgaaaatgccttttctgcggatgccacaattccatatcggctgttgttaagctctacatattcacaatcataatggcttccattttcctgtggacggatatagtcctcatgtaaatcccctacatctgcccggtacaaaccatggctcgcagcctgatgtttatcacaataactttcctgtggtcccattccaaagtatcttacagctgaaagttttttatccaggaacatcctcacaccaaatctcggaagatccgggaattcatcgtcttttgttactgcaatatctgcatcaatctttccagcagcttctattttccatgtaatcgtcacatcaagaatcttctgtactgtctctgccacaacggaagcatggcttgtaatcttcacaccatgttttccctgcacaacctctgtcgtataggctcttgtgtaagccttatcatagtgggctttcttccattcagacttgatgtacatatcgttatctgttggagctctccaaatatttaattccatcggatggttcaagtattcccgccctgcgaatttcatctctgtaaagagtgcagtacgtttgtctatggtataagcaaattcacgccccttgatatgaatctgtgtatcattttcatttacctgtaattcagagtccactactgtttttggtatccatttctctgcaagtttacattttgtattctctttacttacctcaatttcatcaaatccaagaatatggtcttcatccaacagtggcaattcttttttcagatggtaaataagttttaaataacatttcccattctctggaacattgatcttcaggtttgtttttccttccccgtgtggtgccacagaaaactccggaagtatgcctttgctgatcacaagaccatcctgtgtcagctcataactaatcttcacataatctttcaagtcatcaaaatccatgtagttatgaagcaccagttctccgctttctttgttataggaaataactcttgccgggcgataaacattcttgtattccaaaagtcctgtatgtactgttctgtccggatatactaatccatccatacagaagttgccatcatgaatttcttcgccatggtcgcccccataagcatatatagtctttccattctcagtagttccatgagcaatcgcatggtcacaccattcccagacaaagccgccgcacattttatcattatcctgaatcatctggaagtaatcttcaaaatctccaggtccgtttcccatgctgtgacagtactctaccaaaaggaagggtttgcttccatctttatccagatattcctgaatttcagaaagcgctgggtacatccggctgtacacatccagattgctgtaatcatatgtttcatcataattacggtatcttgcactctcatattgtgtgatacggtctggatcaaaattctttgtccattccagtgctttttcaaagttgcagccataagcactctcatttcccattgaccacataacaatacagaaacggtttttgtcacgttccaccatgagttttacgcgatcaacgattgcctcttcccataccggatcatctgcaatcttctcattccatcgtttgaaccgattgtaatcagtgtcttcttttctgtagatcataaatggaccatgagcttcaatatctgcttcatctattaccatgaatccatacttgtcacacatttcatagaaaaatggtgcgttcggatagtggctggaacggatcgcattaaaattatgctgcttcattaacgtaagatcgattgtaatctgttccggattgattgtaaatccagtaaccggatcagaatcatgtcgattgacaccacggaatttaatcttctgtccatttaaataaataacctggtctttaatctctatctttcttaatgcaatgtgatctacaattacttcattctctgtttcaagaatcagtttatatagatatggattttctgtattccaaagttccggacttgcgatttctaatacagctgttccttcttcagcaatacttcctagtgctacaactgctccgtttctatcttcaatcgaaatttttacatttaacggagagtagaatttcatttcaatttctactttcgcaagcatatcctcaattcttgttttaatatgataatcactgattgcctgttttgggcgtttcaaaatgtacacatcccggaaaataccactcatacggaatttgtcctgatcttccaaataggaaccatcacaccacttcattaccaacactgccaccgtattcgttccatcctgaagtacatcggtaacatcaaactcactggtcatatgcgaaacctggctgtatcctatgtaagagccattgatccatacgtaaaagcaactgtctactccttcaaagttcaaaaaagattttggcgctttctcatctctactgtactcaaaagtatgtacataggctccacacggaatgtcctgtggcacatatggtggatcaaacggaaatggataccggatgtttgtatactggtgtgtatcatatccagccatctgccatacacttggaacctgaatctcatcaaaattttctgtatcataattcttctcaaagaaagaatcctgaatgtcatagatgctgttaaaatactggaatttccaagttccattcaataactgcatacgatctgactcttctctgtgttccaccaagttatccattcttctggatgccggaatataataggctctggctggcattgtgttttcgtgcagtacgcttagattttcataataacgtggtacgatcataaatagctctcctccaatacatatacttttttgttctttgttttcctaaagcaaaccttatactttactttttgtttacgttccttagttatgctatatatagcttatcctaattcgcaaaatatgtctatgaattggattagacaaaatatgcactaaatgatacaatgataaaaagtacgaaaagaggtgctgtcctatgtatttgaacaccggttatttgaaccactcacatatggatttcaaagacaaaagtcgtccgctgattgtcggtagctgtggtacttaccgtctttccagacatcccaaacttccgacctaccgtccaaggggtcgtctggattatcagattatatatatcactgctggttgtgggcattttcattttgataatgtaaataatgaaacgattgttccagccggcaacattgtactgtacagaccgaaagaactccaaaaatatgaatattacggagaagataagacagaagtatactggattcacttcacaggaagcaatgtgaaaaatatcttacgtcaatatgggtttccggataaagaacgtgtctttcaagtgggtacatctaatgaatatgaacaaattttcaaacgtatcattatcgagctccaacgctgtcaagacaattatgaggaaatgcttgtccttttgctacgtcatcttctgatcagtttccaccgggaactgacaagagagcacatattaaaaaatgaatatcttgatcatgagatagataatgctgttacctttttcaatgaaaactacaatcaaaatatccatattgatgattatgctgcctcacgaggcatgagtgtcagctggtttatccgaaatttcaaaaaatataccggttctacaccaatgcaattcattgtgggaatccgcatcaacaatgctcagatgttacttgaaacaacaacttattccatcaatgagatttctaagattgtcggatatgataaccagctttatttcagtcggctttttcacaagttgaaaggatattcgccgagagaataccgaaagctgagaaacaaattctgaaatccacaaagaggataccaccgaattatcaaaacaatgatttgtaatatcctcttctcacttttgctattcttattttacaaactcagccgaataataatacatatactcattatctgtatctatgtataatcagtacctcctgtattttgaatatttatctcttcatatactctgtactggcagatgcaaaatcggacatcatttttcgaaatttagcaaattatcttaattttacagtttccatatgtgttatcactgaaccatggagtttatatcattgaaaaagggtataaaaaaacagtctgccctgacggaaaatatttccatcaaaacaaactgttcttcatattcacactaattatattttctgagcatagttactttttgcgaaaatctcagataactccggaaagaaaacaaagaaaaaaatattttttaactccatttgcactccactggaacatccagacagcccgcaaagcctttatttataggctttttcgcaatttagtccgctactcaaactcgtctcacaggagtttgatttctgtaatttcaatagcgttttcgctactttttattgttgtattcgccatattagcaggcataattttgactggcataaaaattgtactcaaaatgtactcatatatcaatccaataatttattccgaaatacagaaattatctctcattattgcattcgctcctgaattcttttatcagattctcaaattctgctacagacattctactatacattttgcaccaatatttcttttgaaagagcgtcactttatgcactgaaagtttacatacttttatcacaagccaacgatgtcttctttgaatttttttatcttttgcttccttaaatgacatcctgacaaacaacacttcatattttgaataaagttcaagtatgtattctaacggtataattagtattaaatacacaataggaatcataaaactaataaaagtatttaatgcatccagttctttatattcatgtattccaatctttatagtctcgtatagtatccaaaatcctgccaccgcaagaaccatatctaacaacttatgtactttctcatactcctcttcgcgctctgcaattacattcataattacaattattgttgtgatcggaataattaccaattcaacccatatgttgaaagtaaatgtgctaataataaattccaaaacaatcgtcaatttcaaattatcttttaaaacttttctaatatattcctcatctgcctcttttgaaacagcattcatgcagtatatcaaacctgaaaagacaaaccaaactataatatctttaataaaagcattatcccaaaacggtaactgataaaatattaaagttatacccaaaacataaaggaaaataatcccccaaagtattcttaacttcttaccaaagaatatttttacaacattccaaaatgcctctctaatctgtctatgtaccattgcatacacaaataaaataaatgcccagatcacagttgcccattccctagtagttaaaatttccatatatcatttactccccaatccgaagtttattccactgttatttttttcaatatcggcaagtatcctacataattcaattattatagttgcacttactttaatttgctgttgcagccatacactctgactgttataatcagtgcatgggtgctaccatacaacggtaggcggttagtccttcagcagagggactgtgaccctctgattacatagaaacccgaacgggaatccactggaaaggagggctaagccaatgagtattgtagattttatagcagtagtgggcttcggcttaacctgctttagtatcggatacacattcggtaaggataatcataaaccacaaaaatagccgccccagtctggtaaactaagcggcaatttttgtctaactttatatcggactaaccgtctatcggtagcactctttttctataatcatattatcacgcttccatagaaatgtcaaaatttttctttgttttgagaatcatctgcggcttcgataatctgtattgcctttttcgcttcatcaccttccaccaatacatccacaccatacataccaaatcccggtgcaccatgcatagcgacgcttgcacccgcttcctgtgaaaaagcaacaattccttgttcttttaaaagttctataattcttcccgcttctactatatctttagcgttgtaaatttttgtacttcctgtctttgtcgttgaaatatcactttgctctccattaactgaaacccggcgtctattccggttaaaatataataaagatccatgcgaggcggtacaaaaattatttctgggcaaacctgccttgcctgccacaatgccatacctgtttttactccggctcgctttgcaatataattcgcagtcagcacaattccatgtcttgcctccggatcgcccccaactgccatcggctttccggcaagttccggatgatgcaacatctcgacacttgcgtaaaagcaattcatatctgaatgaagaattgtcctgctcataacattcacctaccagtctaaaaatcgtaataaaacttctttgcttcatattgactttgtgaagtttttgaattataatttccactaacttcacgaacatttgtttgtattctatacgtgataatgaactctgtcaatagtttttataaagttgatgaagttacgatttcaaaaacttggaaaggatcccactatgaatttttcagacaagattaaatttcaacgagaacagaatcatctgacacagaaagaacttgcagaactggtcggcgtatcccagcgtgcgattgcagcttatgaaagttccggcaccatcgcacgaatctctactatgagaaaactcgctcatgcattaaatgtctcttacgattatttaaaacatgatgagatcacagatccttcttatggaattgaaaaaatggattatattgatgaagtcaatggacagcttggtgaaaaaggagccagagacatcaatgagattctcgaagccaaccgtgctcttttcgctggtggcgaacttgacgaagaagcaaaagatgctttctatcaggctgtaaccaaagcatatctttcctgtaagatggaagctaaaaagacatttggacggaaaaagaaaaacactgaaacggaaagtgattcataggtgtccgtattttcgtacagcacttttgctactctatacttgcagcaaactatcttatgaaatatcgaggtgtttttatgagttcaaaatgtataagagacactgttaataaagtaaaagcaaaatatcaggaaagtgatccgtatcgccttgcagccgctatgcatattattgttaagaagcttccgcttggaactgatccaaactgttgtaaaggcttctgtatgcgggaatgtcgaaagacctgcatcgtcattaacagcgatctgccggaaatcatacaacagattatcctgatccacgagattgggcacgcactccttcatcagaaaacccttcagatcaagtgttttcatgattttgaattattcgatggagtgtcacaatgtgaatatgaagcgaattgctttgccgctgattatcttctggaagatgaagatgtcctggaaatgcttaacgctgatatgtcctttttccaggctgccgcagaactgaaagttccaccggaacttcttgatttcaaatttcgaatgatgaaacgaagcggcgttcagattatagattctccgattacttccaacagtgactttttaaaagatatccctacttcgggaataatagaaaattactaaatatgctatttttgaaaaaggagatttttgaaaatgatcaacttaaataaacgtagaatagattttggaaaaggggatgtaggcattggtgtcatcggtaacactacagattccgcacaactggcattttataatcagagtgcacgtcccatccatatactcaagaatccagatcagaatcctggattcgaatccatggaatttgaagaagagccttttatcatgagcttttccaatccagaaagcattaatgcagttatttcaattttacaacgtgccaaatatattaatttcacttctaaaagtgaacagcaaaaaacagaatagatgaatgatgtatcttataaagaatggccgtcttttctccaatgagcaggcagccatttctcatgtaattctttaatacaaatctcccacatatccatctgcttccagatgcatatagcactcatccacctgctctgattccagaatctttaaaacgtgttccatacctgtagcaagttcttttgtttttaactcttccagcggaatccaataaactcttccttcctcagaactcttcaagtctccggtgaacttatctgctttatacagggtaatgacataatgcactccgcccttatgccaatgatataatcctccaagcttcggtgcttcgatcgtaagtcctgtttcttcccagacctcccgaatcatagatttctgaaaagtctcatttgcttctacgtgaccacctgggaaagtcgtaccggtatagctatcatttactttatccagagccagtacatttcctttatgatcctgaatcatacacatattcataaaacagaccttctcaatccggctctcttctttttcattcagagatttcctgacacgtttgttgatatccgattgtttggatctataatgcttaaagacctctccatacggaatccagatttctgcatcttcgattttttcatagacagtatccactacttcttccaaatgtttgtcattcggaaaagtgcattttttcatataataatctctggttgcctgaaacatccattccgcaatcttttctttctgctttatctttaactgggaatacttcttattcgtttgcagtagtctcccatctatcatcttatggtttttccgtgacatcagtttgacctcttttcttctttttcgttcagattttactataccacagaatcatgcctgcgtcatacttctgagcttcgatgtcttctttttcttctctcagtaccttatttatagaggaatttttttaaggactctcttccggcggctgtgccaccggtaaatagcaaggacaggaagtgtatatacacttccgaaaaaccaacaatttagggaaccctgccctaaattaaaaactcagaagtcactacttcgaagaaccaatgaaaggagaatcttcctatggcaaagagaaaaagaaatatacaaattttgttttgtgtttccccggaagaaaagaagctgattcgcagaaagatgattgaatcaaaaacaaaaaatatgggagcttaccttcgtaaaatggcaatcgacggttatattgtcaatacagacactactccattaaagaaacaatacgaggaaatgcataagatcggtgtgaatattaatcagattgcaaagaaagtaaacagcaccggagatctgtatccggaagaaatgcaagaattgaaagagatggtgaaagaattatggcgtatcttaagatcttccccattaaagtaacagacaagaaagctctggactacatcacgaatccagataaaacagatgaaaaacttctggtttccagttttggctgttctcctgaaactgcagatcttgaattttccatgacaagagaaatggcaaaaaagaatggaatgtacaaaggcgataatctggcatttcatctaatccagtcatttaaacctggagaagttgatgccgaaactgcccatcgcttagggcaacaatttgtagacgaagtactgaaaggaaaatatgaatacgtgatcagcacccatgttgataaaaatcacattcacaatcacatcatcttcaacgctgcaagctttgttgatcatcacaagtatgtttccaataagcggagctaccataagctctgcagaatcagtaatcgtatctgccatgaaaatggacttgccaccagtatgccgaccggagaaaaaggcaaaagctataaagagaacatggaatatcatcgtggcaccagttaactacgtgtcgcagttgataaggcaatctggacttccatcaactatgaggaatttctgcaaaagatgcaattagcaggatatgaagttcgacagggaaaacatctatccttccgtgcaccggagcagaagaatttcacttatatgaaatctcttggaagttattatagcgaagaaaatgtccgcatccgtctggctaaaaatcgtagcaaagcgaaagttccaaagcatctgtccatagaagctcgcctgtatatcaatatctccacttatgttacgaccggcaatcgagaaggatttgaacgatgggcaaaactcaataacctgaaagaagcagcccgcaccttcaactatctttccgaaaataacctgctgaattatgaagatttccaacagcatgtttctgatgttgatgcttctgttaaagcggctaatcaaagaataacgcaaatcaacagtgagctgagcacacagaaaatcattcaaaaacattgtgactcttatcggctctgtcgtaaagttatcgaaaatgcaaaatcagctccaaatcccacagcataccggagcagacatcaggctgaatatcagctccacgattcgttaaaaaaagagcttcaggatttcggcattaccaaaatcccaagctctgaaaaaatccagaaacgaattgacaatcttgtatctgagaaagtatctactatacgagagaagcaggaattgcggaaaaagcaactaacactggatatcattcagcaaaacttttcagcactactcaacacgcaaaatattgcattatcccatccacttcccgaagaaactttgtaatcgaatatgcggggattttgattaaatccccgcctattcgattattgaagagaagatgtatctttctactgtttgttagtcgaacataatatactttacattgctttaggctatgatttgtaaaggataagagaaatttcttccagtcgtttttccagcatatagccgccattagccgccgtatttttacagtgttctggtcgtcgtagacttgccgataggcaaaaagaaagcggcggctctgaaaatcaaagccgccgtaatttagaaatggcgcgtgaagatacctctgctctgcgacggctttttttcttttgccgtcgtccggcagattatagttctattctttacctatatgctatatggaaaatttgtagattttataaagattagaaaaaataatgagcgataccgcagtatcgccctctaatttcttaatatggaattttgatagtaacctgtgcgccgccagtctttttagaattgcttaaaacaagctgcccgccatgttgcttgataatgctgcttgtgatataaagtcccataccaaagtgcatattagaagtacggcttttgtcgcccatgaaaaactgttcctgtgcatgatgtagggcctccggtgtgaagccgcctccctcgtccgttatagatatatgcaaaaagcagtccgttttttgcaccgttacataaattgtcccctgtggtggagaatggtctaacgcattgcttatcacgttcataattgcccgttccaacagcagcttatccgccttgagtgtgcccaggttagcccccgtttccagttgcagacaaattcctttggtaaggcataaagagcttgcctgcgctttaatctggcccatgtaatcagctatatcaaatttctccaaatgaagctgatacccggcgattgtccgggaaatgtcaattaacgctttgatataaatgcctatctgttcggagctttcagtgatgtaacccgcatatagacgttgttcgtcgtcaagctccgtttcatttatcaaatcaatatttccttgaatgacggtcaaaggtgttttcaaatcgtgagcgagtgctgcaatctgttctctctgtaactgttccgcgttccattgcttctctaaagatattttcagattatctttcatatttgcaaaagaacaaagtacatcctcaaattctttgatttttgaatgtctcacttcaaaatcaagattttgttctgccacctgccttgtcgcttcaaaaagtggggagagctgcgtcctcatattttttgcaaacttcgctgtcaatatcacgcatactgcaatacagttgattgctataaaaatataaagtagaatttccggtgagggaaaatgatcataaagccattcatttgtaaactgtgaacctatgtaatattgcagcactacatattcattttcgcgggtcacaaacaaatactgtttgttgagatttgtatttctcttcccggatattgcgtattccatagcccggtccaaatcgtcgccctttaaggtcgtttccgtcacttgatagtttttatccagcactaaatatttacagcccataggaagctgcacatctgccaaatccggcgttgcggcaataacaggagcaaggttttttgtgctgcgttctgaataatccgcataggtaataagccctgtactggttccagctaaaataagactgaatggtattgccaccgcacctattagtccaatcagcagcatacataagaatttccaaaaagacgctttcagtgatgttgttttttttattcccatttatacccaatcccccagactgtcgctattggctgaatatccagtttgttcaattttgaccggatattcttgatatgagtagaaattgtagaattatcactgtcgccctctaagctgaaaacagcttcgtaaatttgttcttttgaaaatacctgtcctttattccttgcaagatattcacaaatcagatattcgcttttcgttaaggcaacaggcgtgttatctacccgtaattcttttgcagataaatcaatttttatgcggtcaaaggtaagtgcggtatgtcgttccctacgttcacgccgtaagtgggcgtttactctcgcccgcaattctgcaatgcgaaatggttttgtcagatagtcgtctgctcccagagcaagcccaaatgtgatgtcatgctccattgtctttgctgtcagaaaaagaataggacagtctacaagggaacgaattttatcacaataagaaaagccgtctacatctggcatcataatatccagtataatcaagtcatatctgttcagcttatcaagcggtacttgtgcggcagaggtataagcggtcacgaaatgtccgtccttttgcagcccgtttttgacaagctctaaaatagctcgttcatcatcaatcataaggatcgccgccatattgttgcctcctttcgttgtcctttttagtatagcacaagctacaagggcaggaaagctgtcattgtcgctttgcaatatagtagttattatttacctcgaccgcaaccgcttccgctttatcggttccgtaaatctcatagacatctgtgtaaaaccaacactctcgcccctgtccggcattttccccataccagtcaatcttgcttaaatcttcttttgacaaagggattttcgtttctgtatcgaatgtaacactttcagcaagaatatcaatgtagctgcctaattcatcatctgataccatatcagacgttacttgataaaccgccccgccccaaagaagctgtgtcgcattttctggattgacttcaaagctgtcatttatagattcttctgttttcttaaaatcaaaaacagtatcgctatctttgacatttttgctgataacagctttatgataccctccgtttacatctacaataagataatcgtctgcgttaggagccgcatatacattgagaaaaggaataatgtaagcggcttctggtgctttctccgccaaatccgctaaggattgaaaagtcaccgtttcaacattttcttgcagcaatatttttccgttctcgtctatggcagccagctgccggatatatccaatccattctccaagcccgccatttgatacggtatctgccaaaatggtgtaatcgttacctttataggaaaaacgtgttacattttccgtattcaaatagcattgttccttgtcactggaatattcttcgattctgtcctgtaaagtacagcctgaaagagaaaagcatacaacaaaagcaaacagcaaaacgataaccatttttctatttttattcataatttttccgtccttcccaatgagaaaaccataataaggtcagcaacaagccacctgtcgttaatgctgcaatccatattttttcctttccatagttgaaaatttgtcggctcaaaatatcctgtacccaattcatagaccatgcaaaggggatataccgggctacacctttcagctcaatattgctatataagatacattgcagactttcaaacacgccccaaaacagggataaccctaatccaaatttgaagctaaggaacaggtgcaagatgtatattatcaaattacaaaaggccatcccggcggcggctccaatcagcatcccaagctgcactgtatcagccattcccaaaagatgtatgccaatcacaaataacaggaacagaaagaacaatgcaaatacccccgaaccataaagataagttaattttgcaagcatatttttgtgtctgtttggtacagcaagcagcgtttggaagtgtgaagccttttcttccagtgtaacgttcagactaacaataacgcttatcaacaacggaaaaaacgttgtcgtaatttccaatatcattttgagctttttactgtctgcggtgctggcatactgggaatagtaagcaagaaataacaatgcccccataacgggtacacaaaaatgaatagccccaaacgatgtatgcttcgttttttcctgttcagaacgaagcgcataaataaaacccatttctgtctacctccctttggaaaaatccttcgcgtcggcataggataaaataagaaacaagagtattgacaacgaaatggaaatcataatggctatagaaaatccacaattccccgcataagttccgtttatttcaattcccataagtggctctgccagttttgctgcccaacaatacggtacaaaccaccatgctattgtatttcctaatgcggtagcagtagataggacaatcccaagtattgtatttaacacaatcggcacaaacattcccgttttgcgtgctaagtacagacacaaagggatttgccagacagacgcaaggataattccgatacttcctgtaatgctgtgtaaaagagaatatactgccgttgccggagcaatgatattactgatagaaataagcaatgctaaaaatatcgctgaaacaagcagtttttcgactaagataatgcccttagcaaattcaaatctcgaaaggtttacaggcatagaaaataccgaatagtatttcccggcgttttcttcttttctgtgtgacaaagaacacaaaattgcgattcctcccggaagcaggaacgcataccaccaataaagcgtcatgtactgataccccatatatccacccataagccacgcaaaaatagccgtaattagcggaacaatgaaaatcagtttgttcgatattgtcctcttgaatttcaaatgttctgattttagatagtccatgccttaaccctccctgtgattgctttttacaacgtccataaaaagctgttccaaattttcgtttgcattaagtttcccctcatagcctaagacgccgcccgcaataatgccgatgtggtcagcggtctgttgtacctcggagagaatatgacttgataaaataacggtaataccctttgcaggaaaggaacggataagctctctaagttcttcaatcccaatcgggtcaagcccgttggttggttcatcaagtatgagcagcttcgggttgtttagtaatgcaactgcaattccaagacgctgtttcataccaagagaaaactgtccggctcttttcttgcctgtttccgtcagccggacgatttgcagcacttcatcaatccgcttatctgtcagccctaaaatagtagtccttactttcagattttcataggcggtcaaattttcataaagcggcggcatttcaattaacgctccgatatggtttaagtcgctgcgtttccatgcgtggccgtcaaactcaatactcccagatgtgggcctcaagatacctgttatcattttgagtgttgtagattttccggctccgtttggacctaacaatccataaacggaatttctttcaatgttcagcgatatgttatttacggctgtctgcccgttgaacgatttgcagagatttgttgttttcaagattatactcatatttataatcatcctttcttttttttcataatatcaatcaattttgaagatttcataaagatattccatctatgcagcaaatgtgcttgatataggagaatactcttctatgaattttttgtttcatcacttgaataaactggtattctatcattccttcaacatggctctccttctaccccatgaaatgccgctgccggatacatccactgtccttttgcatagatatcatttgccgagaattctccagtgaccagactgcgaatcgctttctcatctccatgatacacacaggatttcgcatttcccacaaaggtatccaaatcacacttattatccagcataaattccagaatttcttcatcatgctttaacaactgatattcttctggatataatttgcgaatcccggcaaacagcttcggtgtagagaaaatacacatagcacagttgcaggggttccacccggcacggtaagccttatatgatgggatgtacgcagtaactacagacttcttagacggtgatgtaaaagatatcctaaaattcagcgaaggtcgttgggaaatcgaggaatgttttcgtgtaatgaagactgactttgaaacaagaccagtttttcttcacgatgacgtacgcataaaagcccatttccttatctgttttcttgcggtggtaatatacgttacctcgaaagagatctgggaaatgccttcagctacgaggcactcttggataaattgagaacaatgaatttcgccgatatacaagaacaaggttttattccactttacacacgagacaagctaaccaatatcctattaaataaagaatacaagacaagacgcaaattctaatactgaaagcgtaaattctaatagccaccatcttcttgaactgtcgttcaagaagcatcgctcgcttagctcgctcaattctaatataactacgcaaaaaagcctgctgtccgtgatagacaacaggctcataagccatattctttatggaattagtattaaaattttcaatgtaaatttcccgttttcgcatttggtcatcaactgaccatcatatttctcaacggcttttcgcatattagaaataccgaaaccgtgaagaaaatcatcattctttgtggtacggctctttgtgtttccgctatcctgcaagcagttattttcaatcagtacagaaaagaagttttgcattttccccgctttcacaagtatcgccctctgttcttcaggaagtttttcacttgcttctatggcgttatcaagtccattcccgaaaatggtactaacatccaaaggctcaataaaatctacaccattactataatatgcccttattgcagctacaaaggcatgttccaaaagtgtacatcatattccttttttaaataagaaaaaagaatatgcatatgggataacgatcaacactgccatgatgaaaaataacagtatcttagagtccagaaatccattggcgatcatagccaggccacaaaagataaacagtctggagctgacacggtgtgtgcgattccagttttcttcactggacagtgtccatggaatccgaatgccagcactatagttctgttttgtttttgccagataattgccaattaccaaaagcatgagtccaatgatcagataagtgagcagagtaatattcacatttattccaagagcaatagcatagctagagcacacaacaatcggggaaagtgcagccatgaaccacacaagtgcccggatcagcttcggactgatgttctggcgttttggatcaacatgggtgaaaagaaagcaaaaccacatcattgcaaacataaaaagcggaagtccgaaaacggtaattgccttgctgctccagccatctggagtatttccagtggaaaaatgggtagggagctttgccggaagctgattccacaaaagcaatccgatcaagattgggcttaaagaaagaaggctgccaagtaacaaagaccatttatattttttcatcatgagattcgtctcctttcaagtcttttaaccatagaagtaattcttctacaacggaagtattcaaatcatagtaaataaaattcttttcttttgtttcccatatcagatcagcctttttcaaaatctttagatgataggaaacagtagcaccggtcatatgaaaatgactaccaatttctccggcggacattcggccattctttaataactgtaagatttctcggcgtgcaggatcggacaaggccttaaaagtatctgcaaaagccatagcatcacttctttcaaaagtatttagaaatatttctaaatataatatattctgacgaaacagaattgtcaacaactatttagaaaaatatctaaattctaaaatccttgtgtttcaatcgctgctatatgaaaaatatggtagtatcactgttcaaaagctgttcaacatctggcttttcccttcagttatacatggcccatagattccgcatctgtctgctcaactgctcatatgaccatctttttttactgtttgtgcgactgttgctgtcattgatgataaaaccgtccctgtcatatccgattatcgttataaaatggccggaatctgtaaaatctccgggtcctacattgatgatgatcagacatccctcatccagttttgcctttattctgtcctcatccatcggcacttcctcagcatgaatcccataatgttcacaaccttcactaatcagtgtccagctgctacctgatcccggcacactgtatccggcactctctgcgtattctgctacagatgccggtgtaaccgttttatctccggtcagatacaaaacgaccattgccagattcgtcggtccgcagccggtgtagccgaggagacctccactgtacggcatatacccccagcgttcatcccactgcaatagaagcggtactgtatcggttttggcttcttgtgacagatcaatcgtttgctttttatccttcatttccggataatcatagacaaaatcaattgtctcactatttttttctgccaattccttaagctggtcaggatactcatcactttcttctatactatgcagcttgtcttcctgtgtcagcacatctgcttttccgaatactccccatgttttttccgtatttgtccgtgtctttcctccctgtccactgtatgactgttctgcatcctccatcctgtcactgtcatccacccgaagcagatctgctgttttctgcacagcaaacagaaccagaaaacacagtactgccatgcgaagagcgactcttatacattgttttcttctttttcgtttttttatcctgtaaagttgttttctccttgcatctgtcattggttctttcataaaaaatgcctcctgctataccgtatatccacagtatagcaggaggttatctccatcctgtcgcaaagttgtgtctgagttgtcaaatcgcagtggagccgtaccagactccataaaatgtacagctctattccccgtaaaagcatatatatatttcaccatatacatctcgggatgttttacttttcgcatacccggtatcttcgctatggtactgatactccatatgcagcgcattgtcctgcgttacacaggaaaaaccatacgcatattcaaagtccatctttcctgcctgacgcatcatgtctccggcataaggctcatacaacatctcgggtacgccaaacttcaaatctattccatatactttttcaagcactgctgctgtggcttcacaccaggtctcatcaggctctatacctgctatgccaaactgtacggtaaccggcagtccagtcacagcatcaatggtgatctccacaaactgatcatagatataacccgagtccacccatacagacaattgctgattctccggcaacaccataaaatccggtggctccatctgaatataggtacagtctctctccaactgtgcgtccccactttctgtcagcctgtcctgatactgcagattcccatcatttcctgaaccgaacaccggcgcgtccgtattattacgctccaccgtactcaaaagtccgtattcttccagcatatccgcatatgctatcagaaatttctttatcgtcctctgagccggttcgcaggaaagctccgtgtcaagaggatcacgtacgtttatatacatatctgcaccacttataaatatctgctctaccagcttttctactctggcaatccgggtctttgtatccatcgtataggtatatggcgatacatctccattatccattctccctgtggcagttgccagtttctttgcctttgtattcagaagaagcttggggacgaacattcccgtcagtgcaatcaaaaacgccagtgtcacggtaagaagaatatacagtactttaagtttcctcttcttcatcatccgcctcctttgctaacataaacgatacacaggttccctgtccggccacactctcataaacaagctctgtatgatgcagctttgcgatttttactgccagtgcaaggccaagacctgcgccgtgttcctcccgcgagcgtgatttgtccaccatataaaaagcctcagtgatcttttgcagatcttctttcgggattccccgtccgtaatcacgaatggaaatcatatactgttctttttcacagcttccctgtatatttatccggtccgtacccgattttaaggcattatccatcagattcaataaaagtgtcttaaagagatcatattccagacgtacccaggctgattctgtctgaagctgcacccgaacatttcttttttctgctgtcggttggatcgtttccacagcatctgcaataacctcatcaatcctggcttcttctagctgaaaattagattgtgacagcgtaacaagctccatcagcttaaaggaaagcgcctccagacgcatgccttcattcataatgattccggccagttgatgtacttcctccggcgacagagtcttctgatacaacgtatcggcatatcctatgattgacgtcatcggtgttttcagctcatgggcaaagtttgctgtaaactcctcctgtcttctgaccgcatccttcagctcttccatcttgctttctatcgtctttgtcatataattaaatgtttttgacagatcccctatttcgtcccggctactgatctctgctcgtacatcatactctcctttagcaaacctccgggttgtgccttgcagtctgtgcaatggctttgttaaggtaaaggtaatcacaagcaccaaaaatgaaccggtagcaagaatgcaccagtaaaagaattcacagcgcctgcgcagtgtatccgcatcaaattgtaggcatacgctttagaaacaccaagaattgcacacacatcatccacatccatatacattttttcctgcactatactcatatcgctttatcctccttcaaatattgctcaacatgttccagaccatagatcttgtcctctacatagcgggttggcacccgaccgagaatcacataatagtttttgctttccagatcggcattcattctttccaccacccggtaagcaaacgaaactgataatccaaagagttctgcaatgtcttccactgataaatacatttttctcttacgcatgaaaccattcctttccctcttcctgtggaatctcacaagtatcttccactccgtagaaacgcttcacaaaatactttgtcggaacttttcctctaagcgtcaaatatccctgttcttccagctccttattcagattgccaatgatctcataagccgatgtctgttttacctccagaagttcacatatatcggctgcctttaaaaataatttgttctgcataatcagtacctcctgtattttgaatatttatctcttcatatactctgtactggaagatgtaaaatcggacatcattttccgaaatttagcaaattattttaattttacagtttccatatgtgttatcgctgaaccatggagttaatatcattgaaaaagggtataaaaaaacagtctgccctgacggaaaatatttccatcaaagcaaactgttcttcatattcacactaattatattttctgagcatagttacttttgcgaaaatctcagataactctggaaagaaaacaaagaaaaaaaagattttttaactccatttgcactccaccggaacatccagacagcccgcaaaacctttatttatgggctttttcgcaatttagtccgctactcaaactctatgtagtcatctatatattgtattctcttgatttcatttttcatatatttagtatgcagattccatatattccatgatatctacacttctattgctgtttttgtagacattttatagataattgggagcagggaatttgacattatcattttgataaacgtgatgttctatctacaatttttctgtctcgagtggctctcgagtgaaaactcgagttccactcgaagaccactcgattatttattttcatatacaatacggttatagcaggaacggtttccttttccaactaaaataatcaacttttcttttctctttttgtcaattattgttcttaaacgatacatttagtctttcagtctgcttaacagcatcttttacaggcttcactacgatgaacttcttctgtctaatctgatcggcttccaattggaaatgctcatcaattgtcaactctccaaatactgcctgtggaatcagaacatctccaaacaatttttccagcaaatctattcgattgattttaagaagtgatatcagcggtgttgtatcagagataacaatcataccatagtctccttctttttaagttctctgaatgtattcagttcgtcatccaaatcatccatcgtcatatcaaaataagaatatccccgtttatcatacaaatcaattaactctgattttcttatttccaaaatttcagccgcgtgaccatgagatagcgtctgattcaatatatatgctataagtgagtaaattcaaaaaattgcacaaaactatatcgccaatttcataaatgcttcaaaatccctgcttgcttttgcacactgaaaaatatatcgatatttttcctcgtatatgatgtcacaaatttgagtatatccattctcaaaagaacaggcttcatttgttccgataacacatatataatattctagtgacattaatagccaatatctttagatgcttttgggtttccaaatgctttttcaggatagcttaaaagaactatggcattttcagttgatttttccctcataccgatgcacatagtattttttgtttttcactgtcacaagttgaaaatcagaatgtgcagccaataaaagagtagcaaacttatttagtttctttttgatttcaaaaggataaagcatccggtttgttttttacacactgattgtatgaaatccttttactgcaaaggtattgattattttttcagaaacataccagcagtcacaaaaaaagtagaacataactggaggaactggcagttcctttgcaatgttttgtacaatatcaatcttggaaatggatttattgtacattacaaaagcataattcagaacaatgccattacaggaaagcatacagcaactacctgatgcccgtaatcctgttttccctttaaatgggattggcaaaaatatgcatctttaatcggatacagagcctgtgacaaaagctttgtctttgaagctatcgtatcatctacaatacagaaaacaggggggcccgatgcggactgcttctgaataaagaatctcaatgacatattgttttaatacatttaaaagtaaggattcgtcccattttccagaattgaggaaatgagcaattgtagttctgtgacagaaactatttttagaaaagcccttgtatttcccatgatatcctaagatgaaaatactaatcaggatgctcatgaggtattttatcacttgattagaataaaatttgcataaactcaaacacttaaattggttgtatataaatgaagaatgatgtatagtatttgcaggagacaccttctttcatgaatgttgcaaatgttggtttgctcactttcattatgcaaattcgacaagaacgtaatcttacccaaaaacaattaggagaaatggttggtgcaagtgaagcctacattcgtgcctacgaaagtggtacaagaaataccaaaccatccccttaaaaaaatagcagacgctttatctgtcaagcccgaagtattgacaaactctgattttgatagtataaaggtgattcacagactctttcagatattccggtaatatgacggacacctctttgaatacacggataaagctggaaatgatatggttggaatcaactttggaacattgtctttgatgcgattatggttagattgttataatgaatatatgatagaagttgaaaaatgcaataaaataaaagatgttaagaaacgtggggaagctttactaaaagttgaagcggaatttaacctttgaatggatatttatccagagtcggaacctttgacagaaatacttaaaatgcaaaagaaacatgacaagataatggaccaaattagtttaaattctggattttaattatcataaaatcaacattaatatttatagaggagaatctatatgcgaaaattgcaaattaaggatatttattttggaaaaattgacggttataacgaatttcttgaatatggacaagacacttgcaaaggtcttttttacgagtttcccaatattaatatctcacgactgcttgatggatcaacatattatatatttggaaacaaaggcactggtaaaactatgcttctcaaatatcttgaaagtataatttccgaaaatccgtcccaaaattttagtgaatttattcgttttaaaagagatgtagatgaagaagaacgtaatcaaataaaacgctctgctctccccaacaatcctttcgaagagattatagacagtgaaatccctagtgatttcacattgaactgttcacttgcatggcaggtttacctaattaaagtaatcgtatccagactttcaaggacagaatatggtgtattcaatcgcaacactgaatcatggacaaagttatgtgcattacttaatgctacctatggtaaattgggaacagataatactattaaaaaaatacttcccaaaatgaaacgtggaaaccttgaaattgattttaacaaaatagctaaaaccaatttagaatttgaatgggttgattcagaaaaaaagtctgtatcatttacatctttggccaaacaaattattaacctatattcagttttaactcctgtagaagataaaatctatatttttattgatgaacttgaattggcttttaaacaaacaaaaaaatatcaacgtgatgtcactttaattcgggatttaatttttgcgatagaatacttatccgatattaatagaacacataatttcaacgttttcttagttaccgcaatacgtagtgaagtatacaaaaatataatttccaaaggactagaaataaataaaactattcatgattttggtgttactatttcatgggaacaaaaaggaggaaatatcagaaatcaccctttattaaagatgttggaaaaaagaatacattttagcgaaaccaaattagggcttgaaccatctcccgatatttgggaaacatattttataccatatgttggaaataaaaaaaaagaagtacaaaattatatacttgatcagacatggtataaaccaagagatataataagactttttactactatccaacgccttcatggaaataaaagtattattgatcaagaatgttttgatacctcgcgaaaaccttatgccgaagaatcatggactgaatttgaagagtttttaactgtaaaatatagtgataaggaagtagagggaataaaaaaatcattgacaggaatacttttgcctttttcagtttcggatttccagcatcatctgaatagcaaaaaagatttttttgaagaagtgaacgagttagttactaaacgaaaaacaccagaaatattaaaagatttatacgatataggaataattggtaactatggttcaaattctagatttatgtttaaaggtgatactgatattgacccaataatgccaattactatccattatccgttaattaaattttttcaagcatcaattaattatcatcaaaaagcatagatttttggtactcatgatttaccggagagtgtgaaagttttttctgtctcaagtggtcctcgagtgaaaactcgagggccactcgattatttattttcatatacaatacgttgataacaggaacggtttccttttccaactaaaataatcaacttttcttttctcattttgtcaattgttgttcttgcctgctgtttactaaagccacacaactcttgaatcgctgcatttgtaatagattcattatgttcaagatattctagaatcatttcttttgctttaatataacgaactcctttgtcacgagtatattgtaaatcatttttaacggcctcataaactcttgctgttaacatatattcttttccaacagattcgataagatgcaggttaactaagttagttaatgccttacgtgtattttctaaagaaatttgtgtcaaatcttttgcttccgataactttatgcgtttattctctgataaatagcgcataatcattagctctgccaatgataaaaatatttgatttttttcctgctcatttacaataaacttaacaaacgatacgtcttccactgcactacgaagtgtcaatgatactgcatcactaaacacttgatattcgggatatggctttcccatagatatcatttccctgaaaataatatctactccctgcccagttctttgtacatattttaaatgttgcaaagtttctgcgattagtttatttcttggtgctgaggggtgcgtaatgatattcctttctgttatcccatctaaaaatccaccaggattctctataactactttatcaggataatgctttacatatactgcacccatactttcataatccctatgagacaatgcattcaataaagcttcttgaaatactttctcagagaaatcttctacttctaatctaaataatcccacctggatattaagaattttattatcattttgtattttttccgtcaagcgatctaatacatttacaattggctgttgtaaatctaatcttaaatcatattcttcaagattttcagcactataatgtagatatataacctctgcctgcggcaacaatcttgaaatagaattttgtttaccaacaaataacaaaccagctacagtcaatctttcaacattatctatttttttaataagtccaagatctcttagaaaagccatatcctccaaagctggaagtgttgattttggatctctaatttttagtttttcttttaaagaatatacttctaaaagatttatatcctcaaaagtactttccatcactatcttacttgaaaaatccggtatctgctctctgtaaaaatgatgcgacatttcatctggaaaaaaaggttttgaattcttacccaatcttttcaaaaaacgaccatctgttgtcccataagttttaccatctgcctctactttcaatgccaaaaccatcataccttgataaggaattttttctatatccacaaataacgatggtcttgttttatcatatattgcctcaataatactttgtgtatcgtatttttcacatccagttactgtaccatcatcctctactccaaagtaaacggtcccaccctttgcatttgcgaaagcaactagttcatcaacagcaagcttaatacgttctttcatgttacccgcttttttccatgatttaaattctgtatgcaatgattctcctgaagaaagtattatactaaattctttttcgttcaaaaaaacacctcttttcatgcttttttatatagattttattccttaagctttttctcttcctgctttatcaattctatttcttgctgataatgttttatcttaattttcatgagatcttttctattttcttgactccaagtattcattgtcttattactataaaatagtgtaaaatcatgaatcgttgcagctatctgttgtattgattctgcccatgaattgcattccaaaggtactttaggtaaatctgaaattttaaaatatatagatgctatttgtacatttatatctttcacattattaactaattcactttccgaaatattaccattagaatattctctatatttacttatgaattgatccgcataccctaccatctcatttaaatactttcttgcctctttaataaattcttccgtggtcacagtttgttgatttaatattcgcaatgcattgtatgatttctgcttatccacaagaattccatcaagtatttttgaaccattactttctctataccaattattcttgtccatcgtatcatcaacccatgtagtaatccattcaaaattacaatctgtcatatcctgctcatcatttcccatatggcagcgtatcatattggccggtaatcccctgaatctacgctcttctatttcatttttatagacatttgaatattttatttcatcaattatttcttttgtaatcttcacaatatctatttcatcaaaataatatttcaaaataactttagcagtataccttttctgtcgagaatgatgaaatggcaaaacttcatatataatatattcttctgtttctttaaatatattttgtttttgatacgatgtatatttttgaactggaaaataaatagttcctgttatattagctctaaaaataggatgctgaattctgacaccttttctgttccatacacttatcattcgaaaaattaattcattaatctcttcgagagacttttttcccttttttattatacagtccatagttaatgcatcacacaaaaaatgtgtatacaagcttattttatttcccggataaaaagttgaattctcatttgctccgcaggaagccattacagcataccctgcacctgcaaactcttccaccattctatctatatccggtgttttaatttgaggaatcaaaaaatcaccagaacgacaactatctaatataataattttatttcttgcctctatgttatctactagttctatcacttcctgtacaccaatcacagtttcactaagagcaagagttccattatttccatgacctgaaaagtaaaaaatatatgtatcctctggctcaacaactaatgatgctatttgtaattcagtttccaattcctttatattaactcttccagaacttcccaacaaacgaatatcctgtgatgaaatacctaagccttttatcaatgctgcctttacttccactatatcatttctacaagcatctatatctggagttctaggattatcataattacttactccaaccaacgtagcttttacatttcccatcttatttcctcacaatacctgaaattataacctacctttttataatgtctttatctagttacaatatccaataaagatttatagctgtctaccacatcatatactacttcactattactaattgccttaaaatgctctcttgcacaatgaatttttgatttttcaatcaaacgcagttgcatagagtccatagaacccttagtttctgctacaaaataaatatgttttactgttccctcataaaatgcaatcgcccaatctggattgtatcgtcctactggagtcgaaatataaaatccatctggcaatttcacataaacagccacatcttggcttatatccaactcttctgcaaatttttgttcgttagtagaatcatagatgatgtggtcatacaaatgtttatttgctttcattgcattcacaccaagacgacctttaatcgtcggatctgcaaacacttccgtaccatacctatcatccgtcacattataagtaatatgttcaataattgctgtggccttttcatcattaatcaaggctgcagctttaataataaattcttctggattatccttaaattgattgaataccgaaggttgaattccctgcagaatacgtacaattgcttttctagtcaaattggtttcatctactaactttccaatcaaatcatatttaactctagaactaacagacactgtacgcccataattttctgtcttttcttttagaaaaccacttccatcagcaaggatttctttcgacttaatctcatttaaaacaccagtttccactttaaaataaatcttagaaactcttaactttctatccaaagagtcaatcgctttgcatataagctcttccgtatcaaaatcaacaacatatgctgtctttgaatttatttttgaccaaagtgctttaaattctggcattgcaagtttattttcatctagatgtagttctatattattactacgagcattttcaggacacatagaacgactattataaacagaatctataatttgaattacggagttgacagaatcagcaacctcttctgccaccttaatttctccatttgctttatcttcataatatttgtctgtcaaattaccttttctgtcaacatacctactcattatcaaatcataataaattgcatgtgccatgtcagaagtaattacctgctcatttccttgctcatcttcaatcacttttccaataaataattctgctgtaactgcatgtggtctatcagctactgcctctgcaatttcactttgtagtccttttgcaaagctatcataactctcactagcaataaccgtcagtacattaacactatgtacatcatttccaagtacattggtatccatacgttctccatcctggtttacacaaagacgaagtccacgacctacttcctggcgctttcttacttcactattactctgttttagagtacaaatttgaaatacatttggattgtcccagccttcacggagtgccgaatgtgaaaaaataaatcgtacaggtgatttttctggactcctatctaaaagaagttccttatttttcataataaggtcatatgcatctacatcgtctgtagttgttttcttacgtagaaccttagagtttatcattttgccttttttatcaatagaaaaataacctgcatgagttttattaaccggaatagaggataaatatcttaaataatcatcctctccaatctttatctgaagattgttaataatatcattatattcttcttcgaatatgtctgcgtatattccattaattggctgacctgcatcatcatactgtttatacttagctacctcatcaataaaaaagagggacaatactttaatccctttataaaataactcacgttctctctgtatatgtgaaagaatcgtctctctaatctgaattcgacgcagttggtcttcacttacctttccaattacgtccccagcataaattttaataccgttaataaactccactgaatcgtcacgtccatcaattctagaaatcacaaaaccttctttatattcttccatatttccggaattatcatataaattacatccttctcctaccgttttagtaatctttcgaatactattggcacctttataatcaaattgaatagtggctgttggggcagcttttgaaagattgatactttctaaatacacatagctttctgtagccgttgtaccagattctgaaatgccttttactacaatttttttaactaaacgcttattatatgcttccatggcatccaattgatataccatattgtaaatactatctcttttatgcgtagcagaataacgcaatgtcataagtggattaaattgtttcaaattttcttttgttttcttaccttcaactgactgtggctcatcaataatcacaatcggattcgtctttgcaagaatatcaatcggtctcctagaacggaattcatccagtttcatataaatacgtctagcatcttttccccttgcattgaaagcctgagaattaataatcataacattaattgaattatccgacgcaaagcgatctatttctgtcagccttgcagaattataaataaaaaatcgaatttttttcccatattcttctgcaaaatgttcctgcgttacctgaaaagatttatagaccccttcgcgaattgcaatacttggtacaacaacaataaacttactccaaccatatgcacgatttaattcgtacatagttttgatataagtatatgtttttcccacacctgtttccatttcaattgtaagattatatcgcccttccaatttgccagatggctctatttgattttcacgctgaattttctgtatatgctccaaaatcaacctatcatttaactctggaacaattttatgattactccaacccgtaaaatcctcttcatccatcgtagacatctgagaatatttctgtccttccattgtttttccctgataacctttatccatcatataagaaggtgtaagatatggctgacccgcaaatacatctaccaccgcctttgccgcatcagcctgaaatttctgatgtttaaatcgtaacttcattctttgcctccttaaataactttcacagttgtatccggtgctattaatttaaagatttcaccaacattaattttagacgaactgcttgcaaaactactatcccggaacactgcacgaagaggctctttttttgcaatttctttaattacactgttaggaatattctcatcaaagcacgcaattaaatcaccatcattataattatggactgtacatccctcaatttgttctgaataatacggtaatgaaagaggcaatccccaatccaatagacatccaaataacaaatctaggtctgtacggtcttctttgatattagattccaattgattaagaaatccctgagaatagtcatctggctataatatacttcattcatattagaatcatccaattttaatacacggaaaccaatatctaaattctgtgtgaccaatggagcttcttcttttatcttctttccagcacgtcggatacgttcttttccgatttcgcaaatatttttatagcctgtatctttctttttattagtattttcagctaattgtaccataatatatttacactttaaatttttttctttattaacttccattaaagcatgtgctgttgttgctgatccagaaaagaaatctaatactatagaattttcctttagatttgctaatatcattaatctttttaataatcgagtaggttttggcccatcaaaaactcccccatccataatttttataagttcttgtgaaccttcctgactatgacctacttctttgaaaaataataatgatgtaggtgccataccttcaaattttaattctgataaaaatcttttaatcctaggaactccatttccatctgcaccaaaccaaattctattatctttaagtctctctaaaaatttatttttagagagcctccagcagcgccctgctggaggctctactacccgcccagagggcgtagtaatagaataatctccagacggtgaatacgtttttacagttaaattatcagattgccatacacctcttggatcgttatccggatttgaatatctcgcatttgcttcacttgttctaggtaatcttcctattacaaaattgttaatattttttgcaaacattaaaatataatcatgactattggaaatatattttgcatcatttttaggtgcgaaagccctttcccatattaattgtgcaacaaaattcttttcaccaaatatttcctcacaacacttttttaaattggactgctcattatcatcaattgaaataaaaatcacaccatcatcagacaataaatttctagcaagcataaggcgagaataaatcattgaacaccaatctgaatgaaagcgtccgttagtatcagtatttttaaacatacgatttccatcttcatctaattcactaatttcttccgcatattcttcacttgtcattttaaaatcatcattataaataaaatcatttcccgtattatatggaggatcaatataaatcatttttactttatttaaataactttcctgaagcaattttaacacttcaagattatctccttcaatatagagattctctgtattatcccaatcgactgattcctccttacatgggcgaagcgtttttcgaatcggtttatttgcttccacaatagatgctttcttccctacccaagtaaattcgtatgcctcatccccatcaataacgtccgatgaaagcatctgctttaaa

SEQ ID NO: 425 - DNA, 38213 bp, Eubacterium hallii
attttacgcaatacacgaatttcgtattgcaacctcatatcttgtcaatgtacaaaagagtgtctttaatgagcagcacatctaacggttttctctttaagaactgctacggctattgtagcatattaggtaacagttaacaaggctcctcccaccacctaaaggtagtgggtttccgcctatggcaaacgaaaggattttatttatgaaaatatttaaatttaaaaagaaaggacggtggatggaatgataaagactcttgcaggacaagtgaaagagtttaagaaagattctattcttacaccatttttcatgattttagaggtaatcatggaaatgattattccgcttttaatgtcatcgatcattgatgatggcgtggaaagaggggatattcatcatatttatattattggtatatggatggttgcggcggcaggcattggtctgtttgctggtgttatgggaggaaagtacggtgcgagggcatcaactggatttgcaaagaacttacgacaggcgatgtttgagaatattcagacattttctttttctaatatcgataagttcagtacaccgagtctggttacccgtatgacaacggatgtaacaaacttacagaattcttatcagatgcttctgcgtatgtgtgtacgtgccccatttagtttgatctgtgcgatgatcatgtcattttcggtaaatgcaaagcttgcaagtatttatcttgtagcagttcttgttcttggtgctttccttgcactcattatctggagagccatgggttatttcacagcaatgtttaagaaatacgacgacctgaatgcaagtgtgcaggagaatgtttctgctattcgtgtagtaaaggcgtatgtgcgtgaaaaatatgaaaagagccgttttacaaaggcaagcggcaacgtatatcgtatggcagtaaaagcagagagaatcgtttcatttaactcaccgcttatgatgcttaccgtctattcctgtattcttggaatcagctggcttggtgcaaagatgatcgtgcagtctgttcttacaacaggggaacttatgatgctgcttgcatattgtatgagtattttaatgaatcttatgatgctttccatggtttttgttatgctttctatgagtgtggcaagtgcagagcgtgtgtcagaagtattaaatgaaataccggatattgtaaatccagatcatccgctttacgaagtaaaagatggaagtattgtatttgaccatgtttccttccgttataataaagacggaaagaagaatgtattaaatgatatcagcttttctgtgaaggaaggggaaaccattggtattattggtggaaccggaagtgcgaaatctagtcttgtaaatctgatcagccgtctgtatgacgtttctgacggaagattacttgttggcggcaaagatgtgcgggagtatgatattgaaacactgagggatgaagtgtccgttgtcttacagaaaaatgtacttttctcagggacaatccttgataatcttcgctggggtgatgagaatgcaacggaggaagaatgtaaaagagcctgtcgtcttgcctgtgcagatgaatttattgacaggatgccggaaggatatcatacatatattgagcagggcggttctaatgtgtctggtggacaaaagcagagactttgtattgcaagggctcttcttaaaaagccaaagatacttattcttgacgatagtacgagtgcagtagatacggcaacagatgcaaagattcgtgaagcttttgcaaaggagattccaaacaccacgaaacttatcattgcacagagagtatctagtgtacagaatgcggatcgaattatcgttatggataatggagagatttccggttttgacagtcatgaaaaccttataaagacaaatgagatttacagagaagtatacgaatcccagacaaagggcggcggagacttcgatgagaatggaggtgaataagatggctcgtatgaatatgaaaaatgggaaaaaagtagaaaatcccggagcattattaaaacgtcttatgggatatatcatgaagcattacggtgctgccttcataatagtattgctttgtattttgatcagcgttgtctgtaatgtacagggaacgatgtttatgcagacattaattgataattacattgtcccgatgttaaaagacgggaatcatgatttttccggtcttgctcatgcaattacacgcgtagctggtttttatgcgattggtgtagtactaactttgttatattcacagatcatggtaaatattacacaaggaacattacgaagtctgcgagacgacttgtttactcatatgcaggatcttccaattaaatattttgatacacatgctcatggtgatatcatgtctgtgtatacgaatgatattgatacattaagacagatgatttcccagagtattccgcagctttttaacagtgggatcatggtagtcagcatcattgtctgcatgctcatgttaaatgttccgttaacggtagtcagccttgtcatggtcggtgttatggtttacgtttctaaacgtcttgcaacattaagtggaaaatactttatacagcagcaaaaagatctcggtgcggcaaatggttacattgaagaaatgatgcagggacagaaggttgtaaaagttttttgccatgaagaaaaaagtattgaagaatttaaaaaattaaatgatgaattgttccacagtgctgataatgcaaacaagtttgccaatattgctatgcctgctaatgcacagattggaaatatcagttatgttatcgtagcaatcatcggtggtattcttgcgattaatggaatcggtggttttacacttggggcgctggcaagtttccttacatttaataagagtttgaatatgccaatcggccaggttagccagcaggtgaatttcgtagcaatggcgcttgccggagcacagagaatttttgcacttcttgatgaaaaaccggaagttgatgaaggatatgttactcttgtgaacgcaacagaagatgtggacggaacgattcatgaaaccgaaaaacataccggtatctgggcatggaaacattttcataaagaagatggaacaacaacgtataaaaagcttcttggtgatgtagaattccttggtgtggattttggatatgatgagaagaagattgttcttcatgatattaaaatgtttgctacaccaggtcagaaaatcgcatttgtaggttctaccggagccggaaagacaacgattacaaatctgatcaatcgtttttatgatattcaggacggaaaaatccgttatgacggtattaatattaataaaataaaaaaagcagatttaagacattctcttggaatggtattacaggatactcatttatttactgcaagcgtaaaagataatatccgttacggtaagctggatgcaacagatgaagaagttattgcagcagcaaagcttgctaatgccgatagttttattgaaagacttccacagggatatgatacgattcttactggagatggtgcaaacttaagtcagggtcagcgccagcttctttctatcgcaagagcagccatcgcagatcctccggtattaattcttgatgaggcaaccagttcgatcgatacccgtaccgaaaaaatcgtacaggaaggaatggatcgtctgatgaatggaagaactacttttgtaatcgcgcatcgtctttcgacgattaaaaacagtgattgtatcatggtattagaacagggaaggattatcgagagaggatcccatgatgatctgatagaagaaaagggaagatactatcagctttatactggaaataaagcataatttattggaatataccaaaaagatttcgagagtagatcgtagatgaagggggcacacaaaacagcccctttcatctatttttttatacagtcatatagtacgtttattgcttctgctaaatgttctgtattgaggtaagagtagttgataataaaggtgtgggcagcaaagtcatcaggactgtcatgataataagcggacagactgttcagttttacacctttttggagtgcgcgctgcatgaattctttatcggatagttccatttttaattttaacagaaaatgaagtccggagtcttcttccataatagtgacatgggacgagagaggacttctttttatagcatctaataagatgtcccgttgcttatggtaaaagttacgcatacggtttatgtgtttttcaaaataaccttcgttaataaaacgcattagtgcatattgttcaaagtttgaaacggtacaggagtaaaagctcaactgttctagaaaacgattggcaagttccggcgggagtaccatataactgattcgcatagtagaggaaagactctttgtaaaagtattaatatagataaccttttgcgtgatatccatactttgtaaagacggaatcggctttccagtaaggcgaaattcgctgtcgtaatcatcttcaataatataacgattagcagaagcagcagcccagccaagaagttcataacggcggcttataggagtaacgattcctgtgggaaaatgatgcgagggggaaatgtgtaccacatctgcaccgctattttctaattcgttgacaagaattcctttttcatccattggaatataatggtattttacgttatagctattgtaaatggcggcaatcttttcatagccgggattttcaatagcatattttttgtcaaatccaaggagctgaatgagcagtccgtaaagatattctgttccggcaccaataaaaatctgttccggctggacatgcattccccggaattgttctaaatgtgtggcaatagcctttctaagaccgatgattcctccacatggaggctttgtcataaggtctgggctatttgtattaaaagtttcgcgcatcagttttgcccagattgaaaacggaaagttttccggacgggtctggttacttgaaaaatcagcaagaaaatcagaatatccggaagaaagttctacattttctgttgttaatttcactggttttatcgcattatttttaaaatctgatacatagaagccttttttaggaatggaataaatatacccttcagataaaagttgtgcataagcattttcgatagtaattgtacttactccgagatttttcgcaaaacttcttttggaaggcagtttttctcctgaaattaactttccatctataatatcctgacggatacattggtataggtgcgtgtatagagattcattttttaagtttgtaaaagaataagttagcatagaattctcctgatatatattctgaccatactggctttatctaaattggatatttaaatatggttaaagtgtactataatattatacttgtttcagatatttttacaaggaggaatgatttcgtatggaagaaaataaaacatcggtccttagtaatggattaatctggtttggagccggagtttccatgtcagaaattctgacagggacgtattttgcaccgcttgggattaaaacgggtctgttcgctattttaattggtcatatcattggaggtatcttattatttttagcaggatatcttggagcgaaaacgagaaataatgcgatggaaaccgttgcagttagttttggacgaaaaggtaatctgcctttttctgttttaaatattttacagctggcaggctggcttgctattttaaattacgatggagcacttgctgcgaatggtattttttctgtaggagcgggcgtatggtgtgcagtgatcggcattttattactcctgtgggttctggtaggattaaaacgtctggagaagattaatatggttgcaatgacagcattatttttaatgacgttagtattatgttttgtaattgtgacgagaggaaacttcggaacgcttttcaatggcagcagtgcgaataaggatgcacttacttttggtgcagcaattgagctgtcagcagccatgccattatcctggattcctgtaatcagtgattatacatctaacagtacaaaaccggtaaaggctactgtagtaagtaccattgtttattgtctggtaagctgttggatgtatctgattggaatgtctgctgcgattggtatgggaacttctgatattgcacagatttctcttcgtgcaggtcttggagtagtaggccttttgattattcttttttctacggttacaacgaactttctggcagcacattctgctggtgtttcaggagaagttattggagaaagtttttcaaaacatattaacggaaaatatctttctgttcttgtagttctcctcggtacgattgcagcgattctttatccgatggataacatagaagactttctttatttgataaactctgtatttgcaccgatgatcgcggttatgattgcagattttttctttaataaaaagcggagtgtgacaaaagaatgggattggacgaatcttatagtatggctgattggtcttagtttatatcgagtattgatgcatgttgacattgttatcggttatacgctgccggatattgtgattacggctgttttatgtgttattgtacatcgtattcttccgaagaatcgccttgacaaagctctttaaatgtatgacaatatatcctaaaagaatatactgttttatgtaaaacttatgtaaaacagcgtcttcttttaggattttttatctcagtcgagaagactctcacctctttcaggtggtgagtgacagcaaatttgtctcggtgggagtccaatctccgactgagataaacgctccgcgaggatgcgcagtgattctgtaaagaatatgtcagcttacgctgacaagaatcacgcgccaagtttcgcggttgctcgacttgaaatcttaagaaaggtgataagaatatgtataacggaaagatggagacaatttatgagtcggaatatatgaacctctatgatttacagtatagagaaggcggacactattattgtgccagcagaaggaagaaagatagaatggttgcattgacaccggatgaagaatgtaagacgatgcaggcagatgcagtaagctgttttgttgtactaaatatcaagggacagccgaagaagcttcttttaaactgggaatatcgttatccggtcggacagtatatgttaagcgtaccggcaggtcttattgacgaaaaagactgggataatccaaatgctcttgtagctacagcgattcgagagctgaaggaagaaaccggaattgaagtggaagaatctgatgaggtaaaggtgatatctccatgtgtattcagtaccccgggaatgacagatgaggggaatgctttagtatatatatcaatcaatcgtgacgagatgccaaagatgaatcatgatggggcagaaggttcggaagtgtttgaaggatttcgtctggtgagcaaagaagatgcacaagactatctttgcaaaggaagagatgaacatggtatgtattatcctctttatacctgggcagccttaatgttttttatgggagtatagttgcgatacattcaagaatgccttggtattcttgatctgatatgttaaatttattcgcatacagtatatgattgggacggggagagaccctatgtgaataaggaactgaaaacagggggacgttattaatgagaaggatattgctaattggacgaagtgaaagtgggaagacaacgttaaaacaggtattacgtggagaaaagattacttataagaagacacagtatgtcagccagtatgattgtattattgatatgccgggagagtatgctgaaaatatggatttatcacatacgattgatttatatgcggcagaatccgatgtggtaggaattgttttaagtgcgacagaaccgtattctttatatcctccaaatgtaacaccacttggaaacagagatgaagtgggaattgtaactaaaatagatcactgggcagctaatccgcagcaggcagcggaatggttaaagttaaccggatgtaaaaagatattttttacaagttcttatacaggagaaggaattgatgaaatttttgagttccttcgagaagaacatgacatctgtccggtagaaaaggttatggatgcgcttcacaaagaaacatttaaaaaaccagcagatcttccacactatcaccttcagtaatcttaggaggaaaagatatttatgatacttcagattttacttttatgtttagggtttgtatttttagtaaaaggtgcagacttttttgtaaatggagctgccggaattgcggcgaagctggggattcctcagttgatcgttggacttacgattgtggcaatgggaacaagccttccggaagctgccgtcagtattacatccggtttaaaaggaaatgcaggaattacaatcggaaatgttgttggcagtaatattatgaatgtttttgtgattcttggaattacagcagttattacaaatgttgcgattcagaaatccacattatattatgaaattccgttcatgatactggttacatttctgatgattttttttggaatgaccagacaggcagttagttttgtagaaggtgtgattttctggatattatttatcgcatttcttgcttatctttttgttatgtcaaaaaagaataaagtttcagaagaagaagcccagtgtgatatgtcttatttaaagtgtatcatctccatcattgccggaggaatcatggttgtatggggaagtgaccttgtagttgattcggcatcggcaatagcaagaacctttggaatgagtgaacgtttcattggacttacgatcgtagcgtttggaacaagccttccggaacttgttacttccgtaacagcagccaaaagtggaaatgttggaattgcgatcggaaatatcgtaggaagtaatatatttaatattctttttgtcattggaacaactgcattaatctgtaatgtaccatttgaaagtaagtttttggttgattcagcggtagcagtagctgcaggtgttattttatggcttggaacgataaagaataaagaacttagaagaccctgtggaattataatgctgttagcatatgcaggatattttgcatatttatgtatgaattaagcgtgataggtaaaaaaatatggcaggaattcctgccatattttttattagcgagaagcgcagtaagctgcggcattacacccggtatcccagtaggtactgcttcggctaaatgtgctgatttttacctttccagcggtctgagaagcgtggagaacctttccgtttccaagatagattccaacgtgattagaaccgcctcggtggaataccaaatctccgacggtaacattatgaacagaggaaacagaatacaagtaagaatccatgagttcaagttgttcataagtagtgttaccgatatatttgccggttgcacttttataggcatcacgtacgaggctggaacaatcggcatagcctttctggtctcgtcttgcctgactgtatttgttcccaagtctggtatgtgcataagagattgctcttgagcggtagttaccagtagaaacagtaggggaagttttagctgctttttttactggagtataactttttccaacgtaaatcccataaacataacccttttttccggcagaagttttcacttttttccatgcaccttttgtagtgcagacagtaacgctttgacctgcggacaagcttcctttaatacgtccggaaaaggatggcttcgcacgcatgtttacgctgctggcagtgattactgcgcggtaagatgtgctatttgcagaggatgcagaagcctttttggaactcttaagatatgttttataaatatatccttttactccatctactttaaccgcaatccagttacctttactgcctgttctagttacagctgtcccggcagaaacagaagtgagaatctttgaagagccatttggcttggctcgtatattcactccgtcagtagtatacagccgttgtgcgtgaacaaaagttgttgggagcatcagaaaaagaagaagagaaaaaagtattgccttatgattcttttgaataaataatggcagatgcacaacttttttcgagtgtttgttcgtgttcattggtgatacatctcctcatatgtaatttataataaattgtaacacattttacagcaaaaattaagaaattttttcaagggaaacattacatattaaattttttgtaattattttaactatcctgatttccggcacaatcgatatcggaatataaaaagtatattggataaaaaatagattcatgttatgatgttagggaaaataccttttgatcctaacatcataacatgaatgttttttttaatattgcataaagctagaagaaggaggctgtatacggtgaagaagtatccggttataataatatttttgataacaatgttacttgtttgtggagagacggttatggcgaaggaacgtttgggaaaaccactgggggttcttgcgaatggagtagaagatcaagtcgtgatttcatgggaaccggtaaaaaaagcggatgggtatgaagtttttgaaaaggcagaaggagagaaagcgttttcaaaggtaaaagtaacgaaaaaaaggaagattgttttaaagaagaaagcacgaggaagaagatatcaatacaaagtaagggcatatcgaacgaaaaagaaggtcatttacggaaagttcgggaaaaaggcggagacgatgacagcaaaggattcgacctctactattaagaactttttgacgacggcaattactccggttggctcaaccatgtacatatggggtggtggctggaacaaagaagataccggagctggaaaggatggagttttaatcggtctgaatccgaactggcgtaatttttgcgggaaacagaaggcatcttataactacaggagaaacagatatcaatttggtgcagggcttgattgctccggttttgttggctggagcatctataatataatgaaaacaaagaatggaaagctggggcatggttatgttatgaaggcatcgaagatggcatcatcttttgcgaagtatggatgggggacttataaaagcgcagcagggatcaaagattttaaagccggtgatgttatgagttcatctacccatgtctatattgttgtgggaagctgtcaggatgggagtgttgttttagtacattcaagtccggcaggtgttcgtttgtcaggtactccgaacagacaggggaaagcaggaagcgaagctgtaagattagcaaaggcatatatgaagaagtattatccgtcctggtatcgccgctatccatcctgtggaaggggaatgagttatcttacggattatgctcagttccgttggacaacaggcaagggaagcgtgttagatgatccggatttatatcagaataaaacagcaaaagaaatattacaggatctgtatgataaaaagtaaagaaaagaacataaattcacagccaaagtaaaaaatagtttatgttcatggaaagtgatttatgataaactggtaattattaagagctgctgcatgatcatgattgaaaagcatcagtgctgcgttttattagttatattagagaattgaattgttaggagtacaatatgagaaggagaatagatgctcatgtagtgatggaaaagattattccacgaattacagaagaatatcggaagttatatgacattcctgaagaccatgaaagtatggctgttttttctgcagattgtgaggatgttatgtggcttgcggtagatgatgcaacaaagaaggctaagatcaaggtcattcagattgagacagtctatggtggtgttgatcattcctggagcagatatgggggagagattacagcaattatttccggagagaaggttgcggatgtaaagagtggtcttcattatgcgaaagattatatagagaataaatcaggaaactatcatctgaacgaagatggtacgttaggatattatgtggattatgttccaagaatcggaaagtattatcaggaatcgttaggacttagcgagggaacatccatagcatatctggtatctgcaccggtagagagcatgtatggcttagataaagcattaaaagcagcagatgtaaaaattgcggaattatctgagattccttcgcgtgttaatacgggtggagcaattgtttatggaacggaatctgcctgtcggtctgccgttgaggcatttgttgaaggggtagagtactgtgcatttcatccaatggatatagagtgagatttttgtgaaaaacagagattttatctcagtcgagaagactcccacctctttcaggtggtgagtgacggctcgacctgaatagtaatgaaaggattttaatttatgaagattgtaaagatggagacacatatgctcagccagaaagtgattgcaaatgtgacggctgagtttgcaagagtatataatataccggaaggacatacaagtgttggtttcttttctacggataatgatgatattgggtatcttgcagtagatgatgcaagcaagaaggcaaatattaagctgattcatgcacagacgtattacggaggttctatttgttcctggagtaagtacggcggaagtgtatttgttcttttttccggtccgaaggtagaagacgtgaagagcggtcttcgctacataaaagattttatagagaatcattcggagctttgtaactttgatggagatgagggaacagcgttctatgcacagacgattccaagaccgggaaagtattttcaggaatggtgtgatattaaacctggagaatcttatgcatatcttgtaggaggtccgattgagacaaactatgcattggataaggcgttaaaggcaggcaatacccgggtagcaagatactggtatccgccgtcacatgcaaactcaagtggggcagtgcttgccggaacagaatctgcctgccgggcagcaacgactgcttttatcgaggctttggagtatgcgataaagaatccacttgaaatataagaaaaaaatttctggacattttttttaagctgtggtagactgagtaagatttgatgtaaaggcaatgacggagagaagtagtgagaattatcgcttccagagagtgggggatggtgagaaccctgcagaatgaattttcatgaataacactttatcagccgcaatctgaacaaaggtctgcaaaacggacacgagcagactgatcagtaggtgcgccgtaactgtgcgttagacagaagttggttttgagtgactgttttatataaagacagtaattcaggtggtaccgcggaatcatccgtcctgaactagttatagttcaggacgtttttttgttttgtcctagtcaagaagacttgagtaagcaataaagttgtattaaaagttgtattataagaagggagattagataaatgaacatatcaaacatttacagagacagaactcttgatatgatgaatgaagagaatgttggcgaaactgtccgcgtggcaggctgggtagagaatatccgagatcatggaggtgtatcttttattgatttaagagatatgtatggtgtccttcaggttgtaatgagagatactactttactagaaggaatcaataaagaggattgcatttctcttgaaggtgtgattgagcatagagatgaggaaacatataatccaaagattccgaccggaacaattgaattagaagctcacaaagtagacttacttggaaaggtatataagcagcttccgtttgaggtcatgacttctaaagaaaatcatgaaaatgtacgtttaaaatatcgttatcttgatttgagaaataaaaaagtaaaagataacatgattttccgttctaaagttatcagctttttaagacagaagatgacagatatgggatttttggagattcagactccaattctttgcgcctcttctccagaaggtgcaagagattatattgtgccatccagaaaatacaaaggaaagttttatgcgcttccacaggcaccacagcagtataagcagcttcttatggtatctggatttgataagtatttccagattgctccatgttttcgtgatgaagatgccagagcagaccgctctccaggagaattttatcagttagactttgaaatgagttttgcaacacaggaagatgtattccgcgtaggagaagaagttcttacagcaacatttgaaaagtttgcgccagaaggaagtgttgtaacagcagctccttatccggtaatcagctacaagcaggcaatgcttgagtttggttctgataagccggatttaagaaatccgcttcgtattgtagatgtgacagatttcttccagagatgtacatttaaaccattccatggtcagactgttcgtgcaattaaagtatcaaataagatgtcgaaaggtttccatgagaaacttcttaagttcgcgacatcgattggaatgggcggacttggctatcttgaagtaaaagaagatttaagttataaaggaccaatcgataagtttattccggatgatatgaaggcagagattcgtgaaatcgctggtcttaaaggtggagatacgattttctttatcgcagataaagaaaaacaggcagctctttatgcaggacagcttcggaatgaattaggacagcgtcttgatttattagagaagaatgcataccgcttctgttttattaatgattttccaatgtatgagtatgatgaagaacagaaaaaaatcatctttactcacaatccattctctatgccacagggtggtttagaagcgttaacaacaaaggatccattggaattacttgcttatcagtatgatatcgtatgtaatggtgtagagctttcttctggagcggtaagaaaccataatcttgatatcatggtaaaagcttttgaaatcgcaggatatactgaggaagatttaaaagagaaatttggtgcactttacaatgcattccagtatggtgcgccgccacatgccggtatggcacctggtgtagatcgtatgatcatgctgcttcgcaatgaagaaaatattcgtgaggttattccattccctatgaatggtaatgcacaggatgttatgtgcggagcaccaaatgaagtttctgaaatgcagcttcgggaagtacacattaaagtaagaaagtaacttcattatgggggatttgtttccatgttaatagtatcagatccgcttatttgtgaattgacagtaggaactaagcgataagtaggtttgaaataagaaatgaagttaggagaggattatgtaaagtgatcctctccttttcttttcgacaggttagccttcggataagaaaagaatgtgatttcaaatgaaaagtataatgtgagttatataaagagaaaaaagttctttttgagaaaaaatatacaataaatagaaaactaacggggatattattgaaaaaataactaaaaaacaagaaaaaccgtctataaacttgtttataacaataaaaaacatttacaaacaaaagcattttttagataataaaattaatatttcataaagaaaaataagttataggaggatgagtatggaacgtttaattttttgtgcgccaattcttggaatttgtgcgttactctttgcgttttatcttacaaaaaaagtaggaagacaggatgcaggaacagacagaatgaaggagattgcagcatttattcacgaaggagcaagagccttcctcacagcagaatataagatccttattgtatttgttgcggtattatttatattaattggtgtaggaattggtaactgggtaacagcagtatgttttcttgttggagcattattctctacagtagctggttatatcggaatgaatgttgctacaaaagcaaacgtaagaaccgctgcagcagcaaaagacagcggaatgaataaagcgttatcaatcgcattttccggtggtgctgtcatgggtatggcagtagtaggttttggcctttttggagcaggagttatctatgctttgactaaaaatccagatgttctttctggattttcattaggagcatcttctatcgcattatttgctcgtgtaggtggtggtatttatacgaaggctgccgatgttggagcagaccttgtaggtaaggtagaagctggtattccggaagatgaccctcgtaatccagctgttattgctgataatgtaggagataacgtaggggatgttgccggaatgggcgctgacttatttgagtcatatgtaggatctttagtatctgcgattacccttggtgttgtttatgcgaaagaaagtggagctattttcccattagttatcgcagcacttggtgtattagcatctgtcattggatgtttctttgtaaaaggtgacgagaattccagtccgcataaagcgttgaaatacggaagttattccgcagcgatcgtagtgatgattggctctttgattttaagtaaagtgttctttaacggatttaaagaagcaattgctattattttcggtcttatcgttggtcttttgatcggtgtgattacagaagtatatacttctggggattatggttttgttaaaaagattgcacagcagtctgaaaccggtccggcaacaacggtaatcagtggtattgctgtaggaatgcagtctacagctgttccgattatcttaattgcaattggaatcattggtgcatattctttcagcggcctttacggaatcgcattagcagccgtaggtatgctttcaacaactggtattacagtagcggtagatgcatatggtccgatcgcggataatgccggtggaattgcagaaatgtctggtcttccatctgaagttcgtaacattacagataaacttgatgccgttggtaatacaacagcagctatgggtaagggatttgctattggttctgccgctcttacagcattagcgttattcgtttcttatgcacaggcagttggattatttgaatccggaatcaacttactggattataaagtaatcgttggtatgtttgtaggtggtatgcttccattcctcttctctgcttttacaatggattctgtatctaaggcagcttacaagatgatcgaggaagtaagacgacagtttaaaacgattcctggaatcttagaaggaaaaggaaaacctgattatacatcctgcgtagctatttctactcaggcagctttaaaagaaatgcttcttcctggtgtgatggcagttcttgcaccattatttatcggtgttgtacttggaccggcagcacttggcggacttcttggtggagctttagtaacaggtgttatgctcgctatctttatgtctaattccggtggagcatgggataacgcgaagaaatatattgaagatggtaatcatggtggaaaaggaagcgaagcacatcgtgcagcagttgtaggagatacggtaggtgatccattcaaagatacatcaggaccttctatcaatatccttattaaacttatgacgatcgtatcattagtatttgctccattattcctcagcatcggaggattattctaaaaaataccgatttttatctgtcatgaaaaatagaaaaccagaaaggttaagaaacctttctggttttctattttcagcaataaattaatttgacagaataaatggtttataaatagggagtaatttgctataataaataaattaagagtttttacatataagcaggactctaagtaagattcatgatggaataaagttttctgctggaaagagacaaagcgaaaaaagctttgggaagggatgaatatgatgaagaataagatgtttacaagagtactcggaatgacgtgtgctcttattatggcagtaactgcgatagtacctgtttgtgcaaaagaaagcggagatcaggcgaatagtttccgttatgagaatggacaagctgcagtgcaggcgtcaacatttgcagatgtttatccgaatgcatggaagaagattgcaggaaagtatcgaagtagtaatggttcgattattcagggagcaatagcaagaggaattgatgtcagtcataatcagggagtgatcgactggcagaaggtaaaggcagatggtgtggattttgcaattatccgctgcggctatggtgcgaatcagagggaacaggatgacagacagtggctcgataatgttttagaatgtgagaaatatggtattccttatggggcatatttatattcttatgcagatactgtagcaaaagcaaagagcgaggcagcacatgttcttcgtctggtaagagggcataagattacctatccgatttactatgatcttgaagataattatattttaagccatacgaatgcaaagcaacgccagaagattatacagacttttacgagtattattaagaaagcagggtattctgttggtgtatttgcgccgaaaagctggtttgaaaaagaacttccggaagcttcttttaaccaatgtgagaaatgggtggcacattggagtacgaagtgcacctatcagggaagttatcagatgtggcaggcgacgaatagaggaacggtaaatggaattaacggagctgtagatattaattttcttatgcttcctgcggcaaagattactgtaaaagcggcaaagaagaaggtaaaagttttctggaatcagaaggggaatggaataaaggttcaggttttctgttctacaaagaaaaacaaagggtataaaaaaatagcaactgtgaattccatgaaaggaaaagcagtcataaagaaaaaattaaaatctaaaaagaaatattattttaagattcgaacattaaaatctgtaaatggacgcatttattatagtgattattcgaaaccaaaaaaaattaaaggatagaggtacttatgagaaagattatgtttattggacgaagtgaagcgggaaagactactttatctcaggcgatgaaggggaagacgatcacctaccataaaacacaatatgtaaatcattacgatgttattattgacacaccaggagaatatctccagtcaaagaatctgatttctgctttggcggtttttacagcagaagcagatgtaatcggccttttgatggatgctacggaagctttttctctgtattcaccgaatcttacacctgtctgtaacagagaggttgtgggggttgttacaaagattgaccattgggcagcacagccggcacaggcagcagcatggctggaattagcaggatgtaagaaaatcttttataccagtgcttataccggtgaaggaattgcggatattctttcttatttaaaagaagagagagatactttgccatgggaagaagtgaagtcaaagtatgacgagcttggctttggcgctggcgaagatgcaaaagatcaggatcgatttcataatatctgataaaaataggtggattatttacagagattgttctataatgaatacagaaatttattttaaataaaatgggaggcttactatgagaggttatgaagcagcacagattttgaaagcgaaaggagttacggcagaagatgttgcagaagagatcatttaccgtaaagaaacgaatgctttcagtaataatccaaagaatgaggcgtttatgaatatgacgctgaatgaacttgtaagaattaaagagatgtggaatatctagcagacaagtgtataggaagaaggagctgtcctcaaagggatggcttttttctgttaggtatacaacatagatacagcaggagtaagagactagatagaaggagatagacatgagactgggttcaggaacatataaagaaattgctttagatgcgctaaagggaaactgggtgaaagcagcggtggcgggattatttgccaattggcttggcgtgttttcatcctcattcttatttattacaaaatacgcattcattgcaataattctgatttattttctcgaatttcttccggggttttatccgattttatttattggaacaacagcgatcgcactgatctacttttttattggagggcctgtacgccttggatatattgattttaacctggcattactggatagaagaaagaacgggattgcctgcctgacaggaagaatgtcagactggtggagagttctttgtgcaaagattacattattttttgttttgtcattgggatatattctgtttattataccaggagttgttgcgaagtattcgtatgcgatggtgccatatattcttgaagaacggaagggcttttcaacaagagaagcatttcgggcatcaaaacagatcatgaagaagcataaatgggagcttttttgtttgcgattaagttttattggatgggatattcttggtattttaacattaggaatcggttttatttttattaatccatatcgatatgcggcagaagcagcattttataatgagatatctggaagagcagaagtctattatggtagaaaaacgaacagataatggtaaaaagagagcagaggaaggaaggggaagaacaaaaatcttccttgcatgacgaaaagtattttgttaaaatatgagaagtttattataggatacgaaaaggaaggaagaaggataatggaaattttaggaaaggtgctttctgagaagacagaggctatttataaagatattacagaaggtctgatctatccgattaaaattgtaaagttagaccctgagaatgaggaagattgtagccgtccggtagcgatggataccggaaagaaagaatttattgttaaagtagataatactttggaagattccctctttgaaaatgctttgattcgtgatatcatttattgtcagcagatgagtaataatgcaccggtattaagtgcaaagagcaagaatgatattgatggatttcaggtagctatgatgatcagctccattattatggatattgatgtggagaacaaactgagaagttacgatatgcatattgatgatattgatacgatgcgtttgagtgatctatatgcatttttgaagtctggtatggcagattataatagagaattatataatgtttttaccggtcttcagattacactgttatattttacgacatcaaagcgaagcaatatagaagagattatcgagacattttatctttctgataagaatgcgatggatgcgattgataagtatgtagatattattgatcgttacggagtagatgataatcgttctatgatgcgttgcatgagaaagcttgcaatcgcctgtggaatgaagggcagattgcttctggaatacgaaggtaaagtaacagaagtttaaatgataagaatcctgtagctgttctgataagcgatattgctcctgacagaagctacaggatttttttgtaactatttatggcaatttcatagagcaggaaatcacagaatgaaaaatgatgggatggatgagatgaacataagagaatatttggaaaatcataaattattgacagacggagcgatggggacatattttgatacggtagagaaagagaattatatctgttctgaagaagccaatattaccaacccgtctttggtacgacagattcataaaaattatgtgaaaaatggtgcacaattattaagaagtaatacttttttggcaaacagagaaactttgttgtctttacagaaaaacagagcagaacagtttcaaaatgtaagtttgaaagaacttgtgacaaaaggttatcgactggcagaggaagttgcgaaagaagcgtattctgaaagttatccggtatttccagcagcggatattggacctattttagaagaaaaagagagtgaagagacggatatcctacagcaatattatgaaatatgtgacagctttctagaagcaggtgccaatatttttgtgctggaaacttttcctgatacggaatatgtcttaaaaatggcagaatatatccggcaaatttgtccggaagcttttattatcggacagttttcattgacaccaacaggttatagccggacaggttttcattataaaacgattttacgagatgccgtacaaagtggacttcttgatggtgcaggcttaaactgtggtattggcgcagcacatatgaagagatttttagaggcctatattgaagaatacggagtgccggaagatatgattcttactgcgcttccaaactgtggatatcctcagattgtaagaggacatgcgatatattcagatagtgttacttattttagtgagaagattaaagaagtttcggaattaggtgttcgtgttctgggaggatgctgtggtacaaccccggaatatatcggggaaatatacagaactctgtttcaggcagaacacactttaaaagttccgacaagaatcgtgtggacagatgcagcagggagaatacagaaacgacaagaacagctggcgcatataaaaagtgcagaaggaaagaataagacgataaaaaaagaacaggtagtaaatacatttcgtcggaaactggagaaaggggaacttgtctgtgcagttgaactcgatcccccgtttgatgcgaatgatacaaagttagtaaatggtgcgaaggaacttctttctacgaaggcagatattattacaattgcggattcaccgctggctcgttcaagagcagatgcttctttgatggcagcaaaaataaaaatgcagacaggaatggatgtgatgccgcatcttgcctgtcgtgataaaaatcgtattgcgattcgaagtggattacttggaagttatgtaaatgaaattcgtaattatctgtttgttactggtgatccggtggcaagagaagaccgggaatttactaaaagtgtctttgattttaattctatccgtttaatgaagtttgcacagagtatgaaccaggaaatatttgcagatgatatgattttttatggcggggctttaaatcaaaatggagcaagtccggaaaatattgcaggaagaatgataaaaaaaatagaagcaggatgtagttattttcttacacagccggtttatgacgaagagggtataaaacgccttgcattcttaaaagaaagaacaggagcgaagattttaatagggattatgcctcttgtcagcagaagaaacgcattatttattaaaaatgagatgccaggaatttatgtgccggatcgtgtggtagaaaaatataaagaaaatgcatcaagagaagaatatgaggaagctgctgttgaaatttcaaaggaaatcattgaaatgggaaaagaggtaggtgctggattttactttatgacaccatttaacagagtttcattagtgaagtctatattggaatatgtataagaatctggagtcatggattgatttcgggcaaggggtggtttcagagttttcaaataaaatgagaaaagaagcaaatagcaaaggaaagaataaaaatgaagataaacgaattttacaaaatgatacagcaaaagccagttattctggatggagcgacaggctcaaatcttcaaaaagcaggaatgaaaccaggtgtgtgtccggaagaatggattttggaaaatgaagataagttaattgctttgcagaaggcatttgtagaggcaggaacgaatattttatatgcgccgactttttcgggaaaccgcattaagttggaagaatatggtctttcagaacgcgctgaagaaataaataaacgtctggttgcattaagtaaaaaagcggcagggaataaagctcttgtggcaggtgatatgacgatgaccggtatcgcattagagcctgtaggaccgatgaagcttgaaacgctgatcgatatttataaagaacaggcaagatatctggtagaggctggagtagatctttttgttgtagaaacgatgatgagtcttgcggaaacaagggctgcagtaattgcgattaaagaagtttgcgacttgccggtaattgcatctcttacatttcaggaggacggaaggacattatatggtaccgatccggtaacagcagttgttgttttacagagtattggtgcagatgttattggagtgaattgttctaccggtccaaaagaaatgattccggttattcgtaaaatgaaagaatatgcggaagtcccacttcttgcaaagccgaatgccggtcttcctgttctgcaggatggagttacagtatatccgatgcttccggaagaatttgcatcctggggaccggagtttattgaagcaggtgctggattaattggcggatgctgcggaacaacaccagaacatatcagaatgctttcacagaaggtagccggacttacaacgaaagctccgcataatgaacatcctgtcatgcttgcctcggaaagaaagagtcaggaaattgcattagacggaaagttccttgtgatcggagaaagaattaatccaaccgggaagaagaaattacaggaagaacttcgtgcaggtaaaatgactcttgtagaggaaatggcagagcagcaggaagaaatgggggcacatattcttgatatcaatatgggaacaaatggtattgatgagaaagaaatgatgttaaaagcgatttctaaagtgacaatggtttccagccttcccctttgtattgatacaagctatgtagaagttatggaagcggcacttcgtgtgtatccgggacgtgctctcattaattctatttctcttgaaaaagaaaagattgaaaaacttcttccattagcaaaaaaatatggagcaatgtttatccttcttcctctttcagataagggacttccaaagagtcttgaagaaaagaaagcaattattaatgagatattggaaagagcaaaggagctgggaatttcaaaaaatcagattatcgtagatggtttagtgacgacggttggtgcaaataaaaatgcggcaatagagacattagaaaccattcgttactgtaaagaagatttaaatctatgtacgacaatgggtctttctaatatttcttttggacttccggaaaggccatacgtaaacagtgcatttgcagcaatggcaattgcaagtggacttactatggcgattgccaatccatcaaatcagcttttgatgggaatttctttcgcctctgatcttctacgtaataaagaaggctctgacattgcctatattgaacagattcagcgtatggcgccattaaaagaagcggccatggcaaaagcagcacaaagcgcaggaaacaatggcataaaaaaaacagagcagacagataacaaaagtactgctaaagaggcagacaaaaagaaaaatcctgtatttgaagccgtattaaaaggaaataaagacggcattgtcgattttgtaaaagaagaactttctcagggaacaaaaccaggagagattcttgacggacttttgataccggcaattaatgaagttggaactttgtttgataaacagatttattttcttccacagttgatttcgagtgcaaacacgatggaacaggcagtggaatacttagagccgcttcttaaagagggcggaacaaatgaaaagatgccgacaattattattgcgacggtagaaggtgatattcatgatatcggaaagaatcttgttgcgttaatgcttcgtaattatggctatgaggtaattgatcttgggaaagatgtaccggcagataagattattgcggcagcaaaagagcataatgcatcgattatcgtgttatccgctttgatgacaacaacaatgatgcgcatgaaggatacgatcgcattaaaacaaaaagaaaatcttaatgtaaaagtaatgattggtggagcagtaacgacacagagttttgcagatgaaataggagcggacggatattctaaagatgccgcagatgcagtacgtcttgccaaaaagcttctgtcagagtaaaatgttactatatcaagatacttgtgcgctgatgatacctgcgctaatctaaaatgagtatgaagttgatggaggtgcgaatgaacaagaccaaaaagatcgatgtaattattccaacatatcatccggatgaaaaactggaacgatgtcttcgtatgttaaaaaggcagacaatacagcctcagcggattatgttaattaatacagaagaagaattttttcacagtaaagtgttttcaacattaaaacagggagaaattgtccacataacaaaaccagagtttgatcatggcggaacaagaaaccaggcggcaagaatgtgtgacggggagattatgattcttttaacgcaggatgcgattccggcagatgagtatcttattgaaaatctgcttaagccatttgaggatgaagaagtctgcgctgcttacgggagacagatggcagataaaaaagataatccaattgaggcatatacaagaatttttaattatccaaaggaaagcaggattaagagtaaaaaagatttgccggaacttggaattaaaacttttttctgttcgaatgtctgtgctgcgtatcgtaaatcagaatatgatgcattgggaggattcccgctgcacacaatatttaatgaagatatgatttttgcctcccatctaattgaagaaggaaagaagattgcctatgtggcagatgcgaaagtatggcactggcataattatacagcaaaagaacagttaaagagaaactttgacctggcggtatcccaggtagatgcaggtggactttttacaaaagtgaagtctgaatcagaaggaattcgtcttgtaaagatgacgctgctacattttattaaaaaaggccagttccattatattccaaagattattatgcaaaatggagcaaaatatattgggtatcgccttggaaaaagttataaaaagcttccaaagaaatggattcttaaaatatcgttgaatccatggtactggaaatgaaaatgaactttaagaatttttaacttgcaatagaggaaaaattagtataatgtataaaaagagttttgtacaggaggttttaaagtttggaagacacaaataaagatatgaacatagacaaagaagaagcgaagaaagtaaaaaaagaaaaaaaagctcgcaaacgtggaagaaagggaagaatcgttgcacagattttcgtgtgttttcttctcacagtagcatttgtggcatctgccgcaggtggagcggtagctgcttactataaagcggctacgaatacaattacaacagatacgaaaacagcgttaaagaatgtagatgttgtagatgcagatcttgagtatgaccaggatgtagttaatattcttttgatcggatgtgataaaagagcagatgagacagaagcgggacgttctgattctacaatgattgccacgatcgatttgaagaatggaaagttaaagcttacttctctcatgagagatatgtatattgatattcctggttatggttatcataagtttaatgcagcctattcttatggaggtgtacagcttgaatatgagacgattgcagagacctttggaatcaagcttgacggatatgttgaagtagatatggaagcatttcgtgatgtagttgatctgattggtggcgtaccgatggaattgacagaagcagaagcttatttcttaaaaacagcctatgtgaattctaaacatggagagaagaatgtaaaggcaggagagaatatgctcacaccatatcaggcattagcatattgtcgaattcgtcaggatgttaccggtgagtttggacgtacggaccgtcagcgtaagattcttatttctgtatttaacgaattaaaaggcgaagatgtcatgacacttaccaatatctgtatgaaggcgcttaagcatgtgacaacagaccttacagaaaagcagataagaagtttgttaacttctgttatcacgatgggagcaacagaggtagatcagcttcgtatcccatatgaaggatcttatacagaaggccgcttgagcggcaacggcgcatgggtaatgcaggtagattatgaagccaataaaaaagcattgcagtactttgtttttggtattggagaagatccgggaattaatgattcctatggaatcggtaacgacagatttatagatggatactatccggagaagacggaaggtatctctacatactagtgtggaggaagaatatatgagacagatcgttttatctcttttagtagataataatccaggtgtattagcaagagtggcggctcttttcagccgacgagggtataatattgacagcattacagccggtatcacgaatgatccaaagtacactcgtattacagtagctgtaagtggtgataatcagattcttgaacagattcgtaatcagattgcaaaactggtagaggtacgtaagattgtagagcttgagaataatcattccgtatgccgcgaactagtacttgtaaaagtgatggcggataagaaagagaagcaggagattatcgctatcgcagatatcttccgtgcaaaggttgtggatgtggcagcgaactcacttatgatcgaactaaccggtaatcagaataagctggatgcatttttaaatcttatggcagattttgaggttctggagatgattcgcaccggaattacaggacttggacgaggtgtcagcacactaaattaattcttgtgtggtgtaaaagatatttaagcagcagagttttctgtattaagaagggatatttgaatatcccttctttttttgctgaaaattcgtagaattttttattcaaatgaagggaaatggatagtttaattcatttttaagaaaatttttttaagaaatactcaaaattaccttgatttatgaaataaagaggagtattataacgattgaaattcttatcagaagagatgaaatcaattttggtaattgaataaattaatttttataattattacaggaggaacaaaaaatggcagcaaaaattttttatcaggaagattgtgatttatctttattagacggaaaaaaaattgcgattattggatacggcagccagggacatgctcatgcgttaaacttaaaagaatctggttgtgatgttatcgttggtctttatgaaggaagtaaatcctgggcaaaagctgagaagcagggattaaaagtttatacagcagcagaagctgcaaaacaggctgatatcatcatgatcttaatcaacgatgagaaacaggcaaaactttacaaagaaagtattgagccaaaccttgaagaaggtaatatgttaatgttcgctcatggtttcaacattcactttggatgtatcgtaccacctgcaaatgttgatgtaacaatgatcgctcctaaggctccaggtcatacagtacgttctgagtacttagctggaaagggaacaccttgtcttgttgctgttgagcaggattacacaggtaaagctcaggaacttgcattagcttatggtgctggtatcggtggagcaagagcaggtcttcttgaaacaacattcagaacagagacagaaactgacttattcggtgagcaggcagtactttgtggtggtgtttgtgctcttatgcaggctggtttcgaaacactttgcgaagctggttatgatccacgtaatgcttacttcgaatgtatccatgagatgaagttaatcgtagatttaatctaccagtcaggttttgctggaatgagatattctatctctaatacagctgagtacggtgactacatcacaggacctaagatcgtaacagctgagacaaagaaagcaatgaaacagattctttccgatattcaggatggtacatttgcaaaagacttcttacttgatatgtctgatgcaggatctcaggtacacttcaaagctatgagaaagcttgcttctgagcatccatcagaaaaagttggtgcagagattcgtaagctgtatagctggagtgatgaagatcagctcatcaacaactaatttttgaacatatttcaaaagccctaaagccgcttaaatagtggctctaaggctttttcctttttctgagaagtactaaaaaggtactattttatttcgtttctttaaataattgctctaattttgctaccagttcctcttgtttggatgggaacaggtgagaataggtcttgagtgtaatggacgggtcctcatgtcctagccgttcggaaataagcaggacagggaaacctaagtcaatcaatagtgatgcatgggagtgccgcagatcatgcagccgtatatcctttacttctgaaagctttatatgctctttgaaagagccaaaatataccgttttggctgacggaaacactcttgtatcaggagtaggcttataataccgctccatatgcctttttaacagctcacaaaggaaattaggtattaatatatctcttatgcctttagatgtcttaggtgtggttattacagcggtgcgaccgttattcatggaatatgttttattaatgtgaattatattattatcaaaatctatatcggcaagggttaatgctctcgcttcaccaatacgcatcccggtataatatagtgtcataaacaaagggtaattagggtctaacttatcaaaggttgatgtgaagcggtcaaattcttctttcgtccagaagttaactgttttcttgacctttccaacaatgttcccggcggtgtggcagggattagcggaaagactataaaagcgtactgcaaagttgaagatacttgataattcattccatatggttttcatataaccgggacttaagggtgtacccttctttgtgtggctctcttttagctttccctgccattgtcttatatcagccgggcttatatcgtttacggctttattttggaaatatggcagaatccacgcttcaatacggtttttcttggtgtagtaggtggtatattttgcgtgctgctttctatcagcaagatacagctctaccaaagagaaaaaagtcatgtcagggtcacctgctaacttctccagaaaagaccgctcccattctaaagcatctttcttacgctcaaagccgctctttttcttctgtttgcggtttccctgccaatccttataataaaatttacaataccatttcttactttcatcgttgtaatatgctggcatatatctatcattcctttctagtgctggtcggcggtgttggaatgaataaaagtatagcatatatttttattgacttttggcaatatttgaaagataataagtgtgtgtataatagctagtgtgatcaccgtataaaacatggtcacacaagtaaataagtcttgctatgtaaccatagtaatttcaagacaggcgaaattaaaagctaaaagatagccgttctattctttccagggagcaaggacggttatctttttatttacattttgttatattgacaataacaaaagcatatcatataatatatttaacaagagaaccgatgactagatgaagcctagtcgccggcaaatagttaactacaaaaagtagcgccttagtttaccagacagagggcgctattttttgcgtgatatgtaaataacaagagttatcacagaacaaatcatggttacaaatgaaaatagtgattcataagttaccataagcaccaacccctttcataatgtccggtggctggcatttgcacccttatcggttccctggttaaatatattatattttcaaggtattatttgacatgaccctttgagcggtagtaaatgattttatagcactcctaaaaacaggggtgctattttactttacaaataaactggttattatttcttatctgtgagccttacaagttaagtatggcttgtcttttgtacgaatttgtacagtttcgtattatttttggaaaaatcactcaacgcaattttgcgtttggctaattgtgtcggcgcaaaagcacgaaaagtcgtataattcccaagtgaggagcggcgttgtgcttcggccggattccgggaattaattcttgtctggttctttctggttggatgatgggggttcatccggggcggtttcttcctgatcaggagcggtgtcagctctatattcggggattttaaataaatcacatgagtagttgtatagtttttcttggccttgtttgtttaatgaattaagatttgataaaatttcttttttaattagttcagaaaaatttaaaggcggctcatagttgattttgtccttaaaagcttcgcgaagttcatcggtgtctaacgaagaatattcggattttataaaatctactaattcatcacgatgaaaatataaaatatcagtcaattcgggcagaggaatctctaagtcatcagacaattttttaagtgtttctatttgaggggcttgcactgcctccgcgtatccctgtataaattcaataggtaatccggtactttcggaaaggtttttataagaactctcgtcttctgtaacatcatttaaagcgtccttgtattgcttttcattaaattcaatatctttttcatattctttaagatttgacaaggggtcggattcaataaagatataaaaataagcttctccgcccttggtataagtataaccaaggttcaaagcatccgcaatggatgcaaccattctaccacttggatttctcttacctacaacatattggcttatactctgtggggtagtatccagtagttcagcgagttgcttttgagttgtttttttatattttaatgcattcttcaatcttttaccaaaactcatgtattcacatccttttcaaataaataatatcatatcgtaacactaaaaacaatctattttgagtttttttattaaaaagatgcttgacaatcactcttgaaagagttaatatgcaaacataaacattcaaaaatgagtgatttgaaaggagaataaacaaatgaaaatcaacagaaagaaattagaacttgttaaagcgagagcctgcatgggacagaaagagattgtagcggcaggattttcagccggaacccttaccaacgctatgacgggcaagaatattaagcctgaaacagccgggagacgtgctaaagttcttggtgtagatgtcttagaaatcattgaaacagaagattaacacgctttggtcggcggtgttggaataggtgaaagaagatagaaaggagtaattatttgaacgaaattatttgtattcgtaatgaaacggctgtatgtgacagcctgcaagtggctcaaaattttggaaagagacatgataatattttgcgtgaaatttccgctctcctcaaaattgagggcagtgactcagcccaaaagtgggctcagtgcttcaaggaatcaacatacaaagatagtacaggaaaaagcaataagatgtattacatgaatcgtgatggctttacatttttagtcatgggatttacagggcaaaaagctaatgaatggaaatggaagtacataacagcgtttaaccgcatggaaagcattatcagagaaaaacagactcctgcatggcaggaaagccgccagcttggaaagaaaacccgtaaaaaagaaacagacgctatacagcgccttgtagaatatgcaacagcacagggtagcagccaccccggaagactctataccaactacaccagactaaccaaccaaaccgccggtgtaagtagtcgagaagccgctaccgaaatacagctaagtgttataactgttgccgaatctattatagcacaaactattgattcaggtatagaggaaaataagccatataaagaaatttatcaggactgtaagaagaaattagcagtattacagggggtaggggaatgacagaagagaaaactttagaagagttcttacatgatctactggagaaagaaaaggagcggcatgagcagctcttgaaagaacatgaggaacttatgagaatgattgacgaagcaagaaaggggatgcataagaatgactaagcagttatatacagctaaagaggtagcggaactatgcggaatctctgaaagttctgcatataaaatcattgcaaggcttaataaggagctgaaagataagggctatctgacttttagcggcaaggtgagccaggcttactttagtgaacgtatgtatggcggtattgctggagacaatatgctagaacaggcagaaagccggtaagaatggcatggggaagtatcccgctacaggttgcggagcagagagcggcagagattgccgaactactgagaagtaacccggatttcggggaatgtttcaatgagagatacaaaggaacgtaccgtacaaaagacagtacaaaggaagtacaaaagacgtacaaaagaagtacagtaacacaagaaagtatattacaggcaatcaacccacaaatgcatcttacaagggatttctttaagctgatatacagttttgaattgagaaatccgggttttgccaagaaagctctattaaggctagaagggcaaggatgtagcagggcaagagattattataaaaccgttgtagaatcttgcgagaaaagagagaaagcagcgatgcaagaagcagggaagtacctgcagaaaaacacacagaaaggcgatgataagaagtggagcatcaaggacatgagcaacagcaggctgttgacgtttgcaaagaatttgtaagaagaggcttaataactataactaaggatggcggcattatcccagctgtccctaatgatattgattatacactacaaagtgccgctaccacagaagaaaaggaggcggagtgggttgttcctggatatattcctcgtggctgcataacagtaatagcaggtgagggtggagtaggcaaaacctcattatggtgttcgttggtaagttctatcactacgggaaagcattcttttttacttgggaatgcagtcccaaaagagtttacaggccaaccagagagcgtattagcccttacctcagaggattcctggtcccataccttggttagaagattaagaaataatggagctgacttaactaaagtgaattacatagaccccggaaacccacgttttgtagagattgacttcacaagtgcttatttgaaggggcttgtggatgccaatagaccgaacgtgatcatctttgacccagtacaggcctttgttccgctcaacatgaagatgagtgataggaacgctatgagaaagtgtttctcggcattaatggcatttggtgaggaatacggcacaacctgcattgttattgttcatgcaaacaaacagtcaggagtatggggacgcaaacgtattgcagacagtgccgacatatgggacgcttccagaagtatcctcatgacagggataacaccagatggtcatacaagatatgtttcccaagagaaatcaaattatggaccgctccaagagactgtattatttgacttgaagaataccgttccagtatttaagggattcactgaaaagaaagacagagattttgttttagcagagtcaaaggagcgggcgattcgtccagcaatggaaacagccaaggaattcatcattgaaacactggaagaacataagcagatggaagttaaggagcttgaggagttggctcagacagtgggtattagtaagaatgccttgaagaatgccaagacggagctgaataaagaaggtagacttcattcatggtctagcggctttggacagaacaaaatattcttaatttctcttgtatcagagtagttaaaatatatatttataatattcatcagtggttgactccccctatgcaattttcagaaaaccccctagtaagtaaaatacggcttatttaaaggctctagtttactagagggtgaccccctagtaaggggaggtatcaacgagtaaggaggatgcaattttcctttactggaggggtatcccccagtaagttagagggcttatttaagccatatttcgcttactggttggctttttcactatgcatagggaggcccagacagtaagaaggcaggaaataacatagttattctacaaaataacaactttaaaagaaggtgatttcatggagaagaaaggtagtaagataatacaacttatgaaggtttctacaaagatgactgcaatatatggcagcaagaagccagaaagtaatgagtgggattttaatggtgatgtgattcaatgtcttgctttgtgcgaggatggagatgttgtcccggtggctgttcgtagtactggctgcgtagtagtggagaataaacctgactttatcggaatcctcccgtatgatctgtcgcattgtccatatccgacaatggcaaaaaaggaaattataagatatttcaaactggaggaaaaagaacatgacggacagagctagagagataagtgccacaacctggcaatggtataaaaagtatagagaccaggagcgtacagaagcggtatggcaggaagcactgcaagaagtccaagagcttcaggagcagtataaaggaacttcggactattcttttgctgtagatatgtttttaatcttcatagaccgcttagaacagatggacgctaacaaatgctaacatttggccttgaaatgaaaaagcgtaataagttatacgcaaactgataaataaccagacaataaaaaatcccactccggagttgaccgctccgaaatgggacaagaacatggaaaccatgcccaaaaacaaacaaacacattttagcatggtttccggaaaagaaaaagaggtaattatgaaaaagttaattttaaatacaacaaagaacttgattttaatacttacagtgttgttccttctctggatcctgataagttggttcgatattgtggcacataatgacccatggagaagttcacatgagtatatgccaggtaatgccttttcggtgttagtgcatgagtatgattaatttaatacatggactatacagtacctacagaccgccataaatctgttttaaagttgattaggctaatggatacctctaaacagttaaaatggatttacgggacatttagaaacgtaaatacagggaaaatcagataaagaatgttgtgatataacatagttgtaacacctcgacctaataagatataatcttaggaggaaacgaggtatgttacaaatgagtaaacactatgaaccagaattcaaaaagaagattgtacgtcttcatcttgaagagggacgaaccctcaaaggtcttgctgccgaatatggcgtatctaaggcaagtatatctatttgggtaaaacagtttcgtgaagaatgccaaacaaatgaagaagccaaagcagattatgattatatgaaggaaaatttgcagttgaaaaggcaactggcagaactccaaaaggaaaatgacttcctaaaaaaagcagcggcattctttgcgaaggaaatcgattagcggcttatcgatttattcagcagtatgggcacaaatacagtgtccgttggttattgaaaagactgaacatcttaccaaatgcttattataattttctgaaaaacaggaaatctgaatatcataagcataagggaaaaatcaagcatgaaatcgtggatatctatcactctcacaacggcactgatggttacagaactgtgcacgcttatcttattcgcaagggatacagcatcagttgtgcaactgtccataagtacatgaatactgagcttcagttattttcaattacaaggaaacgcaagccagactatgaatatggcgctcctcacaaagtatttgaaaataagctccatcaggattttaaggcagaatccataaaccagaaatggtgcactgattttacctatttatttttaacggatggtagcaagcgttataattgtacaatcattgatctgcatgatagaagtgttattgccagcattaccgataagcacataacagcagatcttgcaaagaaaacactgcagaaggcaattgattcacagccgggattagatgctaacc
